United States Patent 7,468,248 (METHODS AND SYSTEMS FOR INFERRING BOVINE TRAITS) - sequence listing, part 11

SEQ ID NO: 40276 - DNA, 2299 bp, Bovine  19866880754137
cccagttctaactggcaacaactagaaaaggtatctgtttgccccataatagtcttgcttgtcctccacccccccaaatatcattcaggcattcatttctattcacgataatgaagttactgcaaatgaatgatttatgactgttccctggaggtgcgccagtactgttcttcccagccccatgggacgagcacgtgtcagggtaatgatgagactccaggaaaatatcacgttcctaccaggccaaggaagtcagttctctaacctggggtgtcccgccaatcatctacactggagccattcctgaatacaaaggtgtgggtgaggagatactgtcctggggtgggtgggctatttttcaccagtgagaggcactgaagcaacaagttaattccaaaggttccatatgatttccagaatcacgtgagagatatcacacaaatggggacatgcctccaactcgggtttaaaaattaactggatgcaatttgagggggagaggctgcttgagttctgggatagtcatcttcaacagagctgatagaacaaatccacccttgaaattggcacactaaattcttagcagaaagatgtaggtagggtccatgacatagcaagcagtcttgagcgtgcgtgatgaaaaacagttgcagagcaagcttttcttgggtggaattaggctgaaactgagaaagacatttagccactttacatcagaagcagaagcatcaaactccaccaccgattctagtatactctgtgcagtacaaacgcttgaaaactctcgtggaatgaaatcgtttgtgcgtctctgtcaagcttggtctggcttttcacttccatgtttccccctcttttatggagcagggtggggcgctgagaggactaggacccccccctttccttgcaagctgggcgcagctctccctgtctctgagatggacctccacaagaatcaggaggaagtgaaagatggaagctcgatgctttgacccagggtcctgtcctgttcttgctggtcctcttcctctccacccttgtgatcagtctagagggggtggtctataagcagctctagtgccctgggcacgctgggcccatccccgtcccacagagtacttctaacctgtcactgcgtcatttcctactgagcccaaaggcagcttctgaacaccaacacagagctccctaaccattatcaagtgatctgagcagtcacacagatgaaactttgtggccaacacccaggactacatacctgggccatacctgttaacattctccgatgcagtggacctacaatccaggatatccctgttttataccctccttgctgggatctggaacactggaatggaccagagttgccttatggactgtttctgctacagccttcacctgtggatcccatattttgggtctgtccatagaagccctgcccgatacctgcgtcatgaatgcccatcccatcctttaggtgggttttaagttgaggccttcccctctctgtccacccagttcagatacaactaagcctggctatgtaacacccttaaaaaaatccgtgtgcacacgcgcacacacgcacacacacaagcacaacataatgtaccaacgtatgactgataactgggttcccattgcttgctcatacagagatgagtttggtaatttgcatgagttacttgtaataagcaatacattcatgatgttttaattaaattcaagatataaactcacactacaagcgatattactggtcctgaaacctcgaacttcacttctagggcactcatcaccatttctaaatgaccagttcacttttaaccaaggtggtttagactttccacagtagaagaaaaatacatcagtttagataaaatccactgctagttccatctgcatttcccactttgttaaaaggctaactgaatgccaagctgctttcacggaagtgtatggcttgctctaacttgttgcagtcgacccctattctcctactgcttgcattactaaaaatatttattttgacaagacatttcttagcctacgtgtttccaaaaaacacattccaaaatactttaaattacatagtaattataaactccctaccttataagtattagaaagaaaaacagaaatgtcaacaagtaaaacgaacgccataatttatgcagcaaccagaagcattgagttgaaggggtcaggggagcactcccaacaaccctcacctaaaaccaagatcatgtaaaatccacaaattttaaaagccagataatactgattatatatgtagcac

SEQ ID NO: 40277 - DNA, 1579 bp, Bovine  19866880757274
ttcattgaattcatcccattgatacgagctgttgtgctccccaagtaaggaattaaaagcttacagataggacattgctttaaagctgagatatccttggcttcttcttataacatccaaagttaaaataggaatgaatatgtaaaaggagcaaaggtggctctttggccagcagctgctcctattgtcataaagatctgtcactttaatgtaaaaaagaaaattcctttagaatactggcagactttcaaccctggtcaaatggatttgaaagcactgtcagctgacctctgggagagtggctgctggcaggcccattcataggtgtggtgcagcctccagtgtaccatgactgtgggctttgggagaagaagggggaagaaagttgggaggaggattaaaaataatagcatttattttctgagtactccatgtgtatcaggcagtgaatgttttgtttttgttttttttttaatttttgtctcagtaatcattttaggacaaataccattattaactgcattttatagatggtatattttctattgctgctgtggcaaattccacatacctagtggcttaacactacacaaatttataatcttatagttctgataagtctgacagtgttttcactgggctgaaatcaaggtggcagaagggctgtagtcctttctggaatctatagggaaaaatctttcttttttttccttcagttctgccttctaaaagccactcacatttcttgattcatgcctgcctttctccattttcatagccaacagaggctgggttgaatttttaacacatcttgtcactctgaccctttctgtcttcctcttcctatgtgattacattgcgcctgtatggacaatccaggataatcttcccatctcaaggtcagctaagtagcaagcatactaccatctgcaaacttaatattccttcaccatgtaacctaacataggcacagcttccaggccattagtctgccttcgcagaaacaccaaggagtagagaggtttagaaacgaatgtagggtcacacaactagtttgtagaaggaccaaatctacctttgagcttaaacctgacctggagacaggaacagaggcctggggaaaataagaagagagggagaaagttgaagggaaatttttcttcaataaaggaactgggcttttgcaataaatgtactgttgtttacaagtcagttgaacaagaagactgtatcaatggacagcttgccttcattaatcatctttgttattccaccacttaacctgcaaattgattctgtaaatcatagttcactaaattggatcgaactcagaatcctggcctttctagtgttataaaacacactagggcatcaagacccatcctacaatgaccacacacaactcttaaggagccagtataaaggtgttattgtgtgtatacacacatcaccaaaacacacaccacagttacagggcagagccaattctgactccatgttggatgtgtctctttgactttaacctttgcttttcattgcttttgttattataatcatacatactgcctgcctcagagaa

SEQ ID NO: 40278 - DNA, 2474 bp, Bovine  19866880841307
tgaccaaataataataaaaattatatatatatacatatacatatatatatatatccctttttgcagaagtaagttacaactagtaaagaactgaaatatagtttttctgatggggagaaggtcctaatggtatttcagagatagaagccatcattttcatagcattaaagtggaatttcaggcaaattactattgcctggcatgaaaaatggatgaaatcctggatgacagatgagagcagaagcttgagagggactgtaaaccatcaagagcttgatagcagctaaagataattaattctgttagaaactaataaataaagataacaatatgttgcattatgcttagcatgtctggtacctcaaaaccgagaatcagagaaaaaatgaagtatgagtcagcagtcctaggtggaaaagtcaccccaaaaggcgactctgaattgcttttttcatgaaatcaagtgctgcattagacctaatcactggccttcagctcacaactatgcggtcatcgctggcggggaaaggtggattatcagctttcagttggttaagagtcaggtggcaccgacacagtgaagtgggtcaatatttggacagtcgattttctccctctccctcagtcttcaaatgttaaagggctggaagagggctgaagactactgaaggtgaaggacagcacaaaagaccaagagcaccagcgtgagtcccttttattaactcgtctcaaggagaccagatttttgttattaaaatcatgatttcaggattggctaggcaaactaaaatgtacctagtgcaccttctttccttttcaaacataaaaacagatgatcagtaagagtgaaaatcctggtaaatgaatatggtacttatttcttaaatatggattctattggagctattgcactcagtactttaagggttcctttgagatctcatctttgtataaaaattcaactaagtctttttttcccaaaaatgtgctgtattcctttaaattataatctcttttaatgaaaaaaatgttgccatatcatataaacaagtgtagatattaaaattatttgaaaaactcctaaaccctataaaattctcatggccactttctttgtgccaggctctaggtccataatctggtgtaaaggaactgacagcccagtgaaggagaatagacacctgaacaaatggttaacaaataactcaaataaaatgtgttcagatataagtacataaataatgtgaaaagaattggaagtaaaatgtcttgaaagaatagaaatcaatacgatttgggagatttagtgcccacatttttataaaaataaagtgaagtcgctcagtcatgtctgactctttgcgaccccatggattgtagcccaccaggttcctctgtccatgggattttccaggcaagagtactggagtgggttgccatttccttctccaggagatcttcccgacccagggattgaatccgggtctccccagattgtaggtaggcgctttaccatctgagccaccagggaatttttatagaatggcgttaataaatcaccttcattgcatttatccaggtcgagagaacaaaagagatggtgaaaaacaggagagataaaaactgggggaaattttcattcaaagactgtcatttctagattggattgtgaaaaagaaaatatttcatggtagaaaaaaaaaatatatatatatatatataaacagcagagtgcctaatatgggtctgcaggaatgatgctggctgctggagatacagagccaatacgcttggtcctgagtctctcagtcttgaggaagaaaaaacaggcaaattgcaactgtaacattgtataaatattataatacctaaagcacagatggctgtgttttggttgttttgtttctttttcttgaatctgcattggctagccagagaaatctccttggagaataccaagaaaaatacaaccataattaggagcagaagcccaaattctggaaataggaagcagaagagaatatacattctttcgcctgctctgtgttggtacagatctggcaggtgtgaatttgcatataagtaaccacttcaggtagacacaggtcagcacctgcattcacaaacacaggtggttgggcagtatttgtgaaaatttagctactaaattacagtctcttgttcctaccctgtgttaatctgtctgattctctatgctccttatagagaactggcaatttaaaaccattcaaggggcaaagaaacccaaatacagttaattccctgctctagtagttctccaactctaatcatgagcttgttttaatacaaattcctgggaccatctcatatatattgaattaaatccacagggtgtggggcttgcaggatctgtttgtatggctcccccctccacccagggtttatgctagatgtttataaacttcacttgattatacaaacacgaacaaaat

SEQ ID NO: 40279 - DNA, 1707 bp, Bovine  19866880854822
ctgatgcctattcttgatatgccccacccccatcctgcccagacacacagagctcaaggctcctgggcaattcagacaggacggcgcagcacatggaatctacccagcagacccttaccagcctggtttccaaagcctgtctgttaaaactaaggtgagggtgagtcatggggcccatagtcaccacccaacctgttcgggagcattgctccgtcattttaacagctagacctgcaggcaacgtgtagcctgttatgataggctgagcagtgctcagtttatcagggatctgattggcagagcagcctcagcgctttataatagttcttagaagtgtttacagaacactgtgttttgcacctcagtgtaaagcacaccatgtgaagctgtgccccagcccacgtgcaggtgggggccagtgggaaacttcagatttcccaagaagggacacttctgtctgtttacttcaagcactatagaggaggcattacatttaaatggaagcaagagagatgtagatgagatttgaaaagcttaggttcctacaagaagaatggtttgttattctgtctccttgaaggggttttaaacaatgacaaggaagatttatcttttaccagttttggaatatctttattctgtgccccttggaaaataccaaacaaatatgtcaaactaaatggtgccttatggttttagggctagggctctgttcttttctgttgatttggcatccttatggaatttagggaagaaaattgtttttccaactcttaatgaacacctaccctcacttcccacacacaggtgctcttccttcaggtctttttgcttctaattctctttaattttcttggtcttcccaaactagctctgcattatacattcagagagtccttttgtggacaaagaattaaaaaaaacacagtatgctttcaaaaaacagtttaacactttctgcctttaagcttaatatgctcaaatacaaagaaacatctaagaacccactcgttgctatattttatcttggattgctggacttgtcaattaaagaaagtattttcacgttcagacatattcagggaatattgaaggaaaataaaatgcgagtgtaaataaggactcactaggaaggagatgtaagtgggtggagggtaaaatccatttagtatagaaataaagttatgttcacagcaagtccaaactgagacaggtaacacattgccctaacgatctagcagttaagcttttaaatgcctgacgtctcatattctcaattaaatttcagattagttgtgattccatgattggttcagcttggccagaagcagggagaaagggaaatggtatctctgctccaattttccctctctttctgagtttcaatgctgaatagtgggttgttatttagtcactaagttgtgtccgactcttttgcgacatcatggactgtaacccaccaggtcctctgtccatggaatttcctaggcaaggatactggagtgggttgccatttccttctcttggggatcttcccaactcagggatcaaacctgcatctcctgcattggcaggaggattctttacagctgagccactacagtgggtgaatgagggcaaatgctttcgccagtagaagaaaatttggaaaccctcttttgccaccaatatccagtttttaaattacctttactccaggcaagattt

SEQ ID NO: 40280 - DNA, 1667 bp, Bovine  19866880888529
atatttttatgatcccctaaaattatcctgagtcctaggctctctatctactgtgcttaatgggagacattggccttgacttcccacatatattttcttctctattttgagataactcagccctacctctttattccttccatccctttctaagaatgaggatctcctatatgatagtaatcctacatttgatttctatccactgaaactgcatatatttgcagagagtagcaacgaaatcacattcaaatgaatacctttttcatttaccatgatggcagccactaatatgtctgtcaagcagtaacaatagttaaaatgtgttgggtcctagtttctttcctatgtgagagaactagttcacattttgcggagatgaggaaacaaaagtattcagaagtgaaatcacgtgctcagggccacaccactaggaagccacaccatagccagcatttgcacctgtcaggctccagggccttaaccactaggttagatgtctgaggacacaattgtatgagatatatcatgaaggctattttctatccaatttctcaccctttgcaaaactgcagcctgccaggagcccacagtacacaggctgggaacctatacttagggcaaaagttcttactctttttatagcattaagctgccattgggagtcatttactacctgcaatgttcctatttcagggaacctattatgaaaatgcaggagccgtgcttcccccgtgtgtcccggagctctctctggtagctgtacacgagccaacctaatgagaagctgtgacccgcctcctcccagtccttagtacctgttaaaataatttaaaatatttaagtcccctggacccttgtccttagactggagcactgaaattacagccagtatccccctgggttgtgtcttcaccaacaacgtagattcacaggaaaggaatttaggtgaaaaaaagaaaaaaaggatgtcttaaattctaggcccacaatgccagaaaaatccttgtttgccaagtagaaatttatgtaatcatgagactaaagacacttcttatttcccaaatgttactgccaccagcataataattctccctaagtaggtgccaaaagactttccctgagtcttcccaagtgcttaaagttgatagaaaattatcctcttgaaattatacaagtcaactacagaactacagctgtgccacatgagaaaagaagacaggaaggaaacaattcaactgagatatacattatgggggaagaaaagacataacatcctgacccatatacactgttttctgttccagaaatattatttgcttaacaagaactgtagtagagaatcaaaagcaatgataaaaaattctgatggttttctgtccagagggacaaagctcgagagtttgtcatatttttcattcatacagcttggggccaacaaacatgctgtaactggataatataaggaacaataaatggaagaaaatatatgaaagctgactcacagtggccctccactgtggtctctggataactagcaacgtgctgacagatgaaagatcatatgaccttctctacaacatggccacctttcttaaaaagacccccaaagttatgtgctttttaaaagaagtttaaattccatgggagtctatccctaagtcactgaa

SEQ ID NO: 40281 - DNA, 1208 bp, Bovine  19866880893022
taagagaatttgtttttgcttatgaagcctctccccaccctattgaatgtcctgggttctgagcatggtctcccttatatccttccactatctaaaaagcatggaaaatgttgccttgtgggtatcttgctggtgagttgaatggccccacagcgaacagtgaaaacacaggctgaatgaggccagacctacattttgttgcttggaaggtgggtggagggagcaggagccacccagttctttttcccctttggcgactcagttcctcctgaaccctgaggaataatgaggagagaaaaatgaacatttttgtggctcaactgacattaacatgggaaaaagcacatcactggaattagaatgtcctgttaaattagtcactttttcttctaaaattaaaatgcctctgcaagcaggaaagagaacaagccctcgatgacctcataactcattatttctaaggaatatacttaattcccagcagagataaatctaaaatcgattttccatttctgtcgaccattgactggcggcctggtgagtccttgtgaaggagtccttgtgaaggagaatatgtattctttgtgggacttgcaggggctggtgaggagaggagggctgctgttgtttgtaaccttgagggcagctgctgagcatctgttttccttcgcaagccatcctgagcctctcagaaacctaagaagagggacttgggccggctttttcatcataaaacctacccaactgtacacacagccacttttgcaactgggatccccttcctaggccattaggaaagaatgtggcaggcaccacctgctgataaagagcaagaggaaaaggcattggagccttcattgacaggaggatggttgttagcaagagggtctgctctgatgctttctggaacattctttgctgcccgttctgccggaactctcagcagagctgtagctgagctctgaactctctgagagtccctcctaatgccagtgttatgcctattccttatatcagtgttcctttctgtattagaacagaaaaaattctctagataaggtttaagtatcttgtatatgtctgggtgtctgggtgaacattagaccccactgtgagtgacatcatactcattaccacccccaactcctgccaacaaagtcaagagactaagaatattaatcaccacagaattcgcaggacagattcag

SEQ ID NO: 40282 - DNA, 1160 bp, Bovine  19866880900037
gagggcttttttttcttttcatatgagttgaaagaatgtcccctgtgtggcttgaatagcaagaaaaaggaaaaatattcctctttcagtaggtacttccttctactttaagctggcaagaaatgtttcaataacaggttgtacagaatgtaacttcaaaagacctggaattggcacgctggggtactcttgccacaaactgcatccaaaaatgatttaacttcccccagccagtgatgtgtacaaatggcacacacggctgctaaccacacatgcacgcaatgtatgaattcccacattcctgatttctcattccagccagcgaatatttttttcagagctaaaaagacatgaatcaagttgtaaaaggatatgtgtggaaaatgccaaagaaaaaatgaaaatcagatgctttgaaaggtgaaaggctctgctgagatgctctgtgtcctttcccattctctcatcagaggtgaccaggggagtggccattacatccagtggacttagggggtggagggtgtgggaggaggcaagtcatccatcattctttaaaacaattgtggcatagctcgatactttgaaggaaaggtatttcaaactagttcttatggacataacatctatgcagcataaagtattttttctgtatcattgctgctctgctttcagctggtatgattcttgaaaaagaaaaaaagccattcccagcacagtgaatcctccattagcatgaccaggcgtaggaataaggaaaaaaatacatatatttttttcagtctagtgcattcatagactcacaaaaagatttactggggacatggagaggttggaaggtaatattttgaatcccattttttgtcttgataaatccctgatgtgaattcctgtgctctgagccagtttctcatcaacagaattaacacagtctctgctgttcctgtcactagtacaatattgatcacaatgcagagcaaactcagctgccttctccgcaaacggctacacacgggacagtgtagatatactgacaagataactgctggccttgggcgtattctgtccgtggtgatctgggatatttcatgtatgccactgcttaagagcccttttattggatgagatttagaaggtctgttaaccagtggaatatcaaagcc

SEQ ID NO: 40283 - DNA, 1808 bp, Bovine  19866880958731
taaagtcagagttcatattcctggtggtctcaccattgagcaaggaggtgaaattgcaggaaagtaatagcatagtagcagaatgagagtgagggaagaaggcagtcacaagctgttgacataaacatgttctagagggaaggacttatacaatcagtgaatacataggggactctcactggtagcctggagtctggacccttctgtgtctgtcctccaggaatcatgtggccttgttagaaaattgtccgtctctggacctttcattctacctttacaagttgtattatcagctttcacccatataaaacaattgtggattcagggagtgtaattttccaaagtacaaacaaatttgattatgtttatgattaaagcagggcctagtgggtttaagagccagcccttgggaaaccaacacatcaactctcaggatgaagaacagagtgaaaagcaatgtccaaatgacttacccaatgcttgcttcaaggaagttttcagatgacttttccaactggccaccaacgcctagtggtcctcagtgtgatagccatccacttccaatccagcaagatcagtgggacctggaagatcgaattggcacccttaatctcttactcagcaccaagtatttgcctagatgggtgactaatggagcggttggctttcttttatgttcagttacatgtactaggcagtgtgtgctcgaagtgttaaaggatgatgactgacctttcatctctcactttattgataccattttaatgttatctaagggatgacaactcaacaaatccccataatgaagaactcctgtccagagggaagccagtggaaaggggagtttcctctcacagcctcttctcccgtgtttgcctttggctttattacagtagcaaaccaatcaccttaagaactgatctgtggcttgaaatttttcaagccagatgtggaattgaatgtgcagattaacaatgggaaagcatatttgaaaatctttcaagcccatttgaacttgcataggtttctcatgctctctgttagcccaaagtttatgaaagagtctgcgttcttggaccgtggtgcctggaggctggtggtcaggcaggtatttccacacggagacagtgagacaactggagccctggaaaacgcacccagcagcctctccctcctcttcccacacttctgggcagagagtcggcctcaggaaagtatagtgtgagtgggggcagcaggaagaggtaggcagaggagcagtgacagcagaaaaagcaacaaggtcaacactaatagcagagtagcaggagggaggggatgagctggtaagagaggccagtctgacaaccctgcattatgttgtcaaaggctaaaccaagcagtcttacttccttttcaacctgtgggaaagggtgattatgactgagcctggtttcccacatcattctctagtgatcagacctctccaaatgttaagcagctgagagacgacattgtaggcaagaccagctgctgagtccagatggaaagggcctggtaaaggtaaaatgatgtgttgcccatgcgacactacatatatttaaaaatttaactttctttataccatgacatgcattatgaaagttttccacccaacttcttgtgttaacagagagtcgttcctgtacatgacatcccaagcgtgaatagcagaagtgcacactcgtgtaccaaatgcctactgcatgaagggaccagctgttggtcctggccatctgccagcccagatggattttctgtaggaaatgaacaccttgtataacacacaa

SEQ ID NO: 40284 - DNA, 1284 bp, Bovine  19866881009562
agggttcattgttccccatggacttttactgatgtgcaatcgtgtttaaaagaacttgtcccaaagcatgtctgggaaacaataagtaagttattttaagtaaaatttggttgatgattccaattctgatttctttgactgctcatgtgggtggaaggtcaggaaaatgcccttctggttttgcatggtaggagtaataacacgaatactagtgaagcactcaggaattgtattattgtggcattggggtagtatagctgtagcatggaatttgaaataaaaaggtctgaatgaacctcagtttgctcatctataaaatggggacaatgagctccaccctagtgaccgccctggattgaaacgagtggctctactggtaaagagcctgtctggcagtgcaggagatataagagacccgggttcaacccctgggtcaggaagatcccctggagaagggcatagcaacccactccactattcttgcccggagaatcccatggacagaggagcctggcaggctacagtccataaggttgcaaagaattagacacagctaaagtgacctggcacatgaactttaaaactctatataaatattggttgctggttttaatattttttttcttagtaccttgtcacttcctagctttagctgtcactgaaacatttttcaatagcatgggtcaacctaaaaaaaataaaacactggagaaacatgggaatttgggtaaaaggtgcttaccattgcaattacctccattacagagacaattatttggaccaagatattatatttgctaaggtctgggaaggaggaagtttgatctaaatgcaaaggtcccagtgacaaatgaaaggcacctggacactatggagcattgttctgctcttctggaaggcagaacactgccagaatgaagatggagccattccaagtgggtgatgaaatttactttattgacattatcaataaggatgtatttatgggaaacaaacatgaaatatagctcacacttatgggacttggcaggtaagcaaagggaagtggggtgtctgatcacgaggcctaaacctttgggcttatttggcattggtttcattcctggttagctaagtaatttttaggtaattatctgccttcatggatcctcaactttctcatgcatgagatggacataaaactcccattacatcttataagagtagagaacatcatatttttcactgaaagtaagaatatacactgaatatacagttcatcactatgaggtcatgaacatggtt

SEQ ID NO: 40285 - DNA, 1757 bp, Bovine  19866881015585
gagtactggaactgtggtgttggagaagactgttgatagtcccttgaattgcaaggaaatccaaccagtccatcctaaaagaggtcagtcctgggtgttcattggaaggactgatgttgaagctgaaactccaatactttggccacctgatgtgaagaactgactcattggaaaagaccctgatgctgggaaagattgaaggcaggaggagaaggggacaacagaggataagatggttggatagcatcaccaactcaatggacatgagtttgcgtaaactctgggagctggtgatggacagggaggcctggtgtgctgcagtccatcaggtcacaaagagtcggacatgactgagcgactgaactgaactgaattttactatcataggttttaaaaaagtgtccctgataaagttgaagtcttctttgttctccctggccccattttcctttctatttcctagaatcaaccattgtcatgacctgatgcaaatccagtctgtttatacatgcatatttctaaaagaaacatgtttttatggtatttatcttatgaaattattatattgtacaaactctaaataatattatatctatatcactaagtaagaacattttggtcaaaaaaatgacaaaaactgattttctgatgtagctctagaacaaagtaatcacccttcctagttgcccaatattgacttttccctagttgtcttagcttaatttttaatagtacccactgtcactctccaagtgccccactttgagtgataaataatggtatcctgttctaaagacagttccaaaaaggaagaaataagcgtgtcagcagcggtagggtgaggattgagggtccaacttcctaatgtttttaagaactacctttaagaacatactgatataaatgactgagttctgatatgtttgctttaaagtgaaagtgaaagtgaagtcgctcagttgtgtctgactctttgcgaccccatggactgtagcctaccaggctcctccctccatgggattctccaggctagagtactgctttaaagccagacagtaacaaataaatcaccctctacgtttttcttggctctttggtggaaccgtgagcatgcagacagcaggcgaatagagttgtgatgtgacagtgattggcagctaacctccctccccctctttcataggccatcaggatgagtttgtctgaattttcctcctgaaggttgtccttgatgttatttactgtaactagaatttatctcaataataacaggagaaaataaaggtgctcacatagtataatgggtcctgggtcctgcaatcccacaggaatgaccttggaagtatgatttgcttttgggggccaggataaaaccaggagtgggctgatccatgagtctgtaatgtgggagttgtgagaacttttgctgtaatgtgggccacttattcctgtgtgttgccaacaacttaattctatacaaactctatcttccttctcatattggggaaagagatacactggcatcacttcataaatatgaccttactcattatcacaatacactttcccaaaacctggaaaggacaaaaacacgtcttggaaactcatgactattgatgtaatatcatcatgttctcttggaaacatgaagacataatactgacacttcagactattttgggctaaggaatgtaaatagtgcttcaaacagaaacatccccaactttctgatatccaaaataacaactttgcaccag

SEQ ID NO: 40286 - DNA, 918 bp, Bovine  19866881022738
aaatgttaaaacttctccagatctcacagctaatgagtaatgaggctgctaattggacccagatagtctggttctagggctcttatacaacacaccacgacttggagactggcctccctaggccagatccctttagggagaggtgggaggggatgggaggggggtgtcaagttatcagacttgtagaaataggtccgcatcctttaactagcatttcaaaatgaaaaactgaaacattatttgggccaaatcagtcccacattcttgtatgaaattaaacaaaaatcagggtgcttaagttgccaagataattgcctcagggttttattatcctctgctacaagacagctacatagaagggaatattttgctggatacccacttcctctgtgaatctgaaggatcagattttcacttactgtccttgttcctccctgggcaagctagttaccttttatccagtgaagtgaagtgaatgaaagtcactcagtcatgtcctactctttgcaaccccatggactatacagtctgtggaattcaccaggccagaatactgaagtgggtattctttcccttctcccgggatcctcccaacccagagatcgaacccaggtttcctgcattgcaggcagattctttaccaactgagctatcagagaaacctggagtagtaacactgtgaaaatgtaggctatacatactcattatacatagcagaaatcagaatttctactatataaaccatgtggtgtctctggaaacacagttgagtctaagtaatgcagtaactttacaagtcaaagctgagtttcagtgctgaaagtgaaaagtgttagtcacttagtcatatccaactctttgcaaccccatggactgtagcccactagcctcctctgcccatggaattctctaggcaag

SEQ ID NO: 40287 - DNA, 872 bp, Bovine  19866881032026
tatttacctcagaaaaaagaaaattggacccagaaggaagagaggtttccaaaagcaatcgtgggcaaaataattggcaaacatagggtaaacctaaacccatgttaacaatataaaaaatgacaataattatgaacaatgtgagattcataaaaacaaagttgaaataaaaatctgagaaaatgacatataagagaagagggagaaatcagagttaaagtttctaaagtccttgtaatatttggaaatgtggtaaaattattgattcactttgaactttgttcagaaggcaagcattttaaaaatcaaagcataaaccataacatcataaacattaaagggtataatttcccagcctgatgaaaggaaagaaagaattaaggacaataattcagtcagatacttgttttgagaagagggaaaataataaagaaaaatatgtgatatagaaagcataagacatagtgatagaaatgaaaactgtcagggagagaataagtttaagtgaattaacctcatcagttaaaaaacaaggactaccagattgggttaaaaacacggaattcaactacttgatgtttacaagttatactttatcttattccagttgtattagtctgttttggctgccataacaaaatagcagactgggtggcttaaacagaaaaaatatcttttctcataatttttgaggctgaaactccgaggttaaaaagctgtcagggtccatttctggtaagatctttcttcctggcttgtagatggctgccttcttgctatgtcctcacatgaccttttattggtgcctgcttgcagagagacagagagagagaaaggaagctctagtgtctcttctcatgagggacaataaa

SEQ ID NO: 40288 - DNA, 1524 bp, Bovine  19866881074883
ttactgctttctgtcccagttctctaatatgaggctaataacaggaccttgcctcatatatttgttgtgaaaattaacaattaattttagtcatttataaactttaagttaactaggcaagttttataaagcaagtggcacagagcaaccattcaaatgttagaggaaataacatatctgcaaataaaaatacaaccgccaaaagagggcatatgataaatatggaagggtgactacagcaacctgagagagaggatctctgtgaattagcgcggaggacttcctactggaggatgtagtgttttactggagttttgacacataggtgggagaggagatccttgaatgtatcttggtgagctgctgctgctgctgctaagtcgcttcagtcatgtccgactctgtgcgaccccatagacggcagcccaccaggctcccccgtccctgggattctccaggcaagaacactggagtgggttgccacttccttctccaatgcgtgaaagtgaaaagtgaaagtgaagtcgctcagttgtgtccgaccagggtacaaatgtcccatattcaagagaggagaagatacaataaacaggccattctggcctggaacaggaggttcatgcaggggagacatgggaggaaaagggggaagtggtttaaaacttgtttagtagaagcttagattttggccaaaaaggctttgattgccttggtgtaagtggtgcttttggaagcattacaggacagaggctggcttgccagccttaaggatgaagacccactgccctgaggcttgaattcagtacagcaggggtcaagggtgagggtctgaagaggggttgttgtttagttggaaagtcatgtctgactcctttgtaacctcatggactgtagcctgccaggctcctctgtccatgggattctccaggcaagaatactggagtgggtggccatttccttctcccggagatcttcctgacccagggattgaacccaaatctcctgcattagcaggcagattcatgaccactgaaccaccagtgaagcctgaagtggggtaaggaggccgaaaaaataactcttctgtggattcagccagacatgagaggcctctgctaaacttgtgctaactggcccccagggccttctgctgctcagggaaggacaaaagccagtgtcttgcctgggttgctagaaagaagcagtcttcataaaatggtgctcaaactttcttttttgtattaggcaagaatatcatcagaatggtgatgcttattcattatgaaacaaaagtttaatacctacttgtgctgaagactttcagaagaaatactgatacaaaaccagtcctctaaaattttaaggatctcacaaataggttgtgggagaggaggtgtttggagagaggcatttgttcagaaggccaaatacacggtctctatggcctctcgttgtttgattaagtaccaagtgagttacatgacaaagatgctcttgaaggtcaagaggttcccacaggctgca

SEQ ID NO: 40289 - DNA, 1293 bp, Bovine  19866881107640
aagaatactggttgtagaaagagctgggctgggaatcaggagcctggagcctgaatctgtagccttgcctgatttttccacagaaaaaggtgtgtgaacccagctgaacacctttcacttctagagacctcagtttctttatctgctgaataaagcagaaacatttccttttattctgaattatttctaatttcctcattcacacaggcaccaagaagactaaagaaaatgagacagaggatcttttaaaaggataatgaagtctgatcaattcctattattatttaattggctcttatagacagtttgtccctgtgatggaataaaagtgatcagatatgtctggcaaaggacttttactccaaaaggaataaggagccagtcctgggttctgaaacacaggatcccagagcacaattctctagtttcttggtagctccaatagaggtctttagtcaaaagttttgtggctatttgctatttatccctcctccaccctatatctccccaatgtttcaaaattatctattttatagcattgaaaaacaaaattacatagctaaataaaaacttatctgctgtttaggctatccaatgacgatgatgcctatatgaaaagaaacaaatcctcaaagtcacaggacgctatctgtacagtcaagctttcttaagtccatagttgggctggaatgaaaccaatcttgacatggtaactgaaggataatttgccatctagaaagttatattcctgaagaatattttattgattgactaaaatttgtagtagtgtcaaattaggaagtgttttaagctggaaaattttgttttctagtgcaagagttaaagtgagtaattttagctatgcctgagggaatggactacatttggaccactcatgtaaatgaatggatataaaccgatccatatataccatatatatgaggatcttactgcttattcttatcctgttaaggagaatatgcagtattctgatttactccatgtcttatgccactgaaatctttgatggtcatatatgaaatgtcttcacattgaagaaattctacatttttattttgtgtcaataataaactacattatcatggacataatcccttgctagcattcacacttataatcacactcatgcatatcgtggatcttttttgacagcttgcaaggatccctattctcctttgcatgtagccttcgcagttacaaaactgaaatttctttggccacttcctcggatgattgtagagctcagctttcaaaggtgtttttttttttttt

SEQ ID NO: 40290 - DNA, 1659 bp, Bovine  19866881121600
tgagctgtgaggatgggaataatgtataagtggtatctcaataaatggtagataatattatgataactactctagaactcatttcccaggttaatggagtgtccgaggatgaaccaaatcacgtgaaaggtatgtatagacttctggtcatcctgattttgaaaataacaatacagagctttaatgtgtatattcttctgtgagctcaaaacaccccacaagtagtaggagttttatatcaattatttcatttgatcctcataacagtcctgtgatggatgatagatattattttcttcccttcacaaatggctttgataaggattagtgcgattaaatggtttaccctcagactcatgtgcctgccttctaaaacaaattcagagattatgccccttgaccactctaaaatgtatgtattcatctctgaaatgctcagtgaaaatactcacactcttctctttcataatcacttattaggaaattgtattcccaggatggaaagaaagtttattcagatcatacagaaattcagcaagcggagtgggattttttttcaaaggagactttattagtgtgcggcgaggacagcccaaggagctcacgagaaggcctgggctctgctactttggcaagttacttgaccttgttagttccccaagttcagaattgagaataagagtcttagcttcatggtgttgctgtggcgattaaaagagattatagacgactgcctggcaaagaaatgctctggagacattgatttcctctccctcacgtgttagatcgacaaatgtctacctgatgaaatctggtaactgaagcccagaattcagaagccttctcctgcccccaaaccaggtacagtgagtactcgttacgggtggccgagtatctcgacagttctcggccttggctgtcctgaagcagagccattcctggaaggggactctgaaaatactttggcttctgtaagcagcttgattccctgcctttgctgtgtaagggtgattgccaggaagggtgctaatgagatccaaatgttagagtggcttgtctgctccggatgactcggatgctgctaactgatagatgagcacttaagttcaagcttaatgcgaacacgttctcgcctaagaacaagactgggaccattagctcacagcatgcaggctctgagcctctgtgaaatgattgcagggctcacttggtattcccctcagggcagcgatgagtcctgagtctcattacccactgttgaagcctcgttcctctggccctacttgaagtctacctgcctgcgcacgggagcaattatcaaaggaaggaggggaaaatccattgattcaaaggaggcaagtcttccctgctagcattcagttcttggcagacaagctaatttttgctctctctgtgtgcttgtgtgtgtgtggctatgtgtgcaaactcaccaggtaaccgtaaaagaatattgctttcacgatcacctccttctgtgtgaccctgatgtagagcatgctgtgaggatacacttatgtgaggattattagcaaaggccaggttgtctgtgactgtcaactcagactcatttactactaggtctgtgggtttggctgtagcttccggcttataaaatttgagttcttgctgcgctccacc

SEQ ID NO: 40291 - DNA, 1329 bp, Bovine  19866881248221
ctcatggtgacaagctcaatgttaagttggttagtgtttccaatgaacccaattctgttcatactagtcatttatactggtaatttaactagatttctaaaaaataagattttggcatttcagaactttgtctcatgtgaggcattgtgctataaactgcccctttcttaaatgaccctaaactcaaatttcagggtctgctttccaactgacttggataccatgcatagcagaagcacagttgttagaaccagcagaatttttctcccaaaaaggaacatcagtaggacttcccaaacacgttactagttcataaccagctatatgacaaagcagttggttccgcagtgacagctcacatcaacacatttgactgaacacactgaaaacgtgggtttccaagttcagtgagccacggagaccagctaccccaaaggagtaacttttaaacaacagaaaaaagccaaagaattatgaacttctcactccacttgcaaacaattttcacctttgttaagacaaaacaaaacaacttcaaagaaaaaaaccccatacacatatacaagaattgtactagacattgtctcgttatgtacttgaactcaacgactgtggatctgttttggctgaaaggtgtactggaaacagtccatgcacatatacatatatacatatatcaagggccgtgaagttgtcagaagttgcaaaaacaagctttctgccttttcctcatggttgtgatttttttctcgtgggtgatttcagatcgcagcgctcccacttctacagccccatcatagcctctctgcagcttagcttctggcttttaccttcaggatgctataccgggtggggaaaatccacacatggatgtaagcatgtatcaggaatgcctctgctgtctctatttatactcacaagccactcagtgctgtaagatgaatggttggactccaagaaccctgctggtcaaacatctacaaagacagatgtgatgggatgctatacactatcaataaggcgtcgggcagaggcatagcatcctacgtaaggtgtgactcactgtgataggaaatcatgaattctgcctttgctgttcaaagaaaaatctactgcatttatgctcatgagatgtagaaatgaggcaagtgcctattaccatgccatcttgcaaagtgttgaagcaaaaaaggtgaacagaactgtggcttttccacgaaatactccatctcagatagtttagaaattaaatgaaagttaataatacacatggatgtgctatcaaaaaagcaataaacctagctgataaaactactgtttactaatggg

SEQ ID NO: 40292 - DNA, 1149 bp, Bovine  19866881275196
ggatactccctggcatatttgaagtgttataaatctaaattaatctgtctattggttgagcatatcctggatcggggactgtaatttgccaactgataactgggccatttttaagggaacctggtgccaattgggcccaggctttccataatcattaaccactgagactttgggcaggggtaaatgcagtctggtagctgtcatttccagaagcggaaaggacaagccattggtgcctgaaaccccaaagtaagtctggggttattgctgagggcttacaaagactgttacctttggtccacctgactttgcccagctttcattattcttttgaaattatgtccacaagataaaaagaaataagggcaaataacacctgtttagcctctgattctacttagaaaagctgtcattgcatcatgtctaggtctctgcagatatatgactgtgatcacgttttctaaatccttattcaaacatttgctatttattggaacttattgtatgctaggcactggggaggctacaacacaaagataagttccctgctctgaaaggactaaaagaccgacagaaagagtgacattcagaaaacaatggcattagaatactgtgctggctataaggaactatatttttaatgtaatgatttcatatgctttagagaaagctccctagagttgaggggaatttatttagttactatttttgtaattactcataaaagttacctgcaactttcttttgaaaaatgcttggacattctaaatgagtccaacaacattttttataaccttttattcccgccaatgtgaattttccttctttctttctttcatttttgcttgtagaggagcagtgaggggcaggaggagtgggcagacaatgcttcgattacagagcccattccattggggagttatgcaaccaaggggaaaaatgcattttccactcatgaggccctttgatcattttggctcttacataaccccctaacagctggagctgtaaacttgaaaattggcaagaacatcgttcatattgcgaaagaaaactcgagccacatttgaggagaaacagctagatattttcaaagcgattccagtatttgtgttctttaacatttagtgagtgctggtgatgttgggg

SEQ ID NO: 40293 - DNA, 763 bp, Bovine  19866881331370
gtttcagtgtatacgccccctatgagttcagtgtcccactccttgcaaccaagtacttcagaaaaaaagagtaaacccccccccccagaggcactcagttaccaagcctgcaaagcccatgacttcgtggtttttaaagatgttatctgcattttaaagcaaaatggcttgcagaccaaagttccaagcatcactcttgggaattttgcaaagcataaataccattccagccaacctaagaacactgctgaatgtatatattataatctctccattaaaagtgatagaagaccacagacaccaatgctgaaaagctgcttcaccccgatggccagcacgtttctctgggccctccatttctgagttaaaagaagcagtgcagggtggatgaagtcaggctgggatcctaaaagaatgctatgaaagtagtgaagctgagaatcaaaatgaagatatacgcaatcattatgagcaagcttaagcatgttctccaacccccactatcattataaaatcactgacccatttcccccaaggagtatttcacagaacatggcttcaaattaatgcttggtccattagggtcagggagaagtagctaacaagtgacatttgtttaatccattgctgaaggagatggtgaggctgaatcagaggcagacccggataaagatgctattcgcatatagcttggtcaagaatgaatacctccaaagactccggaaaagccctgaattcaccgtctgttcctgtccaacactag

SEQ ID NO: 40294 - DNA, 1242 bp, Bovine  19866881353271
tctgctaccttgcctctctttctctctcttccttcttgaactcctctctctggaaccttaagggatttcttaatttccctttcagtcaggtgaaattttttcttacatcacatcttccttctttctttttctagggctcataagtaaagctctggaatccaaatctagcaggcttgcctcttgttaagtaaaggcaagctttacaattagaagggtcttttctttttcaaaggcttggctttgaaggtatcgtcacactgtagactcagaacgtcagcttttcaactcagagctaaatgctaacttctgaggcgtttgagtatgtgcccaccttctcttttcctgtggcaatcaactgtaaaggtccaaggaatttacagaaacaggagttgccagggattaatgtttgaagggaagaggaagaaagactggtttaatatttaaagctctactgagcttacaggagaactcactgtggcccatcagctatatgccaggcacagtgttaagtgttgctgttccttccttcctttcatcctcacagctcccaaggacactaaaggacactgaagacactaaagcttatagaacttactgatagcactgaaaatcacatagctaaagaccagtggagccagtattggagcccatgggctctgccttgacagcttgcagggtgactgacttgtgtcagagagagaacagagaggtgaggacatggaaatccacatcacgtccaagagcacactccataaatctcatcacaccctgatttctatatttttcactcaagttttcatgcccccctgaaacacatcaggcaaatccaaatactgctcattggaagagaagatggctcacaatttggcaggaggagataggaagaggaaggcataggacgtccacagaattcccactcctgggaaacagacttgctggtgagttcattaatttttcacccacatcattttgaagatgattttaatgagccatttattggaagtttgttaagggcctatattttgggtgctatatttttattggcttcctttttataaaaaggcaaaaccaaagtacacagcgttcagatgactttcttaaaatgggaggccatctgagtcacagaagtaaagttaaattctctaagcttccggtcccataatatctttctttaaatacacgtttgtcctgcagctccactttctcaagatcacaggatgattctgtaggaagaagaaaatc

SEQ ID NO: 40295 - DNA, 1056 bp, Bovine  19866881363578
cagaaattgttttagcagctttacttgaatttacatgcggtgcataaaagttgattagttattacatggctagaaatttgtgttcgtggggtggagagttgttataaaaataggacatgatatatgagaacctgtttagtgaatgtctctgaacatgattattagaatcaccgtggaatcaaacacctattgcattcttattcgtgtaattggtaatgtatatccaaataatcattaggggaaagtagagggtaaggttaatgtaagtatatttcttcatggaaaatggagagagtaataaaatgaccacagaactcggcagagaggaaaccagtgtttttataacctgatgtctgcctcttggtttcttctccaggagtactggctgaagccgaaactcaatcctgtagttagtatagatgcatagggaacctcttgctgcccgggtcatgtcatctcttcatgagaaaaaaagaagccactgaatgtttttctcaaatggaaaccaccttgatccaaacccactcgtgggttttttttttttttttcttcatatatacgtaatttcatttattgatttttggctgtactgggtcttcattttctctagttgtggccaaagagggctactccctagttgcagtgcttgggcttctcgttgtggtagcttctcatgttgcagagcacgggctctagggcacttgggctttaataattgtggttccccaggctctagactgcggccttgctagttgaggcacatggacttagttgctccgaggcgtgtgggatcttcccaaatcagggaccgaacccatgtctcctgcattggcagccgggttctttacaactgagccaccagggaaaccccgaaacccactcattgttgatgggagatggtctccacttcagctccgagcacagctgttccttaaagtgtttcacagggacaagccttttgctgttttgctgttaacagccttgtcaagtcattttttcactagtaaatctcaagcgttattccccctgtaaatctttgcccacagacagagaaag

SEQ ID NO: 40296 - DNA, 732 bp, Bovine  19866881536604
attttttaaatgaatactaaaaattctgactcagtatggtacccacaagccaagatgacagaaggtgactagtaagaccctacagacaagtgaatgaaatttcttttcacgaaagaacattcaaaatgtggtccatgtgcactatttagaaacatcttcattaatcaagaagtgaaactatattctttaatatagttatatatccatgcagtcatttaatctccagaaatttcagttaactacagacatgaatttccaacaacctctaatgggtgtaacttaagatagaacagatgactctaccagcagattaatcaacctcttccaaactgcaaattaaagaagaaacaaatcaaacactgcgttttcctcgcagatgttgagcaaaatatattccgtcttactcctataattacagcattaggagagatttaccaacatcaaagtaaataaaaaacataccaaatgaaagctgatgaaaaactaacaagagactgaataataatttttttaaaatctcacagccatagaatctcttattgatttcaattatatattcattactttccaattgagaggcctggagttagaattaaatgcacctcttgtggggacctcagccatgttccaaccacacaatatccgactaaattcatctccagcatctgcagttggtttttttttttttttttttaaatcaaatgttttcatttgtttgttggccaaccttca

SEQ ID NO: 40297 - DNA, 852 bp, Bovine  19866881595880
atttctataatttttatgaggtgttcagtattctcagaactacaaaaaaaaaaagagagagagagagaggtctgttagaaaccttgttccctaaacaacaaactcattttcatttctgcacatttgggtgactctgtctgatggaagtatgcaaatgcatttgtgaactagtatctttagaagcctaatgacccatcaccttaggactaccctcatgatccccaaatccaggtttctcttctatcacttaccttgctgctgggaatctgaaaagcagagggctgaagagttcagaaagtactcttgcattcagaagatttttgctggacgtttgagagagcttgaagaaatgttttagcaaatactgcagtgtgagccagtactgatgaggtatgctgggcgacctaatgagtttcttcaacagctggatgtattcttcagaactctgcacttctgtgagtgaaaacaaaaaaaagcaaggaaaagactaagagactgttggtagctatcagtgactaaacacctagatttctgttctagctacagaggagtcgtttagaacgaaggcacgagaatcagcagagaattatgtttgctcttctcattagaaaaggcattatgagaaagtcgaaatctcacgtcaaatggaaacgcaagaaactcttggtgtgcagaacccaggaggtactgggtgtgctgccttctgtgggccagcttcgagtgtgattggctaactcaggggagcagcagataagtatcgcaggttttaactttgaaggttacgaaccacaatttcctgtccccggagcactttaactgagcattagctcctgaagcggagagtcttcttcc

SEQ ID NO: 40298 - DNA, 798 bp, Bovine  19866881755479
cgaacgagcaagtaagtgaaacggtagcatgttagatgactgaaaaggctatggagggaaataaagcagggatgggcaatggggagcactgggggatatgttgagtattaaagttcaaagaaaggaagataggaaagacgtggctgaggagaaaatatttgagcaaatatctaaagagtgggaggactagctgtggatatttgtaggaagagtgttccaggcagtgggaatggcaaatgtgagggcctgaaaatgcagtaggcacagcatttgtcaaagcatgagatcgccctcatcctatcaaagtaaatgtcgcacagaaagtaattctatgctaacaaaggtagccaacaacatgtgaatcctatactcacagtacagttttttctggtcagcatcaatttaatggtatgaagtgccttgggacttggtccatgtgttacattcatcttatgttgctttctatttgtttttatcttatactagtaatacataaataccaaattattgaaaagatagaaacaaataggactttgcacagtgaaatgtgacagttcccttattccacttgcgctgttctagtccccacccacctcctgatctcctcatctcagaagaaacaaccattaatggcttgatacacgctcatcagtcctttctctgtgtatttacatatacagaatatgtagatgaaagtagtttctctcatgaatgaggtaatttacattttttttgacaatttgcttttcttgcttagcaatgtggaagatttaccctgaattagtacagaaatctctc

SEQ ID NO: 40299 - DNA, 872 bp, Bovine  19866881811292
tatatgtactcaagaattttgcacataatttcagaggaaatatggaatccctgaagccatcctttggtctcattttaggatgtcccagcatagacctatacctcactgtccaaaaagaatgtatcatttttgagggctaaaatcatgtcttctcatttttctgctccccatagcacctacaatggtatcttgtacttggaaatgcactccataaatatctgatgagtagctgatgccaaatttcaactctccattggatgttggaactaagcaataataatttggatttaattctcctattcgtagaggaaaaaatgagttttgctttcatgtactacagaatacttgatgttagtactacttttgcccagagcatgagttgtcaattccaaatgggactctcactttccaaagctctgtggccagttccaaggaaggacattcaggccccaaagccaagtcgcactcactaagaagggagtgtgttctcagccagcccctgaaccaaaggttccttacatctttgctgacaaccagatgtcatggtggccctgggcaatggctttcattaggtcaagtttactgcacgtcaatttagagcaagcctaactctggctaaatgggctagacattgaaccaaaaattcaataagaactctgacaataattaactcgtactgattacctttgtaaacgtagacgtactgtaaatacatgttcctttatccaaaaaaaatcaacaaaagggacgtttgtcaaggtgcaaatgcagccatgtgacgggacctgcacttcacgtccctcccgcccactctcccatcccttcaggctttggttgttcctctctgctctcctcctttaatggtccaagca

SEQ ID NO: 40300 - DNA, 948 bp, Bovine  19866881887062
gtaagcaattatttcacataatacttagcactgaatcaccctgaggccgcctaccaatatggcattttaggcttcagggttagaggagatggcagagctcaagaactaaaaaattatgcaaattcagggcccctgaagggctagccactcagtgtaaacatggaataaaaaccattccacctaccttctgaatgagatgagcagagagcttttgtcttggttttcaatccgggaagaagcaaaaaatgatccctcctgagcactgaccaccatagccctgcccttgtgtgggtttgaggtttaaatttgtaccacctgcgtgatctgggaaacctgaaacagagaaattgacacaaaatggagagcgccctgggcacctggctgaagccaaaggaaaccctctgctgaggtgaaccgaggcccttctgaattccaacagatttaagttgctcaaaaatattgaaagacatataggaaaacaaccagcatgaaagtgagatatgtgatattaatagacagttatagttttaaatggttacagaagaaatggaaaagcactgataaagacctaagcatccaatcttagaagctggggagaatgtaagatagaagaaggaagacatgaaataaaccatagaaatcaacagaaagcaagtataatatcagaaagttttttttaggactaactaacgagaccaaactcagcaagaatgatcagcaaaaaaagagagaaggtacaaaaaatattagaagtgcaagggttaaaatactgaggggtgaagattaaaagtatataaacattgtaccatgaatttgtttatgccaagaaatttgaaaacttggtaaaagtgtatcattatcttaaaagccaaattaagacagattatagaaaaaaaatagaaagcctgaacagttctaaaatcattctagaaattagatcaatactta

SEQ ID NO: 40301 - DNA, 1503 bp, Bovine  19866880183265
tactccttggaaggaaagttatgaccacctagatagtatactcaaaagcagagacattactttgccaacaaaggtccatctagtcaaggctatggtttttcctgtggtcatgtatggatgtgagagttggactgtgaagaaggctgagcactgaagaattgatgcttttgaactgtggtgttggagaagactcttgagagtcccttggactgcaaggagatccaaccagtccattctgaaggagatcagccctgggatttctttggaaggaatgatgctacagctgaaactccagtactttggccacctcatgcgaagagttgactcattggaaaagactctgatgctgggagggcttgggggcaggaggagaaggggatgacagaggatgagatggctggatggcatcactgactcgatggatgtgagtctgagtgaactccgggagttggtgatggacagggaggcctggcgtgctgcgatccatggggtcgaaaagagtcagacacgactgagcgactgatctgatctgatctgatctgaacagtaatcttttgttgttcgactacatggcttttgggtttttgtttttttttccaacaaaagttcctatgtattctgactcctccttttcccctttgggacagttcctcagaactacctgagaggctgccttctcaggctatcatcctcagtaaggtccccaaataaaatgtaactagcaaattgcaggttttctttttttctttttcttttttttagtcaacaaaagtaacacacatgaaacccttagagggataattaagtgctcgattacttggactatgtgttcagagaacagaaagttccagtgtgctgaaaatgaaaattaccttcatacaacactattcatattaattcacctccaccttaggtacaaagagctgcattgaagatgggtcatagatgcattctctggctagaaaataataccaacctgtttcctagaaatgaatgaaaaggatttgtgaaaataaaccatcactcttgagaaagggaaaggcaagactctgtagcagtttgaaaatgtgacattgaaatttcccagtcagccccaaatcatcatctccctcccaggagtggttcttggaaatccattgtatactcattttcctccatggagtattcacttgagcatcagcatcatattctgtatgtaagttacattgaacctctagccctgagcgaatcctgtgctctgatttgaggcaggacgtagatgggttccaggctagacatttgcagctagacttctgttcatatttctagaggcagaggatagatgggccccaggttagacactgatgtccagcttcctgtttatacttcaagatagaaataacaacagcaacagggtgagtagctgaactttgtctcctgtggccactttaaggtaatagtaacagcaggagcagagacaggctaagccctgctggtgtaaaggatcaggagatcacaacttcc

SEQ ID NO: 40302 - DNA, 729 bp, Bovine  19866880344244
acaaagaagagacacagaaaattgcagtatatacaagatttgactacttacaatacattacaataaatagggcattttataagcaattcagcattggattagaatctttccagggatggctaattctagttagcaggaatattacaaatccattgttattaggatgacagaaggctttcattgttgctattgagtactttaagcttaatgtttttaaatctgagttttctgtgattttacattgtaatcaatgttttttaaggaaagtaatttaaatctaacagtgtttactctgaccttagttgaatttttataacaaaggtgaaacttttccccatacctcatttttctttttgcaaaagtatgaatcatttagaagcttggtgctatattcctcttcaccaactcttcagtttagatggggaatgtggaaaagtcagccaagggcatattacccaggcttgggtaaccagcatatgccatgcctcaggccaaggtgacttggatcagcaggtcgacaatactagcctatgagagccagacccaaagtttgtactgaaactgtttgttaaacagaatttctattttccactggattttacctgaaagcatataaggcttggaacttcccagggctcctatgagggggaagcctgcctgagaacagaacagcacagagatgaatgatggacagaaccaagagatgcacgtaacagctccctccccagt

SEQ ID NO: 40303 - DNA, 3065 bp, Bovine  19866880368159
cacatgaaaatcggccttaatagcatcatcttcaagtcagggacattggttatgtatagactcatacaagtgtggatacacccaaactgttgtacttttcaaactgtagttttgtaatgtcacataggaagctaaacaatctttaaaagtcttaaggtagccacccaaaaacaagagtttggtcatctttcacttggcctttacaactacaaactgacacataatgtaattcaacatccatttaagcaacctgtaatttgattagctgacttcatggatagtacactggatgaatggttcctttaaattcttatacttattttctgagtataaaaatatcagttctgtagcttctttccataaactctacttaatttactcaatcccttccaactgtttttgccatattaaatgttacattacttacactttgatgattttctttccttcctacttaaatatggacaccacttgttatttcgcttttctttcattcattcattcattcattcattcattaaaaaatactgagccccgctaatgccaggcactatatcaagctcttcagaaagagcagtagataaaatacacaaaagaccccatccacaggaagttaacatctggctaggcactttcagtgtctacacagttcaaaagcagaggcttccataaacaaataacattttctgaaactatgcattggttgttttgcgcttttaacaaacataagctcccaggtctaatttatttttttaagtaatgaatttcagtagttagatcttttcttcaatccaaaggtaattgctttctctcttaatactttggcctttctccagtaagcttttgtataaacggcttcaactggttccacgagtagcgtgggtactttaaaatcataataaagatgccttcatgaccaggtggcttgtatttgatctacattttgtaatgttatcctttattatcttgacaccagcatgtttaccacatttcatcattagggactgctttatcttcaatcactggtagttcgtttttttcctttttctattagccccagataaagtgtcagtattttagttcagcaagaatcatataatagacaggaatctgcatttataaccattttagcagaatttttttcagataaagaaatggttttggaaatctcctgtcagtcctaagaaataaagccccactactcattttaatgaaacattctattttcctatgcagttcttacagtaatgatgataaggaggctctgtgggcgtttttttccagcgcctagaatatggggataactcaacagtgattggagaaatgaatcatcagttttataacttctctgaatttaaacatatgttttcagatcctagatttctttcagacaaccttggtatattgccactcatacacgaaggaaccagtttaggtttccctcaatcttttcaaactatctcttcatagtcaccccttagacccttccatcgcttaataggtcagttgccaaggatccagatgaaattttaccactctttgccagtatctttcttttctagttctaaaacaagtatccgaattcttaaagttagaaatgcctctttttaaaggcatcacagccatgaaatatgcatcttagaagactaccatggctagaatccaagtttacttttatgtgaaaaaaatgtatttcttttgtaatattttcagtcattcttgctgccttcttatctcatattaaatcttaattccaccttaacaccatgctacaaatccattgcacgtttctgagtgtttaatgtctactatgtgctctgtgctatacatgctaagaggagatataccaaagtctgacactgacatgttaaaaataatttttacatgaatatagcaaggcttacgtagcataagtagagttgataattccaagtggtcactctgaagaagtctgtagtgctgtgatgtcacacattaggaacccctcttttgtaattgcctctggagcctgtgacacaagctaatgtgtattctcagtggttgtaagtcgtcgtctttcaagggtttattttaatgaagagtcattcagaacaaactcccatggcatagtatggggtgattcaattggataatctcacatttgatcaaacattagaaatgtaatgtttgcaaaatatttcttgtagtcttcaagctggatcatgttttaaagaagtgttgaaagcgttgaaagataacagcctctttggaataagtatagaagctttaaaagtgactattttaagacatgttctcattgttttatcattgttttcagaatcacttctgcttgtggttaagtggctcataaagttaaggaacatgaacacttgatagaatgacgtgagaagttgaataacaaatacagtgttaattgctaagtgcccaatgggtacgagaggcagtgtttacagatggccaagaaacatatgaaaaggtactcagcaccactaaccatcagagaaatgcacatcaaaatcacaagatatcagctcacacctgttaggatgatcaaaattatcaaaagacaagaaattatcaaaagacaagaaatcacaagtgctggtgaggatatggagaagaggaaaccctgtgcactgttggtgaaaatgtaaatttggtgactattatggaaaacagtatggagataccccataaaatcaaaaacagaactactgcatgatccagcaatttcacttctgtatgtatatcaggagaaagtgaaaacactaattgacatatatatatatatatatatatatgtgtgtgtgtgtgtgtatatatataatacactgaagtgaagtgaatttgctcagtcgtgtccgactctgcgaccctgtggactgtagcttaccaggctcctcagtctatggaattttccaggcaagagtactagagtgggttgccatttccttctccaggagatcttcccaacccagggatcgaacccaggtgtcccacattgcaggcagatgatttaccgtctgagccaccagggaagccaatataatacaccgctgctgcta

SEQ ID NO: 40304 - DNA, 1270 bp, Bovine  19866880457784
caattctcagctaatgggatgtccttgagaggatgttgctggaaaacagataaactgggttgtaactccttgctttccaactgggctgtcttctacaagtcaccaaaacacgctaattcctcagtgttcccatctgtaaaatagggacactgattcctgtcctcccgactacacaggggagtgggaagacacccctaggacaagaaccacctggtaattgacccttgggaatgttattcacccgccagcatgggggaatccggggacctgtgcgcagggaaacctctcgtttagttcgatccctctccgcagtcactttcgccccactgcccagttcacggagccgtttcggggctccaggaaagaatagcggggggcgggagggcggtggcgggcgcgggagcagaaggggcgcagggcagggcagagaggctgagagcgtcaggcttgcagggatcggactccagctctctggcagacgtctggatgcccaacccagggcactgggggcggtggaatgcctaccttgccatacttcttcagcttcttccggtacctcttcttgggcttctcgcttggcacctgctcctccagcggctcgtagcgctctgggaggacggcgaggtgcaccctccgtgcgccccgggaccccgggcgccgggcgctcgcctcgctctccgccgcctccgccccgttctccagatgctccaggatagcggctgcctcctcgtccccctccgtccgccctcgccccccgggtcaggggcccacaacgagggaggctgctcgccgccttgcttcggagcctggctcccaccgtcatgatgccgcgggccctccggctgaggtcggggacaccaacctttgctcccagcccgcacctccagccgcgccgcccacccctgcccagcgagaccaggcccagcccagccgggccaacccggacggggcgggaggacttggcatcgcagcgccccctggccgtggggcctgggatggcggtggctccaccgagcctggccttcggctgatcgggtcccagctgccaggatcccagccactgggtgagggctatctctaaaggttaatggacaattaacatgcaaagcaagttcaaccgcacttaacgaaagaagtgaacctcaactagtgagacttcctttgcccacgtgcagactggcagagatgatgataatggtgatgatgatggaaaagatgatagtaataaagatcgtgcgcgggcttccctggtggctcagacggtagagtc

SEQ ID NO: 40305 - DNA, 1111 bp, Bovine  19866880548321
gagagaactagctgggtcaaatattgagaggacgagaagcactgaggactggaaatgatgactggatttaaccttatggaggccctggtgaccttagcgagagggcaaactgaagtgaaacagtgacagattttactttcttgggctccaaaatcactgcagatggtgactgcagccatggaattaaaagattctccttgaaagaaaaactatgacaaacctggacagtgcattaaaatgcagagacatcactttgccaacaaagctctgtctagtcaaagccatggtttttccagtagtcatgtacagatatgagagttggaccataaagaaggctgagcaccaaagaattgatgcttttgaactgtggtgctggagaagactcttgagagccccttggactacaagatcaaaccagtcaatcctaaaggaaatcaacccagaattagaaggactgatgctgaagctcaagctccaatactttggccacctgatgcaaaaagcagactcattggaaaagacactgatgctgggaaagattaaaaggagaggggcagcacaggctgagatggttagacagcatcactgaactcaacggacatgaatttgagccaactctctgagcgatggagaaggataggggaacctggcacgctgcagtccatggggtcgcaaagaggtagacacgacttgctgactgaacaacatgaattgggttcaagagaacagagagaagaaattggagatggcaagtacagataatcctttcaaggagtttcattgcaaagcaaaaggaatatggagacaggaaagggtatttttaggctggggaaggtaacagcacatttttaagctgatggaaagatccagtagagaaagaagatgtgatgatacacggagagagctgctgaagtgtcaccatcaaggcggccagagttgaggagttttagtgcacacgtggagggggtgccctctgctatgagaagaatgttcatccacctaaacagacatttctctaaagacatacagatggccaacaggcacatgaaaagatgctcaatattgccaattattacataaatgcaaatcaaaactacaatagataccacct

SEQ ID NO: 40306 - DNA, 824 bp, Bovine  19866880624882
aggaaaaaataatgatagcctttagttagtcttaaactgcaagtgaaattaacacttaagctttgtggtcccttctcatcttccttattttatccaacattcattgtatattattacatagggaagcaagaaaacacttagatgatctgatcagtcattgacattgtattgatgttttttccacaggcaagttaaccgatatccatggaaatgcccttcagtataacaaggaagtgaagcacatgaactcggccggagtcctggccacactgaggaattatgactattatgcaagtcgagtcccccagtctgttaaaaatgcccttgttccttgaagggaaatctcctcaactcagccaggagaaggacttggttctcaaaaataatacattttaaaattaactgaatggaatttgagctccacttttacttcattgttgatcaccagtttacatttgattacttaggagtagaaaatagaatttttaaatgtcttgataaatcaatcacccagaccaattttgacatctggaaaatttgcaaagtcactccgtgtcacatttcttttcctccttttatttggagcagtgaaagaaaagttcatttccaatttcgctgtcctgatccattgctgaatcaacattcctattttgtaaacagatttctctagggcatagaaccagttgttacctgaatctcattcttgtctttcagtgtaatgtaaaaagtttccctactcccatcctgaatacattaaaatgtcattgtatatgttgaagaaacagattttggagaaatgtttctttataattatttactttgag

SEQ ID NO: 40307 - DNA, 729 bp, Bovine  19866880698266
aagggcctgacgtgtctaccagacactacagtaacaggggcctgatgactgggatggacagtgagtataaagttcaagtgaattttagacttgaattcccagctcaggtctcacatttccacgcttaacactacaaagggctatttaacagatcaagttaatcaaaacaaaactgataatacactatggacaccaggaattaggagggaatactgcaaatggcaaggaagtataaattgagaggaaatgatgaagtggcttattgtgatccattcatagaagcagaagcaatagcgcaaactcagcaaaaatggttattctggacttttcttcatctccaacaccactcgtggccttctccagtggcagatgattaagactcactcttctaggccaggtcctgaactgcagtcaacaagagaggttcctatcttattcagactgctcaccaagcatctaacaaggtgctttcatactcactcactatgtgctgcatgaatgagtcaatacataaaaacttaagtctaagaggcatcttgaaaggcactcagcattgctttgttttgttttggacaccagtggcaggtatttgatcctatttttctgtccatggtgtaccatcatcatcagtccttgcaagtctcctctcttattttacgtctactttattattatttctttcctctgctccttcagcctgaatcccatttttctctctaccgtaagcac

SEQ ID NO: 40308 - DNA, 2024 bp, Bovine  19866880776689
catgcattggagaaggaaatggcaacccactcccagtgttcttgcctggagaatcccagggacgggggagcctggtgggctgccgtctctgggatcgcacagagtcagacgtgactgaagtgacttagcagcagcagcaggctttattattagttcctttaatagaggaggaaacatgcacataaagattaaacaacttgcccaaggatgcatagctagtgagtagaaaaatttcatttcagttggtattgaaagcagggaaaattctattattattcaggaattctaagtctgataatccatgggattagtttcttgaagagctaatgaaattgctacctgtaattactttgaatacagtacatctcaagcccagatttaggttcacgttgccactgctgcagaaaaatgaaggaattcagtgtctactggattgagtggacaacttgaagaaagaaataaataaaatctgaatttgtattttcagctaaagatgagggactagaatttatagccattatattattgagcttgcataatatcttgtacagctgagacagttcttaattaagcttaactatgacttcagcccgacgagggcatggcagcccactccagtattcttgcctgaagaatcccagtggacagaggatcctggcaggctacagtccatgggatcagagttggacacagttgagtgactaagcacacacagcacagcatgacttcagcccatgctggataaacatttttttctaggcttcctgtttgagagttaatatattgatcagcatggagtgagatcagttatctcaaattactcttcagaaagttcctttaaggaaagattctgctgctgagtggtgctatggcactcctaaggaaaaatgggggtttgagggaaggaatatttgtttaggtgggtgttttataattagcatcataatataaaaaatgtgctttatattccattataatttctaatttaagactcctctaaatgcattctgagaaagttggatggctcctaaaaagggtcatgcttaatgttgaaagttaggagatctcatttttaaaaaggattttggagaatatattaccttttccaattctaggagtgggataagaaagaatagtatttttgtaagagccctctctcccctcctctcctctctaagtacagacactgccatacctatattttcctagaacctccttctctgttggtagcattggccagaagcaatttagtcctgcttttcaaaccatgacgttttacagtagcggttggccaactgcatcctataggccaaatgcagcttttggatatgtttttgtatggccctgcgctaagaaattttctttaaaaatgaatacccaacagggacagtggagtctgcaaaacctgaaatatttattgtctagctttttatagaaaactttgctgacctctgtgtctcaccattcttgttgaggatatacagaacagtcaagaatgctgcccctaaatattgataagttacctgatcgagagtttctccttagggaactgattatactgccctctcttttgttggtagcttagctaaaagttgaacatgtctgataagaatctcctaattattcatttttcctttatgacctcttaattagaaagtagctcttatgtatcagctattgtattgcttggtaacaagtcatcccaacacccagtggttcaaactcacaagcatatgttgtttcttatgagtcacggggttatctggggatctgttgagttaatctgacctcagctgggagtggctctgctcagtgtgtttctcgtcttccttctggttcaacctggacacgcccttctcatggggatggcagaaatgtgagagagcaagttgaaacacagcagagcctcttgatgactaatatgggactggcttataccaccattttgaactcattttattggccaaagcaaatcatatgactggatgcccaaagagtgtaaaactatattctgccctcagtag

SEQ ID NO: 40309 - DNA, 1057 bp, Bovine  19866880798915
ctagtttgtctctatgactctctctcttcaggctctgagtccctccagagcagggaacaggtttcatttgcctttgtatctcgattacctacagctgagctgaaataaacagtaaaggaaataaagaaaaccttcttctgaaactgtgaaagcagcaccgttggtccccaaaggaaaggtacttgataccgcgtgctcattcagtcagtcacgtccaactcttttccaccccatggactgtagcccaccaggctcgtctgtccacggaatttccaggcaagaatactggagtgggttgccatttcctactcggggtgattatcccaacccagggatcaaacctgtgtctcctgcatctcctgcactggcaaggcagattctttaccatcacgctacctgggaagcccaaaggaaaggtagtcatgatttaaagtttcaaaataaacctgacactacacaccttacaggtagttctttaagattttggcccatttctcagcttctaacttgtttacagcctgaactaaactcatagaagccaaaacaatattaactagtacttcctcagaagaaagaggcagcctacaatcaaaggcactgtacaggtaactccttgatgttggcaccttccctctcaaatagttaaccacataaagctaggcgataggaagaaaacaaaattcctcattatcccctccttccaccttccacctacaaacaccacattgtaccttattattttcaagcaagacgattccagtattttctactgctgtcatcatctaccaaaaggactgattcatcatgtctcttatcccacttgctttagtaaccaaagataattttctttccactttagtcaaaagatgggacttattacacagtaaccatcatcatcctcatcatcataactcagtgttttacaaagtctaggtggtagatatcagtatcagaattacttgggctctaccctagagaaactgagtaagaatatggactgagagaaagcaggggttagggaagagaattgaaaggtgccccagcggtcgtaactcac

SEQ ID NO: 40310 - DNA, 2091 bp, Bovine  19866880841472
tcatggacctgacatttccaggttcctatgcgatattgctctttacagcgtcggaccttgcttctatcaccagtcacatccatagctgggtactgtttttgctttggctccatcccttcattctttctggagttatttctccactgatctccagtagtatattgggcacctactgacctggggagttcctctttcagtatcctatcattttgccttttcatactgttcatggggttctcaaggcaagaatactgaagtaatttgccattcccttctccagtggaccatgggagtggtagggtgggttaaagaaattcaaatgtaaaactcaagagaagatagcttcagtgtattagcattgcctgtattggcatgttcaatacaacatataaattatgtgtgaattctagagtaaccgtcttcctgccacttgccacacttcctgtatttgaatacaactcttaagaaaactcccaggggaaaattcctgcttaaactcatcttgtattcccttcccttaaactcaacacttggcaccatccacttcagtgaatgacactttctaggaggtcagcaggtatttctgttcactcatcctaggaagttcatctgccagttgcagtagcctcaccaacatgacattttagtagataatttgtcattgacatggaaaacatcagtctaacagacaaaaatctccccagggcttcaaattcctattacctttttggtaacctaagggggctaactcactacttctcactcctctttgtagagaagttatccaaaatccttagtagatattcaaagccttccatgactgttcccttcctacagttccagcctttccttctatctctctccctaatgtcaaaggtgtagctaagctgggcaactgagcatttcctgaacatgcccactgctttctcatcctgtgcttttgtgtatgcagcgttctcccccatcagggatgccagcttctcacattccacctgttgaaattcaacctatccctcaaaatccaattcaaattcgagtttatctattaatacaaagtcctacctggctctacatccccaaatcttccctactgtaatgaatttctctttccccttggcaatatcaatatacagaattatcagattttgcctaatttaattaccagaaagtatttctctcattcaaaaaatacaatttaagggactttaactttttctctatgtttatcttcgttcctagaaagtcatcttgtctagaatacttagcagatttatgtgataaacttctggttggtaggacccaacctccagattgcatgaatatttaatgagaagggttgaacaaataattagtataaactaattgcttttcttttagatcaactgactcaagctttgaaaaatggtgatgatgctatacttttttattatcgtcctatttgggatcaggataacaccacaccctggtgggtagacttgaagaatccttaaacaagataatatctagactgcttaatattgggaaaagagaataattctgggtcaaagaatgagaaatcagaaggaagtctggcttaaggggaaaactttctcttttagagccagaaacgagtagggcttggtctaggagacacggaaatgcctatagcaatgtcagaggtgggaggtgaatcccccaagaccacagagatgttagctgcgtgtgtcaggcagacagcctatctgagcccgaaccctccagacattctgtatctgtgcaatgtggttatttcctttccattatctcagattttgatacattcttactacctgcagcaatctgctctaccatgtaaaattcaggggaaaccagtctcacccttaaaatgagaagaacagagggacggctacagtcagagggattgtcccaatggtaactcagcctagaggtgaccccataggggatatgggagctataggaggtaacaaagagcacactgacaatttgatactaaagagaatgtgatagcagatactttgcagttaatcacttcctaattgacaagtgttctgagctttttttattggctgctctcaaatggttaataacagt

SEQ ID NO: 40311 - DNA, 1478 bp, Bovine  19866880888326
ttgttacccataggagagcaatcaggatccagtttattttatgaaaggaactacccatgtttctctttagctgggataactcttgggtgctttacaaaccctcccatcttgtagtttccttgttgtgggttaaatgagagattggagacagctttgtagcctattgaaacaaagtatgccctcaacaaacagttactgattgattggtcaagtctatcagacactggatacatttaaagcacatgataaaaaatgtacagttttctgaatttgttataagttctgctgaatctgtcacatttgataaattggtcataaatgactattatctgtgaacatttgtatgaattcaccatgttttttatttagctctgtaaaaagaatattataatgctaactgccagtaactattagttgaagaatacctcctttgagcagttcagtgcttggcatgtggtagagcagcacttagtaagtgtttgttgagtcaaagaacaaattattaacaacttctaatcaaggcctttgattcttcagcaattaaatctctttattctcattttttactttatggagaaatgctgaccaatatgatttaagtcacatacataattttatgtttttcagtatccacgtttgaaaaagtaaaaagaaacagctgaaattaattttaataatgtattttatttaagccatgtcaatatattatggttttgatatataatcaatataaaatctattaaagtgataccttacactttttccctaagtatttaaaaatcagcatgcattttatattcaagcacatctcaatccagatgataaattttctaaatttatctaaatatgtatttagatttaagaatatctatagttgcaaagatagattcatttacccaagttttacccaacataatttaaaatgttccaataactgattcaaatatcagttttcaaatgatttgaagtgatatcaaatgaaaaagttagttcctcagtcacaggagcaaccagtcaagagctcagtagctgcctgtagttagtacctgctgtatacaacaatgtagttctagagaattctgctccatagagctgctggaagacagtgctcattcagcacatttcagtgtgggtttagcacctcatatatattttaaatttttcttctgtctttgcattgttccaatttttttctgaaacctgtattatcctaacaccttagaggttagaaatctctacattaaacatgccccatttagttaataatcctaaggaaaattactaaaagccttaagatattcctttggttatttcttcatagtcactagcacaagaagctatacatgtgacacacaaaaatttgcttatgagcagtctcactattaaggactatggctaaagagttttcattcaatcacagtactgcctcatgccattttaagggaggggggagctcacattgtagtatacactcaatt

SEQ ID NO: 40312 - DNA, 1105 bp, Bovine  19866880943763
ctgtaaattctgccttggcttgctgtgggtgtctgtcctcttacatcccagagtttcctgtgcaacctctcctcagagcatatcccacactgtaccacactatggactgattccctcccctccacactgagagcaaccagagatcacggaccttctaatctttctattccagtatgtggcataatttctggaatggagcaggtacaataaatatcagctgaatgtactgattcactaatagttactatctacttataaataatttaatcctattctacaaaatgcctcccaccaactgtcaaagctctgggctattcttgactctcaatttatacctttatatttgctgacccaaaggatcatttgcttttatggttcaataaccactggcatagtgacttctttactctctctctccctaagatagatctcgactggtcctgagacttcccgattgatgtataaaaacacttgacccactacaaggcaaaacatatcacaagatgactttttcctgggttcccacctatatttcattttaaatgctgtatgtccctttgtttcagttactgtgtattctgtgcacctggaataaccatgttgcctttggaagggctcttgcatttgggggatgctgttctcaaggacctgactgaacggggcctctcagagctaagcaagatactatgcctattctttcgaaacaatctcttcgtgtttagaaataagattagttcataacttagcactgtgaattttgaattctaatagataagattgttagtgtttttatatttttttcataccacctagaatatattagctgtaacttagcttaaaaaataattcacattaatgtgaaaaggtgaaaaacttacttcaggtggttttctacctaaaagaatgtaagtagccatgacttcatcatatttctgatttattaaggcatcatttatctcatctcgtacaaaacccatggtgatcatgatatctagaaataaaaaacaaaatgcaaaatttcgaaaaacaagttttagtaaacaaaccaacaaaaatgggcaagtttggccacattagatatgaaaactaagttctaaaattttaa

SEQ ID NO: 40313 - DNA, 3069 bp, Bovine  19866880947921
taaatgagatatacaaagagtacaaaatgctcctaacctcaccacaagacaggaaatacaaaggatttatatccccaacaatacatctatcagccttcactccttgaagcaaagctgttttagagcatcacagctctgcagagcttcaacaggctaattaaaaactttctcatacttcacagtgagagagacaggaaaatatcaacaataactgttggagcaaagccccaagatctccccaaagcattttctctcctcaccagaaggcaaaggtccacagacaagactcttagggtacaaggtctccagtcagaggcagaaaaactcattaatgaggtgaggaatttacaaccgcaaatcactcattctccaacccaagcccaggacgctgatgagacaacagatccccaggagcattttagaacaaatctccagttacgtaagtcaggcccagtggttcatcacatctctccatgttcatgccacaacccagattctacaatttttggtagcttatccagttacagtactattaacttgatattttatatctcgttactttctgagtatagaaactacatatgctgattattaaacatgatttttctatcacagatgccattccttttgtctcttattttgagcaagcaatcctgttccaaaatcagtgctaccacccacttggctaaatgttttgcctaaagatattattgaaatgaaatgaaatgtattgctgttgtttagtcactcagtggtgtccaattcttttccaagtcctgactgtagcctgccaggctcctttgtccatggggtttcccaggcaagaatactggaatgggttgcaattttcttctccaggggatcttcctgacccagggatcgaattcatgtctcctgcattagcaggtggattcttgactactaagccaccagggaagcccagtgaaatgtatacttcagtcaaaatgtggtatcacttgaggactcccctaaaaaaaatctgaaatagtcaccaacagacacttctttattccctgcacgcaccctgaacttttgcttgtgctatcttctatatccagtcccaggacagcagcatcaacatcacctggacaactttttacaaatgcataacctctgcacactctggacttactggagctgacactcaagaggtggagcccagcaacctgtgtttgaccaagctctccaataattctgatgcacaataaagcttgagaaccacagacctagatttaagagtacctcctctgaaagtcattcatcttaaagggcttcttctacttcaggactggtttcaatattctttctgtttcttccttccctgccacttacagccacagacacttctgagagcaatttacatataccacccaggattacagtctgtgtaagattcttcttcagccccgctccccctctagacggtcagctgtgtctcatcaatatttccagagcctggcacaagcatgcatcagtcaacgttgactgttacatcaaagtactgaatcagacagtctatagacaatacatcttatgagaaaatgggactggccagattgctggacctcataaggttaccaacaatgtgtctaaactccttccaggatactgaccttaggggctttctcggctttcagtttacgaaccactttctccttgtgcagcaacttcatcatacagagatttactttccacaatatttgatgatgatttagaagaaatattctgtcctactgcagcaggaggatttctaggcttatattcctggccagttttctccttatattcagccttcaaagccaaaagctgttttacagctgcatctatatcttcctttgtggctttcttggcttttaattcacgaaccacgtccccttgggcagcgactctgttgtaaaggaccaaggaatcctcagacgtggcacaagtactcaaagaaggagccgatcttgtcttgagaggcgtagatgcctacagatgcagaaaaccaaaaataaaattattaatttgtattaaatatctttacacaaaattttataaaactattttataatattttaagctaaacacaaaattttaaaatgctaatctctttaaactgtttagggaattccctggtggtctaatggttaggactctgtgcttccactacaggggacctgaatgcaatctctgatcacagtacttagatcctgcaagcaacatgatgcggtcaaaaaactttttttcttaaagttcaaatgaacaatctcattccttaaaaaaacaaacaaaaaaaattatcctaataaaaaataacaggaataaacaaaggtagaggtacacagatattcacaaagtgttttttatcatagtaaaaacctgaacctaaatctttaccattaggagactaaagaaatgagaaagtgaaagtgaaagtcactcagtcacgtctgactctttgcgaccccgtggactacacagtccatgaattctccaggccagaatactggagtgggtagccactcccttctccaggggatcttcccaacccagggatcaaacccaagtctctcgcattgtaggcggattctttaccagctgagccacaagggaagcctgagaatactggagtgggtagcccatcccttctccagcagatcttcccaacccaggaatcaaaccagggtctcctgcattgcaggcggattctttaccaactgaggtatcagggaagcccaagaaattataactcacctaccaaatctgagaataaaccactgctagtaccaacatcggagaaggcaatggcaccccactccagtactcttgcctggaaaatcccatggacggaaaggcctggtgggctgcagtccatggggtcactaagagtcggacacgactgagcgacgtcactttcacttttcactttcatgcattggagaaggaaatgggcaacccactccagtgttcttgcctggagaatcccagggacaggggagcctggtgggctgccgtctatggggtcgcacagagtcggacacgactgaagcgacttagcagtagcag

SEQ ID NO: 40314 - DNA, 955 bp, Bovine  19866881022996
tgaaatatgcggaacaagcaaatccatgtagacagcagattagtggttgtcaagggagagggagcaggggaggaagttggaactgactccgtgacaggtatggggtttcttgctgtggtgatgtaaatgttctggagtgagttagaggtgatgattatattactaaagcctactgaactgcatgatatgtgagttgcaccttagtttcgaaagagaaactgacaaatacttgcagctcaagtgttgtatagtagatcatacctatgtcattattttctggtcatactccctaaaggtgtttgggctcctcctgtggctcagcggtaaagaatctgtctgcaatgcaggagacacagaagacttgggttcaatctctgggccagaaaagtcttctggaagaggaaatggcaaccccactccagtattcttgcctggagaatcccatggacaaagaagcctggcgaggttgcagggagtccatggggttgcaaagagtcggacatgactgagcatatgactcacactaaagtgttcaagactttggcaggttaaattttaaaaaaaagtagaatgaaagggagcctggcaaataggttattgtgtgaccagttgtgagtgaggagacatcttgcatatttattgggagaaaggaactttggagagacatggcaacaagcacttactgtagagcagagcagctgtgtttgggcaaggacaaccccaagcaaggagattctcttcccttcccagacaaccatatcctgctataacttcatccttcactccaagcagagcacatgctgctcagatgaaaagcagatctccctgcagcagccaaagaaaacaaacacaaaaaaagcaattgaaaactgagagaggaagcaggaatctgcaacctagctgataacatccttagaatcaaactctccaagatgaatggtcatggccattacag

SEQ ID NO: 40315 - DNA, 1433 bp, Bovine  19866881121145
atttgtaatgtgaaataacaaatcctgtggaagaatattatgttttaaactagaacacatatagggtggacttcttttaaaaatcaactaccattctaaactatctttctgataatttacccaagtttttagttattatactggaaagaaaaactttgctttaggtttcttttccatgaagaaaaaaaaaatctaaagcttgaatataagggatacttgtttaaatgccagatttgaccaaatatgttaagttcactaaggacagcatgactctgcctgaagcagattatttcaggatatgaagcttggttccagtgctctggacctggacagtggtcagaagacccagtcatacaaataaaagctctggatgtcggaagtccggagccctattcagagcagaaatggaacccatttgaactaagggtcttgcaggctccataaggaagccactgactacttcaactattagtgtgtctagattggtacatccttttacctaaacctcaacgaacaataatggaggtggtatgaaatgagatgagactttcagtaccttctcaatgatacccaggtctccttcggcgataacacgcctgactatcgttcctgccttttgagcaatagaatatgctgaagccaccaaccgcatcaacacagtgggactggatgccatgatgggccctaaagggaaatcaagaagaaatgttctgttactttcaaaaccagctgctggtttcatttacctgaattcaattcaacatgtagatattgagctcttccttgggacggtttcaattaactgtgtagattctctaataaacatctactgaaagagacctggggaaaggctccatttcagcatcagctctcccaataaattcagcagtattctttttctcagcaggtgggaaaaagaggtatagaggtaactggtttaggcctatgagcatgtgaaatgtttgatgtatgatgtgtgtaatgtgcaaatgctgtccattaaaaggtggttcaggggctaaaaatatactatgtgccctgctgctgctgctgctgctgcttctgctaagtcgcttcagtcatgtccgactctgtgcaaccccatagacggcagcccaccaggctcttctgtccctgggattctccaggcaagaatactggagtgggttgccatttacttctccactaatgagagctaatattttgttgggctgcgggtgagatactgtaacctaatgtctataaaacaggtaatgccaagagagggatgaatagcataagggacgtttgcgtacatgggaagtgtatgtatgtgtgtgtttagtcatagccaactctttgcgaccccctggactgttgcccatcaggcttctctgttcatgaaattttccacgcaagaatactggagtgggttgccatttcctaccaggaat

SEQ ID NO: 40316 - DNA, 1866 bp, Bovine  19866881225719
aattttattttttataaagtaaaaaatcttttttttgggcggcactagatcttcactgtggcaaagggctttctctagttgtagcacacagacttagttgccccatagcatgtggatcttagttcccagaaccagagattgaacccatgtcctctgcatcacaaggtggactcataaccactagactaccagagaagtcccaggagtttagattttatattgtggataaggaagacttggtaatgattttgaatgaggaagtaattattattttcacagacccaacaaatatgaccaaactgcatgatactgcgagctgcacgattttaccctgggcagctctctagaaagtgcttggaaagttagggaaactgaggcagaaacatccatgccatgcttcgtccccagagggagatcagcccgccttacctgaaacctgggtcagaattaccatcaggcccgtgactgtgtgggcagcaccatcctgggtgactcttgtgcaaacagtgcccaggaaagtgctgattttgggggggggtggggccaagggtgacagagggggtgggagaaacaggagctgacatgctctgggcatcagccgcctgatggaagagacttgttttctcccaggaataacccagatttggtgtgacctgaagtggatataatttgaaggggctctttaagaaaagaaaataacaaaaccaagattaagtgcagggtctcaaaagggtccagagcttgaggctcaagcctttccagagacattcccagtaaacccgcctatttctcccctgttctgtttttctgtgctgatgaattgagggtgcagaagttcagagtcattagatatttgttaaatacagaatgaaatgagactcaggattaataatgctgaagactgatcagaaattagtccatgaagcaaaaattcttgcacaggactcctgtaaaactggcccattctttgctgagacactttcttttagggaatacaatttttcttgatttgtctccactaaagatattagttttagtataagatcttgaaccagaggaagaagaagaaaagatactcccattcctggctcaagaatttttgctttcctgtaacttgccaactaagaatttttggctcacctctaacatgtcaaactgaaccgagctgatgtaagccaaattatatttgcttaggcaatttgagtgggtggagccttgcttttttcagtttaaaaaacgttaagtgaccttgtactccaaagtccatttgttgtttttttcctgcattgtgataggcttacagaaatagtacataaggaagagtattcttatttgaatagaagagtcctttggaaatgcatattaaaaaaaatctttactataaaatgatgctaatagggttgatttattctcctttaaattaaaaagcccaagagttaagggcctgatgcactcacctgtctacctggcaccatctataacccttccagttagcgggactctgttaaatattaatgtaaaatgataatgcacttaaatatttcatagaccaactaataataaacatacagtaaacctaagcatagtgcaaaaatccaggccattatttattgcaaaatcatagagcaataggaggatgcattgcgcaacatttactctttgggacccaaagcactttgtactttttctatgtaattcagaatattaagcagattttttaaaaagcagtttcctttgggccggtgtggtatgcttgaattctgggaatgtggagcaatgaagtttaaaaaataataaaactgggacttccctggtggtccagtggttaggaatccgccttgcaatgcaggggacacgggttggatc

SEQ ID NO: 40317 - DNA, 1089 bp, Bovine  19866881257362
tattaaaaaatgattgaaaagtcaaattacttgtcaatgaggaggttgttgcttttcattactaatacttataacttcattttgctcgtgtttatttctctctacatcatataagttgattggagataagcttaggaattttgtttaaatagagagcaagtacgattccaaggtatggtataaaatatgagtgaggggtaattttagcaaatgaagtagtaatgacatagtaattataactaacatagtaatctaaactggcaaaacttctttttattgttactgtttatttatttacttttttaatttgtttttggctgtcctgggtcttccttgctgtgcaggcttttctctagttgtggtgagcaagggctactctccagttgcagtgcgcaggcttctcagtgcagtggcttctcttgtcgcggagcacggcctctagagcacgagggcttcagtagttgtggctcccctgctctcaaacacaggctcaatagtcgtgtctcgtgtacttgaaagtgccttttttttcagtaggctgtactggaaatgaggtgggaaagcccagttgaaacatggacatctgaaatatttggcttagagctgatgctgtcctgctgtgctgtcgttgtaaaatcactgctttaggagcagcatctggcacatgagtcatagcactaaagtaacaaacctagggaggcagtctcatgatctaattgtagatgtctccaataggcaatatttgccatttcttagctgttttgagtataacctgtttcattcactgttggcaaaaagaatatttgcataatagaatacagacacattttgagaatgatgtggttgttcttttttgtcttcaaaatgatatggtgtttatttgggaactcagtgttctttgtaattgttttttctagcctaccaaaaagtcaggttgaaagtaaatgcttaattgaatgtattggtttttctttactgaggcaagatctttttaaagcaatgatacaagttttgttttgaaatgttgaaatatgcattgtgcatgtgtgtgtgtgtgtgtgtgtgtgtatctatcagatacaaagatcc

SEQ ID NO: 40318 - DNA, 1201 bp, Bovine  19866881342817
cttgctccatttagaatattctattaactttaaaaatgccatgacagtatccttcatttttattaaaggacacctaccaagattgggacattttgctttcagcaaggttcccagtttcttcactaagtgcatgtccttggctcgttcactcttcttatcgctaaaacaaaaaaatacaacaagttcttaaagaaagtgaagctgtcttccttctaattctgatacatccaaatttctttttcttttctacgcttcctatttaactttaaagggatcagtccagagagaaataaaacaatagctacaaaacaaagctatatttaaaatgaacaaccaacaagaacctactgtatagcatagggaactctgttcagtgttgtgtggcagtctggatgggagtggaatttggggaagaatggatacatgtgtatgtatggctgagtccctttgctgtctacctgaaactatcacaacagtgttaatcggccatactacagtacaaaattaaaagtttaatatatatatatatataaaaaaaggactgggaaaagtcagtagagggacattaataagctggcatgcgatacaacttacctcaatgctaagtggaaaggaacactgactgttttcacacttccagacactggatcaaccaggcagatctggtaagtctggggctgccaactctgactagtaatgttatttaagcccattattttatagccaggatacagaagcctgaggaaatcacaaaccaatatggtaagccacggagtttatatgctgcaacaaaagatccacatgatgcaatgaagatccagggtgccacaacaaagccccaaggcagccaaataaatatttttaaaaaagtaaaatagaacctaactgccagggttctaccttgttaaagtgtgctagaaaatcacataaccaggctgatgtcgcagtggcaaacaaagcactcacatgacttcgtatcatcaccaggggaatcggaaagaatctttcctttccagcctccacagtgtaagaagggatggggacaagtggggcaccaaagctgactttaattcagtagtgtatcacggcctcctcagtcagattcctttgttattaaacacttaatccataattacatagcagccactcatggggaaaaaccacaataaaggacattttaattctcaacccaacttgcaat

SEQ ID NO: 40319 - DNA, 910 bp, Bovine  19866881642731
tgaagggagaagtactaggctgtccgactctttgtgctcccatggattgtagcccgccaggttcctctgtccatggaattctccaggcaagaatagtggagtgggtagccagttcccttctccaggggatcttcccaacccagggatagaacccacgtctcccacattgcaggtggattctttatcatcttagaacttgataggattacaaattctcgggccacatccctggacctactgagatcagaaactcaggtggcggagcccagcagtatgtactttgacaagtccttcagtaattctgatgctcaaggtagagcagccagagccagggccttcccaccaaagcacaccatgtgccatgaatgagtccaggatgtgccaaggagcccactgtgtttacccccgtgtgccatgcaagtgtgattttccatgtgtgctgttatgtgagagaagttaggagcaccgagctggacagctgtcctcctgtttccctattaaactctttcccagctcagagccacttgggcagtagcttcatccttaggtttatgccttctcattggaataggtttttgaagtttatcgggaatattaccttctctttaaagtggtttgcatctgtctttgtgtttcggatatttttgatttatagtaggtaaagccatgacatcagtctgtttattcaattggagatgtgcatgtgtcatttttcactgcttttttgttttctagggagtcccgattagacttgaagttgggccacgtgatatgaagaactgtcagtttgtagctgtcagacgagacactggagaaaagctgacaattgctgaaaatgaggctgagacgaagcttcatgctattttggaagacattcacattaacctcttcacccggtcagttccttaga

SEQ ID NO: 40320 - DNA, 885 bp, Bovine  19866881734267
tcttgaccactagcgccacctgggaatccctgacgtgtgtatatgatctcgtctaatggtggcgcaagggtaaagaatcacctgccagtgcaggaaacgcaagagatgtggatttgattcctgggtcgggaaaattccctggaataagaaaatagcatcccactccagtattcttgcctgggaaatcctttggacagaggagcctggtggggctacagtccgtggggtcacaaaagaagcagaaagactgagcatgcctgcaatctccataaatgcctgcgaagtcagttctctcttttgcagtgaggaaaataaagctcagagagtttaaatgatttgctcagttcagttttatggagctgggattaaaaccaagttctccttggcccttctcactgccctgtcccgtctcctattttgtaatccactgcagcatttagctcagggatggattgtccaacttgggtgtaattgcagcttctttgcttaaatatgatggagggcagttcttcctctaaagacatctcccagacagtatacccaaacctgtctcctcaaagatcaagtctgcatgatatggcctgatatcatatgtatccactaataattcctttgtagtatccgttactgaattctcttcagcatattggacttgagacatcacagcatagaaggagaaaaggcaactggggaaattctggagacaaacatttgctggaaaacagagtgaaatgcagtagatcagagtgaatgactactgtagagccctgattattgacattgaatgtggggggtgtcttttagttagctgtcttatctaacagttgttcattagaattcataattgccttgtcataaaagagggcttgcattgggaactgctgg

SEQ ID NO: 40321 - DNA, 1206 bp, Bovine  19866881900306
gttactgaatgatcgttaagttactctaaggttagaaagagaaataattttaaaaactgaaagattgaagtcagaggtttttgtgactgtgtttgtaaatttttttcctttgttttatctgtaatgaaatttgtaaccaacattatagctcttgccttgcctcattttaatattgacaagaccttaatttaagatgtttgatttgagaattttagtctgtgatctggaaaatggccaagaccaatacttttcatgctgtgttagagaaagctctaaggttctgcagagatgcttcctcatttctgattttatctatttcatatgttaaaatactgtataaaattttgtttgggaataagaaagtcctgcaacctaaaaaaaaagtttgagaagcattgggtagtacatatgctaataggaaactagaaaaaaaagacaacttatatagcattgttatttacttctttgtgtttcaaaattgccaagcacttacatctcttggtttagaaagtgtagttcagttcagttcagtcgctcagttgtgtccaactctttgcgaccccatgaaccgcagcacgccaggcctccctgtccatcaccaactccgggagtttacccagactcatgtccactgagttggtgatgccatccagccatctcatcctctgtcgtccgcttctcctcctaccttcaatctttcccaacatcagggtcttttcaaatgagtcagctcttcacatcaggtggccaaaatattggagcttcagcttcaacatcagtcagaaagtgtagctgactagtttatgcccatgaattaggaagtgaaatactgagaattcacgctgactgtgctgacagtcccttatttgtactggattctgtcggcaccactgtcacgtgtgcgtgtctgtgacagcacagtgacagtgacaatgaaaactgcacatgatggacttattaactaaagttgaaggccttgaaaaattactctgggccggggctctctagtcatcacagtggttgatgcaccacaaaacatgtgccactcttcagagtgatatttaccacgcccctgtggtggccagctataatgaaaggttggttaaattactacattttcccatctgctgccttgtgaaagactaatcgtttgatgaatttgtgcgattaacatcaaaagaaataaaattttaaattacatatttg

SEQ ID NO: 40322 - DNA, 1176 bp, Bovine  19866881911173
gcggccggttgtaggccgcgctgcggcgctcgcgcagctgctccccgtggaaggtgctgcggctggagctgccgcaggggaagcaggtgcggtcgggcgtcgaggcgctaatactgtgagcagatggcgacgcagcgggcacgcgctggcttgtgccaggcctgtaagcttcagagctgtctttaatggttggcagtgtgactttaataggatggccggaagcggacatggacttctggtggcggggtcgtgctgagggcacagcggaggccacggcggagcctgcagaggacatgctgctcgcggacatctctgtcaggctgctgtcttttccgttttgcaacgctgtgtatcgatctgtggttctttcacagacatacgtattccttcttgccatgctacctccaggatacacattgttacttggaatagttgaagacttttttctttctggccctacaagaggacttgcagtcatttcactttttgatccaactgttgtgctgccaagtttatgagccacatctttgtcccaaccctctttctgttcactttccacgctgttagcctgaggccttttggtatatgatacagcaggaggaatggatggaccagcatgatcactaaagcgtcgctgcttctggtttgccgagatgctccgctggaccttcaggtgagcaggggacttcagggtgctgttttttaagtcactgctgggccgggacctctgacacaagtttccactggataacgattcacccccgtcaaattcaggtggttttctacctagaagaatataagtagccatgacttcatcatatttctgatttattaaggcatcgtttatctcatctcgtacaaaacccatggtgatcatgatatctattctttttgtgtcattgaaatctggttcaggctcagcatgtggctttagttcttcttcttcatgaccaacattcatccaccgatctttcattatttgttctaagctgccctcttaattggattcagcactaataatttcttcaaaaggttttcacagtctgtggacatatagaagggaatacggtacttccctcgtaagacccgctcccgcagttcctttaaattctggccgtcaaaaggcaaggagccactgactaacgtgtagagaatgacgccgaggctccacacatc

SEQ ID NO: 40323 - DNA, 3342 bp, Bovine  19866880345931
ctgttggttctaaaataaaacacagatctaaaacaagaaacatgtcctatctaaatataatagtcatggttgcgagatgccacaacaagagaaaacacatttttcttttctctctatgatgtttgtggattgagaagaaatacagaacttttggtttgacagtcaatatgaaattctgagcgtgaagaataaaaatatattcatattatcaaattatttaagtgtctcaagataacaccttccttgtccagaattttctgctgagatgttggaaaatatttggtggttgttgctgctctctttatcctgaagtcaaagcatctggaatcaagtcctggctgtcactatttctttcattagaggcaaattgctatctcaggttagaggcaattactgatctcaattgacccacagtttccccagctatacagccaaaatggccatttgtttaaatagattatgagaggataaataattatgagataataaatgtctagaaagaactactagggaaccacaaactgaaaccacctgccttggccaagcacgagaataaccactcgcatgagttgcctcacaacagtaagtctcaataaggaacatggtactgacaccgaaaacaaaccaggagtattcaggagggggcacagggagggaggagatgccagtatacaatatgttctaccaacctcccagaatcctttgcactggaatccatcttggctgagagatgcgtgcaccactagaaaggaccctgagtgagaccaaatatgagccaagcaagatgacgggccaggtccagaaactaaccccattaccataaaacctgacactctgagccatgtggcaggagcagttctcctgggttcccttaccctgctgctggtgtgctccctcccaatacagtgttttgctttgtcagtacatgtgtctcctccaacaattcatttccaagtgttggacaaaagccgactctcaagccctgggatgggtccccctttcttcaacagaactaccatttctgcaggatcaaattacaagatctaaaggagggggcatttgatcacatttatcctcatctatcccagtaaattagaagaagacattacagaaatttctcatatgatttttatacactataggtgtcaaatagtcagagtattattaagaagatatgaaagagtcacggattttgaaacatcatttatactcaaggttcttaattatcagtttgaggtagcaggctctatttcctgcagtcagttggtattagtgaatgagagctgactgtgaacatcttttttctattacccattcagtaaagtcctatcaggagcttgaaatcagccatagtcagaatttttacaacacagcaatctgtaagctttgaaaataaatttcttggtggttatacctcaaacatacctctgcatatattaaaaatgatgggaagatgttacttctgaatgtcaaatgagagaaaagagatcctattgtgtgtccatgacaataaggccttccttgggattttatgtgatttggaaaagccttattccctcggaaaaaattgatataattgaagagaaggaagctgagaaatctagttataatgaataatgtgaaataaagtgcatcagctagaaaattgcagatactttcgagtgacagtgattagaatatttgactgtagtggaggggacaattaatgttcactctatttatagtaatactgtgtgtgcatatgatgtaaatcagggacagcaggagtaaagccttgattcccaggctgacttttaaataaatttgtggaaggtctgaaaacatgtaataccatcagagaattttaggagaaacattaaatggtctaatctgctcaattatgaagaaaataatttcagtgaatgcaatattccaagctgacaactagttggcagactactgtgataatttggttttgaagccacatcaagtcatttgtaaattcagataaaaatacatgaagaagggatgagagaaaggaaaaataaaaatttgaatgaaaagtgcctaaattagttatgtctacagaaatcaaacagagcaccacctttgcccccacctcagaaatacccagtatctttaaaacaatcatttttagtagaagatcttaatgtttttctgtcaagtaaataatatgttgatgaaggaaatggttccaaagaagaagctgttagcttgagaaaaagtactcactagtgatgaaagtacaagcatgttggctcctctggtttcctctttaaaaagtaacaatgatatcactcatttagaggccagtaagaaccaggcagaattttggtttttcaaactcaaccgtttccttcttccttagctcactagtttttcagttcacttttattttctcaaatgctagatttcaaacattatattttgttgccatggatctcatgcttcacttgccatttattgattgatcactgtcatttgtcacttttgtgtaaatgtttttctagaatctgcagaacaatctttcctatttatgatacattctgttttctagggaaacttcatttctcatagaatcgtgatattttgatattttattccctatttaacatgaagcataagattataaaaataagaaccaaaatatcattgcagatcctctaattctaccttgctttataaatgtagaaaaaaagatgttagctgacatgctggagtcatgcagctcattagtaaaaattctagattcttttttcattcacagttaatcaaagaacttagtttattttcagttttttgttgtttgtgtatgtatgcaatctctatttcttttcatgcagatttcaaattggagagtttagttttcaatccccaaaaagaaatctttgttgaaagtcaacatgtagtcagaatataaggtaatcaaaacttttcattttaaattgactctatttctaactataacctgaaatttcaaaacatcgtcaagcagtgatctttgccactcacatctgagctccaaatggccctgcagatgtgaaattgtctgctgccaggggaagaacagctggattcagttaatgagtcaagtcagcatgagctcaagcactagagacaagaaagcttcatttccgtagcacagaattctaggaatggaaacagagagccagattgtggcagcagtggtcccaccagtcacacagctgtgagcataattatgcttctctcctaccggcaaatggaagtattgtttacccttgtacacaggaaacctagccatcagcagaccaatttttaatcctgtccctaggaaagagagcaccaaaccgtttcggtcag

SEQ ID NO: 40324 - DNA, 765 bp, Bovine  19866880479712
ttcttcatgtagtaagctagttaagtcagtgttctgcttgtggtccatctcaaaatatagtggcatagagtattgtcattgtatcacatttagcataaaagttgtagtttcgtggccagctctcttactttccagctctgtgaacctagacaagttacttaacttctttgtatacctcatttatgcattcacagtgccaacggatctggttgctgtaagactttaatagtactgtatataaagcacttagctcagtgtttgacatgtagaagatgcttatgaatagtcagctgctatcattattatcataataattattctcataatcgtcagtaaaggcagtaagaaagtcatgttttatacatgcaaagcccaaagtggcaagatcatgtaagaatgtaacatcagattgcttgtgtaaacttaaatcccccacccccagcacataaagtttagtaatggcatttcccttcagcctgtatcccctagttcagatcaaacactatgaggcttattggtaggaagccacatccactgtcttatccaattcacccctcttatttcctctcatattaattttacttcaccgtcatcaccctgggtctactgtccacttaactagtaaacagatattaaaaaaaaaaaaaaaaaaactaattaggtggccatctcactgatggccaagaccagcttcattatctcaattaggcttgatttatcaattaactgtacaaccgatagttccggaatcactatacatcgcaa

SEQ ID NO: 40325 - DNA, 1044 bp, Bovine  19866880517062
gctgagcaccgaagaattgatgcctttaaactgtggtgttggagaagactcttgagagtcccttggactgcaaggagatccaatcagtccgttctgaaggagatcagccctgggatttctttggaaggaatgatgctgaagctgaaactctagtactttggccacctcatgcgaagagttgactcattggaaaagactctgatgctgggagggactaggggcaggaggagaaggggacgacagaggatgagatggctggatggtatcactgactcaatggacgtgagtctgagtgaacttcgggagttcgtgatggacagggaggcctggtgtgctgcgattcatggggttgcaaagagtcagacatgactgagtgactgaactgaactgaactgaatagatgccagtgatatgctctaaaaacatttgcatacatcagttagttaataaacttctatggaattaaatattaatttttccaaaatagatgatttttatagttatattccacttaggagacagaactttcacctgattttcaggattttaaaagagctatcatttgttaaaaaaaaaaaaacaaaaaaacaaccacgattctttctgtttttaccctcctaaaacagggggaaagtctgagttaactgtttttctctgacactgagtatagatagtgtaaagtttgagtaacctttggctcaagtccttgcccagaggattgtaactatgtaactaagattctgtgagcatttaagagaaggctctgcttggccagtttaacaggagggttggtggctgcagattattttgttaactattttaaacaccaattaactgtgtaaagttgataggcctgttgtctcaccagtgtactgagtatatgcctatgtcccgaccttatattcaacatgcaactagattttggtcagtggttgctccaaatataaattttcctgagaccttggcaaagatatttgtagttattcctacatgctttgtaccggaatctaataccaaggttatcaacatcaggttagcaggccc

SEQ ID NO: 40326 - DNA, 1673 bp, Bovine  19866880629012
acaagaaatgctattccaaggagcagctgatttataactacagtgaatagctgtgctgtggctcatcctcaaccaaagcatgcgtattcatagatttgacagtgacaaatgcctttgcagaggctttgaaaagacacacagagtagatgatcttctccacacctataagccatggtctctgtaatactattttctcttccaggaaccttgacttggcagtgtagcaaaggcgggggtatggagtaggaggcatgagtatatatgagcatttttcttcaggaatgccatttgatttgatttaatttttgtgacatttttctccatcaagtaataatcagtagaaaatttggtcatgtaaaagttcataatcatcagggtgaaatgaagaaatgagttcccagtttaattcatagaaaaatatgtttcaggtggatgtgaatgcaaactaagttgcattactcatatttttaaaaaaatttttttgcaacatctcattacgggttatctaagtcatccagtgttttaatcttctgaggcatatgatgggaagacaagctgccttttctatccaaatatgctgttgaaataaagcagcactaggtggctgtcttatgggtgggatattaatagaaagctatttcaattttctaaatagaacttaaaaaaaaaaaaacagagtaaaaatcagaggaaaatccacttgctgcagagtagataatgatatgattttcctgtatgaaagagaaccatgccaatgtagaaaatatatattgttaaaattttgagcgtctcccagttggttttataaaatactcataagaaaatgcaataggaagaaaaaaattggtgctattctccagtctgttcaactctaaagtttcatcagtgagtgacagactctattcagagatctttgtttcttggtaaagataatgcatagcacagagtctatctaaatcagttgatgttaccctattggttgctgtacttagggtataagagtgcgaatttgttagaattaaggttctatcttatcacagtgtagcaatgcataggcatttaaataaagatactattgggaatgtataaaaatatgaacattaacagtacacaaataccttttatctctcaggtttctcttatagaagtttaggttgatactacttgaaatacaattagaagttttagcacttttgatattaaggccagggtgttacataaaagtatgttcctaaacacatttggtatctcataaattctgcaaacaaggaaaatagaaaagtttcataaagtataagtttaactgtcattgctaatgaagttatgttccttgaagtttctgctttaaagttttcttgggaagagaaagaaaaataacaatagggactgtggctcattgtatatggtgattcttccaatattaattgagtttctcagatgtactcacctggacaggaaacagaataggccatgcagtcagagacagaaaaacagagaagcattgaaaataagcattcacagtcaacagtattgattagtcaatgagaaaaaaagaaaatgaaaataatcattcaaattgttaagcatctagttttaccttagtcatgtgttagagtcatgcatgtaatttgtcccatctgaagctcttagtcattctgctagatgcatatcat

SEQ ID NO: 40327 - DNA, 1900 bp, Bovine  19866880705991
ggctcccaactatactctctagcctcattcctaccaatactctccttgatcacagaccaacctgatcttaaaatttctcaaactcaagaaattattttgcaatttacagtatttgaccctcctgttctcctttttaaaatattcttcccatagttagccaaataacttactccctcacctcactcaagacaagtgacaccccctcaaggatgcctttcctgaggacggaggagcctggtgggctaaaatccatggggtcgctaagagtcggacacgactgagtgacttcactttcacttttcactttcctgcactggagaaggaaatggcaacccactccagtgttcttgcctggagaatcccagggatgggggagcctggtgggctgccgtctatggggttgcacagagtcggacacactgaggcaacttagcagcagcaagtagcagctaacatagcaacctcctgtcactctgtgtccctttaactttattcttactactgaatagtacatattactttttagctgattacagtttttgtcccttcaagaatataagcatcataaagggaggcctttgaatatgtattgtgctgctatgattttaggacctacaacagtaccaggcatatagtaggctctcaataaaacttgcctaataaatgaatgataaatagtaacttctcaatatatttaaacactataattgaacaagattttaagattgttaagattttaacttgactcaacatcagctaaaacacagaacattgcaatcaagtttctaatcataattaagtgactacaacaaagttctcacatctcttaatgatctttaaaaactgaaacaaaacaagacggactttccatttctattgtgtaacatgtccataaatcatacaagtacttatgtgaaaattaaatggaaaataaaattaatactttctgaaaattcattactgacttactacaatctttctgtttctgtttcaccatcaaacttctctcctttagggagcctcatggatattttaagacttccaccaggtaatagtactctcttaagagaacaggaatttattcctcagagcaattaatcatggcctcctggaaatgttttatagacccagtcttcccacagctatttatctccttccctataaactgctttattacacagttaactgtttgtaacctgacctattaaatgtcgtatttactttgtaacaacaagaaaaacccactcataaaacatcatgtttgatccaaaactccaatctcataaaatgctatggaaacaaaacataagctgttggttgacagagatccttattttggctacaggttttaagagcttctcagatccaaatgacttttggagccttttactgaaggttgataacttaaatacacacagtgagaatcctaggatccatggttagctagaatcttctagaaagttgtctttttttattggtcccaggagaatttactgggaaaatggagggcccttagcacccagaatgaacctctgcagttcccctaactgggttgcttttctcttttaacctggcctagccatcctttccacctttctcttcccactgtcctccaatcatccttaagaaccttgcttaaagaggcaggtgggagacaaaagccaactcaagcctgcctaaattgattttataataaagttttgcttacatcttttaaaatcaaattttgctggggttagagttcctggaaaagttaactaagttaacttttcctatatatctgtccttttacctcccactagcaaggacatcatcaccaaactgagataaaaagacaccaaaattaaaaaacaaacaaacaaacctcaccaaactgtcacagggctcagttacagtagca

SEQ ID NO: 40328 - DNA, 905 bp, Bovine  19866880841478
aattctaaaatgctgtatttttagatataaggaaagttttagaatatagaaagcacaggtattctgacttaatttctcatgcaaaatattttcctaatcctacttgtatttttactgcactttttggatcaattttaatttgcatgactgttgaaataaattagatgagaaaagaaaatcggcatacatttcctataaaagtcagaaaatttgcatcagtttgaaattcttgcatgtctatcctaggagaaaagtatcattagtaatctcatttagcaagtgaagaaataggtttggaaaagatgaagcctttgctgaagttcatgtaactttaagtggcaggaccagggcgctaaccagtgcagccttaatctatcaactgctctgtgttttttccattaaccaggtgaagtgatggcaatttgcaagtaacatcttgcctatgctttcctcaatacacatttacacccacagaccactgccctgtctcttaggcactgtgtgtgtgagtgagcacgtgcatgtgttttcatatattcagtacaagaattgtaatatttagttcttattcaaaccagtttgtttgataaaagttctagggtgaaaatgttaaaaactgacagcatctttaggtcaaaggataattacagtgagagattagtcacattctaccaggttaagatgccaatctggactgagaagttgctcacaatttttctctgattctctcattaggataatggttcagaagcattgctgttgttatgactgatgattattatctatacatttctccacatctctcagttttgccttggatcaagttaaaataacacaaactgtgcatttgaaccatatagttttgacacagatagtaaaaacaatggtgttgcactgttgtctta

SEQ ID NO: 40329 - DNA, 1233 bp, Bovine  19866880904555
tatgatcatctcaataaatgcagaaaaaaactgctgacaaaattcaacacccatttgcaataaaacctctccagaaagtgggcatagagggaatcaacctcaaacataataatggcaatatacgacatacccacagcaaacattactctcaatgctgaaaacctgaaagcatttcttgtaaggtgagttttgaaaacagtttaatgtctacaaatagaaacttgatttgggcagtttttccatgtcactacaggtgtaaggtagaagaaagtgtaatcttgcctgttagataagtgttttagaaagcttctgattactcatcaaggaacatatcccattttcaggacagtaatcttcagatttggaatattttggcattcatttttatgacctctggctatttctgtaatttacttattatactgcatttacctctttaaaatccagccaagcttctctcgcacttttttgtctgtggtgtttatccctctggctatgaagctcacaaatggtaagtaaagccatgcttttcttagagataacattgatgctgtgatagaaaacaaagatttagagcactcacagcttgtaagactattatctggagttgtttataacttgtaagccctgttccagagccagtggagtcatagattttctctagcatcacttgctattcaaccatataattctacccactaatctgtaagcatttcccaatcaagcaaatcaaattcgaatgatatcccattaggaaaacctgcgagttagatcaagtggtaataagatttacatagaagtttctgcaactagggatcatattttaacaacgtcagagtgtaataaatcttcatttcaaatcatactgacatttaaactagatgctgggtcattaaaaaaaaataaagcattataaatgcatcacacattcataaaagtgatcttctgagaaataaacaggtgattcattttagatatgtcttttagaatttattttctgacattagtattgctataactatggtggagtagttgttaaatgtaattgttcacatatgctgacttttttttttttttcctgaggaatggttatcattaattttactgataagagaaaggggagcatggattaatgggaagagcaaaggtactgaagccaaatagcctggctaatttgaggcctacttgctgctctatgaactggaggattcagttaaactctcatgtcctcag

SEQ ID NO: 40330 - DNA, 1576 bp, Bovine  19866880983447
ttaataaacattttaatgaagaagactactaaatatttcgaaagagaataattctcattgagaagtgtcccctttacattaacaaggaggatgtaagtaaggaaaggatttttaaaaataaacacattttttttaagtgggtcatcaaaattgttttcaattccaaatggaattttcaatatggacaatgaaggaaaagtatccatttacttcagggggaaataaatataacatgggaaacaattgagaaaatcacttctattagtacacaattttacaatcatttttcaaactacaatcatgcttaaggaaaataaaatttgaagaaatcaaaggaattcaattgagtcattaatattctatgcaagttcagtagtcaacaatcacttttattttgatgtatttattccttggttcacttgtaatgtcctgaatatgctgaaacagaccttcaaatagcacgaaagagaagctaattcagtatctgctgaaggaagaaaaaaatgttaaatgctcaattaaataattattaaatgttttaatttccctgcaatcattctagtttccaattcacataagacagagtgtgaataatagagccatcttacaatttgacattctttctaagccattaacatcattttttttttcctgttctgattattaccatcactttggggaaaatactatttgcaaataaatagcatgtcctttaaaactcttttgctgtgcaatttaggataaggaaataaatgatttatctcaaaaaatatgaatgggtctctactagatcttatttcagatagattccctttacttgcaaagagtgttctgatttctcttaggataattttaaaaaacatgattatctttcttcttagtgacagagtcatctgtcatgcaacatccccagtgaaggcatatacactgaataccttaaaaatagatcaaaagtaaatgcaatgcaatgcaatgcctttttgcaaattgggtaccttttaactaacttattttcctaccatgaggctgtggcttttaaagagctttataaaagcaaataagtggttttatactttttgagatttcttaagagcatttgtgtcttctttatttgggcttttgcataagaatgaggctgggaaaacgtgctaaagtgcaaataagtcatgttatccacaggatttttgccctaaataggaagtaatctcaggtgtggccactttcatgatttaaatacttaggttatgcattaaaattcataaccttcttttggattgatccagaccagataaaattttaaaataggagcataaatgaaaggaaaaatgaacaattgcactcagtactaaataatgttgaactcattctagtcattcttttgtgtgtactctattcaaactccattgtataacaggtatacctgattcactgaaatgagcagaaaccatggagcaacacagaaatgaattagaacagagtttagccagatactgggcaaaataactattcctaaaaacataagttttgttacctacaaaattagcacaataaggctatcatattttgctataaatat

SEQ ID NO: 40331 - DNA, 1384 bp, Bovine  19866881135475
ctatagatagtatgtttttcttaagtaacagcttactttaaatggggaaagcaaaagctagtggtcatcactcattctcctgggctcattattgaagtagccatttattttaagagggaaaatagcattttccgagtgttatatatacattcaacaatggtctgccctgcattttgttaaactttggggaagtactacctgcttatcattattaaacttgccaggaactggagtgacattgtattgattataagtcacagactcctggcattttaactcctttactcctgatgactcctttagagggtattaaatacagttaagcagaatgaactgcaatttcccacactgaagcccttgatataagagactgatataacaggagacatgataacaagtgtacctcttacaccctgattccctccgatcttgagagactgtcacaaataagaaaagcacagttgttctcttgaggtccttctgtatctgtaatgacggctgaatggacgtcagtgaattttctcttctgtttccctcatggagagactttgcatttgacatggcatgaagggatacacaaaaaagagggaagttatcatttgtatttcctagagataagggtccttttagtactcagcttccctgattgtcatatcaacaacaatagaagtactctgagaatagagaaaaacacaaaatcataaagagcatgcccaattagctaaaacaaaaaataacagttcaattgtgtgtaattatttgtatattgtccacattgatacagagtacaccaattggtgctacctgtgggtaaaaagaactttctatatataaaatgagtgaaggccaagagcatcagaaccatattacagtaccattgctagaagtcaggtttattataattaactttattataagcttattttttcattgccaagatactataaaatgattcattaactcaactgacttttattaaacactaagtatgaggtgctattccaggttcttgtgatttccatcagtgaataatgagagatgaaatttcctatccccaaggaacttactttccagtgtgcagagatgaatgataaggaaattgatgtttatatatatgaagtatatcaggtctatcatgttctctgaaatattacacaaaatatttataaacttccatgcttctagcctattcctaaatttagtttttgaaatggatgcaagctcaaaggtctgatgtcagttaatatatctgggaggacttctataccttggcagacatctactctcaagcatactgcatgattgagtgctatgctatgctatgctaagtcacttcagtcgtgtccgactctgtgtgaccccagagacagcagcccaccaggct

SEQ ID NO: 40332 - DNA, 1448 bp, Bovine  19866881169469
atgcaaggcaataaagaatgaataaaccacattttaaatggagaaatatttctttcaagttaacttttatatccaaatgtctctttctactcctccttgcctcagaccttccttaatacccaaggaattttgtaattaggaggaaacgtcctacaaacttaaatcatagatgaaataactctgcaatagatctacttaatttcataaattctacttgctgaaagccatggatggttggagatacaaatgaaatagggtagagctgcaagggtccacttaataccatctggttttcattcaaaatactttgattatcgagtctctcacacctgctgcacatccttaaaacctcttgaatccaccctgaaagttaagggagaaaatgtcattttccgccttcctttctttattccttacatcttccctatagttacttcccacagtgtggctcagatggtaaagaatctgcctgcaatgcaggagacctggattcaatccctgggtcatgaaaatctcctggagaaaggcatggcaacccactccagtattcctgcctggagaatcccatggacagaggagcctagcaggctacagtccatggggttgcaaagagtcagacatgactgagcaactaacattttcacttttcagggggttatacatcttgggagtcatgggtattaaaaattgcagaactttatccaatcaataacattctaatgatgaacatgcataaaatggccatgagacacatttgtgtgtgtttgtgggcaaacacacattgctggaataacaccaaaaactctttttttgttatttatctgggtcacattttttcattcatctcaatcttcagtgcttggaagttatacactgtgctaggcacggggactttcccaaaatataatgaaatgtactctctgtagctgacatcatttatgtgcatgtaatttctggtgaagtcctggattgtaaggagagtaaggatccccagtaagatgaagatgaattatatctacagatcataaggaattatgcagactctgctggtgatctactcagttttttatttcacttcccttcctattaaagatcttgatttcattcagacagtaatgtgcccaaactcagatgatggaacatgattgaccttttatgaaatcctgtggtttccttttttgtccctctggtaggagtatccatgtgaccaagactggccagatggttcctagagaaatttcttctttcttgaaccaaaggacaaatagagctggcacctctttcgtccccttatccctgccagattataaatgtgagagctggagctacagcagccatcttgctatcacaaaagtaagttcctgagaacagcagaagtgttggccttaatgttgttgaaccaatgccatcaatgctccaaaattcttatgtgagaaagcaaagcacca

SEQ ID NO: 40333 - DNA, 1681 bp, Bovine  19866881181685
attagaacatttctcatattatgtcttaaactctcccaagaagagtagatgagaaacaaggacgtaaccaagctgtaagcagttaacctgtgaacagaccagtaggtaagaagttctgactcgagatgaactgaagttccctcctgttccacaagttgtgtgagtactgcaagtgaccccatactgctgctactgctgctgctaagtcacttcagtcgtgtccgactctgtgtgatcccacagatagcagcccacgaggctcccccgtcccggattctccaggcaagaacactggagtgggttgccatttccttctccagtgcatgaaagtgaaaagtgaaagtgaagtcgctcagtcgtgtccgactcttagcgaccccatggactgcagcccaccaggctcctccgtccatgggattttccaaagtactggagtggggtgccatcgccttctccgagtgaccccataatttcacttattttctcctgttgtgcaccacccttcaaatttgaatgtgatttaagctgtctagaaacctagctagacagagttcatttacaagaagaacaatattactagggtcaaaaatattgaagagtctatcaaaatgagttttaacaaatttgaggtatataactttggtgatctgaagattgccacttctaatgagagaaaataccatgcctaaaaaaataaataacaaatgatcttgtaatttcctgaaatattatcttcaatggaggagttatttcagaacctcattaatacaaattaaggagctgctattcatggtacaatgcatctttgtagtcctgaatcattgttttatcactgatatttttagagatatttttagtaactgtaagacagatgtttaatgttgagaagagtgcactgtagaactagataaaggccagtttgattgttgttgttcagctgctgagtcgtgtcctactcttcgtgaccccatggacagaagcatgccaggcttccctatccttcaccatctcctggagcttgctcagactcatgtccattgagtcggtgatgccatttaaccatctcatcctctgttctctccttctcctcccgccttcaacctttcccagcatcagggtcttttctaatgagtcagctcttcacactggggggccaaagtattggagcttcagctttagccccagtacttccagtgaatagtcaggattgatttcctttagaattgactggtttgatctccttgcagtccaagggactgtcaagagtcctctccaacaccacagttcaaaggcatcaattctttggcactcagccttctttatgttccaactcttacatcaatacatgactactggaaataacttttgtcatcatttgtcatggcttttcttccaaggagcaagtgtcttttaatttcatggctaaagtcaccatcttcagtgattcaagggcccaagaaaataaagtctgaaactgtttccattgtttccccatctgtttgccatgtagtgatgggactggatgccatgatcttagttttttgaatgttgagtgttaagccagttttttcactctcctctttcactttcatcaagtggctctttagttcttcttcactttctgccataaggggtggtgtcatctgcacatctggagggttgttgatatttctcctgtaca

SEQ ID NO: 40334 - DNA, 1471 bp, Bovine  19866881269051
ctaagttgtgtctgactcgtttgagaccccatgcactgcagcccactaggctcctctgtccatgggatttcccaggcaagaatactggagtgggttgccatttccttctccaggggatcttcctgactcagggatcaaactcacatctcctgcatgacgtgtggatttaccactgaaccaccagggaagcccaaacaccccaaggagggaaactccatattgttctcattttatagatgaaaaaactatggcttatagagaatataacttgcctaagctggcatttgaactaggctctttatctccagaagacactactttaaagaccatgttgatgaataatatgcatagatacacatgcacacacacacatacacattaaattcaatctgattttactattttcactaacgagtatttatgcaatatctgtagaccagcaaaggattcaaatggccaggaatcttgtgtttagaattcagtaattctgagcagggataaattgctgttaagggattcttggttacactgctctattaatttaatagcagactctgactttattacagtaaataacatattcattaaaatgtttaaacactcatgaatgaagagaagaagcattagagatgcactctggtagcataactaacaaagcagtgaaatcatttctctgcattggggaattctgaggaggtgatctgcgtgctcagtctcgggctctttgtctgttccgtgtttggcattcaaacccgccttctataccacaaaggccaacttcagacagctaactatttgggaaaggagaatcagcagcctcttggtggaatcaagtaattaagaataatgtaggccttcacaaagaaaaagttgttttggattagtttaggctaacccaccacagggaaataccgagcagtccttcattcctgttgcacgagcaacacaattgcctcttgagtggggaactgaaattgcaaatgtgttgtgactgtcgggtgaggtcttatgggctctggagataattttgtttgtgattctaatttcataggcttcagatcaacttctctagtgaagggtagctccagagtgttcctgacatcagaagttggggcacttacacactgataagttaggcttccctggtggctcagactgtaaagcatctgcctgcattgtgggagacccaggttcaatccctgggttgggaaaatcccctggaaaaggcaatggcaacccactcaagtattcttgcctgtagaattccttggacagaggagcctggtgggttacagtccatggggtcacaaaggagtcagacatgactgagccactaacactttcatgctgatgaattaaaatatataacgagggggtgattttcagaaatagtatttttaattcatttttaactactcttgaaggtctttgaatggagccatgatgttagtatgactgtaggtgcacaatt

SEQ ID NO: 40335 - DNA, 908 bp, Bovine  19866881386250
tgtctaaactagaacctgatcaaatattccttcgaaatataaaaataaacagcttgaggtttatgaactccaggagtttaaagacaagcttgggtagattggctttgacctatggatcatctattctagctctgagtaaatttacttgaagtaagcatgaaaaaaaaatcgccttgtctaattcatttttaagtgcaaaccccggtgcaaaataagggatgacttataaggaggtttataagactaagaccttttgctctcttaagattgactcctattattggtcaggcacatcacagcaaaaacatcactaagtagagtcaggtctccaagaatattttcagcttagggccattcatggctgtctctactaagcagaaaaggaaaagcaattgaatttttaatataaggtcttattacactattgaataaaatgctttgaaagaatggaagaaggattaagaaaaggaaaaagaaaaaaaaatcctcttcttaaagctgctggagactcttgaaaagttagaaaacctctacttaaaacataaagtcatgcaagatcttcttatcttgccttaagaggaagctattttggctttctttttttccttaaatgatccgtgcttcgtaaaagtgaaaggcagacaatcagcggtaaacgtgctatctatctgctggatgttacacaaataggacaactatttgcattgcaaatgaatgactgataattgcattcctgaccaggaccctgttttcatttcaacattttcctttacttcttaagttctagatatttttaataaagtcctatcagcaagatgataatcatatacttttcaagatatttttagatgtgctaatgaggaagcctgggatcagtaaaacagcaagaatcattaaaattagattta

SEQ ID NO: 40336 - DNA, 1812 bp, Bovine  19866881499927
ttcaagattttctcctctgttctgtagtttcacctcttctgtctgcctgttttctttgtgtcttgtttttaggactgaatgtacctgcaaagagacagagagaaagtctcaatttggaacaaactcaaaagtctgtacctgagattctttgtcacttgatgagtatgaggctcagacaaatggttgcattgatagaacataagttgagaggggggtctcctctgaaggctgtgaaggaccacaatgagtgtgtttcccaacataggcctttgatcctccctctttggaggatgagtatagagcttactcagtggtaaaggacttaaaaagtttcagagcaggaaaaaataaagaaattctggtaccaaatgctttataatatctggggataaaggcgatgatgagggtagggaagaggagaagtttaggattagagaaagtaactcaatttttaattttaaatacattttaaagagtaaatgtatagttattagttatattatttttcaattatggaagaaatttttttttccctaacactataaaaattcctttaaggaaaatgattgtatttttgtcatgttgattacctgccatgaaaacaagatactcactcatgaaacttctgaaagtaatgttaggtaatatgtgaatgaagaaaaatgaggtagtaatagatgtaaatattacataagtcaaggagttgagatataaggaatttgtgataatcagggccatctccagggagatgtgagatttaagagatgcttttgagagtcaatggcctggaaggaaaatccagaccagcagataatgagagtacaaggatggaagtgagtaagagggggtagtggagtcatgactttaaaaaaaaatggccacagttttatggtgcacttttaataaatatatatttgtggggatattctacgttttctgaaacaaacatgtaagcaaacaaaacaacaaacacaatgactaaattatgagtttagtaggcatgtccaattccatcactcactgaagacagactgtagattgcatactctctaggggccagcaaaatttcttttctatgggatggtggtcaaaaaaatagtttaatataaaataggaggaattgatcccctgcttagtacttagcattgtaaatgcacacaaaactacgtgtcaagtaattagagtaatcaagttgcagtcactagctttaattaaactttacaacactgagtgaggagtactaaatttatatgaaataaaagtgaagaggatttaggtctggtctgaattgcatattgattcagatgagagtaaaatgtatgagaatggacacatcagtaattaactagtgtaaatcatttccagtaagtctaatctctcacaaacatattgacaaaaaaaattagggaggagatgcccaaacactgtattagtttcagtcatgatactagactctggaaacttgtgaatagctgtaggtaaagcactgcctggccatgctaacttaatgaagaatgaacatattcagttcagttcagttcagtcgctcagttgtgtccaactctttgcaaccccatgaatcgcagcacgccaggcctccctgtccatcaccaactcccggggttcactcaaactcacgtccattgagttggtgatggcatccagccatctcatcctctgtattccccttattctcctgcccccaatccttcccagcatcagagtcttttccaatgagtcaactcttcgcatgaggggccaaagtactggagtttcagctttagcatcattccttccaaagaacacccaggg

SEQ ID NO: 40337 - DNA, 1034 bp, Bovine  19866881528285
tggtatttgattcttatctaattgattacttgtcagtacccatggatatcctataagtgtatgtgtctgtactgtttctgattgtcttcctattccacagtaatgtgggttatattcaataatcctagtctgtacagtgtggaaaatatatggtaacaaggatatatatgtggaatgagaaattataaccaagtggaagagactcacagattgctacataatcaccttaaggaagctacacaatcatttactcaagtgcaataagaacttaaagtaagtagtctcatttcatttataagaaaactctacaaattcagcctaaaagggatcagtctaaaataatgaaaataaatatggattatctctttaaaaaggttttctttctttaagatatacttatttcatattaatgactgccaaaaattattattttcaaaatatttgtcatttttaaattgaccagaattacttaattttaacacatttcatataaaagtaatattttaggatgaagaaaataaaaattaaaagcactgtctcagttagtagtggatagatgaaaaagtactccgtgccatagtatgggacagaatgctaagtaagcgaataatgggaagagtcatttctggttgcctgttgaaagtggagtttgagattcagtatattgatatactgaatatatatatttcagtatattgatattgatgggaattacctgtaataactgttttagttttctattgtcttattaaaaacttatcccaaatatagtaacttaaaactacacgcattttttttttaataggtcaggagtttgggcatctagacgcttcttgttgcctcatgcgcatagtcaggatgttggctggttgaactctcgtctggagggtcaactgggaaaggatctagttccaagctcacttaggctgttggtattaatagaatgcattcccttgtggttgaatgcctaagagtccaagtttttgctgactttggctggggactgctctcagattttaaggtcgtctaaagat

SEQ ID NO: 40338 - DNA, 754 bp, Bovine  19866881532738
cctactgaaacaactgactttagattatagaagaaaataatcgcatttgatatctatttatatagttttttatatatagtttatatatatatataactactatatataatttatatatatatagttaactttatgaagagaggttcaagtggattacaaatggtaatccaaatacactctttcttgccacgtctggaatacaagtacataaataatgtgatagcaacatgttttgtttcgatgaaggtgaaaaaccatggttttacatcatcttattacctcacagcagtgaaggcgatggcaccccactccagcactcttgcctggaaaaccccatggacggaggagcctggtgggctgcagtccatggggtcactaagagtcgggcacaactgagcgacttcactttcacttttcactttcctgcattggagaaggaaatggcaacccactccagtgatcttgcctagagaatcccagggatggcggagcctggttggctgccgtctatggggtcgcacagagtcggacacgactgaagcgacttagcagcagcagcagcgttacctcacagacccactaacttgataactgcttgcaaaagagtattctacttgtctagcttgattgcacccaagaatattcctaccagtgcctgatgagcttcaggcttggagagataacaaatacaggtaatctttgaaggaagtaggtcaactgttcattagcaaaagtaatattagttatggtggga

SEQ ID NO: 40339 - DNA, 2308 bp, Bovine  19866881548555
ttttctctgggtatagggaggggccctctgacatgaggattttatgatctgtttcagggaatataagggaaaagggacagagatcaaagagacctttctgcttctaccattttccccgaattccttcagtttaagacattcagtatgtcaaggtgccctagttgggactgtatgtcctgagccccaactacctccttgttctatttctcccccctctaatcatgttgctcagatgggactgttactagaacttctggagtgtgctggtgcttaattcgaagcgtagtggaagtattcttcatgccatggacatcttaaagtgcttatcaggcacactgagtagtggttactattgggttggaaaaaagtctcagtaggttcacaatggcttcccttgtggctcagctggtaaagaatccacctgcaatgcaggagacctgggtttgatccctgggttgggaagattccctggagaaaggaagggctacccactctggtattctggcctagagagttccatggactgtatagtccatggggttgcaaagagtcagacacgactgaacaactttcacacacacaggttcactataattaattgctgttggaaaaacggtaagctaggtatttacctgctgcatggataaggaacacaagtggttatcagatcacttttcattcatgatttattaattttaaatatctttgctgcactggctctttgtggttgcatgcaggctttctctggttacgatgagtgggggctactctctgtttgtggcttgcaggctcagtggatgtggtgcaggggcttaattgctccatgaaatgtgggatcttcttggaccagggatcgaacaggtgtccctgcactgcaaggtggattctaaactatttgaccaccaggaaaaccctattagatcatctttaatttccatctctcactgaaatcctgagagtctaccttgggttttggtgactactaaattttcaactctcttgtcttttctcttgctgctcctgcctcctcaacccagaaacctatttaagcctacttttcaacccagttcccctcctggcaagcagatgtatttagacagttaaatgcaactaacccctgaagaagtatcatctaagggagatactgacaatttaaaagtagagttttagcaattaggacagctttaagacctgaaggaataattcctaaagagcactttggttactgtggcagagggaggaagagactgggagaggccttaatgtcacacctcatcctgcacgtagccatcttcccatccagaaggttaattatacggtggaggatgagactgagccatgatttctttttggtgcctcattacatatttttctcttaggctgagtcttcagttttatgcagagccaggtgttgttgagtgggctgaagtaacaaatcaacccatttgagctttggaagatactaatttgcctttggatatctttaatccggctgtatatatcaccctttcacagcatttctgaacttaaacactatccaaaacaacatgtggcaggttctctaattactgatgattaaggaaaaaaaaagccaagtcaggccctcaaggcatcaacactttgccattttcctggagaaatgaatgctgcagtgtaaagcagcttgaaaattaatgcacggcacgacacgagacagcggtgcaggatggcatttctttcccgcactgtatttcagaaacgtttcacacgacacgaaaggggcggggggaagagcagatggactcagttatgaaagctatcggaaacaatggtgcagagacattttctgggcggcaaaaacctcatcacaatcgtcagtcactgcatctgcctcagagtgaagggacgatagatgaagagcaaaaacagaaatgcagctgttttgatatgggccctagaaagtaacagaaacgtggttgaaaaaactgagaaggatgtgtcaaactgttagaagtatcatatggggtttctccatgagttaaccaaaaatgacagtagagaaacactcattttgtaagcatatggtcaaatttttccgtatcttaagaagtgatttgtaaatttatttttcctttaatcaataatttattcttactgaatttggggaaaatatttctccaacttggagacatattatctcatttgtctatcaaaagccgaaaatataggagttaatgccaaaaatcagcctgatagatgacccagggcaaaatgtagcaaaaggcttgaagtggatattagcagttttataattcctggaataaggagt

SEQ ID NO: 40340 - DNA, 3535 bp, Bovine  19866880393858
caagaatactggagtcggctgccatttccttctccaaacatacaccattactatgtataaaatagataactaataagaacctactgtatagcacagggaactctgctcaatactctgtaatgaacaaatgggaaaggaatctaaaagagtggatattctttggtcacctgatttgaagagattacttattagaaaagaccctgatgctgggaaagattgaaggcaggaggagaaggggatgacagagggaaagttggttggatggcatcactgactcaatggacatgagtttgagaaagctctgggagatggtggtggacagggaagcctggtgtgctgcagtccacggggtggcaaagagttggacaagactgagcaactgaacaacataactgattcactttgctgtacaacagaactagcgcaacattataaatcaattatcctccagtaaatattaattttttaaaaaaacaagcaacaaaatccttctcagtcaacatcatcatcgtgggctcataatatttattgaactacatcccagactccatgttatctcatttatgtcttatactggcattaaccaaaagttctaatgttatacctgatttatagatgagaaaatggagacttggaaaagtaatttgcacataatcaggctgtctgaattcaatcagggatctgaatccagccagtctgactcttatgcccaatttcttaactgccaaacgatgtacaacttctcacaaaacttcttccttttcacccagggcagtgcaatatttgggtccctcagtagtcaggaaccctttctgaggtgcaatacatttatgaagatattggagttaagtattttgcctcatttataaataactgctattttagtctacatggctcattgatttttctgaacaaattattgcatatcattttgaatattattatgaataattttctcactcatttacttaggtgaaagtaactcttatttttctctgtgctagattttgcttttcacattacattattttcttgattattttcaataaatgcagtatttcagtatttgttgtgcatactttgtctgtgtaatggtttaaaatttcctatcatcatacttgtctcttttttcaaaagaatttatgcagatatttttaactttgaggactcacaaatttttggctatatggatgctaatttatattaaaaaatctatcaactggtcttcctacttaatctcctcctgcaatgggctgcaaaatcaagtggatttgcaaagagaacatattggaacacagatggctttttggtctctctcagggaagtcaagagcttggggaaaactagagaattatagtatttgaagggagaaaaaagagttgtctccaagcaaagtgccaaagctgttggatttggtacctaaagcagcaagcctgcaaagatttccttgggtcagagtcaaggccaagaatccctctgatggctgcatttatgtcatcttttgaatgtgcaggacaaatgctgctaccacaaacatatctttgcttcccaagttccttcctcagtgaacacatcccccgtgaacgagctagacatattccacaacttctgagaactctcagatctgcatctcctgatgagattcctttcaaagacccagccctgtgtccagctgttcactgtgccttcacttggatcccttacccggacctcaaattctttcagcgctaagcttgtcatcaccatctcacccccacccacataacggtaacaaccacaacagtcacaaccacaactgaattccacctcatatatttctcatttaaggcctagaaaagctgctcccacaaattagcacctttctccaatctaccagtccagctgattatcaactcataaggattctattttctgaatagctctcgcatccatctgtcttgcattcccagggccatcttgtatgcctgtcctccctgtattgactgtgaatgcctcgacacagtgtctaacttgcagctaagacatttattaggtccctaacaccatcacccagatagtgacctacaaaatgtttgttgtgagaaagacggagaaattaacacatttgatgcagagttattactttgggaaatgagctcatttttggtcatttgaatccaaagtggagcaatttttatttccttttgttgtgaccctcccatctagagctttgagacacttttggagtttttcttggattcatctgaaaaaaatttccctaaactttgcgactgtgtgaaagataaattttaagtacatgcatttatttttaaagcacattaatcatctgtgcttcttgaaaaggccattttatctagctcctctgactccaggcttttaggtgtggtgtttctcttacgaccttcatcagccagttccaagatggaattaagccctaattactggaagagataccacttgcccataccgaactaacttctcttctcttgcaccttccagaataatacaagctctctgacattcttgggacaactgagaatatagtcactcaagtcatgttctgtctcatggttcacaggaggaaccccatggagaaaagcttcagggtcttaaaagaagccttagaagaagttttccacagtctgaccagagactgtgattctctgaatagtgggtcagtctcctccttcccaagccaactcatccatcctctacctcctgtcccagagagcaagaaagccccactagccatggataggatggtagcaaaatattctcctcattctgtgtcttctaagtcctctttaaactttcaaccaatatttagcctcagagttggaaaactcttctgctaggaactaggcgggcatgaaaagaataaccatcatcaaaagctgtgttttcttttgcttctctttggggagaaatagttaagaataagaactgtgatggcagacttgaaagtaatccccagccttgacaattggcctcttttgaaagaccttcccttgacccctgttccctaggaaaaggaaggtggctaacaggaatattacaaggttccattgatgagatgtctctccaaccaagctatgtacgatgacaactagtgggtggaaaaacttccctcaaaccaggactggctatctgccttccaaattacttcactgcatgccaaaaggttatctatgaggaactaggaaaggaagtgcatttgaaaacatcactgggacttgtatacaacatcttaaggtgtttgatccttttatgaactgatgacagctttttgccattgaagtctatgtgagagttgccagccaagcaaaaggaggaagcagggccagcctgtttgaccaaagaacccctgagagctgtttagatcacaagacatgagacagccagagagagggaatggcccagaatcccaagaaaagctcaggcagctagctgcatcagcagtttcaacaaggtttgttctagccatttgaatgtttccctttgactgtgatgtccttttcatttccatcttcattca

SEQ ID NO: 40341 - DNA, 1207 bp, Bovine  19866880421117
tatttgatagtagaatcaacggactcaatgagtcattatgtgtggtacaaatagaaaaatcagcggaccttctgatttctggctgcctggcttaggttgctgtatggatagtggtggcctgcactgtgtagagagcacaggagagaagcatgtttcttctccttctctcaaaatcccctgtgcttctctttgagcccaaggaattttccaccactccccactgtaccctagaaatataactgcagccatcctcaggaacaagcacctgtgaacacctgttctgtttaaaacaagagtagctatttttgaattcctattaattaaaaatcaactcacacatttcaaattattaaaattctaaaaatgaacaaaggttacttatttaactaaaatttgactaggaaatggtggttttaaatgtgaatgttcaagcttttatcaaatgaacaatgataaattaatttcatgcacttaagatgcagactcagtccctgagatatggggctagaaatggggctgctggcaagtgagggtgtggacaggttcctgccatggtgtggctatgattgaaacccataatttccccatttttagaaaatatgaatctttctgtgtgtgttatctatctttgtttccatctgtcatttgaggtcctttgtagataagtcaagctgtctcatatgaacagtgcgtgagtgctcagtcgctaagtcaagtcatggctgatgctttgtgaccccagggactatagcccgccaggctcctctgtctatgagattttccaggcaaaaatactggggtgggttgccatttctttctccacatatgaacagtatcaatgctaaaatgaaaaataaccataggctgaaaggaaattaaggctgtgtcaaggtgtgtgtgtttgtgtgtgtgtatgtttgtgtgatgagaaagagtggaccaagaagagactcccttttcccagtcatttgtggaaatctatttcaggtgaactggaacaaactgtgagttctggccttgggcaaaatctctatttgcagtcagcaaattaatggatggcaccttaaaatgggttggccttagctgaatcaatgtctgatgtgcaatctttcctcagatcaatttcccactgaggatcctaggtggaaactaactgaaggagtggatgactgaaaagactgaatttttcagtcctctcacgcattca

SEQ ID NO: 40342 - DNA, 888 bp, Bovine  19866880492904
cgggttgcaacttttatttcctagtatagagttaatgagcagaaaaatggcagagccatttccacacatctaaggcttacaattttcttgaactatttaatgaatgtacgttattataaacgttgagactagcgagtatgtgctgtaggccctgagaggaaaaagtgaagtttctttttagtctcttataattaagctatcgtcgagaattgcagtctatatttttaggcctttgtcctctgactctccttcaggctagatttggcttacatttctactctagtctctctcttccatttcctatccttaatcccatcttgtcatccttccagactacttagcagatgttgttgtaagtgtcttcacgtttacatgcgaggaaagaaagaagactggaggaaaatgggtcaggatgtatgtacatgcaacgcatgcgtactgtgctctagcaaagtctggtctgtcccagctgggagaacctctaaattcctgacatcccagccctaaatactgagctcagagcttttactctcacactggcagtagcagctccaagggattaggaggggcaagggtgtaggggtggactgtacccgctaatctccagcgatatcctcagcctccccagataaacacctatgctaagtgaaagcattcttcaagctagaacctctaatcccttcttccaactagattgctgtccctaagccccttttatgtagaaatgtacatgctaggtaaattgtcaggcatcttcccctgtgtgtgtgtatacacacacatacaaatacatgtacatgtaatgcagtgtttcaagctgatgagttagattgcctgcactcgaatcccagctccaccatatcatgggttgtgaccttaagcaagcta

SEQ ID NO: 40343 - DNA, 1664 bp, Bovine  19866880549722
taaagataccaaactgacttctgttaaatcacaaaaataaatattgtctcattctccaccttaagttctaatgacataatgcattttcttgcctttctatttctctcagaaatcgaatgtcctgtgaatcttcctctccattgttctttttaataggcatgtccagacatcctccagctcccgagatccctacgttttatcccctgtctccgggtggtgttggacagattaccccacctcttggctggtaagatccttcttgcaacctgcagccaggcgtctgaacatacatcttctactccccgtttatggaaattagctttatgaataataacacttgtggagttgaagaaacttcaacacatgaggtgctaactttatttcatttcaatttaaaagattaaaagacatacagactttgaaatggactgagtccgtttgctaatatgtgtagaaaatgactgtgtagcattcgctttgaagcttatagttttatggattcagtttgtggctctgggcatttactatgcctgtacaaagtgttcactgtggtctttcttttctagttctttatgaacaacttatatttttgaagcacaaccttagatatattgaatatcgatctttgcttataaatgggcaggtgacgtaaatggcaaataactgtacaaatgcaaaagcatcttgtgaactttaataaagtaagcaccagtttgagttcagaggagtgaaaaacagacaaatggactttatcctttcagaatccaaatgttccctattttgttgtttctgaaagatccataccactgttttcaggttttttataattataaaggtaaagaaaaagaaatgtatttagggaagaaacaatcacttcatacagtggagcctatttttatcattttattgttagttagcacatagctttccctgccctcactcccattcctctcgccccactgctcactccatggacaaagggctgcaccttcagcaaacattttctctcctttccttcctgactctgtgtccttacagacccctggagaaagccccagtctccctccctcacatcctgacattatctcttcttcataaggagggcttatcctgtcatggatattccagctttctctcttctctttagcattaactctcgcagtcaataactctgtttgaatttaattgattatgcaaacacttccaaacctacatcaattattctgtctgaacttagctacttaagggcaataatcctgggctgagttccatcagtggcatctggaaataaagactgtgtaaatgaaaaatgtgacatgtaggaaaaacagagggagagatggaattctcagagcagagagaaaataactccaatgaattgatcttttatttcttgcctgcagcatgggtgtaagggtgggaggtggggtgcagggttttcaaaaatgtgttcatttttatataaacttttatttcctcctttcttcccttccctgaagttctcaaagattctgataaagaatccattatcctaaaaagaatagttcaccattctcagcttctgttatattcagtaagagctgtttacacacctactttgttcaaagcatcagtggggctggagaggggcaggggcaggaagcgagtcatccaggactgcagtg

SEQ ID NO: 40344 - DNA, 1832 bp, Bovine  19866880634429
ttcttatggacagtaataatgttgattttatagctctacatctggaattttttgactatggaacagtttaaaataaatgaacaaaagaaaagatatttagggatgaactctactctccaggggtctgtctgtgtttcttctatttttccttgtttcgcaaacaagatgccacaaacagaaatcacattcatgcctggtcctcgctggcactgagcaggtttcccgcttctctgcacttatccacaaagccacctctttctctgcctgactctgaggctgcaagccatacaactgttctgatgtggacacaggatgcctgttatcctcctgatctagctcacttgattctagaaagtgcactttgtgtgtaaatctgttcaggctaaagcaggcattcctcatattttgttaataagcttgtcagctcattatgtgaaaaagaacttgctgagaaaagagcaattttgcgtaaattcgaccgagcttcagtcccccttaggccatgtgtagtttccatttactaggattagagttattttctcttgaccagtggaaatgaggactcctctgtcagaacagaccaggaacatactttctcgagctcttggaagtcactcctggcttactatctggaaatacacattgaggcaaagactgctacggtttaaaaataaaagaatgtagtttgatctaattttgctctttctttgattcatgagtctgtcatgaataaagttccatcctcagaacggcacctttttatgtctttccgggtagataaaaagggaaccatggctctgactgtatccacagcaacataactttttatatggcagcatatagattttgctttcagggccctctctcgggttgccaagtggaagatcatgagatggttttcattacaggatttttctgcagacgtttttcaggataaagcactaggaatctatatgacatcagaacttgcctttgcaatctagggagtgatgggggaatagtaatcatgtttgatttacaagtatgtcttaaaatgggtaacgaggagctggagttaatgagttctacctctccttctcagaattgcctcacttttccatatggccagaagactaacagcatcacatcaatttaggtgcaactgggggacaactggaacaacgaatgtatcccaccatcctgttgccctgcctaaggctttctggaattaacttcctattactctaattacaataatatgctattactatgagaagtgttgggaatgggtgctaagctgatttagttctctattaggcaagactatctggtcacctgagtaacaaaatggactaaaaatatgccacaaaaatttttcagaaagaaaggaaggggaaaacactccacttacctttgttcctggtaaccctggtaagcctggttctccctgaggaccaatgaaacctggttctccctttaaaaaaaatggacagatgagatcaccacatgtttgacagtaaatatgtgaactattgttcatccccggtgggtcagctgataaagaatccgtctacaatgtgggagacctgggttcaatccctgggttctatccttgggttgggaagatcccctggagaaaggaacggctacccactccactattctggcctggagaatctgcatagtccatggggtcgcaaagactgagtgactttcacttttcacttcactgggattttacttctttgattgtatacagcttttgctgagatccagatactaactataaaattaattagaattggttttgaccagtgacaacactttgagcaaaactttggagaagctctgaa

SEQ ID NO: 40345 - DNA, 2644 bp, Bovine  19866880676177
tttctaggtagaagaaggtctgtaaaatgggtagactgatgaaagacccccttgggagagactggggtagaattgcaactaagaaaggctaggaaagggggctgtagccttctatgtaatattttcatttttttttttttttacaaataaatcgtatctgtatttatacagttcaaatttaagtccttttaaacaatcacagtattatgaggttaaaacatttatttcttgggatgctctatttagctaaccattaatattgccctgaaaaccagctagtcttcttcctgaggcttatttactcctgaggttcttttctcgcaaagcaatggaagagggagggtaaacagagcagaatttgaactaaatctcaacatggaacaacacaccaattatctctcctccaccctttcttggccctgagcctgctacttctcagtggccacccatctaccctgaaagaaacagagccctttgctgtgacccccttgttctaaggtgaggagactggtttgctcaagttagaatccattactctcaacgattaatcttgttctctacaagctcacttttagccctaccttgggagtgaggtgggggcagagggtggtcttctctgcaaacccctcctaagaatttcaacagagaaatagctattactttttcagagctgtttatttccattctctggaggattggtctctttaactgtattttcagtatttcagttctacacaagccagtttcttcagcttctctcctatcattgtctctccatctttttctctacctctctgtatttctgtcctcttccaatctcattccctctctcagtgttctctttatcttctgcaaagaatgttctaggaaggaaatttgggggatgataaatttcagtaataatactaattcttgtaaaaaaaaattacgaccagaaggtagattcagttttaatgaaatgctcttcttttaccttgcttttatgttgctccctttatctcttcatcaaggaaactatattccatcaagcctcagggtatgataaataacttacaaggatgctcgattgtacattattcttttgacagggtggctcacaacactgataggtattatctacattctttaaacggtttcctgcaggggtaaacccatgtacacccagaaatacaaaagcacacgtgaggattaactgtctagaggtggcttgtttggccccgtccttatttccttgcaaaaggttgcttaaaaaatgcaactacattcagaaaggaataattaactgagaaacagatgccagtggtctgcctggctctggagccttcctggatggcccatctctcggggtgtgcagcccttcacgggctccaagaagaaaggcaacgtgctggctgggagtgacatgaatgcacgtctcctggccgtacttaaagaaacctttttgccaaaatgcttttccaaaagagtgggagttccataaagtgacacttttccctttgacctcgaaccttttggcatttttgtttacatctgctcaggcagacataggaccagggcttatcagtccagcacttgctgacactgctaaaccatgaaacgaggctctggtaaaattatgactttttatacctgacaggcggtgacctgtagaaagctctgcgttctggcagaaacacaaaatcaattgagtttcatctaaaccattctttggctttcaagaccctttgataaatctcagatggaaattcttcagtcccacagaagctcagaagggcaaccgtacactttgattcttgattttatcatgtaattgaggtggcatttttattgatcagttgctcagtggatcagtgggtttatcaacctgaatttctagtcaaataacttgataggacttcatttaaaaacaattttactgtctgcaaccaggctccccctgggcagtgaccataaattactgaagtcagcattttactacaaagcctgcacaggagcaggacaaagatccaatcaagttggggaagttggaaaccttaacatctacttcctgcaccaattggcttctttgcttgagggaagaaggagggagtaaattaatccactctccacactccagcaagagatctttctaaaatacaaatctttctaaagatatttctaaaatacaaatcctatcacatctatatcacacgtgctgctgctcctgctaacttgcttcagtcatgtccgactctgtgcgaccccatagacggcagtccaccaggctcctctgtccctggaattctccaggcaagaacactggagtgggttgcggtttccttctccgatgcatgaaagtgaaaagtgaaagtgaagttgctcagtcgtgccctacccttagcgaccccatggactgcagccctccaggctcctccgtccatgggatgttccaggcaagagtactggagtgaggtgccattgtcttctcccatatcctgcataaaacccactcttggtataaaaaacaaaagactcatcctagcctaccccatcctcccagctctgcctgcctttctaggctcatctgttgcccctcacggtgaaagctctgctacctgaactctacagctgaaggaagtcaccagcctccctctacttctcggcc

SEQ ID NO: 40346 - DNA, 1179 bp, Bovine  19866880704212
actttggtagatgataaactatttataagacacaaatactgtgtaaaaccaaacatgcagtataaaataataaaaaatcagtacgtcaaactatgtaataagtttacaattgcttgaaatatgtaagcataaatttaagagactagaaggaaacaggacgaaatgaaaacagttatagagtgataggattatggatgcaatgttttgcttccttttacgttaaaagattattttaacaaaacataaaatcaaaggaaaaaaaggatcaagttttagtccctcgatgttcatattttaagaaggatgttatgcagatacctaagcatttgtctcccgtgcttcaaaatctcagcatgtatttcgtctggttccaggggcttaaccattaaaaaaaaaataattctggctaccatagttattctttgaaagtctaaacaaagtttgtattgttccctggcagcatttcttgtttgcattaaaccatgagttatgatattagtgcatcctgttgtaggttctttgaagaagcagactccgtagctctttttatggttacacagtaaatgagagtcctctttaggggtgtattccatttcctatggagttcttacccttgtgtgcgctcagtcacctcagttgtgtctgactctttgcgaccccatggactgtgtgatccaccagactcctccatggaattttccaggcaagaatactgaagcaagttgccatctcctcctccaggggatcttctattcttacccttagtgaaactgagtgaagtcgctcagtcgtgcccgactctttgcgaccccatggatagcagcctgcaccaagctcctccgtccatgggattttcaaggcaagagtactggagtgggttgccatttccttctccagggaatcttcccaacccagggatcgaacccaggtctctcacgttgtagacagacgctttaccgtctgagccacctacaaagggcatatcaaaattttcttataatggccatcattattctaagtcaacatgtttgccattttcttgaagaaaatgcaaatgattgcaatgtaactttatagaggaagaagaatttcttccatgagttaagacattagcaattatagtacaataacccagtgtaatcgtaaaacatttttgcccttttagaaagacactatatg

SEQ ID NO: 40347 - DNA, 1492 bp, Bovine  19866880712832
ctctggcagcttctcctaaaatccgggaaggagatgcacctctgcgttagagtgagtggggatcacagctctcttgaatggagagtttcttacaacattccgtgttcctctcctacactcgctaacccaatttgggcctctagctgagggaatccaaaactgtaaagccaattcttaatttttttttttcctttagatcatctgtaagtgatgatctggtatctctcttgggaatttctatattttcctcattcaaaactttaatgttaacagccagcacaggagaacagcaactttttgtgccctcaacttacttatgaatatttcaggacttgttattaaaggttataaatcttcctcaggcctcttctttcaggagctaaatgagcccaattctcagagggtcatttctccaaggtcctttaataattttgatttttctcctctaatttctctagttttattacgtttcaaataatttgtgcatcagagaaatgaacatgcaagatgtgtgcgtgactttgacagttttatttttctttcacttccaattcttcgtaggtagaagtttcatatattttaaaccctgcacgttacagaagggtgtacaagtgacagcttccttacatccttgtcccaagccccccagcaccatcccccactcccaggaaggagtataagtaggtccctgagaatccttccagtgacactctgtgtatacacaagcgatcgtgtatttataatctgtctcccactcaccctcacacttttccctttgcttttgcctcttataagaatatcttcaagatcctctagatcagaaaacaatttcctcattttcttctgtagctacactatagtcctttggctggatgtcccagactttaactcattccctactcttttttattaattaaaaaaaaaattagttatttttaattgaagggtaattctttacagaattgtgttggtatctgccaaacatcagcatgaatcagccatgggtttacccatgactagttccttactcttgaacattccaaagtctatcacaaataatgctgcgatgaataatctaaatacatcatttagctcatatttgaatatacctactggataaattcctagaaataaaattgctggtcaaagaaggcatgcagttatagttctaaagatgctgtcaaattgttttgcatcagaatggcaccagttatacccttcccagcaatacaggagagtgcccatctatacagactcgcctccatgccatgctgccaaactctttaatcattgacaatccaaatggtgacatattgaatctcagttgagtgaggctgagcaaataacttccctacacttcagtcacttgtattttcttattttgtgaactgtcttgcacatgatatttgaatgcttacctggacaggtctggaaatggggaaggattacttcattggccacacagggaatagtaggggatgctgtcacagag

SEQ ID NO: 40348 - DNA, 3180 bp, Bovine  19866880747266
tgtgtgactccgagcaagtcacatcatctctttgagccctggtgtcctggtcttcagatgacacggaaataaggccagatgacttcaagggtatctcctggagtcaaagtgtaacttttgaaactacttaaagaaatggagaagaggatgaggcacaaataatatacaataatatacacggaagcttggagtaagcttatacagtcctttgcggcactgttaaactttagtgcctgaatattattaatatgttgcagtgttctgcatgggcttcccaggtcgtgctagtggttaagaacccacctgccaatgcagaagatataagagatgtgggttcaatccctgggtcgggaagatcccctggaggaggtcttggcaacccacgccagtgttcttgcctggagaatcccatggacagaggagcctggtgtgctgtggtccgtagggctgaaaagagctgcacacgactgaagtgacttagcatgtgctgcagtgttaagtgtatgtgtgcgattcaaaccccaaccacgggactgcccgctgcactgactgtagaaatggaatgagaaggaagaggggaactgaagtcctgggatttatacatgacatcttgcagtgggaatcaggcttacttgtatttaaagcaaataagtcgtacttaaaatggaaaacaaccttgttgatctttgaatatctgtggtggagagtagctctagttggtttgctctctcaggagctgtctccccccggcctgtagagttggtctgaaccctcagccactcactggcttttgtgtctttcacaagttctgccatgcaccaaacacaggcttggcggtttcctttgggttttctagagttattcttactagtgaggcagaaagacctctcttcccaactacacttttggccgtagattgcggtttttttgtatgtggttttcttcccctgctgttagactaaatgcccctctatattctctatacttgctggaggtgctgaatggcacccttcacacatgcatcccagtttccctgcagtagggagcccttgctgctctggagcgactctacgccttcagatggaatgccctgctcagcagtctcttcagggtcgatcagaaaatctccatgacaccaagttcgagtttgcagaggtgtctgccagggctgggggcttccccactgactcaagcagtaaagaatctgcctgcaatgcaggagatttaggttcgatccttggtcaggaagataccctggagaaggcaatggcaacccactccagtattcttgcctggataatcccatggacagaggaacctggtgggccacagtccaggaagtcacaaagacttggacacgactgagtgactgagctcacacacactgccagggctgctgctctcccccatcttcctgatccccagcatagccaccaggaaaagccacatcattaccacttgttccagtgtcaaatcctacatgaccgaggacagcccccagccctgaatttcagagaagttttatccagtgatttagtatttgatgttttcttcttgcttgattttctctttcggaaaatccagatactgaagaaggtctcacattttttcatatggaaagagatttctctggtttgtgattaaagatatttatttcttaaaactcagtgctttaaagctgaaatcccggtgttctacagcactgatgtaagtctgtcacttgactgcaccactttgaaagtaaaagctctaaggacatggtgaattaagcaggtagaaccataaaaactactttcacccaatttaattgaattggaatagagaatatgggcagttggaggaagatggagaattgtgcttagagcccttctgattgttagtgacagagactccattcttctacagcttagtagcaaagatgtggttgtgatgaactgccataaccagatcacaggaaggggaccagggagctggcctcagtgtcatctggatcaggtgccaggagcgccatcaggaatctgtctcctcctgcacttctctcatcttggcttccacttcaggcctttggcttgcttggggacttgaagacaggtagctccagggctccatccttgtgactagagttccaaaggggaaagagaaatatccctgccagctaccatttggaaaatctgagacagcctggggttggccctggctgggtcccgtgttcaccgccggctcatccctgcggtcaggcgggtgaagagctctgagtggctgccacacaagaattacaggacaagtggttgctggagtggtgaggagaggggagcagttacctaagcaagagtggtggcagttgcgatcactgagagaagaaggaaagggttctagaaatcccgaagcaactgttaaacccaaaagcacgtgcggaatttagcctacgaccttgctgggaaccatagaatcatggacgattgaaatggatggttctgtcctccaagtgtagaagctgaggtgcagaaaggtctaatgatctgcctaaggctacgaacaacagatacccactctgtaggtgcaaggactgtttgcagcgttactctacagcttgagcttaatttccagctaaacgtttcatccaaaatccatgcttaataaatttgagtttctgctccaaactcaagaagtcacagaagtgtaaagcaggcaatatggtagttagttaacattcactggactttcattttctcacctgtagagacatgactagtctctggcagcgggaatgatttagctaataaaatctcagaatcttgaattaaaacacaaaacagaaatataggtgaaccctttggaaaaggtaagctgaagtatttaaattatataataattaaacccttgattaacactgacattacctcagtaacttacatttatttcaaagttatactcacgtgtcctgccctggcaggtagattctttatcactgagctaccagggaagccctgactgttctatattgctgctgctgccgctaacgtcactttggttgtgtccaactctgtgcaaccccatagatggcagcccaccaggctcccccgtccctgggattctccaggcaagaacactggagtgggtttccatttccttctctgatgcatgaaagtgaaaagtcaaagtgaagtcgctcagtcgtgt

SEQ ID NO: 40349 - DNA, 1650 bp, Bovine  19866880776093
acacataggagattctactggagtcctgaaaacttttttagaaaaataggaattggagctggcccatgaaccacatcatcactccgatggtaaagaatctgcctgcaacgcaggagagctgggtttgatccctggttgacaatattccctggagaaggaaatggctacctactccagtattcttgcctggaaaattctggacagaggagcctggggctacagtccatggagtcacaaagagtcggacacgactgagcaactaacacccacatgaaccaccccagaccaggaataactgagaattctgttttgtatagccttaagttagctgccttggccttgctgagaaaaggctgatcctcaggggttgtagtacaaatggagctaggaaaactgagcagatgatggaacctggggagtggtgccaagccagaaacaagccagcaatcacaggcaatcacttaaggcaaagggctagagacactgtgggaaatggctgcaagcagtggaactggggacatcagacagaatcctacggacagtcccaggacagcacgggggggctgtgtttgtgacagccgcccattgccaagtgcaatgacattgctctcagtggccacacagcagatgtggacggaataacttggattaaccaaattatttgttttattgttatttagggactggacttcaaaacccacgattggttgctcaacctaaaaaaaaaaaaaaattgacctcctgccactccataaataatcagcacccgtgtgatactaaacaggaaatgaaaacgcttggctcatccctggagggatgccatggatgtgtactgtcagggctgctgttacaacatggatcgttgactcgtggccagatgccctggttggttactgtgccctcggggataggaaataaggtacagtaccgacaaggagtcgacttttagcacttaaccagctgaaaggaatcctcgtgggaggtaaactattgtctctgagcgctttcagcactcgatctgatatctgctttatttttgtatcatgttttccaagtcgaacattgttttagtgtggatctggtgggaatatgttcccactaaaccatgggccaatttttcctcctacaggtacattctttgactttgatatatcagtcaatatatttgtcttatacagaacactatttccatgtaaccagctcttcctttttagctccctttcaaataatagcagcagttgctaggtatttagtgttttctatgtgtcagagcctgttctaaggtctttacgtggattatcttattttagtcttactaaagcttgaataaccaagtgctctgatcctcatttttcaaatgaggcaactaagtgatttgcccaatgacatgtcattaaaagatatttgccttgagatctttgttaacttaaaatctacaaatgtgggagtatggagtacttcctaaaaggctgcgtgcatagaattgttgtttctttactactgacacctggagtttgcttgtttttttctgaggcaaggaggagctgtgttgactcacctcccgcatccgccattccatcacttaacaggtgtcattggtgctcccaaattgtcccatctgaactctgggcccagatatccagtgcagaa

SEQ ID NO: 40350 - DNA, 1675 bp, Bovine  19866880783683
agctgattttaaatttctatagctgcattttaacacgtgaaaacaggtaaaattaattttatttaaccctaagatatctaagctactatcatttcaacatgtaatcaatatagagatgtcttgtgttctttttctactcagtctttgaaatctgatgtctatcttacaatgcaccttggtttggactagccacagttaaagtgctcaacagccacctgtagccagtggcgactatccttatcagcggagagctaggtgaatacagtttatgtcaactcagtaagcggaagttgacccttcaggcatgtgcctggcagaggcaggaaacaccaggagaccagactcctgaggagtggcagtcaggagcgaagcaccttgagaacggatgccaccttcttacccccagggtggggcccagagcctcggcccaaagagggacaactggcagaagtgtgcggggtaaaaagtgcaggtcatctggatccgcgcactctgtccttgcttccccttggccctcttcaaatcccgcctgaccagaccctcgtcataacatgctcctctctatcacgaccagtgaggacatgtgaaggagagcttaacctgctgtgatacatactgctcagatttctttagggagaacataaaatgatctcctcccctgctcctctgatttttaaaagatgactagattttaagaagatgcaaacccaaatcacaatgagataccactttatacctcctatgatggctgttacaaaaataacaataataattgtaggccatgacgtggagaaattggaacctccttgtacattacttgtaggaatgtaaaatggtccagccattgaggatgacagtttggcagttccccaaaaagctaaacctaggattgctgtatgacccagtgattgcactgctaggcatatacgtgaaagaactgaaaagaggagcctgaacagacagtacactcatggtcactagggcactattcacaatagccaaaaggtgaaaagaaccaacaatatggctatttacgtctcctgttctgttatcagtccccgtggaatatttaatgattatgttattatgctggcctaaagttaggcctgttttattggcctcaagtttcaattcaaacatttaaaaagcaaacaaaggccagaaccctctcacaaatgtgaagtggtcagagaactggtcttgaagataatgatgacaagaaatcaccttggggttttctgcaaacttcttcttggccactttccgaagactttcctcaattccctttctagatttttccaggatgtcctctgtttggtccaccaacactactgtgtggccagttgctgcagcaacctagaacaaaacaaaaaccaaaaaaaagcaagaaaaaataaaaattaaaaaaaattagtagacaggaattctctgcagtccagtggtcaggacttggcactctcacagctagggcctgggttcagttcctagttggggaactaagatcctgcaagccgctcagcgccaaacaaacaaataaaacccagtagagttgcatattctacatgaactccagcactattctactcaaaataccacataaacataacaataagccaacagaaattaaacacacacttctcctcaggcactgcttttaagtccttaacatggatga

SEQ ID NO: 40351 - DNA, 887 bp, Bovine  19866880788892
ctgatagatgagaaaagggagaggacagacagaaagaaatctcttataaaaggattcagactcaaagtttaggaagatgctagaatgtgtgcaaatgcttattttcttattctcaccaggcaccctgggtggggggcctgagaagagaagcattcctgtggtttcctcggggtcactgcagtgaccagaagtggccacagaccccagagctaaggcctgacatccacaacaggaatgtgtccttccctggggcctctgggacttgacatacaagcgtttccagaaagtaaatgttgtaattactgcaacagatgagtgaagctttcactggtttctgaagagcatttgctgtgaaagtctcctcggggaggcaatggagaggtggggccacgggcacttctctttattagcagtcgacagtaaatggtttccagggctgaagtaccgaaaagcaccagaatcctggcttctccacttatttattgtgtgagtcaaggtaactccttgagcctgttttcttgttcctcaggattgtcatgagcattatatgtcaaaaaacatttgaagtgtttggcagaattgctgggccatggtaggcaattaacgagtcattgcaattattttcatagatgtgcataaaaaggataaggatatatgtgttgatggataccagtttttctggctgtcatcttgacaagtttcctacttatggaaactttaagtttccacacccatcgtccagattttctatatagaagttatgcattaaaagcttttctacacttccctgggggtgccacagataagaaaccacttgccaatgcaggggacatgggttctatccctgatccaggaggatcccatatgcggatgggcaactaagccag

SEQ ID NO: 40352 - DNA, 1360 bp, Bovine  19866880815678
attaatttgagagcatttctcttgaaatctgtatttcattaatgttttaccctgagatgctcctgtttcttctcagatcaccctgtttattgtgtacatgcctggtgctgggttctggaatctttattatatgtgaggtgggaggagtaagtccctttaaccttgaaagttctacactttatatactacatgatactcaaaagaaagtttaggttgaatgcctttgtatatccctgctccacccaaagctccctgtgccatgagagagagatttatcctgggcaggtataaaatactatatttgcttaaaaacctgtaaacagcatcttagtggcaagatattagagccttgctgctgctgctgctgctatgttgcttcagtcgtgtccgactctgtgcgaccccatagatagcagcccacaaggctctgtcctccctgggattctccaggcaagaacactggggtgggttgccatttccttctcctatacatgaaagtgaaaagtgaaagtgaagtcactcagtcgtgtccaactcttagctaccccttggactgcagtccaccaggctcctccgtccatggggttttccgggcaagagtactggagtggggtgccatcgccttctctgattagagccttaagctcccaataacaatacaggaaatgggttagaaactacagttgatggtcccgtcaagacatcagtggaagaggattagaagctaagttgcaagtgtcacttcagcttttgtacaaattcaagttgctccgttcttggaatgttgtatccattattggccaaaaaagagtgttatgtagtacaaaaatgcacacaggtagaaccttaaattataagtatgatgttggggctttcatctgagaaagaagggaggagcttgtgcagttcagacttgtagatcacatccttgcatagttggaccaaggtgtgccttttgaaacctaaggtgttaaaaagaaagctgtttacccctcagaatggaaatataatggaactgtcattcaagaagttgataaagaccaaagatttaagtaattctgtccttacataacaaggtttaaaagagcctcagccactgtgggtggcagttttaatcctgtggaggggaaccaccctttgctgaagaatatctctgtgccactttctgccagtcggttggctttgatctgtttttgcactctaccctagatcatgccatttgaggcagtggtgcctcattctttatgctccttgacctacagcttttggtactggctaaatctgttttgcttatttggtgccatagacttcttagttgctacatcttgactgtagattgtattcagttcactgtggggag

SEQ ID NO: 40353 - DNA, 939 bp, Bovine  19866880832804
gaagttattggaaaagctgatcccaagtctggggaaggagatacaataaaagcctggcatgccttgtgatactggatagcaaagaagctctctaagacagatagggtcatgtgcaatggacttgagaaccaacttgaagacaaggttcccactgaccaatctaaacttcagaatggataagaattgtaaaggcttgaaatccatcaaataccttgaaatctgtgcattcataattttatatgtatggaaggcactagttggccaccttttgaagatagcaggtaccaattcaattatttaaaaactggatagataaaagggaaaaaatctgcttctcctttgtgaaccataccactaggttatctccttataaaattattacagctaacaaatgaaaacaaaataataaaattagaatgtcacaatcttgtaactcctaataaatgaatagatccaggcattgagtcagtggctgcttacatcaaaaaggaatgaaaaccagacattgggtgcctttttaaggaagaacacagcacaaattgaactttgccaaactgaatctgatctactctctgtattcagctgctagtttacaggagataccaaggacagaagaacaaaatgaactaaaccaagggtagatcagtaaaatccagcccatgggaaacactactgttaaagagcctaagacttttttcaagagggaaattataaggaattaagaaacggcatggaagttaagtggtaggttaaaagaggttgaaaatatatatcagattttgaagaatggacaagattaaatgacagtgtctcaggacggacacttggatgataaaatcagaaggagctacaggaaattgttgctcttaatctcaggatagtggttgcttctgaagggaggaaggagctgtgatgggctgctgggctgagggactgctg

SEQ ID NO: 40354 - DNA, 1853 bp, Bovine  19866880841830
tgtttcgaactcgctagagctcttagtgtcgctgtttcaggggggcctgttgaatttgcctgaggtaaactaaaacggaaagtaccgactctcttaaataatttcagttatttcttgtagcttctgcagcttacgattgttccagcggagcgggtgggagtggtgaaaggtatgtagtacttctgattatcttccaatcagagggaccaagataggggctttataatactggcagggctgtgtgccaagatgtaatcaaataggaaactgggtgccaatggtaattttttgaaatgtgcttttatgacatccttctccaagatgaaagcagtgttccctaaaacaaacaaacagcgtcggactggggctaaagctctgatatgaaatttatttatgtttcaccaaacccaacttgaaagtaattgtatatgatttgaaacttttaattgttcttgttgtttctctctgcaaataaggaaatcctggctttctgtaaaaaaaacaactctagatcctgactattggtttcttttcaaggttttgccacactaattgctttctgtttgattctgtgcccttctgaaattgaaggttgcctcgaggcaggagaaaagctgtggtggtgacttgtgggtttggggactgggggaacccacagtggtggctgcaagccagcctcattatcccccggcttgggggggggccaaccagggggcccgttttcctgcttcagatctgggcctttgactggaagggttagaatctcaaagctttctctttgcattatttatcatttctgactgataacagcaccactctcttctaggaaccaaacactggtcattatggtttggttttaatgtggtatcatgtattgtatttcactgttcttcaaccgcagatgtacaaactgaggatatgttaaaggatctgcgtttcacaggaaacagacatttcacttcttttcagcaatgatatgatattattgcttctacaccaacggactcctactattactatatgattgcttcctttaaatctgactaaactggagtggtgaaagttggagtgactttattggcttctgagaacatgtatgcattcaatgaagtcagaaacaatttcatccatgtgtgccccgatggctttgtaaatagggtttcagaatcataattcaaagtatcaataaaggaattgcttagttatccagaaaggtttactctataaggcacataggtatccttgctgaatgaaaacttgacccaaagtggagtcaacagggaaggctgtgggtcagactgcttggattcaaatcccagttctgtcactcacccgccaggaaacttggctgggacatttctctgtgcttcgatctgtcctgtgccacctgagggttttaatggtgtctgggacttggcggtttttaacacatactggtgcttagaacagtgccgggcacctggtggtgacttaataaatgccaatgacgatgattaatatttcccaaaaatgttagtgcttttgaaattgtacccattaaatattacttggcgttttccttcagactctgggtcatcactggggacttcagtgatggcaaagtgatgcgctctgggccccaagcaagctaaccacctgccctccagggggcactgctgttgcctcgagcctttagcagatatcttccttctgcccgccatcgccccatcgcctgcccattactttgtgggcctgttggagaaggtggggtgttctttgtcttctcccacacagcttgctcgatttctgctctcactgctcccctcccacacaatccaagccagttaaaccactaatctcccacccatgcttcc

SEQ ID NO: 40355 - DNA, 923 bp, Bovine  19866880930416
gccagcaggtttctccccgaatccctccacttaccagcaggcccatggcttgagccaggaggaagctgacccattttttagtccttcccagaaccgcatcctcagaggctgccagcaggtacgacagcccgagttactgccagctgcgagtgggtcatttctgggaatgctgctgtgggggtggctctcagggtccctaagtggcacccacttggtgtccacaggaggtgtgggttttattggctatgatgtcagagccgtctttacctgcagggaccagcctgggtggcaaccaagctggctttctcggagtgttttccaaccccggacagaaaggtggctgttgagcgggtgcagctctgaccgctccggctgaggtgcctctttgtctgacgtgattcctgtgccggggatggagaccacacgctcatttcacggatgtcatgtactgtcagctgtggtccactctgcatccaagattttatgaactgggcacttgagggaggccacgtggtatactggtaatgaacatggtctctagagccaggcgtcctgcatctgaacctggctttgccactggccggctttgggcctctgggaaagttacttaccttctctgtacttcattttcctccttcccaaaaggcagataatggcatctataaagtgttgtacttggctaagtgtgatttactgtaattattgtgtgctacatgggtagggtggtctgatggtagggtttccagtttgggaaagtactgtgggcttcctcctgtgtgggtgctgactacagacaggagagttgtcttctcaaatccatccttgatattttgtacccaccaccccgcccttgcttccagtacctgctcattccatcttttacctttgctccctgccggggatgtgtaacggaatcagtagat

SEQ ID NO: 40356 - DNA, 2673 bp, Bovine  19866880960000
tgtatagagtctctcttgtgttgttggaagacggtgtttctatgaccgtgtgttctcttggcaaaactctgttagcctttgccctgcttcattttgtactccaaggccaaacttgcctgttactccagatattgcttggcttcctacttttgaatcccagtcccctatgatgaaaaggacatcttttttctggtgttagttttagaaggtcttcatagaaccaatcatcttcagcttttttggcactagtggttggcacatagatttggattattgtgatattgaatggtttgccttggaaacaaacagagatcattttgtagtttttgaggttgcatccaaatactgcatttcagactcttttgtggctctttgtggctgccctaaactggcaggaagctgggcctctgcacccccacatcagccagtctttggtctggtggctccctgaccgtgagcgaggcagtctcttgaagctgagagcaatgtccaatgacccagctaatatccttagtccagaagagaggatttgcatagagcatctcagtgtccactcaagttcccttccagtttttccaggccagttattgaggtgagaaagcaggtgagtgaccaagggcagattccctgtccatgcagacctatgtcagactgtgagacctgtaattccatcctgttcacatttgtcaccacgccaaatgggaggctctggttttacccctccctttgctgactctcacatagctgcttctcccctgaccttgtcatagttccttctctccttcccagtcccttcccttttcatcccttggaaagtctttcatctctgtaccagtccttgagatgaagtctggggcagagagtcaaatgtggtctttgaatgaatgaacaactgaatgcatttacttggaatatattccatttctggaaagactttcccagcagttgagtgtaacagaaggtgggggccgttagtgcactgcagtgaacttggtggacttcacctatctttccatgcccacctccactccagtagataagaaccgtggtctcactgtcacagttttcccttatcgtacttcacctagttctataacatgacttttctcctctttcaatctgtatttgcatttttttctctatcagacttgccagagacatggcactgttattaaacacttcaaagaacctcatttgcttttattaatcttttagttttttgtccattaatttctgtgtacacttactaaatatctccagttacatattgtactggttttttttttttttttttaatagtagttttatttatgtatttatttttggctgtgctgagtcttcgttgttgcacgggcttttctctagttgcagcaagtggggcccctctctagttgaggtgtgcaggcttttcactgcagtggcctcgcctctttcagatcgtgggctctagggcttgcgggcttcagtagttgtggctcctgggctctagagcacaggttcagtagctgtggcccacaggcttttttgctctgaggcatgtgggatcttccaggaccagggatcaaacccatgtttcctgcattgacatgtggtttctcaccactgagccaccaggcaagtcctgtacttttaaaaaaaaaaaaaaaatctatttatttatttggctgtatccagtcttagttgcagcactcgagattgtcagtcttcattggggtatgtgggatctcttttagttgtggcctgtgggatctagttccctgaccaagggttgaacctgggccccctgcaatgggtgctcagtcttagccactggaccaccagggatgtccccgcagtgtattcttatcactgtatctctaggcccttcttctggttattgtttgctgcataacaagccatctcaaacttagtggcataaaataacatcactgtattacacttacggagtccatgggtcaaacatttctgcatggcatagtgggaattatttgtctttgctacaagatgacaggggtgcttcagttgggggtgacttgaacagttgcagactagagtcatctgaagactttttaagttaattcctgggtcgggatacctcaaaaacccagctcagcctgagaccaccaatcagagcacctctacacaacatctctggggcttggattctcacatacatggcagctgagagagagcgtctttagagggagcgtatagaaagcaagcagtctaagagaacctgtagaagctgcatggccttttataatctagccttcagagcaacatagcatcatttccaccgtattctattgaccaaagctgttatgagcccccagatccaaagggggtggacatatattcttacctcttgatggatagaaaaagtgaaagtgttagtcactcagctgtgttcaactctttgcaaccccatagactgtagccctccaggctcctctgtccatgagattctccaggcaagaatactggagtaggttaccatgccctcctcccggggatcttcctgacccaggggttgaacccataactcatgtctcctgcattggcaggtgggttctttaccacctggggagccctgatggatagcaattttgggattctattttaaagctactacagtttcctacactcttaatatttattatccttttctttttc

SEQ ID NO: 40357 - DNA, 1370 bp, Bovine  19866881013968
cctgggtcttaggccccggtccctgatcctcagcagtccccaccctctccctaggaaaacaatgcagtgttaaaccctcaaagcctctcagctccgttgttacggtaattgtgtttactcttttccaaacaaagtcattagaatcagaaaagtaaacgtgctcagtcctcagttctttgatgtcatcttcctccttgctcccagtgtgggactccgcagcccaaggcaccatggcccagagcctgatacacaaattccataagtacacaaagcctgatgcacaaattctataagcattgccatagctacaccatactgcttgtgatcgtgatgcaaaacaaacaaaacataaggaaaaactaatctgaaataaaaaaacacaagctatggggattattctgccctttgaacacctacagagattatgaaactgtggagtgttttaaaatttcagaacaatttttcagcatgaccaagtcccagatacaagaaacattctctttcctgaaaataatatctgatcaaggcaaatggtatgttgaaacagtaagaaccagtgtctgtgccacctgagcctatcagatgctttccctctaggtgacccttgttaatcacctcagctctaaatatgattttaggatttcaggttcctaagactgcaaaagctggtggctgtgtagtcatgctgactggatctacgcaggggaaagatagagccatccctgccctatcagatgaattattcgactcatccagataaagcactctggtcaatgggacacctacgggctcctccactccaaacctcccagggatcagtcagttctcactttgtggggtcctgagtctactctcctggagcttcggctgcttcttttgttgtttctccctttttaacactccctttcacctcaattccttatagcaaaaagtttgaagttggaagggatttaagaaggaaaaaaaatagaaaacaatccaaaagaaatttgctagaatatcttttgctcatttaacaccctgaggttaagcttctctaacggcatgtaaatccttgggctttttttcattactttatgtacttgcaataaaaacattccttcagatgttagaaattctaactaaaacaagaacaaagagtgttccttcttttcagctctccacccaaagttatcattgtaaatcaaggtaagaaagtaaattaactactggcatttaaatgtttgctgtcccaaatatttattctttcccactcccccaaatttgtttcatacaaaacaatgctcataaaaacaataaatattcattctttatctaccaaaatttttagatcaaagtcctgtgggcccaaatccgaatagcaaaaagta

SEQ ID NO: 40358 - DNA, 702 bp, Bovine  19866881016174
atcaggagtaattatcctagtaactcttaattctctctatggttagtaattctttacaccctatcattacaacctccacccaaagaaacttatgaactaaaaaaaagcgagggggggaaaatcacacttttttagacaatgatatgctctccttgctagatttccccctattttataattaccagctcccctctaacagcagagctcgcacagctcctatagcccttggcgtttattaagtagagcaccattatcaaagccacacgcctttctctacacacctctgcacagacatctatgcatataaatgtgtaaaaggttaaaaaaaaaaagtttccatgcttttcaagtcttaatgatacagtgtgccaagtacacagaatgagcttctcaaatataaggaatttagagtgctagaggaagtgaggggtgggtgggtgtaagggatgttattattataaacccctttaaatatggaagcaaaaatctcaacactcaaatgctaaaatgaatgcatttcaactctacttgagaataactgtttcgagttccctttcagaagtctcataagaagcataatttaaacgatctacaaagatattttcttagggtagttaaaaggagtaaagcattacagaaatcttctgcaaatacatatatatatatatatatatattatacacacacgcacattttacgtgc

SEQ ID NO: 40359 - DNA, 1223 bp, Bovine  19866881118873
tctacctttggagagaattgtcctgttcagataaaagtagaatgtgaagatgcagaaaagtgtggatgtactggaaagggaaggtggaggagttctttccgatgacttcactgaggttgtagatatctcatcttccaagacagcaggtgtgggggttcagggccttgcagagagcagagagttttgaacagctgctgtcgagagtgggatagggagccgacacgtgtccgcacgacagcagggaagaagattgtcagaggcccaccagaaacacgaatgaaagggtcattccatatgcatctgtagttcattaagaagactgtagcttcctaaaaggttctcatgcgattcacatctgcctctgctataggtttaaaaagtcggtcagtgctgcctggaagtcagcctccccaccctgtctgacaaacactcctcagatggaccgccctccagcccacctccagggccagtgagacgccggagctgtcacactcacagagacccattgtggcatgtcagaacccaccgaaaatgttcctcctgtgcattatttatgacttttctgcatttatataatatccagcttcctgaaagtaatttgttttggattgtgtagtgctgggcagcacatcaaaggtatgctaagcagtggtaataaaacattgaggtttatggtcactgaggtattaaatatcgctcataaattacagggtgagtattttaaatgagctatggctcagagaacagtaggcgccccctcatagcacatattaagtgttggtgcctagcttattaattatcaatagtttccaaggctttgttgctgttgttttcgtgaagagccaatctcctgccctttctacagctctgtgagtgtgtgtgagtgagtatgttgtatgcatgggctggcaataagcgtaataagaaatgtgagggtactctaggatactgtggagtctgatagcccttcatttaagaatcgagtatccctccatttgaacccctgccactgtggttgctgtctcctaaccaggcatgctgcttactgctgccgactccaagggcaaagtcagaagaaccctacagctttgtttcacttcaggttctgatcagtttgaatttttggttctaaggctctgtccctgtgattcccaccctttcctgccaaattgcgtcctgctgacaacgaattaactttcacagactccatttcagccggaatc

SEQ ID NO: 40360 - DNA, 940 bp, Bovine  19866881162207
gaactctaaatcccatagccataaacctaatttaaattttaatgttactttaaaaaatcacatagttatctgggatagattcatggatgatacattaatatcaatattttatttatattgtatttgaagttttagatataacaaaccctagcaagcatttgaaaaatacatgaaacaagatcatccgatacttatcttttgctttggaaacaatccgtatgattctgggtcctcagaaaaattctagcctgcttagacaaaataatttgttcttaatcctgaaactctaatgttaattttatggtaacagagataaggatgtgaactaagggttgcacaaagcagacctgtaatgtcccctaattatccctagccctcttctcctatggcatttgcacagtgctgggcaccgcttgctattcaaatacattgttattatgatgatttattcctaatgcaaaaatgtggaaacagtagaaaaattcagggttctaataacatgttaagagtggagatgtttaaagttctgagatatacatatatatatgtatatacatacaaaaaattacagccagccatttattgtgttgagcattatttagtctaaaaatatttttatcacaaaattattttgaagcccactttccagtatatctgagaagcagagtttaattgacaaacattcagttatatgggcttcccaggtggcacagtggtaaagaatctgtctgccaatgctggagatgcaagagatgcagggtcaatccctgggtctggaagatcccctggagtaggaaatggcaacccactacagtattcttgcctggaaaactcatgggctgagagcctggttgggttatagtctatggggtcacatagagttgagtacgattgagcatgtacacatgcagagatacatatgtgtgtgagagagaggggg

SEQ ID NO: 40361 - DNA, 1718 bp, Bovine  19866881399300
tcataaaatgtgttgtggcttccccctccctctttctctctctggctttctctctcatcacttatcccagagaagcctgctgccatgctgtgagggcactcaagcagtcccacagaggcatccacagggtgaagaacaaaggccttctgccaacagccagtagaaacttgccaggtacacatgtgagccaccttcagatgactgcagccctggctgacatctggactgtagcctcatgagatgctctgagccaaaactaccctgctaagtcactccccagtttttgacccacaaaggctggatgagataatatctcttcctttaagcgactaagttttagagtgattttagcacagtgataaatacctaacaaattggggcactgggcctctctgctcctcaccactgcctccccagggccatctgccactggtgagcagccccagcagctcagagcctatctgtgggagtgtggcacggcactcccttccaaggtgagagcccagtgaccacagacacccttgcttgaggacctcagcactggcatcagcgatcgcacagcagctttgatgcctcactggtggttacccagcaaagcacttggtgaaagtgtacccggacaattttctgggtccttggatgtttgctatgggcgtgaaatttggtgtgtctctaccctcctcccgaacctgttttcactttcttcagtctccatcccaaaacaaaatgtacctttgagaacagggctgtttagaaacacacacacggtgcccatgtctactcctgaccacagtctcctctcctccagctccttctcactcccacctgtgttttcagacccacggtcacacttgaccacaataaggacctctcccctttctccactccccctttactgcccccaataatcccaccatccacatcccctacatttcctggcacaaagacagtcctcaacaggaaatagtacattacacacgtctacacaggcttttctccctggaggaagcaataaagaaagagtctcggtcaactgtagaaagaactattgtagattcgtggtcttggtcaagaaattctgctctagttggtttggcaataataacaacagtaaagtaataatgcttagcttccttttttgacacgattattttatattaaaattctttcaacttgaagttctttaagatttataaggtaagaagttagtttcaactcactagatcccccaagttgctctaaaatgaacacctaagtatcaacattaatcaaatgcctcctgctttttcgcagtgcaaaagtgagacaaagattactttattcttaaacttttttttctccatgtttttgcctggcttgaaatcagactcatgttctataaaggagcgattaagtacaggcttctattttaacaggatgtatttaaggcagccacgagtattctccctgcaaaagttaaaggtcttaatcagaaagaaaaatgtatttcccatattgacataggcgtcacttattgttactgtccatgaaagtgtaggatatttcagctttgcatgaataggcaggttccaacacaaggacatctgactccaggctcctcgtgtctgagtcttccactttgctgtcagagagaaattcacatttctgtccctgaacacacgcagttttcaagtgttcttctatactggcgcctctctcctactgtcttccaccccaaa

SEQ ID NO: 40362 - DNA, 788 bp, Bovine  19866881417550
tttagcacgggttggatcttggatgggagcaagctctcacatcagcttctgtagacaatgtagggtgaactctcctacatcttcaggaaaggttgtttcatccacccgcttcctgggatttgtgatttcttcagcaacccaagctttggtgagatgtacacatgctttgtcttcagcaacagggactgccattccaagaacctcctaccccaaagaagtgctgtacgcctctgtcattttccaaatgcacccattttgacacttgctggaatttggtttattaaaaaaaaaaaagtccactattctgggtgcctgcctttttgtaaacctcttttctgcttggtcacacgagagacagcgcaggaggctgaaccaatcctctatccttgtcttcactgccaagggcagcccaaggaaaactggtgtcagcaactagctcagcccctggacgttttaaccaaggaggccacatgagcccacaatcctggaagctgaagatctgtagctgggaccgcagcgcccgtaaaatacaagaccatttgtgtgtgcgctctccaccaccttaatcactttttggcaataagccacggtgtaacccccttgagatgacaaaagaaataaaagctccgttgtgatcaaatgactcatcacacggcatgctagcatctgaaggtgtacagcaagcaggctcggcacacaatcatgctctttagtcagtttcagtggggtgggggtggggtatgaacagcaaaggtgaggagggctgtgatgataaactctaaactcag

SEQ ID NO: 40363 - DNA, 1525 bp, Bovine  19866881419659
ttgtgtatcagtttaatacgtaactatttaccctctaaactactctagtgcacatgggaacatgttttctgtgcatgcaaagccaccaaaataaaacgatattttgggagcttttctagtggtccagtgattaggactccttgcttcaaatgcagggagtttgggttcaatcctggttggggaactaggatcccacatttcctcatggcatgaccaaaataaaataaataaataaataaaaataataataatatattttgtttagtttctaaacatccatggagccaagatcagaaatgtttgtaatgttttcatgttgctaaaacttgtactccagacagccaccaagtaaccataaatagggatgacattttattagactcaaaagagtgggttaaaaggttagaataataattggatcgtattatttaagaatggaaaatccatttgctgcagaacaagaaccaattaaaagacatgaaaatgatctgtaaaatctcctgcacactatttaacactaagttatttgtagtagcttttagtgctattcatttctttacaagtaggtttgagggagagattagatgacaagcaagctctattttgggcaatggcataagacagtcttttttttcttccaattttattggtatgtaattgacatacggcactgtattaagtttgagtttcacagcataacgatttgacttacatcatgaaatgactatcacagttaagtttggtgaacatccatcatcccattaatacaaaatttaagaaatagaaaatcccctaggatttgctttcttaacaactttcgtataaaacatacagcagtgttataatcaatcatgttaaaaggtaagacgcccttatcatgttgtacatgatacttatttaccttagtacttatttaccttataaatgggagtttgcgccttttgactatactcatctgatttccctgcctcccagctcttcccaagaagtgtaatctctttttttctatgagtttattttgaagcatgattcacctacaacactgtgttaattcctactatacaatatagcgattcaatatttccatacatttcaatttggtcaccgtggtaaatctagttacaatcaagacaaaaatctgcttccaaattctggttttctctcttattggcttgaaccaagcttcttaatttttctgtgcctgttttctcacctataaaagtgagaatgatgataactcctattatattattgttggaaggattaaatgagataatatttgtaatagctatcagttcttaatatataggaaggctcaaaaaaaaattttttttttcctagttgaacaaaatttcccaaaggaaaattagttcttggtttgtgtaattagagctgtcagagttgatccatgggcctctaaaaggtattgtcagatcgtggcaaatttaatataacaagcataagaaatgtgagcaatgtcacggatggggggttaagggtaaaagtttccaggctaatatgaaat

SEQ ID NO: 40364 - DNA, 1328 bp, Bovine  19866881465405
gaaatgaaacacaaaattaagaacttttgactcattaaaaaaaaaaaaaaaaaaacctgacaataggaaaaggaaacagaaactttaaaacaaaacttttaaaagtaatttaagaatagtggatgcattttaaaacaaattaggaaaaagaaaattaataaactggtaagatgaaaatggatgtgagagttggactataaagaaagctaagcaccaaagaattgatgcttttgaactgtggtgttggagaggactcttaagagtccctttaactgcaaggagatcaaaccagtcaatcctaaaggaaatcagtcctgaatattcattggaaagactgatgctaaagctgaaactccaatagtttggccaccttatgcaaagaactgacccattggaaaagaccctaatgctgggaaagattaaagacaagagaagaaggagatgacagaggatgagatggttggatggcattacagacttgatggatgtgagtttgagcaagctctgggagttagtgatggccagggaagcctggtgtgccacagtccatggggtcgcaaagagtcagacatgactgagcaactgaactgaagatgaaaatatccagaataaaaatgttataaaaggaaaacaatcaagaagttgagaaagtataacacattgactgttaaagccaagaagcaaggagagaaaagattgaaaagaagcaatatttgaaaaaataatgactggaaattgatctgaacattcaaaaagccctactacatccaaactggataaatacaaagaaaaccacatttaggcacatttaggcatatctggaagctagcctccaaaatgtccctccagtgatccctgtggggatttgatgcttggggaatcagtacaaatgatgctttctggctactactgttgtggtgagtaataaaccatcctttgtctctcatccagaagtctcatgtcttctgccagtatctatgaaattgtagtaggctaattcttagcttagagtaattaccatttctttttagtagtttgaataattaagttctagtcttagcaaatttgatgaatgaaatacagtattgttgtctatattgttcatttgtttttaaaataaaattgaaatggtcatttcactttatataggaaactgatttttttttttttttggtagtgttttgaccatttggtttatggatgatgaaccagaaaatagaacgaaagataaccactttttggttacctccataggtttttttttggggggggggtgggggggaggggtcagtgacaatccattattccagatggggagttgggcaaag

SEQ ID NO: 40365 - DNA, 2587 bp, Bovine  19866881490092
cttgattcatgtactgttgaagcctagcttggaggattttgagcattaccttgctagcatgtgaaatgagtgcaattgtgcagtagtttgagcgttctttggcatttcccttctttgggattggaatgaaaactgcccttttccagtcctgtgcccacgatgatttttccagatttgctgcatattgcagcgctttaacctgtagagggtttgtgaacataaaaaatgtatgaaattataaatgtctttaacattacttttggtagtaataactatggtgctagtaaaaagtgctagagtttaaggcaacaagttaaattcagtgaagggaggagaaactggaggagatacaaaacagatggagaaagttctagcctgatgatggaggggcagtgttagtggaaacaataaatttagaaagaggagcaagttttaggacagacgtacatgagtttgacttaaggactattttatgttttctatgttaagaaaacaaaaaaattaacccatatctgcaacccagcattttacattatggacatcattttggtctataatttatctaagtcagcaatgcctcacaagtatcacttcacttctaatgctgcctgaaccttgtgtagaagcctctgtatgataaaaaatagaagtgcatactgaccacaggtgagggaggaatagtattaatatactactgtataatatctaatgaattcactttacttgcatttttcttattaaatactcactatatcactgtggaaggaacactaccagttttcccgtcttttcattcaagatagtgacacacacaggtttcattgttcactgtagtctcagagtttagtaagtggtagaacttggattcaaagccacatagccctgatttagaagctgggacccattttataaactagttcctccctctaaagaataatcctgagttagtgtcagtaaattatattgaagattaaaagcgtctgttatatttgtgctttattaaacaatgtaagtggtttggctctagtggtggcttaaataagttctcagaatacttgaaaattgtcttctggtttattcaacacataatcatgtaattgctcaatgtgttcttgaaaagtcccaggaaatatttgtttcttgggtgtatcagccacattttgataaatgcttaatttttatgggaattcctattgcttaattctagggtcccagtgtccacatatcttaaggactcaatagattaatcaaatagcagtgtgcgcagaggtttttgtcatttttggaatctccttggtgaatgatgttgccaccttattccataacaactgagttttataggcaaaaatctgctgccaaagagtcttctttgcacaataagcaattaaaatgtggtaggtgctttgtttctaggagctgtttgtagtgatttttgtggtatcccgatattaggttaagtaagagaaattagcttagaattaactggaattgtgatcatttctgagaagttataacagtgggtttccttaaaaaaaaaaaaaagaaagcttttttggtaagaagataattattagaaacaatcttctttctctcaaaagaaaatgtctctgttgttgttttaaggtaatatatatatttttaaagttaggggaaaattcattaaagaacagaaaaaaatgcaagtgccttctgtcacttatataatggtttcatttatgttttccttaaaattttctttatccaactctacgtataatacaagttttttttaataagatggctcataaggttactgttaaaatttttcatcaaaaatatgttgttgctcatcttcccatatgaataagtaaagatctatatcatcatctgttgccatggctggatactacccaggtatatgagtattttagtttattgattttatcctcaattatgggtgctttttgtctttcttattttaaacaatgctaaaatgaaaccttgttaaaaatacatatttataatctatttttataagttatacagaattaaatagattatagaaataagtctatttaaatagacttcagataaatgtgtttttgcgtatttatgtttatctgaatcactggatcatatctttcttgatttatgcaagctttttatatataaatatatatatggctcagcaggtaaagaatctgcctgcagtgcaggagacagaggagacatgggttcagatccctgggtcaagaagttcccctggagaaggaaatggtgaccactcccattattcttgtctgaaaaatcccatggacagagaagtctggtgggctataggccggtgggtcgcaaaaaagtcagacgtaactaagcaaataacacgtgtttatatataaagcatattaaccattttgataacaagaaaatgctttccagcactagcttggctcatttcatgtaatttatttcagaagaaagaccctcttttgactcttgtaggatggtacagtaaccagagaaaacatgttatttcctttcactatcagaagaagttacctgttgtagcagtctctgaattagccctcaagtctagggttaaacgagt

SEQ ID NO: 40366 - DNA, 1002 bp, Bovine  19866881845482
ctcctcccatcccatgggattttccaggcgagagtactggagtggggtgccattgccttctccgcttcaagcaactaagtttgtaataatttattgcagcaataatggaaaactaaaacatttatatatacttgaaattttctaagagagcaggtcttcagtgttctcatcaaaaagagtcacgatgtgagacaatggaagtgttatttaacttaagtgtggcaatgatttcacaatgtttcaatatcaaatcatcatatggcacactttaaatgtatgctattctatttgtcaattatacctcaataagactttggccacctcatgcgaagagttgactcattggaaaagactctgatgctgggagggattgggggcaggaggagaaggggacgacagaggatgagatggctggatggcgtcactgactcgatggacatacgtttgagtgaactccgggagttggtgatggacagggaggcctggcatgctgcaattcacgggtcacaaagagtcggacacgactgagcgactgaactgaacaggtcaggaagttaagatgctaagaaatagcatggaaatagggttttccataaaaatacatgaaacatttttaaatatcaagagtcattatgttataatattacatgaagaagcaagacacagaatttatattgtatcagtatgtttccaactatatttttaaaataagccttgaaaaaaagattcaagggaaagatttttcaatggtgagatcttagggtgttttttccttctttctattacttttttgtataagttatattcaaatggctagttgtttcactttattcaggtctccttgctaggaaaaagaaaataaactgcttaaaaaataattacaatgcagtatgctatttgtaataatacatggaaggaagtgtaaagccaagggctggcagaaaggaacggagaacactgggagagcatcacagaggagcggggaactaaggggaatctcat

SEQ ID NO: 40367 - DNA, 819 bp, Bovine  19866882056160
ttgaagtgattgaatctgcccatcacggtaaaagctggtgtttctataaaagcagtctgtacaattgaaatcctttagaaaagagatataaataaaggagcagttcaaggactttcgtggcagctgagtgattaagactcagagctttcactgccgcgggctggggttcagtccccagttgggaactaagactccacaagctgcatggtgtaagaaaaaaaaaaaaaacacaacaaattgtaaatcccaagatagacatcataggttaagaatttcaggaatatcacagagcaatattttaagaatagtgaagaataaaagcaaataattgaatatacaaaaggaatgagggattagtgttctctatcttctttgtttctcctttttaatttgtatcccaccaagaagaacataagctatgtgtgatgtagcagggccagttaaaatcagggagtcctcagggtcttctgaaggaacaagtgttaggggcctgtggctctctgaaagtcatttttgctttctaaagcggtactttctgcttctacagccccatttccacttcaagttatatgttattgttgcaattttcttcttcccaggggaggaaaatgcaccctggatttttactttccttattgtaactatttcagttcagagatgatgttgctatcggtatataaaatagtaaggatgtagaagtcagcatttggtggcccatgtttcattatgtttaggtcagcattaactagtagaagtattgtgtgtatttgttactgggtcacttgagtgggttttcctaattaacattttggtgtgtgt

SEQ ID NO: 40368 - DNA, 3279 bp, Bovine  19866880369935
aaacagttttatataaatgactatggaaactgttcttccttggcagtgtctgggagaagcagatgtactacaattgatattttttccctcaagaattggcatgtattgattatctgcaaaattttttaaggaatgaaatattattaatcaattagatttggactaagtgaatgttttacaataccatctatttaaaataagttaaaaattatcatgggaaattatcttgaatataaatctacgtatttaataaatttcctgaccattttttatgacaaatatgttataaacgatgtctgtggtcccctctgtttcacttccttcatactctaagtgattaacctcaaatttggggaatttaaaaacatttataattctttcatgatgtaagtttttattccttttgtttgacatttaaaatatattagtgctacaaaattgtagatactttgctaggtttcatatggtgtgtttaaaaattaagatctagaattgatgagtcttgttaaaagtacagagatattgccaatatgttttagtgggcttttatccttaataaatttttttttttaatgaggatagaattgatatgtgattttaaaaatggtactttaaaaaattagtcaattttgtttgggaggcagctttctggtagtttaattctcgtgtttacatagaagcaagactgtgagtcacttcccaagcagcccctctttgtctcttcagtggcctagggaacagacttgtcactctgaagtgctcacctataattctgtcctccccttcttccctggggcgagtctgaaataagcttatcagatcatatcttattgacaaaaagcaaagcttactggttgacaaaagaagagaagagaacaagtaaaacgtaaatgacagaggtttgatgtaaaaaaaaaaatctgggttaacgtttctaaatattttttgaaagtgggacatacatctttttatatttgcttgatttttactttatgtaaaattttgagtgcaataaaagctaacggttttgtttgttatagttacatgttccttgtaagcaaatctttctatcatatttttgaaagaacttagagaaaagtatgttgcatcttatgtactttaagtataattttctaatagaaaatagatatggctttcagacagaaagtagacagagctttcggataggaagtagaaatattataaatattgaaatcaattattataaatgttaaataattataaggattttatatcatatttaggctacccttttagttcagttggtaaagaatctgcctgtaattcaggagacccaggtttgattcctggcttgggaagattccctggagaaggaaatggcaacccactccagtattcttgcctggagaattccatggacaaaggagcttggcaggttacagtccatggagtcacaataatcaggcacgacttagtgactaaaccaccaccatatcatatttatatcctgtcttcttcactaaacaaaaatagtcttacagaacttttaaatcatatttatttcttgtcttcttgatcatataaaacaatattaccatctccattataatgcagctgatatttattagttgcatagcagatgtaggaacttattctgggtactctgaaggtggtatgtgctgtaaggctggtcactttgattcattctttgtttccagactctttaaccaaccttctaaagttgctctatctactagtacacatagatgagtcaaatccatctcctgactgctagatactggctcctaagcaatcccagagaacaaagaaatctgaccttggtccatgattgagaaagtcaggagaaatgtagccaatgcactctgggccacaaagagagaaagagagaagtcgcttagtcctctctgactctttgcaaccccgtgggttgtagcctaccaggctcctacatccatgggattttccaggcaagaatactggagtgggttgccatttccttctccaggggatcttcccaacccaaggattgaacccagatctcccacattgcagacagacactttaccctctgagtcaccaaggagtacaaaactatatttgaagtgagactgatagcagctaagtagggaaaggtttggaagagacattaaggaaagaactagagctgctaaatagcaacagtttgaggggaagagagccacaataggtaggttttttaagtttttaccagttactatggtggtaagtgcaagcaagaacattcctgaagctatcatgaattcatcctcagtcatccttgttatgagtattggcgaaggatagaagagtttgctgaaatagagaccaatgaggaagaaaagagaagttcatagacttgaggaaactaatagtagcaatgtaatgagactagtattccgataatggtgatattatgaaaagactgatggaaagctaagtggagactaaaatcctaaaatttgattgcagaggaggggaaaaggtattgagatatggagatatgttactaacttaggtttttaaggaacattaccttgcttagctcatacccttcctcggctcttccaggaaagactgttgaggctttccaaaagtttcttataagtttacagtagggtcactgggattcccaagttattatctgtctacattcaggaatgtaatcccttcaataggaagggtcttctctacatggaaaggaaaccacctgctttaggatggtgaaagccgacatatgctgagaaagttagaatggcctaactaagccatgcccattaaatactgcaagacacaataaatcatccacttgtccattaggaatacggggcagctctcagagccttctggtttgtatccagattaacatctagtaatgttggtggagacaacgaagtcattcaaaatatgaaaccagaatatataggttttagaacctggaatgaaagtactgtgtcattaagagttcattataatttgtgtcagaaagtacaggaaataaagcattcagaaaaaagttataccagttcagaatgtgtcacctatcatgttgtgtgccaaaatcctaacaggcatttctgtttacacatggctcttctgaacctcattcctgcctttgacttatcctgtatgaacaacatccttcattagtaaacaaatgaacacacttcttcactcagcagttaaagaaagccactaattcacctgtaagtctcaaggattgattttggggaattatgcctcaattatatatatatatat

SEQ ID NO: 40369 - DNA, 2430 bp, Bovine  19866880442348
atggacctagggattatacagtaagtgaagtgagccgacaaagacaaatattgtatgatatggtttacatgtgagtctgaaaaaagaatgatacaaatgaacttatttacaaaacaaacagtctcacagacttacagttaccaaagtggaaaagtggggaaggataaatcaggaatttggtattaacagagacacactaagttatataaagtggataaccagcaggatctactctattgtaatagcccataagggaaaagaatctgaaaaagaatatatataaatatataactgaaccactgctatacacctgaaagtaacacaatattgtaaatcaactatgtatcaattaaaaagaaatggatgttcttggttaaagtatatactgtatgctaacttgcttcagtcaggtccaactctttgagaccgtggactgcagcccaccaggctcctctgaacatgggattctccaggcaagaatactggagtgggctgccatgctctcctccaggggatcttcccaacccagggatcaaacccgagtctcttatgtctactgcactggcaggcaggttctttaccactagcatcacctgagaagcccaaagtaaacactatatatagcatgtttatatggaaattctagtatgagggcatatctttattttaatttacaatatttaatgacaatatatcatttgctaaagtcatacagtttttaaaacttctcaggtattaatattttatataatttattttaaattaaatgaaaacttgcacaattatgtggtactaaacccaagtgctgttttcaatttttgttagaaaatactgagaagacaaaaataagaaatttatctaagtggcaggtataaatacagtcatgtggctatgagttaatatctaacctaaaagttttgcagcttttaatccaagtcacttcagcttttatccataatatttctatgatgtctcttggatgaaaatacactgatagagattaatgatacaattaactttatgttgacatataatctccatgcagaataatctgacatgacaaactttataataatgtacccattaattttcttttcatagttattcttacatttttcaactcttccaggtggtattaaaagtcatgaataaaacatacttttttaaataaacagaactttacaaaacctgcaattatttacattggtcaatatcttgacagaatttaacattaaataatttaacttcaaacaattctagagatatctatagctcacctctggctgctagtgacatagattttaacagtgaaatagtttctcattttctgtaaaattttctaatggaatctggctatagccagacaaaacagacattcaagagaggcttttgtattcagtcttcaaactttacctattacatataccatataaaattgcaaatctcaggactcatctcagaaaaattaaacccatttatttttaaagtatattcaaaaaatgtaaattataaggactttggcttaatttcatttgctcaagttctcattaattaacactctaaaaaatataaactgctacatctgcaaatgattacaattacaggaatgtgctataagtaattataaattaccagaatacttaatttccccccatctgaaaaacagcaacaaaactaaacacacaaacaaacaaatctggccctagtttttgggacaaaggaacttcacattttaaataagagaagaaacactgggtcgaaatttcttttgtggctctgctttaacataggcataagtggaaacagaatttggggccaataagttaagcatcccctatttttgaaattcacgggctgtgaaagtattacataagagcctttaaatcccctccagtaggatttaaagcatcatcaatatgaaatagcatgggacaagcaatcataatatcttagggctaaatgggactggagagtccttccatatgggcaggagtgctaaaaagcagtcgttttcccataagggaggctatcagattctcctttgttatgaaagtgatcttatagatctatctagcatccagaaaacttactgaaatcaaatgatgtgacatatttcaaattaccttgcaaactatgactagacatttagcaaaagaaatgtaaaaggaaatagatttggggagtgataccgtaacagcatctttctaaggcatgtataaaaatgaaatactatagaatacttttaatggaatatccaagtccatacagcttcctctcccaaatacaagtcatctagctggcagactgttcttaactagattttttttaatggaagtttattggtaggagtatctcttggtatcctgcatatttttaaatccaatgaatacagcataagaattcacaaaagggcaaatcacactgttaagt

SEQ ID NO: 40370 - DNA, 2443 bp, Bovine  19866880503606
gtgagaaatgacatctatatatctgaaacttaatgtaggcaagacccataaaaatgcaatgtgagcctccaatctctctcaccaggatggcacagggattaatcaaatcaaaccaggagaagtgtttcagcgactctagagggagaaatcaaccattcttggagaaaaacatattttccttctattcatctacttaaaaaatataaatggcctataccaaccttcagaaaaatgatttaccacactactaatactaatcctttacatttatatagtgctttaccactttcaagaagctttcacataaattatctcctatagtattagatcccacgacaaaaatgatgattctagaaatgaaacaactttttttcccaactcccatgcacttggatatactgattacttttcccctgatgttatgaactttaatcataagaccttttacctgtgaacattaaccttatgctatgaactgataaataaaattcataattcttgtttacttaacaagacaataatatgcgcaagtgggaaataaaggtgaatttaaaatgaataaggagttaaaggacatgatttgccctttgctagccttttcaatggcacagagtttaaaacaattcaaggtctggtttgtgtaaatttcttaccacctttaataacttaatagcataattgtgtgcacaatttctccctgttctggcaagctgccacaagactagaatctttgtctcgttcaaaacattgtaaacatcattaaaatgccaaaacctgtaaagcacttttacgaagtaatttgcaaattttatagacttaataaggccacagcaaattttagcccgagctacctgatactgcattgtcattccattttatgtcattcattcattcattcgctttttcattaattcattcattcactgcttatcctccatggaatctatgaaggttcgagtgcttgtatcttaaaatctgtgtagatattaggccaagaaaataaaaagaagtagtttagaaagtaataaacacaaacatgacaagtaaataccccacttctacttttttaaagaaaaatgctaaattaaagaaggaagggatgcagcgagatggtggtgaaagatcctcagtgatggaaaatatgtttgcagcttgatctcttggagctaaaaagtgaggttacgtgttactacaggcaaagggaattgcgaaatactcattagaataatgacagcaatatttagaacccacagaataagcacaggagtagagctacaaactgggacaaccttgttcagtcgctcagtcacgtctgagcctttgcaactccatggtctgtagtgcaccaggcttccccgtccttaaccgtctccctgcgtttgcccaaacactcaagtcctttgtgtcggtgatgccatccgaccatctcaccctctgtcgcccccttctcctcctgccctcagtctttcccagcatcaggatattttccaatgaatcagctttccacaaagtcctggagcttcagcttcagcttcagtccttccaatgaacattcagggttgatttcctttaggattgacctgtttgatctctttgcagtccaaggggctctcaagagtttttccccagcagtacaatttgaaagcatcaattctttggcactcagccttctttacggtccaagttttacaaccgtatgtgactactggaaaaaccttggctttgactacgtggacctttatcggccaagtggtgactgtgcttttgaatatgctgtctaggtttgtcatagctttccttccaagaagcacgtgtcttttaatttcatggctacagtcactgtctgcaatgattttgagtcccccaaaataaagtctgtcactgtttctactttttccctgtcgctttgccacggagtaacggaccagatgccatgatcttagttttttgaatgttgagttttaagccagctttttaactctcctattttaccttcaacaaatactcttattgttcaacagagactcttaatgacaatatgtattaaaaataaaaatattcataaaataggacttaatgatactaataacaagcttttctgaagaaataatcagagattcagatgacaatttattatgaagatacttgccacagtgttagaagaaaacaaaaaatgatgtaattcaaacagtttatagtaaaggaatatttatataaatttgtagctgcctgtagagcaatcttatgaaggctttcatgtaataaaatcttaagcaaccgttacaacaaaatgtacgatgaaatcctaatgatgttgggaaatgttaatgaaacaatgttaagaaaggcacacaaacttgaacagttagtaccgtaacaagtgtatagtatctttaggcacacgcacacacacacacacacacacacacacacacacacacaa

SEQ ID NO: 40371 - DNA, 3252 bp, Bovine  19866880568510
tgaattctaactacagctcaaagatgtgaactttcttttttagcatttccattatacagatgcaaaaactgggggaatgagagggtgaggaacttgctcagagtcacacaaattctggcaggatcaggttttggggccaggcttccaagaccatattttcaataactatgttgactcccctctgtagaaacagtactgtagaagtgtcacccagagtgaccgtgggcaagttgtagctttgaagtcaggaagaaagcagcaggagaagatttcaggtgtgtttaaaagacttccatttcattctttgagatcaattcagaaacatttaatttagtttccaatttctctgcctcctttcctctgaataagtgtaaggaccgaggagaaaacagaaggttgaaaaagtctgcatgacagggacagagttaccttttccacttctttcaatgttatgctatatctgtgtgtatgaaatgcaacgggatttttaaaaatcacagatatcctgaaaatggtcactgcaaagtcatctagatattgatttgtgaaagatagaattaaatgtaaaatgtaacaatagtaatttaaactgctaatataagagataacatagatttccactagtggatcccattaatatagaggtaccactgacacagaggatactctccagatcaaactaaacacaagaaggaattaagcttccttttcttcccagcttgctgctgctgctaagtcgtgtcagtcgtgtccgactgtgcgaccccatagacggtagcccaccaggctcccccgtccctgggattctccaggcaagaacactggagtgggttgccatttccttcccagctttaggttacagaaaaattaaacttcagaaaggaaaaaaaaatcataattcagacttcaaaattatagaaaatcacaactgaaaagaagttgttctctgacttcccaaatcctgacaggagcctgacaggaaaccatcctgtcaggatggtttttggaagtcagccgtctaaaatgttgcttattcatgatgttggcaaggtagaaaatactgagaggaaaatgagattgcaatctctcccttgtccagctgtcaaagacgacagcaaatttctcttccacggtagagacaaaacttgaaaaaaaaaatcacattgtcagaaaactgcatatcatctccgtgggtttgaggaacatctaaaaatggatgtaatgtgacagcagccacctggacaccaattcaaaagtgacaaagagtattgctctagtacagtgtgaactatagggaattggaaaatggtaatgaagaaaaagtctacacgtgtaaaactacacagaagacatgattaggccctcagggtgctggagaacagagacaccaagcagggtaacaacttacaattctcagatgcaatgtttcccttttgtcttaactttaatatttcatgcaatcttcttttcaacataactaccaattacgcagtttaatgataacaaatcaacgtccctggtaagatcaccaccttgtacaggacttgtacacctagatgatcgactaaaaagtgattataatgtccactccagagtggaaaatttttttcttcttaaagctggagaagtcaaggtatacccacaaagctgaaatttagaaatatgtaagtcaaggcaagctaatcctcaaagcacgaagagaaaggcagctctaagagcatcccatggaaacatttcagagctttcctctcctcccaccctggtttctcaagccctttctcctcttgatggtattctccagtttttcattttataagtgtgttatattgacacatcttatttgcgaagatggaaaaccatctcaatgattctattcaatgattctattctttcttatctaccatcattattatatatcttgactattggtactctctaattctagtcttcatatgtgttttaatcacttttattcagtaactttatgtaaggagattccatcagcattagtgttttcttcctctaggtttccttattcttgcctgtaattgatctgcttttgaccttcttccccaaacagggaaccatattttattgacttttgaatctctgacagaagccacagtcccttacacagcctgtgctcagaaaattcttgcagatacaaagtacaagagccagaagatgttctagaacattttgtttctattttcttacaaaaatacataacatacagaaacatctgagcacagctgcatacctcatgaataattacaaggttgggcatctagtcaacctggtgagggattaaaacaaagtctctgtgcatcattttctctcttctacaggactcccatttggttttccaggatcactctggccttgcttgtctcaacactgcaggtgtttcctcttgagccccagaaagggattcagttgtttaactgtaagtgctacagtgactctcagttaaagaaaggagagaggaggagagaaaaaaaattaatcttctaaccctttgtctattccagattaatgaaattccgtaggagaaacatatccttttatatccgttctctctttacttcatctttaagctccactcacttccaaactgtctactacttagctttagacaatatggctttgagcatgatttggatttattactttagggatggtggttagagagtgtgaagttgggaagtttgggggctgtccttgggggtaggggatggggggattttaaggggtgaagtgggagaactatgcatagtttcaggtcatagtaattatattctctaaaaactgtaacgcaggatgaataggtatctgtttagagctttgtttcctctcagttttacagacaaaatgacaagagagtatctatccaccatgtcaacattattcccaaatatttctagttaagaggaacttgtgaaacaaattctatcatgaaaaataaatcagaattaaactccttttccattcactataatattaaaatgacattttaatagaattcttgttattgtagctgactagtctgtgtattgtaataagaatagaattacatcaagtaaacatgaagataaataaaccttcaaaacgaactgcaaagtatttaaacattaatagatgcagtaaagcaaaacataaataaatcaaattctattttttcattgaacattagaaaaagatagtttataaaaattttcttaaaattgtgtattctgtccaatgtgtcccgta

SEQ ID NO: 40372 - DNA, 2200 bp, Bovine  19866880637830
tagcttgagttgtatgtatcaataaggaagtcatccttttgagggatggatgcttaatgaatatggattatgtcctgccctttgttataattctttatagtgttttgcatacagtagtcatttaatgactatctcttaagtgaactttttaaaggccacaacttgagatgaaatttgccatttccatgctgctgtatttctcttttactcttgtgtgttgctctgatcacatactgttcatgaaatctgtgactctttataaattttcaatgaacacatttttttttttatcattgatgttctttctcttgaaaataaattcattatacttcccttagatatctatgttaaatggagaccagcatgggtaaattttttacaagtgaagaaagtttatatagtacatgttcattaaaaattcaaacaataaaaaacaaagtgaaagtgaaaattattgatacatacattgatttaaacagcaaattgaacattttagattaagttttggagaaattttttcttatgcacataaaaatatataaatatttaaattcctgttccaaatatttactgtgtgacaggctaggctttgcttgggtacctaaagctactggggtacttgttctgtgtttctcatcctgagacccaagctccaggaacagccccagtctgggatatgacagagcacaggaaacgaaggaatggagagagagaaactgagaaagaaacagggaattttaagcttctgttgccttgtggcaaatatcatgtcttctcatagtctattggtttaaaacgtgccttgtgattattttccacacctgacatttgaccccagtgttggctctcctctttgttaagccccactcccaaccagggatgcaaatttattttcatctatggttccatcagcagaattgttcagagaatttgggcaaagccagacttcatgagagggtttatataacatgcctctcaggctacaggtattgtggggcacggggtgatcacagagtctctaggagaggcctctggttttcaacgttgaaggctttctgttttcaagatatccaaaatagacataacatgtattcaacctattctctctttagtctgaaaatatgtgcttgcctaagactaacagctctggacaggaagctgtgtccttgaggctttcatcctgaaagggggataagcagtttcaactgaggccaccctgccaactcaaacctgctttacctccttgtggtctgcagggaaagtttttcccctagtcttatctcccaggcagaattctggagttaatattctagtcaacagtcctctgaccacaaagttcagcaaggataggagatgaagatgcatttttgaggagctgtcattgactggtctgggggaaaaaaaaaaaagcaactatagaaaaatcctaaagagagtgttaaaatgcaaatatctcagctgtataatcgccatgtagttatttctgtgctttttcaggatcgagcagcagcattgtagtggcattacggctgtgtgcttattgcttttacagtttatcacgtcatttccccactacatttatccaacttctagaccaggggttgcttcaccaacaaagtgaaggtccaggagatgtcactaaaatattccttttccaaccttccaaaagcagaagctgtattggtcatgcttatagtagataaagctcactgatgctgaattctcagtgctagaatgttccattataatagtgttcagaaatgagagagcctgttttgagaagaaatataaaaaatgctaacataaaattattaattgtccagaaaatttttattaatggattataagaattactttatgactgatggatttatcattaaaacagatgtagggatttattccaatcttttgagaaatcctttattttgatcagtagtatatttatatatgtaaatccctacttatattgtcgtcttaatttaagttgaagtcttgaaatggcaaatattaggcatatgatcaatgctaaccattgagtgaagcatcctttgaaaaatcaagaggataaaagcagagtcaagagtataaaattaattctcatgtaatattagaataaaaaatgtaaggatgtgatgacaaatggtaataaatgctgagtttccctaatgatacgggacacattggacagaatacacaattt

SEQ ID NO: 40373 - DNA, 940 bp, Bovine  19866880653942
tgcagtgcaaggaagctgtgcccctttattttctggaccgggagtggactagtctcactgttccgacagcaccctctgtgcaccctctacttacctcctcaccccatctctgggccccacaagcctctgacccagtgggagaatctccgggccctcccctccaacagaacctaacagacagcagtgaggggagccgagtccctctttgggaatgtatatccaggtgttagtggtgcccttgagcctgccagaaaccagggagcaagcagactggactcgatggtgcagctgaagtggccccgagcggaagaaggaagtgacagccagcccagagcagcagtctgcgcagccaactgggtggtcagtgagcatacgtgaaatttctcctgggaaccctaatatgcttggtttcgctgatgggagatttttttagaaatatgccttagcagatggtcaatatacattatcattgtagctattactgcatgagtaactcctggtgtgagaatatgtaaaataaacagatgaaagtaagacatcttttaaaaaaaaaatcccttggggataaacatttatgttgtcatttttaataagttcatgaatatgcaaagtctgcatgaacactttgactgccagagatgttaagacaaattggcctaatgatgaagtctgtgggactaaagggactgaagccctgggtcaggctgcacagacacagagcagctttttacggcgaaatcacagtgtcaagttctcagtggtggaggtcacaggaaggcggctgatcacaaccacgagcaatgctggctagcctgttataaagcatgctgctgctgctgctgctgctgctaagtcacttcagtcgtgtccgactctgtgcaaccccatagacagcagcccacgaggctcccctgtccctgggattctctaggcaagaaca

SEQ ID NO: 40374 - DNA, 630 bp, Bovine  19866880678945
cttagtaattatgaggccttattgagtatgtgttgctgtatacaacacgggttttatctctgtgttacacaaacatgacaaacattttagctaatcaacctataattgcagggttgctactaatgtaggcaagtacacattgaatatcaattcacagtctaacaggagaaaagctccatttccaggctttcctttcattgtttccaatattttttgatgttcttattggtggtagactattatcttgtatcattaaaattggacagggcttattttatggaattttactttagagagaatatttgaagcagaatatcctctacactttatgaatatgtcttttattcatgtgacagcctcattcgaacttaatctttaaatcagacttccacagcacagtatcagagcctttctgcagacactggtgatacctgctagaaaagataaagacagcttacttcaccacaatgacaagaaaacatcaactaattggttacttttatgaggtccctggaggttgtgtgctgaccacgtgcccaggtccggctcctgtgccctcatgtatctgcgggactcaggacagtcatttgctgaaggtggggcagggcgttaaggtggtaactctaggga

SEQ ID NO: 40375 - DNA, 2427 bp, Bovine  19866880783602
tcttctaggtccttaagctaaaaatgcttccttatggcagaattttcttaaacatctccagtgttgttaactgtttgaaagcaccgctgcatgaagacagccggctcttccactgtgggtcccagatgagggagcctgcgggcctccttggggggccctctgatcctgtacaggctcaccacccagggaagcccctccacctgctgaggaagtgccccgggaaccccgaggaatggacggaggaagaagatcctccagaacacaccaccgaaatgaaacgagaaaactgagagcaggcatctcgtggctaaggagacacatccagagggggctgcatccaggaggccgaagaagacccattccagaaaggctggccagccgtatttaaccctgcccagcagccaaggaagacgcgtgctgagctctgttctctactcgtaggtgatgagaacagaattattccaggggagcagtgagaatagaggtcagagttgggtgggagatgtcagagacgtgagggtcagatggcggcggtggaggttcagcagccaaaagggagaagagggcagctgtggcagggcgattaatgcagggcagggcgttggggaatttatgtgatcagacccgagtgtgcgcaaatgccagtgaggaggaaccagcaggaggcaagagttaactgcagagagcagaaagggagctggcttagaaaggagatgggatccacctccagaggagggcggggccttgggtgggcacggccctcttgcctggtgatactggcggggcccggtcggccacaccagactgcatttcagctgagccggcagaagagcactgtcacctcccttattcagctaaggtgttttctcacagtcagccactgttgttttcttctggagttgattagcaaaaggacacacgctttcttataagggcccccgctgagtagcatctcctctttccacgcatatgcctttctgaaccaagttcaggttctaacatttctttcctttaaatgccattctattagatttaggtcacgtttccaatttgtcaagatctttttatattttaatcgaactcacagcataccgttgacgtgtttcacccttgtgtcacccacccattaaaatatcagctgtatatcttcacccaaagagctgtcttgagcttttctttaatttccattccatcaagcgccctgccccccgtccactcatagagacttgggtgaaggacaattagactggatgctttgatgataactgataaagcgtctcgtgctgaggagtcctccggaattggattaagtggactcatttgtggtttgcggtgtttatgttttagcgacacagagacgtgaaaactctcactctgcctgtgttcattctcacaaatagatgggtactgtcacttttcaaggcctgtccatctggaatgcatcacaaacacattgctgggaaagtaagagccccagaaagagcctcattttcccctgcaactgtgaaattgagtggtctcgtttcttccatgttgttgtaaaatcacaggagtgtaatgtaagctacatttttaaccatttgggatggctttagattgaataatgcttcctgccagacatgttttccctttatttatcacttacttttctctctaatttcagcaacagcgattgctgattatggaaatgactccaattgttcaacctcccataaccacatttagtcaccaaaagcaatttatctgctactttcaaaagctgttaaacaaacaagcaatttattccagccttcttgtaagtaaccaaagaatacagccaagttctccttgctccttgcatcgctttcagaactgtgagtgcctttttctaacttgaatcaaaactggctgtttcctaaccactgtctttgcaaccagtaatctgacgcggtgggcttaattcaaagcaggcactcacattctttagactgttggtcagtcttccaggaaatcaagaagaacaacaaaaataaacaaacactggccctaaattaaaccaactagggcggaagaaacttcaatgaatggtgaaacaaaattaaaagaaaaaaacaaaaaaggagaaataaatagaaaatattccaagttctcacttgccctggccccatgggcacccgctttatcttcctttcctggaggaaatcaaagcctctcccaagagcaattattccggtcagtcccagacttccacagagcctccctctcgcctgccccagcaggtgagcacacctgaggtccctgcagagacattcctagaggtttctctgtatctctattgccagtgtccctgcagaaatctctgtactgaaataaagcagactcccttttgagttaaccccagcttggctcctcacagccacttctggtgctgaacagaggagccttccc

SEQ ID NO: 40376 - DNA, 1763 bp, Bovine  19866880830395
cctgaaatggtctttgctttttaaaatgaataattttgccatttgaagggaagagtatattacagctgcaaagagtaagctgaatgtttcaaagaactattcctggcatcttttagaataagacacatttaagtcaaagagatggctttgggtgagatcagaggcagatccaaggttttagtgggggataaaacttctggccatttcccaaaatctccagagcgcccccttatttacacattcatttgtgtgtatctcatcgttatcaaatgcactcacatatttactgtgtgtatgaatttcctgacagattaatataaattggtctctgcccaagttctccagcagttcatcattggtctgcaacctgcagttctaacgataaggcagtgagaaccacatttcatggctttatgggctatatttggtgactgaggtttgccctaaggaacccaatatttaacctagaaatatttgtgaacaggatcattttcctgtcttccttttcctttatctagaggtcactgccactagaagtatgaccaaactgagaaacaaggagtaaaacagattttcaagttaaaaaattctatattcatagaatatagaatacatagatatactgtcaaaatagttaatcctcatttaaatttttattatattattaagtgctcaatactgaaaaaaggcaggaaatagagaaaaatactaaaaagaaatgaaaagttgcccaccatctacattttgtaaaatgtactaagatagttctgatacacagagttgagactgttgctgctggtgattaagaatgacaagattattacattatctcatagatcagtagactactattgtggcaaactgtacttcctgaagatgactgcaacagtatttcccagtcctcacagtcttctgtgactctgacactactcccatggagaggagggtgtctgtgttccctcctcttaaatctggatggatctgtgactaatggaaatcatataagtaggtgactactgaggacaagttataaaaatctgatggacttctccccgtttctcctgagatgctcattcttaaaacccagccaccacgcctatgaagaggccaacttggagagtacagaggtccccagcacacagccccggctgcgctctaagcagaagtcaacactgactgtgtgagtcatccaacttgaaggtatatcctccaggccccaggtcagccaccctagctaatgccattgtagacggagatgatctgtaactattgagatttgtacacaaaatatattattgtttttgttttaagggcactatggttttggggtggtttattatgaggcaacagagaaatactccacctaatagctaatagtaagagcaagtacaactgaaaaggtaagcatttattaatactacatggcaaaactgtaaaagggttttaaacattgtaactcagttaattctcacaattaccctatggcattaaagtactattactccaaatttacattttaggatattcaaacacacacacagattaagtaattcacctacaaattaattaactgagcaagtagaactgggctatgcaccaggaggtctggctacaaagctgatgcccttcaccacaacactgagcagtgggagcactactatctaattaagatccgatagtgtgcagctgagtcaggatctgcttccctagatctgcttcctctctgctcagccacattcttctcttcctaatagaaagacaca

SEQ ID NO: 40377 - DNA, 1794 bp, Bovine  19866880841899
atggaagcttgataaaaagatgagatttgaagtactcaacctgttaggaataagtagttttattgttgatttaagctggtagattgaaatatctcagaatgctaaagaggcagagcagcaggtttcaggtgattaaagaaaatccctcatcttggaggaacttgaagggacatgatgctatttaagtagaatctaatcagaaagaagaaaagcttgaaagtaaaaagacggaatgtttcatgtcgttatttgcaaagcaaccgaacaaaaggtgagcaagataattaagtgccttgctgctgagtagaatttttcaaagtgggttgattagaggtctttcttaaaaaaaaaaaaattaaacatctaagtctaggaaatctagttgaaacagctaactcagttataaaggtggagaccagtttgggagaaaatcgacagtattgtgtgtatggtggcatatgttcacaatgatgagtttaattgtcagcaaaatcctgatcagttctgaatagttttagcattaatgatattttcctgtgttttaggtttttgaaaaatgggaatccaagcagacttaacatgtgatggcactaaatagattattttccagtgccttggttcctccatttttcagttgatctggataaataggacttgattcttttattttcccttttgcctgaaaaaataccaaaagcgagtattatcagtcttattataaaatgttatttgtaactgccaggcgaaaatgggatgtcatttcttatatctgcattttgtgtttcaagacatttctgatgataacatgaggaaactgacatgtcccagattgtgctttgtgaacttcatgctggcaaggctctgccttctcttgaaggcaggccaggtcaaagcactgatggatgcattatagctgaaaatgaaaaccaggaagtcatgaccttaggacctacttttctaccaaggaaaggaagcttgaagctaataagttatgccagtcaaacacctagtgggcatatgtttttttgcattgttcttttactctttcaacattctaatgacctcaggcttacttagtaatgcatccttttgggggcaaacatccagcagcagatcacttcatttattatcactgaatttatttatttcagtcagtcattgcagagctttgtctccaaagaattaattataaaagttaaagtgatcctcagtcacctggcagtccactgtgagtataaaatggggaactactgtctgcctttgagcagtttcaaaggctggttttgggactgtcatcttggactgttgttgtttagttgcttctgtcatgtccggctcttctgtgaccccatggacccaccatgtagccctcctctgtccatgggatttcccaggcaagagtactggagtgggttgcatttccttctccaggggatcttccccatccagggatcgaacctgcgtctcctgcactggcaggcagattctttactgctgagtcaccagggaagatcactgtgattttggatacccatttgaaaatcaaaaatgataacaggcccagacattctcagctgaaacagatgatctaaatacgtaaattagagaaaaaatcatttttggattgtagaccctacttagttactaaaaacagccttggtttttaacttgtgccttgttttagctagtgttcctcaaattagcctgcacataattacctggaggaacttgaaaaaattcttatgtcccaggcacactcccctcccagaccaatcaaatcagaatttatatggg

SEQ ID NO: 40378 - DNA, 649 bp, Bovine  19866880879684
cctggaaggcactgacttttttttaagttattttttttgtatacatctctcaaatatcacttgaccaagttaaaaaaaactgtagacaaaaaaatgaaatagaagcttgtatcatatgactatcatttctgtcttcctgagcgatctttctgcatctgagttcctgcatgtacataagcactgaaatcccactacctaccctctcatctgccactccgtgtggacactggtggggaaaccagtgatgcccttggatgctccgaacaaagggtccctcggaaagccaaggaaatatccacagacatcaccaggagtggaaactcagaacacaagccaggacttcaagatggcttgaagtttattttccagggctcttcagtgtcttgaacttttttccagctggcagacaccaagtcccctgactcttttcagctccaactcttggactgatccttttcttacgattccctaggagttgataaactccccaagttcaccttttatggagagtgctggaatgttccataattagttttctcacataaaagcaaagcatataaacactcagtgaaaactgcagaggaaaagtttgaggagtcagttttccaggggccctgctccctcattgagctttctgagagcttctcat

SEQ ID NO: 40379 - DNA, 1541 bp, Bovine  19866880976769
aaaagttttgatagaattggaggctccttaattaacacttggaagcaaaagaaacataccttctattttactgccacgttcaagttatgacaaattttcttactgtttttcttctttttgaaaaaactttacttgctgcccagttatatatttcacagatgttaatgtttaggaagtgtttaattgggcattctgaacctaaacataatcgatttaaaatgcagggggggtgggggatgaaaagcccaattaataacatagtattatacagcacaattaataactgataattagtattatacagtattatatacaatattaatgaattcattatgtttattcattcaataatatctttgctgaatcttgggtttgatgtatttttggcagcattctatttaaaaaagaaattagacgtgattttcctgtttaaatacatgcaatcatgtttttgcaaccctgtttttttatttcaggctaattaatatatctagatatgtgtgtgtgtgtacattgtatatacacatatatctgcaaactaagtggcatatctctgatttaatcttacagattaaaacctggcatgttattattaatattggtagtagcggtaacattaatattttgtagtacttttaaaaggttaatttctttctttcctcatttcaaaagagatgggtatcagtcatctgtgactctgaggtcctgtctgaaaacaaattcattctttatgtttatgctggttaggatattcctgtgtgactggggataaatgaaaggcatagcctcagcctgtgcactatgatagtgtctttattcatattgtttccctaatgagggaacatacgtgtgcattttagagcggatcgatttattaagaaaatttaaaatagctaattgttaaaaccgttagagaatttggttctataattggcacatatcaaggcttttttttcctttttcattctcaggaagtaaataacaatcaaacccccagatgctgagaaaatataggcctgttgcactctttatttctattcaaccattttgtttcagatctaattcactgaaaaaaaatttttttgagtagatacatttaggtagtttttgaaagctttgtggtatgaaatatttctttcaatgtaagattttcctattataagttgcaagtgaatggatactcttcagtatcccacttgatgaggctctactcatttttccccctgccaccctgaaatccctgcatacatcaggcttagcttccaggctgagctttgttagtttttctgagtagactttgccaattactatgctagtcacataccacatttgcccgagcaatggattttggcgttctgctggagaggggatatggtttgtaagagagtttccccttcctctgagttgaattcactagttgagatttgcaagcctggaatgcttgaagcagctctggcaggatagcagtgcaagctttaaaatctaggtgtagctgttaatccttgcagaggcacataagtctccaggagtagctgggttag

SEQ ID NO: 40380 - DNA, 1871 bp, Bovine  19866880985415
tcacatatttttttttaaggtataaacagttttaaagtatagaaactctggttcttctctgtactaagttcactgccttcattaaaagtgtctaaaatataatcgataaatacttattgtggaaatacattcccatttttccccacacagcttcagattaaacaaagtgaaaaatcatttcataaataacctttgtgcaactgaaaattctggctgctgaaaataattctgaattgttggcaaaggcaagattttttaagaaaatgaaatctaaacttttgtcaagttagaaacagttgttgtattggttttccaatgagaaatgattatcagagaactgtcaagactattattagacacacatggatgttaacttttatcagccattgtgagattgtcatttaaagttttattattatattcctattcaatactttacaaactaatgtggttaagaatgattttggagaaattattaatgtatgagttgtaattgaattctcatgttatatagtatcttttaattattagagaccaaattaattgctggaaagaagcattgaggaatgaaaagagcaaaaataaagtttgatgaaagttcagctcggattcaacttccaagtagtgagattggaaggactttaagggcaaagctttgttcctctgggtttgggaaaacagggagtgcttgcgatgaaaattttcccttacctgaatttttttttttttttaagagagaagagaatgtaaaaggattcctttaataaattcctctaaggggttttctcaaccacttttatccactgctcagaacttagatttaattacatttgcaagactgagggtggggtcaggacagtagtctatttcagggtcagagtgccaactttaaatttcttgtcctcaatccattggtatcactaccttactgttatttaaatgtatgatttttttttcttttttactgaatttcctttcaaggaacacataaaaaccaatttcttttttctaagaaacaaagactctccctataacttactagatagacaattgcattttgagtctgtgtggtagcacactaaaacattattgggtaaatgtgcagatgaagatcctaaaaattaaatagtcattgtattattaatagtattgagttaacttacatacattttgaactcaatggggaaatttttaattataaaagagatttgcttaggatactaaaatttaagtataaaaatattaaattatttctcgtaagaaatgattccctttcttgccttgtattaattgcaacttttgctctcatattttgtaatttttgagcaatttatactgaacttctttatattgaaatatcatattcataggctaatccagctttttataaggtttaaaaataactttgatcgtatttcatctacacctgtctgcataatgcgtttttgttcttagtaatgtaataagaagaaagttggttcttttcattattgacttcattctacatattgaattagtgtgcagttactatattgagattattagaagtcaagtaatcaatgaaacagacttttagaatctccttagtgtttctgtggttattatatattttcaagaggcctttgccagactgccttacactataagccttttgcacatggcttctgtcttccagcattaatcttcctttctttcttcatctagataaatccttcccattcttcagattttagttcctctcaagtgtcttccctgacctgcctgatccatcagctcccttgaatgcttccgtgttctaattacgtgttctccctttctgtggccttcatcatagtctacagtttgacttctctgtgattatctgtccaact

SEQ ID NO: 40381 - DNA, 1264 bp, Bovine  19866881007045
cttgtaagaatgaataagagattaatttagaggttggtaaaggtgagcagttgagagcttggggcagggaacaagctttacgtttgcattgacttttaggcaattgcaattaaaattacgcttatccttgttaaaatgcaaacattttcgcactgtgagcctgatattccttcttcagtgtggtgagtacaatttgcttgatatgctttaagtttctaatagtcaagtttccatactctagtacaacaaatatttaggtctgctgtgtgccacgcactgagctggaaaatgataacatccataatcataaaaaacatccttttttttttttttttttcatgtcagagttgcgtattgctgatttaaaccattaaagaggatgaaaatcatcagcacataaactgatcaatccacagttcagtggtgcactttaaaaatggggtttaaccaaatgtggtctctgggttttcttttcaaagttgccacggtaacttgtgcacgtgaaaagtgaaagaataaagaacaaaagctgtcattgtctcatcagagcaatttctcctttcttgcatttaagcagactaatacctggagagagctttttatgcattcctgacacttgatttggggggctaggaaagagattatgcgtatgttaaacaaatacaactttagctgctgcttaaattacagttttgttctttttttacttaaaatctgttttctctagctctcttgtcaacagacatcaaagtcctgaaaccagctctcctatgcaatataaacatggctttcaatttgtttttttaatgtgatgttttaccaaagtcagtgatgttgatctgcatcctgaaactggaaaatgctttctgaaatgtatatttctgttttggtttttaagaggcagaaggctttttccaggagacatttacagactatctcttagttagaaatttgtttcttgacttgtgataaatttttgaaatggtggaatgttagaaagagttgacaaaaggtccttttaatgttctgaagagaaaactgcactttggagaattaatactgctgagagatttactgtagagtttttgcccgctggggggtggtacactctaccagaacacagctttcagaagccgcaagtcagatgttggctgctgccggccacttttcctctggcttaattacaacaaagcctcccgatgagaacagtgaaggcctcgggggcacaagttgggggtgggagggaagagggagtgaggggaaa

SEQ ID NO: 40382 - DNA, 1469 bp, Bovine  19866881007602
tcaaggttaattcatgaaataatctacgaaacagagatccaagcaagaaaaggaatctcactacctatagcaactttcctgtggctaagaatcccatttactggaattgagcttcttccacaagcataagactcacttttcaaatgtgctagaaaaaaagattcaactgaaaccatcatttgcacttcaaagaggatgtcacctggcatattttcatttccttgaccagaaacaaaagtatcaatttacaagcatctacatttccagaagatgtaaagcctggagtgagtgtatctttcctgtaacagaccccaaataaaaagatgaccctcccccaagaacataatattacatcctcattccaactatttacaaggtagcaatcaactctgtgcttggattcaccagggttctccaggaagtcagtatttgtttaggagcagaacggagcttcttagaaaagcatccagtagggccacctaagcacagccccttgaggaatgcacgtgataataaaagtcagattgctctcaattacatacattgacagcttccacttcacagagccctgaaattacagtcagggaaaaaaaacagtcttggaaaaagataatgtagtttgagaaacggtacatttattctttaaaatcaaacatctttgatttaactacttttcagatttgttcttgacaacgttgcattaacaccgtaacctaaagcaaattcatatttatccaacatacattccatgtgaaaaattgcttactctctagataaacattcaggcacgccttcccacccacatttaggaaaccagaatcattactcatacaagtgtacatcacaaaccgtgaaaagctaactctttaaaaatagccaaatatataatactagcggggactgtactgttattaaaagaatacatatgcagtattacagattaattgttgttctcctggaagattttatgctcaggtcaatttaataaatttgaatatgtcatctactaaattatgaatcaccaagaagacctactcacccagaaattgttctgttgtttcaaatgcaactttaaaaaaatcatcatctcaagcattgagaagattaaattacctgttttttaatttcagcaagcaatggagtgtgtctacctgctggatcctctgccaactgacagacaaaaggctgaagggagtgcactttggatgctatcaattaaggaaaggtggttcattaatctttactgtcaacgcctgaattctgctctgatggctcctacggtatgcagtcagttgcttgcatttcaaaccaagacccatccagctaaattccccttgtagaaagataacttgagcttttcctggttaactgttaagtccattaaaaaaggctaatagcatggcttccctggtgatacagtggataggaatccccctgctaacgcaggggacacaggcttgatccctggt

SEQ ID NO: 40383 - DNA, 1119 bp, Bovine  19866881010128
attctttaacttctgcttcttttatttgcttattagtcattctcgctagtaaatcatacctgtaaaatgtttatgatgataaaatgtagtagcatcagttcagttcagttcagtcgctcagttgtgtctgactctttgcgaccccatgaatcgcagcacgccaggcctctctgtccatcaccaactcccagagttcactcagactcatgtgcatcgagtcagtgatgccatccagccatctcatcctctgtcgtccccttctcctcctgcccccaacccctcccagcatcagtcttttccaatgagtcaactctttgcatgaggtggccaaagtactggagtttcagctttagcatcattccttaaccaacatttattgccaacttcctacatgccagatcttattcaaagtgcttgtcacataataactaatttacttacaaaattcttatgatgctgaatagagctcctgtgagggtccccgatttacagatgaggaactcaacctatggagccaaatggtggcactggaactcaagcctgtgtctccagagtcatccttcttccactctgcaaagccgcctctcataggatgaaagcttctaagtctcttagcatcctggaaggcacttggtaaatcctccaaagacgagacatattattatcattattggatcccctcacagcttcttgaagaatgctttgtgcaaggtagtttaataaatttatgttgatttgatttagaaagaactctgttgtatcctcttgagcttctaagggatatagtcaatgagagagagcctcttatttttcaggctaatatgatttgtgtggcagcttttagattaagttatcttttatttacagaagaagattaaataaatatgtacaggtctaagaacttcagaatcctcttgctaaaagtggtttagaaacttgtctttgtaagacaagggagagacctcacaggaccaatttctgaaataactggatttcactaaatggtgcttttagtattttttgttaaacatatatttagaactctctcctggttctttctttctttctttctttctttctttttttttttgctgcctcttgcattcagggtccacagta

SEQ ID NO: 40384 - DNA, 1232 bp, Bovine  19866881027952
cgctgagactgcagggcacaattgctgaagggtcctctttcattcagcactcattctaattttaacttatttggtactgctgtggaaaagctgtttgcctgaaataaggtaaataaataaatgatatcctgagtatagagttcataaaataggatgcagaaatctgggagctaagatttagacccaaggcactaattttcttttaacttttcctcttccacttttattctcccttttctccataatgatcatatcgatcaggttggcagggatgaaagaacaggataggatacaagatttgatcaatttgtttacgcctctctgtttgaaatgggtggcattgtagaatccagcgaagctcggatcatgtcctaaaagactgaggtgtggactgggtggaaggggctgcctggcctttgcggaatccagaggtctcaaggaagagcagagagagcagaccaccctggtcaaggagacccaaagccacggcgccggctgtttcactgaggtctgctgcattgaaccaagtcatgctgggtgtaaatatgaagcagtttaaatagaattcttaattttctcacataggtattacatcttaacatttccgtagaccagtctcagttttttttctgaaggtagagaagatgtatccctatgtcctgcctccctggaaaacaacaaacaatgctgtcttggtttttatcatagctttcaatgctgaccttggggagttactgagctttgagtttcagtatcctcatctataagatagacaaagtaggattgctctaaggattaaatgagataacatgtccagcagttaccatagtacctgccactcagtaaataagcactgtcactattagctcgtaatagcatttcaatcattttcaagtttattatgacatttattctgcctggcagccttgtagtgtgttgtgtaataggtgcaggcaaacttttctgtaaagggccagatagaaagtacgtttaactttccagtctgtacagtttctgttgtaactactacagtatgaaagaagccaaatacaatgtgaatgagtggttgtgtctgtattccagtaaaactttatttacagaaacagctggcaagcagatttggcctggggactatggtttactgattcctgacaactctctatttgctattatctggattttaaaaataagaagatggaagcttattgctaggagaaggcccatgtcctcat

SEQ ID NO: 40385 - DNA, 4753 bp, Bovine  19866881031804
ttttattcttttttctgttttcttctttctctctctttatttgatgaacacctaacaataagactttggaaatccacaattggaaaaataaaaccactattgacagccttttcaatatactggttacattattgaatgtaaacaggaaggttaagaatgtctcccaaattcccttttctattgtccaataagcaaacatttctatactgagccattaatccccctattgtattctcttccctccattctaactgagtaagattagaaatcaagagggaaaaaaaagcagttgagagattaggagatactgacaattcaaactcacaaagagtctctgaatgcccaagaaataagaaaggctggcctttctcattaaaatctttctgaatcagtgcaaagtctgaagccaccacgcaaagtttatctgtaactctgtacacttgagatgtggtaaaataatcaaaacaagattggtttcatttgatattagcttctctaaatgtctcaggaatgactggtcacttaagaaacggtagtatgcagggcagtcaatgcatctcagctgatgtgagaaacaaagaacgccagccagtggcaattatcagtatctatttatcactttctagatgcgaacattagtgtcccatgagataaagcaaacactgctctgtggctgattaccaagaccctagaatacactccacttttgctgctgtgcttctcagtttatttttaataatacatactaattttatggatcactggcatgcagccatatactttcccttattcaaatataattctcctaaatggaagtgtaggaatgaaacaaatgtgcatttccaaccaagagagatatatgtttgactaacttctgtgactctaacctgggggcatattaaaaaaaaaatgaaagcctcaacattttagcaaactcgaccccactttgaaaagatatatgtgaaatttccctgaatctattagagtctttcattattattgttattttaaagaattctcttctctagtttcattaaacttctgacatgaaaaagtatgtgtttcctacagatggaagtggtctggacaggacttaagaagctgactaacagtggcttagctagctccagagtgactcctattagaatggaaaataaatagagtaagtgccaaagtcaaaactattctcttacagagataaactacaagtgctctacagaaagctagaacagctctccggggaatgctagggatttgggtaaagaacaatgcaactgtttctgtaagtcaagtggaaacacttgggagaggacagcagttgggagagatatggaatgagccaaagggtgtggacctaatgtacacccccatttagtccactggcctcagagaccaacaccaggtcagttctgaaaaggaagctaagaaaccttgtgatgaatatgaaccccatttgtaatggagatgccaactatgtttttttttttttttttaatatttggcaatatacaaactatcacctagtctttaggattaataacatctttcaatgcttcaagaaaaatgactttcctaaacatggctaataatttatacatcctgcttttgcaaaacttatgtgatataatgattaacttgggtgcttctaaagtcttcaacaacactgaaaattactcctgaggaactgcaggatacagatggagacatgatttattcctcttttctgtaaataataaaaaaaaaaaaaaaagctgaaattgacttcaaaaggattgtctgaaagttgtaattatgctttagcaaaagactccaataaatcaaaatggttgcatattctgaacaaaactccagaaagaacacttgtgacccactccagagaaatctgagcaactgtctcaatccttagagtacaaagaagtctcagtttgaatttacaacctggtactaaatttgggtataatttaggaaagataaaaaggattgcatgttctctcttaatttgaactccaacatgcttggtatgaaagcttctccgtttgggagaaggtaccatggaatccactcagacagaaggcaaaagctgaccagcagagacaacgtgagtcctcagaagaggagggccctctctcagccctcatcaggactctacctgtaggaatgatcatacacctgagtgtggaggcggaaagtgcattatcaattaggaaacgtgtggactgagctcgattgcatttgtctgtttagaaagagttaaaaatatcataagaactaatgagtgagtagataaaggtagtaagaaaaaaattaagcaattaaaactatagtaaggtgcatgatatggacaaaacaacaaacaaaatacaggatagcaataaggaggaagtatcccagagaggcagaaacgaggctcaagccaggatgcttgcatttcctgaatcatgttaaaaggcatcttaacttttaaattttccccaaggaagatttagtcagtaacatgtaaaaatctgaaactcaagttactcttctatgagtatttattgaagcaatgactatctcaggaattctgcatatgcggcaatgaaccacatgcttatttcccactatacaaatgaaattataacctaaatatttactgcacccttaccacgaacttgttggcttttttttttttttttgataaatgctatttaaagcatgaaactttatattttgaaaattcagttaaaggggtttattgaatatttattgcttgtcaccagcccaagactgagcagataaaatggaagcacatcttcagacgggcaggactttaggtcaccagccctaagcacatgctatgttttcctgttgattgtggtgtccattgtagtcaagtaaacataaccgaagcctctagttaagccattcaggaccttttttacttcctcattttcataggtatcaagggagcttgcaaattgtgaactgtcttctgactgctgctgtccctagatttgtcctaagtctctttacattagactcagtatcactcaactgagaaaagaactatttccaattgtatttggcatgacaaaatacataaatgaaaataaatatagcttatcaactaggagatatgtttaaaatccattattccatttgctgcttctaatttgtggtaaactgagaaactgctacccagtctactaaatttgaaactaaatacatataaattggatcaggataatagcttgaggcaacctctataaagtaccatctgagagtctggtgcacaatgtctgcttgtaaacaccaaacaccctccttaattcatgtctaagtgtgtgtgtgtgtgtgtgtgtgtgtgtgtgtgtgtgtgagagagagagagagagagagagagaaaccacagagacacagagagagagaaggagagagaaatggaacgtgaatgttgtgagcgcatgtatgaatgcaaaccctagaagcaccaatacaagactttgctcaagccatagaccgcatgtgtctctctagggatgtcttttagaaccaacaaaactctaaagcaagaacttattttgtaagtgttttacaggtttgttttttttccccccaagactttgacccatgtttcccaaatgagccctctaatttaagatgcagaatccaggaatacattttttttttttttttaggaatacatttttgactacaaaaatacattgttagtattactgagaatagagagaagtattaaaactgctttgaggagctacatttctaaccctcacttaagactgacaaggcatcaacctttgagagagtcaacgaggatttgcatgctagcaagaaggctgccttgatttttaaagttgatgtcttggtcttaatacacagtaaaagcagactgcctcaggatctccatgctctagccaacagtgtgaataaatctgtttctcagacaaggcagaagatcactaggtgagaaatgcccatcataaattgctctgcatagagtcctgaaataaaagttagatatcagtaggtataactgtgccatatataactacactaaagcctttgtgtggatcacaaccaactagaaaattcttgaagagttggggataccagaccatcttacttgtctcttgagtaacttatatgctggtcaagaagcaacagaatggaacatcgaacgactgactggttcaaaattatgaaaggagtatatcaaggctgtttattgtcaccctgcttgctgctgctgctaagtcacttcagtcgtgtccaactctgtgcgaccccatagacggcagcccaccaggctcccctgtccctgggattctccaggcaagagcactggagtgggttgccatttccttctccaatgcatgaaaatgaaaagtgaaagtgaagtcactcagttgggtccgactcttcgctatcccatggactgcagcccacgaggttcctccgtccatggggttttccaggcaagagtactggaatggggtgccatcgccttctctgtctattcagagtacattatgcaaaatgccaggctggatgaatcaaaagttggaaccaagcttgttgggagaaatatcaacaacctcagacatgcagatgattccactctaagggcagaaagtgaagaggaactaaagagcctcttgatgagggtgaaagagcaaagtgaaaaatctggtttaaaactcaacattaaaaaaactagatcatggcatctggtgccatcacttcaggcaaatag

SEQ ID NO: 40386 - DNA, 916 bp, Bovine  19866881122780
tctgccttattagatttcacaaatgacatttcctcagtttttaatataacataaaatgtagaactattgtctggtcttgtaaaggaatttcatacaattaattatgagtttctagcataccctaattttatagtagcctatttacagcatctctctgggcactgaatttaatcgttcctgacaaaagagatgggcaaaaaaaaattgcatacacataaatatttacacaatagaagcaagtaaacaagatatttgctttacagtgaaatcctaccaggtaggggaaaaaaagctttgagccattttccaaactttattcattacttttgtttcctagtattaacttagcactttttcagtgtggccttttcacttgtttgctggcttgttttggccatagtctgtagtctttatttatccttcaggggttagtcccttctttgtgatcattctggatagaatgcttcatggaaacaactgcacaacagcactccccacggagccagaatgtgtatattttagtatatgcaaaacactaatcaaaataaattccctggttgagtatgatatagggaaatccatctatctcgtgtttcctatgtaaagcatgagaaactgccataccaaaacatggttttgctaattagtaggacaaaaactgatccaaatgattgctttattgagctgactggccaatttcattaaaaagtgatctctcttatctcagggcttccctggtggcttagaggttaaagcgtctgactgcagtgtgggagaccagggttcgatccctgggttgggaagatcccctggagaaggaaatggcaacccactccagtattcttgcctggagaatcccatggacggagaagcctggtgggctacagtccatgggatcctagagagtcagacacga

SEQ ID NO: 40387 - DNA, 2176 bp, Bovine  19866881177079
gagggtaaaaacagggggaaatatggaactgtaaaatttcacaacttattctatcaatgattatcatccagctttactatttaaatagcagcacatcctgtgtttgactgtcataaagaatactttttctgaagtggttttcttgagagtactgttacacatggtcattgtgtcctctctagacctttgtacaccagagtgggtcacatttcggccatcccatgtcaccatcacttttaggcaatattaattgatttctggtgaatggcaatacttaaggtagcattaattccagagtcctttccccccagcaacagcaaacaaactaataaaatatattgaattttaatctgcccttttacctcttattccttgaataaacgttagaatttattttgttaacatacaaggaacctctgacattattttcgtggaataaaaattgattcattttcgttcatctgaaataccagatggactgtcagattcagatgatgttttgttgctttatggtaatactcaatgattaagatattgtccagatagattaacacctagaccctggaagtcttatagtctggcatttaggtttaagtatatggtgcatttgtaacactgcatgcaaaccaaagaacatcactgtccattgttaaaatttacatataaattatgtatgagaaattgtttgtaatctaagatagtgctattatttaaaagaattttattagatttagttttcgatttgtaatgtgatttggtaactgctcttttcaaatggtgctttctaaatgtcttgatctttgagacattttagttcagtcataaactgccttataattgtggactgaaaactgctacaagtttgggtaaatacttggaattaatactgaagagccttttagtatccaaatagtttatattttcatgggcttttgagttttaataaagtgaccttcatcgctatgttagattttggaactgcatatgggaattttgtatttttattttcaaaaacaattcaagatttctctgaaagtgaaaatcaccctgttgtttccaagtctttgcgaccccatggactatgtggtccatagaattctccaggccagaatactggagtgggcagccgttcccttctccaggggatcttcccaacccaggtatcacacccaggtcgcccacattgtgggtggattctttaccaactgagctatcagggaagccctcaagatttctctggggatttttattgttcattgggatggtaagttttttggggattttgtaatgactaagagactgtgtaaatcttgatagtattattatattttgtcagtctgcacaagttatacctatgtattgtattgatgaggaaggaacaccacatttaacatgtgaaatacttcatgtgtgttacttgaaaatgacaaatactttatgtgggttacttaaaaatgacaaataaaaaactatcacgtaatagaaaaaaatatgctttgaaacataatttctagtgctatattttctctattatagttaaactgccctcctcaatggcaactcactccagtatttttgccaggagaatcccatggacaaaggagcctggtgggttacagtccatgggttgcaaagagtcagatacaactttcactgtttttcaagtatatatacctgtatgtatatatatgacctaaccaatactgaccctgcttgtttaagtgaccgctgcatgtgtttatagataccactttatttttttctcattttaaaatatttgttgtggctttctaatttcaaaagtaatacatgttcattattaacaaaaaaacccaggaaatttcagagaagcataacaaagaatcaacacagcaccatacagagataaccacagtaagatttccagattttttccatgaaaatacagataatgtacaaaattacaggtaggtaaacacttaaatgttgcttattaaaattgaaattgcattacttcatggggtttcctaccgtttaataatctagttttacatttgatattctatgtactcactttaaactattcccaaatttaacttagaaacaggtctaacccagacacctggtctttaaactccttctacactgagctaaagcccctgcctagttagtgccagccacacttttaaatcctatc

SEQ ID NO: 40388 - DNA, 3275 bp, Bovine  19866881198799
aatgaatgccttggcaaattaatttttgattgtcagagatccaaaaagaactgatgtcattagaaattatttgtccaaagctttctttcacttgactaaaattgaggaaaaaaataaagttgtttttgaaacaactgtgtggaaactcagggcttttaatattttataattggcaccaaccataattggcacaaggaaaggaagtgaactaaagttgtgttaatataaacacaaatgttttgtttccatctgaaagaagaaaggtttttgatgttctttggtggagatatttattgcagaaaagcctattgccagtctacattccactgcaattgatttttaaatatggagctaaacaggaaatgtcatgagtaatgtgaccatctgtcaagtgtaaatgaagtcagagcaagtagatggaatctgcacaaacaaggtaattgcattggagttccgtctgagagattttaaactcaaggagctatgagtccagtgtatactgtctgtgtcacatacttgtagttcctgtgcacttgggtttattgtagctcttgtcacagctctgataatttctgctaagtgaatttaaatagcatctcattccagtttcatagtttccatctgatatgctttggaatacctggaacttcatttctttcgttctcttttgaaatccttaggagttctttcctagaggagaaacttgttttcgtagtaattataaattgggagtgcaggtaagaagaaggaagaaacacaaaagggtgctttatgtaatgccacccctttgctttgttcagagctgtgaaaaaggaatcaggagttgttaaaactcacactaagggatttgtagaaggcatcaaattggtgacaagttacaataaaagttttcattgcaaatgctctcaactaacaatgtaagagctcatcttagtaatcagtggagaaaaagttctttcaggaaaagtatagtatattctaaagtgatttttttttttgagatgtagatagtcttttaagtaaagctttaggagtaaaacgatacatctatcattttggttatacgtgttatatacatttttcttgaaatgtggatggctttacctttatcaaattacagttttattatttcattgctgtttagattaatttccattaactctgttgtgattcatagtttaaaatgggacacaaaaattgctttcatcatttcacaattttaaaataagtatcaacataaggctatcctgttcctttaatggatcagtttaatccttagtaatgtaaccctttaaagtctacatgtcaaagatagcatttttacttgaagaaagtaaacataaaagaactttaaagtttttagtatctgtttcctttgccgattttaatggacttcgaaaacaatcaagggcagtgggtggcctcttactggtagaagccagtttttaaatgcatgcatttcttcttccattttggcctcttacctgggacatatttactgtcttttaaaattatatatggtaaattagcttattgaaatctaaataaggacatgttccttttcagcaatttgaaatgctgccctttataaatttaaaatgattgaaaaacccagacacacacattcatgctcagacacacactgcatgtatcaaaggttatagcaaatacactaatattgtatttgtatcagatacactaattgtatcaaatatgctaatgattatatttgtatcaaatacattaatgattgtattacttgcatgttattagccacaaagaatatacattattcacttatagtttcatgcatatttttgatgtcttgctaacacattgttaatattaggtacctgatattaggtactgtgtgtgtgtgtgtgtgtgcacacgtgttgtcattagtaaagtcgtgtccaactctttgcaatcccatgaactacagcccgccaggcgcttctgtccatgggattttccaggcaagaatactggagcagtttgccatttcctgctccaggggatcttcccaactgacccagggatccctgcactggtaggcagatcctttactactgtactacctgggaagtccagagaatgtgccagactcttttctaactgcattcagttcaatctgttacttagttttcatcataacaatttaggtatgtattgttttaatctccttttactaatgacgacatgaaaacttacttaagaataacttattcaaaaacatattcctagaaagtgttgacttgacagctgaaactctaattggtcttcgtgcagagccataatgcatagtggcatcctataaaatctgttttgtagaattcatagtttcctaaaatactatgggacaactttatttccattgaattctgctatattcccctctccacccaaccctgattcatctttattttctttaatggcttttctcagtctcctttatttcaaatgcagaagagaagtcaagagcagagataggtatgccatgaggatatggctctggatgagatcaccaagaaagtctgaaacaaaactaatgttgaagatagaagttcccaggtggtgctagtggaaaagaatctgcctgctgatgcaggagctgtaagagacaagcacaggttctatccctgggtggggaagatcctctgcaagaggaaatagctgcccactctggtattcttgctgggagaatcccatggacagaggagcctggtgggctacagtccctggattgcaaagcgtcagaggtgtatgagtcaaatttgatgtagtcaaatttatgctttgtggaatagaaattgactgcagttaagctctactgagaaggactatagtcatttattgccacctccattgaaatggacttcccaagtggctaagatagtaaagaatctgcctgatgtgcagtagatctgggtttgatgtatgggttgggaagatcccctgagaagagaatggctacccactgtagttcttgcctggagaattccatggtggactacagtccatggggtcacagagttggacacgactgagcaactaacactttcacttcagatacaagtgttcagttcatttcatgtgattcactcagtcgtgtccaactctatgcgaccccatggactgcagcatgccaggcctccctgtccatcactaactcctggagtttactcaaactcatgtccatggagtcggtgaggccatccagccatttcatcctactgttgtccccttctcctctcacctttaatctttcccta

SEQ ID NO: 40389 - DNA, 786 bp, Bovine  19866881256653
atactgcaataaaaattaattaataaaaataaggttaatattctttttccgttcctttccacctccctcactctcccatcaccactgaattattcaccacagaccaggctacagacagaccctgataatgtccgtgggtgagggagggcattgtgattccttttgtgagctttgtctctttgatcatctgtagtcagggtcttacacacatagcacacagtggaaatagaaacaattgtctaaatcaggggtctgcaaactttttctgtaacgggccagacagtaaatatcttcggctttgtgggacacgtggtctctgtcacaactattcaacttgtggaatgtgtgaaagcaggcttagacaatctgtaaacaaatgaacacagttgtgttctaataaaactttatttacaaaaacaggcagtgggccagatttggcctgtgagctgtactttgctacccctgatctagactcatccattcaacagatactctgttcctcatacatgaaagatactgtcccaggtgctggggatactgctgaaaatgaaataatgtccttgccccagccatatcatcaaggtatttattcttgtccatttctcacactgaggagaccaagtgaagacactttttccaaaaaggaatcatcatctgtgtgagaggctactagaagtgtgaatgaactgaggactgagaagtgaccaccagattcaataaggaagaaaccatcgggtgacgagagcgtgtccctggaacagtggagatggaagcctgttgagtgaa

SEQ ID NO: 40390 - DNA, 1289 bp, Bovine  19866881285410
gatactgaaaaaaattacagatacatttaatttattatttaggaaacgtgaaagtagaaatagcagttagcagatggataaagtagtctctagtgagtattgcaaagtgcccacagaggaaagtttaagtgatgtattgcttaatgtgaggttttacaagtaatgcctttagggctttgctcattattgttgaatttcagtggagtattttcttgaactcttgctttcttggtaagtgaaaatggaaaaccaagctgtgaaattaataattacaatgttattttaaaaagtatcttctgtcaaatgttttctaagcttgaaaattattcaacatataaaacaatttggtaaatttaagaaaaaaatttaaagcaatttaggaaacagttacttttgttaaattgcattaaaaactaattaaaaccattataaaaatcgcacagagaacctgcttaaacggttgccaataggcaggcatttctcctaccccaggacacactttaaagttgagaagatgaatctgatgaatggaagtcaaaagttgttggtcagcctagagtatgtacaaggtgatgatcataataagcagagataaagctggtagctgaagtgtaaagtttttaccaattcaaaatctaatatgtattggtttttacattttcaaaccagagaaagaaaaaatattctacactggtatgaaaaggaagattaatttatttttgtttgtttagttttacaagtgtgaaactgcttcctctgctctatttgatgtgcaaactcacatggccatgaatacaatggtggtaataacgtgggattaacagaaagccgaaaatctcattcagttcttggaaaatgccgttctcttctccccagattgcattaaaacaaaaggcaaaaatacaaaacatatttctctggagaggatactcgttcaaaaatgaagattccttcacaagttcctactccctttactcaaacagtccaatgcatgcgtgattttgtttcatattttatatcttctcttgcctttttatatttaaaaactatagtgctaaagagatttgttttattttgcatattagaggctgtaatggtctttccatctgaaataagcagctctgctcccatgtttagacttccctgtttctgagctggctctacgtattcatgcatatagagacattgtagttgaatgtgactgaggaaaaaaaaaatgacccccactggcatgcacactgtggccaggtttccacagcgtcgacttcagaggctttatgtctgcatag

SEQ ID NO: 40391 - DNA, 853 bp, Bovine  19866881381873
ctccccccacatcatcctagaagtgaaactgttttactgaaagaacactatacaaatagcaattcatttttaaaggttaaattgtaatacagtcaccataaatatgttattgaaattatcaggtatttaacagtctttttaaaactaatgtgtccatactctcttgggagaggaaagaaagaaatccagcattaaaccccacagatattttagaaggcatttgcttaccaacacaagtgtggtttagcagtcataagcaagttactacaagccaacagctttactttttggcaaagcattgttctttcctgggtggtctgataaagccgggcaattccctagaattaccatgtacttaaactaaatgctagtgaggtaaaattaaaaataacaacaagaataagcctttcaaagagccttttcatatcatttgacatggtcttatgtctttctgtttaaggttttcttatcaccactaagccagaaagacatgtactattacctttgtgataatgatttaattgttttatgttcttgcccagccacacaggtggcacttttcacggacaaagaaaacccttagtaaatagacagcccaaaccccagagacgcgggatctgctctcacactgcgttaaccgtgctggctggtgtctccctgcgcagccctgcacagcttcactctgccaaaaacaaacacgacctactggtttatttccagctgtcgctgaggtttttcatctgattttatttacttgtctaaagtggccgtataacaagcaccaaataagccacaattgcccagagcagaatataaaattaaagggcttcaattaagaataagtaataacaca

SEQ ID NO: 40392 - DNA, 1173 bp, Bovine  19866881396963
cagtgactctgacctgttattaggaccgaagagacaaacgcggccaaggttttgcatcgggcattaggagaacatgaacgcagcttgttcaggctgacttgcatccttgattcttgtgttactgtctgaggtcttcctgacaacatcgggccattttgtcctggtggctaaaggaaagcacatcagtggtctgggcccagtcgggtcagagcgctgtcctacctggtgcttggtaaagctgtgagatacctgatgtctgttcccaggatgccagccttctcttttaaactctcagagtatttatcctcctctgtattccccattttctgccacagctagtcaattataccacagggttggttgctccaaatatctattatgtactctggaagaatctatcgtggcagatttagactctggctcttttaaaacacatttcagcacacggtattattttaagcaagaggatttctgagcctctgaatattatgttaagtgtaaggtcaccctcaatgatttaattttgaggaccagcactttcaggatttgaacagaatggaaaattaagccacacttggagcttcttaaccttggaaggagatcctgcaagcttctaaacattgacttatgggggactaaactgtgggacatagtatgccttaacatggttacaatttctctcctccacagaaatgaaatggatggactgatcatctggtattttttttattatggaataacttctcctactttatcttaatgtctatggtgtttcatttaagaagagcttaactgaaccttatatcgaaatgaactgtgttgcaatagcattggttcccagctggtcgctccgtgaaggcagagaatgctgcattatctccctgcccatcctgaactcttttaagaaagtcattgaggtacagacacttgagagtctctctctcttttttttaaattattattttttttattggagaataattgctttataatatcgtggtggcctctgccatacatcaacatgaatcagctatgggtattttattgctttgcaaagaaattccagtttagcatttacctgcttatggtccccaaatatttctcaaaggaagataaatcaagcttgttgggaagttcctagtcatatattatccagtctcattacctgaacaa

SEQ ID NO: 40393 - DNA, 809 bp, Bovine  19866881410755
caatttcaattattctcaagtgcagctatgctgtttcttttattctgctgtttgtgaaacagcaatctcagtaattgaatattaattttcaccaagaaagcattccaaactcttcttcaaagagggagttaagcttattaattcattccttaacaagaggagaaagtgcatgacttgctgtataaggaataagaactcctaggggccaagaagatttaatcaaggattgaaggggaaggaaaagggaataaaccagaaggcagaagaatgtgaggtcacctgactttttagaaagagaaaaaaaaaaaaaatttccagagctcagccaaagtgaagtaacaatgcaaagccatcagaagtacaaattcctcctgagatataagctaacgcattgactttcctttattatgccactttaatttctgggaaaattccaaagcaaaggtttatatttcatgatattgtcaactttgcataagactacttgtgctactcatgacttacacagccatagggacacaattgatttttttctccctcataaatctggaaaatgttctctgccttcccagtagatctctaatatttatttggtgtctatcctaaaataacagttcaaggttggagctatgaaaacagttggggctctaatttaccatagagaaaacctactggaagaatcagtgataatacaaagcactccaagcttgcccagaagatactagaaacacctccacctagacacacatactatctttcctaatagattctgctacagaaaaaagttacagagtgacacgtgacacagg

SEQ ID NO: 40394 - DNA, 1254 bp, Bovine  19866881775216
ctcccctttatttatatagaaagacgggaaataaaagagaaagaggtcatcttatcccttttcaacaactactatgatgaaagatgttgcctaaagaaagaattgaagctaaatttctaggaaatgtctctagtatgttaaagttctttgttaatagctgattaaaacattttactttcacaggagatgctcaggtccagtgtatttcaaggaacagaaatataaaggaaatctagtatgcttccatttttcccatgaagaatatttgaattaagttttctttacctcttgaaagaatacctgttcttgcataacctgtgactgcaccagatattctgagaaagcagcaagaagcaaaagctggaaatagctatttcacagcaggtaatcatacctcaggatgtagctactgtacaaagtttatacttggataatcctggatgggaataaaggtggggggtaactgcctgaaaaacctattactgtacaggccttagcatcatgaatggctttcttcatgaggatctgaagttactatctctgaccacattgcacagaagagcccataagaatttcaaagagagcaatttccactaagggaattaagctacacaaaaggaaccttcacacagaaactctataagaaaggaaaaaaataggaaaccatgtgttctacacagtaacaggaacctgaattgtttctggtccctactttaatgagcttgcccaccacgctgaaccacagctggaatgttcattgacaacagcaagcctgatctggaggtgtgtgcggcatagaataaacagtgaagaacatttccaaggactaaacaagagtttataagtcccagcccctcaccaggaaaataatatatgtgcattggattttcactcacgcaaaatttactcacatcgttcaataaggtaggaaaaatattaaagtcttttcttttcatgcctgaaattataaaggctaactaatacctaaaggtgtagaagaaattatattacatactagataaatataaatctataattctccacccatggagaaaggtgaatcatattttagattagaacttgaagaaagataaatacattgtgaaaacatgttatgagctagaatataatgaaagatgttcataaacccatttaactatgtactacaaaacatacagtaaaataggaaaaaaagaatttaacatgaaatggaattttccacttagataagatagatgtattagctatataaat

SEQ ID NO: 40395 - DNA, 1177 bp, Bovine  19866881816023
ctttttagttcctcttcactttctgccataagggtggtgtcatctgcatatgtgaggttattgataattcttccccacaaacttgattccagcttgtgcttcttccagcccagtgtttctcatgatgtactctgcatataagttaaataatcagggtgacaatatacagccttgacatactccttttcctatttggaaccagtctgttgttccatgtccagttctaactgttccttcctgacatgcatacagatttctcaagaggcaggtcaagtggtctggtattcccatctctttcagaattttatacaatttattgtgatccacacagtcaaaggctttggcatgggagggcccaatctggcagacaggatgtagtaaagcaagactcagtcaaaaagtttcaaaattcatatcatacgccagcaagactaaggtctagacatcatgacctgggcagcagctgtaacagagatgagggctccctgtgtagtagtttagccaagacacaagtttagtgtatcttgggttactctgactcaaccaggcctaaatctgaggcacatactacatgcagccctaagataagttcattgctacagccagactctggcaaataaagactttctctggaatcaaccaagtttctctctagaggcaaaccttactttatctgtgcctgtaaaacaaatctacacagagattaagacctcatttaactaagagtgctctattgccatgtctgtggctaatgagcctatacagataagcaaatgcttagtgaggtcagtccactctgctttggagtccttccgggtcctaaatccatctgaaacagagactgagatctggtagctgagccttaggtgcaatatatatatatatatatatctccagagagtgattaaggatggcctattcagatgcttgtcaaataacaaaacaccatcactggaaatctttttaaatgtgggaaaccttaaagaccttacttaaaaactttactcaaggaagaactggtgaggaaggaaagtcagattcctaaagcctgcttcagcaatcatggagggctccacactgccacccaaggaaagctgctatattctactgtaggactttttgttaaccaaagacagtaaagctggtatcagagataagccacgaatcaataaagaat

SEQ ID NO: 40396 - DNA, 1869 bp, Bovine  19866880397169
ctgctagtccttagaccccaggcatggccgtagaattctcagcgtcaccagtgagggatgctcttttattcactggtagaaggaaacttgggtacgtttcatatgaatgcctgtaccaggaactgtccgagttggggatagggaggagtgagagggagaggaaataataaatacacgttttcagtggtacccattgccagggagaaatttaaagccacaaaggggtgttagggtaccattttatggaagatggcatttgagagaaatcctgatggtttgagggagcaagccaggtgggtgtcgtgtcacacggcagtgtctcgccccatgaagccatcgactacttcttcacaggcccacgaagccgtcatccatggccactacccggcccccgaggagaacctgcaggtgctggctgccctgcggctccagtatctgcagggggattacgcaccgcacgccccggtaccgcccctcgaggaggtctactcgctgcagaggctcaaggcccgcatcagccaatccaccaagagcttcacgccgggggagcggctggagaagaggcgcacgagcttcctggaggggaccctgcggcggagcttccggacgggctcggcgatacggcagaaggcagaggaggagcagatggtggacatgtgggtcaaggaggaggtgtgctccgcgcgggccagcatcctggacaagtggaagaagttccagggcatgagccaggaacaggccatggccaagtacatggccttgatcaaggagtggcctgggtacgggtcgacgctctttcgacgtggaggtgagagcgggctgctgcttcctggaccaggctccacacctgtcagtgtgaccctcggtcaaggtcaaggggaaggaggactgggtggaacacgtggctctcttaccctctgaggttgcgtgcatgctaagtcgttcagtcatatcagactccttgcgaccctgtggactgtagcccactgggctcctctgtccatggattctccaggggtgaatactggaatgggtttccatgccctcctccagggcttcttccccacccagggatcaaacccgtgtctcttatgtctcctgctttggcaagtgggttctttaccactagcgcaacctgggaagccctgcccttgtaggttagagctccccagttttacccttcacaccctcctgtacccacccaaagtattcttcctccttttcagtaattacttgtaatgttagaagcaagtggaaaattaagatattatttattcttaagtaactgactctcattcaagccgtacacccaatgaaaaagtgctggtaaaaatctgcattaaagtttttaaaaatatcttagcagtatgtccataaaattagaaaatttggatacacttggattttaattttttttcccatgactatttgtagggaaaaatttcttttacacaattggaatttggctaagtttgcatcaacccagtactgattcatatcctttttctttttttaagtagaccatttattggaagagaattttattaatgatcaagatcaagccttgacaaactgcagcctgagggccaaatgctgcctgccttcttttttttgtaaataaagttttattggaatacagcagtgctttcttttatgtatttttctctggctgctttcaggctgaaatgacagagttgaatagctgtgatcaataccacaaaacctaaaatgtttgccgtctgttccttaacagataagtttgccaactcttggtctagatgagcatctatttttcttatgatcagagtcattcagcatgttatttgttgacttttaaagaaggctttataaaaccctaaatattgatct

SEQ ID NO: 40397 - DNA, 1635 bp, Bovine  19866880407526
tctgttggtaaacgaatgagatcaaccaccatacacacaaaaggccattgctgctacttgtcacaagatgtattttgcaggaggagctgaaactgcacagcacatatttggagaatttccctctatgatcctagattttgtatttgaagaacacccatccaaaacaggattgaggcggaactagagatagacaggaatccccaggcggcattagtggtaaagaacccccctgccagtgcaggagatgtaagagatgccagttccatccctgggtagggaagatcccctggaggagggcatggcaacccactctagtattcttggctggacaatcccatggacagagaaacctgttgggctacagtgtgtagggcgcaaagcgtcagacacagctgaagtcatttagcatgcagcaataggctgcttgatttgatgggaaattactgtcgagtttctcgcctgtggccaccttcacatagctaattcacatggccaagacagtggtgatgttgagaggtggagagtccaagcaagatgctgaatttaccagttggtgttctccaaatgcttggggttaatgagttggtcagaaatcaatccaggcagtcagagagctaccatttctcacgtcttgtatttcagttgccctctgcataaagacacattgaatgtgttcagtacaccatgcagagggctgggctcagagcccttcttgtggtttctgtgtcctgtttctgactttgctgatctgatcttgccccaactcttgcccgccccccagtgcaaggaaggtggctttccccaggacctctggctgggcgtcagcgccgatgcggtctctgtctacaagcgtggggaggggaggccattggaagtcttccagtacgaacacatcctctccttcggtgcccccctggccaacacctacaagatcgtcgtcgatgagagggagctgctctttgaaacaagtgaggtaagaggcaaacctttcgtccgtggccttgatgaactagcaagacaacatcccagttcctgatgcctttgaccaaatagcttgatttgcatatttcgctctaagacataggaaaatacagtatggtggtccctcccctgctgcaggtttctcacaggccaaaatctgacagtcccacgtttcttctgtatacctttgcaatggagaaatttggttttcagctgtcaggggattttacccttgcaggaaaagaagagaaagggaagtgacataggaatgaagagatttggtttccagctgtcaggggggtcttacccttgaaggaggagaaagggaagtgacacagaggtccaaaaaattatatataatttggcaataaagccttgcgaaaattattagacaaggtggcagtgggtcacagccatgggactggggccaggcagcgcccacggagcaggagggtgagtggcagcccagcctgcgaagagctaattctcacaataaaaatcacaaaacccctgtatatatgccatcctactccaaagcataaaatgtagtagtaatcatgatgagaatgcaggaagcctgttgaggtctccacacagggagctgccagcaagcaaaggtgagaaatgggcgtaatcccaagtgagggtgaggtg

SEQ ID NO: 40398 - DNA, 1363 bp, Bovine  19866880508926
tatctttaccataataagaaaatgagtatttgttatgtttgaaccaaaatattagtgtattcagctggtgaatatatatatatagtaaaaaatattttagatctaaggagactgataacattacttactactgcctaaatatttttcatcttagtctctacaactgatactttcaatttaattctatttgttgattgagtatctgctatgaagtagatgctatgtaaagctctgggggctacagtgattgcaaaatcttccaggattttggaggaatctggcaggtaatgatgactataatataaaaaatggtgtggtaattttttaaaatagaaagataagaagcaatggatcaataacttacttggattctgtatgtgttggcagggatgttaagtcctccgggtattcacatatgctttcttctattcctttgtggaaccagtttttgagcatccacattggatgaaggaggtagtgttttaataggcagttggtgacacccaaatccctcacccacacagagctaacgtcctattccttgtgatctcatgaaactctaaccaggtaagatagttctctctctttaacttcttcatccaattctccagttcacttgaacctatgaataaagaaactgtagaagactgtaacatattcactctttttgaaccacaaataaaagcttgttcctcaacaatggtggtccaaaagtatcatctgtgtcaatataggctgctttagaataatctagactttatcagatttggtcgactcatttgatttgtgctccttatttgagaagagacaattaatgggaagatattgaacatttcagttgaaatgctgagtctcctggtttgttgctgagacagctactttaattttcaaaagagattgcaaaaattgactcttttaaatgttcgtttaactacacagtattttaagaatatcagcttagacaatagaacactaagaatacataccactcaaggcttaggtaaacccagaatatttcacaccatgcttgctagcaagtggaatatattaaaaaatacttaaagtacttgtcatttggcatcccttgcccgggtgaggatgcacatctctccccagcaatctgaggaagttctccaagtcctggtcctcatattctcttcgccactaagagatggagccactgcaactcaggctctcgatgcagtagaatttcagtgctgtgccaattgttaggctaaaagctctatagctcatgtgatcttgggcaagataatcttgcccaaactccagttttctcatctgcaaaacaagcacaataataatagtatctataatacttcatagggttattaaaggtatcaag

SEQ ID NO: 40399 - DNA, 1206 bp, Bovine  19866880609834
agttttatgtctgagtttattggggaagaaagcagtcatcaatttccttgggcctgtagccttactgaggcaccaggtccaccaatgggtgtggctgggctctgttgctttgtgtagagttcttcctacgtacacgttattttttcccggatgtataaacggatgtgagttcaggactgcgaagaaagaagctggccctgaaatgtgtttatgcaaatgaatcaatttaagcaaagaaaatctgataaagtcaatttttatcagatggttttaaaaggttagtgagtcaacatgctgaatgggtccacagtcaggaataaataattcacagcatcccaaatgagccctattacagcacagctgattcagtcatattttatttatctctggactgaagaaaatcaatttgaggagatttgcagggcgatcccggtatcctggtacttacctgctgtggatgagtgggtaagcaccaggataccagatgtgttaagttagatgcttcttttcaagtgaaacagctgcaaaactttctcctgctctttctacctctctggtaagatctccactgcaggtattcaacaccaccgcagttttcgtgcatttgttcttctcagtgcacttctgacttgtaatttaaatgatggctctgggattctaatagtcagaatgacatttatgttagagtttagttcttctcctttatccatgtcttccctaaacgtcctagctgggcaatgtcagatcttctccttgagcttttattcctgtgcccgagaaagtcttagcacttcctagtgcctgacccttcatgaggtgataggactctgagaaagcaacttctgttataagggtgctttgggggaattttacccaaatttgattgcttaaacatttgtccctcgatttagatagctctttatttagatgcatgagtgtgtctgtatgctcagtcgtgtctgactctttgtgacccctggactgcagcccgccgggctcctctgtccatgggactcttcaggcaagaatactggagtggattgccattcccttctccatcatgagcatggagaagcaggcaatcccagctccctgctaggcagggcacacatcatgaaggtagcgtagtgggtgaagtatattttctggtgagagggattcagttcctggctcccggaattgaagtgtggtcagttagatttctta

SEQ ID NO: 40400 - DNA, 857 bp, Bovine  19866880749209
tttaggagacggagagggaagttccggcagttcaagagtattcattatttaacaatggagtttgtttcctgatacatttgccctaaatatttctgaatgaaattcatcacaatagctatcttggtagcagactttaagccaaaacagatattaatttcttggattaaaatacaaatgagacaatatattcagctggagcaggggctagcaaaggacagccttggagtcacatctggcttgccacctggtttgtaaataaagttttattggaacacagccatacattgtgactgttttcacagggcagtggcaaagcttaaaatatttactgtcttgccagttttagaaaaagtttgccaactgctgagttggagaatcaaagccagggaaaagatgcactcaaatagcacaaactgaattgtgttccaagggtaactctacacgagattttgagaaatcaatatgcaaataaaatataaaatgtcaataatttcgaaatgtattacatgttgaaataacatctcagatttattgggctaaagcctaattccacaaaaattccttccttttaaaagtggccactggaaaaattttaattacatacatgactcacattttacttctactggacaatgctgctctaacaaattaggctgaacctctgccctgtaatgacttgggcagtgaaagaataacaaagcttaatattgtaattctactttgaaacttggagcatcttttatataaatgaattgtcaagactattttaatacaaggcttatcgagagacaaacaacacctatcacttctcatgaaaacattatccatgttcaaagataaaagcaacactcacacga

SEQ ID NO: 40401 - DNA, 610 bp, Bovine  19866880756000
taaatttcttcctgccttggataatatttctgtgggtcggtaatggaatgtcatacaccagtaacagaagatcagtaaacagctgtaagtggaacatcttatacacttgactatgcctggaacagagcgccacctggatccatgacctcagtgtgagctgacaagggggtcttttccaggcagagataaattaataatggaaatttacttcctcctgcatctttttatctggcaatgccctgaatctctcataggaccttgcttctattaattcttaattactggagctagggactatgaacagtattttggaacttttcacatgtttgctgaagctaagtgctgcaaaaattcaaggaaaagaaagaggaacaggactatagtatggacagacagatggtccttaaaaaacaagatttttctagagtcgggaaaggagaaaggtgagcacttggggaaaagggaaaagcaaggtagggatggaaatttctcccgtggatcatcacatgcccaacgtgccagagaaaggggtttaaaggaagagagatgcaggcaggaacgtgacccgtcagaatcaggacctgggcttcgatgactgacgtgacatgca

SEQ ID NO: 40402 - DNA, 2030 bp, Bovine  19866880791331
gagcatgataaaataaaataaatctacattatatgatggaatatcaacactgaaaacactgacataactctggtcattcaaacatagaataattgttaagatgtattggagatagtagaaaagaaaacggtgtcctggagagtttttatatctgttatcacctccgagaaataaaaaggaaatgcccacctggatgctggtgtgttgattaattaggatacaagaaacaagtcatattgttgacccttagcaaaagcactgtgaggcaggtgggcaagggtggtagataagagttctttttactctgcgccctctataacatttgatatttgatatttgtccataaacatgatttcaaaaatacagcaatcaaagtcttaatgaaagtgcataatacagtcgtccaggttgttttttatatacaagtatttcaactgttttgcttgtgtattttaatggtaaaaataagaggcagagggtagcactaacatatacacactgctgctgctgctaagtcgcttcagtcgtgtccaactctgtgcggccccgtggactgcagcccaccaggctcctccgtccctgggattctccaggcaagaacactggagtgggttgccatttccttcttcaatgcatgaaagtgaaaagtgaaagtgaagtcactcagtcgtgtccgaccctcagtgaccccatggactgcagcccaccaggctcctctgtccatgggattttttaaggcaggagtactggagtgggtgcccctgccttctctggacatatgcacactaccatgtgtaaaacagacaggggggaagctgtcatgtagcacagggagttcggcttggtgctctgtgatgctctacagaggtgggatagggggtgggtgcgaggctcaagaggacagagatacaggtacacttgcagctaacttactttgttgtacagtggagactaagacaacattgtaaagcaactaattcaattttttttattaaaaaaattaaggcaggaataatcatgacctttacatttgatcctatgattctcaagtaattttataaaccatatagaggtcaacttaaaaaaaaaataacaaagccaaaattattttcagaggtatcttggcagtaaattcattagaaaggaaaatagcttttaagaataagagccaatactcaaatgttggtcttttgacactagcattaatttagaacttgagaaaatgatattttaaaaacctgtccaatccagtgtgtacatggtagattctttagcttctttgcaaactatcaagtctttgatctttgctctgaaataatttcacttgtgttgatttcatatattaaaaaaaaaacttgatcttaatctctcattttctttcatttcttcctttttaaccagttgaatttattgcattttttcatcaagtggaaatgtctctttattaagactgctggactgagttcataatgtgcagttaatctatagcagtctttaaaataatatgccaagattttaaaaagattggagttttatgagtaaaattggctgcttcatttgcaatgttgtattaaaaggccttcaggtaattttcctaagaggctaagaatcaattgagttaaaaagacacaacactttgtatttaatggtgctggcttgttcacatagttcagaaatatttttgctcaaataaatgaacaataattgaacaataatgaacaataattcccactgcagtgggaattcaaaaggagtttattaaatcagtttctctaatttttgtataggttttgttccagtcttaaaatttctagcattgttgactccagtcacctaagtttataatcccctcacttctcttaacttcgcctcctcttctctgtcctccctgatcttccctcaaaaggaggagcatctccataagagatggttcattcattcaacaagtatttcttgcatgtttctgtgagtaggcttccctgatagctcagttggtaaagaatctgcctgcaatgcaggagatcccagtt

SEQ ID NO: 40403 - DNA, 1193 bp, Bovine  19866880842278
tagaaattaggctaaagttcttaatataaaaagagttctaacaaatcaataggaaaagcctaataactcaattaaaaatacggataaaagttttctgtaaacagataatgcatagaaaagataattataatggttcctgaacataataaaaaatgctcaagctcagagaaatgcaaaaccataacaccatactggatagccttttttacctatcagatttacaaatcaaaatgtttgctaaaatgctgttgctgctgctgctgctgctaagtcacttcagtcgtgtccaactctgtgcgaccccatagatggcagcccatcaggctcctccgtccctgggattctccaggcaagaacactgcagtgggttgccatttcattctccaatgcatgaaagtgaaaagtgaaagtgaagtcgctcagtcgtgtccgacttttagcgaccccatggactgcagcctaccaggctcctccgtccatgggattttccaggcaagagtactggagtggggtgccattgccttctccaaaatgctgttggcaagggtataaaaagaaataggcagtcacatgcattgttggtaggagcataaattggtaacactccaaggaagtataataatgcaatgacagccatcaaaactacaagggcacattccctctgatccaacaattccacttctgggacttcctcctacagcaatacttgcttacatgcaaaataatgcatgttcagacccttagctataacgctgtcatagcaaaagtttgtaaagaatcttattctgtcagtaggagacaggttaatgtgtgacatccatacagtgggactcagctgatcacaagaaagtgatcgccaaagtgcgctaagaagaaaaatagcccagacagtagtccacaatttgcagagaatattttgtatttgttgaaatatgcactatctggaaagatacacaagaaacaggtaacactggttgcttctggtaggaaagtgggtagccagagagagacataggaaagacatttacagactgtttaactttttgtaccttaaacttgtgaactctgaggctattagctatttttttaataaagtttaaaattaataattttaaaaacatgttcctcattggtaaaatgagagagatacagccctatgactattgttgcccaatttaccatcatacatatat

SEQ ID NO: 40404 - DNA, 811 bp, Bovine  19866880926911
aagactattcctggctattcctatccagcgtctattcctggcttagccaagtaaaacaatgaatgggccaaaaaataaaaggaatcatgtggggatccactcaaaaacacagaaattcaacctagatatcactcttgcaaaatggtttcacaataaacattttttggaagcaagctaaaactaaccccaaagaaaacagaggccattccagtcccttcctctgctccaaagttaagaaatatcactgcttcactgggtggagagtgcaagcttagtcaagttttgtttggtccactcaatgaaaaccaaaacgttctgcatttcttgtcaacactttacacactgggaaaattcacagaaatctacttatctagtccctctgtaaaaatgagaagacctggcaagatggagccttaattatctcaggtctgtgagctcctgttgaccacagtccccaccactccctatagcacacaatctgcatcatctcacttacccttcttacctgtcggcccctaattggcaacccttttacccagtgcttctttttttttttattggcagtttagttgctttatgatgttattttctgctgtacaacaaagtaaatcagctatatgacatgcatatccccttttttggatttccttcccatttaggtggtcacagagcactgagtagattttctgtgctacactggaggttctcattagttatctatttcatacatagtagtacatctatgtcaactataatctccccattcataccacccctgcctttccccccgtggcgtccacacattcattct

SEQ ID NO: 40405 - DNA, 1611 bp, Bovine  19866880964540
tgtgttttattggtaaatctggacagcaaatgaaagtagtaattcagtttgctctggcctgggtgtctgcccatccctacttcaaccccaccctcctcactcatttccccaacccaatcaatggatttgtgaatgtggggttggaattcgcccagtaatatctgaaaatgccctctcacgttgtctgaatctctaaggaggaaattattcagacgactgacgctctttggggcacaatattaaattgatcgtttggcaaggaagaccttatataacttaataccacaattcccataaataccaatcagagtatcaaccagaaggcttacctctttctcaaaatgagacaagttctatatacctttttgtgtagttgttatgtttaatatgtgtgtatcttaacatgcgtaagccaagtgtgacataaatgacaccagtgaaaatacactgccaagcacccaatatgcttgatgaaacgctgccattgtaggactgtttttgagcacttacctttcaagtaaaatatcctctagactgacattatttttgctttttctaaccctcagtgggaattctcttttcaacagaaagttttattgtattcccttctgagacatgactgtattttaatgatttaaacttgcagaagtattagttaaacttgcaataggtatatttgatagctttcttactgtgaacctaaaacgtttgtaaaagttttctttccccaggaaggcatttcttgcatccatttgttcattcattcagtaaatattcattcagtgcctgtttgtgtcagatccagggttctaggcgctgggtgttcactggtaaccaaaacagacatggtcccaaataaagatgaagaaaaatcaaagagaggtgttcagtaggtgagtgaggcatggcgtaagggtgctgtcagggcggaccctccaggcacataacacctgaacagagaccagaatcaggtaagaagtgagagagcagctgtgccaggggaggaagcttggagcagacagaaagtgtgcaaagaccttgaagagaaacatcatgggcatttctttatttctttgtgtgtgtgtggcttataggatcttttatacataaataaataatatatataatgaattatatataataatatatagtttatatgatatataatatatataatttatttatttttagctgtgctgggtcttcgttgctgtgtgggcttttctctagttgtggttagtgggggctactctctagtttcactgcacaggcttctcattgcagtggcttctcttgttgcagggcacaggctctagggcatgtaggctcagtagttgtggctcctgggctctagagcacagcctcaataagtgtgatgcatgggcttagttgctccgtggcatatggaatcttcccagaccagggatcgaacctgtgtttctcgcactggcaggtggatcctttaccactgaaccacctgggaagtcccaatttttaaatatagcccaaggaagcagagttttattattattatttttcttttggccatttagagcctgccttgtttgcataccctgtgaaactgcccaatgccttctagagatacagaag

SEQ ID NO: 40406 - DNA, 1206 bp, Bovine  19866881067156
tcccatccctctgggtcatctcagtgcaccagccctgagcaccctgtctcatgcatcgaacctagactggtgatctattagaaggctctctttactgatgaagaccagaaagagacaaaggtctgtctagtcaaagatgtcatttttccagtagtcatgtacagatgtgagagttggaccataaggaaggctgaatgccaaggaattgatgctttcaaactgtggtgttggagaagactcttgagacagtaaggagatcaagccagtccatcctaaaagaagtcagccctgaatattctttggaaggactgatgctgaagctgaggctccaatactttggccacctgattcgaagaactgactcactgaaaaagaccctgatgctgggaaagattgaaggcaggaggagaaggggacgacagaggatgagatggttagttggcatcaccgactaaaaggacatgagtttgagcaaactccgcgtaatagcgaaggacagggagccctggcggactgcagttcatggggctgcagagtcagacgagactgaatgactgaacaacaagaccagcagatacccagcttttcttgtagcaaacatttctaaagggactgattcatctccagaaatgcctggaggccatcggatgctagccaggcctggagaacattcccagaaatgcagttacctggaggggaggttctttcagtgtctgagatctctcagccctccccaaggccagggcagcaggtggaactcatccagccaaggccacaagggtgtcagttgatgcgtggtgaaatgggactttgaaagggattctctggtccctggcccataccctcaaagctaataatgattaactagtacaaggctatggagctggatagtctccatttcagtttggcttctccaccaaatactgggtaaatgtacaaccaagaagcatcttatcaggtgctattaaaggaatgaaaactactttttaacactgacttcgcaacatgtgataaggaagattaacagatgaaagtgttacataatccttggttaaacataggttgtaattaccctctgtttttcattgtgttttttttattaattaattaatttttaattttgaggagatgcagatgtagagaacagactttgtggacacagtgaaaggagagaatgggacaaattgagaaagggagcgtggaaat

SEQ ID NO: 40407 - DNA, 1118 bp, Bovine  19866881111306
ttttcactttcatgcattggagaaggaaatggcaacccactccagtgttcttgcctggagaatcccagggacgggggaaactggtaggctgcggtctctggggtcgcacagagtcggacacgactgaagtgacgcagcagcaacaggaatgttattaagcattaatgatatacaagacactaagctaaacctattttcttttagtagctatttagcttatatttaggggtgaaatgcagaaaaaaatgtaaccaagaaaaaattgtatgttaagcaccaaatggataatacagactatagtcaaatatctaatgactgaatgagacaaactgagatgtaaaccattacttatcccatttcagagaaaccaaaatcgtgatggagaggcacacacaatcaaatcattaacaggggaagtgaaagctacagcattaggaaatgtgaagcttatcaggagaataaatatgtatgtgaaatcttatactggattttcctgttcctctttcataaaagatgccagttttcaacattgaccttgggcaagatcaaagctcacctgggctaagtcagcacacacttgctaatccttaagtaaaaagatacacttgtgaacagtaacactcagccaagctcacagactccacacacaatcagagacttaaagggtaatttataaccaggtgagtaggatgtttaaggaaccatgtttcattcactaaaccaaggatcccgttcctgccccaagtgcagaaaaagcactcggtatgacttcaattaacctcgctaggcacccatttccccatctgaaaaaaaaatgaagggctttggaatagaacatcctataagacttctcatgatttgaatagattattttccactgataaaggacgagactctctgacaccaaacgcttcccttcctaatactttggatcaaccagaaacctgaaaatttcatccaagaagctttccttaagataaagcgatagcattttcccgagaataattgccagtctcgttgaaactttagccagggaacttatcaaataaagaaaccatctagttccagaccataggcagagtccaggaaagtcaaacccacggcctcaggaaatttag

SEQ ID NO: 40408 - DNA, 1328 bp, Bovine  19866881339037
ctgttctcatcacagttaaaaaaaagagagagagaaattaatatgaaataaccaaaacaaagtttcaaacaaaacaaaaaattctctagcaagagttaataagttaaaagtgcttgggaaccttgaataaaggatctaggagaaacaacagaaaaagaggaaatgcaagcacatctcataaattgtttcaacatccatgaggagagactctgaggaggcaggaaacaaaaggcctctatgaaggatttaagagataaattgtatcccaatctacaactgcagcatgacaaagggttctttaaatatttctgatgggaatgcagtgaattacagctgacaagagggggaaggaggatgggaaagggcaggagttcgggtcaaagaagatggtgagtgtcctcgtcagcctggaatacctgcctcgcctcttcaatgaggcttttgctctttatttaagatttgagagttacttatccttcgcataatttgtttctcatcacaatagaatctatctcagaggtgcttctgttttgattaccttcacattctaaccattgttcattcattcattcattcatatagttttctgttttattggccatgccacgtggcacgaggtatcttagttccccaaccagagatggaacccatgcctcccatggtggaaatatggtgtcttaaccactggacggccagggaaatccctttgtgtgtgtgcgtatttttaaaaggcatgaaattatacgtgattctcacgtagttcattaagagacatttccatccgctgaagtttacaaaaactctcaccactcattgatccaatcactaggcaaacctccatccggaaccaagcacagctccaggcagtgtgctgtgagctgaattatgttgtaaacacagccctttgtatggagaccagggccaagtaaaatccacacttagtgactcctttcaaacatcaatgttgcgcatcactaacatttcatgagaactagctctctgccagggcagcattatctcatttcatcttcacaagtgctgctgggaaaatgaacaccgatcactccacactacagaagagaaaactgaggccctgaaacgctaagtagttgacctaaggccccgaaggaggctcccttgctgtgtctgggagctgccaccttcctctttgcagaaatagaggagaaaggatctcagatcatcatctccaatccaacttttttaaaaggtaccaacagtaggatatatgtgtaggaaacccactggaccccaacacacacagcatcccctccctggtcctgctcctgcagttaatccagaggtcagga

SEQ ID NO: 40409 - DNA, 1068 bp, Bovine  19866881395602
tctttcctattttgagtacagaggaagtcccagtttaaaaatggaaaggagacttggcttcttcacctgcacctacttttagcatcaaaaccatggcaacaacatacacacagttcatcatacattttcacagcagatttatgctgccagggacggctttctgatctgcttatttaaaaccaatgtgaattttatatcaaacttgacttaacacatgacagtgaaatcctacactgtactgaaagctggagaggcccatgagaggtgaagaacccccctgacccagcttctgtgttcatcaggagcaataagaatgtacacaccgcctcggtccaaagtcatcaaagagcaagggatgggccgtgtcaggggctggaacagaggccaggaagcaacatgtcttctcacaccagcctcaatgggtgtgcaagcagggacaccatgtttcttccagggtgtcttccagggtgagctgggggtccacttctcctcccatcaagtgcagctgctgtcacagaaggggttcacagggaggctccccaacaatgagaaatagctgtttctggggtctctgcgatggcacaggattataaacccgaagggcaaaactgaggctcctctaggggcatcggcctgaaaggtaggcttcactgaatgcatgcccacaggcccccaaacaggcacagttctttaaaacgtgctgtgctgcgctgtgctagaaattatccctctaaaagatgatttcaaactggagaagactcttgagagtcccttggacttcaaggagatcaagccagtccatcctaaagaaaaccctgaatattcttggaaggactgatgctgaagctgaagctccaatcctttggccacctgatatgaagaactgactcactggaaaagaccctgatgctgggaaagactgaaggcaggaggagaaggggcaacagaggatgagatggttggatggcatcattgacttaaagggcatgagtttgagcaagcatcgggagatggtgagggacagggaagccaggcatgccgcagtccatggggtcacaaagagtcgga

SEQ ID NO: 40410 - DNA, 1287 bp, Bovine  19866881450404
cgttgacggctacaagaatggcatctaccattactaggagctaagagtgaactttttaacaaaagctttgctaaagacgacttaaaaggcatgaaggatgaacggggtgtcttccttgggcaacacagacagctattctttgcatgaataaaaatatgcatgaaactgggtcttcagtggtgccaaggaattttatctgacccaccaagagatactgtttccaacagcaggttcagcagcatgctctgggaattacggcctcaaggctggatccagagcataaaaactccaaaggtgtcctgtcttgtttcatgcaaataaggaaagtccatacctttcctcctcctcccgtttcctcttttcttcctcttcccgtttcctcttttcctcctctgctcgtttctctgccagcagttgtctgtaaactcttctggcaatctgacctcggagttgcttctggaaaaccacagctgcttttttcaggtgcaaaaatctcctcctcaggaggaaggccctgtagttcttctgtatgatcactacacaatcaaggaccttcttgtattgctttctgaaaaatgagaacgaaaacagcacaacagcattgctgaggacggaatgaggccacaagctcttcacaggagtttatgttaatgttacacgacaagagagcaggatctcatttggggctgatccactcattatgggactcattacagggagccagtgagtaggcccttgtgggcaaaacagaagaaaaacaaaagaataataacagaactcaagcaagaagcctatcatcatattggctaaataaacacatcactcctaataactgactttgcaaagtcctggcaggaagtgaggctgtaaacagaaccaagggatgtgatactttctgctgttcttaggagcaaaagggaaaaggattcaccaccgcaggatggcttttatgtttgagaaaatgtaatgtatgatgatgagatgatgaccagtggaccagcctgctggtctagggatgcacgagaaagtgcctgtctcattgggcaaacccgggagagggggccgctgtggaccccgtgggtcgacaccaaggtaaaccggcgagctgcctgtggcttcagtatatggccccaaggagctagggaaattatttaaatatctcgcccgatgccccccagagacactactgctctgagacatcacgagcccctgttcccacttactgcccacgtcaagctaactggcatcaccaattgggagcactgccctggccctctcctagccggt

SEQ ID NO: 40411 - DNA, 1198 bp, Bovine  19866880347097
ttgttttattgtgtatgagtaggtatgattattatcactatttctggagcagaaaactgaggcataaagaagttagatagcttgctcaaagccatgcaactggcaaaaggaggtaaaaggattccaatctatcccaatgtaatctctgctaataggcacaaagacacatacacagtacaatcacagaaaatggccatggtcataatctagtaatacagctgatacctgaaatgctctctcacacatacgcatacatacacatctgccttattcagttcggcttttaaatgttacacattttagtagggtaatctattaaaattgtttaacaagccacagtgtgtgggacaatctctatgtatcaatgctcagtgaaccactgagcattgtactgaaaggcttatcatgatggattacatggagaagtgtattttaatatcggtgcttaattaatactttagtaaatatttagagtagaaatatttacaaatatttgcaacaacttttgcagagtttcacgattggttagaatggaaacgaaatagcatggatggtaactgtgggaacaggaatgtgcattatactaattaaacgttgtgctgaaacactagcatggttttgtcctatttttataaggaaggtctgatgattaatctttaagtgactaaaactaccaactaaataaaaaagttctttatttgaagttagggacaatcttcaatgtattttgtcccttggcactattttgatgacttttctgtgtctggcctctgattgaacttattttatctcctgaccactagtttgttctctgtaacttgactgggaggcttgcttccctagacagaaaactgattagtggtttgtgagctccccagattttcctggccctgaattttagcaaatctagggtgtcttggcagagggtttaggcctggctacctggctgtcatctctgtatctctgtcacattgcgttaggtctgttataccagtaggtgtcatactgggctgcactttcccacagaaatacatcaggtagaaattcagaagtcctgtgctataaactctgaaaatagagcactctaccatacagaagcaggaagttgtactatcttaattatgaatgcatcaggtatgaaggcctttctctcttcccaggtctactcatagagcttacacgcagcattagggttgtt

SEQ ID NO: 40412 - DNA, 4390 bp, Bovine  19866880393537
ccaggagatggtgaaggacagggaaccctggtgtgctgtagtccatgaggtcacaaagagtcggacgtgactgagtgactgaacaacaaccaacaactgaatattttagtgaattaaatgtaacatcaggaatgatttgaaacacaagtgtgatgctacttgaacagagttgagcccctcccacgtgtacagtcttgggattgagcagtggggagggtactcagtctgcctaagtcaaacaaacatattgaccaagacaaaatacagtgagctctaatcagttgtctaaacggttcaaaatttatctggatgagagaaaagattaatttttaacttagtgaaaactgaaattaaactcactttagcataattgtttataaactctcctttgaatgaacctttttccacatgcttaactgttttctgaacacaaaataattgcactagatttgaaactctttcatgactgagtagagggatctctgaactttctaaaattgtatatgaaattgatgtctattcactttgttcagagatgttccatagctcctatcagatttttaaaggaaccgtcacccatcacaaaccctaattgaatccctctgacacaaaattagcttcagaaatatattccctgaattttttgagaactccaatatttctgtaacacatataagaaaagggaaaagtaattaaagcaaattgctacagtgagctaaggagtagtgcacggattataacacgttttcacagagttccagctggcatagacaaattagagcagccttccctcttagacttagcacacagagaagacttgaatcgctactggaccaacactcaccgttaggggacactccaagcgtcttgaagtttgaaaacatatttctgaactaactcaaaaaggcatagagctaagtaaatgcattttcattacacaaattactaaaaattaatgtaggatatacctctgagttagaagttttctgcagatttattcagcctacaggatttcagaagagtagatagatgcattgtaattagaggtaggattacatacaataatggaaataagaaaccattaaaaaattatagattctgaaattttaggcttcttgctaagctctctgaagctgcagctgtcttttttaaaaattacatcaatgcttctgtttaggaaaatggctgggaatgaaaataaatctttgtgtcactaagtaagatattaaaaaatcacagaaaaaatggttgttcctgatgcatatagttactgagcacatgtgatttgaaaataagatattcatttctgcatggctcagcaacacaaatgcgatttcaaaagagtaacctgtgaacagaaatttctggtatgtcatctgactgccttcaccaaaatgttttccagtgaattataaaatgtaaattacccttatgccttcagccgtgcatgaactgaatctcattctagatgtgtgtctattgctgaaatcctaagctctattgctccattatttctattgctccaaaacttgttttctttttctctgtggccatttttgtactcctcttgctccctaagtcataaagtcctgacattctgcagctgtctggagcctcttgcttccccacaatacaccaatgactgccattgctacctttagtcccaaagcaggtgcgctttctctcactttccattctaagaccattatacctcttcccaggtcactatacttctgtctccactccagatgccctctgtagtgactccatcactgtttaacattgcattctctggatgaacagttccaactactttcatttttactattctttctttttacttttaggacttccctgatagctcagttggtaaagaatccgtctgcgatgccagagaccctggttctattcctaggtcagaaagatctgctggagaagggacaggctacccactgcagtattcttgggcttcccttgtggcttaactggtagagagtccgcctgcaatgcaggaggcctgggttcgatccctgggtggggaagatctcccggagaagggaagggctaccaactctagtatcctggactggagaattccatgaactgtatcgtccatggggtcacaaagagtcagacacgactgagcaactttcacttcactttctacttttaccaaaatatccatctgcaaatgctaaccattaacatttgctctgcctgatcagtaaaaccattatggtaagatgtgttttcaggcttcagtggtagctcagctggtaaagaatccatctgcaatgcaggagacccccgttcgattcctgagtcaggaagataccctggagcagggataggctacccactccagtattctcaggatttcctggagattcagatggcaaagaatccacaggaggcctgggttcgattcctgggttgggaagatcccctggaggaaggcatggcaacccattccagtattcttgcctggagaatccccagggacagaggagcctggtctacagtccataaggtcgcaaagagttggacacgactgagcgactaagcacacagcacacacaaggtgtgttttcaggtccttcaatctaaaccattgctgatacacgtggtttctaaatgaaacactaaaatatttaaaatcatccaaggccattggcctttttacaatattattagtcccaacaattagttttcatgttgtatctaactattccttttgttttgttcttaaatttaaaaccttggtttgtccttgaggaatatttattaagttaaccttttcatttagctacaaacattttttggaggaaggaggaaaagaaaataatgccttctttgccatgtatcctctcctatctctatttgcacctctatattttcttcctttttctattcccatttaatagcagttgttgatttgagtacaaggatagtgaaactactggtatgagaatatcatataactttttgaaatatttttctatacttggccattgaccattttcagtggtgattataagaccctgctggtttatttgaacaagacgaattttgtttagatgtaatgtttgttcacagacttctgatatgaactggtctctatctactccagtgatgtttcatacctcttctcagatttacactggagggaaggatgatgtgcacccctccagaggagctctcagcttcttgcttgcaggctttcccttagttcacctctgctttcctgaagcagcatcactgcctaccctcactgccccagcttgggttactctgaacatcaaacctcaaactcagcctctcctgcctcacctgtcgcccaaagcattttacttagtaatacactgcccaagggcaatgcacccctaccagtatttaaccacttccccttcccatgaattggccagtcactttcagctggaaatatttttgataggaatagtaatttggtagaaagaaatggtatttgaaggtggcatgttggacaaggtggcatgcaattcagtgtctttgggttagggagacagctgagtgattcagatcctggggctctgggtttgggaaaacaagagcaatggttggaagtaagaagggtcttattacttttttttcttggtgtactgtagtttatgaatcagagcctttataggccatgagaagaactcctaatactgtaccccctcattggtctcagttcttggaggtgatgggagtttacccattttcttgtctctttcttttaatggaaagttagaaaaaaatggagggtggctgtaactgaagctgctagataaaacgctgtattaaatgaggaggctttccttaggagcttatcttctcaaagtgcctttgaattataatcctttttactcaggcacaaataattttttctgaatttggtgttatttatgaacctgattactatgcatagcagatcatattttccaaagatggccacaaaaatatcttggcatctcccaagctctcttgcaacacgaccttgacattccctcatcaagaaggagagttgatttctccacccccttgaatctgggtaagacttgtccttcttgatggataatagcagaataacgctgttaaggtatagcctttcctgacctgtcacttttttcttcttgttttttgaaaactttctctaggaatgttcacactgagcctagctgctattctatgagaaacccaagctacaaggaaaaactacgtgtggttgtcccagaaagccagggagcgagttaggatcagctgtcaccatgagaatgagtcatctgaaatatccagtccagtggaactttcagatcatgatgccctggcagccatgtgatttcaattaatatgagagtcccaaagtaag

SEQ ID NO: 40413 - DNA, 869 bp, Bovine  19866880640014
gaagtggtcaagaagcactgattaaggattcagattaattttcaggactactgctgagaattttgatttgttgcagactcttaacaaaatggtttaagctgcttctagtagttttccaaaacttgtgcccttacgtctcagattagttatctccgtcatgtagatctctgtttaatggagtcatatagacaccgtttaacgtggagtttgaatataaggaaagattgaactgaagtcttatgtgtgttgccattattgcactgtcaaggatattttcaggatggaagaatagcaccagttaagaagagcgctttaatggtaaggacaagtaaaagctagaatagaactctttcaaaatgtgtataaaaaaataacactttgtttcggatatcaatggtgcacttttaagatatgacaggtaaatgctgctgaaaactggaatgaccaaattggaatatctctaggcaaaaaggaaattgctaaacatagtataacaagctgcctatcattccaaccactcaagtgactcctgatagttgaccatattctttttcccaattccagttaattctctgcattgtagcttatgcattttctgtgatatgtccctggaacacctgaaactgtgccttttgtgacaccttctgctactaatttctcttatactcatcttaaacatgtttctttctccattcttgcctaactcgaatatgatggtgggtgtacttctttgattaagaatatgagctattcacttgaagcttccattagtgcttggagaattttctattgtttgaaaatattagccagaagtgagatattttaagtcaaatatcctgtgattgacagatcaccaaaccaagaataat

SEQ ID NO: 40414 - DNA, 1299 bp, Bovine  19866880715854
ggagaaagattattcaatccagctgtaccctgatccttattatagactcgagtttcaattccttttaattgatgatgcacagagaacctcatttaattatttgggaggataaaggagtaaaaacaagggagagaagattgatggaaggatgttagcaaagattcttcacctacataccaccattttaacatccgaaatgtaatttgcacatattcaacaaggaaacatgtttcagaaagtaatttaaatttaagctaaacagctggtctgcaacaaaagctatcctccaagcattttttttaaatgttaaatataagcttggaagaacagttcctaaaacatcccacagcatacactgttaatgaaaattatatgttgcagtgggtgtggtgatatatactcacccaatattgctccatataaagaaaaaggaaaccaaggtcaacaataataatttaaaaacattaaaacataagaattagtccagaaacctatgaatacccaggctaaaagttggacagtaaacgggagtattccttttaccagcagataagaataccctagaaatttctagaataccctagaaatctatattagaagcccctaactgtgagaggtcgtgactaggaaaacaaaaattacaattatatgaggtatgaattgccctgagatgtgtaaggtatgtgttatatcataattccttaaatgtttcaagtgaattaaaaaaagatcaattcgctactcactcagattagcaggaagacatatcagtcattttgggctttctgcaccctgttaagattgccagaatatttcgatagataaaaaactgaccttccagcctactagcgttttgagctgaaaaacgcctcggtctgtggctgccacaatcgccattcattctttggggacacatgctactgtaaagctctagtttctcactgcttgtccaagctgtcatgccatctgtgacccgagccaacaagctccatttgtggatgggcagcttcactcactttcaggcccagactggccacagaggggctttgcctgcccctaagggcatggctcagaattcacagcgttcccctcagattcctgaccctcggagttaccgcatctaaatgggttcaggactttctacctcccaggagaactatgatcttttcctcatcttactcctggggacaagcccaggcagacttttttttttctccttttgacactataaatttagattgatttgttctcctccctttttgtaaaaattccctggtggctcagatggtaaagagtctg

SEQ ID NO: 40415 - DNA, 1001 bp, Bovine  19866880760214
ctcacattcatacatgactactggaaaaaccatagctttgactagatagacctttgtcagcaaagtaatgcctctgctttttaatccactatctaggttgttcatagcttttcttccaaagagcaagcatcctaatttcatgtttgcagtcatcatctgcagtgattttggagcccaagaaaataaagtctgtcactgtttccattgtctccccatctatttgcgatgaagtgatgggaccagatgccatgatctttgttttttgaatgttgagctttaagttagatttctcactctcctctttccttttcatcaagaggctttttagtttctcttcactttctgctataagggtggtgtcatgtatttcctgaattgttataaaggaggagtagatgaaatctaaggtcctttccatctctaagtctatataatatactcactctataagcaatctggctaaagatcatctattgctgttgtttttcccataaatgactcttctaaactgtactggtatttctggaatacctctgtctgatacaaacagactgaatgatgaatttttgaccaacttttatattgttatgctaactaaagaaaggggcatagcaaaaagggctggctggtgatcctaatcttaaatagtaatggctgcaaatgatgaggggactcatagtatgtaataacaatactaaaaagtgtggtcagctcatcacttgaagagtaagaatcaagatgggatatctaatcacaatgatatattgtgattatatagaatgacatatatagaatgacagaaatatcaaacatgcatgctaacctaaacataagaaagaaagattaaagaacaatgaatagatcctggtgcaagatgtggttcagggtcataaaagggacttgatttgaatcagtaacttaatgattcataaatggtatatatttccaactaactgaattggaatcaagattgccaggagaaatatcaatacctcagatat

SEQ ID NO: 40416 - DNA, 913 bp, Bovine  19866880842331
gtctgtatctgtaccaaaataaacccgaaagaattgttaaaacttgcaaacaaagcacaaaaaggaagctggtgctctttgttatagtgtataatagaaaactaaagagtttgaccagaaatcctctagctgtggctattcctgcacaactgcctccagaattacatttatactttttatacttttgttcatgttccagtaaaaaatacaatctattttatatggcttgctgttttctagtcttggatggcttgctcaggctaacatttttttaattgaataattcaagcatctgacataaaattataaacttgcactgacaaccagcaaaaaaaaagcagacatggcataaaatatttaaacataaaaccaatgaagcaaaatattgcagggcaagatatagtctcccaccccaactccaagcagcttagcctttctttgctgatttcttttttctctgtttctctttttggcacacaataaacactaaaaattaattcagaaactattgtgcatctttgaactcaaatttatttggcttctgtgtgctaatatgaagtttcacctataaaatgagaagtcagagttaataaagagctattgaactgtgcccaatgagagagacaaagctgaggctgatggttcttattacttgccactaacaccagggttgatctgaatgtctatgacagagcctttgagtgtggggaaatagtaatgtgttattcaggtacagatccagtctttttaatccagacttctgagagacagtctttatgaaagaccccactaaaaacagagtggaatcctcttcattttatgcctaacaagcacatacaagaacacacaggcatccattttacaccccacttttaagaccagggctttcctggtggctcagatggtaaagcat

SEQ ID NO: 40417 - DNA, 4182 bp, Bovine  19866880918795
taaaatttaaaaaaatagaaaggtaattaacttaacaactaaaagagaaataacgctgtctccaaagcacttaaataactgaaaccaaaatactgtgtcacctctagcatccttttctgctcttcccaagtccctgttcaaatgaaggatgtcacagaaattgctcttagaaatctctcttcttccatctatactgtcacagtaaatttgctctcttttgcaatctgaaggtttatagcatcctaggaagtaagagggaatagttattccttattttcaatcctgatagctgctgatgcatcagctatctcatctcatggttattctttcctttcacagtctattaacttgcagttccaggcccagaagtctgtaactaactgtagaggccaccacatgtgcagggatttaagtgttatctccctaagctcaatgtgttgtccaaaatctgtgggtagaatttcctctttcaattcaattttattttatctgttaaccttggaggaggagagttgactgagacttgtcttgctttttcaattattaatgtttttattctctctccacatgtttttcttttggtgtctactaactagttttaagggaaaagtaggttattcctttgatgattccctagctgtcattattgaaaaccatttactttccctggattttgcatgaaagctgagtcaaaaacagaagagttttacattggcaaagtgcacacaagatctatcatcttgtagtccgataattctttaaaggaactaaaagcacagtgttgttagttaaagctgagctttttcctacattcactcaggattttagaaatatattttatcttccttaacaatgataaaagcttcactgtgactaaaggagatagctacttgaagcaattaccagtctaggttcagtgtttgctgaagttttcccaaccctgtgtctaaaacctaatttgttcttattctatatgtagttagcttgtcctactgaaaaatagaacatttaacgtatcaagggaataataatcaattattttttagtaaaaagcaaaagtaattgggaaaaacacttacttgacatgaatttgtcttacttttatgagtttataaagctaatctcttttccctgcagtacagttattattattaaatttattttatgtcaattcctacattaacagacaattacattattataatataatctctgggtgtgtttttcaagagtttattttataactggaaactgaaatggaaatgctttcaattgcatatgcaaaaaattaggaaatgtgtactaacacaaaaatatttgaaaaaattacaaaagtccctcattcagggtgaacagagaagagatttggtatgcaaggcggcctacacctggatatcactgtctggaatttcacagaccctaaaataatcatttttactttgtaatatatagagtcaataggattactttcttgaatcattatccaaagaagaaaatgtaaacaacttactcctgtcaaatcagctcaacacagagcagcaaagcaagaaatgttctctgtaacaacccaaacggttaccttttctcaaagctaaaggataacaataatataataaagttttgtgttgcattattgttcattctgcctagcattagtgaaatgctgggcaagaattgggagttctgttttcattttttgtaggtaaaaccctcctgccctctatatcccaaaacaaatggctttagagtgtcaaatggcagtttcaagcagggaagagacgtgggagccagaaagaattgtgacttcagatacacagatctaaaactaagtatacttagcttagggaaaaaaaagtttttattcgtaggtgcaattccaaaacatgatatttattttgcttctttgttactcactggaagttgtatttctattcaaacatagctcaattataaatgctaaaaatatgaatacttggaactgggtttccccagtggctcagtggtaaaggattcacctgttaatgcaggagcctcaggttcaatccctgatctggaaaaatcccctggagaaggaaatggcaacccactccagtattcttgcctgggaaatcccatagacagaggagcctggcagggtaccgatcatgaggttgcaaagagtcggacaggacttagtgactaaacaacagcaacaaatcaatacttggaactagtgatatactgctatcttcttatgaacagtggcgctgccattaattctgtatcactgaatataaatgccatttgggcaaaaccactccaccattttttagggagaaatgactcaatttggttatgcttccttaatgagtccccagattgccccagcaagagtctgaaattatgggcataattctctttgggtacatacttgttttccaataatgaatccaagcagattaatgaataattaacaattctttggtggcataccaaagactctaccttagttcaggccttcttatttatcagataagaggaaaaattgctttgaaaattctaaacatcacagacttgtgaacctaaaataaaacccagcaaatttctctttggatgtgggaaaaaagttctcatctctctacagatgaatgaacttcccaggacagttcttctaagagagcttttattttctatttaaattttgtagccacagagaatttcagataggcctttaacttctctggtcagttttctgcatatacttctataaactgagttctcataggtcatgtctggatttatgcataggttgaaaaaggttctcacttctgtgctgacccttgacaggttctgtaacagtatcctaaccaaaaactctttggccaacagttgcagtcacttgagtgtttagccatttttgaagatatgaaacctgatataaaagagataactcattctcaaatcatacctatatttgagagagtaattattgcccatgtctcatttaaaacagaaatccattccctctgttacattatctttaggcaaaagctttatcaatctccacctcccatcaaaattaagtggatttaaacatatattggcttatttggcttttcctattaattcattctatttaacacgattaagcaacaggtgtataagttctggagatacacagtgaataaaacagataaaggggaaaataatggggaaacaaacacaatagatggataacaaaatactatgtgatttaatttcagatagagatagatacaaattatgacgtaaagcaaggtaatggaatgtatactgtatgtctgtgtgtgatctccttgaaaaagcataattcaagcaaagacctgaatgtgaaaagaaaccagtcatgcaccaatttgagagagttgtagtctaggccaaaggaacagcaaatacaaacagccaccaccacgatatcactttgctctaagatttaattaatttaaattcatatctatataaatatatagataaaaaatatataacacctatttctgtgatacatgtataagtagatgtatgtgtgtgtgctcaggcatgtctgactctttgtgatcctttgtactgtaggctaccaggcgcctctgtccacaggatttttcaggcaagaatattggagtgggttgccactttcttctccaggggatcttcctggcccagggatcaaacccacgtctcctgtattgcaggcagattgtttacctactgagccattggcaaaaacctatttctgtggtaacatcatctacatcagtaactgagctcaataaattgcataggattctgaaagtcaaactagtctctatctctctggtattgtcacaacactagtcaaaaggagtagggacatagtaccaagagaaatttgctttgtacatctcatatggtttttaaatgtgagtttttaaatagattgatggtaaaggcaggtgaccccttctttagcaactgttctttcatgacttcagattttgctctactattgatatctttccaaatctgtcatttgctgtctttaaaaatgaaaatccatgaggattcaacactattaatttattattattaaactggcacagtgtttcccttcagttaaaataaagcatttgtgtcagtttagaactctgacgctatcactgtgtaaataatagacctaccactcaagga

SEQ ID NO: 40418 - DNA, 1350 bp, Bovine  19866881220640
tgggaaggactagaaatctcttcaagaaaattggagatatccaggggacattttgggcttcctaggaggtgccaatggtaaagaacccacctgccaatgcaggagacataggttcgatccatggatggggaagatcccctggaggaggtacatggcaattcactccagtattcttgcctggagaggagcctgacaggctacagtccattaggtcacaaagagtcagacatgattgcgtgaataaacaacaacaacaatgcaacttgtcgtacaaaaaagatcagtggtgcctgggaagggagtggaggggaccagacttggaggaagagagaaaagatacagggacacgagcaaacctttgctttttactctcttgttcttggtgacaactttatgtgtgagtacgtatatcaaacattaaattttacacattaagcatgtattatgcattatatgtcaattagaccccaataaaactgctttttaaaatacttaacaaaaagttccaatactaaggtcatgcttcagactaattaattaacatctctgggggtgatgggggtgagacccattcaagaattaatagattttaaagttcccccagtgattccaaagcatggccaaggctgagaaacactattatgcagaaaatctccagggaataataaaggaagaatgtgatcagctgtgcacaatgcactaaaaattataagtaatatggattaagaagaatctagaggatccaaatagggaagaagttcatgtgcagcttagaaagaagagagacagatcaaaaaaggccccaagtcaccgtgcaatctataacattagctcttctgagttcaactaatcctttattctgagaatcacacagaaaacctccaggcaagactctacaggggaggattctattgactctgtgacatggtgatagattacttagattttgtaacaaatttgcgaagtgggaaaacgtacacatatatatactttgtttctattttaagtgcccctggtgaactcttgaggaggaagaaaaatcatagtttaagactgaagcagttccttcagaacataatacaagttgccatagcatttattaatagttttcaatttaaaaaaatccctgtacacctgtggctgattcatgtcaatgtttggcaaaaccaccacaatattgtaaagtatttagcctccaattaaaataaaataattaattttaaaaaatcaaggcagaaagcaaatgtttttatttcccttcttttacactacaagtcaatcacatatacataaaagtccatacaaaacacaggtaccttctattttaaaaccttcagtttcaaagaagca

SEQ ID NO: 40419 - DNA, 793 bp, Bovine  19866881312173
tctctgcttgctttgcccatttggcctggcatgctgtctactttattgggccctcagatacttgtgtcaaatttctgtcttatagtttaaacatctctgctatgtctgttctgttaatgtttgttctgtatcttcaaattgtgctttttgtcttttagtataccttgtagttttttctaaatagctggaaatgaaatactgggtaaaaagaactgctgtaatagccccttatttacttggtggtgagatttggggggatgtatattgctctatatggttcctaaggtgggatactttacctcttttctaatgtattgtttagaaacactgtttaaggtgaaatgcattagttttgacatattgtcttttgctttcactcacttcaatatgtttttttcatttcttttgagacttctcttatccactggttatcaagtttataatcttggtttagggttccagtatattggatttttcctgttatcttcctattattggtttctaattttatccttttgtggttagaaaacactgtattttttaacttgctggggtttatttttatggttcggtatatgatatatcttagtgaatgttccatgggcattggagaaaactgtagattattttttcaggtggagtgttctgtaaatgtcagttagatccatttattaatgatgcttttgagttcttctatatccttgttgatcttctgtctaattctattataatgtctgaaaatcaacctaaatcaaaaacatacaaagagctcctagttatttacccaattaat

SEQ ID NO: 40420 - DNA, 1515 bp, Bovine  19866881526906
ttacataaactgttggaatgaaaaatcagtttatccagcaaaatagtatattactttagtcagcaggcacaaaacacctttttcctacaaacactctgaaaactctgcttcttgtccttttaggaactctgacaaggaccttacatgaatcattcattttgtgaaaatacaatattctgtcagcagcgttagctagcccagttggattaggaaacagaatcagcattaaatggatggacacaggatgaaatagagtctgagaccatgggggttactttgaaagtggtagcctactgggctcagcagaattttagacttcatccacacaaggacagaggtgcctgtaaaattttcctagccaagacatatgttgaacaatactatttcaccagtgaaaatttacttccaaagttctttgtaataatatatgaaccttctagtgaagattcagatattgatatcttaagactctttcatagctccagtcctgagagtggactcctgactatttcaaatgttaacaatgccttaggttgtgacttcagtttaacacacacactttaggcatatgcatagaaaaagactggaaaggagtgcatgtaaatatcgacaatggatgggatgggggagttgtatgaaattataattttagaaatatttttcctctagttttttatattaagcatataattttgtaatcaggaaaaataacttatttgaaaataattttattattttcatggataacatagtattttctattttgatcttctcatccccagatcatgatcctagataccattcagactgtcttggtgactctctcaccttattatctccagttgtcttaactagcagtgtaagaatcctacacagtttcccttggatcacgcatagctttagggacactgaggcttcttgctattatttccttcctcttgtgcctttggcatatgatattaattgttcaaggcactgtttctcctgaccatatattctcctctaggttattccatttcactatgcctaaccagctggaattggcagcaggtgaaatcagcaaagcctaaactaatctggagatgtagagagtctagccatgcttggagtgcccatgaggcaggtcagctggtttctacttatatggaggagtaaagagcttattggaaaggagctcttccaaaagtaagaggggttaatatacagcaacttgatcgcaggacaagaattgttaaagcgaaaaagtggttttgaaagcagggtggcatttgctaggccctatttatttttgccacagccccatagctgaatcctaagaagcataaggaaacattctttatgagtaagctgcgttgacagaaatggctaatggtgttcccactggagcataagaatgaaatcctaatatttcacatttggaaactgtagagaagaaaacagtacagtgtatgccaatcatccctctggaactttccaaactaggagtaatttgaatagggatggagtttctgaatt

SEQ ID NO: 40421 - DNA, 1085 bp, Bovine  19866881542325
ttttctcctcttttctaatgagaaggtgaaaaggactcaatgaaatatctattcccatacagcttttgaatgaagccagaaccaaagcagattttctatggagcctttctcattaaattacaaggtcaaggaggtaattgctcacttaccttccatggtagctgaccacaaagactttgttgtttgtggcatactctgttgtagctggttagtgatttttttttccatctctgggaagagaaatccatcaaacccaagaagaaagggtgaaactcctcattctatttggagctcactttaagtagggggagggctaactaagttcaataaatcttaaccctgtctcactcaaacctggagagcttaaaaggtgtcagcacacaggctctcctctccaggaattctgattcaattggtttagggtggtatctgtctatttttaaagctaccttgaatggatacatgcccaggcatgtccaactcatttgtgaccccatggaccataggcctccaggctcctctgtccatggaattttccaggcaagaatactggagtgggttgccatgtcctccttcaggggatcttcctgacccagggattgaacctgagtctcctgcatctcctgcattggcaggtggatcctttaccactgccctgcctgagaagccccaaaagctaccttagtgaaagtcactcagttgtgtccaactctttgccaccccgtggactgtacagtccatggaattctccaggccagaatactggagcgggtagccattcctttctccaggggatcttcccaacctagggatcaaacccaggtcttctgcattgcaggcagattctttactatctgaactagtagttccgagttatctgagccatctgagttctctagtttgaactgaaaactctgagccatctgagtgctctggtttggggaacttcaaactagagaactaccatatacttaccaagggtttggggttgagcagttttgcatcagaagtaggaatttctttggtgcaaaagatgggaatgaatatgccagcttgagagaactgtaagcagtgatgcagaggca

SEQ ID NO: 40422 - DNA, 902 bp, Bovine  19866880359419
cttaaggatatttttgaatggttatgacctttggatatggcaattgcatgattcatatccattttttacaccttcccatttttagtcctaaaatcaaaataccaatatcaaagtttttatcatatgctttgctctaaggcaatattaaaattattacaaagaaaaagaaccagtttctgtatggaaaactaaagcagagtattgaattaaaacctgatgcttctgtcccttggaaagtgtaatcattttagttcagcatcttaaacaggatgacagctacagcctaaatggaaatttctagattccctgtgaacctttgtgaatttcctcaagaagtgcttttctgaacactcttgaagcccttatccatttatgaaattctaagatttataggagctacctgagtgtttatttcatctgaatatggaatattaaaattataccatatgattagatttaagaacatgtaaaatctggatctgtaaatttagaaatatttttattcaccctaagtccttattggtccctcaatattttgtcccatgaccagatgttgatagcatgctagtatagtctctcatacttaaatgacatatttcgagggttttactatcattaaagatcatcttgtccttctacatacaggcagattcttaatcactggaccaccagggaagtcccagacttttgtacagttttacctgaggcaagaaacacttaagtgaaatatctcatcacttgtgaaagaatgcatttctctttatttccatccctcccctacattcttggttcatcctgaaagccattaaaattacactttcactatagaaaatacatcagtttagttcagtcgctcagtcgtgtccgactctttgcgaccccatgaatcacagcacgccagg

SEQ ID NO: 40423 - DNA, 4070 bp, Bovine  19866880369721
acccttgtcagcaaagtggtatctctgctttttaatacactgtctaggtttgtcagagctcttcttccaggagcgagcatcttttaatttcatggctgcagtcactgtctacagtgattctgaagctcaagaaaataaaatcagtcacggtttcctctcttcccccatctatttgccatgaagtgatgggactgaatgtgtcatgatcttagttttttgaatgttgagttttaagacagttttttcactctcctctttcactttcatcaagaggctctttaattcctctttgctttctgccattagggtggtatcatctgcatatctgaggttgttgatatttctcccaggaaccttgattccagcttgtgatttatccagcttggcatttcacatgatgtattctgcatataagttaaataagcatggtgacaatatacagccttgacatactcctttcccaattttgaacccgtccattgttccttgtccagttataactgttgcctcttgacctgcatacaggtttctgaggaaacaggtaaggtgatctgctattcccaactctttatgagttttccacagtttgttgtggtccacgcagtcaaagactttagtgtagtcaatgaagcagaacagatgtttctctggaattcccttgcttttctatgatccaatggatgttggcaaggtcttacaaaggatttacaaatcgcttcctaaaggcctactccaacttgaagatgcattttgttctgtttgtacaatgacgtttaaaacttgtcattatttaaaatatgaatttgacaactttcaggtcatgccatctcccctccaagctcaccacaggcctcaccattgtttatggtcaaacacgcctgctgtttcaagtgtttatattatctgctgagcccctagaaacatttgagttcacagcctgccttggtcttgcaaacagtccctctgcagtacactctggttaaccaacagatccccacaccacctctgcccagcacttactctctgcttctcatttaaaaaacacgtctcatcccaatagctccttcctttctctgtttttctgttctcttccctcagaagcctgagggaaacatcaataaacaagaggatgtgtttctcttctctccctcagcttcttccccagggaaggaggaggagcaccaggtatcaagagagatccaggacttccctggcgctccagtggtcaaaactccatgcttccaatatagcggatgcaggtttaatccctggtctggaaaggaagtgagttaagagcatcaagaggagggaatgaaggaggaaacagacagagctggactccatcttaggccaggctgcgaacattaggctacaggcatggtcacccgcccagtggactctgaactttgtgcctggtgtctgtaggaatggcatacccatggaaaaccagacccctggataaaagggcctcaggacttgtacttggactctcccttgcctaaaagaatatgccaattatctctgtaacaaagtggtaaattccattatgtttatgaggatatgaccccaggcctattgataaatatccactgtttatctagtcttgtgacacatgaatcatgcgttaactttgatcctatctctcttttaccttgtccagactagtttcaaggaatctggggaggtgggtttgagcaaatacacttagggtatatgaggcttccctggtggctcagacggtaaagcgtctgcctgcaatgcgagagacccaggttcaatccctgggtcgggactatcccctggagaagaaaatggcaacccgctgcagtcctcttgcctggaaaatcccatggactgaggagcctggtaggctacagtccatggggtcacaaagagtcagacacgactgagcgacttcacttcatacttcactttactaaaatataggtaagcttagaaacagagatttggggaacctcaacatttgactcaagaattttcagagacaaaacttttacctgttctgatgaatcacaaataagttaaaccaagagttctcatcttctttgggtctcaacattgttacttttttgttgacaaacattcgatagagcctttcatctggaatagatcctgaaatagacattacattattttaaaagttttgcttctaaattatgtgcttctctgagtatctcgttttcctatcagagatattttgaaatctgatatcattattcacaaatgaaaacgttccaagttcatgcctgacagctgctgagcagttgttgtttagttgctcagtcgtgtcggactctttgtgaccccatggactatagcccgtcaggctccatctatttgtgagatttcccaggcaagtactggagtgggttgccatttccttctccagggggtcttcccgacccagggattgaacctgagtctcctacaagtgtcccggattggcagggggaatcttcactgctgagccaccggggaaacctgctgagcagttgcattcaaagaatgtttttcatgtcaagcatactactactactactactactactaagtcgcttcagtcgtgtccgactctgtgtgaccccacagacggcagcccatcaggctccaccatccttgggattctccaggcaagaaccctggagtgggttgccattccctcctccaatgcatgaaagtgaaaagtgaaagtgaagtcgctcagtcatgtctgactcttagcgaccccacggactgcagcccaccaggctcctccgtccatgggattttccaggcaagagtactggagtggggtgccattgccttctctgacgtcaagcatacataccttcaaaacctagaaaatatagaataaaaatctgttttctatgctcatagtcttattaaaatttttaacaatattgttttctactctattttttctatgtgtactcttgatctaacatatacattgtaaaatacacaggaaatgacagtagaaggggtgagattttaaaatgtacttaaaaataatagttttatgtatattatgcttttaaataaaaacagtgtgcttttaaataatttaatgacttttcaataactcttcctaattccccaaaggatagtataggtcaatgaaaataaacatgcaaattgtaattttaaatactataaaaggaaaaaaagtcaggatgctaagaaggcaattatcagtgggaggacaaggttactacttcatggagtgattaaggaagaaaacccaatgctgcagaagtataagagctagaagaggtctagcttctagagagaactcctagtgctgccaatgaaatgatggtggaatgtatgactgggataaaaaaagcaagacatgaaaatccagggcattagaaggttgatctacttagctgcagaaacactaagaacactgacaaaattggaaggcaagcaggtaagaaaactgaggtaatggaaagggcagtttactggttggcagttagcttcaagggtacctgaaaaggaaggacaggtggtggcagtggaaagcaaggagagcagggacttggcctccagcccttccgccctagagcctgtgagaggccaggagaaaactgcacaagacacaggagcctcgtgggccactgtcactgagagtggcacagcacagggagcattcagggactgatgatatgagtctgctaactaaaaagggctctagcatatggcaccccactccagtattcttacctggagggtcctgtggacagaggagcctggtgcgctgctatctatggggtcacacagagtcagacacgactaaagtgacttagctacagcagcatataccgagctggggtgagagtagatgctggagggtagagactgagtccagttaaggaaaatagaacaggatgagatgagagactggggataaaagggatgatgggaagcagtttgcctctggcagtgactaaggcataatgggggtttgtccttggtttgaaagtgtgaggatcaatcattttcttcagatatgatccccaacgttacagtgattaaaatattgg

SEQ ID NO: 40424 - DNA, 2174 bp, Bovine  19866880416733
aaacaactttcagaaacagcagtgacccccagataaaggtcgatgcagcttcccacagtaagtggtgaggacctcaccccgtgtgtgtcaccttccgacccctcagagcccttcgtaacctaaaggatctgggcagacggaatgaggccgaggtggaggctgaccgtggctgcccctctgcccactctgctgtgagtgtcatggggacagacctctcccttcactgctccctgactttctcactgcaccctgcttcggccaggcatgacctacctgcatgagccatttgaactgcctggagtctctgagtccagatggcatcctctttctacccccagagctgggtggtagggtggtgtaacccaggggctctacaatgaattaaggggtacttgattttgtaagtaggacctacctgccttgttgtgacaagtgagccacatcatctggatttctcatttgcttcaagctgtattctgccaatgatgcccagttttgtgtgttttccaggtcatcatgcatccgttaaaaccccggatctcaatcacaaaaggtgtcatctacatcgcagtcatctggaccatggcaacgttcttttcactcccacacgctatctgccagaaattatttaccttcaagtacaggtgagatggactagtagagagcagcctgggggcctggaggactttgacagatggaaacttgagcctcctctgaatctcagagttactagcaccaagttactgtgccaagctggtctctctgcttccttcccatcctgttgcttccaggcctgtgcctatcctctgaactttttttgttttgctttttttcctcatcctttcttctaaacactttacagctcttccttgttattctctgtccctttgtttgcaaggtcaaggcaagagcaatcagcttctgccactggtgacatatactcacccagactgaaattcagaatcacctagtccctttttaaaatgatgaggtttaagttctcttgcaccacctacaaacaaacctgtatatgtctaaatttctcaggcaggatgctgtccccacacacacctctcatttatcgtatgctttgtcttgtgctcttctagaaaggaaagcactcagtgttgaaatttaagtacttgtgcatgctgctagctcgttaaaggtgacctcccctgttagactgtgaggttggggggaactggctccatttctgattttgtcatcttgctgtccctagcatctaaatgactgtctccacatcacaagctctcagtacatatttgctgaatgaatgaatgaacgtagagtcatctttatcagttcatagttgttttagctgaagttctatagaaatacatcctgagataaaggaagatgcatgtgcccatgggttttaagaaagtgctcccaggggacttccctggtggtccggtggttaagaattctccttccaatgcaggggacatggattcgatccctggttggggaacaagatcccatgtgctgaggagcaactaagcccatactgcaactactgagcctgctctccacaactagacagcctgcatgcttcagctaagacgtgacacagctgaataaataaatgaagtgctggacttccctggtggtacagtggataagaatccacccaccagtgcaggggtcacaagttcgaccccaggtctgggaagattccacatgtcgtagagcaactaagcctgtgtgccacaactgctaaagcctgtgtgcccagagcccaggcttggcaacaagagaggcccccaccatgagaaacctgcacattgtagtaagagcagtccctgctcgctgcatctagagaaagcccatgcacagcaacaaagacccagtgcagcaacaacagaataattaattttcaaaataccaatagatttctacatacttaaaaaaaaaatcacccttagaaaaataaataagtgaagtgctcccaggggtggtagatactgggtggagaagcaggacagcaaatggggagagaccgagggagggcctggcctgcggggggtgctctgggacagactgtagctgcgtctgccagcttggaggcgacggagctgcgctctcatatcctaagaaactcctggtcacttctagctcttagtgaatctggagaaagtgtctgtagtggc

SEQ ID NO: 40425 - DNA, 1728 bp, Bovine  19866880500108
cctctccctctcccacagtgcctgtacgactcagcgtgtttgctctaatgtcttcccccaccggaacatgaaatctgtgtggaaaggaccttgtgtgcccttctcagcactttgcacagtcccaagcacacagtaggtattttacaaatgcatgtatataccttctaccctgcactgtgtgctttccaaggaagaaaattttcttctacttttattttccaggagtcctagaagcatgtgtggtggtgacaagcccagactcttgagctacctgtgctgttttctagcttcccttctctgcaaaatgaggtgataataattcacccaactctcaggagtgatgtgaggatcataggagttgggacatataaagctatgtcagcatcagacacctgttaagaaccacctgagcgcttactctatcgtcatctcactgggaggtcatgtaacagtgctgggccagagctgatggagtgggaaatgctcagcaaaaggcctggcttacgagaggtggtgctcaatagatgctgagtcttacctcaaattccaggttagttaaattacatgtgcatcagtccacaagttcaagagtgctaggaagtgaagttgaaagtcgctcagtcacgtccaactctttgcggccccatggactatacagtccatggaattctccaggccagaatactggagtgggtagcctttcccttccccaggggatcttccccacccagagatcaaactggggtctcttgcattgcaggcagattatttaccagatgagctatgagggaattctctgtagcaacctactctttgttttcaaattccctcccactgcatagatgctggcattgtgctgacagtcccatttgttgcctttctgggatcctgagttctccccactatgttcttaggaagccacagggaaagacttccaggttccaaggtgaggcagagggtctgtgctgaccaggacaataaatgtttcagggaaaacccatactgaggggtggtttgaaacctggagatgtcctaagatatggcctcgggtcagatggcagatgcatagtaactggggtaggagggcatttgctcctgggctctgatctatgggggtgccacagactgccactgggacaacctgtcactgcaactctgtcctgcataaagagctgttgctttttaaacaggcgaaatcaattttaacaatttcagttaacccaacacaaccaaaattttatcatttcatcatgtgataattgtaagatatttgttagttatatagtttatgtttttgttcataccgattctatgaaattcaatgtatgttttatacttacggttcatctcaatttggactaccacatttcaagtgttctatagccaagtatggatacactctactatattagtgctgatctagaagactgcggttgtggctcttctgttatatttttaataggtgaaaatgctctcatttcactttgttgtcatttatttatgggcaagaccagaatggcagggacagggtgcagacacacccaccgccctctatctctctaagaagcttgaaagacaatcccagaagattaaagctagctctttctgccagcctggatggatggggctgaaaacagaaattacactgagtttcaagaaaataatgaaggatatatttcttacatactcatgggctaggactgtacatatgacaattattatacaata

SEQ ID NO: 40426 - DNA, 2130 bp, Bovine  19866880511468
catcaagtcctcacctgacagaaaaaaagggggagctctatggactcttcttttaagagcagtaatctcatcaccagggccccactcaccctcatcacctcatctaataattttacctcctaaaggtccccatccccaaatatcatcatattgggggttcatgcttcaacatatgagtggggggtcaatttaacccataatagatgcttttgaactgtggtgttggagaagactcttgagagtcccttggactgcaaggagatccaaccagtccattctaaaggagatcagccctgggtggtctttggaaggaatgatgctaaagctgaaactccagtactttggccacctcatgcgaagagttgactcattgggaaagactctgatgctgggaggggttgggggcaggaggagaaggggacgacagaggatgagatggctggatggcatcaccgactcgatggacatgagtttgggtgaactccaggagttggtgatggacagggagacctggcgtgctgcaattcatggggtcgcaaagagtcggacacgactgagcgactgaactgaactgaactgaaagaacctctaggaacctaaaggaaatcaacactaaatattcaagggctgatgctaaagctgaagctccaatattttgtctacttgatgcaaagagccgactcattggaaaagatcctgattctgggaaagactgagggcaggaagagaaggggatgacagaggatgagatggttggatgtcatcaccaactcattggatatgattttgagcaaacttggggaggaagtattcttcaagtatttgaaaattattatttgactaagcaaagaatatttgtggggaagaatatttgtggggatttccctggtggtccagtggttaaaacgcggcattcccaacgcaagagactgggttcaatctctggtcagggaactagatcctgcatgccacaactaagacctggcacagccagataaatattttttaaaaaagaatatttgctgccgctgccattgcctgacaccactgtgattgtcccaagaagtcaaaatgaaccaaactcagtcccgtgcacagagcaatgtgctcaagtccaagtaccagaggagatgcaatggtaaaagacactgcggctgtcagcaggaagtgcatcattcaacgttaacaaccccccatacacagaaagtacagcagagtaagtcgaggatgacagacacctgtgtgcatgccaccacctctgcccacagccagcatgaggctccagcatcctgcccagcagagcaggcaggcagcctccgctgtgcttcccatggtgacctcacacaggagtgcaaacttcaggacatcccagctcaaaagttcaggagagagatcaactggaactacagcacttaaggaagtggctcagctggtaaaggatctacctgcaatacgagagacccggcttcagtccctggattgggaagattccctggaggagagcatgacaacccactttcggtcttcttgccaggagaagccccatggacagaggagcctggtaggctacagtccacagggtcacaaagagttggacacaaacttaggactgagcacgcacacacaaaccttaagtatgtcaaagaagagtcaatcaacaatttgtgaatataagaaatatttaaaatagccacactactaacacaacattgtaaaacaactgtactccaataagaattttaaaattagctgcacaaagcagtgaggactaagtacccaatgaaaactaaatcccttttctaatgccagctgctagaaatggctcccctaagtatatttttgtgcttggttgtttctttatttagaaacctcagcttcctctttgattaaattttacaagggcttctattaattttaaagataaataattaatgctcatagttatcaaaacacttgcaattacatcaattgagtctcaacaggaagaatggatgtcatctacactttacacaaagagaagaaaaatgactcagggagataaagtgacttttccatatcagtggcagagcagggactcaaacagtgtgtgtctgacttgaaattcatgacaccaagcctccatgccaggta

SEQ ID NO: 40427 - DNA, 1907 bp, Bovine  19866880686185
cattagatcctgtgtttctctctctggtctgactccccctttgcctttccttctttgagcagagtataccttgctattgctctaggtaatggaaaaacaaacaaagctaacaatcttgattactgctcattgtaaatcattatttatcacagacatgttactatctacaagtctttcctaattgcaccatctttttgggcttccctggtggctcagatgttaaagaatctgcctacaatgcaggagacctggtttgatccctgggtcagaaagaccccctggagaagggaatggctacccactccagtattcttgcctgaagagaaaggaggagcctggcaggctacagtccatggggttgcaaagagttagacacggactaactaacactttcactttatcaaaaaccctttaaggtgagttggagctctctttatacatcatgtttggagaaggcaatggcaccccactccagtactcttgcctggaaaatcccatggacgggaggagccttggtaggctgcagtccatggggtcgctaagagtcggacacgactgaacgacttcactttatacatcatgttaccactaacataatgtataaaggaaaaaaaaaaaattaaggttctaattggaccctttaaggctgtagacatgggaagcgttctagaacccatcactagtataacagcatgctgcctcagttcctccagggtgaccggtgtctacagagctgaagacaagcaactctaatctagtccagcaaaatgggtagctcacactgccctgatgaaccctaatgagttctccttcccaggccttcacattcatccatttcatccatgtcccagccagtcacaggtcagtggatgaaaaccacccagggtatctatggccaccacccttgggtcacccttgctgtgagttcctgtgttcctccagttttggtggagtccagcttcactggtcttccctgctaatttggcctccacttttacctaatgcacatggcttatgattttagacccaaatatgtcccttagaagtcttgactcattgtagtagactgatatactcatcaccaaatattctgatcctcctccctgagaggattataaaagcctgtcctgttgaactccagagtagctatggcccccttggccaacgggaagtgggcagaagtgacagtaagaacatggcttgccatctttcttcccctctgtctccttgacctgaaacattccctggagaggctacttcagaaaacacatttcccctggaaagcctggtttcagtacggagatatggaacaaattggcagctgactcgttttgggacataggagtgagaagtaagtctttattatcataaatgttgaaatttggtagtcttatttgttactgtgtgtagcatgtgctaagtcacttcagtcgtgtctgatctgtgcaaccctatggaccgtggtccaccaggctcctctgtccaagggattctccaggcaaaaatgctgaagtgggttgccatttcctcctctagaggatcctcccaacctagggatcgaacctgcatctcttatgcctcctgcactggcaagcaggttctttactgctagtgccacctgggaagcccaaagttatgggcttcccaaagttttccggtagtcccaaagttttccagtagtcatgaacaatgtgacatgactcactggagaagcggtcgaacccttcccagcccagggattgaacctgtgtctcctgcattggcaggcagattctgattcacatatccttggattcctaccactttcaccaacttcagacagatagacagactgacagcctgctaaatttaattctagccccaacataccatgatgttcagaggggaggatagacccaccaggcagg

SEQ ID NO: 40428 - DNA, 901 bp, Bovine  19866880735195
acatatatatatatatatataaaaagcattcctcctatgtatatgaaaaggatctttagtgacggaaatctgaagtttcctccccttatcactcccattagtattaggcactgtttgtagttaaattcagagaaggcaatggcaccccactccagtactcttgcctggaaaatcccatgggcggaggaacctggtaggctgcagtccatggggtcgctaagagtcggacacgactgagcgacgtcactttcacttttcactttcatgcattggagaaggaaatggcaacccactccagtgttcttgcctggagaagcccagggacgggggagcctggtgggcggccgtctatggggtcacacagagtcggacacgactgaagcgacttagcagcagcagtagttaaatcaaaccagcctttcctaactgctggcaaatgatgaacattttttcctataaaatacagcaatattcaggtcagaagtttttaccgtctgcttcactagaatgtactgtttcagcttctgtcattggaatgttttcagtctcccctaaactttcatgttccattgagaggtccagttcttcgtcttggatctgatcaatcacagcaggcagaggctctggttcaaggtgcaaaatcaggtttcctttcacctctcaataaagaaatgcacaaacatgtttccattccaaaatgactaaaaagaacttgcacataaaattttaaagctcatcacagtttcaagtttaaaatatgagcacctctttcaaatgagaactcctttcaaaacaaaaactgcttcatcaagacaaatgtattttcccacaaagacatttaataagtaacattttagtgacatttaataacatttcaaagtaaacttgaaagtttactaaa

SEQ ID NO: 40429 - DNA, 894 bp, Bovine  19866880736777
ctgtgacagtttctcagtttgcctgtttttcatgaagaatagtgttttaaaatgcttaaaataacacaaatccacaaacgaaatggatgacatggatatacagctatcacaacattaaaagacaaatttgtatatgcttctttattagcacatttgggtgggatctaacagatggcccaacaacacagtaacttggatgatgaagaggacgaagtacttcaagacagatgagatttccatgggtgacagtcacaggtggtactaatatcactttagattcttgactacttacggacatggtttacaatgttaagttttagttggaagtagatagaaaataaagctgccctatgttttcttatcccagttcatggacttcctgacactctcatggagcccacattaggaagccctgccccaggggcaagagaaaaagcagaaatggctcagaaactccacaaagtcttgggagttctggcatgggatggcgtcctcaaaattactaacccaatttacaaagagctgctacataatgacacatgcagcaggctgtgattagctgcattttagccacatgatttattgttggctacagtcagatgcagttccttcactcctagtcaccctgaagggtacccattagtataaaaatgagtttgtgttgcttccataaccagaagaaacagggatttcctttgagaaccatggagggaacatgtttctaacttggggctatgaaatatgtgtttaagtcacttttgtttcaaagctatttgaataataacattttacctccaagcattcttttgagttgaaaagtaactgtttacagtctgtgataacttttctaacatgccaacaccatgtataattagcaccaataatagttcaaca

SEQ ID NO: 40430 - DNA, 662 bp, Bovine  19866880747869
tacccactccagtattcttgggcttcccttgtggctcagctagtgaagaatccacctgcaatgcaggagacctgggttcaatccctgggtttggaagatcccctggagaagggaaaggctaccctctccagtattctggcctagagaattccatggactgaactgtataatccatggggtcgcaaagagtcagacacaactggatcaactttcacttgcactttcaaggcttatactcagagctatcttgatctttgaaactaactaagaagaaagttctattattattaacatgaagaaagcactctagcaggaccttatcatataacatgctttacggtattctttgtcatttaaattttaaggtaatacgatcatagtaaaaggatttgttcagaacatctttaaaggttaaattctcaatgtatattaaaatctcctacaatcttaagcacatgacacacacacacacacacacacacagtgtgcagaggcctttaccataatatgagtcttcacttttcccttctgaattatgaaagcacctcccattcctacaggcttatctccataatgtttttcaagagtctgcctcatacatgtcacaaagttaagttttccagttcttctttgactttcacctcaaggacctagagagaaca

SEQ ID NO: 40431 - DNA, 899 bp, Bovine  19866880767936
accttgactgacccaccagcccaccagtgcctttattgtcaagactaaaaccactgcaagagtggcctaactctctctctcccatcaatgcatcttgaccattgccactagactcatctttatcatgacactctaaggatgaatggtatctctctattgcctacaaaataaatctgaaccaccaccatgatcctctccacaggctaactttacatgtttttgttcctcaatcccccttcatgaattttttcttctgccaaattgacctactcacttcccccagatacttcttgattttactcattctgcttcttctttggcaacatgtcctatcttctgtttctctgatccatttctgatccatttattgaaatccaatacatcctagagaagccatttctaacccaaccacctcttcaaatgctcagtaggatatgattgctgtttttactgagcaatttcctaaaattagggccttctcttgacatttctctcctatcatatgtgccagaaattctaataaggaatttcatttttaatagaccacagtcaccactaaaaaggaaataagtatcatatacagtttaaatgcacttttaaatcaaataaaatgtatttttatatgaagttttataaccctgttttatgcaatgaattgcatccttattcaatgctgcagactcagctaactacagccagacaggtcatcaggaccagtgtggtcaggcttgtgggactggggatgaagagacatcctgcccagttaggagattgcctaaatacagagggatacagaaaataaatgaatatattgacgatgatgatgggggaagggagactggggtaaacccatggtgattggttggaatggaaatatggtcgaacttgcaatttttttc

SEQ ID NO: 40432 - DNA, 1768 bp, Bovine  19866880825742
ctgaagtgtattcagaggagctgtacagtaaaagtttgtaagattcacagctcaatggggtaaaagctcttgagtgtcaagggattaaaaaaagcaaggagcactggctgtaatcactgagataacagtagtggagtgatatttgaaaaggattcatttccagagcaagccatgagtatcttcaaattaaaggaatataatttgaagtggttaactcaaggacctgtatgccttagtattgatgtgaattgggacattttgagttctaatgctaaagttccatcagaagatgaattaagatgacaaagacatttttacattttaatagatgtttatagaagcagtacttttctggctctggacattgtaagctcttctcaacaaataattatgcataagaactttacctgaaatggttacttgtgttgtaagaggatttgattaaattctgtttttaattgcaagaaaatcttgagcatctttttgtattataatatagcagttacatttatctacaccttccttaggtaattcagcagtccagggcagctatctcaaacttatgcactacatacaaagacatcacataaagtctaggagttggttgacaaaaagtggtgtatatgctatctttttgtccttctcttgttgaattcagaacccttcagtcgcaaccttattacagaggctgagctccagaagtgtttagtctccaaggtttaaatctgtgtaagtagattatattacttatattactgtgaatatatatatgtatatatagtctagaattataatcattttatcaaaactccattggaataaaacagtttggatagcctgtggagttcttataatgataccattagactaagacatgttatttttttttttaaggtaaatagctgttttctcctgcttcctctcttctttttgcttaccatgcctcttcctccccacacccctgaaacacacatttttggtgggaacttaatgtatacttcactgatatgtaggtgagatattattatatactcagtaatttctgttgaataaacatgttaactgttttgattttcctgtttttaatatcccattagggtctctgtttccccatcatggtacatttgaagtaataaagaatacagatattgatctagacaagaagatacctgaagattactgtccccttgatgtccagattcctagtgatttagaagggtctgcatatatcagggtatttgtctaagtatttttcaagtaatttcctattaatagcccagaagctaattagctaacatattttttgtgttattattttcacataggtttcaattcaaaaacaggctccagacataggtgaccttggcacagttaacctcttcaaacgacctttgcctaaatccaaaccaggtatagttctgttctctaacttctggtcttgtctgccctgactaaaagtaaatatagttaggaaaaataggtactttaaataagagcaattggaaatatgactttataatttgttaatcaattattagtgaatagctggtgcagtccttttgttttttcgccacaccatgcaccttgtaaaattttagttctctgaccaggaattgaacacaggccctcagtagtgagagtgcagaatcctcatgacaggatcacgaaggaattcctgtgcagtcttttttgaaaggttgaacttatttaccatttttctctgtgtagaagaagtaaaaaattctatattttggaaagggtatgctgt

SEQ ID NO: 40433 - DNA, 1075 bp, Bovine  19866880842509
gtttaggaatatcccatgggaattattccttatcactcaattaatataatttagcaaagccatgaattacatgtattccttatctcactcaaaaacatgtattaagtgtctagttttccaggcatttttgttggagctgggaatacagagagacacccaaaactttcctactgtatcaaagcctacattacagtgggacaacagtcaaaattttaagtgcatacaggaaatattttaggtggagataagcgctatgaagaagagtagagtgcggaaaagtgagtgagtttgcaggcaggaaggaagatgagggacttttagctagggtggggcgaggatgctccggggaggtgatattggtgcagggaatggaacagaataagggagggagccaggcaagacctaggagaaccttctagacaatgggaacagcatgtgaaaaggtcttgaggcaggaatgaattaggtgtgttcaaaaaagaacaaaagaccagggtggctggagtgagctagggggtgaatacaaggagatgaggtcagagaggccgaggccaggacatggagtatagagtgacaaaaataacatggtgatgcccagcctgagaacaggagtactgcagattaggaaagcttctgaacagggacttacttcctctgaggaggtcacatggggaaggaaaggatgtaatgaggaagatgaatatatagggtgtagaatgaatttatcagaatcttgatttacaaaatgatccagtaaatctatggctgatgttgatcctaatttactttctgttactttgtgttaactttcaaagtgaagtagactaagaagtctcccaagctatactttaatacattcatttctttcttctctgtagaaaggaatagacaaggaattccccctactagttacagtctttgatgagaatctgagcaggtatcttgatgaaaatattcagaagtttacctggcatcccttcagcgttgacaaggaggacaaagagtttgtgaagtccaaccgaatgcatggtatgaaaaatcttttcctcttgtaaagtcaagtcataatcacatt

SEQ ID NO: 40434 - DNA, 2348 bp, Bovine  19866880882235
gtcgatttcctttaggatcgactggttttatctccataccagcaataacaaaataaaacagattaaccatgggtaggagaacaggaagcaacaaccccatttcctgggtctgggaaggaatttttgaagtgaaggaagagtagctgagtgaagacgtggcatattgagttttatcctcaggctgcacgttgccctgaaagcttgcagtctctaaggatttctgagttcgggcccaaaccaagaagtttcttcacctggagttctttttatgatgattcacctgtgcttgaattcttaattttgatttacctttaaattgacaatatgaagcgatttttctcaagaagaatgcatagatatattgtatgagctctacatagcaaagaatatctagtgtgactttctcacttgaaatgaactttactacattaaaaattctcagaagaatactattaatgtaattgctcacactgtatttttctgacagttttgcaaaagaaaagtctggttttgttcttttccagaacaccaatttaatttttctatttttaaaataaattatttattttaattggaagctaattactttacaatattgtagtggtttttgccatacattcacatgaatcagccataggtgtacctgaggacaccagttttgaagcccaaattattatagaatatattcttctttacccttttacccttctcgttcagtttttccaggaagtgagatgctgttttcagagcgtcagtttgaaacacggtgattcttttctatttacaaacagtgcttttttttcagaaagattttctcagtgtcatccttgatctttggttctgtttcttaaagagccctcgtcaaccttgagctgtatcaaattctctcatccatatctattattttattttatttttttttatatgctgactttctgcacaaaaggtttctttttattcattaacataggcaaagttatttaagtcaataaatttttaaggatttttcacacgtcctgattctttccactgcctatcaccatagctcctccgaggttgtcatcttcaaggtagcccgttcaagaagttctgctcaatccacagctgtgatgcctgccacgttgttttagttgggcctcttagatcttcagtggagttcacttctaagtttgccacctgtaatcttcaaagacccaatttcctcaagcagtttactataggatcctgtttagggtcaggagatgggatctgtctagttcttaatgacaaccgtaagaaaaaaaagtattagttacttttgaagattctgtcaaactgaccagtataagaaactaaaaggatacttgtatcagtagaaataccaggtctaacatgcacaaagcaaaaaaaccaacgatgccagatactgaatttatatcgcactgtcttttgaacagccagcaggaacaaactgctgaatgcagataccatgcagtgcaacatatctattattttaataatcccccacacctgtatttttttttctgtttccctacatcttttcaggtttgtttctcatgttattgatttagcttattcagtatgtcagctctattctttgcagcttcagatgatggttccagtgttgctctgattaccttcctcatcttagaagtcatcatctactctgtctctgttggacttaactcgaatcctctcccacctccaatgcctatttctttgatttaattacccattgaaattcatgaaaagatgtaatcatggagacctgcctgcaggacttcctgtctctgactttgctaatggtatttccttgaaggaactgatcgattgttctttccatgatgcatcagaatgcaaggtaggttctcagcatcatctctctatccctctggccctctctcttcctgttcatctctggaagctgcaggcacagtatggatgtgctctgaactacagtgatacccagcaaagcctgagagagtggaatggtcctcatgttgtagctgcctccaaaaacagccttacagaaatgacttcacctttcactggctgggttaaatcttgagtttctgatccaggttgaggaataaagaggcacatgccctaatctcactgaagctggcagtaggtggagcagcctgcacattcatttactttcaacctgattcccttgcccctgatcttattagatgcttcttccaaatgcagacattgggttgattgcactggtttatgatgattagcaagttttgatttttttctgtgtctctgtagatacaggtattttttaaaaatatttttgatatggaccatttttaaagtctttattgaatttgttacaatat

SEQ ID NO: 40435 - DNA, 2620 bp, Bovine  19866880974981
cagtcattcattaactcacagttctactggttcaaaatcttggaatagtgtggttgaattctctggttaggttttcacaaggctgatatatcagtgtgtcagctgaaatgtggtctcctctggagctcaggacattcttccaagctcatgttgttgtggctaaactcagttccctgtggtttggggactgaggccatcctcttttccttgcaggatgaaagtgaaagtcgctcagtcgtgtctgactctttgtgaccccatagacgatacaatacatggaattctccaggccagaatactggagtgggtagcctttctcttctccaagggatcttcccaacccagggatcaaacccaggtctcctgcattacaggtggattctttaccagctgagccacaagggaagcccaggaatactggactaggtagtctatcccttctcccactgaatcttccagacccaggaatcaagcctgcattgcagctggattctttaccaactcagctatcagggaggccctccatgacagattggagataccaaaaacagaatctatgccatagtcacaaatagattgagatgcactgggctagtgggtactgaggtctaaaaggtatattgtttagagtcatgctagaggctgtaaaaaataaaccctcatcaaatcagcagctcacaagatacaagtttatttcacactatcacaacctttcaatgtgagtatttctagtgacccatagattaagccagggatccatgctccttttacttggtgattccaccatctcctatgggctcagagtcctttgagtctgggcagaggatgaaagagttaaaacctccactttgcctgacatcaatataaccacacatctctgttttgtgtttgtgttgcataccttccctcccccaaatctttgcttttatcctatatgcatctttaatgtgactcttatagacaggatataattggttctttttaaaaactgaattctgaaaatctttataatttttgtgtttctcacatgtgcatttaatgtaatagctggtatgtttggcattaagtctaccactttattatttgttttatttgttccctctgttttttgttcctctgttttccctttctggctcccttttggattgtttgagtattatttcactactccattttaattgatctcgtgatttttgagtatatgtctttgcaaattttgttcgtggttgctgtagggaatacaataaacatgctagcctaaccaaaatatttcacaactcaggtggaatatagcaacctcccaccacgttggtcccttcactccctctcctttatattttaaaaagttaaccatatgtattacatctacatacaatgaaaatctcatcagtgttataatttttgctttcaactgtaatacacagtttcaagaattaaaaggcaaccagtctatcatgtttacccagatcttcaccatttctattgcttctacttcttcctgacattccaagttttcctttactaaagaattaactttggttttcctttcagagcaggtccatgccaatgtatggtgttggcttttttcatctgaaactatccttatttcacctttattcccaaagggcatttcccccagatatggaattctagattgacagttcttttctctcagcacttataaataatgtttctctttctactgaaggtctggttttttgttttttttttttttaaagagacagcctttatttgaaatatttttacactgaagaattcaaaatgtggtaagttctggaactgattgacctgtacttaaaaggaactgttgacaaatattcaccagaaataatctgaacaagcaagaaaatacggttaatactactgaaacctactaaaagaattccaggacatatggtttctatgacacaatgatacctcttaagcactgtcacagatatgaaactgactgctcttctagacacacagcagtatagttaacaacattcaatcacttttgttctttcttgactatataaaaattaaaataccaattaaaaaactaatacagtcttctctttaaatgttacagatacaatttccatattttcagtcaatagcagtgtggcttcagagatttttcattcacgagccaaacaacaatctgcgcaaagggaactgatagtctataggctcacagtgcaaatgaagagtttgggaatgcaacaactgacatttctaaaacaggaaacagacaaaattcttaggagacacacagtaagttcttctaagcagctggccacagaactagaacattggttaatttcactggtgatttcagtgggactccagatgtttccaaactcagcttgaacgctcaccttcagctttgtattttgcttttccagtttcactagtgacacaaacatgattcaaatccctgaagtattcattatagtcgagggcatatctcacaaggaacttttctggaatttcaaatccaacaaagtctggtctatatccaacactttgaggggtccttttcaccagcaagcttgcaaccttgcccatctttggattacgctgcttgaccaaagaaagcaaagtttgcattgttttg

SEQ ID NO: 40436 - DNA, 1144 bp, Bovine  19866881022335
tatgtaagtaacaaaaggacacccaaccaagaaacaagaccactctgtgcactgaatgcccatcttctgtaacagttttccacgcacgggacccttctggttcaacattattattcttaaaactattactggggacacatatttatggatgtaaattaaggtgattcactcttttttttaagagagaaaacaaaataaaaactcctagaagccctcagcctttataatcagtaaagttctcaacagttttaacattttacatttttttcttttatttactctgtaaagcaaagaattgacaatcataatgtacaaaatataaagtagcccacaattataaaacttttgttccttacctcggtataatttttagtagcaacatttcgggagggctgctgtcttgtagatttaaaggctacaatgaaaaagatgatacatccattatgtttttcttaaaatagtttagaaaaatctgcatgcttctttagctgattatttcctaagttttatctgtaaaagctcatgatgactaattataaaaccacttccatttcttaaaatctgaagggagatggaattatatgtgtaattgtcagtctcaaatgatttttctgatttactcaaataaagtaataagcagtgttcataaagacatttatagtaaaaagtattttacagcaaaatacatggataaaatctgatcaccaaatagactgaattccaaataagtgaaagtaacctcctcaggtcttctcttagagttggcaagctctttcctcgtggctctactgtgttaggagccacttgttccagtaagagcttccttactctcctctactgtgttaaaaatattcagtatctaagtaattgtccagagggaattctagaaaaactatgttgtttcacaataactttcctagaaatccttacattttcacctttgtaaacctggttagaatcatgaagtttattcttcccaagactatgatattatgattttacagtaagaaacataatttggtcttcatccacatttctggcagagagcccctagccagtcagtgttagtcactcagttgtgtctgactctttgcaacctcatggactgtagcctgccaggttcctctgtccaggaattctccag

SEQ ID NO: 40437 - DNA, 3785 bp, Bovine  19866881062161
cgctctccctaccttgtcctactcttcctcctacatctctgcgtgttccttcttggtcttctgggagggttctgtttcatttatctgtgtttgagtgttttcttgagctctgtccttggacctctttccttctcatcatatggacactgcaacctcatcctcaacatggcttccatgatcacctatatttgggtagtttctaatctctctcttcagtcctgacctgcgtatgtgtgaatgtgtatgtatatttatgtgtatatatgatctccctttctctctccctttcccctttcctcctctccttagttataacagttaaaatccaagagtattttacttggatttcccacagacaccttacattcaatatggcccaaccattcttagctcctccattcaatctgcttttgcatgctgtttggtgagactgactttagtcactcaagccacaggactaaagtccagaagttgtcctggactcctctaccacttcctgcaaacattttaccatgacatgtgaggcccttcacagccactggctgctctcaaatcctctccctcccagtcccagcctcaccagcacgcctcctgtgctgggctgcttgctgttttctgaacatgccactgctctgggcctgcagtcctacagccccatctgccaggaatgacctgtccccacttcttcactcagctccatatcctttagggctccagtcaggtgttatcatctcaagaaagcctgcccttgcccctccctgggatagaatccaagtgctttgtgcacttctttttagtactgcattcattgcaagggagtataagcttctgcagatttgcttgcctccccatttcgattctacatccctgaggatgaggactttaccctgtctttctgttactggcccctagcccagtttatgatgcacagaagtgcctctaactgagtgagtgagtgagtgcttgagagctgtatacaagatctgatggttcacagaggcctgaaactacctgtagcatctgggttttctgagtccatggacagtgcttccctcgtagtttacttctcagtacccttccttggaaatgtcccatcctgccagtatagtgtgtttaaaactgaaagtatgtctgaacaggcaaagcctctcagtagctcctctcaaagggaaccttgaaacactctgcatatgttcttttggactgggacagttttgcgtggttataatacacatgatccagtgtgttataatacatatggtccatgcctgtccatggccacttagaacatgactcagcctaactgcatccccactgcatttcctgtatcccaccatctacaagacgtgagctgatattggtgtcaaccactgaactataaccaaaatcctagcctctctggtgagagaaagagacaaggtcccaaagtccagctaaaaggaattgtctttaatactttcaacattctgtgatcacttttgctctaggcctgtgcacatgctttcctctttcacctgagacctctcccggatcctccacactcttaggaccttcccttagctgatgccttccttttcaggtctcagtttggagaggtctgcactcaaggaggtccatgtctggatcaggtgtccttcctgatgctctcacagcccctaggctgcctctgtcaggatgccacactctcctggaattgcctgctggactccatgtttccaattagactaaagcccctggaccaatagagaatgtgtctgtcagtttcacagatgtaactgcagtgcctagtgcatagtagacactcagtaagtaattataaaatgaacaagtgattttccttggtaagaaagtttctctcatatgattcatttttacaaagaaacatacccagaaacattctgggaaacctcagcgttgttgtggatggtcacagttgtgttttatatatatgtgatgtttaaacattaaaaaaaatgtgttttccatgctcattcacctctcacttatgactaggtaactcgtgcccaaaactctcgtcttgctcatcgtttttattccctgcagctctgttaaccatgtggcttggcagatgtggttggtaaactgtttttcttttaggcgcaatctctcttagcacacaatttcatatgtaaacaatgaaattggatcaatttatatttcatagattaaagaaaatatacatctttctagatttgttttagtctttatatctttgtcctacattaaaaatatctgagaaaatgcacataagagttggaaggtccacttgtgttttgtggtttatagaaagaaagcagtggaaagtaagtagttttatggtgacagaaatttgactctttacgcccttgtgtctataaatgaaatgctagagagggaaaatcaattttccaaaagactatgggtatactgccttctggtaatgcaacgatcaagcagttgccatttctagaaaagtaaattttgtgattctccagtgacctctgttataagtcagtatggtatcatgctatgtgaagctgttgaatgtttacttaagactaagttttctggataattttaatggttgcaaatattacaaaactagattttaacttgctaagtgtctcctcatacttgacttgatgattctgttttgatagaaacttgtggaatgtctggttgccatggatactggggcttaagaggagcctctgagtcctcttactgcattgtccttaaaagactgcacccatctgcagaaatgtagaaactctcttagcttctccaaattccctgggatggtggtttgttttgaatctggatgaagtttcctggggttgtttgtactgcaggttggatggtccctttgggtggagtgaaaggacacaggctactactgtggtttttctgagagctgtgccttctccattccaggaagatggggaaagtcaattaaagtttctcaagcatcactctgttccaggtcctgtaactaaactcttgctagacctcatctcattgccttgtctactagtcaagagcaaagactgagtctagtttaatactgtatactacacagtttatattgattgatacaaatgatttttgaatgaatgagtaactaaccctgcagaagtattaaaaaatggtatggacctaacagaagcagaagatattaagaagaggtggtaagaatacatggaagaactatacaaaaaagatcttcatgacccagataatcatgacagtgtgatcattcacttagagctagacgtcctggaatgagaagtcaagtgggccttaggaagcatcactatgcacaaagctagtggaggtgatggaattctagttgagccatttcaaatcctaaaagatgatgctgtgaaagtgctgcactcaatatgccagcaaatttggaaaattcagcagtggccacaggcctagaaaaggtcagctttcattccaatcccaaagaaagacaatgccaaagaatgctctaactactgcacggttgcattcatctcacatgctagaaaagtaatgctcaaaattctccaagccaggcttcaacaatatgtgaaccatgaacttccagatgttcaagctggatttagaaaaggcacagaaaccagagatcaaattgccaacatctgttggatcattgaaaaagcaagagagttccagaaaaatatctatttatgctttactgactatgccaaagctcttgactgcatggatcacaacaaactgtggaaaattctttaagagatgggaataccagaaca

SEQ ID NO: 40438 - DNA, 1116 bp, Bovine  19866881102950
tggtaaagtcttctatgactttcttgccattaggtgagtgaatttctgcctcttctgtcagaaacagaaaaactcagattatccagccatgtcagaacatccactggagagaccaactgtgtgtggaggtatgtgcatcagattggtgaacccacacccattcatgaaaacttgaatttgtgacttgctgacatatttaaaaaaaaaaaaaaaaaaaaacttttttaaacagaaaccttttcaaggtgtacagctgcaccagagagcttacaagaagcattcataaaaagaaaaaaggcatttatagagagatcctcacagagacagaaagagataaaggacaaagttcatgcctctggatattctcaaaccaaaacaataacagagaaaactacaggtatctgttatcaaagagaattatgtatttacttagtggttttattcagtggcattatgtattttactcagtggcttgttttccactcaggttcctttgtgagtgacctaaagggtatgagtaaagttagggtgtcgcttcctgaagataaaaagactgcacaacccccatacgcacaaaagggcagtagggtatgtatatgtatatggatttacatatatatgatagacaaaggaatggcaacccactccatgtcccttgttcatagggttgcatagtcagatgcatagtcagtgactatacatgtatctgaagtatctgtctttaattccatacaaatttcttatagattataccttcaattagctgaaatgagaaagcagaaggaagacaaagcaaagcaagatgcacatgcccaaaacagagcaaggacaaaagaatttcataaggtaagcagcatcccatacatacccccaacttttcatgtctaaggcacatcggagcctgatactaataataactgatactatttcctccacagaaaacattagagaagcttcgagccagaaatatatgctgactttctgcacaaaaggtttctttttattcattaacataggcaaagttatttaagtcaataaatttttaaggatttttcacacgtcctgattctttcctctgccaatcaccatagctcctccaggccttgtcatcttcaa

SEQ ID NO: 40439 - DNA, 1016 bp, Bovine  19866881108243
aatagtgccataatagtggaatatgaggcagtgtggcttgcctgtggaggatcttttttgttaggggggtcatttctgaatcattcccagtcccttctaaacaacctgtgtttatcacatcctcatttgttggcacccagcttgacacacaattcaagcagcctggacgctgttggcttctgcacagtacagggctgcttccaagccagactgtgaatttcaagtgccgtggccaggaagaaactagtaattataactccatacatagcatcaggcttcacaacaagaaaatcatgatctcttaagcactttcttacggattagcatgttagtggctaagttgtgtctttgcgaccccagggactgcagcccgccaggctcctctgtccattggattttccaggcaagaatactggagtgggttgccctttccttccccagggactcttccagaccctgggattgaatctgtatctcctgcattggcaggtggattcccacctgggaagcccatggattaatatggttatccttaagaagtccaaggtgggggcaggtcaggtttgttgctcccatttaatggatgcaggaactgagattcggagaatttaggtaacttctaagatcacacagctcgtctccctatgcctattccagtgcatgtccctcatggagtgttgctctttcagcatctggcactacctggacttcaggcacttgggatttgggtcaggaagggccaaagtgcaagatggtaggggtggtgtcatcagtcagagcccggggtgtgtggcctcctccagctcagcagctgggttgggggtggagggacagggactgctttctatattggttttccgcatctgtgtgggtattgatttccttctcaaagggttccatctgccttccacctaattatgttaacaatcttcatcctagtcctttgaagacttttatccctgttctaaagaggtgcaggtttccagggttaccagaaatccagagatgaagccttt

SEQ ID NO: 40440 - DNA, 1157 bp, Bovine  19866881142373
tttccacataaatccaattactttgtttaaaaaaaatctagaagataaaactcaaagaaaaaagcaaatcaaagagttatatcatgattcttgtttgatagtatgtaattcaaggaaatactactggtttgactttagtaacttctgggaatatatttaaatagcctatttatctaccaaaattttttttaaaaaattaacaagaaaccaaatctctggtgggaaagtaaaataaacacacaattctgtacattcaaaactgttaatgtgttcatatcttttgattcgggaattcttttcctttgttcctatggaaataattaaagatgtaggcaaagactttgctaaaatgatgctcattacagtgcaaaaaagtaataagaaacattagaaacagcctgtacatctcaacataaggaacaggctagttctggttcatcaatgtctttggaaacatatctatgaataattcactacactcaaagtgctctggaagaggattcagtaaggtttctaacactcactgcctgtaagtggcagcattataggctttgaaacatttttcttccttttgacctctgttctttgatttttcagaaatgagcttatctttgaacaacttagaaagggtttatgtactatagtatgagactggagaaaactaccttgttcctgcccagaggataatgttctgtcttcactcacagttgctcctgattcaactgtcagggctttactttcagcttcactgacagttgtaatcatttcaccctcctcttcagacacggatttaattgtccagagagatttttggcttcggatcttatttaataattttttaaaaagaatttttgaaggaatctggtgggtcttcactgctgagggaactaaaagaaaaggaaataaaatttattcagcacctattacaaataaagtaaattactctatctttacacttagttaccacaactaccactggttaaaacaaaagtacaactgtattttcctcagtatttacaattaaacgcaattttataaccaggtataaattttttcaacttaaataaggacaccaaaattcaattacagctgacccgtgaacatgcatgtgaattgcacgtgcatgcatgctaggtcactgcagtcattgtctgact

SEQ ID NO: 40441 - DNA, 964 bp, Bovine  19866881240861
ggaaggagggtaggaaaaaggaaaagacggggtacatcaagggagagaaatgaaagaaaaaaagtagaagaaaagtgaaggaaaataagaaaaaaatatgaaactgttgacagtttgagttttcccttactcagaaagtggtttaaatccttcggagtttctctttcaagccagccccctgtcagaacttgaaacaacatcttttctgcatgggatacaggttgtaggaaactgcaaagacacaaaggtacctgcttattaatagattcttttcctacttagggtgtgtgtgctgtgcgtctgtgtctttcccttagtagggctgtggcaaccacttctgagtttgcaaacaacgatgaattctctttctttctccccaaacacaggctctgcttttagtttgttttttcgctgtgatggcttcgtggggtggtgcagaggacagcaatgcagtcatttatcttcaggccattgatcagccaggggcaggggaagggagatgattagcttttgcatttctacgactgctttgtaaatttcaaaaaagaaaacaaaattcgtctcttctcctttcagccctcctgagcgcccgcggccccgctcttctctctcgggttcccgcccgccgcagctagccgctgtgcccaggccccaagccctgctccacgagaactgtgcttccccacaagagcggctttcttttctgtcaactcagcaggcacccgccaggcaggtccttctaacttcccttctgatgactcttctagtgatgctactgacaaaagatgaaatgaaaagccaaaacctaaggttcttagaagacaaaattctcaacggtgggatctataagtgtcaagcattagtgtgtgtgtgtatgtgtgtgtgtttatgtttagaagtgagcgtgtgtgtgtgtttaggagtgagtgtgtgtgtgtattatgtttaggagtgtgtgtgtgtg

SEQ ID NO: 40442 - DNA, 1232 bp, Bovine  19866881257850
catctacaaaataatagtgcactctgctctccttttccttccatttagctattaatggctacatgtatggcaaccagccaggcctaaccatgtgcaaaaaggatagagtctcctggcatctgattggcatgggcactgacacggacatgcatggagtttattttcaagggaacaccatccacctacgagggactcaccgggactccctggcgctgtttccccacgtctccacaacgggcattcatgcagccagaccgtgcaggtaaacttggcagggccagctcaggtgaccagattcctatcttcaggcaagtactcttagggtctttccccagaagaaattggttgaatttgggcacttctgcgtgtgcagaaggaaatatagccttgagtagaatcagagagtcctgactattgtatttcaaacacataatgtgaagaacagaggaaaagcatctaataagatccataaagcaaaagtaggagtcctctaagtgacctggcctcacaaatcctaggagaatgctctttatttatatccatgaacaattcagcccaagaaagagtatttttgtttgcttgtttattctctttaaacacagacttcattttagttgctgcttggaagcatcaaccagacatgagcagactggtggttgcttccaggttgtagatgtgaacttatctcccttctctagagattgatagtggtctcttgatgagtccaaacagggacttgcctattgtcattctctcgggtacccagaaagcaagctgtgttggatccggagtccatggagagcccgttgaagtgccagtacccatcccttctcttagagattaataagttaattaggtcactggggcattttaataaaagataaagggtaatatttggcaacatatactctcatgaaaaataagaatagtaaatgctgtggatattaaacatgtttctccaaaccaactttttcattggtctaaaaatgaaaccaatatgctactcaagataagtacttgcctgctctgtttcctttataaataggtatttacttctttccttcacactggaactgcattttagatgctactctctgtcactggttaagaatttgagatttgagggaaaaaaaaattcaaagagaaaagaagatagagctcttcaaagctactcttttctattaacaagtagtaaatatgacttacgtcacctctttacacgttaaacattt

SEQ ID NO: 40443 - DNA, 1155 bp, Bovine  19866881265761
gtaaattctaatttctgattgtaaattttattctatttataattgcccatgtgtttttccctttttttgttgcttcccctacttggaaagcctttttcttcttcctcatctatcaaattcttacccatatttctaggctcagattagggaccccctcattaggtagcctttctgactgttccagtaaagtgacaaagctcaagaacatttatcattctgcctcaaattttattcattttgtaaatgtataactatgtttaactactagattccaggttccaggaaggtcttatcaattttttcaatcacctcttacctggttcataagtaggtaattaattaataaatatctgtcaataagatgccaaataggcattatacattttcctatgtttaatattaattgtaataaatataacacagacaaaaatccatccaatagcatgcactgaatgaacaccgttgactgtgtggtttaattgtgccattgtaaccatttccacactggcctcatcctttttaccttggaggtgatcactgacttggcaggttatcatccactttccaggattctcaactatcatttctattgtcaggaaggtggctgggaacaggttgacgacatcagtccgatgccctctgctgatgaaggtgttaccataaaaatagatggaatggatgtctatctcattccccatcccaaataggtgccaggacactgattcaccaacgcacatatcaggttcagggaagtttccaaagaggtatccattgagcgctgaaaaacagaaacaccggtgaaagacactcgcctgcagagcccagcagaaccagaaacgatggtaatacatactctagcacagctgaacaactagcacagatcactgggttgtaatatttttgtgcaggaaaaaacgtggcttctttgataaaatgcagtccccaaaggaatgaaaagcattagtctttttaagagaaaagcactcaataaaagtgatcagcaataggaacacagcctgagctgctctgtgaacacaatgagatcaggagtaaaccaaagtgctgtttataattcaggacagcttggccacctcctacttccacctctatttgcatatttaccatccccctggatctgttctgtgtaactagaaa

SEQ ID NO: 40444 - DNA, 838 bp, Bovine  19866881292209
aatgatttgaaagatgaaatatagaatatattgttcggatccttgccaaccatgggtttccaaatgccaaacatgcaacagccagtggggcctgggaaatgcgcatcttctaaatggggtgggtacccttggctttgcttcctgcaggaactgcctaaactggcctcctgctgcctcataacaccctgcacacccacaaattattacttcattagacacattgtagcaccactaaaattatatctgcaaaaaaaaaaaaagcttcattaaaggactagggctggcttaggaggaatgagtcataaagattaaagaaaagccattccacaatcttggcatttcttgagaaattccctgaggctgttcagcagaaaatttaatcgccctgctagctagctggattttttgtaactttcagagcctagagatccaatcttactcatctccttgtgggtctttccactgagcaggcagggtgaatttttttgtcaagttcagcggaaatttagagatgactgggtagtgagatagccaagatactggggtggggcaaggtgacctgaatataagctgcaccttgatctgcatccaggggagtgcaatcttaccttgtggcatgggcaggagaggtagggaggcagggaggcagaccctgagaacatcaagataaatgagcaaagggggctacagatgggattttaggacagtgtaactatttaggacagtgtaaccatacagtatcggagaaggcaatggcaccccactccagtactcttgcctggaaaattgtgtggacggaggagcctggtaggcctgcagtccatggggtcgctaagag

SEQ ID NO: 40445 - DNA, 1178 bp, Bovine  19866881797477
tcataagtgtttatttcaatcataattatttattttacttatagaaataagtactttgaaaatcaccctcaggtacacaccatccagctccggaattggaatgtaagagaactccataaactcttcctttgtacacttgatattaactcttctttctcttctccccagggtaaacacctgaattggtcccttataccacagattagctgtgactgtttatgaattttacattatgaatacatattataccttacaatattaatggttagtaagttctccaggcatattaaaaaacttagtaaaattgaagtaaaacaatgtaaaggctgtgtgaaagttaagcagttactttttcttgatacattgatcaaacttttaagagtttagatttttaccctttttactttcaagaagaaacaaagtttctaacatccagtaagtcagttttttttcctcccaggtaaacctgatttttatcaagacagagaccccctaagggtctcaataagccgagaacaaagttttcttgggagccctctggaccgtgatccatttggtcatcttcacccagttgctcaggagaacatctgtggtgatgactctgataaagcaggtgagagaaaaaggaatcagaagtggaattactgtacacaagagtatgtgggcagaagataattattgtagcattgcttgtaatgcaaaatagtaaataacttcagtaaaactgcagttttgtgaaagtgttaaatgagaggagaaaagtctgttcgtgcatttgaaaactgtctgaaataagaatcaacatgttggtacaggttaacccttgttggagattgggtttcactgtctatttcttatgtttacatactgtaaaattttttcccataagaagcctgtattccatattcaaaaagttgaataaggaaagtgaagtttatttagataataagtaatttcacatctgtggcattctaaatgagctgttttatgtttagttttaaatgttggaaagtattaaagaacaagttacaaagaaaaaactttaaatgactaaaatctgccactcaaagacaactgatgttaattttcttgcttttgaatttatgcatgtttataacaggctgttttttatgtgtaatattgaccctacaaagcataggtccagtactgcttcatta

SEQ ID NO: 40446 - DNA, 1783 bp, Bovine  19866880350601
tattcggcgcagagtttcggtgatgaggaagtggccccggctgacgtgtgggtcccaatcaacccttgccaaagccagcagcctctacaggagccccaatgtcacatccccaccctgatgtccccggagggggcaggacaggggagggcagctggctcccaggctggtttattgcatctgcaagtggaggagtgcttagttgctcagtcgtgtctgactcttgtgacccatagcctgtagcctgccaggctcctctgtccaggggattctccaggccagaatactggagtgggttgccatttccttctccaggggatcttcctgacccaaggattgaacccaggtctcctgcattgcagtcagactctttactgactgggctacaagggaagcctgcaagtggagaggaggaagggaacccacctcaagccaagcagcccctggcctggctgctccttgggtggtggtccctaagcttggtcaggagcttcttccaggaaggggagagggcaggagcatccgcaggcctggagctcgctctctagagagagcccggagtggtgccccttacctggtaagaggttccctggacagagaacattgagggggtgacttggcggattgtgtgcaggattcatcgggatcctttcaagcttcactaattaacatgagagaacctgttctcactaaggcatctgagaaggaatgggtacccaatggcctggaaccctgagctgggcaggaatatccccctcccacaggcaaaccctcgagtggggatgagttgctgattctgaaactcactcattcattacgacaccagctgcctctcaagtctttctttacctgttcatttagctgtggggctgcaagctagggcccatgggtgtcttttgtttagtctggagttgttttatcaaattagaatttgcagttcttcagacagtactggctcattccagtccacactccacagacacctgccatcacacttaatcatggttccagtcatctacatcacctgcctcttccctatagatagtttgaccccaaggaaccccctgaagcccaggcctgattcctaggtggtcccagtcagaccctccatccttcttgaggacagtttctgcctcacctcctacatctgtctggagagcacattaacttccttgaaccttttatagcttttactgcatttgagactcagaataactccctgagatgtcaaatggcatcatccccatttggacagctggagaacatgagtaagaagagtaactggcttgctttaggccacacaactggtcaatgaaagacagaggaggacccagagatttttatttcagatgtctttttttccaccagaccatcagttcagtttagttcagcctctcagttgtgtccgactcttggtgaccctatggacttcagtacaccaggcttccatgtccatcgtcaactcctggagcttgctcaaactcatgtccatcgggtgagtgataccatccaaccatctcatcctctgttgtccttctcttcctgacttcaatctttcccagcatcagggtcttttctaaagagtcagttcttcgcattaggtggccaaagtattgaagctttggcttcagcatgaatattattagcatgaatattattcaccttgcaatgaatattaggattgatttcctttaggattgactggtttgatctccttgcagtccaagggactctcaagagtcttctctaacaccacaatttcaaaacatcaattctttagcattca

SEQ ID NO: 40447 - DNA, 1779 bp, Bovine  19866880362604
attcagggggctccctcgcccacacgagtcactgcaggccttatagcctttcattgctgggcatggcgtggggtgttcctggccggctcctcctcacacctcccgtcactcagtagctgctgctggccctgcagatgtggcccccagagcgggactggaggatatagctgagagaggctaaagttagggacagttagctgaggttcacgttttctcttttttttttttttgagagccaaagacccagcttggattctgctgctgcattcatggttataagctttccatgccttggttctgggggatttatctctgcgtgtgtatttttaaacattgtttcctgggtactgggcatgtgcctgtctgagccccaggcccatctgtccacagcccaccatccattctgtttgtctcttcctggacatctcctgaggtggtctccttggttcctagaactagggcccatcagctcttctcttctgccaggcagtgtagtttaaaaatggctaaagatggcagagggcaggagcttgatagataatcttttccttgttttccttgtttctgttttggaaatgaaaggggggtttaaatggtcatttgaattctcttttccaaataaaggtttacctttttccccccaactgttgattattttattaggatccccaagagcatgggggaagggaaggcctggagaatgagccgggcagagagcaagagattgacctggggtggggcctctaaccctacatctagaccacagaaaagggttgtcatctcccctaggtaactgagtggatgcccactgctctgaggaacagggcctgcgtgcagcctcctgccccaacctttaaaaggtgcagctctctatcctctcccagctcgaggagagtggtccattcagctgctttcattcgtattctatctgctgcccttgtctctccccctagtctgagcagaggagggtctgtggcaaaaagcaggacgagagaagcgttttccctggtcaaagctgtggcagctgcatgaggcgtgatgcgcatggccgatgcctctcgccgcgtttctatttctgatcatcatctcttccctattctggagccaggcctgagctgtgggccatctgttgctggaaagctgtccctcctttaccaggcctcagtccgctgggagttctgtcttcccccggcctcctcacgcagctcttgtgcctgtggggagaagccctgaggccaggtggggtttaacgcctcacctgaactgaagcccaggctccacacctttaaatcagtacctgagaatctgtgttacttaaagctccccgggcaccagtggaaacacctgggttacgattcagcagaaagagaatttagccagggattaggatcaccgcctgtcatcttggcctggttgctcagtggttgtgggtaagttaacctctccctgtgtttcagatatcttggtgaaatggaaattaaagtagtattgttttccactcgtcaggaattttcagatctgaagttacattgtttgaaaggatgctaggaatcccagagtattattggtaattacagtaattggcaattattggtaacagttgggagttaaggatgcccatggcaccccactccagtactcgtgtctggaaaatcccatggacggaggagcctggtgggctgcagtccatggggtcgctaagagttggtcacgactgagcgacttcactttcacgcattggagaaggaaatggcaacccactccagtgttcttgcctgg

SEQ ID NO: 40448 - DNA, 763 bp, Bovine  19866880406874
ttgtatgacatctctacctgcaagggaggccaggaaaacaaatatctggtgttccagactgtaatgggaggtggcaagagagaagaggagtaggaacggctcttgagtataaaaacaagaatgtctaccatggttcaccagggaacccacaagaagtcagattttggccaatagctgcctttggaagtagcaagtgtctaggtctcagcacaagctagatgcccacttggcaaggggtgttgccaaatggaatcctgcaggcaacagaactaaagtggcctgagagtcacactgggggtaatctaggaatcatgagtctaatggaaggatgtgtctcattttgattcaatagactctagaattggaccgagcagtcatttactatagcgtgtaagtgccggagcttagagttcatttctggttgcgtgcacattagggaggtaacagtaaaaccagctcaacaaagttgagttggctaataacccttagggcttggttttaggtggaacacttcaagtctttattttgattcatgatgtaaaagggacaggaccacttttgccttctttctctccatcatatattatttatgtatgtatctataccttctatgtccttgggattctggtcttcaacagaggaaaatgcttttatggttaatacagctcagtgcacttgaacctggggtcccactgaccagagccacctcttatgatgaccaggaaggactccaggtgcccagatgagggccacttgtgggagt

SEQ ID NO: 40449 - DNA, 769 bp, Bovine  19866880488216
ttgttagcagcaattacactccagtctgtcaggaggtgtagaatgactgtgggctcaatctcattctaaggaaatgctattaaggatctgtgtaacaaaagagccattacagagcacttgaaattatagtgctacctgcattagaaaagtctctgccgtctcccagagaggagatagagagagagtggcagatagacagcaggggagggagtcttctccccttgactcctctcggccccatgaaagttggagtgctctgggccttggcccaaagatggtgatatataataagagtggctcttcattgctacttcctgggtgacaggcatggagctggggctttacacatcccggagccaagttgctgagtgatgcgactccttcagggccttcctaggctgacagggacatgccagaaacatgtttcaaggacagaggggctgaggcatccagggatgggactaagagggctgagtatgacctgggaaaggcattcaggcgtcagccggccagaactatcctgagccaacctgcactcttggcaaaggcgtgcagggagaaatagcactgagcaagaggaatagaagaaagaagcttattttttaaagcatgcagtttggagcagaagagtgaggctggggacttccctggtggtccagggactaagaatccatcttacaaagcaggggacatgagttccatccctggttaggggctaagattccacatgccgtggggcaattaagcccacacaccgtgactggagaag

SEQ ID NO: 40450 - DNA, 1025 bp, Bovine  19866880517670
tttccgcttcaacgtgtcctcagtggagaaaaacgaaaccaacctgttccgagcagaattccgggtctttcggatgcccaaccctgcctccaagcgcagcgagcagaggattgagctcttccaggtgaacctcttcccaggacagacaccacatcgggggtagaagtcagttcctttgccagattgagcctgcgctctgctcggagtgcagcaggcctgggtgtgaatcctgccttctctgagccttagtttctatacctgtgtctgtcattaagaacaggggtccctaacctctgggccacggaccggtacctcctgtcagatcagcggctggcggcattagattagaaataaagtgcacgataaaggtgatgcactcgaaacatcccaagaccacccccctcctttccgatccgtggaaaagttatcttccatgaaactggtccccggtgtcagagtttggggactgctgcttaagaggattaagacttaactgaggagctcgaaagagcatttcagaagtcttagttggctcctgttcccctccccatcctgctgcaccgtgacgctcaggtgccctgtcctggcctcgggacttactccttcctctgccccgtagatcctccagccgggtgagcacatagccaagcagcggtatatcgatggcaagaacctgcccacgcggggcactggcgagtggctgtctttcgacgtcacagacactgtgcgtgaatggctcttgcggagaggtaggttgactcaggatgaacattttggaaggaacctctggtcccttctttcttcatgacacagggaaggggatggcactaggggagacaacagatctgggttcaaagcccagcttagccattaacttgctgtgtgtccatcattccttcattcaactgacactgagtaaatgctccaagccaggcccttggggattcagcagtgaaccagacaggcagggtcccaggtctcatggggcttttgttcggtgagagagacacatagtaacaaataaa

SEQ ID NO: 40451 - DNA, 1697 bp, Bovine  19866880531781
gagaccaaagagagatggcatgtaggaaacacttagcacctccccccctgtacccccaaattcccctgccaccccaagccacacacacagtcagtgctcagcaaacctgaaccaggaaggtggcgatggctgtagctgtcactgtcgttgtagttgttggcatgctactgacacgactcttctcccctaaagcctggaggtcctgggggtcccaagcttccagactggcccactgacctgggtttccacggagtctactccaccctcacctgctgtcctgtctctgagagccactgtccctccctactttccaaccagtgtaaccaaccagtgctcaactttagggggttcccaggggatgaagcccccttcactagcaggtcccccgttcccagtgtacacccttcttagtctgatcactgcggttcacaggctgatctgtagccctggggcctgggatcaccacccggctgctggcacccccaggtgaccgcccacagagctggagtgattactctgaggccacggggcaagcgtggatggctgcgccttcccgggggacaggctgtggcacacaggggtcgggggcgtgtgctgtcgtccagacccagcatgggagcagaggacgtgcggctgcctgcagtggtggggagagccgggaggtaatgaaagatagatagaaatggacatccaatttcccttatcgagcctctgagcgggagaggcctggggtgacattaattaacagataccaatcagccagcatgggtgtgtgtgtgtgtgtgtgtatgcacggacgtgtggactgcactgggggtgtgggtctcaaggcagacagactgggagggaagatgtaggaggtggatggggcgaaattaatagacaattgtattggaaggtggcagagaaggaaggcgagctgggcttctggaaaagaaggagaaaagacccgtacgaggttcatcactaggagaccatgagctctgcccctctgttcaccccacaaatacttactgagcacctactaagtgccaggccctgtgctgggcactggggacagaccggccagcttgaaccagggccaggccctgccttcatgagctcggtcaagagggaaagacacaccccagtgtctgtcttgtgaggtttagggctgtcagaaaagctaccccgagaggaagggctgaagatatgcaaagggggagtttggcccaaatgagagagagtccaggcggctttacaggagaggaagctttggggccgagctctgaaaggcaagtggggtgtgtctgcgtggacggctgtcacctctgggctcctgggagcatggtctcccccactgcccagcacctggcctgcggcagaggggctccacaaacattcccagcacagaggagggaacggacagacgccactgagcctcgagtcccgggtgatgagaaaacaggccaaaagaacagggctggaccctcttagtcctctgggcaggattccaggttgagctgcctttgctgatcctgtgtgagtcagagacaggcctgcagggcagggggtgtggtggaggtgtggtggcggggatgagtgcctccaggacgtagggtcagcacctgagggtgccctggggcctgtgcacacacccccggctaggatggtttggggagtactcagcccctgactctctttctccttcagaagga

SEQ ID NO: 40452 - DNA, 1563 bp, Bovine  19866880535318
ggtttttcaagctaccttttaattatccatttttctgggcactcggggagttattcagagctgagaattgatgtcgagaggcacctcctcgttactgccagccttgcacggaactggaccacgtcagggaggagcactttctaggtgaggagtgcatctttctttgggagacctggaagggttactgtaaagttttggctgctgcttggaatgatttgggaagaacagggcctcagacagcttggcaggagcctgaagctctgtttttttccagtccagcccttccttgtggatcgagctgtcagggaatcccacgaatgtctggcttctgcccctttgtatgtttttccagcatttgtcattgaattatttttatccatctctggctttttcacacacacaacctggggatttgtctgttcctcgatgttaaaggtgcgggggaggttgaaggcacagccctgagtctgttcctcctttttgtgacatcttggacctagactgcttggctgggtggcttgcactctggaaaacaattgtattttagaattttaaattcagtcctggggaatggggtacaatgaagccacaaatcttggaaatttgggtgctatttcacattaccttgttcttctgcccgcttacatttaaataataaattatagtctgggccctttcttttacctaattttttgggaccaatttccagaggttttgataccagttcagctaatacttttctgccttcttttggattatttttttatgaatgttggtagagactcaggactctgacttcccaccttttcatttttagtcagtcttcagaaatactgtttattttctttaaaaataaaccctctaatcattttctgtgtattaggcattgtgttagcacacacaacctggagatctgtctgttcctcgatgttacaggtgtgggggaggttgaaggcacagccctgagtctgttcctccttcttgtgacatcgtggacctaggctgcttggccaggtggcttccactctggaaaacaactgtattttagagctttacaatttagagttctaaaactgtattttagaactttaaagctgctgtggagcactgacaagtaagacagaattgccctgcccccggagcccgccggccaggggctgtctgactttagcctagcacaccccacttcgttgttgtttctgttgtttagtctccacgtcgcgctcgatccttttgtgagcccatggactgtagcctgctaggctcctcttcccaggcaagaatactggagtggggtgccattccctttccaggggatcttcctgacctagggattgaagtgggtctcctgcactgcagctagattctttaccactgagccaccagggaagctctgcagggcactgggtagggtctaaaagactttcaagacctgttgttggatgactaaaaggctaccatccagcggcaagaaggaaccacatccacgtggaacagttaggaagccgcgttgggcagcatagacaaagatttaagttgtacacaagcaagtaaagaagggga

SEQ ID NO: 40453 - DNA, 1412 bp, Bovine  19866880538167
cgggggtggttggggaggtgtgtcatgccgggaacctggggagaagggctcgaaagagggcgaggagaaacaagacggggtgccctggggaacagcctctctctctctctccgggccccacgtgcgcacacgggcacctctcccttccccgagccccgctccgccgtcgctctcgcagaaatgtcctccagatgtgcgcggcctccctccccggccgagggttccgcggggagctgcgccagccagcgcggagtcagcagttggcccgagcccatttcccagatgggtgaggggagggtttttttgtttttttctttctcctccgccttcgttccttctctcagcctaagtttctaggtcttttctcaccaaaagtttcgggagggcaaaccacaatgccagcgccctttccaccccactgcccgctcacccccgaccaccccaccccgctccgacacgggataatctccgaattgatggctttccagggaatcggtgctgctccccgccatcccatcccactccgccccagcctgcctgaccctggatcctaggacattaacggaaagaacgttctctgcatccccagggctgtggttgatcagcttaagttgaggaaatgaagacacagacctgtttaagaggcttcactgcttgtgaggggtggaggtgatatttaacacgggctctctggtttgggaagacattatttttatttgcataagaaatgagggatcctaggtgtatggcaccctactccagtattcttgcctggaaaatcccatggacggaggagcctggtaggctgcagtccatggggtcgtgaagagtcggacacgactgagcgacttcactttcacttttcactttcatgcattggagaaggaaatggcaacccactccagtgttcttgcctggagaagcccagggaccggggagcctgatgggctgcggagtcggacacgactgaagcaacttagcagcagcagcagcaggtgtaaaaaggttaaagtaacttgcgtttgaattacttttaggtcatataatcagggggagtcaacactgagattgggacacaggaagtctgttgccagcatctattcacttaaatgtgctgtgcttagtcgctcagtcctttccaactccttgtgaccccgtggactgtagcccaccaggctcctctgtctatggggattctccaggcaagaatactgggaggggctgccatgccctcctccagtgcacttaaatattatgctctatttcctctggaattcagctatcatttgaaaaatatttttgacacttactatatgccaggcactgttctaggctctgtggaggcagcagtgaaaaaaaccaaccaaatcattcccttaaggactttacattctagaagtggaggtagaacc

SEQ ID NO: 40454 - DNA, 1501 bp, Bovine  19866880587062
tgatcaattatcatgcatgttatagtggggtgagtgtgggtgttgagggtagcctaggttgggagaggccaggtcagcacattgactgattatttctagtcttctctctaggtgattttcaatcacctgtcatagctcatatatacacttaattatcaaataatttccttaaaaggcaatcagtaaccctgaaattgatttacagatgaagccagtttccatgttatttggttccaaatatatatttcaaagctctacatgatatacagaaccatacagagatcagaaaatatacaaagatcagatcttgtcatttgtgaatttggtgaattatactatttgaatcaccacttgaaggtgtattatcttacaagtcttatgtattctcaaaataaaggaggccttcagatacccaggtgtccaatttctctcttttttagctacctaatatattttgcattaatctccaccttgcctttcttagtcctcaaccactaagcattactctaaccagattcccagttgattatattttaaacgagtgtgcttgtgaaggttgcttataaagatagttgcacatcctgagctcctgcaggaaatcaaaagacagaattagacatgagcctccccctctgtgctcaccatgaaaatattaaataggctagaggcatgaagaaggcataagaacacacacctttgtagttgggcttttccgctagaacctgcagatccgtctacattttgtggaatatttttacaaatgtgtttattgactgagttttagaaaggtaggtgcacctgtggtttatcctatgttagctaccagtaggcttaggatttcctgcctcatgtgttaactagatgtcagggacctgtcatgctagtaagtgatggaaggccaccgggacctgaggaagtgcctagtgtgtggacagctctgtaattgacttgtcgacatatctagtttggtctcagaacaaaaatagacaaatttagaaagtctgctttatttctgtggttggtatgtctttattctttactctgaagtgctaaagaatattctcccaaactgcaaattttagcattccaacctgttgtaactgcattagaagttgtcaaatacaattaattctttctacccctaggaacagaacttttacacagagccacttcctatactggcagggggaaatatgaactttgctataattgccacttaaatgtcttgtacccttccaaatgcttggggtctcccaaagcttgattggaagatgactggtgaggtgtgaaagtctactggagagtggcaggcaggaatgagaatgtgtggagttggagagagaagcatagaattgagtagaggatgaagctgttctgatgatggagtcaaatccttggaaaagtggggaaagcctgtagctcagagaagcagcaccaatgtaccgacacacctggaggtagggcggattctgggatcaagagtccttggtaaaaaaaactt

SEQ ID NO: 40455 - DNA, 746 bp, Bovine  19866880628517
gtgctgcctgctggaccgcacactgagaaccccgctatcatcaatggcctcactccagtctcacccagcacgcagattctcctgggtgcccgatctgctgtgtgtctcccctctgtgtcacccctctctggtgagacccctgcccccagaactccatacagaccctgtacatacaggaagagaggacttcaataaaataggagacatgaggaaattcggcctcagataaattggattgattatgaaatgaaagggcagcgggcagaagagttaattaacttgaatgtctgtgtcacttatttaatatatcccttcaatagtgagaggtgattttcatcctgtgactggcagctttggtcacagccgaggaagacaggccacgctggaaaaatctgctctcaatcaggtctgccacttctgatggtgggactgtggccaagctgctgacggaccagtttcccactctgaaaatggagggttataacgatgcttgcttctactagagctgtgaggcttagatgaagaaacattcgaaagtgcctactcagtaatgaggtgcatggctttcaaagtggcacagtggtaaaaaaaaatccttgcctgccattgcaggagatgcaagagatgcaggtgtgatccctgggtcaggaagatctcctggagtaggaaatggcaggggatttcctactctgcccgttggaaattcttggaatttcccatttcaagaaaaccttgcctgtagaatc

SEQ ID NO: 40456 - DNA, 2642 bp, Bovine  19866880634559
tggaaataggtgaatgaactacgtttggacccctggggtaatctgccttctgggcctgtgcttatatgtggagtattttagcgagaaaacactcctttacccatgagagagttgagataggactgaatgagagaatgcacagcaaagtgattcacaaatggaaaggtgccacaaaaggcttaatattattaattggacagaaggagcgaaacttctctggcgcactttgagaaggagcagagagtgtccatcagcccccctgggttctcttgaagcctgcctgcccagtgggagtcgccggtctgttaggtagtaacagggtgggatgggctaagccggcatcttggtctccatctctctgataactgggtctgtctctcatttggtcctcaagttgggaaggaaaatggatctcaaccatctacttccagccccatcaaacccaatctcagggaaatcaggggagccaatgagcaagccacagtgaaggcggcgggtggaaggcaagctggaacgggtccccatggtggggctccatgctcacggtgactttgatctagctctcacactggcttgcataagcctgcagctgctcaaggtcccagagtacccacacatgacatggaatttcacagtgcagtggatgagataccgacataagaatgggcaacagcacagactccatcagaacactttggggtcaaattttggctctgcttcggtggtctcaggcaacttaattaacctctttgtgtcttatctgtttaatgggaatagtgacagtaccaacttccactggttattatgcagattaaatgagacaagtctggcacatagtaaggctcagtaaagtaatcatcattattaagaaaacagcatatgcaactagagattatcacactaagtgaagtcagtcagaaagagaaatgccatatgatatcacttatgtggaatctaaaatgttccacaaaatatgtgacacaaatgaaacagaaacagaatcagggacatagagaacagactaagtgttgccagtgggcagggggttggggaaaggaggggtttcaaggtactaaagtataacacaaataactatagtcaatatgctaagtcacttcagtcatgtccgactctgtgtgaccccatagacggcagcccaccaggctcccccatccttgggattctccaggcaagaacactggagtgggttgtcatttccttatccaatgcatgaaagtgaaaagtgaaagtgaagtcgctcagttgtatccaattcttagcgaccccatggactgcagcctaccaggctcctccatccatgggattttccaagcaagagtactggagtggggtgtcattgccttttctgactgtagtcaatattccatgataaaccataatggaaaatatttttttaaaaagaatgtatatacacatgcaactgaatcactttgctgaacagctgtaattaacacagcactgtaaatcaactatacttcagtttaaacaaataaaaattaaaaatatagcacagctgctagtttaattaggggagtcagtaactaccatacccagtgggattgcctcagagatattaactaaaggaagtttttaaaggttattcaaggaccctgtcctggatgccatcctctcatttttgccagtgatggagagcaagacagaaaaatgtatgcttatcaaagtgcaggaaaaccaaagctgcagatgaaggtacacgcttgcaacggcaggatattcaggatcttaaaaaggtggatccacaaaccaatctaacaagacaaaatggaatagtaatagtaattgtactgttcttcatgtagatccaaatataatcaaatcatatgagcatagggtagaaaaacagctttgcagcatgtattagaaatgcaaagagattttagattagagctgttttaaaactaatccaaaggatgtcttccaaagcccgcttactgaccaccagcacagaaaatggaaggggatgcctctcacttacctctgggctgatgatgggggattaggcaggagcaggaaggctactcaaggaatttgaaaggagaaggaccaggggtatgcttccaaaccagactctttgatgagtaaccaaatataagggttaaatctaaaggaacttaacaggattatgaatgggaaagaatcagaagaggttgggaaccaagtgcaaataggatctaagtgaaagtggaggggcatttgaagaggaaattatgagtgatgtccacaagcagcatagaacagatttgggctagtgtgagaacatactttctaagagttgagttttctgacaatggatgagcagcactgtgaggcagtagtattcaggaaaccattgggtttacctgatggggtaaattatataaatttcataaatcggatggggaatagggccgggccacagatttaagtccctgtcaattctgaatttctgtgattctatcatgaaaccatgaatacacagccttgttctgacagcaagcatagcatctatcatattaagggacatcgatccattatgtaacccagaagttaaagttcagtaaagccactcctaagctgccatgttgatagttagctagctccaacccaagagttcaaagaaa

SEQ ID NO: 40457 - DNA, 1880 bp, Bovine  19866880639257
atgtctgtgtgtgacccttatcttccttttaggagaggtcggcctcacaggagagggtcttcccccttctctctgttccctggcatcacccccagttaccttctggacttgattctgggcatttggtacaaggcccagtgattgagctgcagggaccctactggggagaacactgcatgtctcacttcccattctgccccccaggtgtagacccctggctggattcacccccatggaaacccttagggcagagtggagtggagagtgaataccacaggtgggcctgggggctcagcccaaagctgtctacaggtttaaaaccctgtgcttttatgatgaatatgaattttacatcttgccccacatataatcaatccatgatcacttccttatgaaaaatgctttagatggtttattagctaaattacttaattaccccttctctaagccctcggggggagagcagccttcctcaccccaaagctttgctcttgttgtcctgtgcctgctgagtgtgcaggcccagctccagcctcatgggatggaggagtctgacaccctgccctgcaaagccagtggccaggctgtattcccagggccagggggcagcatttggtgaggagggaggaaccaggcttcagagataagtctgttttaaaggggcctgaattccaagttcaagagcagatgggggagtcactgggcagctaattccctgagaccccatgtccaggctccagggagctggccagccatggagaagcagttacaacaatcaaaggctcttcagagaagtcacagttcggtcaggggtgtccactgtgctccagaagaaacaagatcagtgccaaggtctccggcctctttggcatgctatcccatgcactccccaaacaccatctttacaggaggcccccagcccagtggctttcaaagacctgcctatcattgcacgccacccccaaccaccctcccctccagaggactctgcagcaggactctgagggaagaaggaaatggaaggacagaagggaaaggggaagggcctctttccttatcttcagtggttgtctcttctccgaccccttaggctcaggaaggatgtgagggggaggtgctgggcttgagctgcggcagcttggaaggcaggggagtctttgtccatctagtctacctcccaatgctccttcaccagaggggactggagcctctgtcctaatgactctgccttccaacccccccaggctgatggacctggccaaggaaatgaccaaagaggctctgccaatcaaatgcctggaagcggtgatcctgggaatgtatccttcctctgagaggtctgggagggggtggccagctactcacacctccagggccatcttcctcctctggaagggccctcccggctccctttcccagaagtcacgaacttggccccagagtgaaggagtttgaggggggctcagtctcttgcacctcagttgctaacttccaaggcttactgggcagctctttttttttgagcagtggacacagtgaccctgttctccaaaccacaaatcacggctcatggtctcataaggctgctgtgctatttccaagaaccaaagagtccgggagaagcaggttggatgcccaactgttggcatttccaagacatgtggatctgtggagatggtggacatcccctgatctttaaatgtaaatctgcatattaaaaaaataataaaaagggtttctcagtctctcccccacccaaagggtagaactggacctatagctggatcaccagagtagttaggtaggacagacgaggcccctagagggggcacccaatatccccagttaaagcaaagttaggagactggcatgggccattt

SEQ ID NO: 40458 - DNA, 759 bp, Bovine  19866880643166
attttaaaggcgtttgcctcgggcacttttaaatgatggtgtctcaattctgtaatcatctttcaagagctttctcttaaagggtcttttaggtaaacccagtccgtcaaccacacttatggactcaggaatcatttttcccaatatctgccctcctgcgtgtgcatacgtataggcgagtatacccacacacatggcagacatctgggcatgtttagaaagctgggaggacctgaaactggaaaggaagaccctaccggttggccataccaagttcacatcttgctaaggtaagagggtcccctatcaccgcttccctggatttctgctatacctaggctttgcttatctgcaggtattagaagggaagacttctcacactgaggcccaagtgatatgctgagtcccaacctcagatgcacaatcaagcctgttccttcccatctcacctaagtgttgtctgactgtcagacttcaagatgagtaagggcaccacggccacctgcttggagaatgcagtccccaggccacagctgactgtggctttagttacagactatttggagcaactcctacaaatccatctgtctcttttagttgcagagaacaccatgcctcttctctatacagtccccatcgcttgaaacagacatcctatggcatcgagccctctatttctttctaatcacataaaaatctaaggagccttaagatgtccctgggccagtgggttctcaccaaactggcttcgtctcctct

SEQ ID NO: 40459 - DNA, 2021 bp, Bovine  19866880668713
agtcttggatatattgcctttatccggactgcagttgttttcctgtgataaacaatgtcaggactgtacattttggacagacacagcatgcaggatcagctcctcaaccacggattgggaattccacgccccttgcagtgggagcacagattcttaaccactggacttccaagggaagtcctgagttttcgtattttttatagtttgtatttggagtaaaaattatggctgggcttagagccttctcttggtgacacctgttaatgctgagacacagaacaatggagggatccgtccaggtcagaggcaggacctagggcccagcgctgtgaatggcctgctcccagctaggctctgctcatgggctgtggtagaaacggcacatgatacaatcaacgtcacaaccactggcgccagaaagcaacccctgcaaagttccctggtctttccctttgggggttagttgcaccataacatccctcccttcacctcttcttcaagttcaaggtcagtttctaggccccattctagtccaaggtagccctagaaaatcttcccctacccccaaacaacctctggttgccaggacagcctggaagctcagcttgtgagttctaattccatggggaattcccagagctacccacccacaagcagccctaagtgaattctcaggtggtccttccagaactggcgatgacatgggccccagccagacctccctcaagcattctgctctgttccaggcctcagtttctttatttacctgtaagtcactgttttgtgaatatttatttagtctcttgttgttccttccttagtagtaagggtgactaagtttaatgaggaagggcttagtagcttagagttgtgagttttattactggttttaacactaagtgaccctaaactattcatttaatctttttactggataagcatacttacacataaactggcctgttttgagagcttttaggttgtccttaaagcactttgatctccctggaagtgggtgctgagtaaataaaaggtactcttacgtgtacatccacaaaagcatcggtggattccagtgctgataaactctcataattcactcgaccaggggctgccctgtaaacagtgaaaagatgtaaagagaatccactgctggctgtacttttcatctgcatattggaggattcagtgacttggtagccacaggaatgaaaactagtgactcacaagagctctgcaaatagtgttatttttcatttccctgtggtgttgctattgttctcaattttatggatcacacaagttttcaccagacaaccttgttcttcccccgctgttttgaaaccatcccaagtatagcccagggctgtcgtctcccattgggtcagtgtgagctcagcccagctcctcaaatccctcggttcctctggtctgtctggagtccctgttggagctttgttgtgggagaggaaggcagagagcccacgccttgcccagacagtctgaggcctggccatggagcttgcagttccctagacactcagagttggacttggccagccattcctctgttgttacttttcagaggtaataagtgagattaattgcaggccaatctccagaagagaaggtagtcagggccaaatgcagtcacatgtttagaaacctgaggtgtgcctctgaacaaggccgactgagaatgatacaatccacgatgcaggtaccaagtgttcgcaacctctttttttcttaaaggggttgtatttgactcttataatacggatgatgttgttgttatttagtagctcagtcatgtccgaatattttacgacctcatggactgcagcccaccaggctcttctgtctgtgggattctccaggcaagaattactggagtgggttgccattcccttctccacaggatccttctgacccaaggatcgaacctgcgtctcctgttgcaggcagattctttaccactgagccacctgggaacccccccccccgaccccgcccagatg

SEQ ID NO: 40460 - DNA, 1128 bp, Bovine  19866880685805
tgatgctaaagctgaaactccagtactttggccacctcatgcgaagagttgactcattggaaaagactctgatgctgggagggattgggggcaagaggagaaggggacgacagaggatgagatggctggatggcatcactgactcgatggacgtgagtctgggtgaactctgggagttggtgatggacagggaggcctggcgtgctgcagttcatggggttgcaaagagttggacacaactgagcgaccgatctgatctgatctgatctgaccatcctgtgaagctaagatagttctgatctggctgatagaaatttttgacacttaggacaagtttttctgggagtgaaaaagagcacttatggagttgattgaagagaaatggtacagtggagcctgaagtctatgtctaatacagtgcttctcaaccagcagtgcatagcagtggggaaagaggagggtagcgaccataagttttaaaaagcatgtcaagctataatataattttatgtatggagagtgataggaaatttatggctttcataaaacaaactgcagaaagtaaaatctttttggctggcagagcataggttataaaaggtcgagaaactgctgtaatcactcttttattgttaatagacaaaaaagagggatacaagatagtggcttagaagtgggcatgcagtgaaccataaaacccagaaagaggatacagtttagaaaatgcagtgaaaagtaataaaaatgattagtgggaggtacggattagtttggaagataaatataaagtaacagacatattcaggagcctttggagaacgaatagggaagatctttacaagagaaggatggatgatagttaaaactcgagctttagttcaaaggatgcaagggacatctgctttgtggtgatagtgagttgacgtctgaatcctcagaaactacgctgagtttccagtagctttagcctctaaaattagtagcattgtcagcttgggtgtctcatgtttgtctaaccatcagcatctaggtggcaaagctgtcattattcccactcacaggcaaacctctcttcacctgcagccctcttttggtctctaaaattatgctaatgtgaggctaaactct

SEQ ID NO: 40461 - DNA, 1626 bp, Bovine  19866880717105
ggtgtttaaatccccttttcttgtactgccgtccgctggcattttgcttctgggaaaacttccagaggagccctttttgcttctgggaaaacttccagaggagcccttctgggaaaggtaaaaattcagaagttctatataagaaaatggcaagccaagaacataacttggggagaaaggcagagaaccccaaatagcggcagatggacctcagaggctggtctgaaggctgttagagataagaacaaaatgaggcaaggaagagtagcagcggagccttctaaaggcggtcacttcaagggcgaggttgtctccatgattctgagatgatggccttcctcatttgggatgctaaaatggcttttctttctttctttttttaagaaaatggctcttcttttatgaaatgattgtcattctgggttcttccccaaccccagcccccattaaacttcttacttgacagaatagtcaactttgtattggttcccaaatttggtggtagtggggttgagtggggggtttgttctgtgagactgaaaaatggggaaccactggcctaggacccagaacccagactccaggcatccaccagctagaccacaggctttgtagggaacctgggcagcgagtgctggacacaggatgcaagcgctcctagctgatacttttcaagggagaggctcctgtgagagggggctccgtccacccaggcaagctcttcccccttaagctctgctctgtgatgttccaggggcagctgattggaaatcccagagaggggagagttctctgctttggccaagcgccatcctcaccctccctggattccacccctggcctcctgcaaggaggagtggggggagatgcatgtctcagctgcatgtctgagaagaaaggctcctgttacccgtcgtggtgacggcagttcagggccaggccactgtaccggccaccgcagccccagatgctcctgtgagaggatccagaggagaaaagcgctcaacccctagtgtcagcttgtgtcaaaagagaagaggggagcctgaaacagactggggactgccattcatgaaagagctcaaggcgtgtccgactctttgcggcccctcggactgtacagcgcatgggatgctccaggccagaacactggagtgggtagcctttcccttctccaggggggatctccccaacccagggatcgaacccaggtctccctcattgtgggcggattatttaccagctgagccacaagggaagcccaagaacactggagtgggtagcgtatcccttctccagcggatcctcccgacccaggaattgaacccaggtctcctgcattgcaggtggattctttaccaactgagctgtcagggaagccacatgaaagagcacaccttcttcatccccattccagcctttccagcctggaaagtggaaagaaagtgtgagtcactcagtccgtctgactctttacaaccccatagcccgtagcccaccaggctcctctgtccatgggattctccaggaaagaatactggagtgggttgccatttccttctccagggaatctttccagcccagggatcaaacctgggtctcccacattgcacgcagattctttac

SEQ ID NO: 40462 - DNA, 2565 bp, Bovine  19866880753991
tctccgtgatgcctgttggatgaatgaatgaatgtttaaccttcaagcaacaagctctcaaaagagtattaatagaagatatttgcatacaaggagtatgttaattaaaattagttttatttattcattcatgcaaactcagcaagaaccccatttggctgctgttaatgtttagcgtgatttactgtaagtactagaaatataaaaaatgtgtttcttttcagaggaaagccacagttccttctggcttttcctcctccctccttccatttatctgaattagtaaagctttactttagttcaggtcttttcctgagacttgcaggctggttgcctggtaatttaattacttctgaatctaccgaaggcaaataccaagcaatctatggggaaagattatggagttccaggttatttattaagtaagccttggtagcccttggggtggcagtggtaacctcacccctcatacctaccccttgggggagggaaacccaagtagaaaagtctacattttggagtatgccagcagggggatggcagaacccttatacaaagactggccaagatggagggatgcttagctcctcctgaaactcaagggttcttcctggaggaacacagagtcataaacacagcagcttccttttctttccaggaaggagatgccccacccctcattgagcaggttgttgggggaagtgtaggtctggaggggaactgacttgattcatatcccagttctgcctctttcaaggtgggaatgttacagggcttccctctgcctcagtctcctcacctgtaaagtgggggtaagaatagtgtctccatttcataggattctatgaggatcagagaagctaacacatataaagtacttagaacaggtacttagaaagtgctcaggtataaaaggaactctgcaagaaactcatccacgagacccagctgatttagactgtgatattcattgccgccacttgtcccttggctgtttcctcacctctgtcccatctgcctgggggctttttgttgttcagtcactaagtcgtgtaccaccctttgccacctcatggactgtagcacgccaggcttccttgtccttcactatctcccaaagtttgctcaaattcatgtcctatgagttagtgctgctatctaaccgtctcatcctctgccgccctcttctccttttgccttcagtccttccccgcatcagggtcttttccattgagtcagctcttcacatcatgtgggaaagtattggagcttcagtttcagcattggttcttccaatgaatattcagggttgatttcctaggattgactggtttgctctccttgccgtccaaggcactctcaagaatcttctccaacaccacaatttgaaagcatcagttcttcagtgctcagacttctttatggttcagttatcacatccatacgtgactactggaaaaaccatagctttgattatatggcaaagtgatgtcattgctttttaatacacagtctggatttgtcatagtttttcttccaaggggtaagtgtcatttaatttcatggctgcagtcaccatctgcagtgatttcagagcccgagaaaataaaatctgtcactgattccactttttacccttctatttgtcatgaagtgatgggaccagatgtcatgatcttagattttaaatgttgagtttcaagccagctttttgactctcctctttcactttcatcaagaggctctttagtttgtctttgcttacagccattaaaatggtatcatctacatatatgaggttgttgatgttttcttctggcaatcctgacgtaagtatgcaaactgggaggctcaataactagctggtgaatactactcctgaatctgattccccagtggcaacagttcattcagaagaaaaattattagcagtattcaggatacttgagtatcaaatgtttgccattctgtctagtctacatgagtgtgtgcacactaagtcacttcagtcatgtccaacacttagcaaccccatgaaactgtagcctaccgggttcttctgtccatgggattctccaggcaagaatactggagttggttgccatgccctcctccagaggatcttcccaattcagggatcaaacctgcatttcttgtgtctcctgcactggcaggtggttctttcccactcataccacctgggaagcccttctatctggtctatatcccctacatgcaaaatagggacctgtataatgctccatggaagttaaacactctcggatggaactacttttatattaaacatgtagatagaaggaaaatactaaccaaataactttaagagaaaaattttgggttttttgtcacagttaaaatgtacatgtaccacaaactatgataggttcggggtctacaaatatcactagaacccagtctctgctcagtctatggacgacagagctggatgtgtaggtgagtagtctccagtgtgatgagtgcttttgttcactggacatgtagaatagattaagagcacagagaaggaatttctaaaacagctgg

SEQ ID NO: 40463 - DNA, 1152 bp, Bovine  19866880757029
tttcccctgccagaccttggtcatgtcatgaagtttctttaccagctagaaatggattatctgttgagatttcatccctgcctgattcactacaacaaggctctgagtggggccaagcgaaggaggtataattcttaatcacctccagcacctggctgcttcttccaccgaaacccagccaactgctacccaactcagacttcttccctgcctctgcccagagttttgttctttataatagcccatctcatgggtaaacaccagaatcagttggaatacgggacagtcccaacaatcccccttttaaagatatgctctagaaaagaactccagctagtgcccctccttggaggctgaagtcttaaggcagacataggatcccttggacacttataatttcagccttcctgctggtctgcccaaagtgcgcatgagggcatggcagagcctgcagccagtgtttcggaacgattaactatgaacgcaacgggcaccccttctcatgtggtcagccaaatcacaagtgtattcccttcactcattatattgtagctgagacaattaagtattgtgactgtagcacagttaaaacttatgtaattaaggcaggtgaggatgagaagaaaaggactctgcttccgaaagctcagccttgaagttgaacaaaacagcaatacacattttcaccactagatggaaggcttcctggtttattcccccagctagtccaatctgaagtacagaaatgatccccgagcggccctcccacaaaccagtcctgcgaaatatccccatgcagactcatagaaggttaagggtagacaaaaatttggtgagatatttttggccaaacctttacagaagaagaaagagcccaagagatcggtagacctcaggtttacaaattctcccaggccaacttacttttgtattatcccaccctgcctcttgacagaagtcatccaaaaatcgacttaaaaagagataacaatatggggtgtcctcagtttctgaaaaatgtgtagagccatgtaatgatgtgtgcacttttttgtggggtatgtaatactgacagatagcatttaaataccagagacattactttgccaacaaaggtccgtctagtcaaggctatggtttttccagtggtca

SEQ ID NO: 40464 - DNA, 934 bp, Bovine  19866880787162
tgcagttctgaaagcaaatcacatacgggctggcaatgtttacaggaaataaatgattaaaaaccctagtactagcattccccagaagctctttcatttggaaaattgcaaaaggaaatgaagagaagtgggaaatgttttgccaacaagaaagctaggggaaaaaatcctcttaagcatatgttgaaagagactttatattttacatctatatctttgtcaattacctcaattatgagtgagtgcaataaacatttaaatattagtgattagaaaactgatttgaaagaacattcccagtatctttgaaatgctctgatgtgattaatgtcaaaatgagacactaatttgcgtccactgtattggcaaaaggaaagttggattacactaagcaaggaccaggatgtggggacctgagaacttacgcatcgctggtgggagtaaataaacccacatgaagagtgatttgggagtgactagtaaatgtgagctgtgcacatccaaagtgaaaatgaaagtgttagtcactcaggtgtgtctgactctttgtgaccccacggactgtatgtaggccaccaggctcctctgtccatggaattctccaggcaagaatgctggagtgggttgccattcccttctccagggaatcttcccaacccaggtatctaacctgggtctcccacattgcaagcagattctttatcgtctgagtcaccagctcagccatcctagcaattcagcttctggttagatacgctaaagcaacagttctcaaagtctaatcccagaactgcttcgaggggatctacaaggtcaaaacttttttcaaaatgacattaagctgttacctgtctcttttcctgtcttagcatttgccctgatggtataaaaataaaagccacggtgcataaggctactgattacttagcatgga

SEQ ID NO: 40465 - DNA, 1009 bp, Bovine  19866880832606
ggttaagcttgcccttttccagctgccccagacatcctagttctcatcccacagttggatccctccctcacatattcttggaccggccttttcttcccacctccacactagctgcagggcgtggaccatatgaccacgtacacatcctgttcttgccatacagcttccctacctagaactgtttgtgggagagcagccctattgatactccagagcaagtttagagagaacgatgggaaaaccaggaaggcccaggcatgggcaaagcccatgaaactgacaaacacactaagaaatgtctttaatgtcaaatctagccctgttttctgtcccgctcaagaccaccttttccaagcaaggaacttaagccccattacagtctttgaacgctgctggggatcgcaacttcagaaccgaagcagctctggtcccaggccgaggcacctcaggagttaaccaggggtatttatttacaggttaaagaggccagctccagagtgcgcgctgtgctgaggagacgcggagcgtgagctaacaagacgctctctctagcggcattctgggcgattactcccgagcacccagccataccaaaatcaataaacaatttcagcgcagcccagggaactttgccacacttaataaaagtctccagctgcagttatggcttcatttcaccttaacgtcttctttaactgtcccttcttttcaagatcaattagaggtacatgcaaagagaataaagaaatccgcacgtgcagacgcccacacgctaacacacacatggccagcaaacaaggtcaaaactggtaatgagggcagatggactctcccctcgttgctctaattcccagctttagggtgagtgatgctggatatgtctaggcacatggttgggggagtggggttgggttttgggggagaaaggagagggagagaatggggggatttgtcccctagttcctaagtacatataactaatctagatacagaaagcgctcctactcta

SEQ ID NO: 40466 - DNA, 1076 bp, Bovine  19866880861007
ccttcttcctgggcaagccagagctttttatgcttttgtttctctggacctggaaaacagctctcacccccccgatatgctcgaaatgtcctctatagacttcaaagcccagctcaaatagtagatgctcaacatttgtcccaggagaagcatcagtaagttgggcaggtggccaggataaggagccagggttggctcctcttcctgagccattgccatcaagtcctcacaccccgccacccagctcctcatctccaggagtaccaggaagggaaatggtacaagtgcctggaaagggagagactttcttctgcgtgctgagcacaaaagcgggactttggggatacaccgtggcggaggtttagcctctcccattccatggtttaatgtataactggtcacctttcctgaatgtccgtttcttttatttgccagtaacacgttcaccttgttcggtctccttggttacaatgcacagttccagatcccctgcagatactttaccagcctggccacctaggcgtcattttgattgacagggactttgacaccttgtctccagccccaggagcctgatcaaggctagatttccaaatcccccagatacgcccccccaaaccaccctcacccaggggccagcttctaagagccttggatattctttgagggtaaaagccttgggagcagggcctacgtctcatacattggaggtgctcaaagaatgccggcagagttaaaccaaattgctgtcccttcttctgctaagtttccttcgttcgaagatggtttctgtctcctaggaaagattacactaaccgagaagcttgcccacctttccttcctctccttcagtgagcgtctaacataggtcagcacagagaggcctgtggtaaataagtcattccaggcagctgttttacagtgatgacctcacagtggggagggggcgagtcaagaagtcaatgtggtgacctcagatcttgctcgaagggaaataagcagaggcccctgacaaaggagagtggcagggaatctgctctgttgaaggcagtcggggaaggggccattggaagagg

SEQ ID NO: 40467 - DNA, 1052 bp, Bovine  19866880933354
tatctctattaaataataacaacttgcccctctaaatattcaactcttacttctgtgatttttgtctagaagacattcagtatccaaggacacagttacctccataccacccagctccgtcttcccaggacatacattgctaatgagtaacacaataatttggggctcacttagctatggcctccgagtcttctttacacagtcctccaggcagctgtctccagttaatcagaactgacaggggagacaactattttcaacccttgttctagaacaggactatccaatagaacacattgtgatggacatgttctataaactgcacagttcaatacagcagtcagcggccacagatgatcattgtgcacttgaaatatgaccagtgtgactgaggaactggattgtaaactgtatttaacttaaattttgaaagccacatgaaggccgtggccatcttatcagacagcacagctctagagccttgaccagatctggctgaatcctatgagtacagacttatgcctgcctaagttcagtctaagcaaagtatctccagattaaatgagttttgaatgtctctagttctttcttttagcttctcggttttttctagaataggcagaagaattccttgaactaaaacagacccacgcatcaactctggtggcccttgctacaccttgtcttgactaaggatagggctgaccaaagggcagggcaggtcttaagaaactctataagccaattagagttcacacctggcagtttcttccttaaagggacggaatgatgatgactattcctgtcacaggctccctttgcttccctgtccatctacatttctccagctaacataacaaaaccagctttgataaaatgaagagaaagtggaaaatggcatttaattacacctgatttgcaacaaatgggtaacatgtcactactaaagaattttttttttttttaatgacaaggctcacagcacataaagacacagcaccagtcacaaaacagaggttcatcattgagagaggaggatcaggcaattaagg

SEQ ID NO: 40468 - DNA, 2499 bp, Bovine  19866880935623
ccgatgggaaagacagtaactttaagacttagggctggtctttgggaaatgtagccacaaggacgaaaagtgaaatgacacaggacgtggtaaccaaagtaagtggaaatcacggctccacaagtcagtttttgctgttgttcagttgctcagtcatgtccgactctttgtgaccccatggactgcagcatgccaggcctccctgtccttcaccatctccccgagcttgcccaaactcatgtccattgtgtcagtgatgccatccaaccatcttgtcctctgtcatcccttctcctgccttctatcttttccagcatcagggtctttcccagtgagtcggctctttgcatcagttggccaaagtactggagtttcagcttcaggatcagtccttccaatgaatcttcagggttgatttcctttagaattgactggtttgatctcactgcagtccaagggactctcaagagtcttttccagcaccacagttgaaaaagcatcaattctttggtgctcagccttctttatggtccaattctcacatccatacatgactactggaaaaaccatagctttgattatatggaccttggttggcaaagtcagggggcaaactttcatcagtgcttctaaaaacctttatttcagtccattttttaaaaaactagagatgatttacactgaatgatcagggtcttttacttctcctagaattttcttctccataataaagaaaccggtggagacttccttctggtcactcactagttgttctctctgcctttccgttgcatcctgtggtcccccacaggcccgcaatcacactgggactcacccaagtgagaagctacccacagggaaggtggtgcagtggtacctgccgctagaggtggccccctccactgctgaatgtgcgaggccctcccggggcctggcagggtactgtgtggggcagccttctggaaggctccggatccaacccagtgaccccctggtacagaaccgaggacactctggcacttctcaatatggcctcttgtgcgatgactgctgtgaaaccaggagaaagaggcctagcccccagtaaccagcggtggtgagggaagacgggacaaaaagtaaaaccaccagcagacccaccagaccagaaaagaaccgagcttatacaaaaggggttctatttcgtgtgcataaattatacctatgtctgcccgggctgtggcttcgacaacgaaaacggctttcagttacttctcaataaaggactaaaaagagaagggaaaaggcaggtatgatgttcacagatgcattttatttttgagagactgaatccatcaaagggagaacaaggagatcatgtatgccgggagaattctaaccaatggcaggcgcccccgtccctccctgctggctttcagccggctcactctgcaaagcagtgcatccccctttagcagacgggctggctcaggggacacaacttcttttccttgaaagtttttttttgttttgttttgttcagtaagattgcttcatatgatcaacatctcatttctgcgagggtcccggaggaccgcagtaaagacgggttttattctcacagatgcgctgttgcacaaatagcgtagtgcacggccttttcatgaacttgagatgaatgcctgccgctctccaggtttgaggatggcatggctgcagaacgagaggcacattctattacactaattagctggacgaccttgggcagcggggcaaggtgacatctgccggcttttctaagtcttaagattccacccctgagccacttaaccgccccaggcctcatttcctccacctccaaaccgaaggggccacctcgtgacctctcgggtccttcctcagctctgtgaatgacgctgaccctgcctctactggcccccaccgcccaccccccgagtctgttcccatgaaaactatttcctactctgacaacctcccaagccgcccctttcccacacctggtctgtgtgctcagtcgctaagtcgtgcctgactctttgcgaccccatggactgtagcccaccaggctcctctgtccacgggattctccaggtaagaacactggagtgggttgccacgcccttctccaggggaatcttcctgatccccacagctgtttaatccagccctaaaatttcaatcactgtcatgtgctggtttggagattcccaaagtcaatgcgtggggaaaacaaaaccaaagaggaaagtggggagggagcagaagggcagggaaagaggacaggaacagcggggaaaggaattgggggacccttctcccttatgcagtcattcctagagacaacaaagttcacacagactctcttcctactgaagacctgaagacattttcctccttggtccccccttccctttccctgtgtgctcagtcgcttcagccgtgtctgactctttgcaactctagggaccataccccacccggctcctctgtcggtgggat

SEQ ID NO: 40469 - DNA, 1831 bp, Bovine  19866880982077
ctgggttggaaaggtcccttggagaagggaaaggctacccactccagtattctggcctagagaattctattgagtgtgtagtccatggggtcacaaagagttgcactgtttactacacatgctcaaagtggaagcaggacaacatattaaaataaggtggctcaaaatcaatcacaagaaaagaaaaaaaacaagcaagactcaaagagattaagaacatgagcaggatccaagtaagatacatactttgaaatacagaattataagcaattgagcagggaggtttctgatcattcattcaataagcagatatatagaaaaggaaaaggaaacagtagtgatgtctgaaaaatgtctaggggggttattctggctaactttaactctggttttattaatactgtgtgaccatgacatacatgtgggaagaagtatccagtcaaaaagctaagagctgatattctggcccttttaaagtacagtgagatcccagccagctggacttgacaatggatttagaatgtgaaccagacttctgctgtctccacactcgtaccactccatgattgatggaacgatccccaggaggaggaaattaggacaacgttggatttctcagtacatctggcagaaaatctgggggcaagttttatggaacacaagactggatacaaaaccaacccttttaaaaggttaagttcacagcactgttctagaagacaacttagaattctgggaatcagccggttatgtcgatggtgactccttagtcctgtatctgttaccagtctggatctgcaaagacagatggatgcttagcctgattaacaagaaatgtctttgatccagctctttactttggcataaccagcataccacatgaagcctgaaaaacggagctgtgaactaaaaaagaagtgagcaaagggtgacctttacgaaagccaaaagagaactccctgacaccagttcattcaacaaggaagactgaacccagctcagaaggatttttatcaaataaagggaaaagtctgatgcctttgtgacaatacaggtacacacgagcacagctggcccttgtaaacttggaccaccatcacctagctttcacagcctgcagagacaagccaggaaaagttttcaaagtgaaagctaatgtgcagattgtctagggcaactgacacgccaatttccaagaacttctacactgaattgtggctgggttcaaacatagtgcacacaaacagcttacaaagtgtcacacatttagaattcctgccccatcacatcagttagggctcctttcgtttctcctctttttcctggggagcaaaacagcaggcagcttggaacagtcacgtccacagtttttctggcttcagtaacctgtctctgccccctttctcaattggccaagggaaacgggagatggttccagaactccaccttccttccttcctatcctcttctttttcatcatcctgtttttgttttaaaccttctctacctgttcttttcctttctttataaataatgatatttttataaaatagggagaatgctggggaaatcacaaggaaggagattttcttttcaagccacagggccaaagaggggaaaataaaatgtgtgtaacagtccagacttcttgctgcagtgtgtgtgtgtgtgtgtgtgtgttgtgtgtacactgcatctgaagagcccattctcaagctacctaccaaactatggaaacaactcttcactgcaacaggaactggtctcttattcatcaagtccgtggcaaggctacaacagtacctgcttctgttgtgtcatgacaagtcta

SEQ ID NO: 40470 - DNA, 1418 bp, Bovine  19866881141680
ctcgggaacccataggattgtggtcggaaagcctcattgaaatcattcgctaggctagatttcttctcattatgtagcatgtcaataattactgaaaaggagcaggatggtcgtaaaatattcttttaatcatgatactttacaggaaaagggttctgcctaatgttgaatgtcactggcgatagactgaaaacatttctggtcacatgcctttacccagtgtaatagagaattatgtcactgtatttggctgattgcttttatattccattttaatctctccgttggcttttcaggtatagctttttgaactatttttttagtggttgctctagggattagactatgcatccttatcactggctagatagtattatatcacttcacatgaaatgcgagacccttgtgacagaataaatccatttgtccctttattctctgtactagtaatgtcatactttaaaaaaattgcgtactttataaaccccgcaatacagttgccatttcacacggttgccacgtagagaaattaagaaaaaaaggtagtcttttatattcacccacatggccttcccaggtggcgctagcggtaaagaatccaagatgctttccctgggtcgagacgaattccctgggtcgagaagatcccctggaggaggaaataacgcctcactccagtattcttgcctggaaaattccatgaacagaggagcctgacagactacatagtccctagggctgcaaagagctggacttgactgagtaccagtatatatataataaatccttacctttataattgttcatttcctcctgtagatgcagatttccatctaagtgttgatacgaccaaaaccttggctttctctgcccaccaaagctgaattaaaaaatacagagacagggtttggaggaaatagaaagatggctttaatccacagccggtggcggggagaacactgcaggctagtgcctcacgatcttgtgccccccgccccccaccggcctccccctccccataggtagggctcacagtctgggcgaagggataagagacaaagtagtaagaatctaacattcttcttcttgccttgctgtagaacagccgtagctggcgtcaggttgcccggtaattgggtctggcagtcctggaaatgggtccgtttgtctccggtttattcccctgcagcctcctttctgaaacgcaaagagctacaaggggtggtctgaagagaaccggatgaaggcacaggatgtaattagcaggagttaaagggtgcagggtgtaacttacctagtcaggtagttgtgaagtaaacaaatttggttaccaactacagataagaaatagctagagtaaaaatttggagtgatgaggcctattcggtgttctttttattctatgttctcaggaaagg

SEQ ID NO: 40471 - DNA, 1585 bp, Bovine  19866881213760
ctgaaagaagagagcgactcatgcccatttgccaacgcttcagaagcctgggaggcttcgctctctgaactggagctctcctcagaggcagaggagagaagggtgggcccagtccctccccaatgccctgcccagactaacctgtggagctggtgatgggcacaaaggctgcagagttaaggctgctctggagtccgttcagctgcccttctgcggaggcccctctgaaacacaagtggcttggttagacctgaagacagaaaggcgaggtcaactacagcccttcaggggcactgcctcttgcttctggggttgcccccctcccagcttcttttaagacttctttcaagtacagatgtcatcttatcagaaaggacttgtactatcaacctatccccttcttctgaagtgttacatgttttaaaattgtccatttctccccactagaatacagcttcaagaaaatataggcttggatcatgactgtgtcccccaccccccactacctatcacaacgcctgcacctaataagcactcaacagataacttgtttactgaatgagtaaattaagttcctagtattgacttagacaaatcataagtaaagacgtcaaaaaaaaaaaaaaagttttatgtgcaacagtggttctcaacttgggggaggaaggaggggcggatttaggcctctatccccaccctccagtaagggacacttggtgatgctgagatatttgtggttgtcacaactgcggggcctgctggcatctagtgggtagaggctgggaatggtgctaagcctttcccacagtgcccctggaaagtgcccccaaagagtattctagtccaagatgtcagctgtgccaaggttgagaaaccacatatagaggtagctcccctcacaccaagttttgacaagagataggacagagtattttagattctccagcacaggttccccagccgcctgctttagaagttctttcactggcttgacgccttatagactatgccaggtcctcctgccacaggctcttacagctctgtcattctttcattgcatttaccaaaattatatatttttttcttttaaaatttttttccttgactgcatctcatggcatgcagaacttctgaggggtcaaacctgcatgccctgcagtggaagcatgaaggcttagccactggaccaccaggaaagcccctgccaaaaccatgggactatggggtagctgtgagcttaacatctgtcatccttgctagaacgtgagctccatgaagacagagatttcttcagtcctactcactgttatacacttaaaatttctagaagtaatctgacccattaccccataaatacacttatttgttgggcctggtctaccttgatttcagttgacatgtaaaaattttacctgggagagtcagtaaacaccctcttccaacaacacaagagaagactctatacatggacatcaccaaatggtcaatactgaaatcagattgattatattctttgcagctctacacagtcagcaaaaacaacaccaggagctgactgtggctcagatcatgaactccttattgc

SEQ ID NO: 40472 - DNA, 1617 bp, Bovine  19866881219598
cttgggaccacgttatcagggcgggggacatatcaagaagggcaggtctggagggctgcgctgtttcggccagacctggaattgcagcctggctcttcaagtggatccccttgtcactgtgagcaattcgctcaacctctctggacctcaggggtcctcttccataaaaggtggatagggacccctaatttactgaggcgtcactgataaagagatcatgccagcgagccctgatcaaataccaacaaagcagctcccttcccttccaagtggctaagatctggcacttcccgaaatctactcacatggcccagggaccatgtgacactctccctccagcatccctgaaggccagggttcctgcctgcccacactcacataccaccaggccccttgagtctgggaacgcaggggcccagcccatggctgctcatgggcatgctgtaacagcagcggcaagagcagggcatggggggcccttcctggtcccacctgcttgcggggacccactcagaactgcagtaacacaggacagaaagccttctgaagacttatcaggctctaaatccaggctgcaaggatggtgctgggcagacggaaatatggtggcctttagagaaccagggcatgtgtaagtcagaggggtgctccagtgtgtctcagggctcaggaccccccagcccctctaggccctgaatactcacagcttaaccccctgccatgtattccctggggggaaacagaaaaactagtttcagacctcacccactccctcaagcaggcactcttggtcagtggaccacctgtgcaactgtacaggtgacccactgtccaatgcacagattttctcaaaggtatccaagctttcaccttgtatttattgaaggttcctccacacctggccctgtgctgcagattcacaaataaatgggactcaggcctttaaggggctcggggtgataggacacactcacgaagaggtgggaaggagggtgtaattctcaaggctgcctcctccttggcaaagtcatttctcaacaaaccagggattcagagaatgaagcgagcccccattgacgagatgcacccttggtctgcaaagccatgcgggtctagctagtcccatgtctgcaggctggcggtcctctcaccgctgaaagcaggctgtctgtgaccgactctctgagctgggcctctcgatgccaaaggtctgagcccgaagcaattgccagggaaccaccagtgcagagaccttctctgcggccagagagggctggggtctgagaatccggttgagatggagtctaggagagcctggcgcactctggcccccttttgggccgctgctgcgctgggcgctgtggaccacaagctctctccttcccattctcctgcagcttccccagcaattgcaacatggccaatgtaaccccagggcaagctgattacagcatatgcactaacgtggagatgctctggaatagatattccccccaactccccaaaccagaggagcccttgcctcctccggcatgactgcgcttcccggcatttccaggaagaggagccgccccctcatatgatctaagggacccactgcagccaccgcacaggctg

SEQ ID NO: 40473 - DNA, 1148 bp, Bovine  19866881251704
tccaaacccaggaatcaaacaaacctgcctctcttatggctcctgcattggcaggtgggttctttaccactagcgccacctgggaagcagttatgaacgggttagtaccaattccagatgaaggctccagccttggggccagggcctccccttacaacttcatccctcgtaaacaattagcaacaagcttcactagaactcctgtcttagaaggctttgcctttccaagaagaactaggtaaggcaggaagggaaactgcaggaggaccaaagaaggtttagagaaatagagaagaaggcagtcaacggtacaagatttaatatggataaacaccggtaatacacttgtcagcaatgaccctagaatgagccagactgtaggagagctggtggaagggcagcgatgcagagagagatcggggtcaggacagatagcacatcaagcatgggcctccagctcaatggcatgataaacactgctttggggtaattctacaaaacccagccgagcaaggagcagccataattcctctttactctctcttactacaggcactgatggaattttatgcgcagcccaagggacttgctttgaaagcagactggaagggtgatgaggaaaggactggaagagtggtgaagaaggtgtcgaggcctcccgaaggctgtctgagccccacactgcgagggacagacgtgggaccatgtaggatgggttgcccctctgcactgaaggtcaacacctgtgttcagagcctgagtcgcacgcgcacactgcaggcgtcgtcgatggtcccctcgaccgcctcctttttctctctggttcagcaccccactcaggctgagtctcacctccacgtccagtccacgagggctggtttagtgagggtcccagacgatgcaccctagaagctcaggagggtagctccctgaattcttccctttttttccctgccctctgagcactgtttcctggtgtggtttctctttatacgccctccggaagagacatgcacgccagacaccctgctaagcaggtggtggccagcacagtaggcatcacatcactttgcttggcatctgacctcacctccctccccttcccatcgccctcccttcccaggccttatacttctccaagtaagtgt

SEQ ID NO: 40474 - DNA, 1478 bp, Bovine  19866881285218
taggtgacattagttgaatgtctgctttgtactggacactgtggtaagtactttatatgcattattgtctctgtacccttatgaagtagagactttttttaacagatgaagaaaatagctgaaagcataggccaccctgctgaggtcacacaaatggcaggtgatggcaccaggatgcaaacccagatctctctgactttatactctttcccttggtgtttttctgcctcttctcattccacacaggactctcacctctccttagactctagtgactgagcttaaggcctctgtagagttgtagccaagccatcagattgtttggtagtgaattcaggttcatcactgagcagccttcttaatccctggagatgcagtgagagtagatctgtttatcgtggtggcggtggcccccatcgactcaaagactgaataatgaattagaagtacaagaaatggatctggccatcttgtaaggttttccaggaatgtctttggcaattcttgatctggaactctttgtagattttggaacaccaagtgtctgtgtgtgtatgtatttcatgtaagtgacagcgtttatgagagaagacatggcaagagaactgagttctaatgcaacagagctgcagaggttccttgccttgcctaacccccttgaaagtgagattaacactggaactcttatctcctgctgattagaatataaatttcttgagattcattttatcagtatccaggaacaggagacaaaggtcatgccttaaaacatgtttgtggtcatggctaatgatttaatacctgctcaggaagtgccctttaaggatgattcttttcttgtttcttaattgaatatattctctagtatttattcagtgatgcaaatcatgtaattaagtacagatccagcactttgcgttttcatttatcttgagtgaaatagatcttgggtccagtgatttttttttttttattcaaggattgccttttgttccagcgacatatggtaaaacaagtcagctaggactcaccactacatttctctattccaattcagggccccatggtcaggggaatgaagggtccatgacagactgagttgatcccatcgtattctgatgagcctttgtatgtgaaggacacagagaacgttgttctcaagatgctgctgtgtagttcagagtacagtgtgaatacagctttagaaaaattaatcttcgtagcagtgatatgaagtgagtcttaacctttttggagtgagagattcctttgagaattgaatgtaaattacagtttttgtcctaaaaaaaatgtgcactcaaacttagaaatgtacattaattttagagagttcataaacatttcctccccctctagcttaactccttcatgatgcctggtggacccaaggtctccaagttgagaactcctgaaaacttttaggtagtatagatcactaatatcagtaattggccaaa

SEQ ID NO: 40475 - DNA, 1583 bp, Bovine  19866881310098
ctaggttgtttgtgagtatgattctcctgtatactgtttctgatgatttgatctcacggtatcttatttccctcttgggtttgtggtttttaagtgtgagctacccatcatctttgtgattttctctagtggaaattcttttggcacctagattggagtttcactcttccagaagagtgtgtgtttgcttctgccagtcatctggggtcaccacctaccttggtccactgtaaattaaattcctgcttgcagtattttggagcacccaagtagtataaatttgggccagaaacctctataagggacaacttgttaaatatttttaggttaaattaaaagtccttcctccatccagggctaaggccaagaaaggtatgttcccttgctgttatttctgcttggtttgtttatttggtattcacccttacactgcaagtgtagcacttccgaggtcctcactctgggagatctcagatctttctgccttgagcaggccctactctacctcctgcactcatcagagtcatcaagaaagagactcaaggagaccaagtctcagcagacacctgcagggtggaagatggcttctgttttacttgactcccaagttctgagctttcacatcccttttgacctctacagagtctttcgtttcttgcctctgctctgtgcatgtagaaagctatttttgaccctcaatgataaagctaaccccaaaagtactaggtaagttagcaggataaaaaattagcatataataatcaacagccttcatatataagaataaccaagtagaagacataatggcagagagaaccccacttactagcaacaaagattaaatatgtagggaataaccttaacaagaagcacactgaagctattcgaggaaaattttaaagccgtccttaaaaggcacacagatagactcgaagagtagaaatacaccccctgttcttggataagatgattcaacattgtaaagatgtcagttttccctgttagttaataaatgtaacatgatataaaaaataccaacacattatttttatggcgttacatgggttgatactaaagtttatatagaaaaacaaacatgtaagattaggaaaacactgaaaacttatgacgggactagctctccctgtgctgtaagttttccataattgaaacagtgtgggactgcgctcaagtagacaaacagaccagtggaacagaagagaaaagttcagaaagagacacaggtgcatgcagatcccgggctgaacccttaaccagagaaagaacgctattggcaaaagtggtgaaattcaatgaagtatgctgcttagttaatagggttgtgtcgatgttcattccctggttttgatactcgtgtcttgcctacgtaacattagaaactgggagaagggcatacgtcaattctttgtcctattcttgcaattttccttcagtccaaaattatttaaaaataaaacgtgtgttttttaagggtttgaatcccggacccgagaatatagagagaagactgagtcacaggtaacgtggcacactacaaaagggccactggccaccactgttgg

SEQ ID NO: 40476 - DNA, 1239 bp, Bovine  19866881396060
ctgcatttactttttactctaactgctggtggaggggcaaggggaagagtctcaaagcatgtaccgtcaccccagctgtctcattttggtattttggtcaagttccttgattttgctcctggttcaggccaccactttgtggaatggggaggagcagggagggtgtcttgggtctccgcagtcctgcccaccccccaccccgccacgccctgcacacaacaggtgacccgtactttcgccatttttctgggccggctgatcctccctagccatcgcctcccatgggtcacggtcctaagacccaggcgcagcaccctcaccgcacccaacccccaccccgccaccgtcgtgtgcgtcagggttcccagagtccagggaggcccacaaggggagaagccggcgcaccccgctatcgccggtgcaggtcacggggtggaagaggatgggtttttaagccttcacttgcagaggtcgtgatcctgacctttggatagcctcctctcaggaacacgcgcgctgggaggtctctgctcacccagtgggaagacctcggctgacagatgggggaaaccgaggtccacagagggcagtgatctgttggacgtccccacgcgaaatccaccactgaatccggtctaggaccctggacttccaggccatagtctagtttctagaccctgagcgccccagacaggcagtctccctaggaagtatccaacagctagccttccaagcccggaatctccgtggagtttgcgctcgctttggcacgttgcgaacacttcccacgcccccaccctccaggagctctgctccggcttcgcggctcccagagaggggataagaagggagcacacgcccaccggcgtcccggtcatgacttgggggtgaagaatggctgcgggaggcggaggccccggcggggacgcgctggccctttaagggggggacggagcgcatgcgcggcgcgggccagagtcgagccgggtgggcggcaggccggcagagtaccccgccgcctgcccgctcggttggcctaagcttcgccggagccgagacctgcgcggggatccgcgcgcgcgcgcagcaaactgctctcgggggactagcgtagccggccctcccagaggctttgcccctcggctccggcttcctccgcggacgtggctgcgcgagcctccaggcttgctctccccgccccgcggtcctgcctccagcccttagccaggggaggcgggg

SEQ ID NO: 40477 - DNA, 1370 bp, Bovine  19866881515086
aagttctttggatccttaaaggccaagaacagggttttctccatattgatcatatactgggaaatagaagaggcattgactctcttgtttcctactagtgaagtggagtggttaagagcatgggcttgggaatcagattggggttcgagttctaggtctgcaacttcctagctgcgtgactcaggacggatcacctgacctctctgcacacagggaataccagcactacctccttcgtgcactttgacatggggatgaaatgcaagtgggtgtgggatgcttttgatacgtccttgacatcagccatatgctcgctattcccttttgcctgatcttaagggaggccagtctcttaatttggatcctgtgattttaagatcatttctggcatgagaagtatatgtaatgaacaggtcttgggtgatccagacttctcttcattgcctgtggctccagacccctccttcagccttttaaaactggataaaaggaaggagctgatgtttttttatgtttatgtagacacagatacccacatcctctacatcacacctttgctgaggggctttctaaagtctgtgcggtttgctcctttacagttctcacggcttggttcataatgtcggggaaacagcctgttcccctctggcagtgacctatggtggactcggattcttcctagcttatgtgacatgggacagtttatcttcctgtctgtagatcccttctgtgtttgccactggctctgaaagatgaatacagcattcgtggttctgtagcaaaggtgtcctaaacctcagatgccaaggcccacagttgattggggcaggtcagaaagtccttatataagatgctatgtgcacgacttatgggagtgagccttcctgcagataacagctcagagatgttgctggtatcaccattggcaggaagcctagagttccttcagcagggactccctgactcagggctgggctccccggggatctgggctggagcgcccttactaaggagctcagcctcttaggattacacactcagtagtttttgaatctgccctgtgctgattcagcaacaatgtggggtcaggccactgcttaagacacctcagcctggattgctccactaacccagggccaaatggggcacggcccccccccacacaccccgcttcccatcacatgctcctcttccagcctgagcagataactgcatcgcagcaatggctcaggagtggctcctggtggacccgcaggtcactgcctccttttttgaccacctcatgcccacagtgcctcccaggggtggagaagaaccaggagtcactgcgtcccctgtgcccattttccttctcaccccccagctccacc

SEQ ID NO: 40478 - DNA, 788 bp, Bovine  19866881592433
tagccaggtgaacgcaggtgaattttctgtagatggagtggactctgcagtgccgcgatctatttaaaaaattatcctaaagcaacagatcctattgagtctttctcttgttttcttttcttctgaacctcctttaggtagatgtggcctcatggatgagctggttcatgacttagcctcagccttggagcagacatctgagcagaataagcttggtgagctctgggaggagatggccctgagcccgcggcagcagaggcggcagcttcgcaaacggagaggccggaaacgccgttcagacttcactcacctggcagagcatacctgctgctacagtgaggcctctgagtccagtctggatgaggctctcaaggactgtcgagaaatggccccggtcaccaatttcagtgactctgatgacacaatggtagttaaacggcatccagctctcaacgccattgttaaaagtaagcagcattcttggcatgaatctgactcctttactgaaaatgcaccctgtcgaccgctcaggcgccggcgtaaggtgaagcgagtgacgtcagaggtggccgccagccttcagcagaagctcaaggtgtcagattggagctacgagagaggctgcaggttcaagtcggccaagaagcagcgtctgtcccgctggaaggagaatactccctggacctcatcaggtcacgggttgtgtgaatcagcagaaaacaggactttcctaacccaaacgggaaggaaagaaaggatggagtgtgaagcagataacaaaaacaggg

SEQ ID NO: 40479 - DNA, 1640 bp, Bovine  19866881619143
aaatggcaacccactccggtattcttgcctgagtaaatcccatgaacagaggagcctggcaggctacagtccatagggtcacaaagagtttcagacacgacttagtgactaaacaactactgtttctcacatgaggtccccttctccccagtggaggagaaatatgtccatagacatccaagtggaagcatagagtaagttttcccatggaaacgctgtatacaaaatggtttgggtttatgttatcacaactttaggcacatgaggggtaaataggcttttgttgtgattataatatcacttccttggaaaatacatttcaacttctggacaacccactcctaaatgagacaaacactgcttgtctagagcctgcatgttaacttgtacttgctgatctgatgattctttgctgttttcatagggagtacttgtattttaggaaatatttacataggaaggtaagtatatgttccctcggttctttctaagttaatcactgggctttaacattaagataacaggacctatctcataacgttgttaagaattaaataagatggtggatgtaaagtacatcttagtacagcgtcaggcatcacacttagggctaaataaacattaattattaatatagcagcattatttttacttagaaatacatggatcacagccttgtcatggtgaaggggcttgtgtaactcaatggaagctgtaagccatgccatgtagagacacccaagacatgggtcatggtggagagttctgacaaaatgtggtccactggaggagagaatggcaaaccattccagtattcttgctgtgagaacccccatgaacggtaggaagaggcaaaaaattatgacactgaaagataagccctccaggtgggaaggtgtacaatatgctactggggaagagtggatagcaattactaatagctccaggaagaacgaagaggctgagccaaagcagaaatgatgctcagttgtggatgtgtttggtggtaaaagtaaagtccagtgctgtaaaaaacagtattgcataggaacctggaatgttaggttcatgaatcacaaattccaagtggtcaagcaggagatggcaagagtgaacatcgacgtcttaggaatcagtgaactaaaatggacaggaatgggcgaatttaattcaaatgaccattatatctactactgtgggcaagaattccttagaagaaatggagtagccctcatagtcaacaaaaacatctgaaatgcagtacttggatgcaatctcaaaaacaacagaaggttcttgcttcagttccaagacaaacctttcagcctgacagtaatccactgtctatgttccatcctctaatgctgaagaagctgaagttgactggttctatgaagacttagatcttgagcttcttattgcaaaattcaggcttagattgaaggaagtagggaaagtaggggaaaaaagacctaaaccaaatcccttatgattatacagtggcggtgatgaatagattaaagggattagatctgccagacagtgcctgaagaactgtgggtggaggttcgtaccattgtacaagacgcaagaccaaaataatcgcaaagaaaaagaaaagaatgtaaggaggtaaaggg

SEQ ID NO: 40480 - DNA, 858 bp, Bovine  19866881742775
ttgggagtggggaagagagcaatggtttgacttttcttctttattggttaggcttgacacatggtgttctccctaacacctaccttattttgtttcagctcctataaaataagagccttccacgcccatggaagtaaataatttcatcctggagaaccccctttagcttgcctggaaggaaagccgggcctgttggatgtgtctgtaatgatttcaaatgaataggataatatttacttggttaattcatcttcatcaccttaaagggatatttgtcatttctagcagaggtcactgttctgccccccttcttctccctcccctatctctctcctctttttctaaattgtaatcataaataatgagtttcattcacagctccctgccagcgagctgctaattacgcaaagtactgcttgtaatttacacagtaataaactgtaaatttaaacattacggcactttaagttaataatttttctgctgtaacaaatagctcatttttcacctatcttttctcgtggccccattgccatggttgtgtctgtgaccaagaggcgtaggtgtaaagagtgaaaaataggaagaatacagtatgggaagccttttcatttagctccactcccacccaaaatctgacctccaagttaatttttctacagtcagttctgctaaaatgtgtaccctcatgtttaggctaatccacacacagatgagtacagataatagtgtttgcccagaaacaaatgtgtttgagtaacaggcttgacatttttgacattcatgcccatgacttacgctctttcatcttaacacgtcctcacacgcgtgtaactctgctcatgtactgtcagtacg

SEQ ID NO: 40481 - DNA, 994 bp, Bovine  19866882064269
cttgataaatgcccccagctgtttgcccagccctggcaagatcagcttttctaactctactctttctgtaaaatcttgagcgttttccttttgtgggtcctcccttctatggaaaggtcattcctaacatggtggcttgaatccaagatagactttcactaaaccattgaaatagaaaactagtacctctacgttagagatgtggaaagtcttgaaatatagcaccagaccacagtcaaccttgtgaagtaatgatcaaaacagatcttaaagaaagaatatcactttcaggaaaagtttccaccgatcaaaataatggtcggaggcagggagaggaaaccacaaataaaggaaatacagagtcaccctcaccagcaaaatggataatggggattttacccattataaccctccttggtgatggcatgttacgtaggcctgctatatgatgtgatcttaatggtggtggaactcctagccacccatttaatcatcttctattccctaaatgggcttccctggtggctcagagggtaaagagtctgcctgcaatgcagagacctgggttcaatccctgggttgggaggatcccctggagaaggaaatggcaacccactccagtattcttgcctggaaaattccatggactgaggagcctggtaggctacagtccttggagtcgtgaagagtcggacactactgaacaacttcgctattccctaagtagagacttgccctagaagaaatctctcaaaataataaatgcagacatatttccacttacagagacactgtttgtttgcaatgtattattgaacagcatctttgaaaggcctgttcccctcagtgccaggatctttcttagacctcaggaaaatggaagaggcaaaaagagtagaaagaaatggagcaagtgaatcgaattctgggttaggaagtatgtatctaatatttgaggaactcttaggtactaactttgaatagtcccaaggaa

SEQ ID NO: 40482 - DNA, 1599 bp, Bovine  19866880348467
atggacagggaggcctggtgtgctgcagcccatggggtcgcaaagagttggacacgactgagcgactgagctgaactgatgccatgcagcctgtgagatcttagttccctgaccagggattgaagccagatcctggctgagtcctaaccactggaccaccaaggaactccctctccctctttttaattaaaatctctgcaaaatattggaaaatgtatcataagtggaaaactttttaacaccccaatccaactccaccatccagtgaaagagcctccccatccagcactttgtgcaaaaaaaatctatagattcatttcccacgacagtaaaaagtgctggccagcaggcttttaagaggctgcctaatatgctatcatgagtcccaggtggctcagatggtgaagaatctgctcgcaatgcaagagacctgggtttgttccttgggttgggaagatcccctggagaagggcacagcgaccccctctagtactcttggctggagaatcccagggacagaggagcctggcgggctacagtccatggggtcacagagtcagacacgactgagtgactaggcacactgttctatcatgaaggtaggctctccttttcttgggcttccctggtggctcagacggtaagaatccgtctgcgatgcaggagaccagggttctatccttgggtctggaagatcccctggagaaggaaatggcaacccactccagtatttgtgcctggaggatcccatggacagaggagccggatgggctactgttcttggggtgacagagtcggacacgactgagcgactaacactttcactttcacttagccaggcccctatttttctgctccctttccacaaaagccacacagggtagtgttcctgcctgcggtctgcccctccttgacccccacgcaggaacaaatgatgtggccagaccacaagctcgggaacgaaacgctgtggctccggcctgcagccccaggacttagctgatgtgcagcatggatcccatgggtcccaaatgtcaggtgggtccctccctggtctgcagaacgtggcttctcatgtctagtcggttctgcccaaaccaagcacagcgggtgcagggggagctgaagacgagggcgatttcaccctcagaatgaggaatctgtgcccccagccttcaaggggtcctggcctgatccttcctcttatgctctgcccttgaccacaactatgtggacggagtcacggcccccaaacccagaacaccaggtcccatgctgggcctcccagggaacgctggaaaatccacagggctgaagtcctgggccaacattccacagcctggcaccccggcaggccaacttggatggaaaaaacaggctccaggccctggatgggagaagcaggaggtggtctcccggccaagtcagcagcctggagggccagggagggaccatctggagtggggaggaagccaaggctgcctgtatgttccggctacacgttggatctgagctgctggacataatagctgtttacatgatatttgcgactgcaattattagcccaagattgaggcaatgactgggtgctggcggctt

SEQ ID NO: 40483 - DNA, 1210 bp, Bovine  19866880348468
ggtgttaaaaagttttcccttatgatacattttccatattttgcagagattttaattaaaaagagggagaggaagttcctggtggtccagtggttaggactcagccaggatctggcttcaatccctggtcagggaactaagatctcacaggctgcatggcatcagttcagctcagtcgctcagtcgtgtccaactctttgcgaccccatgggctgcagcacaccaggcctccctgtccatcaccaactcctggagcttactcaaactcatgtccatcaagtcattgatatcatccaaccatctcatcctctgtcgtccccttctcctcctgcctgcaatttttcccagcatcagggtcttttccagtgagtcagttcttagcatcaggtggccaaagtattggagcttcagcttcagcatcagtccttccaattcaagcatcagtccttccagtttaagactgatttcctttgggatggactggttggatttccttgcagtcatggctgggattaattaattaattaaagtataaaaaaaagaataaaagggtcagatacttgtaaaaagtatctcctgaggacctactcagcgccaagcacgggggattcggtgtcgagggggcaggcccaacaggcctggggtccgggagcaccggttaaggtcaggcagactgccccctcccagcaggtgcctccctctctgtcctcccgcagatgaggggctctgggacattctcatcaaagacatccccaaggaggtcacgtcctacacattcagcatggacatcctcaagccaggtgtgagctacgacttccggggtcatcgcagtcaatgactacggtttcgggacccccagcagcccctcccagtctgtaccaggtaccacctacagcgtgaggggtggggggtctggggaaggggcgagggaaggagaggcagcagccccagaggcactggtctggggacccagaaggcattgtcctctcagttctccgaagccaagatccctgggctggggcccgggtcagccttcaactccggaaggagctggggggcagaggtcttgggagttcctttccaaggactccagaagccctgggcagcgggcccagtgggcttgaggatgaatcagtgggaccaagatggtagcttaccgtgggcttatcacccaggaaataccgagggcatcaggtcatacactgtgtat

SEQ ID NO: 40484 - DNA, 1642 bp, Bovine  19866880361398
ttagtggtttgcaaagttgtgcaaacgatttgcatcctgctgtggctggcagacaccctctgtccccagctcctcgtgactttctccccaccccgctgtggagctgcctgggcttggctctctctgcctagtgaccattcctagcgaatgccgcttccaggggggctgccctggtggcgcagtggtaaagaatccacctgccgatgtaggaaatgcgggtttgatccctgggtcaggaagattcccctggaggaggaaatggcaacccactccagtatccttgccagggaaattacatagacaaaggagcctggtgggctaatccatgtggtcacaaagagtcggacacaaccgagcaactgagcatgctgcttccaggacgaggtgaagccagctgcatgctgcctgctctgtggcccaggcgatgctggccccacctccacccgcccggcaccccatgcagagagcccactaccttgtatacaggccattctttcggcagaaggagttcttgacagagagtcgtcggttgttgagttccagggcaggaaaactgctctcatccaaactcatcatctcgccatggcccagcgcaccagtcttggtactgttgcctggggagggcagagattgacatccatcacgcactccatccttttagaccgcgtggcccctttcccctatggctgggctgccccctctttcttttgttagggtttaaaccaaaactggagatggagattgtgagactgtgtgtaggaaccctaggagacccccacccccatcagagcggctgcttttccaggagagacctcccccacaccacctttgccgaaaagggagatggtcccgagaaagtcccatccaccagctcacctgcgtctgtcttcttagcatacttcttgctctggcctcggatgatgagcacaaagacgaggagcaggatgaagatgaggccaacaagtgcgatgaccaccaagaaccaccactcctcgtagaaggggttggctttctgggctggagcatggagtgggcgtcaggtccgtggtgctcagacctgtcctgcctccaagcctgtggctccagctaggaccctaccacctgctctcacattttacgggcaggtgagtctgcgccctcagaacgaggtagaatcttgggttggtagggatggtttcatctcaagggccagctctggtttatcagtaaaggggctgcctggagggctggtttgagaaagggctgaggccatttctagactgattgattagtgatgtctgctaaaaatacaggcggaagagtgagttgaggaggtttctcgactcctgagtgctgggattgattagtgatgtctgctaaagatacaggaggaagagtgagttgagggggtttctcgactcctgagtgctgggattgattagtgatgtctgctaaagatacaggaggaagagtgagttgagggggtttctcgactcctgagtgctgggattgattagtgatgtctgctaagcacacaggaggagcagggcctgtgcgcttgctattttttcttatttttccttgccacttacggcccaggggctaccttggtagatgtcaatgtgtgctagaaaggtgcttgcctggcctgtgctgtgcctgg

SEQ ID NO: 40485 - DNA, 1442 bp, Bovine  19866880471165
ttcctggggttagttcagcttgggaaggctggacatactgtattttattctggcatatttagcggagtcttttgtatgctctgggaacctccagccagcctttccaaacccaggtgagcgcacagccccacatccaggggctcgaaggtgggacgggggtttcttcggaagccccgtcctgccccgcccacacagagaggagcatgggggctcctgctaacccctcagccttgcccgagctgtgtccccagcctggcaccctttccccacatccctgggccctcccgtctctccctctgcatctctgctcaaacgtgacttccacagaaaagctccccaggctctgttcaatggccgccctccggcgccgagcccgtcagcctgcttctcctttccccgcacttttcaaccccgacgcccatgtctcaccaactcccagctacgcctttgttcgcgtcgtaatgtctctgagatgaggacgtgtcttacaaccgacagcatgtcataatttaattggcagccttttttctttcttagtggcgcataaaataatggggcatcttacatacaacccatggcattttagatgaaatgaaataaggtatctttatttgtttattggtttgtctgcctcccctcatgagaacgcacagttctggaatagcagggatctggctcttgggttcattctgtgcctctccagccccgagaacagtctgggcacacgttgccaaaagtgtcagatactcagtcgtgtccgagtctttaggacccccatagactgcacccctcctggctcctctgtccatgggattctctaggcaagaatactgcagtgggctgccatgccctcctccagggggtcttcccgacccagggatcgtggtaagcccaccccccaccaaatgtgtgtccaataaatcactgtcttccccgcgtgtgatctcaggacgggagtcagtgtgccccctcctcctccacagggccctccctcctgccagggttacagtcttctctctgctcatcctgtcatcccattatcccagattgcaccctggttttggggtgtcttttagctcagctgaactcaaaggagaaggatgggaaaagcggtcagggtgcaggaactctgagaggggctgggggttaagtagaagtggtcgcaggagacgaagcagaatggcccagaaaccaggcagagacacgtccaagttctagcagttctgacattacgacaatatggcattgtctgcaactctcacattatgggcaatttgagtctgtcacctgtcctgaaattacggtaatttggattcatttgtaaccttcaagttacggtaacacagggttgatttccagccctgagattacggtaatttttcctgtttgcttcctagggtgtctgcttatagccagactgactctctgctcaatggtgagag

SEQ ID NO: 40486 - DNA, 1005 bp, Bovine  19866880667119
aaggtgtacctaacccccatatcagacccccagcactcactggcagcccaaagtgttccctcgagctggagggaagcctgcagcaccagtgattctgcctgttacaaaggctgcaagaatcagggctggtccttgggcgatcattcattcattaagtgactactgtatgctgagaacacagccaggggcaaaaaccagtttgctctcagggagcatacagtctagaggataagacaatgttagatgaaattatttagtttcatagtgattgatcaagttacaagaatctgtaaaaaatactcaaaggggggatctgtgatctgggtgtccaggagggcttcctggaggaggggacatttaagctgatccccaaaagatgtgtaggagttactaggcaaagaggtgagggatggatttgctgggggaggaggtggcctgggtagagctcctggggcaaatgggcgggagcttgccatgcctgagggaccggcggaagagaaggtctcagccttaaggtgctcacagagctggtggggaagggggcaggatggtgagacacgagcctccctcacactcacttctatacacggaggcgagagtgcaatgctgtggagggtggggggtggaatcttctggaagacttcctgggtgagtagctctaaagcctgcatccaaagggccagggggatacccaggtggggagagagccctgttctggttgggagaggccggctgagcaggagaagtggggggtgcccaggcagggtcaggggtgagcgggcagggcagcgggactcttgccaggagcctggccccactctcgcgtcgctctctttctctgaaagggaggctggcggagcttctgcattattaatagtgacacatagtaaacattttggtaattgtcacagccagaggctctgagaggcagcgccagctgttgccagcgtgaaaaaagaaggcaacacgctcctgccagcccagcacacacccccaaacgctcgt

SEQ ID NO: 40487 - DNA, 1504 bp, Bovine  19866880712725
atttttttaaaaacacctttattttttatttatttggctgtttggggtggggggggtcttagtttcagcacatgggatcttcagttgcagcacgtgggatccagtttcctgacctgggattgagcctgggccccctgcattgggagcacagagtcccagccattgggccacgaggaagtgtttttgaacacattttcagggtctcagtcaatgctttggggaaggaggtggcgtgggtgacctaggcagatagaacagaagcagcatgctgaccacaggtggagtcctcagtcatcctgacagcctgtgctcaggcagccggaagaggcaagcttgttttcaaatatggtgaaattgatacctaaaacccaacgagtgaggctcttgtacaaacccagagaccatggcatcctggcaaacacccgagtgtgtatttctttgtaccccggaagttgcgatcggtcaacgaaatgggtgttgcctctcttcctgttgcccgtacacaagcccgtcttcagtttcagggatggaaaaacgtccctgacggtgtgaagtgcctgtctgtaacggtgcttgaggaatagctcaggaagcccgaggattaaaggtcgatgtttattgtgtgttttgtgggtgaggaaggtgggacagccacacctgtgagggatggggctgcgccaacgctcacacccacaccccctacactcggcatatttattggctggtgcttgtgctgacggttttggagccgtgtcctcagaccttccgcatgcactgtgattttattagtgcccagctttgtagagagttcttaaaaagtacctttgagcgattgttgagtaacatttccattttctttcactgagagaacatgtctggcattaaaaaaaaaaccaactttatggtttctcataaaggtgtaattttgcttcgttcttattcatttattttcatggtgaggagaataaaattgtttccctataagaatgattgtctattttttgccttgcacgttagtgatttttcacccaaccccactccctcccatggctccctaggaaaaattgaggcaatttaagaagaaaatgatgcaatcttagagcaggccatgtctggataaatacaatgatcgatgaccacaaccacttaatgtccttttggagagatgaataatcctttgattatatctaagaagagaaaacacatgaatttatgttctgggtcttaaataccttctccctcacccgccccctcctttttttttttactttgatttaacttgcctgaaattaatgaagcaaaaactcagggacagaggccagttttgtgaggctggacacttatacaatttaaggagacctttttaagaaaaagaatacaaaaatatcttacttttacatatttttctttctttacaaaagcatatgaccatgtgacataccgcccaagcaagacagatccctgaagcttaaactttattggcttcatggtaagtccatttctg

SEQ ID NO: 40488 - DNA, 882 bp, Bovine  19866880757194
gaaggaaatccgaagaagcggggagaatgtatacgtagggctgagtcaccttggtgtatagaagaaactaacgtaagactggaaagcaaccataaactccaagaaaaattaattaaaaacaagaaataaaagtgtcagtcgctcagtcatgcccaactctttgtgaccccatggactgtagcccgccaggctcctctgtccacggggttccccaggcaggaagacaggagtgggttaccattttctcctccaggggatcttcctgatccaaggatcaaacccacatctcctgtgtctcctgcattgacaggcggattctttacccactgagccatcagggaagcccagtaaaggcgggagactttcctgctttcttctttgagtcttttgagaaggggccaggctcttctcttcgtggtcggcccaagcctcgtactggcagaaactccactatatcctgtacacctgctccctggctcctgaaaatacaagcccggaggactttttctctcattacaaatccatccagttggcccctgtccaggaggctccggaggtggcaggccataacgactcgcacggcccagggcaatggcaattgtacatcctttatggggaagtcaggccgcccggtcagcccccgggaaaaggttttcctgccgggcctcccaggccttgctgcgaaaggccccgacagaatgggaataaaatgtaaaaaatcaagtaaaatgaagggggaaagaaaggaagcgtataaaccaaaataattgcaacaatataaaagcctcatgtaggtgccataaagagcgatcggattgaaagctgctgatatagccgaatccataaaagtgtgctccacgttgtttatgacacgccgggccg

SEQ ID NO: 40489 - DNA, 659 bp, Bovine  19866880793206
ggcttatgaggcgtgagggcaaacacagccgctctttaaagagccttgctgcaatcaataccctcacccatttccacgcaggggccctgggccaaccgagaaacttcattattatgtgccatcgttacgtccctcggagaagcttaaaaagaaaaggtcgctgtttccaagtttgttctcctccatttgccaaacagatggtttcctggggtctgtggggccctttgtatcaaaggcagcccgcaccggcctgctggggctgactccagacagagcagcgccccacgccggaaccccgggagtcaccacattcagccgcccggctgcccaccccccagcctcctcagccatggtgaagtttgggaccaatctcttgtcggacatttacttatttatttatttaggccaggattcagaaactacccaactccgtggtaggtcgggcaggaaggaagggaaggctgtgggttgctggacatcacgagtagctccttcacactcactacttctgggcaaacacaggggatggtccgccgagccctcaagcccgccacagacacctctgagccttccgctgctcgtccctttttttaagggaatttgaactcacagtaaaatagaaaagtgacagaatcccactttttcttgcacagaaggca

SEQ ID NO: 40490 - DNA, 2933 bp, Bovine  19866880797988
cagatttggtttgcccctccgtgggacagggcaaaagtagacctggtaggaaaaacttaactccagtaattctgctacaccaacctcgaagccttgctgagcagcaccgaatccaagttcatgaaagttccgtacccccggatccctcatgcatctcccccagctggccccacgctgacctggctcttgtttgtcctgactcagctctgtgcctttgcccgcagccccagcagccatcccaggagaagttctacagcatggctgcccagatcaagcttctcctggaaatccctgagaagatctggagctccatggaggcctcgcggtatctccacgccacccagctctacctgctctgctgctacctccacaagctgctgcagctggagtcttccagttcccgacacagccctgtcctctcccggttccccatactcatccggcaggtggcagctgccagccacttccggtaagtggtccgccagcaggaccttctctggtgatggccgagctgcaccgctctgattttatggagcgtgtcttctctctcctcgtgtactgggtggtcttctccgaagatgtcagaagctccctgtgacctttgccatcatctctttaggtcaaccatcctgcatgagagcaagatgctgctcaaatgccaagctgtgtctgaccaggctgtggccgaggccctgtgctctatcatgctcttggaagagagttctccgcgccaagccctaacagacttcctgctggccagaaaggcagcaatccagaaacttctcaaccagcctcaccacggtgggcgtggcttctctcccagatgtgatatggggatggagcaggaggagctgagggagtccagagcattctgtgtttctaactttaccaaaggacactgctaaaagagggtggtttcttctcgcaggtgctgggatcaaggctcagatttgctcactggtggagctgctggccaccactctgaaccaagcacatgctctcttctacactctaccagaggggctgctgccagaccccttgctgccgtgtggcctgctcttctccacgctggacagcatcaccagccagcaccctagcggtgagctcttagccagcctcttctgtttcctggttcattcgtttaccaggcacctgccagctgctacgctgggccctggggatacagcagtggattggacagatacagacccactttcgtggaggtcacagtctagaggtagaggcagatgttgaactcacgaatccacagtatctgcttaatagcaatcctggtcatcactctccaggccgagtgcagcttgacttggtagccgtgaatggagggaccacagttggacaagatatttagttgccctgcagcgtgtgggatctcagttccccagccagggattgtacccacgtcccctgcatcacaaggcaggttcttaaccactggaccaccagggaagccaggacgggatatttaaactgaaacctgaaggttgagtaagaggcaaagaagagagttccaggcaaaaaagaagagcaggtgcaaaggtcctgaggccaggaggatgttcgaacgtgaggaagtgaaaggaagcaggggcagttgaggtggggaggagcgtgaggaggtgcgtggctggtttctccctcatgaccagtgaactcagcacatgtgggcagaacagcagacagccttctaggaccttccggactcaggcctcctgcaccctgcgcttttactgggtggcatctgtcccaggtgggattagacgtacgtggcttttacgtggcagtggttccccgtggggtggagcggatgctgagagctcacttaagaggctgtcaccacgaaccaggtggcgagtgatgggggcagtagagacggggctcactggacaacgcggatgtgtgtttaggagatgggtgttgagggattggctgtggagggtgtggaagggaggtgtccaagtttaccagaaaaggagacttgttttcttgttgaagtatagttgacgtgcagcggcgtgtttctggggtatggcacagcgactcatacgttcttgttcaagttgtcatagtttattgtaagatagtgaacatagttccctgtgctcctagtaggaccttgtttatctgttttacatacagtagtttatatctgctcaccccagactcctcatttcccccctcttccccctgggtaaccacaggtttgttctctaagtccatttgattgtctgtttaaggttcactctgataccacccagtgttcgctgctctctttctgacatgcttcactctgtgtgaccatctctaggtccgtccatgttgctgcaaatggcgttagttcgttttttatggccgagtaatgttccgttgcatgtacagactgcagtttatccattcctctgtcagtggacatttaggttgcttccatgtcttgattgctgtaaatagtcatgcagtgaacactggggtccatgtatcatttcagactatggttttctccagaggtgtacccaggagtgcaattgctggatctgtttttagttttttaaggaacctccatactgttctccgtggtggccacattcatttacattcccacagacagagtaggagggttcgaaaaggagttggcttaaaagggccgatgacaactttacttttgaaaaccttgccttggaaacagctgcgaccttggagtgggactagagaggacgggcgactgtgggtccagaacagagcagtgagcagtccggctggagacacacccgccgtgtatttgcatggctgtcatgaggccttggaagtggatgatgtcataggtaggagctggtgcaggggaccgagcctcaggagagtccagaatcagagatgagaaaaaggaagaagggaaggggcaggatgtggtggcggacaga

SEQ ID NO: 40491 - DNA, 877 bp, Bovine  19866880806921
tttgggcttcctttggccctctcgcccgaccccaccgatgtttgtgctgagcagcgtgtgaggatgcgtgtgggcaggaagcagggcaaaggacctgtcagggcggcctctgacggggtgttctgccgcagagacggacgcctggagctcagctggcgtcactcgttggcaaacaagacccgcaggcttgtgcaaagggaaaaccaggcctctcccttgcacaggcctgcactaggcctgagcctgcccccaggcggacaagaagaaaaggggcacaggttctcttttcttgccccagcgaggctggatcagacgccaaaggcccttgcgctggcatctcttccctagggatgaggtctgttgctagccttccctgcagtgggcaggtggccctcagaagcctgctcccccaaggggcagcctgaggccacggttccctttggggcagcgggagatcccaggaggggcagggctgggcagggggtggtgcagggggaagcgcagctcccagccttgcccagaccctgggggggggtgtgacctcaccgtcatccagggtccgctccaggattggagggtggctggggcccccgtcgccgatgcgcgtgaaggccagcacctggatctcatacagcacgtacttgcccaggcctgtgagctgggcgctgcgggaagagttcccttccaccagccagaaccgaggtggggcgtccgagtccttctccttgtatagcacctgtcagagcccagcgcagggtcagggccgtgggctgggttctggtcttgccagaacgtctcctgtctcctccccaggagctgggtggggggtggtgaggatgagtgggtggacccggggctccttgaaggggcttggtcc

SEQ ID NO: 40492 - DNA, 1224 bp, Bovine  19866880861107
tagcagagacagatgatggtcaggggcaccaggaaccccagaatgaaggcatagatgatgaagcctgtgtaccaggccccagattcgcctggccagttgatggtgcaactgcttctcccccactggttgctccgaaggccagcatatatcatgatcggcaagatgaccagcagagagacaccccacacagccacgttgatcatcttggctgtccggggtctcctccacttggccgacttgatggggtggaccacagccaggtagcggtcgatgctcatgaccgtcagacagaagatgctggtgaactgattgatgccatccacggtcatgaccacccggcagatggccttgccaaagggccagtggaccagagccacctgcatggccaggaagggcagacccagcatgaagagttcatctgcgatggccaggttgaggatgtagatgttggtgatggtcttcatcttggcatagcggaggatgacgtaaatgaccagtgtgttgccacacaacccaatgatgcagaccacgaagtagatgaaggtgaggacgacgttgctggccaggtcgtagtacggctctgtctggtttgaaatgttggctgcccccacggagccattgaggtcgaacggagcggtcagccaaggttgggtctcattgagttcagacaccagatccatggctgccttctagtcttaggctagatccaacccgccagaggtcttattctcagcttcatgggtcccagaggcaaaggatccactgtgacatctgcaaggaagaaaagaagattgacttatctgccagaggttacttaagctgtcaccagcttcccgtgtttcggtttgctctctcagacgctcttcagttgaaaagtgtgttgtctttcacaccagtgtgagcactaccagctcattctcacacgcaggccattggagttgtttttccagtggcggggaagggtttgagtgaagtcatcccagtttatcttgtcatctttggtgacacacacgtgggagttgactctacctgcaagacagtggttcctaagaagcgggctgatctgaacgtagagaggacagagcctggagaagccctaccttagaaaagtctgacacctgcgttcctggtctttcccccttgaggaaatctatgctgacttgacagctgctttggagtctttctattgtgaaaatcccatagtggaaaaatgccagactttag

SEQ ID NO: 40493 - DNA, 1512 bp, Bovine  19866880994033
gatccacgtgtgagcagctcccggggcagcgggaaccgccagcacccccgcctcatgtggccacagggagcgggaggggctgggccttctgggcgggccttggggtcgggccagccccgcgctcagccacctctcagcgccctcacggccgctagccgcctccaggagaaccaagaaggggtgtgtgttccaacacactctgtagagggttttaaatcctctcgagccctgccactcccgtgcttttatttagtgctgctgctgctaagtcgcttcagtcgtgtccgactctgtgcgaccctgcagacggcagcccaccaggctcccgtcctgggagtctccaggcgagagtgctggagtgggctgccactgcagttgcgttttttaattgaagtctagtctacagtgtggtgttagtttcaagtgtgcagtaacatgattcagttatgccaattctgatttcagaaaattctgaaagtaagtttcagattatttttcattataggttccactgtgctgcatacagttgcctgtgcaatactaggttcttcttgcttacctgcttcctgtacagcactgtgtatatgttaatgtcaaactctttgaagtcatgctctggggctctagacttccttggagacaggcctgtccagggagtaaggtcggcctggtgaaggggctgtaggtgccacctcccatccagccagaaatgctgttttttttaatatatatatatattttttttttttaataaacatgctgagacatatagacatttatatttatatactaggactcagttaagaggttttcaagtagagtccagcttttcttaataaaggtgaggtgactacgaagccccagagaaatgcttctgttgcaggtgtaatgaagacatcagaaacgggatcagcagcctgctgatgtacgtgacgagcacgaaggggctggcggggatccgagacgccgtgtgggggttactcgccaacgagtcgatccatcacagctgggatgtggtctgccggcggctcctggacaagccgctcttgttctgggaggacctgatgcagcagctgttccttgaccggctgcaggtgaggtgcgaagtccacaggccagctgcctgctagccagtcctgcccggtgccaccttttgactgtctggatagatttccaccacttcctataagtatgttctttccctgctgacttattcccggggtgactcttctgaataatgagctgtaaaaatgaacagagtctgctgctgcgtaagagaccaggcccccgtcgggaggctggggaatgcgtccgcccccatcagtgacgacgctcccctctgccgccgccactgggccatctctctgagcgtcggggagaacactggatgctgggggtagtctgccactcggtgctctaggttgagatttcctggaagcacgtgggatttgaactcttctcccctctctttcagactctgaccaaagaaggcttcgactccatctccagcag

SEQ ID NO: 40494 - DNA, 1523 bp, Bovine  19866881025644
tgtccttcccctctgccagcacagggaccctctcccagagaagctcaggggtctccacgtgctgctgggcgttcgtgtagcaaccactgtttgtgaaaacgcgtgacggagggcggctgtgaatgccgtgtcccttttcagtgggtgtttatcgtattcatcacagcagcggcttctcgctcttgacagacagccacaggtgtgtgagacgcatcgatggtatcggcgggcagggtgtggggcgcacgtgtgctgtctggacccccgtgctggggacccctggcttggccctttgggtcccgggagcaggctgggcttgctaagccacgctggaggggcctctgattttgtcctgagtcctgggaaggcgaggatggttcgggatggaagagctcacctgagttctgtgagaggggaaaaaaagtggatcctgcgtttgcctccctctcctgcctctttcctttcttcctctatccctcgtctctgcccctccttccacacacgcgtgttaaatgttactggggattcatagagggacaggccccttctcggccttccaggagctcctgagttcaattggagaagccagaagcaagggcggtgggacttccggtggtccagtggttaagattcctctccttccgatgcaggggacgtgggttcggtccctgttcggggaactgagatcccatgtgctgcagggcaactaagccggtgcgccccggcaaagacccggcacagccaaaatttaaaagaggggaagttggtgccttcagggtggggttccgtttctcacttgcccctgaacctgcaaagtctattttcagttgtcttatctactggggatctatttgaaatttcacttaaagaggttgacacctctgatgctgaatccacttacttgctgtataagcgttaaggggaggtcagagaggtgcctatgggcttcccaggcggctccgtggtagagactctgcctgctaatgcaggagacgcagatttgcagtttcgatccctgggtcgggaagatcccctggaggaggaaatggctacccaccccagttttcttgcctggagaatcccgtggacagaggagcctgctgggcttcagtccatgctcaggactgagcatgtgtgcgtgcacacacactcacacacacacacacacacacacttacccaggagctcagagttggtgacaggcccagaccggcacccacgtctgctcctctcctcgcgacgtgtccaggcccctcccctcttcccgggtgggtggctcaggccggaggcttgggggctggcctgggagggggtctctgctcccgggaggagggtcgagtccctgggaaggcagaggccatcgatccatgttcagctgagagcttcacacttaacttgcagcttcttttctgggagggtcatttactgacaattacgggtttaaagtgggtccagtttagtaagtggtttctataaagagcagagccgggtccccagggagcgagagccgggcggaggcaggg

SEQ ID NO: 40495 - DNA, 626 bp, Bovine  19866881045901
cacagagttttctaagctgaatgggggtggacaagagaagcaattaaagtttgatccatttaggaagctattagtgacccagaggggtgatgaaattttgatgatgtgataatccgaagaggaggaaatattactggccgcagtgcaacccattcggggagttcagcttctggggtggacatggagactctcaggggcctgctggagccacgaccccggatccctcacacctagactcctctgtgggagggggctgtgttgcccagagtctgagccgtggcacctgcctgcctgggcttgtccccgggtaaggtaagccagttctgagtctggtccaggtgtcctatttcctgcttcgaaccacaaggggcggttcagaatgtgcctccagagggtccagatgggataatgtgggcccataaggggcctgagacacagaagtctccctgaattcattttcccgtcatttactgcttgggtaaccctggataaggtacacagcctccctgggcctcggtttttccatctgtcaagtggagatacagctgtcctgagctcactgggttgtaacagggtttaatgagacacgctaagctcttaggacagagctccgtgcgtggtaaaca

SEQ ID NO: 40496 - DNA, 775 bp, Bovine  19866881082895
ccaccccagccagagaaggaggtgccaagctgtggtttcagcttatgccccaggtgccgcacccacagccccgatacagggctgtgctgtgtagttgtggtcgagcgaaccgccaggggccaggtgcccagtgcacccacctctgccagctgctgtgggatgccccccctccccctgccccccgccagtgtgggaggggcgccctcacggctggggattggccactgcactcaagggggctggggtacccatgaaggagggagcccccagggtgtggagggggtgggctgctgcatgtgcagagggctgacggctaagggctccgtggcctcctgaaagagggatcagtgccaggcctcggctctccctgctggccgagcagatgcggaggtgcggatgatccccaaagcacaggttacaccggaaggaccgaggtgagcaagcttagcagctgtggctccccgctgaatgcttcacgtaggtcgtctttcagcagcctcaccctgggtatccccatttcacaggtgaggagcctgaggccagcggagaggccgggacgcctgcctgtggagagctccagagccagctccaaggtcggagctcaccctgccctcccggcttctctctgctgcctctgcatttctcctggtgtgtttaccttcccgatttagccagcttttgtttggtttgatatgaaaatgagtttgcccagaatgcacagcagcagaaaggaagggggctcggggcggacctgactgagtggcaggaaggagca

SEQ ID NO: 40497 - DNA, 733 bp, Bovine  19866881547698
cacagaaggcaagaaactgccagcacaaccacatgggaagccattctcagtgctgttggctatgaaagtgggcctcctccagggtctggctgatgtggaagtaagggccttggcacagcatggactgctcggcacaggctggggatgctgtgggctggactggcgacgaggtggtttaagctgctttcaagcccactggccctgtctaggttactgatgctgttgctattggtgctcccaccattaacactgctagaagactatgtgtcccaggagttatgaaagacagggtttctactattcctttggtggtcttcttcaatgctttccttctccttttcctgcagcaaaggtactcacccaccgcagctggcagaggggagtaacaaggccccaggagaagaggggacagacagtgctgtgtttctgtggttgccacgcccactccctcaggccgcagctctcactgtatggcagtacccctctcactgtaagtggtacccttacttccagcatctgctccacatccacccccacagccactgtgatacccaggcttagagtctttattgtttccactgaaaggaactagggttctttagagaactggctgatttcaagtttggggcaggattagaaaaacctgcatatcttcaactaccaaaataacaaagactactggacctacttggatcacatcaaaagtactcaggagtcaacctgaagaagctcc

SEQ ID NO: 40498 - DNA, 991 bp, Bovine  19866882052086
aagcccgcaccccaaaattagagagtagcccccactcaccgcaaccagaaaaagtccatgtccagcattgaagtcccagcacagccaacaataaataaatatattaattaaaagaaaaaggctgaggagccagggccagctccaagccccctttgcatgccccttcatcctgcccagcccaggaagaggggcaagagaggggaggtcagggttggaaaccagctctcatcacgtgcccaggcccctgagtcgtgtaatagccacttcctgcccatgtctcttggaagccttctgcctaatccagttaacacctcctgtgatccgattactgtgtgtaagaaaccccagatctgatcagaggcatcacgtgggtggcacaggttggcgggggggggagtgctgcagagaagaggttcaactgtggctgccatctgccccctccccaggcctctggtccttccgagctgggtgtcccgcctctggcaggcctgggaggtgtcggggagcaggggacctgagccaccaccgtcctccccaggtgcctgaaaagcagatgctgtccagccccctgtagccccctggccttggaggggaagccttctattcctgctcacccaccatcctcgttcccttgggtggagcttgcctgctttgcgaggaggaaagttgcgattgtggccacaagtgtggccaggggctggggcaccttggagagcggaggcgtttgggtcccggccctcatggatgctcctgcaggctgtggagggacccacagagccccgccttcgccccaggtgacacgcaccctggcggaggacggatggagccacccacctgctgagggacgacctggaggaggcgcccattctgtgcctgggggaggggggagggcaggagaggggctggtcgtgcaggacgccaggatcctgagagctcaagggagcccgcctgggcctctcactgtccaccctagaatgagcatgttgcccag

SEQ ID NO: 40499 - DNA, 903 bp, Bovine  19866880390352
ttccaccctgctgcagagcccccagccccacttcaagtgcctgtgttgctgggtggctgcctggtgaatctgggttctctctcctgtgttctcagtcttctactgagctggcaccaggaagcgggtgccccagtaagggggccaaggttacaccctgttagatacctcagacctgggtggctgcttccagtgagtctggccagggcctgtcctgctgagcatcctccatttgacgtccaagaagaactcacagagtttgatttggcggggagatgggtgtaggttttctacttggcagccaggaaccctcgactcacaacacaggagcttcctggttcctctggtgatacgtgattagggaaaggaggtgagctgaggccagtccaggaaatggcaacccactccagtgttcttgcctggagaatcccagggaaggggacgcctggtgggctgccgtctctggggtcgcacagagtcggacacgactgaagcaacttagcagcagcagtagcagcagcacccttgcctgtgaagtgtcttctgaaaacagtatctacgggggatccttgcgggtgctttctgcattgcaggtgcttgtttcagcttctgctctaatctatgatgctattatgcccattttacagatgaggaaactgaggctcagtgaaggaaagtgccctgggccagaggctagtgtgtggaggggctgggctctaaccccggaacccagagcaaactctgcactgaagttgccccatttctctgggataaaatggttttcatgtgttcattcagtcgttcaacaagcgttcactgagcagatcttattctaggcactggggaaacagcaaggcataaaacaggagcttacgttataattgggaaggcagacaccaaatgcat

SEQ ID NO: 40500 - DNA, 3786 bp, Bovine  19866880425786
ctgagcctggatctggtgactagagaggtctgtgactctccagaggttagtgggagtctttgaccaagaaatgaaactagtaagtacttgagaggccttctgaagtttctggatccagcctgggctgagagtaagtgttgatgaagtcaaaagcccaacaggaagttgtcaagagtctttgcatcctggctgtgctgggaacatgtggctgcaaggctttgggggtggggaggtctctggattccaggttggggtgctcacagaagattttccagtactggctacaagttggacaacatggccaagaggttaggcccgtggttttctggaggttccagggagaggagggtgtctgaattccagcaagttgtttgccctccatgaagtatattattgacttgtggtggctctagacagaatcaggattgagttgtgtctgggaccttttagttcctgtccccattttttcccccaaactgtttctgatcatttccagaagatatcaggttataagcatggggtgggggcttggggaagatggatattgtattggacacgggaggaggtgtgtgagatatcctgctctttaggaagtcaccatgctgtctttactgaagatttttatacttatggtgcaggaagttgatatctaatttcactcagctgttcaagttgtacaaagtattaaagctttcagggtgctttcatgtacacccagagttctcaaaccaaaggtgtagtgcaagggggtagtttatgagtggattacaagggtctatgagctcctggaaataatcagaaaaactgtatgtgtattgttggggccaggggtagggagggaagcagccacaaagaggaggagtggatcctgtccaaggatggttcagagcagtctgtgactctattgtcattcatatgcaaaatggtatgagaatctacatttttctgatgtagagttgatttcataacatacgattttaaaaaggatagtgaccccctgagaggttaacagctactagattaaagcaggccctcctattatctattaggaaaaactagaaatgggagattttccctcttctccccacatctggtgttagtgcacacttcaaggtgtctcacacactagcctgcctgtccaagctcagtctccatgcccctcccacccattcggggccacaccattctgaagagtatagatctagggttgaggctcatgtgagcctgggtagtggaccatttggaccaggaagtcaggggttttgagttcccagagtatggtctagaattgggaggtacaagtgggtacttcctagatacccttggactcctcagcccaaggggagggacacaactagagatcagagtggtcccctctgtctggatttgaggcaatatggatattcaacactggtttggaaagtagtccctatgaggaagttgaaggtctcagaagagttagccccaagttaaggctgaagaagaaagctgtctattgtgaagaggcagtggaacctaaattgtttttatttctagtctggttcttttgccacataatctacaaaaagtgtgctataatagggtctctatgacctagattcagctcacctgcctattactatatccgtatcttgggttatgtagaacatagatttaagggaagaaagaaactcattcactctgtggcatctcttctctggtatgtcttggatgtacttaactaaagaatgaacacttcaagttttctgtaaggtttgggtaattggttttaagctgtataaaatgtgggaagtttaatcaccttaatttgcagaaagcgatatgtctctgggacgagtggaaagttcatagaactttcctaaattgaatcttgtttaacttgactttggaggtactcaatatttaatacatgagacaaagggagtatttttcataaaacaaataagcatccctctaataggcatattctgatggtttagcttttttttttttaattagtttatttggttgcaccaggtcttagttgcatcacacaggatctttcgcttttccttgtggcatgcaggatctctagttgcataatgagaactcttatttgcagcttgtgggatctagatccctgaccagggatcaaacccggcccctctgcattgggagcacagagtcttagctactgagctaccagggaagtcctctgatggtttaagttttaattataatatttagagagaatccgtacttatgttgctattttgacattttttacatcaagctgagttgtgcttgaatgggcttatggtcaggtatatcagtaagaataaaagatatcagatttcaaactttatttagtaatataagtattataaaggactgagaggcaaaaatcatacctccttttcccacatacttctcttccaattatatcctatgtaaactttcctgcctactccactctatcccaagatgcaggcttgtgtccacaaaacctgtggtttcctggctccaccccagagagacaactgcaggagattcctattgagtcagcctggcaaatggagggtgggcaaggtttttgagacttgcggggaaagagaagagaaacacaacattctctggtggtccagtgataaagagactgcgcttccagtgcaggtggcaagtcttcaatcccttgttggggaagttcctcatgacttgtggccaaagaaaaaaaaagagaaacagtcagcagtgtgcttacccttccaagtcaaagtggtacttgcttctgcttgtcactgctcagtgaaagatggtttggactgtgcagtcaagaatgtaggcaggaagaagggctgaggtgtaaagggcccgacccctctaaggaggcagtctctaaagggatagccttagatgagggtagacaccaagtgggagggaaagatggggtttcctaacctcgggggctttagttcactgaacggggagtcccctcaccccttaccctccctgttaggtttcctgaaagcccacagccctccctgtcaactgcatttggataagaaaatgctactctttgagcacagcctccatctcttctgaacatcaatgggcaaaccaccagtggaggagctgagtcatgggcacatgctgtaggcctgggaagtgagggggaccccactccactgggtgatgacgtaatcttccagacccctatacctacacttggggttcctcctttgtggcttccccaacttattccacatcctcagagagtgtgtatttctgtgtgggaggaaaggatgttttccctccatatacgtacacatcaaggattggtatttttctgtgtccaagtcaagggtcttttatatgggtatttcatgggtccctgggtgtggtggtgtgaggagttagaaagcttagaaatggaaaatatttaacgaccagagtagcaaatgaatacaacttccccatttgcattttccctttcactctgactcatcttcccctctccccacactattattgcccctccactggccccacccattggcacaccctgtctgatctaggaagggataacatctgcttggacccaagctagaatgagaggtagaatgaaggtatgttaggtctcaacagagtagaagggtggtctgaacatttgagggtcctgaagccaaaaggcgaaacaggagttttagagacataatctttgagtctaggagggaatcagaatctaggagagaagccttggggaaagcagactgggtcttgtcatcataccagcctaccagtgccgga

SEQ ID NO: 40501 - DNA, 875 bp, Bovine  19866880627230
ccaagtgtggccttcaacaggacgctaaggccctgcccgtccttcccagaactcagataaccagaccccacccaccccagcacctgcctgcacgcgaccttgaccctccctcctcctcctcccccgatagatactaccctcccgctgcccttcagctttcctcctgagtgaccccgttccagccctgagagttgagctcagccccaggcctctccatctcccccaccccatgacccctgccccctgctccccctgcagtacccacccagctgtggctccccccgagccaggccacacacagcaggagcaacagcagagatgagacagtggccgacttcatgatctcccgcctgtggagcccttgactcgcgacctcggcttttattcccgggaggacctcccacccagctccttctccatgactcacagcttccctttcccaccccacctccactgggcacacacacaaggaggaaagaagggactgagggaggcaccttccctcagcagggaggaagcagaaccgaatctccatgcagctgccctggggccccgaaccccgtgtccccagagctgagcgtcctgacccctaaaccgggggttctacagcccttacctcagtaatgactttccagttcaagaaaggagtgttgtgtttgaaatcctgaaggaagaaggaaagatgagtgggccacagggaaagaggattcagagggtggagtgtggcagcctgttgtgaaagtttcaagatcacgtgcaagaacgagttttggcgcctgggtgtagtttggggttagatgaagataatcctccaggagactgagggtgttacattgctgatgggactggtgataagacttgggggagatgatgca

SEQ ID NO: 40502 - DNA, 1870 bp, Bovine  19866880634324
cttcttggtggtacctactgttgttattcccattttacagacgtagaaagtgaggactggagaggacacaccgtgggcatgtgatcgctccaggaatagcacttaggcttgactggaagagatgtggaggcaggaatggtcacgcgaataaataccagggtggccaaaaagttcctttgagtttttccataggtggaaaaacgaatagatatagaaactaattgtggaatgaatgaatggatctttctgaatgccaaccccaggctgccattcagtggcccagggcagcaggaagaaaggggaagttggatgatgggacacatctttcacgtgtcccacatttttcattttcccacgaggcccatctagttccataaaggactcagctcacattaagagcagaaatgaacatctaggcaggaaggccatcaaggtcaaccaccacagttgacacttgcagagcatttacctgtgccaggcacaggcctcagggctttgcaagtattagttcattaaatccttcccacagccattttaatatggggaaatgaggtgtggagagaccaagtgacttgccccaggccacagggatcggacctcagatagcctggatccagagcttgtgtagaactactacactctattgtttctcaagaaacagcccagtgagttgccatgtcgatggctaatgtatgccaggccctggctgcagcctttgcacaagacccctgtaagttggggccgtttatcatcactcccattttgcacatgggtgaaactgaggcccagtgacttgtactaacttgcacattgaataaatggcagggcagaggggtcatgcacctaccagatgggcctctatgactcgctactgctgctgggctaaaatcccaacacttggcggactccaaggctcctcgggtgccgcccctctccaccctcacttcatgcttgctcccagcactcttcaggccccagcccacaggctgctctcactctcagaggactctcctagcaccacagtctttgctcacctcctctttatgctcacacccagaggcaggtttctgggtcctgtaccatcatggctgagctgaggctcccacctggcctgccctctctgattctcagcatccttatctggtaattggtgagaattagcggaggtgatgatccgtgcaatgcttgactttcagccaacttggttaacatggacttctgtgtctcagcctttaggctttaactttcccgagctggacctttctgttcccaggctccataccctccgccccccacaaccactctgcataccaccactaccccctctatgaccctccccacatggctcatgatttactcctggtgaatttcagaagggcaggggcattttgtttaccgccctagacagtgtctggtgcatagaaggtgcttaggaaacctttgtttaatgaataagcatgaggacaaatctcagaggtgaactaacttgtcctgagcttcagctggaaagtaataaggccacaattcagacctgactctggccatcgccagcactgtgccctcccattacacttgggtttttcaaaaacgttgggaaattacaaaatgaacaaacagaaacaacccagaaatgatatccccacctcacttttctgggatttttcacacctctaaatatatcagacaatttggtaagcaaaccaggtgacccagaacgtactttctgcatggcttaaaataacacaaacaagaataaagagtttaaaagtgagaaacagtggcacagaatatagctttaaaaatacttggagggggcatttgatattccttcctccctcccttctcctccttccgctcctccctccaaata

SEQ ID NO: 40503 - DNA, 2455 bp, Bovine  19866880656918
tgaccccgctaccctctgtctctgacgtcatcttctactccgccccttgcgaccccccgcccccaccccgccttgctgctgtcgaggcccgtgctgtttccagctccttcccacctcagagccttggtccttcctcacctctgcttggaacactcttcccctaggtgaccccagggctgacttcctctcctcctgcagctcttggctctaacgtcagcttcatcaggccctctgtccactcaggacaaactgcctccaccgtcccttacttgacctcctttaccagtttttttttttcctcacagcagttgtcactacctgacattatactcttctttatatggttcctccattcacctcttgtccttccaaccctggaaaacaagctccctcaaggtgagaacactgtcgcgtgcaccactgcgtctccagcaccttcacctgtgcctggcacctcagcgttgttgtagttgctcagtcgtgtccgactctttgtgactccatggcctgtagcccgccaggctcctctgtctcatgggatttcccaggcaagactactggagtggtttgccattcccttctccaggggatcttcccaacccaggggtcgaacccggggctcttgcactgcaggaagatcctttaccatctgagccactcagggaagccctttgtcaccttgcaggtgctcaataaatatttgtcaggtgaataaataagtaccagtgctagagccctgctgtatgcggggtccacttctacctccacaagcatgtatataccaagttctgttattaacctgcattttacaaactgggagactgaggctgggagagggccattcccttgcctagggtcacgcagccagcctcaggtgggtctggaattctgcccgaatggcaggtaacttgtctgctaaatgaaaaggatgaggataggggctctttcgggaccacagtgggggatttttggctgagggctgctcttcaggtcctgaccttcagttctagatagggtgaatttccagaatctccccagcccaactttgccaggcaagaggaatcaagggtggggctggcccggggcagagggagaggaagccagggacaccagacacctttgcggtctgggcctttgtgccagcacttcctgggctgtgaaattcccctgcaaaaaataactctcttgctgttccggtcccttctgtcaggggtggcaggcagaggcacagtaaggacaggccttaggcaccacacaggggcacctgcaaactgatgttcgctgagcacctactatgggcttgtgccattctaagcactttactattaactcatttaattcttcctacaagatgggtgttaacattattcccattttacaggggggataaactgaggcacaggatgggtaacttgcctcaatcgctagctagaggagaggagcggccggctctgtagtttaccacttgtggtccatcctgcctcatccagcccctccttcagtcctctgccccacaccatcaattaagattcttacagcctgtgacctgtcagaggtctctttttacccttcctcattcactctggaaccagaacaggatttgagtgagacagatctgggttctacctggaccagaggttttgcctctaggctcatttctgaatcggtaagacagggtccagcggcctcaaattctggtgtggggggcctctgtatctgcaggtggagacaccaggggctaggccttgcctctctgctgagtggtgccaggcatgtaactatttgtctccatctcatggtgtaactgagaattaaatgaacatttgggtttgctggtggctcagacggcaatgcacgagaggggggtttgatccctgggtcaggaagatcccctggaaaaggaaatggcaagctactccagtattcttgcctgggaaatccaatgggtagaggagcctggtgggctacagtccctggggttgcagagtcagacacaactgagcgactaatacttcagaccttggcacagactctggtacgtacttggtcctcactatatgacttactttttttctcccctgattttttttctgccataatagtaacctttattgaatatttactctgtgcaggccctgtttcaagtagccacctttattaattccttgaatccttacagagtggttctcacagtgaggtccctggacattcagcagagcatcacctgggaacttgctggcagtgcacgacctcagcagactcatggcaagtgggctgagtctcaaactgagggtggagtccagctttctgctttttaagagtcctccaggagattctgatgcagctaaagttcgagaaaactcacttctaacaatcctaaaagaccggtgctattgtttttcttggccactctgtgaggcatgcagaatctttgttccctgacctgggctccaac

SEQ ID NO: 40504 - DNA, 1519 bp, Bovine  19866880834953
tactgtacatcagaaggtttatactagtgagaaaccctctgagtgtcaggaatgtggaaaggcttttagagtacatgtacatcttatacaacatcagaaaattcacactaatgaccctatgaatgtaaagcatgtgcaaaatttttagtcatgcctcatacattgtacaacatagaatccatactggtgagagaccctatgggtgtaaggaatgtgggaaggcctttagttctgactcttaccttgttcaacatcagagaattcatactggtgagaaatcttatgaatgtaacaaatgtgacaaagcctttactgtgtatggacaacttattggacatcagagcattcatacaggtgagaaaccctttgaatgtaaggaaatgtggaaagacttttagacttaattcattccttactgaatatcagaggatacacactgttgagaaaccttttaaatgtaaaaaatacaggaagacttttagacataaaggcctttagacataaaggccttagagcacatcagagaaaccacatggctatcaaaccctaagaatttaaggaatttagaaagtcctttatgtatggttcaaacgttgtttaacatcagagaatttgtgctggtgagaatcttttgaatataaaatatgttggtaggcttttagaaaatattctcatcttttattagagaattcatgatatttaattcagaaaaggtaagaaagccttcacttgtcattcctgtgtttaaattatcagaatatcatcatcatactggtggccaattcagagaaagtgggaaacattattaatgctcataatattgacagcatttatgacatattctaatacgattgaataagtgaatttaaaagccttccaattgcttttaaatcatttggaacgtcaggtaattcatcttaatttttaaaaaccagttggaaaagactcttgagagttccttggactgcaaggagatccaaccagtccatcctaaaggaaatcagtcctgaatattcattggaaagactgacactggagcagaaactccaatactttggccacctgatacgaagaactgactcattggaaaaaggccctggtgctgggaaagattgaaggcaggagaagaggacaacagaggatgatatggttggatggcatcactgactctaaggacatgagtttgggtaagctccgggagttggtgatggacaaggaagcatggcatgctgcagtccttggggtcatgaagagttggacgtgactgaagaaactgagggccgaagaattgatgcttttgaactgtggtgatggagaagactcttgagggtcccttggactgcaaggagatccaaccagtccatcctaaaggagatcagtcctgggtgttcattggaaggactgatgctgaagctgaaactccaatactttggccaccctcatgcaaagagttgactcattgggaaaagaccctgatgctgggagggattgggggcagaaggagaaggggacaacagag

SEQ ID NO: 40505 - DNA, 1621 bp, Bovine  19866880862379
aaatatggtggctaggggatggattgggaagcaaagatggctaagggtggcctctgtcctcctgctccctaggctgttatccaaaatcccttcagcaatggtggcagcccggctgctgaggctgtcagtggggaggcccggtttgcctatttcccagcgtccagtgtgggagataccacggctgtgtccgtacagaccacagaccagagcttgcaggctggaggtaaaggaaggaaggggccagggcggaaggcaggggaggcaacaggcctagcagggagggaagctccccccccaacccctagccagttctgactctgcccccagttttagtgctaacccccactttccctgcaggccagttctatgtcatgatgacgccccaggacgtgcttcagacaggaacgcagaggacaattgcacctcggacacacccctactccccgtatgtgcaggagacctggtcccaggaataggggacgctgggagggcctgtcgtgggcacccaaaaagaggaggttttcccgggatgggaaccaggcagttgaatacacagcaggcagttggtgtattttttggtcagcttttgcttttctagtttaagtaaagaaaataccattttctccctctctttgtctctgcatatcgatttgtcttgcagagatcatttttaagtctgactccttaataaatgtttggacacacaggctggaggtaacatgtacccatttttttccatactcttctaggaaaatcgacgggacgagaacgccacgggatgagagaaggagagctcagcataatgaaggtaaggtcaggcaggagctgctaggcctcatgggctcaaccccagctgggtgtttggagtcacagatcagtggccgggttattgatccaagtactcgagaggtgttggttgaatgctgggaaggcagaagcagagaggctacttgtcagcagcagatataggcaggaggcatgagctgtggtatatttgtcttcctggctggtgactctaaagtaatgaccagcagtttaaatggcgagtttcacattcatgtgtggattttctgctcctctgggaaagttgggctgctctggtgcagctggacctgccttcccatgtggcagctggtttgctcaagccccccaccccgctgcttgcctggcttccagaagtagctcagatctgagagaaagtacatctgaaatgaaattgcaggcagtctgtgtctctggctcaggccggcgcatgaacatgtccagggaacacttccacccaaatagctgtcatttggcagatacttcctgaaggaggattctaggctgggcagtatgtgccctgtgctaggtatggaacctagcgtggagtgtttaggaaactcgggttggctcaaggtagtgtgtgactgaacactgactggaggagcaggtgatatttccccagggaggtggcctttgggagtgcctgtccagcagagggaagcacaggaagtcagggtggagaagggttgctccgggggtgctggttttggttgtagcagaggttccttgtggagtgcttgggagggccaaggagggccttgaatgtcaagggtgaggccttgagagtcctcactgt

SEQ ID NO: 40506 - DNA, 1952 bp, Bovine  19866880949776
ggggtgtttgttttttgtttttttttttgcccgccatgcacacaccttgtgaaattttattttcccaactagagattgaacccaggccctctgggcacttggcagtgagagcatggagtcccagccactggactgccagggaattccctaaaataattattaatattcaggaacatttattggttgcttactttgtattaggcttagtgcttcaaacatgatgtgcattagtttactgtatactactcataactctcaaaaataggaaacttcttgcttgggaacactcttttacagatttggaaccaaaaaagtaagagtacttccattagtaggggctgttatcctgtactggtagtatgtgaattcgaaaatatttacttttccactgggcttcattattctcatcagaaatgtggatcacaacactaccccctagaattcatctgggccaaggcacatgtggtaaacgtaagttccctattttctgaaggagactgtctgtagcaataggcaagtattcaattgctttattagagacggcttccttgaccatcctatttaaagtttcagtccccctcctgggtactccccatgtctctttcaggctatattctttttcctattacattgcatttaaaatgttctgcttgtttattgtttatcttccattctctataagctcattagggcaaggatttttatcgttttgttcactgcggtgtccccagtacctagagaagtacctggcacgctaatattcgctaagtgaatgaggctaaacttgaaaagagattaacagggagctagctggcacctagcgagtgctcagtaagagggagccccgcctaaccccagatttgttttcctcttagggataaagagacttgcacggttaaataaatcctgttcaatagctaaactgatgttactcaaagcttctaactctccaagttctaagcagcagcctcgcgatgctctgatccttcgtttcccaccatgcgttacttttaccgagtctcggaagttagaaccatgtcccaggaagagccccgggatgtcgttggtttgtttccggaaaccaggctctaggaaggtgggactgagagctgggagccgacaccggcagctattaattggccacgatatgggattgacggttacactgactaatgggaacaaagaactgccgaagagggcccgcccacagaaggaacaggaggaggtggcggcatccgcgtccgtcgcggccggacactgctcagggcggcggactggctacacatgaagcttacctttgacctctccccgtctgcctccggccttgacttgtgacattaggctcttttgggctcccctggcccagctacccagatcccagaccccaaccatgttcccggtgaaggtgaaagtggagaaatcaggtgaggatcccaaggttgggggcaggtaagggagccccattaaacaggattatcgcggtaaggtggactgcgtgacttctccctgcagcccatatgactaccgctgtcaggcatcgatcgagcgattctggccaccttgataccctcccgaactgtgttcaggataggtttgaggctatggtggtgggctggcagtgtggtgcagtcccacatggggaacccgaactgtgtgactccaagaaggactcttttcttggctctgcctccatttccccctttctggcagtggtcttgagtcaagcattatgctgatcacctgaagtacaggaaagcttttaatctttgcactcactgtatcccaataatcctaggggattaataattcctatttcctaggaagtaggaaatatagatagggaaactgaagctgagagagaggaagtcattctggttttgggccaagctgatgggaacccagggctagcatgttatgggtggtgggagagaccggaatccagaccaagtaaa

SEQ ID NO: 40507 - DNA, 1103 bp, Bovine  19866880961536
ctgtgccacgtctttggctgtttctgttggtccttcacactgctccttgcccactgaagagtcggggtggtaaggagctaaaaattcaaaggcctgaaaatggtctcttcctgctttgctgatagtacactgattcacttcttctcaagccacctcttccatctatttctcttttgaattctttgcttctacaattgggacaccctggggttggagagctctcacctttctccccactgaattctcgggggctagcacatggcatatacgcagtgagtacttgcttagtgaatctaggaataaaggacttttgcgttttagcttcctttctgtagtcttatactcccttccctcatggtaaggactagaagaggctgtgcatgtgcagagagcggagactggaatcacgcgagggatacagaatgcttaactgcagccagcctcagctcaacaccctgttcaggccacctgactgagtcttcccagccgttctgtaaggtgttattaatatgattatgcttagtccactgcaggggaaactgaggcagagggagaccatacagcaaggaagagggactgctgagaaaagaatccagtagtttaactatacagactgctttgtatactcaagtatactgctgtttgaagatggatgaatattcagcagtttgatgagcagtgtcatctaatggttaggagcacagacccatgttagacggcctgggttcgaatctagctcggccgtctgggcagcttgcaagccctctgtgatatggagagaacccccggggatgctgcgcagaggactctagtgagacctcaatgcacagtgggcactgtgtaagcagtgggtatttgtgatttcttctggaggctaaaggtgctgggaaggggctgagatgctggataaggaagtggggcaggcctaccctgggtggacggtcctggtggcaggttggtcttcatgtggagcagataccagcgtcggagactttgttggtcctggaggaacagaaggtcctggcgaagagaggcagccctcgggaggagcagctccggagcctggagggaggaggacggatagtcacctggggcggaggttg

SEQ ID NO: 40508 - DNA, 1568 bp, Bovine  19866881000731
ccctccatcagagcctgctagagccctggactcagagccccaggccgcaggaacgcggagctcgtctctccccactgtgggggcgccataggacgtcacgaagagtcagaactgtctccacagtccagtagtcacaagctcactctcctctccacctcccatgttggtgccagtggaagttccgtgcagagcatgaagaggcagtcctgtctctccctgccagagaggtgccacggagggcaggtggggaacccatgctcccacctggtcaagcacctcttccccctgagtggaggccaggcgtggagcctgggctcagttcccagccggcagagttggtgtgccacctctccgtcctctactggagcagtgtcacagggagccagcctggaaacaagaggattaaagaggtcaaaatctcctagcttgatacccaagtttctcagattcagtataaaatcgtcatcccaagaagtaagatctcagactgaatgaaaaaagacagtttgtagataccagcactgaggtgacataaatactggaattatctgacaaggatttttaaagcagccatcataaaactattctagttagcaattatacacatgctgaaacaaacgaaaaaaatgaaaagtctcagcaaagaaatagaaactttattcttctttgaagatccaaatggaaactgtgtaagtgaaaaatacagtgattgaaattaaagaaaaaatagtttactggagggggctcaatagcaaaatttagggatgaggggaaagaattggtgaactgcagtgtagaatacttaaaattaaaaattacctaatctgaataataaagagaaaaataaataaatagatgaaaagaacagagtcgtaggggcctatggtactattatcaaaggtctaaattttctgtcttcagagtcctggaaggatttgagaaagagagcaggataaaaaaaattgcttgaagaaatggtgactgtatactcctcaaatttggcaaaagacatcaacttaaagattaaagaaattgaatgagccagaagtgggataaacccaaagaaattcacactaagacacatcatagtgaaacttctgaaaactaagggcagagaaaaaagtcttgaaagcagcaagaaattacactttagttatgggaaaaaacaatttcaatgactttggatttctcattaaactgtgaaggccaaaaacaagtggtgaaagttttgtgtgaagaaaggaaataacaatcagctcagaatcttacatgctgtgaaaatatccttcagtagtgaaggaaaatcaagacatactcaaagggaagaaaaccaagagaatctttagccagcaaacttacctaagaaaatgagcaaagtatgttttctacatagaaaggaaaaactagaagaaggagccttgggatattaggtagaagaaaagaaaactgtaagtaaaggtaacagtcaatacaatatactttccttctcttgatgtttataaacttgatggtagaagccaaatttataacactgtctgatgccattctaaatttgtgaggaagaaata

SEQ ID NO: 40509 - DNA, 1559 bp, Bovine  19866881150347
aatgaggaaatgtcataaaccacagggagacaaaatgaaaaccctcacccagtggatgagttggatttaagagacccactgctcttctttgccccttaagctcggcactggagaacttgccctggttctgtttcattgttcccctttttgagccccctactccccaaaacacagtaacccaggttggcaaatccagtctcatatggccgcacctaagctcccatttcctctctctgcagctggctgtccggctcgcctcctccagtaccctgccagggaggcgcccccgctctgcagccttttatcaaaggctctgcgcacagctgaggaggagaaatacaaaatcaaagggtcgatgcacgcattgagagcggtgagcatcacggcgcagacccgccacctttcgctggtcttatggaagaaccccaccacgtgaaatacattgtagggccggaaacaggccaggaaattgaacagcgtcgcaacaaccagcgccacagctctcgagtgcttccgggtcaccacttgcgactgggagagaaggattcacaccaaacgccagtaacagaagatggtgacccccatggggatgaaaaagaagaggaggcacagttccagccgcaccggaagcaccaagcgcagctgctcttgggtgaagttgtcatagcagacagggcggctgttggcctcccgcgacgagttggttggtaagtactggacaatgatcacaacgctacagtgtccaaaggacaagagctggatggccacggcagcgatcactccgtacacgggccggcggttcagcttgtactgcacggggaaagccacgctgcggtagcgctccacgctgatgcccaccagcagccacgtgctgcagtagatgccacagtagaagccgaaacctgtgagggcacagagcgtgttctccaggggccaggcgaaattatgcgcagcctcaaccatcttgaagagcagcagcagcagcagcagcaggaggaggtcggccagcgtcaggctgagcaggaggatgtggatgggtgcggggtggggctggcgcacgcgccccacgaaggcccacagcgccaggaggttggcagggagaccgaagaggaaagatagaaagtagacaaggagaagtcccaggttttggggacttggggccatccttcctgaagagacaaaagatgctgtctgaattctgagtttcctagccccaaaccaaggtgaatcagactctgtgtctcccctctgtgtttcactaagggattattgcctaccctgcagaccgaacactattcttcttcctgtgtgtcagggagaaagaacttgtccttcttcacaacaaaattgtgcttttttgcttcacaacaaaattacttctttagaatctacacaacagaattacccaagaaaattacttctttagaatcttcctcttctccatttccgccctgcaaattgagagagagagaaagagtcttaagaattttgatgtctcagaatctcccacaggaaaagttcgaggtctccaagtccccagtagaaagggggacttccct

SEQ ID NO: 40510 - DNA, 1374 bp, Bovine  19866881177269
ccctggggctgaggtggtgtgggctgcctcccccagactcacctgcgttgacctggcaaggagacccacacaaagaaccaagatgtggctgagagatgccattgtcctggggaataccaaaggtcaggaaatgcgtgccctcagtctcccaccactggggcctgaacccaagcggttaagtcagagacagtccagggacttaattccaaaagcatctatcatccggcttggtcaccctgagaaacagaggcgccccctgcttcatcaggaaacagcgtcaccaaaacaacccacacaaagagggtcacccagcagcaaggacggggtgaggcacacacagcccacaaggatctcccgcaggccggggcctccctcactgtaggccccaggttccccgcacctaccctggcaggggagagcagatgcctcaccccacccaggtggagagacagacactgccagggacgagacagccaggaaacgcccaagggccacctgcccacacaccacggccttgctgtgtccgtaatagcccggctctcctgccctcggccgctggcccgctctctgcctgaccctgggtataaatatctcccacttcaccctggaggaatttgcctcgcacaggccaccatggcaacagccttcctccccccacttgggggtcatgcacaaccctgcccggggtgaggccgggctgccacactgccaccagctgcccccgtgggaaaggccaccccttctcctcttctggaagcaatgagaacagggaaaacatcccctggcctgcctctggatgacatctttcaccagcggacagcaccaggcgagtgacatgaggcttgggccggtggggctgagatagaagacagatgccaggggtggggacgatgcacgcatgcgcacatgcatacagacgcacagtggggctgcaatggggatgacgcccgctccccaaacttctggttggagcaaggcacggggtggagacacaggcacacattagtccccatctgggcctccggtgccctcaatcagtgaggcaaccgacctacacacatgagtgtgcgaaacccacacccagccagtgtgcacgcgccacagcaggggcagggaggagctgcacccacacttccacccctgagggaaccccaacgtcccaaccacactcccttcctcttgggtctggcttgcctgggaagcggctcctgctcccaaaataggcggcccagccaggccaggggtgaggccctggaggggaggggcgggggacagctcaccccagtcagactgtcccctgccgaaagaaggcccccaaacgtccggctgtgccccggggccgagcactttgcaccccctggcccagagctggct

SEQ ID NO: 40511 - DNA, 1264 bp, Bovine  19866881181682
tttggatcttgactcaacagatccatgttgggcccaggattctgtctcagatgaggccaaggctgcaggtctggggccatgctgagcagcaaagatctaaggtgtgttttgaatcatttttcatcatttcggcttcaactgcttaggactccttccctgaaccatcttctgattgggtgtaaattggaattttccagggccccaggggccattggcctagagagtcagggagatatcccagaccttgggcttccaaagagcatggcaggtgagtcccgaggggccatcagtacatgccaccatcacgggccgtgtgcattggtgccctccttccccaagaccggggctggcctcatcgtcctgtatgaagtccctcactgaatcctcccacccaccatctggtggctcagacagtaaagaatctacctgcaatgcaggagatgcaggttcgatccctgggtcaggaagatcccctgtagaaggaaatggcaacccactccagtattcttgcctgggaaatcccacggacagaggagcctggcaggccacagtctacagggtcgcaaagagttggacatgacttaacaacgaaaaaacaacccaccttctgccgtagaggctcttcttatccccatttagcaggtggggaaactgaggctcagggaggtaagattacaaggcgaaggtcacagagttgcgacctggatttgaacccagccaaacctgtgtgattgttgtttttattcttggcatgattcactatactctgccgtcagccagagcctgtgggttcctgttggtaattagcatttttacgggtattagcaaagtgatctagcagaattcaattcaggagacatgtctgagcgactctttggtgtaggtcacgatgctgggtgggtggccacccacagacgtcgatgatggagccctgccctggtgagttgggtgacggtggaggagttgtaaaaaagacacccccgaatactgtggcttaacaaagtctgggtcagtcccgtctcccaaatctgtgctcaggtgaagggttagggggtaggaagtttcctggatgccctttgggcacccaggttctttccatcttgtggctcagcccttgctcatgatgctgtcttccctagcatggtggagcctgggctcaggcacgcccaggtcccagaagagcctctattttttgttttttttttttttaacattatctaccacgttatactgcttcccagtatatgtgggaggcttatattta

SEQ ID NO: 40512 - DNA, 757 bp, Bovine  19866881207462
tgcacctccctcctaatgagatgtccggaaggcagggctggcttctctctcttattctgagtcacgtgcccggggcatggaggagtttcacaggctagaaggacagtggcctcgcagagagaagccgaggatacctcccaggcaaagggcagagcaggcctgctccccgactgaggctgtgccatcaactgatgtacctcccttctccatcagacagtgctgccaccatcagcaggcgtgcggccttgggagtggggttctgcctggccatcttccttctggccatctggggagtcaagcttcagcggaggtgagtgcctcctaccacctgcctcctttgctttgcctcccacatcccagtgagtgggtccctggtcactcagccttgcagcccccagcatgctgggtcctcagggagctctccccaggcccttcgtcctctctgatcacgtctttatttctcagttggaagaggattcagagacagcagggccttcaagaaagttccagtggacagagcttctttgtgaggaatttaaaggtaggagggcagaaagagggaatgcagggcaggtcttgacgtcaagaaagaagcaaactggaaaatcaactatgtgtcagttaaaaaataaaaaagaactttcctggcagtccagtggttaagacttcgccttccaatgcagggcatgttgggttccaacaggtagctaggatcccacatgtcacaggaccaacaaaccaaaacataagacaaaag

SEQ ID NO: 40513 - DNA, 1394 bp, Bovine  19866881222967
tggagggctaggggcacatcatcaactttacctaccctgcattgcttcctgcgtggtgaggagctcatgtatgactacaagtcaccactgacgatgccagcaacaagatgccgtgtaactatggtacctagtgctgctgaagctgtggctacctgccacaacccctgttgccaacttggccctagcctggggacttcctcatccctcccagagcatctcaccccaccatcatattcagggttggatgtgggcacgcaggtggcaagggctctgcctccccacctccaggccacccagcaattacccccttcctaccctggggccccagaatatagacactgcccaaaggtttctaaatcccttcttacctatgttaggagagtgggatcccaggtggcaaccagaccctcccccaccaaagtctatcagtgttaaaaacaaaaaacaagaacataaaccaattccacactcacggttttagcttcatattaattattcacataaggaaggatagattatttttaataattgtgaaagagagtagagaagtagtaaaaggaatttggaaggtaaaatacttagggcttaacaatgtggctcagatacgaagaaaagaaattagttaaaggtcacaccaagatttctgatttgtgtccctgagtaaacgttggtgccattcactaagatttggaacactggaagggcatggggtgagggtgggtgactttgattataaattgctttaagataaccaaaaagaatgtcaaatagtcaagtggactatgtggtcaaattcagaaaggtctgagtgacataattcatgactcgcctgcacataggtgtaaactgaagctgtatagataagattacctggagagagagggtgcagaataagaaaagtgggtccaatgcggacccttagagaactgctacatttagtatctagatgaaggaagatcagcctgcaaagagggaaaataagtaatcagaggaggaggaaatcatgaaaatgctgtgcaatgaaagccaagactaaatgattccccaaaggcagttgtgaatactatggacaagcaccaggtggaaaagaaaaaaatcagaaaagaccaactccaaaagtctgaatttgtaatatatacaataaatcatctactatgttgggacatacttagaaaattttgataactatttcatatcattgaatccaaccccagaaaaccagtttctgtccctgctcttatggcaatatggtaatgctttaaaaattcaagtttctactcaataagtaactaatagctacatattaagtcgattatttcacctgtacagctacattatttactaccataaactgactcagcagccaccaaactacagaaacctacccacattta

SEQ ID NO: 40514 - DNA, 1046 bp, Bovine  19866881257042
cgacctaaattcttcccgttccccacgccccaggcccttatccaggccgataggtcctccccaaccctcagcctctaccaaggacctgcccagtaagcaagcccctcacgctcagtccctccctgacccacccaaggctgctcccgcagcgcctgggcgctgtcagcccctcagttccccaagccccgcctctcccccttgatgtcgctcacaaccccgcctcttcctgggcccacagctgtccatccacacgctggaggacccgcgagacccgagacacgtgcttgtcatgaagggcgcccccgagcgcgtgctggagcgctgtagctccatcctcatcaagggccaggagctgccactggatgagcaatggcgcgaggccttccagactgcctacctcagcctgggaggcctgggcgaacgcgtcttgggtgagaccccataccctgcccaatcttctgggccagccccaaccctgacctttcccatccttgttcgacagttgacctgccccaatctacacactcaactttgactttccctatctcggtcctgatccctgtcgtcaatgcctacctccacccaacctgtccttacctggatcttacctctcttgactcaacctgtgatctcttgattttccccaactcttgccccccctccaccccgatgaccagtccttgttttctttctcgtctgcctttcagcatcctcctccagacctttcgacttcctccagtctctgcctcaactcaaggttttccccaatccttgttctgacctctgaccccctcccaagtgttgtcttgcttccttaagcttccataacccttgcctcgatcttccactttgcttggtgtgtgacctctggcaagaagtgtcccttctccaaacctgtttcctcatttggaatatgaggatgctagtaactcctagagtggttgtggggataaattccaacacagtcgtctttcagtgtccataggggacggcttccaagacacctaccacattccccccacacccttattaccccacagatacca

SEQ ID NO: 40515 - DNA, 791 bp, Bovine  19866881326797
tcgcaccagtcgctggcagctctccacaatcaccgcttctgctggggactggtacgagcaaacaccatctcagggtgggtccgcagtgcctcgaccagatctgatgggtccatgtccttcagctgcatgccattaatcacacaggcacgggcatccctagaaagggacgtgggaggacatcactggggcctcagtccatgtggggtgtgggaagaactacaaggaggacataaggggacttacttccggttaacctggtccacgggcacacggaggcgggcagcgatgtcctccactgtctcactgccttctgaaatgatgcccacgctggctgcaatggccttggctgtgatggggtggtcacctgtcaccatgatcacctgaaggaggaaccagcagacccctgactccttcagattaacccacctgtccctgtctgccccagtggacattcctcagccacagtgatcagtttaaggatgaacatgtaactgaatgtggaataacggccaaagatgcattctttttttggtgtgatggctaaacaggtgggatgttattgagttggagctgctgggtggtggtcatctttgtccaccaaaatggaggactgcttgagaataaagccagcagagagaaaagtagagctgagacgtggagaaaggcaaattcctaaagacactgaactcctggatccagctttacccaaaccttcattccccagaacttttcagttcttgaaccaatgtgttcctttgtgcttcaagctgttttcaggtgagtttctgtca

SEQ ID NO: 40516 - DNA, 948 bp, Bovine  19866881390267
agcagagggtgggcggcaagggaagaagccgacctgctgggcaacgtgactgcgttcttggatgtgaccacaacaccgacccagggaggaaaggatgagacagggatgccctgggctctgcctctccataccccatacctcataccctggcccctttctctccaaggattctaggcttttcacctcgatgttcaccaagaccctgagaccctagcatgcagcccttccctgagcccaaggaggctgactcccagcccctaggtgtgtctgtaatgtagcaatcagggttgggcctcgcttcccacccgcactcaagttctggcagatttggggtggagtgggaagccatggcctgtgggaaaacaggggcttactggtattctaggagtgagaactaggagatcaaccagacttggggctggggtgacacagaggcaggctcggtgactctgcctgactccacttaccctgtgggatgcagtcaaagcaaggctgaacctgggaagatcctcctgctgagggtcccattaactgaactttggggactctctctgccaatgaggatcctcctatgcctctcttcccaacctgcccaaccactggacactggacacttgggaaacacaaactcaccaaggcagtttaaatgggggaaagggagagagctgggagagagggacagtagactctagattagcatttacagcataaatcatgtaaagccaaaattacccttgaaaatcaggaaggtgccaaatggaaataatcataagcccggcacggccagttgttttttgttttaacttttaattttatattggagtatagccaatgaacaacactgtggtagtttcaagtggacagcaaagggactcagccatatgtatacatgtaaccattctcctccaaactgccttcctgtccaggctgctacataacattgagcag

SEQ ID NO: 40517 - DNA, 725 bp, Bovine  19866881579512
ggtggtggggcccgcggcgtgcgccccacctgcccgccgccctcctcaccacacggagaggacctcgagcaacctccgggcatgcggcagcctcccctcgtccacgcagaagaagcccgacgtgccattggcgcccgccgtccgcacgtccagctccgagaagtccaacgccctgggcagggcagcggtcagacctgtccccccgccctcccagccccccaccaggggcaccctgggtacctgaggaagcccatctcctcgcagctgagccccgccaccctggcattggagcgcgaggagcaaagcaggcgccacgtgccctctgtctggtcgaacaccgtgagccgagcatccgccgggccgacctgcactgcagggcaacaagaggagcgcctgggtcgccttcccgcccgagccctcccggccgcttctctgctcgtgccagtctagtcctgagtcctggcaggcccgatcggagcaccccgggctccgcacatttgtgactgcctctggaagggctcaggactcaagctggaccaaagattggggatcctaagactctggctgcatcgccatggggaaactgggcaaggtgggggaggggcgttccttttgccaccgggattcctaaactggttgcccaagagctggaagctagatttgtcaaggtccatctttgcctgcaggagggggaatggggggcagcagtataaaccaattaaagg

SEQ ID NO: 40518 - DNA, 1523 bp, Bovine  19866881703771
tgtctttctaaagcataaacctaatatgtaccttcgttgatttggccttatttactgggtcattgcaaaccagcccctttcttgtgactcctaatccatattctttgctatttcttcatagcacttcatgtgctacaaagctatatagccttataacaagttatacaacttacttgtttattatgattaccatcttttgctttctctaaaatataacatctgtgaggctgcctaccatcttgtaagcattacatgttctctgttgatgggatgaacaaaccagaccatcagacaagcacctatggtcctcacctgacaatcaagaccttacatcagccagccccttgtggagagagatccccatttccttccctggagccccagacattgctgggatttgccagcaaggctcttgttgaggtcccttccctctcctgctcattgtcacccaacttttaaccttccaaacctatcaactaaaccaaaatctagctaactaaaatatattgtctccacaggacactcttacttcatgttgttgagatgacttatacaaacagtcaatttttgtgacattaacttccttacttgtaggaaaaggatatgtgttctgtaatgttctggtgtcatctcattagatcaaacttgttaattgtgtcacttaaatcctgatagactcttttacctgatatctgaggtttagtatctcctatatggttttaatgaaagtgcacatctgacctagtcaccctgcccagcttccagccctgctgtggcaccctagtgccctccagagaacaaccactgaaacagtctttcagccaccaagactatgcttggatgcctactgaccgcttgaccatcctcttatgatgctcttcagctcctgacttcccctgttggaatcaggctaaactaaagagggaaaggttttggtttataagcattctccttgccagtaatatttccaaacttagcctttgcattactagctcttcattatcttttgggtctcagcttacagatccctttctgccagaagccttctctagtccccctgatgtccctcttctgagctccctactgccagcctcagtcaccctgcctgggcttcccccatcccggccctgatcactctggctgtcactctggtgatgagtatgttctttcctgctctggaccaggagctcccgtagggcctgtggtctttaggtgtgcccctagcattgcccaggacagggcccggcccagaggagatcatcagtggtaagtgttttgctgaatgaacaaatgaaaaggaccccacatctcccagagggttccccaggctcttcggcagaatttcttgggtgctcagagcacccacaggcacataccttgccctgagtgccccagtcccccttgacacacaccctcatctctcccacagctgtggcccccccagagtgccactattctgcgtccagccttcgtccctcacgtgctgcaaagagcaggtgagggggccaaggtcatcatccctg

SEQ ID NO: 40519 - DNA, 1287 bp, Bovine  19866880214049
atcttgattccgcttatgcttcttctagcccagcgtttctcatgatgtactctgcatataagttaaataagcagggtgacaatatacagccttgacgtactccttttcctatttggaaccagtctgttgttccatgtccagttctaactgttgcttcctgacctgcatacagatttctcaagaggcaggtcaggtggtctggtattcccatctcttgaagaattttccacagtttattgtgatccacacagtcaaaggctttggcatagtcaataaagcagaaatatatgtttttctggaactctcttgctttttcgatgacccagcggatgttggcaatttgatctctggttcttctgccttttctaaaaccagcttgaacatctggaagttcacagttcacgtattgctgaagcctggcttggagaattttgagcatgtgagatgagtgcaattgtgcagtagtttgagcattcttggaatacacttttactaatctgcaaaaaatttttttctaaggcatatccataaagattttataatataaggaggcatattgctcattaagaaggggttctacaagaaaagcacttattaagttagcaactctgagaaggaccaggtcagagatgaattaaatgcccaacttcagaagggatgggaaggtttaaaaaaagaaaagcttaagaaaacacttactgttaatatggacatttcttcatcatctagtgtatttgacagaaattaaccttttcaaagttttacccatgatactttcaataatttaattagtataaatttatctccatattttgtcaaaatagtgttttcaccttttaataataacaagtgttccacacactgcactccagtgccctcaaccagaggatactttgccagaggggacatgtaaaaattcttctcaaaatctcaccaaagctaatacactgatttttttccaagcaaggctttattggggcccctgctgcagcgagtggagaaggcgatggcaccccactccagtactcttgcctggcgaatcccatggacgaaggagcctggtaggctgcagtccatggggtcactaggagtcggacacaactgagcgacttcactttcacttttcactttcatgcattggagaaggaaatggcaacccactcgggtgttcttgcctggagaatcccggggacgggggaccctggtgggctgccatctactggggtctcacagagtcagacacgactgaagcaacttagcagcagcagcagctgcagcaagaaagag

SEQ ID NO: 40520 - DNA, 4281 bp, Bovine  19866880859780
gatgcttctggcaccccatgcagatcccatcacagcacaaacacatctgacctctggctccagtaagcagtagatgcgaatcgcttgcagctgcctcctccccatgctggcctcagcctgagggatatgagccactcccccccaaggttacaagtcactctggcccccacaaacctgagcaatgactaaatgacaaggcatgacaaaggtaccccctgcctcatgctgggacagctctgatacgattcatgctccagagctcccggagggatcaggctaagagggtgcccagaagaaatcacatcctcattggctcctccctcgccccactccatcctgcttctctgagagcacccccaaagaagaagcgctctctcaggctctctttcttccgcatactatttagctaggatgcctgtgtcttccaaagtcctgtgcagtttagatgtgctccgttgagcttctgtccagcctctcaacactaagttccagtgacccgagcatgtttttagttgacaaaaccaaccctgctctctgagattagcccctcttcacccactgcaggctgatcttccctgtctagggcctgccaggtgaatagctgtttccagttactaacaagaataatacagtcaaagcaacactagattttcttctaagagctaaaaagagttccttttcaagcaacacttgcaacccccctctcttgcattctaaaatgcaaaagacaaacaaaacaatagaagatgcctcaacccagcaattctattatcagttcttagacagctctttctccctccctcccccatcccaaattggtctttatctcccccttatgtattctctacacagctggaaagaccactgaatctaggaagaaaatgggcaaaaccatccagcttcgttgcaacaaaatggcacttcctccctggatatccacgtgtcagctcttttgccatttctaaaagattgctcaggctgtgactccctgctggacactccatcctgttcttggaatcttgatgtgggtgggaaggacctctcgatcgtagggaccagattttcaatctgctcagcagaacagaatcctataatttgggggcatggagctacaccaggaaaatatcactggcttagaccacctgggtcacagtgagggatgcaatgatcgctcagggggaaaggggaggatgactctacgcccacccactctaagcatgcagtgggcaaagcgcatcgcttctgatagcaaataagagaataactgttgaccatctcaatgaaagcaatgtgtctgggtcgaaatgggcttggtaagatcttttctctctaaagcccaagattactgatgactccgtcttccgaagagattacatttgtagcagatgttgctgaggacctgcctaagggctttttcccacaccacaggaaatcattcagctgcaagcagaggaaaccggaaatgcaggggcgtagtacagtcacaccaactgatggggctgggaagagataaaaaaaggcctggctctctagtctgctgtcagatcccctgaaccatgctcaagaagttcctgctcagggagtccccattgggtggaataaagctcccaggctcccaacaaggcaacctgctcatctgtgcaccctttattgactcatttactttcccagattattactgcttcctgagatcacctatagagaaactgcttgcatccaaatcttctcattgggtctgagttgcgggaacacaaatgaacgatctatccattttatccatccatcccctatccatccacccatgctattcaattcccttttaggtcccggttactgtacttgcatgggttgcagagggggcagtcaggcaagtacaaagctaaataagatactcttcctccccccagggatctctcagtctacctgaaataaacaatcatacgatggggcagtgctagaacagacagagacaaattgctatatgaacacaggggagagaagagctaactaagctagggcatcaagggaagcctcagtggggagacagagtgtctaccagctgtgtaggatcagtagtaccctggaaagatgccttactggaagagggagggtccagggttggcttaaaaggtaaacgcttacattgctattgctaagtcacttcagtcgtgtccgactctgtgcgaccccatagacagcagcccaccaggctcccccgtccctgggattctccaggcaagaacactggagtgggttgccatttccttctccaatgcatgaaagtgaaaagtgaaagtgaagtcactcagtcgtgtccgaccctcagcgaccccatggactgcagccttccaggctcctccatccatgggattttccaggcaagagtactggagtggggtgccattgccttctccgaacgcttacatacatgataccagaatctctcaacatcattggcagtgtctaaaattttctccttttcaggaagacaacttttatcgactaaattcttacatgatatgagctccctgatattatccagtcaacaaagaagaggcaaggatttccaggtggagagaagagaaggtgaaaggcatggaggcacagactcgtacggcagttagttagatttctgggtgtagagtaagtggtgctgattaagcaggtgaaggccagattgtgagccccactaaaagccattctcaggagctttcactttttcctacgggcttatggcagtcacagagcttgctgaacacaggagtgatggctctagagtgatctttcaaaacacttaaattgggcttcttgcacacaacatatataattggatcttctttttattttaaccccctgccagtggagaaaactcttgttttaattggtgtatttagatcagtcacatttaaagtgattattgacattagttggaataatgaccctcatttttataactttttcctctctgttgttcttaattcttggtgctttaaaaaaaaaaacttcccctctttttctgtcttctctgattttaattcagcattttgtatgactccattttatctcatttcttagcatattaattacatttctttttggtttgtttttaatttcatttctttaaaaattttttttgtgtgtgattgctctagagtttacaatctgcatttacaactaactcaatgaagaccctttttcctaaaaggcaactcttttaaacaacactataatacttcacagataggatgggtaccttataacagagttcccaatgcctcactcccagcccatggaacactgttgtaattcactaaatctttcaaactgtgaggctgaacccagtgtggatgatgaacttcagtcagacagaaataatctgacagaactttaaaatcttggaggcaagagctgataagcaggagacagtttgcaaaaatggctaacatcatgctttcatggatgggacactgaccaacgtgctccaagcaaggacttgcaaaatacccccgcactgagacagggcctctaatgaaagtgttagttgctcagtcgtgtctgactctttgtcaccccatggactgcagccacctgccaggcttctctgtccatgggattctccaggcaagaatactggagtgggttgacatttccttctccaggggatcttccagatccaggaatcaaacctggttctcctgtactgcaggcagattctttaccatctgagccaccaggtgcttaaaagctgagtatcattgttatttaaaggccaagcttagttcagtaacaaacaagaaaccttccctttagtgtgctgtgggttgtggtctgatcttcccagacgtccagctgccagcacatcagcctcatccatcacagagtctttagctactgtgtccactttctggaggctgccagcagacagcccagccctccattcactggcctttttaataacattaggaaaaccttggctccagtcaccctctggttcttgatatttgggaacactcaccagcctatctattttattaaagaacagttgggacacagtgcaccctgcccccacatgcacaccttaaatggaaagagggcaggaccagaagatttatgactggtgatttggcatgcagcgagcccaaaggagcacagtgatgtccttgttgttcaggctgggcggaagctggctcaccaggtaccgcctgcatcctctcaccccctctgtgggacacacctcctttccagcttcccataagccaccagccccagcaacgcttcatc

SEQ ID NO: 40521 - DNA, 1329 bp, Bovine  19866880862424
ttaccaaagcaggcatattctcttacgtcccaccatgcagacgttagtctgcgatgtagaggccatagccagtgatgaccagaactggacccaggaggataaacttttgcttgagagccaactgatcttagctacagctggaaccacatgtgtctagacccttctgtatcagtagcctgcattgcaaatagacttgctctataacaaacaaaagctaaacactcttcccatgaaaaggagcctcaagaggttttcggcgcctgctctgaatcggcaacagaagctgtcccattgtccacctcctcctgagctaagaatcctgacttcttgcaaaaaaataagagaaagtaaaacaagtgggcatcatggccttaagacttttaaagcaggcaagtgtgtagatacgtggatacagagaccctgtaacttggctgtcccagctcaagtggatgtgcagaaatatgctacagggaagaagcctgtcagatacgaggagtcacaaccaacccaggaggtactaggtgattctgcagttggatgtgaggctgcctaccaatcccaggcaacaaggttgaccgtcaggcagccaactgataattcacttgccactggaaatgggtctgagaatgaagccacaagggagagagagccgtgtctgccccagccctccacagatgaccagttcaagagtttcctgcccaggccacaggctgatgctgggagagtggtcagtcgatccgagcaactggtccagaagagcgcccagtgtccagtgcagatgtcacccagctccagtggctcagcccatctcaggcagccttctccagggacacggtcagcacagcctagggctgcatccatccggtcctcagtgccagaccggggagccagacctccacccccactcaagagacgtccctggagcctagagaagagctcctgcagtgacagctttacctcacagcaggcgggcagctctcaggcccatccatctgctggccctgctcctcagccacccagtctttcccagagatcatctgtgcagctgaacagaagtatcttgcttcctgcagccgccccgtccaccgtagtcatgttacaaagaatcccggatgtccaggtcacgaccatctcccctggcctgaaggagatcagactagtgggccccttttgctgtagccaggcctcagggagagggtgtgcccctagggcccctgctcctgtggggatccagccgggccagcagcccgcagctcagccattgaacctgcagcccgcagcaccactggggcttcctccacctgctttttcttccttctcctactccca

SEQ ID NO: 40522 - DNA, 2353 bp, Bovine  19866880972408
ctgcaatgtgacttaccgtaagtctgctgcccatgcctattggcatgaaggttttgatttcactgtcatccatttcctgttcatgaacagtggtagcagctgctgcagcaacagcagcatcttcctctcctacaatcacttccatataaacttcatctgcaatttcagcaacatctgagtacaaaattaacagaaccacttttgtgaccaagtttacagaccagataggaaaaatatttttatttgaattctgttaacaaacagaaagttcaagtgttacatacctagaatactactttcatatagtaaatacactataaacatttattcaatgaattattttcttggttttcaccataatttgtttataaaatggtatcttgagtaaacaccaagaatcactgatatttttctttgcactatggcagtacaataatgtctgccatagtacgactttttttccttcaaatagtggtacagttttaaaaatttaaagcataaagaaacataaaacgctctcccacaaaaaggccacctacttacttaaatcttcatcttcttgttgagagtcattgacagtcatataaaccatcttttcccttggcatacgaatactgttattctgatcaaggagttcaactccatgatcattctcaggctcactctccacaatgtcgacagtcccacctatgagggaagatgacaattccaagtatttatgtgaaaacttcatttcctcctgtttcatcttaataagcaattagctttttcaatattttgtattaatacaataaaaacctgttttaaaagttatcttcagaaacgattacaagtattttcagtctaaaacaccctaaagtaattaggttaaagtgtttgatggggatattcccatgtttagcaggggaaaagaatctctctgccactgcagtagaggcaggtttgatccctgggttgggaagataccttggggaaggaaatagcaacccactccagtattcttgcctagagaattccatggacagaggagcctgatgagttacagtccatggggtcgcaaagacttggatacaactgagtgactacactttcactttcaggaaaccaataccacagccgtgctcattcatttatatattgtctataggcttcccaggtggcactagtggtaaagaactcacctcccagtgcaggagacgtaagatacatgggtttgatccctgggtcaggaagatcccctggaggagggcatggcaacgcacttcagtattcttgcctggagaatcccatggacagaggatccttggtgggctacagtccacagggtcacaaagaattggacacgattgaagcgacttatccagcatggttgcttttacactataacaacagaaatgaatagttgtgacagagaacattttctatctacccctttacagaaaaactttgatgaccccatatgcagattaaagaaatcaagtccttaaaagtcacaaactatcaaaatgcacccaataaaaataaccagaataatcccattcccattaaaaaaatggatttgcagtttaaaaacctccaaaaagtctcctggcctggatgatttctctagtgaattctaacagacatttaaagaagaaataacaccaattctacacaatccctgccagaaaacagagaagggaaaattccccaactcattttacgaggtaagtattatcctgtgcacaagccagatgaagaagaaaactacagaccaatatccctcatgaacatagaagcaaaaatcttaaacaagatactaaaaatttgaatacaacaatatatatattaagaagaataccccatgacccagcagagtttattccaggaatgacagactgattctacattcaaaaattgttcgatgtaatccatcatattaacagaccaaagtagaaaatccacatgatcatttccaactgagataatagatgtatgtggttttaagctgctaagttttgtgataattttatactcagaaatatataattaatattagcaacacagttaatattagtattagcagctcatctattccccctttatttcttcccctacccatctcattcccccagagaaaatattttggtaacctctagggaaccactaacctgagtgtgttatctgtctcagacttttaaaaatatcagtacttttacttaaatgtatacatgtccaaactatacatggtatattttaatgttttcatatataaatggtatcacactgtgtgcaattcttctgttaagtattcttctcttaatcttgtactgtgatatccatccatgttctgtgtgtagatctgttcattcac

SEQ ID NO: 40523 - DNA, 1727 bp, Bovine  19866880779578
gccctggggtgatgggcagttggatagtggcccagagtgtatttgccccataaaggaggtggttgggaatatgggctctggattggcatttgaaaagtacacacagggacatgttgtttaccatctctaggaattcactgatcttaggaggggcagtccctccagggtcagcaaggcctcagatgttaaatcattgttgttattcagtcggtaattcatgtccaactttgcaaccccatggactgtatatagtccaccaggctcctctgtccatggaatttcccaggcaattatactggagtgggttgtcatttccttctccagtggatcttctggacccagggactgaaactgcatctcctgagactaccgcattgcaggcagattcttatcactgagccatagggaaagccccatggactgtaatccaccatgaaagcattagaatacacaaaatatattttcaggggactttcctggtggtccagtggttaagactcactctcagggcagggagatgggttagatccctggtcagggaattaagatcccctgtgccttgccatgcagtgtggcttaaaaatgaattggaatacagaaaatataggacatgattaatatacagagagagtttggaggttgaccagcattgttacaaatcttggttttgcttgatttaaaaaaatagttttttatcttttgaggtaaatacaatttatagaggtctgtaatttgttttgaaatcatctagggtggagtgggaaataggtgtaggaaatgtatttagactccatttttttctaaaaataatctaagatgattctctgccagtaaatggttgtacaatgtttcagtaagttacattagctttatgagtctcattttcctcacctcttggataggaatagtaatacttctctcacagataaggtactggagaaatctaaaatagggacaaaattaatattattaataatgtggtatctgcaaatgtcttgtatcttagtgtctgatatgcctggctatgaactaagatgaacataaatagtctgtttcaacaagtatccgtttcagaaacagaattgtggttttggtccctgataattatagtgtgtgttttcacttttataagggtcttgtttccaaagtggtgatatctagactttttaactaacaagttcaccttgtttagttataatatccggttttcatttcaaactctttgctttctatcttttaaaacatgtgaatatgcattcttgattaatcatgtatttttctatctgagaaaccacagatcctaaaatgtatactgctgatatggagtcttatataggaaagattttctggggttgaagaagaaatagcataatagaaaaattatccagctagagagaaagaacatggactcttttcaatgtaaaacatttttttttgagaatcagcagggggcactaagcttccacaggagaaatatatccctctagcattcataaattatttttcttttgctttaacttcaaactgataacaccataaactctgtccttttttatctttactatagctgataatgtattttttctttttaaccctcaaggtatacgtgcatgtaacaaatttaactgccaattaaaaaaaaaacaacactctgattaactcatctgcatgctggtttactcctcattcaacattcaaacgcatgctattttcctctctttgacaaa

SEQ ID NO: 40524 - DNA, 1265 bp, Bovine  19866881188449
atgctagacagtgcaataagcactttatcaaagtgtgcctataattatctgcttgccgctaagtcacttcagtcgtgtctgactctgtgcgaccccatagatggcagcccaccaggctcccccgtccctggaattctccaggcaagaacactggagtgggttgccatttccttctccaatgcatgaaagtgaaaagtgaaaatgaagtcactcagtcgtgtccgactcttagtgatcccatggactgcagcctaccaggctcctccgtccatgggattttccaggcaagagtactgaagtgggttgccattgccgtctctgaattatctgcttaacatctccttatagatgccttaccagcacttcagattgaccaggtctaaacaaaatacaatttccccctacactccctagcacctcacctatgcaccagctcactatcctgacttgctctcaacatctccaacaatacatgggtgcttaagttctataactattaatactctgatattaatgaagcagaaggaatctttcagatcagccagttctacctccaaaatcttcctctacaggatagattttcaactttttagctaccatgtgtacgaatcttctgagattgtggataatgatgtgtccttggtctttctgggaacaatatccttagctgcagaactcaaaagagtttaaacactatgaactaggctcaactgtgcctcttctctcttctataatggccaaatccaatttattaccaaattctgcccattcaaaattccatatctctgtaaggcaaatgtatttctccttcctcgctgccactaacagatcatactcataactcttagattgcttcaacaacaagagcaggaaaccctgctagggagcagtctgtccatggtaggagggcatgctaagtcacttcagtcatgtccaactctttgtgaccccatggactgtagcctgccaggcttctctgtccacgggattctccaggcgagaacactggagtgagttgccataccctcctccaaggaatcttcccaacccagggatcaaactgatgtctcttatgtctcctgtattgatctgtgggttctttaccactaacaccactgggagggcagctggagcttgatcacatgtgaacacccatgacaggatcaggtgggcagagataattaggaaatgaaatcaaagccacatcagtgggaagatgaactgggactaaacctgggcccacactataccagatggcatcagag

SEQ ID NO: 40525 - DNA, 1444 bp, Bovine  19866881361340
cttcttttaaaatgtggctattaggatattgaacattacatccatggcttgtatttgtggcttgcatcatatttctcttggacaacactgctctagataatgcttgtgagtagctattggtgacagcctgaggagagttgagatctctgtggagaggacagagaaaaggaagtgcatagggttgaggacataattgtggagatgcccgcgttcatagatgaaaggggaggctgagaaggacctggagagtgaacagaaggtgaagaagaaggaactatcttaggaactggaagaagagggcattttagggaggagggtctactcccttcacgcaaaataattccagtaattcaaactttatcctattgcagaggttcttccttcagaaagcgaaatgatcaaatttaaattttgagatggttttggcaacaaggattgggttgagggagaagctgaagtccaggtggccagttagaaattcagggaataagaacccaaagcccttaagcatctaccaagccaaacaggaaagaacagttttcacttggagaaagaactttctattttattttttgccatgaaaaatgaggtgagtgagattttgataatttaaagcatgtgtcttctgcttctagaatccaggaaaatgggttgcaatgaaaatccatgtcataaatgattaaagatcctttgtgcgggaacacagaaagatgtaaagaaaccaaggacacaaaaattgtaggatttctaagaaacaatggttgtctttttgtataaatgtctcacataggaaaaagagaagagaacattattccgcatccttgagagcgtgacagcaggaagaatggtttctaaaaagagttttccttgaggctctgactccgtaactcaagatcatttcaggtacttctgagtgtttacaaattgaacgagctgtgtcttggggatgtcctttaaacagaaaactgggtacataaaatgatttatttggagctccatttaaaataaaaaacagatcgaagtttatgaaagtaaaaaattcagggtaccaagtaaaggtgagctgaatgttttgaaggcatttggatactgtttaaattaatgttttaaattctctgctggtttaaaagaaaagagggaacaaatgatgataaaagaaaaatcaatgagggactcccgtggtggtccagtggttaagattctattcttcctgtgcaggaggcatgagtttgatccctggttggggaactaagattccagggagtggccaaaaaaaaaaaaaaaatcaatgaaagtagttctattaggaaactaaacaagagggaaatgactgattcattaaagatacttggaagatagtcctaggtggggcaccatatacagaatttggataaaacccatgcctgggcagaataatagtaataataatcaccaagtagcagca

SEQ ID NO: 40526 - DNA, 795 bp, Bovine  19866881890685
gggtaaatagcagcagagtagagagggaaatttagaattaataactccagggttaagtaaatcttcataatggtggttaagaatatgcctgtggactggacacatcttctaatctactatatttcatacagaaagcaatttcttcttcatattgcttttcatgatgattgagaaaaaacagaaagagcttgtttgccaaaatttttgctctttttatttaaaaaaagtgtgtatctgtgtgtgtgtatatataatgcaaattcaatttttattaaaaagaaaagatataatttatatcctctcctcattttatatttcaattaagctaatttctcctccttatcctctgtcttttgaatcaaattcggttggaatgtggagagtaatgtcacctttggtcaaaaatggacatctttgcattgacatagtcatttccactatccttccctgacttctgttacacaaaatgaaaacaaaagctgataaaggtgtttaccagaagaggtggaagtgggaggcaggaggaatgaggagaagagaatggaagagaaaaatacattttaagcattacaatggtattgtttccattacttctttccatgtctgattccactgagaacaatgctcctgctgggtgccctttcttctgatacagtacacttttctcactgaactccattgctccttgttttgtgacaagctttgtgcagagggggagataaacactgccttaactattttgaatttctcaccttgacattgactctcacaatttattcaatttgtttttggttg

SEQ ID NO: 40527 - DNA, 678 bp, Bovine  19866880716478
ctagttatggacatgcttaacattctgatttttaggtaaattatatccctcacaccaccccctatgtacagcatttccacctagttttgaggcttgtatggtaaactattttgaaaaacagttacttggtgtttttatataaaggttccagagtagaaaaagagaagcatctgttaaaaaactgggacatttctagggctacaatctaaaaatctatttctaacactgctttttggcattccgttaaaaaagttttttttttttttttttttaagcaaacatatttagaaaaattaagtggctcataattcccttcagtaactaaacagctcagacaaagctcaaagaacaggcattttggtggtggtgattctaaggcataatggaaagaacggactaatgtaaagggtacataaacaagctcaaagacagctatacagaagtacaaggtttaggggcccaaaagctggaaatctataaatgtgggagtggtgcagaaaaggctggaaggtaattaaaaatgctacttaaatttagccctccaccaagaaagagaaagcagaaactcctcccaccttttcagagcctatcagggtaaggaataggggtgaggactgtgtaactcttaagggttggctggagactctagcaattattcaaaatatttaattatctaat

SEQ ID NO: 40528 - DNA, 866 bp, Bovine  19866880863642
catggaaacttacaaagatccatgggtgaatggcgtcccattttgaccccttaactaagatccactgagtactcacttacacttggaaggacttggaagtctcgaaggcagggaagccgtgtccctccacccaggtgacaggagatgtctcctctgttgcaggactgacagctcctttagcttcatggcattcttcttcaccttcatggcccagctggtcattagcatcatccaggccgtgggcatcccaggctggggtgtctggtaagagaccagggtgtctgggactgacccagggctagctgggcggcaactggggtgggtcctttgcttacttctgtgggctaagctgcctggcctgtgggaacaccatgagttattggaagtgtgaagggattcaggataacttagtagatacagcatagcatcagaggagaataaggcagtggtttttaggggtgatgagggatatcaagcatcatgagataacccaagagaaggaagccttatgctctgagaagcttgtttcctgagccaagggttcttcctaaagcactgacacaggccctgtccatccattgatatggtctctctctgtggcaatgagaaggtcccttactctagtggggcggctcctgggtgcccgtcactgtgccaggcagccccacagctggcctgtctctgcagcggctggatcgccaccatctccttcttcgggacgaacattggctcagcagtggtgatgctcatccccaccgtcctgttcacggtcatggccgtcttttccttcattgccctcagcatggtatgtggccgcctctggagctacagggtggtgttgggagggaccgtgatctgtaacgacc

SEQ ID NO: 40529 - DNA, 1246 bp, Bovine  19866881015156
cgggggaactggtttccagcaaattggtggctccccacgtggacagaatggaatgtgttgagcagcaagtggcaggatcctgacgaggcgtggctggagcagtaagggtttacttgtctcctcagtgagaagccccagggtgcacagtccaggctggcggcatggcctgccgtgtttttagggacccctgtcagccccatcttcctcttgtgtgtatcacaagatggcatccttggtccagacttcttgccagctctaggtggaagggagaaggggcaaagggagggacttgtgcctttttctctctggcatgactgtcccagacccccagctgccagggaaccgcagtggggagtgtttggcatcgtgaccttaaacaaacccagcgttctgttaggcaggaaggagagggtggggtggggcagggagaccggaggctcagggaaggggtgagcccctcttatgtgctgtagagggacagggggcaggcagagccttctggagctggtcctgtcactgggcctcacaggtgtactggggggaggagcacagccgtgcaaaggcccagaggcaggcagtacagagggagtgaaggccaggaaccgtgacaaagctaatggggggccgtggggccataggggagtgcctggctgcgtgaactgatggatttcttctttattgtttctgagcactgaccctgctggggggcggggtgtagacacagggttgcactaggctgtggttggatttagcgctagttgtggtctcaccaaggcaggtgttatcgttgctcccatttacagatgacgacactgaggttcagagaggccaagtgagctgcccaaggcttcccagttaggaagctgcagggctagaccgcccccccctcctccacagaccctgcgcactctgctgcctctgcaggggtgggagtgaacgccaggaaggcagtgagcagggggcggtgggggcctgccttcatcctgatggaggcagcgaggcccagttctggaagggttctgagcagggtgggtgcagctgtgtctttgggtgcagggtggttcgggcagggagtgccatgggtgccaggcccaggatgagcccccatggcctcccaggcatgcagaggcagagtgtgcactgcacggagcggcaggcggggcctgtagacgagaggcactgtgaccccctggaccggccggatgaccgccagaggaagtgcagcgaggagccctgccctgcccgg

SEQ ID NO: 40530 - DNA, 680 bp, Bovine  19866881141917
cgggcaccaccttcacctatgcccgcacaggcaactgggagaacctcacgtcccctggccccaccgacgagcctgtctggatccaggtgactgccttccggggccaggcccgggcagggcagaggtggagtgcgtgggacccagccccgtggcaggagtgtgccctggggcagtcgcggagcctggctctgaaacggccccatggggtagccccaggtcccggaggtagctgaggtcggctcctttaggatgggtgtcagggctgggttgcgggagaggccatctcgtgctcacaggactcccgcctgcctgccccagctcctgttccaggagagcaaccccggggtgcgctacgagtacatcatccacagggaggcggacggccacgaccacatccagccgcctgagttctcctggcgctatggaccctggtccaaatgcactgtcacctgtggcacaggtgagggagagggctgggcacggccgctgcccagcggggcctttgtctctgggcggtgaggcccagcttcagcctctggctcattgcttgtttgcggggcctctctgagctcggaatgctgcttctgggcctcagtttcctcatctgtataatggggctagcagtggtcctgtctcatggatccactgggagagtaaccaaggtgaggcaggcaggcaca

SEQ ID NO: 40531 - DNA, 1405 bp, Bovine  19866880072074
tgatgccatccagccatctcatcctctgtcatccccttctcctcctgcccccaatccctcccagcatcagagtcttttccaatgagtcaactcttcacatgaggtggccaaaggactggagtttcagctttagcatcattccttccaaagaaaccccagggctgatctccttcagaatggactggttggatctccttgcagtccaagggactctcaagagtcttctccaacaccacagttcaaaagcatcaattctttggcgctcagccttcttcacagtccaacgctcacatccatacatgaccacaggaaaaaccatagccttgactagatggacctttgttggcaaagtaatgtctctgcttttgaatatgctatctaggttggtcataacttttcttccaaggagtaagtgtcttttaatttcatggcttcagtcaccatctgcagtgattttggagccccaaaaaataaagtctgccactgtttccactgtttccccatctatttcccatgaagtgatgggaccagatgccatgatcttcgttttctgaatgttgagtgttaagccaactttttcactctcctctttcaccttcatcaagaggctttttagttcctcttcactttatttgtgtacaatttctagttctttctacagtggacatgtattattgagtcttttaaaaatggcagctgtcctttgattttttttttatcctgagctcctaacaagacctttgccttataacgatagaattcagggtaaggtccaggaagatggaacccattgagttggtgtcacacaatggactctacccaagagataacaaatggtacagtaaccagctggcccaggaaaaaaggatctgcttaactcaggatagtcagggaaggcttcacagaataggaaatattttatctgcaatcatgaaggaaccattaagagttcaaaggcaaaaatgtggaggaaagaactgggcaagtcattctacacttttgagtctttgcctttttgtctgtaaaacgggggcagtagcatgtttcattgggtttggaggccaattaaataagacaggtatatagatgttcccctgccccccacaaccccagttgtagcacagtatctggtgcatattaggtaatgaggagctaattttcatttttgcattaaagataaacattctggaagggcactagttttggcttttaaggagttcactcctgttctcatcttttcactgttctcatcttttcagcaggccgaggacactggctagtggctcggaaaggtggcctcaagaagaagcccaagaatgtggctgagacaacagctgaaggtcaggaaggccagaagatttcctttgaggtggagggaagaaagggtctcgacaggaaaaccaag

SEQ ID NO: 40532 - DNA, 731 bp, Bovine  19866880358812
ccgtaagaacttcgactcccctctcatgtaggccagtggtctgggccccgggggattgtccctcctggtcaaagggcatgagaatgaatgggctccagggaagggaacatctgtgggtgggaacctcctgctcagggcttccacacccttctgagctgcctggtcacctcgcactgaccctggccatttctgtgtcctctgtagactgcactccttgagggcaggagatatactcaactcatttctgtatcctgcagggcccccagctcagggcctggcacatagcatgaatgaatgaatgatcagtgatcaatcctggggtgcagagacagggccagactgtttgtagtaaatgtaatttaatctgaagctaattaaactccccctgctttggtcagagctgggcctagggtcaggtcaggcagagctgaaccagcagtgttatcaggagacagagactgaagtcaagcaggacctgagctggaaagtcttcccctccgcctcgggggttccaggcgtggccctgctgcacatttgtaggtggccttcagtatgtcatcctcacccttgggcttagtgcatctgtgcactggggtgggaaaaagccctgctgtctcgatttccctaccacctccccagcaaacttctctgagcctcagttcttctgagtgtgtaagggggtctaggcttccctgatggtgctagaggtaaagaaactgcctgccaatgca

SEQ ID NO: 40533 - DNA, 1248 bp, Bovine  19866880440296
tcctcatttgtatttgagaaatctgaggcacaaagaggtaaagtgatttgcccagggtcactccgctcagtggtagaaactagcctcaaacttaagtccctgtctgtaaaattgttgcctcttcctgtttcacccatctccttgtcatatgtttctcttctgggaaacattttctaaggacacctgatcccagctctctactctgctcctcccatggactgaatcttcccagaccctccatcttagggtcctaccttcttgccagggtctcctttcccctggccaggggcttaaaggctcctaaacctctgctaccccaaattgtctaaagctatcccaaagcaggtttaggaattactgctgctactgctgctaagttgcttcagtcgtgtctgactctgtgcgaccccatagacggcaggcccccaggctccgccatccctgggattccccaggcaagaatactggagtgggttgccatttccttctccagtgcattaaagtgaaaagtgaaagtgaagtcgctcagtcatgtccgactcttagcgaccccacggactgcaccctaccaggctcctgcgtccatgggattctccaggcaagagtactggagtgggttgccattgccttcttctaggaattactggatccctttaatgaaaaatctcagtctctaagagctcagggtttaaagaatttagatgttcgattagaagtttcttttcctaaaggaagtggcattggagcctaatcttaaagcatgagatcagcgagatgaacaagatggaagagctgttttgggccaaaggaacactaagaacaaaggcatggacctgtagggcctcagagaaagggtgtgtgttgggggtggtcctggtgggctcataggctgtgctggggtgagagcagccctgcccctcctcactccttacttccttgttttccgtgcttggctctcagggtcatggcctctgcagaactctataagctggatgatgggaagcctcacctgagcaactgctttccagctaaaaacctgcttcggacaccagaggaaggtcaggtgacttctcaaatcagaacctttgcctcacactcagcacctgcttcagaatgtctctaacacccatgtcttcctcttcaacccattcactaatgtttcctgccccatcctatcacttcccttctaatccatcttcccccccagcagcctcagggagtctaattttttttttatcctattcatgt

SEQ ID NO: 40534 - DNA, 3350 bp, Bovine  19866880463938
gtagctcaaatggtaaagaatctgcctgcaatgcgggagacctggctttgatccctgggttgggaagatcccctggagaagggcatggtaacccactccagtattcttgcctggagaattcccatggaccagaggagcctggcgggctacagtccatgggcttgcaaagagtctgacatgactgagtaactaacactttcacttttgtgtatctgtttaaaatgtcttatttttatacaatttttcaagattacttttcgtttacagttattacaagatgttggctatattccccatgtacagtacatccttgagcctaacttatgcccaggagtttgtacctcccacccctacatggcccctccatccctcttctgcgcttggaaccactagtttgttctctgtgtctgtgagtctgcttcttcaatttttttattcactagtttgttgtattctttagattctacctataagcaatatcttatatgggcagtttttctctttctctgtctgacttatttcacttagtataatgccctcaaggtccatccatgttgttgcaaatggcaaaatttctttttaatggttaagtagtaccccattgtatatacgtcccacagattttatctgtttatctgttgatggacgcttaggtcgtttccttgtcttggctgctgcaaataatgctgctttgaacactggggtatgtttttgaattagtaactttggttttttaaaattatttgtttacttttggctgtgcggggtctttgctgctgctcggacttttctctagttgcagggcgtagcggctgctctttgttgtagtgtgtgagcttctcattgcagcagcttctcctgttatggagcgcgagttctagggcatgtgggcttcagtagctgcagtgcatgggctcagtagctgtggttcccaggctctagaacacagactcagtagttactgtgcatgggcttaggtgctccatggtgtgtgtgatcctcccagaccagggatcgaactggtgtctcctgcactaggaggtagattctttaccactgagctactaaggacgcccagcgactttgtcttttttggatatatacccaggagaggaatttctggatcatatggtcatgctatttttaattttttgaggaacctccataatgttttccgctgtggctgcacgaatttccatgcccactaacagtgtacaaaggttctcagggaaccttctcatgtacaccacagtgttctcatctgttcagtgaattctcactgctgttcctttacctttctactctaccccaggccttgatttatgccctgtttcatagtgttctattttgacatagctttaaaaaaaattgttaatttttttaattgaaggataattgctttacagaattttgttgttttctgtcaaacctcaacgtgaatcagccataggtatacatatccccttccttttgaacctccctcccatttccctccccatcccacccctctaggttggtacagagtccttgtttgagtttcctgagacatacagcaaattctccttggctatctattttacatatggtcatgtaagtttccgtgttactctctccatacatctcaccctctcctcccctctccccatgtccatgagtctattctctattcacatagttttttaccatttgcctggaatgttccagcccttattccagttgtccagactcctcccatcccacaggctcagcttgtctcccacaccttccagtaagccgtgtccagctactccagccctcagtgcccatcctctcttgtgagccatcttcctttttgtgtttcttgtttgatgtatagtcatagtctgcctagctcctaaataaagtggcttaaacttgactctgctaaatagtttttcaagcatttatctaattaaagactcccctggggcagggacccctcctaatgctgagcagagtccggcacatggaacactgctgagaagtgtggtttcactggattggatttattgctctgaaagtgtagagcaagggaaaagtacccctagcttaccctggatcagtggcttgctggtcactctgtacatggaatagtggaagaacctactcctttagcttgtcctccccacttctcttgagtgattttacttttcacataggaccttctgtggccacctagttgtttaaaaccctcctgtggagctgtcagtaagaactcatgatttcatgcccacactccctcgcacacacatagatggacagagaaataaatacagctgtatatatcttcatgtgttagtatacatatgtatatttcctggcccacggagggcaataatacctcagttgcaaagggatgcttggcacctcagtgttggtttctaaataccattctcgaatacaagaagccagggcttctcaggcaaaaagttgtttctagggctgagtcaggaaaaaatacactttgagccagaaaataaagcagtgctcagaaaaatgatgagggcaatttgaaaggacataggtgtcaacctgagggaatgcccagtggggaaagctggaacagtatgagcagcaaaataaacaaaggtaatattgggttgtaatctgtagaataagttttaatatatagtcacgatctcatacaatataattaaactctgattacataaataagtgggggagaagagcagctcttccttacaatagaattctggttaataaatgtagaggaatgaaggaaacagaaaatcactatcaaaacatcacaataataatttttacaggcaagaagctctacagtgttctttagagaaatagaaccagtagaatgtgtgtgtgtatgtctctctgtatgtatatcctgcatgttttgttttcatatacatacatgtgtgtatatatgtggactaacacacacagataaattatatatttcaaggaattggtttatgaaatgtggaggctggcaagtctgaaatctgtaggacaggcaggctgaaaactcaggttttcatgctcatgctgcagtcttaaggcaaaatttcttcttcctttgggaagcctgttttttggcttttaaggtctcttaggtgaatgggtgaggcccacacattatccatggattgtttcaggtacttaaagtcaactggttgtcagaaacacctagattagtatttgattaaccaactgcttaccatagcccagccaagttgacacatgaaattaaccatcatagatgctagaattcatgggttaaagtatgatgaaaaacaggttatttatatagtcttgagctgtctttactaatttcaaagagacttcttagtaga

SEQ ID NO: 40535 - DNA, 843 bp, Bovine  19866880516387
ccctacctcccaagcttccagatgccctaattggcctccagaggggaaccgaatctcatagaagggcactaattaattcctagaaatccaaggtccccaacatccttcctctcactccaccctaactcccctgttacttgttccagacaggaaaggaactctgcagactccccgaggaaggagaggccttgggagggcgtcatgtgtgtgctctgtgctgactgttgtaatgaggccccaggagacccgctgcaccaaggcagacctggaacttggaaaatgactgctgagtaccttccctgcacctgttctggctgacacccatccccatctttgcccacatcataggcacttgtgttctcacctggcttccccgtgggcagttaattttggtgtctctgctcaaattgctctagctgtcccatggttccagggttctggaggcatggtctgtgccactacactgccgaagtcttgccctcacagaggcatttccatcacacacttctgctcatcttccaagccctggggcaaacagtcctctgtaaatcttagccaaatgtcagacaggccacctcaccctccctgggacacccatggtttgtggctcctggcagagctcttaggactgtgggcctggaagcagagctggtcacttgcatctcactcctcctggccagaccccaggtccacagacaagtagaagctgaggcaaggaggcctctgtctcagttctgctctgccaactcctttactccaaagtgatgctctgcattccattcatagaagttttttttttaacagattctatagtgaaataacggaaaaggcaatagcacccca

SEQ ID NO: 40536 - DNA, 2509 bp, Bovine  19866880623097
ctgtctctgcttaaatttctttaaagaaataaaacactatagagaattgatatccctgcaacatatccctaccctccctctcataaaaaacagctatcctgaattggtgattatcccacatctctttaatacttgcattacatgaatgtgtatccacaagccatatatagtttttatttatatgttttaaaattttatattaagtaccatcatactgtagataccattctgcaatctgccttcttcactcaacaccacatgtttgagattcacttgtgttgagatacacagatcttttgagatttacttacattcatacattttaacttctgtgtggcattctacaagcaatctctctttatatgatatggaaggcctacagatcaaaaatacgtgctataatatatatactggggatggcaggccacaaatctagctccaagctacccattagccagtgcaaggaaagaaacatgactcattatataagtcacagagtctgtgagctaagaacaaaccaagacttccctggaggtcaagtaattaaaatccaccctcccaatgcagggggcacgggttcgataggtgctcagggaaagatccagcatgccatggtcaaaaaaaaaaaaaaacagtcatcagtatcttgggagaaccaataccattcctggcactgaaacctgagagaaatttctcctgtaggctcttctgatgggaactctctgcacacaatgaatcataccccaataagattctatgcacattcaaaccgcttccataaggttatttatttcctttaactcacctcacatgggataatggcaataccaaatctatagcaaaagacagtgtctgtgaatgttgtttccacccagtgagtccctgtgtgactctcctccttcctatgcccagattcccagttcccagagactctggaagttatgatggtcaatcagacaggagccacctcaggtgtagctcaccacaatcacatctctggtggctagtcgtaccttggagaacttcaggccgctcacgttaatgctgcagaggtctgatggatccttcacacagtggtgcttcagctgcaacacaatgcaaagaatcagcactcagggccccagcaaagctcatataattggccaagacaacaaatgactccctggtgaggagggcagcctggtacagtggaagaacaggctttggagctgctcagaatcaagctgccacgtcggctctcccacctctgtttctcatatgtaagatgggggtggaaacatggactttatggggctcttaggaggctgcattcctctctattccttctctgtctttttagagctccacttcctctaactgattcttagaataaaatctttatttctggggcactaccaaaacacttgtcataacttttatgtttgctcatctattcatttattcgccaaatatttatatactactttgggccatgtgtcatgctaaatatatcaaggaactttctccggggacttcccttgtggtccagtgattaagactctgtatttccaatgcaaagggtgcgggtttgatccctggctgtggaactaaagagcctataggccactcagtgtggccaaaaaaaaaaaaaaattactttctcctaatcttaactaaactcttcgacataagggaatatatctcttcataaatgagaaaaataaggctgagagagaggaaatgacttccctaaggttccacagccaataagtgatggatctatgatttgaacccaaatctgtaatcactaaacactgtgctcttaggactaccatatattgtccttgacaattaaaaggtagacaaaaagtctcaactttgaagttgctatttctatttaaccaaacctcattccttctttcagttaatcatttagttatggtgccttttatggttaggcatggaactgggaacttaagacaacaaagaaaagcagaagtatttcatgccttcataaagcttaaaactgcatggaagccaatgagcaagcaagtatttacaaatacagtaagtattttaaaggagaaattcaagaagccatgggagacagtaatgggagatccttatcttagtgtagaagtgaggaagtacctatttgaggaatatttcagccgataccttaagtgctaagtacgagctggtcccatgaaagtgggtggcagggtttgtgaatgccattcaggcaaatgaaagcaaggtgtttctgagaggatgaaaaacaggtaggtaaggttatggacgcgcttattagatcatgcggattcatggtggctctgcaaaggattgtggattttagcccacagtcaatggaaagctgtcaagaggtttttggcagagggctgatggcaattttacaaaaactgctgtatctgacacacacagaggatgagaagacagaaaagggggaaagaaaccactataccagacattgttagctcatttctctagagccattctctacttctcactg

SEQ ID NO: 40537 - DNA, 814 bp, Bovine  19866880699120
acctcgtttctgactccaaccctcttgataacctactttctgttccaaaggtttccaataggttctgactagtttcaaattaaaattatctttcctataacccaaagattaaagagaagaagggaggcaaatcttctgagaagaatcaaaagtaggtgatacagtaaatcctttgtgatctggataagtgagtcattgttctggaccttagcttctgccttagtaagaagaagaagctggaatagacaactattaacgtcctttccagtttgactattagatgtctagatgtctccagactttgaggacagttccagaaatgttttcaccaaagacaacatcattggaaaaaccgtgcagcctccagctgaggccacctgagggggacaatgtacactgggatatgtaagatctgaaaggcttgttaaaatgccagtcacatgactttatagtaacagctcatacatgcacagggaatgccagtccaccagagattccctaaaattctatcctaatccctactctcaatgagcccagatgggcagaagcaccaagcaccaccagagatgcaaaagacacacggtgtcacctgctaaggaaaataaaccccaaaggtccatgggactgaattgaccagctgcatccagctagacaccgtgtttccacagtagggagtctcagtactgttcttgcctgacttctgggcaaattttttggattttagaacaacactgcagataactcttgtccaaaaggagagtaataatgaggtccaatcagtttatctaacagagggaaccccaggaaaacagaa

SEQ ID NO: 40538 - DNA, 1073 bp, Bovine  19866880731753
tttggggagggagagagaactggcattattgtccctgattacagatgaggaaactgagcttcaaacagtaagatcagctgcccaaggtcatgtagcaagataggtcctcagaccctagtcctgggttctgtcccctgcaccacacacccctcttgtcacttgaatacccagggtctcagacaacttcttccaaagaaaaaaaagggcagaaggttcaggtgcacccctgccctggctctttttatttctgaactttttgccttggtaaacttaaccatcgtctaaccaagactatcacctctaagtcaatgacgccaatctgtgcttccctctgaggcccgagatctccagagcctaccaggtctcttcaggtattgttcatgcttccacctgctcctcattcacccagcttagaaaactcagcattagcttagtttttttctctttcaacttctaaatccagttggccaggtcctgggcattttacttaattcctttattcattcagcagatactgattatgtgctgtaccttttgagtctactctgcatcccagtgttacataatacacagtcctgtgttctgtcttcttttgcttagtgtaagatttataaggtccgttcatgttatggcatgtgttaatacctcacccctttttttggctgaataatactttgttgtatggatatgccacattttacttatctgttcatcaattgagggacatttagcttgtttctactttttggctattaggaataacactgctatgaacatttgtgtacaaatttctgttttgacataagctttatttcttctggatatatattactacctaggagtagaatttctgggtcatatggtaacaactatatgtttaacttcttgctggtgctgctgctgctaagtcgcttcagtcgtgtccgactctttgtgaccccatagacggcaccccaccaggctgccccgaccctgggattctccaggcaagaacacttcttgaggagctaccaagtggttttcgaaaagggctgcaccattttgcatttccacggcaaggcagagggttccac

SEQ ID NO: 40539 - DNA, 954 bp, Bovine  19866880757888
tggtgagaggtctggttcgtggagaggttggtaggttgctaagttgagatctgaacctcctctggcctgtcagtgatccacagtcttcctcatttctcagggctttatgctaaaagcagctcctggagaactatacttgtcctataatcgtgggaggagaaagatcattctcctctggtaaaagtacttcagaaacagaaagcaatattgcagtcaggttcacagaactgaggggggtatctaaaatgtccaagggtgctagatggtaccttgaatgggccacccaagatcatcactatggccctttacgaaaccattaacgaactctccagccacacatacattcaaatacattccaggagacgctgagttcaagagcacggattgtcctttccttctttatatccatgacccagcacagggctggcaaaagttcgaaactcaggaaatatctgtcaaatggaacagaaaggatgagcagcacagccttcggtcatcagcatcaccagtcaagccagtggcagctttctttccatcttagtcagtttgtaatcacatagcaattaatcaagcagctttaatctcttaagggcatttttaagagaaaatgaacaacaaccaaaaaaacacagaaggcattcatcactagtgcttcctccaggcaaaaatttaaggattccatttaaaaaaataaatgaagccatttacaaaaggttttcctgggaagtttcagccaaaaagaatcaaccttctaaaaagaggcaattatatgaaaggggccaggggctggatacataatccccaaacttgacatcaacccaacaggcccagataacttcttccagcagatacaatcaatggatcatgaacatgttcccaaagtatctttcccacttgttaaaaaaaagggcttcgagccccgttctcaggaaccgtgtttcttggatttcccat

SEQ ID NO: 40540 - DNA, 2779 bp, Bovine  19866880863931
tttaaacactctaaccgtaacaaacaattactcttacgggtatgcagtcctaaagttacctaacatgctaggtttgggtctggactagtcttagcaagagcaatctcaaatagtcaaaatcagtataaacctagccctgagccaagagttttaagtcttgaaggcataaacatctcagtcaaaactaggggacttccttggtggtctagcaattaagaatccatctgccactgcaggggacacaggtttgatctctggtttgggaagactgcacatgctatggagcaatttagcctgcatgtcacagctactgaagccctcatgctctagagccctggctccacaacaagagaagccacagcagtgagaaggctgtgcactgcaaccagagagtagctcccactcgagaaagcccacgcgccagcaatgaggacccaacgcagccaaaaataactaaataaaactcctagaagctctgtaaatacttaactgttgtgctgaggagctgaagagggacgtggacctcaaatacctgctgggactggagtgggggagtggggcacgggtctagaaatcaagtttctacctataccttaggtaaagtagaccctcctccccgcttaaaactcagctagtttgacctcagtttcacaggcaggagagctggcccaggagccccctgaagcgggtgttccaccatggcctaagtgcaagcacctgagggcggtgggcacatgtatgcacatgagacaggacacgaggctggggcttgccattacacataaagactgaattcctagttgtagcttttactatgaatgggagatttttctccttgcttctgtcattaagaataaaaaaaaactgtgatctatcataaaataaactcctaaatctgtcaaacaacaagccattctagagatcaaatatttttctaagactcacagaatgttcctatgattcaaggaatagggaaaaatcagaccaccatcaggaataaagcaaatgaaatgagtatttaactcaatatatgggctctcagtctattcaccaattcctacccactggacatttgcaggtgaagaaactttgaagttaatccaaaagcctgccttttccattttggttccaagttggactacaagtttcagcaaggaaggtgatagggcaaaatttaagaagactgatactctctgtgccatcctaaaccctccctttttagtttctcttaagtgttctcccctgtcttatactgttatatagcctgtgtcaaacacctgttgacctcattatggaagtatttcaataacacccagaaacgggcctaagaagcacatgtgaaaatgcaaagatgttttacataacagacatagaaatctgagatctaaacagaactggctagcccatttaataaattttttgaaataacaaagtgattaaccagaaggcaaggctacaaataaatacaataaacatatcaccacacatttgtatgcaagtccactcatctcttaactaataaacaaaaaccgtaaaaggcaatagaaacactatgctttcccatttccctgggtgggggaagagggggtgggggagttctaatcaagagactctctgtaaagctaacaacaaacaaaacaaaacaaaacaaaacaaaaagttccaatctgattaaagttagtaatcaattgtacttactgtttggcctgattaacatgaactcctagtgtatagctcagccatttgtatgtcacctgtaagaaggaatttttaaaaaaattttattagatgactgcagagtataggtcagcccaaagggctcctaaagattctaaggcaattacgccttataaattacattaaatgccaccctagttttgccaagaaccatccatctgggcaggcaggactcagacatttattttacaaagaagtctgtatcacagaataatgcaagaatctaaaaaggttgaatatacacagaaaaagctctcagtttccttacactccctgtttcaccctggtccttctttccacatttctctctttttatggggccaccaccaaaaactatcctcaaactcactcagaaacttgttactttggagtgtacaactcagaaacttccgaagaaagttgcagccacataaatattaaagggcacaggtggtgcaggggtcagggaatgaatgagtgaagtggatgaatactctgtcagaggttagactgggaattactggcatcaagctttgctcttccttccatccttccttgaactgtcatttgccacttccttgtaacctgtcaccctcccctcaaagtcttccaattctaaacgctgagtttccagtaattagaagacttagcacaggttgggcaaaggcagtgtgatgtagaggaaagcacgagcagaacagacatagactggaaaactgattatcccttgtgtgtgtgtgtgttagtctctcagtcgtgtcctactctttgtgaccccatggactacagcccagcaggctccgctgtccatggaattctccaggcaaaaatactggagtgggttgccattcccttctcccagatcttcccaacccaaggatcaaacctaggtcttctgcaggcgggttatcccttactaaccacaagttatttggcccctctgcttcaactaccttttctaaggctacttccgccgacctctatgggtcactgtaaaaagtaaaagcaataatgtatatccaaagctcacagtaggcactcaatcatcacgatgtgcgaaacg

SEQ ID NO: 40541 - DNA, 1717 bp, Bovine  19866880966834
ctttgtggtgatgtccatctaaacaagggaaatccccagtcctcttctcccttccatttgccgtcacagtggaaaaggctacccaacagagacagcctcaaggattccaagggcctagaggcctcagctttgcacctgagccctgctcccaacacacacacacactattggacctgtcccccacctcccacacacacacacacttggctggcacacacacacacggctgtgggcaagttaacctctctgagccttagattctgtgctgcttctctgctgcatcgaccattttgtgtcttagtgcttaccccagctctgtgggattaccgtgttatcacctgtgtgactcaggcaggtttcccatgggactcttcaggatgtgtatcagctggggtttttttcccccacaatggaaccacccggcccaggctccaaaaaggactgagggctaccttgctctatgcactcactctttattgctgttggacaaagtgctgattcctgcctggcccaggaaggggaggtcctgaccagctccccctctctgtggccagcaagcaaggctgagcagagctcggagacccgaacctgtcccaaggggtggtcaaggggtgtggcacccttgtgaagggtgcagggcacaggctagttggcacccatggccccatgcacagccctagcctttcaagtcactggctgtgggctcctggtagaattcatccatgaattcgaggaagcggcccaacttaggctggctcccgctcagtgctgggcgggcctggggtggcgctgtggtcccaaacactgaccgcagcgagcagcgcaccagccgccggtagcgcgcacggaactccttcagcagctttttggcctccaggaactgcttctggttcaccagccgctgttctgtccgctggcgcaggacggctcctatagggagaaaagccaggagggacacccagatcacctggggtcccacctatcccagagcagtagggactgggtccagagtcccccataaagtgggatggagtgggaagaggatggtgagggcctgaaaatggcctctccagctcgggcactagaaggccagagggatggccttctgagtctgtctcaagccgttggaaacatgctgtgtgacttcaggcagctctctgctgcactcggctcacttcctccatctgtacacaggaaggtcgggcagatgctctaaagggctcttcctgttccgacacaagccctctgccttatcccagaaggggagcaaatgtctagacctcagagcctggctgatgaggacggggggcctgagccatacctagtggtgcctctgtaatgttctgggtgtcccgcatgcgaatgaggatgtcatccagcagctgggctcgagtcttccgtcggggtggaacagggatcctccgggtctgacaggaggtgagagagcagagtgttagcacaggctcagactttcgtggcctcacctcattcagtcacaacgacaggcaggggagaactaggggcactagggaaaagcatggctcttggaggtcccaagtgacagccatttctgttccttagggtccccaggggcagttcacatgcacagtgaggtggaggcttacccgcttctccttgggaacatagtgcttctgcagagtatccagcctgggcttgctggagcggtacacgagtgggtgtttcaacatgtgctgca

SEQ ID NO: 40542 - DNA, 971 bp, Bovine  19866881022180
cctgtgatgagaacttgctcctacctgtagaagtcccttccaaccactttttcacctgacttctactcatccttcagttgtcagctctaagcaggtggcaccctctcagcaccctgggaagatacactgattgagcagtatttcaattcaaggcatttccggtgccttgggatcagagttcaccctcagtcagaacagactcagtgaagatcgggcaggggacttggggtgagggtgggcatcattagagggatacagagcctgctgggagcctgggttcatcacgtgcatgcagtgggggggttgggggatgacagaccaggcaactgacagtttccatccagtggcatgagcactgacagaagggtcctgtgtctgggaccttcccctctgaaactgggcctctgtcgaccctggctataagcctcttcacctcccttcccccacatcaatcccccgacgtttgccctgtgtctgcagatgcctgactggggagagctctgacctggatggagccccccactgatcccaggcacctgtgaggagaagaacactgatgaggaggaggggaggaacaaggagggagggagttcttctcaaaaactctctgcctccctaagccctgggagccagagtttggacagagacactattaacacaaaatttgcaaacatggcttctaaaaatagccccagctggcaaggcccacctggcacatgctgcacctttgcggctgctggcctgctcccctcatagcgccgccttggtctgtcagcaagcgtgtcactctgccctccccctacccagcgtgagggcagccacagccctgggtccaacccaagggagaagctgaggcttgttccagtctgatgggggctacggggatgtgcaggcctaggggaaggatggttttgcctataaggtggttggaggagacagtgcagcctacagggagctccccaaatcagggt

SEQ ID NO: 40543 - DNA, 1223 bp, Bovine  19866881040194
ccttggagggcctgcagccccttctgggagttcgcagccccccactgatccaaggttactggtagggacacccatggggacaaatcacagtcctcctttctcatcactggcagaccattccccaaccccagcctgggaatggctctcctggttcttcaagacttagctcaggctaaggtaacaatccctccaggacgcttcctggcctcctgggctattttagagctttctgtgggctcacccagcacccttgtgctcccgtctattacagcatttatctcagtgtatggtcagtgtctgttttcatgtctgcctcctctcaccccaggcttgcttcttgccctaaacaggatccagcatgggggcccacacacacctcagaggtgttaacggaatgcattttcttttccttcttgggcacaggtcagtgggttgtcttcctccatcttccagagggatgattcagagataaaggagaaagaacaaagaccaccatccacagcacccagagaggcaaagaggactcagaagaagcccccatctgcctctttccccaggaagtaccatggctatgaggagctgctgacagccaagcctgaccccaccttcgttgagccaaaaggtatgtgaggagaatgtctctagggcagggagccctctccatgactcagagcaagtgagggcaaagccaaggctggtgccaacactcttttccaggccagggtgctgttttccatctgcccctcggagtgtcctggtttagagccctacttgtcaggagccctggcctggaccttcattggttttgagggaatcacagctgttcagagattccagccattctggacctacctgctttggttggaagtctctccaggaagggtttaatgaataaacacccagactagtcagattccccaggtcctcccccagcccaggtaatccctaaaccgaacatccagaatcctccctgtttggttggagacaagggaggcagcatcttctcacaccccttattttggactgatgtgttttgcactggtgcccagctgtgctcttgtgggtgtcagtctctgcagtgtgaccctccaaggttaatgggttacctttccccactcttgtgctgtttttccattaggacctgttcactgaatgatggtacctctggcaccacaacagatcaggccaggatatgggaacagtgtcttctggctagaaagggt

SEQ ID NO: 40544 - DNA, 715 bp, Bovine  19866881040384
tggggggactctagaaccaggcccccatagaattggggtctatcggcagcatctgagggacttggggccacaccacttcactactgagtactcaggcatgggcatagaggcctactgtgggcctcccaagacaaatcacacagtggatcagtggctggactgggatgaggacacgaacctccccctctctcacccagggcttctttcctgctgccaccagcctcctgtgcctacgcagcagaaggcagagcttctaccatgttggcccctggtcaagcctgatgccagtgggagcacaaccccccccatccctgcctccccttggtttcttagcacatctgaggccaatcagccttttcaaaaagaactttgtgaaatatagccaaaaaacaagaaggaaaccataacagaaaattccagacatatcatgcggtccagttgaccaagtccaagttttgtgatcagtggagctaattcatttctccctccctggagttcacacatacacaatttcctcaccccaaggggctgtagctgacatccccaaaatacactctgaattccttccttctttccattatcatcacttcccctagtctaagccactttcctctctcacctgggctgctgtgtgagcattctagagtctccctgtaccccttttctctttttaaaatattttttggtgttgaccatttttaaggtctttatcgaa

SEQ ID NO: 40545 - DNA, 1145 bp, Bovine  19866881096998
gttatgttcatcaatacacaggtttgtagactgcaaatttatgtcaggatgtaggaaaaccacagagtagtgtgttagatgggtaaaaactgtacaaggtggccttcacctccgataaaaggttattatattaacattcacatattagtcaaaggaacctaagaacatgcttactcatagcagcttttccaaaaaaattgcttatgacattccccttccctggtgccttggggcctaccgaagatgcctgaaagcaaagcaaaagaaaacacacatgatttttttttctgtgtttaggctgttcttcaagaaacagtaaaaaatgtcaatagtagaacacactgtcgtgatcatagagcctctatattaccatgccagagtgcgtacatactaggtataagaacaaagccagaccacatagcgtttggtattcatctccaaagcttagtttctcatagtttttataaaattattatccatgaatgtgtctaaacatttttttattatatttaaaaactacttactttgacagaattaaaacagatcagaggcagtatggtacaaaacggggaaaaaccttcagaacattacatttgtaatcactgtaagtggaactgcattctggttccaccacttaacaacaatatgacatccaaattacttaacaagatgacctctccctcacagaacggaaaatgaggatttaaacaaagatcaaactatcggcccaagaattaaacgacctacaccaaagtagaaaaaactagaactaaatatcagaaccttatataattaaaccacaaccactggaattatcaaatgctttctagttccccattctgagctgagagaagacttacattcattacttctttagcctctgttttggtttccttattggcatcttgggctttagaagcagctttagaagcaaacatgcccatgattcctttgggctgctgggaactctgtttggggacaggtgggccgtgaccattggttgtcagctcatcgctggcttgcatctcaggtgataccggaggatctgactgctcaagcttttcagaagaggaggattcggcaggagctctaggaactgcagctgcacactggatggcactaaacctgaggacagaaatgtcaca

SEQ ID NO: 40546 - DNA, 1053 bp, Bovine  19866881178023
taaaactttttacatacagtcccttggtatgggtaggagatgggttccaggaccacccacctctacatacacacccccatacacaccccctaccccagtccccaacctccacctccatcttgcatcaccaccaaggacactgaaatctgtggaagctcaagggccttgtataaaatgatgtagtatttgcatataacctgcacacagcctcctgtacacgttaagtcatctctagatttctgataccgaacataatataaatgctctgtgctgtgctgtgtcactcagtcgtgtccgactctgtgattccatatggaccacagcccgccaggctcctctgtccatgggggttctccaggcaagaatactggagtgggttgccatgccctcctccagggcatcttctcaatccatggattgaacccaggtctcctgcattgcaggcagattctttaccaactgaacctccaaggaaacatattttgtaagtggttgtaaatataatacaaatgctacttaaatatctgccagtgcatggcaaactcaaattttactttttgtaactttctggaattttttctaaattttttatatccctgttttgttgaatccatggatgtggaaatatagacatggagggctgactgtactgatcctgtctgagtctacaaagtatcctgccttagggaggaagaaaggaaggggatcatctccatttagagagagaagcggcagctcacagagatgtgttctgcgtaggtagtgctggctctgggctggaatccaggtctatgtgttctcccacactcagctcattgcactccaaaaacaagatgtatggcgttacaggtgaacagacaggcaacttctaacatgaaagactggcagccaggaagcaggaggtggttttcaggaagaaaacttacctagaggaagcaggttttctgaggcattgatgtaaatcactgaattaaaatgcttgaaatccttttccttagcctgtgaaagggcatttcaaagaacataagattagttccctgcctggaggccttg

SEQ ID NO: 40547 - DNA, 743 bp, Bovine  19866881233730
cacagaaggtaaggttaggagcctagactgaataagcaggaggcagggagcgtgagcaggaccggcaggccgagcaagtgggaggctagtctgggtgtacaccagcagacagaggggcctactgcgccttcctgcagttccggtggtgggtcgtctgtgctcgatgggtcaatcccgaggggccaaggatgggggagagcctctcaggccaaagatcacagcctagccagtcctctcttcatggcacctagtctgcttttctcttttcttcacagctgccttcacctgctctatctttcccattctcccaacccaactgtggctgaaatcggttcagttaggagacagtatcatggtataggtcccagggccctcaagaccttgggtaactgacactacagctgttttggatgctcacctggcacagagacaagcttcaagttacagggttgggttaaaacttgtctgcagctccacctgtgcaggcttctttccctcccacacattttgtggaacagctctggcctgttgtcatttcttcttcacagcagccaccacctacaccatctctccagcctgggcttcctgtgtgtacccctttctcccccttcctaaaggtgtcagtactcctccctgctgtgcttttccttcacaactgccatcacccctctggtctgttctctaatcctcattgtggattacccctgtgcccaaccctcttttcctgatattactgaaatatg

SEQ ID NO: 40548 - DNA, 1034 bp, Bovine  19866881496460
tgcttctgtggttaccagttcttggggtgacacaacatacttgggagtcttccctgaccccagattgtgcagtgttcttcctgtagaatgtttcccctaattttgccaccctggtatcgtccatgaacattactaatacctctccatcctgccccaacttgggctcgctgagtccatcagtggatatgtgcaacctttctccaaatgaaagactggatgtgtgagtggggtttggggaagggggtaattggagatgggattacactttctggtacctctgtctgcagaaaccattcttgggcactagagaaatttccaaggtggttaggcttctttttttttggtgggagggggctatgccacagtttcagacttggtttcaaatcctgaaaccaagtttcaaatcttggtttcagaccagggattgaacccatgtccccttgcttcagaaggctggagtcttaaccactagaccatgagagaaatcccctggttaggcctcttggttgattccctatcctctgtttcttcctgggaatgatggagcttgtcccgtgtgcttgatcatgactgcaggtctttgtgcacacagggaggcgtctgtcacatcgctgaccaccaagaggtacatcctgaggttcccagcgctggagacactgatgctggatgacaacaaactctccaaccccaactgttttgtcagcctggccgggctcaagaggtaaagctaaaagcctgtctctgcagggcccgctgtaacccccatccttgctcacaccttgagtactgctctagaagccaaaaggcctggctttaaatcccagttcctccacttatctcagctgtgtgggcatgggtaagtcatctcccctctgagctttagcttgagccaaaaaagcagggcattggtaaagatatttctgatcacatgattggtttagaagcagcaaagaggagattaggatgagatattatcagaaacgggatcctaaccctaagagaggagatggaataaaagaaaaaagagtgagaat

SEQ ID NO: 40549 - DNA, 1278 bp, Bovine  19866881906772
gtcatgagcgcagtgtagtgcagtgggcggcagatagccacatagcggtcataggccatggccaccaggatgaaggcttcagagcatgtaaagctttggaagaggtacatctgccaataagcaggaagtaaagctgagaaaatggtccccaaacaggaaaagggacagcatcttggggacagtggttgtggtgaagaggatgtccagggctgagaggttgatcaggaagaagtacatgggcttgtggaggctggactctgccaccacagccaccaggatcagggcattacccatgaggatgagaaggtagaaaaggagaaaaattaaaaacacagggaggaagagggactctggcagagaggggatgcccaccaggtagaagactggtgagccacccactgatccattacaggttgtggcctccatagtaagccagagctggatttctgggagatgggcagctggaacatctggacactgaaatatctggaaacaatagaatcaaaggattctggaatgagaaatctacaatatttacactctagtcaaaatataaaggtaatattacaaccagctcttgaagacttattagtaggttgcggtattaactcctaccgtatgaacccaaaacttctacctcctttcttttgtcaaactaattattgattaactaataccctaccaaatgaaagacttgctatgttcagctgacacagtgatgaaaatggagaaagcaggcaaagtccctattttcttagactttacattttactaggataatcagatgtaaacagttgattgttgaattatgattgtgaaaaactctctggaaagatttctgctagtcttcatccttagattttatgtatctagtttgggatgtcaggtctcttaaatcaagtccttgaactcatgcctcttcttttgcagtcaaagttccaccatgttgctttggaaggactgctttctcccaaagttctttgcaacatgctattgctcacatagttatcaagcttattcttctcttgtaagccttgaatagtagttcctcctgactccttctaagctagatgtcagtacttccatttctgtgtagaatataatagatcacgctagcccaacacttttactgcagcaattaggcaaacctgagtgaattacacaaatcatatttttcagtaatttggagaaacatgggtacaagaaggattcaatgagttggatttccaggtaggaggggtcctccaaagtgaacctacaatcaccagctcttttctt

SEQ ID NO: 40550 - DNA, 701 bp, Bovine  19866880481889
tattttaaacaagtttttaaaacaagagactaatatcttatacactgtctcatcccctctgtcttgagagattcaatgtatatatctaattttgttatatattatatgtaatttattataaattaatagctatatttaacttaatatatataaagtcagcaagaaaaatatcaatgcctcattagaaaaatatgtaaaccagtcaccctttgtatcaaaggaacacatgtgaaaatgtagaccattttaaacttatcacatggaaaaagcttcttgcattctatttttaattacaatatgcatgctgacaaaaatttgattgataagcacttacatgatgtaggtggaataactatcaaaatgcctttttgcaaagcaatttggtaagatgtaccaggagctttaaaagaattcacaattttcgatgtagtattttcatatgaaggaacgtgttgatgtgataaacttaaaaaaaaaaaaggaaaagaaatatgcaggttccctggtgactcactggtaaagaatccacctgccaatgcaggaaacaaaggtttgatccctgatccgggaacgtcccacatgccacagagctactaagcctgtgcaccacaaatattgagcctgtgctctagagcctggcgtcacaaattctaagcccaggtgccacaactaacgaagctgcacgtcctagatcctgtgtt

SEQ ID NO: 40551 - DNA, 1199 bp, Bovine  19866880567923
atgatcattaatattttcatagagataagatactgtaatcttgaaataagagacccctataaaaggaatatttaaggaataaaaaagaactcttgaaaactaaaaatatgattaccaaaatgataaactcagtataaaaattaggcaatgaaacggaaaacatctctgaatgtagagcagaaaacaagggaaatgaaaaataagaaaagaaaacattaatgtgtcattctagcagatttaacagctgaacgttaggttccaaaaaagagaactgcaaaaatggaggggagaaatttgtcagtaactcaagaaaatcccccagaactaaagaaatcagtttcaatctaatttcataagggacttcattgtgaattttcagaactcaaagcaaatattggtgcagagagagagagagagagggaggtgtgaaatacaagaggctagaaatcagaatgaccagatttttcacaagcaacactggaatctggaaggcaatggaacagtgccttcgagatttaacccataattctgtaccgagccaaattatcaatcacctgtgaagatagaataaagacattttaatatatgcaaggtgtcatattttatttatcatgcaccctttcccagaaagttactggaggatatgctccaccaaaacaaggaagggtaaaacatagggtacatgaaacaggtgatacaaatgaggtcaaggaattcccaggattgataatgacagatgatcccagaatgagagttatgtaccgaggcattgaagttaactaccccagattggaacatctcagaaggctctggaagatataattgattgattacctgatacatatggatttctcaagtcagattcacactactagcaaagtgctagagattaattcaaacttgggagacaaaattaggccagagagaaagccaacagcggattcagacatgggagatcgtgcagagtaggacgtatcagcatagtagagataccacctaataataggaaagtgaagtcgctcagttgtgtccgactgtttgcgaccccatgaactgtagcctccgtccatgggaggactggctcctccgtccatgggattctccaggcaggagaactggcgtgggttgccatttccttctccaggggaatcttcccaacccagggattgaacccgggtctcccgccttccaggaagatg

SEQ ID NO: 40552 - DNA, 1289 bp, Bovine  19866880656205
tacaaagcaaacttatcttagtccagtctcccataaataaaagtgtgttactgctcagtgtattaagatggataaagctaaaggggatttgagctatgatccaggctgttgacagatcccgagatcattctgacagcagctcggagtgacagaggggttgaatgtttttggagtgacagtcctgtccccagagcttttcaggcccccaaagaaaaccttctctgtgtccctgatgttcttaaaaagcacagcagaccaatttcaaccatcctggacaaatggtggccaccatcccccagcctgtggaacggcaccctgaccctcccctggaaaatgcttctggcccttttctgagatgggaaactggaataaaaaggaggcagggaggagaggtgaggagtggaaaaaaaacaaacaaaaactagtgtccacatctgtaaaacgcagagagaagctggacgaatgagagaacgtatttccacaaatggaacccaaacacgtttcacacactctctcggcctgacgaaggattagctgctaaaggccacaactgcgggtaccacactctgtttacaaagctcctccgccctgcatggagacgtgactttccgtgtcctcactgaagggctggttgtctggttacctgagctgcctcaacccaaacaattctcagagtctctaggacaggagtcaaggaacaaggcctggagccaggttgtccacacaggttcaccgtcagctgagctacgtgtgtcttcaagagttttctgtatgcttcagaaaagtcagtgtcatgaaaggtgaaaaaaggttgaggaactgctcttgattagaggagataaaagaagcatgacgactatgatcctccattgcattttggaccagagcagggggagggatggatattaccataaaggataaaattggaccaacggacaatatttgaatatgaagtgtgtgttagctaacagtgttttaccctaaagctaaatctgattaggccagatactgttaaaaaaattttttttgacccacaacttgtagccacttgcccaggaaaccaaccttttatctacaataaacagcccaggtagcagcctgttataagtcagacttgtagaaagccagattgctctctctagtaacaatgcaggatgccaaacaataattcagtaacaattggtcccaaatggccaggacttgattaataagggacaccttcctaatgcttgttcctgctcccaacttaggatcaactagagaaattcaatcatgcacccctaaccaat

SEQ ID NO: 40553 - DNA, 2153 bp, Bovine  19866880825213
tactggttgaaatgtggcacaccaggtattctcgttcttgctggtgggaatgtaaaatgggatgtcactttggaagacaatttgatatttcttacaaaactaaaaatcctcttaccacaatcaaatacccatgctccttggtgtttactcaaaggagttaaatgcttatacccacacaaaaacctgcacatggatggatatagcagctttatgaataattcctgaaatttggaagtaatcaagatatccctcttgactgaatgaatgaattgtggtacatctaaaaaatgaaataatattcaatactaaaaataaaaataaattgatatggtcatttgttcaactgtatgtgtagtgttggtgccatgccccagttagcagctagctgagatagcttgcagtgtcttttctagtttaaatggtgaacagacatgaaaactaatgaatagaatgagttaatgacgaggctcttctctgcctttctaaaagaggggccacctacacgtgtttaagatgtccctgcacatgtctcaagttctttataagaaaggaagcaacacaggctggattccaagcggtgtatcacccaagctctagttgattttccacagccaggttgttgccataatagctttttcacacatgacggtggtgctccctggctctccccagcccctaaaggctgttgaaacatagcaccaggaggcctgagaatgccaggggctctagctgcctttgtccctgcttctctggcatgtgccctcctggtgacagtgggattgaaacagtagctctcagtgattgcttctctggccttgagtgactgtccacagttcactttttcctattaggaatgacgccttctctgtatccgtgctccattgaatctctttttcatacatcctagaatgaaaggacttggcttctactacttttattagacatctgttttctccctccctagactattaagtaatattgttcctgcttttatccctctcagattcctgtctgagagctgagagctgcgggatgatgttcagtctctctatgcaccaggagctgaaccgcgtggagggtctacttaaactgttcatctgactctcatgagttgacaccgctcctttcttttattgtggcaaaataaaaccctaagagtctttggggaactctcaaaaactgggaaagattcacctccataaatgttaaaagattgtatcttatgtatagaagtaaataagaccatatggaattactggactgaaagaatagtttagcttataatgaagacagaaaaatatatattttgaaaatgctgctaaatattgatgctgacagtgtttttctcgtgtgagtgacccaagcatattataaatagttggtaaagggaatggagcctgtggggtcaaggaaaatgttgcactacctgtgcctagactcatgatgacagctttatgattatgggatttgataaaattgtaattttttattctattccaaagatgctttctataggatggccattaggtctagaaatatagatcacactattttgtcattcactagaatgtagcatcaataaaccatttattaagaaaaaaaaataaattgaatattattcaatactaaaactcaatactaaaactcaatactaaaatacatgagaagacatgaagaaaccgtgaatgcatattacaaagtgaacaaagccaaactggaaagactacattctttgattccaactgtataacattcaggaaaagtcaaagctgtggagacagtataaagacaagtgattggctggggtagggccaggatcaatgggcagtgaaattactctgtacagttctaataaggtggataaaactggagcctattatacagagtgaagtaggtcagaaagaaaaacaccaatactgtatattaacacatatatatggaatttagaaaaatgctaacaatgaccctataagcaagacagcagaagagacacagatgtaaagaacagacttttggactctgtgggagaaggcaagggtgggatgatttgagagaataggactgaaacatgtatatcaccatgtgcgaaatagatgaccagtccaagtttgatgcatgaaacggggcactcaaacccggtgcactgggacaac

SEQ ID NO: 40554 - DNA, 1400 bp, Bovine  19866880864207
gtagttaagtgttctgccttgaccattgaatgagttgattaactgggcctttatacttaactcaataaaaaactaaacagatataaagttaaataaaaagttcaagttcattgcccagcgtacctattaacattatatttaacaattgtctacctaaatttttgtcctttgactcactgataatttcctaggcgacacactttagattcacacattagtaataggtcactcaccattgttaggataattgaaacttgcttcactaaagaaagtttagttaaacctctttacaacattaatgttaggtacatggagatcacttgtctaataatttaacttgacatcatatatcagaattgtattatatttgaagaacaaaattgaagtttttttatttggtgaatttaatgtctttccagagttctaaaaagataggttttttgttttttttttaatttaaattgataaagactataatttagcagaaatagggccataaagtagaaaaatagtcatatagctacagtcataccatacttcagcttccatgtaggaatagaagtggtaggtccagttttgttagtggaagaaaagggatttatggaaaagttatgagatgtttcaatattgagtccaccaaacactttgcacaatgttatacttcatttgtcagtgaatatttgttaaaatgtatgtctggttatcatgattgcgacagcctcaaggtagaacacactgcagtccctagctgaacagaagttagcctaataattcatgacagaaaattgattaaatgccttatccttttaattaaggctgcagaactgttaacctaagatcacactgtggcaagagtcaatataatttaagctagaggttacttggaggttattactcaggtgtaataacatttcgctgtctttgactagggtttaaagccctgttaacttggtttgtaccagcccagactttttccctcttacaagttgaacacactgttgagtttgtgcagggtctttcttcagcaccagacattccactagtgatggttagccttttgacatttagaacttccaaacttgaatcttagatagtcccatgtgtctgacaggccagccatgaagaatttaagatttaattctaactttttccatgttggccttgggtgaatgactcgtcttttgaagaatagctttaagtgacttggtcactgataaaactcaactattttgttgacacccttcaatattattttatgtttagccatatttaaatttaagatttaatagagtctagtgaagaaattagtggaatgtgtgaatataaaaaaatacaaaaaaagagaaagctatttaaaatgtggctttattatattcctaacagttcaaaatttattacat

SEQ ID NO: 40555 - DNA, 4054 bp, Bovine  19866880930450
tgtgtgtgtgtgtgtgtgtgtgtgtgtgtgtgtgtgtggtgtgagtgtgtgtgtataaaataccaaccgaacatttcttaggtgggcaattagtccaaatatttaactcaatgataaatcaaaatatttaactcaaggatgacttaaatatgagcaaatgggcaaaatttctcattggcccacagtcttctagcaaaatttggttgaaataacctatttaggttaatagacaaggattaatagacaattattattgttattgacaatagattattgtcaatctattggacaatctatctgtccaatagattattattagagaaataactctttggaaaagaattctcttggtccaggttttctatgatagagattgacaatctaatattcagatttattttaaaaatttgaagctagatttttaaaaagtccaaatgcatctttgcaatagggagttgccacaataggtaggtttttcacagagttgaattagaattcagaggtaagtctgattgctggctctatatctgtattaaacaatttcagaggggcagcctctcagtttttacataagttgctttgccgttaaactgactttaaatatataaaccagcagccagttaaatgaagtcagtgagactaaaacatgaatttataatagataggcagtaatgcctgatatcccgccaaacagcagcagcaacaacagcaacaaaatgccaatttctctttgaacaataagaaaccagagttattttacacctttggaggtttagaagcttaattaatcttaattgcagtgtctttcagagaagagtcaggagttgaggagatgttttacagtttttcttgctgttttttcagggttgaggagatggtactttttttcaggattggggagatggtactcaattgcaaaggaagataattttcttactgggatttctgaacttttttttcctaactagggctctgggacactgagctagcttggtgagtcagggctggcctgctggagtcaatggatgtcagaagagaatacctagaggtctggacagttgaaaactgaagagactacatgtggctctagaaggcaaaagcaggggtcttattttaaggtggctgaggtttccagctgtaagtcaggcaggaactattaaaacctccaggcttcttagagaagtgtgggactaaatgtacacgtgtttggtgtgtgctaagttgcttccatagtgtctggcttttttgtgatcttatagaccaacctcgctaccctttttttaaacacaattttcttcttgcctgactctgttgagcttctacttactttctccctctctccagttaatctttctccctttaaaatgcccagtcacctctacatggatcaaagttgagcttagtttacattggactctcttaactatagcagtaggtaccgaataaatctgtttttactgctttaactcatatccaactttgtttctctttgagagttttaacaataactttgagtggctcaaagttgtgagatgacatttctccctacttgtgctatggctatgcaagacctagattatatatgtcttcatagatccatcatgttccaaggttcttcgctgcttatcacagtaactctatgacctctttgatcaatctggaaccagtagatgttcagagggaatgtggaggaaggggcattcatgctacatgaggcaaacttgcctgaagagagtaggaaacacaaagcaatcagtagataaattgcccacctttcttttccctaacaggtgatttcaagacactgtagcttttatggcttttctagagaggtcccatgatgactggacagttcattgtatgcattatggagctatggtcaacttattaatgctctactttgtatttacctcctctccttccctggctgacttctcttttttcctcttttttctgtagaattgcactcccaataaaacaatggcacaaaagcctagattcagttggaactgaggctaagaaaacagatcccagtgcatgtgggtggtgccgtgccaagttgcttcagtcaagtctgactctttgtgactctatggaccacggtctgccaggcttctctgttcatgggattctctaggcaagaatactggagtagttgccttgcccttctccaagggatcttcccaacccggggatcaaatctgtgtctcttatgtcaccctgtgttggcaggtgggttctttaccactagtgccacctgggatgccccaacagattccaggattggtcccaaaaagcaaattctcaggatggaattttagagttgaattgcctacttgactaaaggcaatagagaccccactgctcagtggtagtgggggtaataacccctggcagtgaggtcacaattaatgaaatttcacccctgattggttggaaggagatgcaaggcagaaggcaagacactgtgagattataatgtggtaaatggtaattatgagatttgttatgtgggggtggctgcttttggtggcagtgcaagtcttattaaaagaaaatgatagactcagggcagctccttgctaacttaaatgatcctctgaaaaccaaaggtgtcaatagcagtctggtctcagagtagaatgagttgaaaatcagatacagattataattataaagacagtagagaagtaaaggaaattaaatttgtagcatccattaatatgctatatgaaaatctcaggacccaggtgggaaagagggcaggaagacctgtctgtaatgaagatatttgagtggttatacctaagaaagaactaaaaaaatttcctggaatgtttctgggccagtggaatctacctgctttctttgctaaaggaaagcagcctcctctttcctttcctagagtctgtgcagtgatcttacgtaaatgtgcctaacaagataatacttgttctcctcaaagactgcctctactacacctcattggcagctccagataaggaacgttagaatggatttactatgtacaaccggagagcttatcactgattatataccctggaagggtccagagctcactcccatctctacagcaataagaaatatactagtgctaggtactccagtttctttaggaagcttggtggtgcctgttctctgctggccatgactgtatacgtggtgtaaaagttaggctgcgtgatattaataaggctggtagggtttcagaatgacagagaccagtggcaggacttaattctcagagtcacaatggacacaattacagccatgggcatcaaagtcagagtagaaatcggagtgactaggcctacatggatttatggtgattttaggggtaagatagatggagaactgacctgggcattgtttgatttgtgtaatagaaaactgagagctggaaagctgacatcagtgctatagtgaaaaaatcacccagtttctagaactaaatgggattatagacctagagttcatttactgatagggagacctgtccccatgaggaagagtctgtcagtgccaccatagatatatatgataaatgtcttttctgattcttccctaaggggaccttcggtcatttaccagagtaactgttccagaggaaagggcaactactcaggcttttcaaatctgttagatatgaggtttgagctggcactgacactgatattgtgctgtgctgtgcttagtcattcagttgtgtccgactctttgcaatcccatgtactgtagccctccaggctcctctgtccatcgggattctccaggcaagaatactggaatgggttgccatgccctcctccaggggatctttccaacccagggatcaaacccaggtctctcacatttgcaggtggattcttaccatctgagccactagggaagcccgacaccgatattaggagaaccaaaatgctatcctggtcttctagttagagcataagttacagtagccagatgataagcggggtattagcccaagtccaattcacagtaggacaatgagtcagcagacttgccctgtagt

SEQ ID NO: 40556 - DNA, 1833 bp, Bovine  19866880965897
aaatatgctgtgctagtttatttagtctgtccaactctttgcagccttatggactgtagcccaccaggctcctctgtccatgggattctccaggcaagaattctggagtgggttgccatgccctcctccagaggatcgtcctgacccagggactgaacccacatctcttatgtctccttcattggcaggtgggttctttaccactagggccacctgggaagtagatatatacacacgcgcgtgcacacacacacacacacacacacacagcattcactgatggctaaaccaaaactcctgtcttataccaacggttattacccagcttgaccctgaaggcctacagctttcggtctttcagggcaccagctgaccatcaaagcaagttctcattataaaggcgtacatacttgttggggtcatggggcgggtcttgggccctgggaagggatttgtccaagggactccaaccaagacagtgtatggcaatccagtgaaatgtaacagaaaagccagaatctgagtgtctctcttaaaggtggtagaattaagggaggaaaagtatcagagggaaagactgaaacaagaggaggagatggaaatgtctgtttctggtggcacaccttcggagaaaaactcttttgagacagtttctgctatgagtttgaaaacccagttcctggggcaatggaaataccaggagtatcccataattatgggagtgaaacatccattctctgtgggggagaggaccaagaccatgctgttttcttagactagtgtcagtttaaatgtcccattaaatacacaatgttagaaatgtaccatttctgagactgggcagctgaggggagagtttaaaggcagtatttcatagcaggagtttctataaaagctgtcatccaatgacttaaaagtacactgggccacaacctgggacctggaaaattccaaggaatatctttccatcatcgctacctgttttaggaccaagccattgaaaagccaatttctcatttccactccttgcaccaagcctaatgtagttttaagaaccatgggcaaagcctgctctatcagtggtgataaaaatgaggttgggctgagttgggagagggaaggctggcatggtttccctccctggctgggtgtaactgcattctgataaatcttactgtttaacaggttctgtaaggaccaagggaaggtcaagggcatgcatgcctttggaagccaagcagagattcttggaggcttcaaaaactaatttaaaatataaaattcttatcacagaagccacacttattcatcatcaaaatttagcatgttatatctttctagatatataaatacatatatatatgctgctttttaacaaaaatgggattattctataacatacttatttcacttaacaatatagtataggcactttttttgtgtattaacataaatctacatcattttgggggcttccctgatagctcagttggtaaagaatctgcctggaatgcaggagaccccggttcgattcctgggtcaggaagatacgctggagaagggataggctacccactccagccttcttgggcttccctggtggctcagctggtaaagaatccacctgcaatgcgggagacctgggtttgatccctgggttgggaagatcccctggagaagggaaaggctacccactctagtattctggcctgcagaattccatggactgtatagtccatggggtcgcaaagagtcgtataggactaagtgaccttcacttcacttcactcaccatgtgtaaaacagttagctagcaggaagcagcttttccag

SEQ ID NO: 40557 - DNA, 1296 bp, Bovine  19866881008679
ttcagtccctgggtccggatgatcccctggagaagggaatggcaaccccactgcagtattcttgcctggagaattccatggactgaggagcctggtgggctacagtccatgggttgcagggtcagatatgactgagcgactaacagtttcactttgacttgactagggaacagtaccataatgaaagatgagaaatgaggagttctggaatactgatagtaaattatttttcacctgaattgagctggaattacacaggatgatgattatttaatagttattttgaaactcaaaattctaggcctgagcagttttacgagtcattacttcagtacctgaggaatatatagttggggagaagtcaagtctgagcaaaacatggaattctgggtgacatttggttcttagttggaagcttttaggatacagtaacatatgtgaaaccattttgtaaatgtaacttaatgaactgtttgaaggtattttgagtctcacttgatgttataggtgagtgaagcaggtgtccatcgaccccatgttggtggaattcatggtcggagtaatgatggcgcttactctctcgtcctggctggtggatttgcagatgaagtagtaagtcatgatgcaaccttgttctttagaacctgtcttgattattcagtaaaatacagaagctttgtccaggataaatcccatctcttttagcatcacttttgtgttgaagtggtcagttctatacaagtaacatagtaaatcagtcagtgtctttaatcatttcttgtgctgattactgcaatgaaaatagtcacattttctttagagctcattttaatttggggataattgtagattgacaattattagaaataatacaaaaatgtctgtgccctttactcaatttcagccaatggtaacatcttgcaaaactatagcccaatatcacaaccaggatactgatactgctatacattcaggacaacattttccttactgcaaggtccctcacattgcccttctttagccatcatactatttctgcttccccaatatcccttaactctagacaaccactaatttgttgtccatttctataatttttgtcacttaaacattttttataaatggaatcttctagtgtataatctttgggattaggtttattcagtcagcatagtcctcattgtggcatgtgtcaatggttcattcctttctattgctcagtagtgttccattgatataggtgtatcacagtgtaaccattcatccattgcagcaaataatgctgcagtaaacatt

SEQ ID NO: 40558 - DNA, 2928 bp, Bovine  19866881077746
atgaacctccatcccctcttgattggatccccagagctggccctccttgctctatccgatcgtcctcaggcaccccagccactgcagggacgggaaggcatttggatcctggaagaggagctcagttccaaagtccagctcagactttgggtcccacaggccagttggtgcagttcgtcagaactcagtcactcacagccagtggcaaatgtgccaccagtggccaccgaacagccccagcttccagttccaccttctgtttctacgcctccccaacctcgcacacacctgtgggctctcccacttctgctgacggcccttctgtctccaaccttggggtgcccagctcagctgccccttccctgaagccagtgtcacaagaggtaaagcaaacccacaccaggtgcccccagagctcagcaccaccttccatctcctctctcctagctctgctggcctgaaagccccccttgcctcggagtcagcccgggctatcacaactactactcacttcctatagcccaagaggcgctaagagagtcacacaatgagtgaactggggcctcagaggaggcccccagggcaggaggtggggcaagagagggggcaggtggctcatctacacccactgggagaagatgggagcccctaacgtgggtgagccatgcctggcacgtggacggggtccctgcatggtcctgcggaagtggacacgaggattcagccctgagtcctggggcctcagagcccagcagggctgcaggggggctaagattgggagatgagagccttcaggaggaagccctggcaagccctgtgctcagacagcacgacagtgctcggcactcaggctccgggagcccgaggtgcctgctggaacggggcgggggttgtctctgcctggtcagccagcacctgccccttccccgtgcctccccgggcaggtgggccctacacagagaccaccttcccatgggccctttttctgctttcgaggtccccaggctgcatttcccttggttctcacctgtactgggaggaagccgaaccgatggacccatgctgcacagtccccaagcctctctgtgtccctgttttggagctttagacatggagagaggcctgagctgcctcttcgctgctggcagaggggctggggcatgtctgctctgcagcggctctcagatgcctggaaagccccggcacaaggtggcactcggggttctgccaagcagatgctggcccaaggctggtccctgcatctcccaacatcagacacacggcagagttgaccagctgcgttgcgagtcctccaggcatagtgctcaaactttacacagctggccagtgtccatccaccagtcctcctccttcactcatcttcctttgatgcacttcagggtgagtcttggcaacgctctttaagagagaaaaccaaagtctaaaagtctgtctatgggggaggggtatctggatacggaatgctgtgccatttttttttttttttttttttgctttgctaatcatatttatttattttcaagagctcatcagtttaaaaaaattaaactcatttatttcaaataagtaatacttccataaggttcagaaaaccaaaacaatatacaaaggtttacattaaaaagtttttttgcaaagagctcaactgtattctttgttcttatcttttctaccttatttttcttgttttacagatgcagtacattctcaaacttctctgtgaatactacttggacttttatttaaaacctcctttagttccctgcattagctctgcttgttccattcatcttgtgatttctccttataaattagttccagcctttcctcttgtgtctaatgctccctttgcttcctgttcatctttcttttttttcttcctgtccataaaagtaatgacggcacatctttaatattaaggaaaaaggctataaaaagttcaatctcagaatttgttttagtaaaacctcattcgtgctcctttgtgggtgcatcatgaagttccatgggcttgttcacctgccagtatttctcaccgaccaattccaaagagagagggccatttaacacatcgaaactggcccctggctgtggctatgtaaatggcatattgcttcttactggctatatcaaggttcgtctggcttgattctcctttgcttcaaagttcttctaaagctaacttcacagccaggttgataagtgatcaacagtggcattacctgagctcttcgtgaatcttgtctgtgtacgatcatcttcttccaaaaacgtgggatgaagcctcagtactaattcagtttcactagcagggtccattacacagtcagatgtcacttttgcattgctgttatcgagttcaagcccagaatcatcagatgttttggtctgttactaggtgctgcttccaatggctgtacgtggatgttttcctgcagtgagagctgtctccactgacttcggctccactataattttcgatctgtttcccacctcactgtcgtctgctcacggcctgttatctcggtccttccttgatgctctgaccaagtgcttgctgagggttatgcttgttgattctagctaatgcttttttctcgatgagcttcatactcaccaagacttggttaaattttgctgatgagtgcatcaaagtttaggtctgatcttagtgatcttttggaatctagcttttcccaacagcttgttgttgttcagtcgctcagtcgtgtccgactcttggtgaccgcatggacttgtgcacgccaggcttccctatccatcaccaactcccggagcttgcccaaactcatgcccactgaatcagtgatgccatccaacaatctcatcctgtcaccccgttctcctcctgtcttcaatctttcccaacataagggtcttttccca

SEQ ID NO: 40559 - DNA, 903 bp, Bovine  19866881097008
ctctaataatgaccctgaagttcacgagctttttatttgtttgtatcatagtttaaaatttcatatttgggggacagtttcctttgttggaaaatgggcttgaaggatgctgtgctaaggcacatgcccattatatcatcagagccttttatttgtccaaggattgatataaaataatacctctggagagaaataactcctcttattaatctgtcttgagccagggaaagtaagcaatgaattaaaatgcttgtttgtttctctacaagtttatggtatagagtcatattaactctcaaatcacaactcagtttgaaagttttttccttttgtttatagtttcttctttgaacttaaatttcagttggtagaaaggggttaaaaacctgagcaattcccacttgatatctgggaaagaaacaagtacgagtccttgcagagacagaaaacagagggtttggatgtcaattttggtcacctagcgagaatgtctttgtgggtgtttttgagatggtaagaacactctggatgcatgaaatgacacctctgtgcccctgctgctaggtgtcccgtggcctgaccctacaagatgccaagagaagaggctcacttcttctatggttcccccaggaaagggcacagccactcttatgtcacggctgaagagtaagttcaaatccagacccagcggggttacagttttgctgtttgctgacacagcctctggcttccaccagcacgtctgtccgtaaatctctctagtgtttatttctccagaaataaacctggcaaagagggaaggagaccctgaggtcctacaaaaggtctcaggtttctctgagaccaaagaggcaaagagggagggaaggcaaaaacccagatcttgccatttttgtttgcatt

SEQ ID NO: 40560 - DNA, 2192 bp, Bovine  19866881174898
tcttattgcctgtgacccaaatacatcttgtacattctgacctttgcccatcaaccagttccctggtacatttctactcaggccacaaaaaacgcagttcaaatgtcaccaccttcatgaagtcttcctgacttccacaaacaaagttaatctctcctggccctacaatcctacagcactgcgaagctatcactatttcactttatcccagtgcattggagtcactgtggtttccccatcattgcatcccccagggagactgtgaccttctcaaagaaaagactaggcctgaagatgggaacccactgggtactcaaagacaatatgagacaaaaatgaaaatattactctttctactgtgccttcagcccaaagtttcataattggacaactgaaattagaattttactaagcattcctgtcttaccctctactgtaccccaatgccatatcaaccagagtgtcagccacactctggttacatcccactgcagcaagaataaacacttgaaattgagccgcatcatgtagttcttttggaaactctagtcatgaagatataagtattggctcaaccataaacagatggctaacctcaatgaatctttcttcagtagggcctgccacacagaagggctccttacaccatatcccaacatgaactgaactgagaccaagcttcaggtactgaagacatgctagtgaaagtatgctgtttacagtcttccgtgtccccagtctaatccccagcaggacaaactgaaataaacaggtgtgcacatgccatactgaaaatgagggaagaaagaaagattttcccttttattatcttagaaaatcagaatgtttgtggcttgctctctcactaattattcaatttttagtcctgctctctcataaacctaatattaactttgtttttaccaaacaaatgtatacagttgaaaccatgactacggctatttctctaagacagcatgtattattttggaactctatctcccctccctttctctcctcagcaatgtgtcactaacccccagaccacctagcatgctgacagaatctgtatcaacaacacacagctttaaaaaaaaagagtaaaggagactgaacaagttcagtgcagctttagatacagtgctcatccaggcagaaaacagtgtgtcagttctgtgccagagactgcctaagcacaggggacagtgaacagaatcatccctgccctcaaggagctgacagtccaccagagaacagggctattcaaataaaaataaccggtggtcccagggaaggctggcagattaaagagcatggtcataaaaactgccactgtcagcagaggcagaaggctatgctaacacgccttgctgtcaccaacaccccaaacactgtttgccagccgtgtaaactcactgaataagtctgcaaccctcagaataagaagttttccagaaagtcaacatggttctgggagtcgattttccataaccatgccaaacaatttttggtgtcacaaaaggccaaacataaggaaccccacctgagtttgacttcaatccttgaaggtggcagaaagaaattaataaaaaagcccaacacttaccacataataaaatctttttgcaagggtatgtatgaatattattttggctacagctgcagttccatacagacaaacggagacatagaagtggttataccatgagagggactgtccaataagtgagatgaacactgctataatgagaactgtaaccaagctggtaaaccagcttatcagagtgatgccaagtccacagaagaagtcctttgtgtaggtagcagctgacggagagaaaacaagagcagtgatcactgtctttatcaaatcaatttcaccaccagttagtagaattaaaggagcaaacattaaaacaaaatttaccactataattgaaaatattaaaatttcctaggggtaaggtttgttaaacattacaacaaacaaggaaagtatcagtgaataaaattcaagtatgaacatttgctgagagtctgtgggtacaaaggacccaaagaggtaagtcttcaggaaaagttcagctatattcctgactaggaaagggagtcatctttgatttttaccacctctggaatgctttgtgtattgaaataacagcaaaaatggaaggcagagttacatataaagt

SEQ ID NO: 40561 - DNA, 1273 bp, Bovine  19866881224216
agcctaaatgtccgtaataagtattagttaaaattatggtacacaatttaagttttaatattatatagccattaaaaataaagatgggggttttgatctattgaaaagccaagtgttcatgatatgttaaatacttttttcaggataaagaagtatatatatgtgatatattacaaatagaaacacatacatatacacccttctgggaggaatctgtacagaggaatctgggaggaatctgatacagaggaatctgtaccaaaaagtaaccattagttactagtggatggtaattatggtgatttttcctccatttttatatgtatttcacaactttctacagcataatagtgaatatttaattttttaaaatttgaaagcagcaaccaaatctctgggtatgactggaaacagactgttagtaggatttacccttcagttctctgtgaagtgtctggggcagaaggtcaggtttctctgtagagaccggtggctctcctgttttgtctaggtctcaagcgagccgggcaccaactccagcatgacttgttctttgatactttgaagattcagtgtggctgctcagtgaaggaggtcttgggcagggccgctcagcgacaaataaatattcggctctttgaggatggcaccgtaagtcagactttcagtttcattttacaaattctataaattttcatgactttcctcattaaaatatctttttatttaaaaaagatctcagtattggacctttgggcacaatctgtttctttgtaaacaattttcatttccagtttggaaccctgtgactttttaaatggtaattcattgtcaactttccttaaggtgttgtgttttcatacatggaactcttaggcacatattttgctcatactactcctttattcacaatatgactgttcaaggtaaaggctatgataagcaataagatgaggcaagttaagggaaaaaaatggtgagcttatctagtaccaaaaggggtgcccagcagccctcagacgagttcagatgtggctgtaaaactctggatcttgtggagtttgggactggactagactgctttgccaaagagtcaacctggacataatgatattctgtttttttaggacaatggagagttttgtccagcaatttctccccttggacttctcttattagagtttcagccctgatttgtgtgtgtgtgtgtgtgtgttcagttctttttttaaagcttatttttaactggaggataattgatttacagtgttgt

SEQ ID NO: 40562 - DNA, 1174 bp, Bovine  19866881287964
attgtgtatatgtaccagtccactgtgggaaaaggaaatggcaacccactccagtgttcttgcctggagaatcccagggagagaggagcctggtggactgccatcttcggggtcgcacagagtcggacacgactgaagtgacctagcagcagcagcggcagcagtcccttgtatacacaccacatcttcttgatccattcctctgttgatggacatttaggttgcttccatgtcttggctatgtgactagtgctgctgttaacatagggggtgactgtctctttttgagttatagttttgtctggatatatgcctaagaataggattgctggataatgtgataattctattaactaattttgttagttttctgaggaacctccatactgttttcaacagtggctgcgccacctttagagccccaccaacagtgtagggagggttcccttttctctacatcctctccagcatttgttatttgtagtctttttaatgatggccattctgactggtgtgagcgatacctcactgtagttttgatttgcatttctctgattagtgatgtggagcatcttttcatgtgcctcttggctatctgtttttgttttttttttaaggactttttttaaagatggttgacttgtgtttagataggcagtccctgaacctctggccacttttaataacaggaaaaactacactcaattggcctcatgaaaagagaggggccaggagccatctccccaagtggcctagggaaagggaatgactggtgtcccaccccgacactgctgttgcccctactgagatgcttgaactctcatcttttcttcagtgtcaactcttgtgagccctgtctgcactggggagagaacgtccccttggctctctccacttgctcagtacctccctccaccttttattgccagatctccagaggtcctaccttgtgggtctgagtttccagttaagtgtccactccttacaggcaaatgcacctgcttttagtgccatctctgaaacaagacaaatgggtccttttttattgccatctctggaactagacaaatggtccttaatcaagaatgacacacaaggctcctgcgtcctccttcctaagtgcttcaaaaagaagtaaaaccaagttatcaaaactcagtcatgtaccctgagt

SEQ ID NO: 40563 - DNA, 2366 bp, Bovine  19866881300618
ctgagaaaactggatagacacatgcaaaagaatgaaattggacccttatcttgcaccatacacaaaaactaattcaaaatggattaaggacctaaatccacaagctaaaactatgatatctgggacttccctggtggcccagtggctaagactccacgctcccaatgtaggggggcccaggtttgatgcctggtctgggaactgaatcccacatactgcagctaaagatttccacatgctgcaactaagaaccagtgtgccaaaataaataaattaaatattaataaataaataaaataaaattacaaaactcttagaagaaagtatagaggcaaatctgcatgaccttggatttggcaatgatgtctttatgacaccaaaagcatgagcaacaaaagaaaaaaatagataaaagtgtacttttgtgcattaaatgacactatcaagagaattaacagacaacccacagaacaggggaaatatttgcaaaccatatgtctgataaaatatccaaaacatataattaggatacatggcttgctcctcattcttctccaggctgatagaatggctctctggagccctcagtgggtattccctaaattcctcaaatgcatggaacaaacactgtgattaaatttaaattaattgtggaattctagagggaggatacttattcagttttgtttattaattagtttaaaagagaacagtgtaatacttctttgataatttacatttgttttctgatttgaagtcaggtctcaaagaaaacttagacaaccagaacagcactgataaacactctggaacctatttctgcttcctttcattggtttatttagcaaatatttattgagtggctcttatgctataagccttgcagagtgttgtgattaacaccttgctacaggtgtaggtagctactgatgcttctcttccatgtcacagaatctcatcctcacatgtcccagctatttcatcattttagaaaccaactcagtcaccccacactgcttctagttctcatgttctctctctctcctcctagcctttgtggcggcttttcccagcatctggaacacctgtagctccatcctccttctctgcaattgtgtctggatagctcctacttatctttcaggtctccacttaagagaacttcttctgagtcttggtgagaagcccctcctctgtgctcatcacagacagtgcccatcataatacctcacctagactgcattcttgtgcttgttcagatcctcaacagactagaagctccataagggcaggaaatatgtctgatgtagcactatcctggggatgtaacaacttccctggtggctcagacggtaaagcgtctgctttgcgggagacctgggttcgatccctgggtcgggaagatcccctggagaaggaaatggcaacccactccagtactcttgcctggaaaatcccatggacagaggagcctggtaggctacagtccatggggtcacaaagagtcggacacaactgagcgacttcactttcactttcactctggggacttaacacatagtaacgacctggcacatattaggtcagttttcccagaatcaacataaccaagatgtaaacgttatgaagctttgtattaggaatagcttcaattaagtacgattaacagtccttcccactaacctgtctaatcagtcctggctggggcccagagcagtgacctctaactatcagcagtcatgggagcaagagaaaaatcagtagtttaattttaacagcaggccaccaaggtcgttcctgggccccctctccctcacagctcaggcccacaagaggcaaggccatctctgacatctccccagagagtccttatgaggagtgtgtattttaatttacttactgcagacgactcacagccgaagatccacaacaagtcatccagatctttttcattgactgtttcatcaagagaaataccaagctatagaaatgaaaatgaaagggaaaacatcagctctaaatgtcaagatcagggctgacataaaaaggaatgaatttgaagaagctgtagtgaggtggatgaactttaagagaccgtcttacagaatgaagtcagaaagagaaaaataagtatcttatattaacgcatatatatggaatttagaaaaatggttgtgataaacccctttcagggtaggaatacagatgcagactagagaatgggcttgtggacacagagcagcaaggagagggtgggataaactgagagaggagctctgacatatatacactacaacgtttaaaatagataactagtgggaagatgctgtatagcacagagagctcagctcagtgctctgtaatga

SEQ ID NO: 40564 - DNA, 1542 bp, Bovine  19866881318226
tgaaaagtgaacgtgaagtcgctcagtcgtgtccgactcttagcgaccccatggactgcagcctaccaggctcctccgtccatgggattttccaggctggcccccaacagtacatgaagtttaaatgtcaccccttttcaggctcaagtagagacagacagaagagagagacgctgaaatcccactaacagtttccatttgaacatattagaatatggatttagaaaataacatctgaacctcattttggaaatggaactcttcccaaaccacttggctgtggcaggggcctctgcagatgaagtcttgctttagcagcgctgggctgggctgggctgggcttgatggggcctttcagtaactgaacctttgcttgaaagactgtgctgtctgctggccagcaaaagagactcctccccatcatgagcctgtctcctcctcccctcctgccagctgagtgttccacagagcagagcagagcagtcagctccattagcctttttctttgagttgttgttacaatgccagggtggctgccagaacctcagaaaagaagggttgaagctcaaggcttggctccccagttgcggtagcatagtggggcatttaggattcctgaaattaatagttgatgaggagttaaataatttcacagttttccccctgaatattccagctggtcatttaaggcactttttttttttttcccctctagatttatctacctctgaatacatttttctccttttgaaccatactccttactattgaatcctcatcattgttagaaagcttgttttaaagatatgtggtgacagtatattcaaagtcttaggttctcatacttttatttacaaacaaagctaaccccttcatatgtattcatcacacaagaagcagagcagttcacagattttgtcttcagggtctgttaatgactggagctattctcctcaggattgagaagttatgacttctcccaagtatatttaagtagattcattgtttgctgagaatcaggatagtgggttaagaaggagtgcattattttttactgagtaggtactttccttgaagataattcatcagttatgtaggccatggcatttgggaaactcccaggaatgttgttctatttaagaatgctgagttagtggtttattcttgatgttggatgggtggtcaacagcttataatggggagatggtggcctgagcctagagaagcaaagtgaactgaccgccgcaagacttcagcctcttcagctccttgccacttgcggtgtgctgttcaacagccttatttctaattctcagtctgaagcctgaaactgaaacctcataagcccctttgaagaatcatataaaattgtgtcttacacatatacatttagtatacatttacctgcccacggaagaaaccattaattggatattggtagcaaacttgttgaaaaatgtatcaatggagttttaacactagaaatattttatataaaataaaatatatatataaaataaaattttgtataaggaccaggca

SEQ ID NO: 40565 - DNA, 1669 bp, Bovine  19866881387444
tgtccctctgactaacggccgtgtgcagtttgctcagtggaaagtcactcgtcacagaaggcggcctcattcccacgagtgaagccaaatagcatctttagttaagtgtgagcctgtgcaaaagaaagcacaaaacaaaagaaggcactattcctatggttgggcactcatgacatatgcctgcctcaaagcatctctgaaactctagaaaacctgaggcaaacaattacgccatcagagagccctttaatgaattaaacactgacaagatgatctgtcctgagttttcaaaattaagcatgaatacataagtggctatcgattttttttaaagtactgcctagtacagtatttctttcacatgtcattttatactactccatcaaaacccatgggttagctattattattattctcattgtcactattactcaagcctagtctttaaaatagtaaaagctcacttgcaagacgttctcctcagcaccattaaagagaaatatgaccgcatgatgtaaggcttctgaagatgtcgacaagacacgaaggacttccagcatcactgaacagctaactgcgtcatcgctggcacctttaaatcagaaaaacagatttgcttctcagattttaaaacctttatagcacaaaccatcatggcaagaaaaggagttttcctaccaaggcagcatcagaacatctgcagtagcaccgctctggcatcatcaggtaataactgcacccgccagcagtgacctccaggaggacagggatctttggtttgctcgctgacttactctcagtaactccaactgtgcctggtcccacagcggttgctcagttagtattttttaactaatcaactagaggagacctaaagcaatactgaacactggcattctcatcaccaaaagcaatttaatttatccttattcatatcctctgtagtatcttcacttctggtttcctatgtcatctccaactgccacccactcctttcctgctagtttttctgccaaaaatcataaaagctgcagatcattccacatttagagggggtcagtttggatagtgtagcattattttaaaagtttctccaaggggatcgtgtgatggaaaaatataaagaagacacctaataagaaacaggaaagggggttaatgaccaaagtattaataatatcccaggtctaagaactgataaaacagaggaccttatcaaatcacttaacctcttgattcagaaactttaggtattaaacatgactataaaggtgacttttgtacttagacacttttaaaagtaccgtaagaggtaattaaaggaactaactggatattagctgatgtcgttagcatgctcagtcatgtctgactctgtgtgaccccatggactgtaagcctgccaggctcctctatccatcggattttccaggcaagaatactggagtggggtgccattttcctcctccaggggatcttcctgacccaaggatggaagctgtgtctcctgtattgcaggtggattctttgtcctctgagctattggggaagcccttctatatactgtggaagtagatataatcagttttgcttacattttttacatctctgctcccaaggagattcgtaatattttgtctacttggtatcaaggtagacggcctcacag

SEQ ID NO: 40566 - DNA, 1061 bp, Bovine  19866881638405
tggcagaaaccctaactttatcacaacctgatctttacatttatgactgaaattatttttaaatgttaaaataagtaaaaatatagcatttatgtcttcctacctctcctaccccagactcccttttaaatctgccatgttaaaagcttttatcaatttgtagttgttaagctcaggtggaattaagctttctataaatcatttctcggtcccaaagggttgagattgaggttttaatttattccttgtatcaacagaaggtttttgtatcctgctgtggtgtttggtaagtatctgtactaggccagcatgtttatttttttttttctatgggattattctgatatgacaaatcacattaggaaaagagaatcattttctattataataggattttcttcatttacttttatgttggctttttattctgcttaatgaaaaaaagaataatatatatgctatgcaagagtttgaataaaccatgcttgaaacaactcattgagtttcacggatataaatcaatttgggggcctttttgttcctcaaaaaataggaaaaggttatatttttgtgtaagtgccctttccggggccactgtgactcacttgtacaatgaagacagtaatagtacttactttataagattgcggtaagagttaaatgaatgaatttatttaaagtgcttagattagtgcctgacacatagtaagcaatttctgtgttagccattgctatcatcgttatcatcattattaaagttagtattgttattactattacaatgtatacatatgcatatgctttctcctcttgctcttcagcctatcacatggaaagaatttgcaaacatccaacccctttgtgcctctggaccaagctcaagggtaccagcagcttttccgagaacttgagaaggatttgtgtgaactcactggctacgatcgaatctctttccagcctaacaggtaaagggatttcttcttctgtctttttagttatcttttgtagtataataccccctgggaggaggactagacgatccaaagggcctcattttcaga

SEQ ID NO: 40567 - DNA, 1260 bp, Bovine  19866881757044
ctccttcaagtaggcaaacacttttactttgtactgcacgtgaaaactgagtacaggggcaaaagaaaactttcttttggttcatgcttcacatctacaatctactctaagagttcctacagtggtacagggaagagaagagggaagagaatcttttcagagtaggaaaagctctggattctcaaagatttagagatccaccaatacaactccttaaacaaacccccagggagcaaactcaacctctcaaagaatatctaaatgaggttaccctactttaactggaacttacagcccagaattgctgctctccccattttgactctcaaaagtagagtcaatcacacaattacagtgctgctcaagcttcatttgcatacctaccacctggggaccttgttaaaataaggattctagttcagtggggctggtcaggtgaagctaatgctgctggtcctgctgatccaggactcatactctgaacagtaagaaactagtatgaggctgacttcctacaaaatgcattttcaaactctgatgttcatcagtgtctcccatggggtcttgttaaattcaaccacttgcaattttagggtgaggtgaacatctataataaatatccactaagtgattctgatgttttatcagagattaaaagcaagagacctaacatacaaaggtggaagaggaggcaatttacatcatggacactgtgaatgtttttttatttatgacatttttcactatgtggcagtaaggtatcttgaggaaggagtgtattttcctaataagcacaaaactctgacttctcaaagatttagagattgaccaatataactcttccttaaaaaaattccgacctccagggtgcaaattcagcttctcagagaagcatatccaaatgaggttaccctactttacctggaatttacagccttgctctctctccattttgactctcaaaggtagcatcgatctattctgtcctttctccttttgactctcaaaagagcattttacaggataagggcaggtctttgacaccaatccagtagaaacctactacagacacactatcttgtccaaggactgtagactgtatttccaaaggagaatagagataataatcactcccatggctacttgtcagcttgtaaataaatacctggagcactatctttcttctgtctccaactaagtaggaacccaaggtccattcctaattcctacttgtctaccattaaagagaaatgaaagcag

SEQ ID NO: 40568 - DNA, 993 bp, Bovine  19866882028826
aatatctgagtggaatctggcttcaaattgaatcctgagaactattttattcttttcagagaccatgactcttgattaatagtgttgaacatctaacattttaccaacaatagcctatctttcattgtccaaggaagtttgtcaagtgacctttagtttgttttgaaacatgtgtgactgaaactcttttgcatttttgaagtaggggcccttttaacaaacatgccctggactgtacagaaatgagaaggcagaggagagaaaagcttaaacatacctatttctgttttgatgtttctgcactgaaattataactttcatgtttacagtaatagaataactggtacagaagttaaaatgtataaagttcaaaaggcaactttcttctgtagaactcaaggtgctgtacaggaatcctcagactttcagacttcaaagctcaaaaagtgttgatcaaaccccccatggccctgtgctctaaaggtcctgcagttcttgaggcatgctgttggaggcactccaacagcttatactgttcttcatatgggttgtttctctggtttgcttgacattctttgaaaatttcatgaataagagcttatagtagtgaatgttttaagggaagtcctttcttctactttagaacatttccaaaggtctctcagcccagtggagggaaagcttatatataagtaacgatgtttttaccctaacttgttaaattctcctttcttgtgcagcaatttgaacttattgcttcctgagaggaggtagctttgtcagtgtttacttcatagtttaaaggatagaccctgctcaagacaaaatgtagcttttctgagcagtggaaattatactgcagtagaagatcttgatgagttgtctgtattttttttctttcagaatgccagtggccagtatctgggagaagtattttttgatgtctcgttgtttgtacactgtgggttccttacagctctcacttaccgaggg

SEQ ID NO: 40569 - DNA, 1498 bp, Bovine  19866882080754
tgtctccgaaatgtctaacatcagctttgcaaatccctgttactgttgccttgcctacacctgtgactatatcccctaaaataatcaatacagttgcacaagcagcaacagttccaggaactacacgttctgtatctctttctaaaagacaatctcggacttcggtccagtttcagtcaccgggggtttcaactacagtgccaacaaatataaacacaaataaacctcaaactgaattgccatccctttcaccaaatccaggtaaaataattaacatttccaattttgcttctctgccaaaccagcaaatgtcccctgctttcttaaaatcgatccctagttacagttctactccaggtgtcactgccattcacactgctacagcaccatcaaatgtaactagtctaatagggagtcagttcagtgaaccttgtattcagcaaaaaatagtcatcaacaccagtacacctttggcacctggtactcagatcatgattaatggagcccggtttatagttccaccacaaggtcttggagcaggcagccatgttcttcttatatctactaatccaaaatatggacctcccttagttgttaatagtggccaaggtgctcagcctacgccagtagataacctggcccagaagatcacactagcatcaaataattctttaagtgggcaacctgtaaaacattgtctaaaaagctctacaaaaattgtaaactctcttgggaatgcaagttctctatccacaatacctgcagcaccacaaatcataaacccaactgctaaagtttctgttccacctcctgtaccaacagtgtcactgacttcagtaattaagtctcctccagcaactcttttggctaagacatctttggtttctgccatttgttctagtaatcctccactgccaagtaacacttcagtatttcatttggacacgtcagtcaaaaaattactggtcagcccagaaggagccattttgaataccataaatactccagcatctaaggtttcttcagtctctccatcactctctcaaattgtatctgccagtcgaaatcctgcctctgtcttccctgcttttcagtcatctggcttagagaagcctgacacagctgcatcttgaatttagactaaacgagccagtttttaaataatggggcattgttttgactcccataaaaattttaactgtttattatactgttgaaaacatactatacatagtttgtgtgtgtgttaatgtatcttttcattagcttgcaacaaggctttgattttcttggggaggaaaaaatctgttccgtttcactcattgatgtgagtatgttttcaaaggttatttgtttaaaatagacaggatttacctgtctatatgacataaattgaacagtcaagtttgactagtttggaataagctagggttttgcacacctgcatcgacatgtttcttcttgaatttggactgttgcagcgtgtatctctgataca

SEQ ID NO: 40570 - DNA, 1798 bp, Bovine  19866880393218
cttggaagcaaagaattctaaggccggcccatgagttattgtggtggccactaaatttttcttggacaaagcccattgggccaagtcttgggtaagtatcaggaacaacaccagaaaggtcaaaaagaaatctctctgtacttttcagcactgggttgaccttcttccagccgtagaccttgttgacgctgctccctgagaagccacccttcagccagtgacaacttcttttgccatcaagatctatgagccgaggacggtcagccaggattgtcccctctccttcccagctcagcccgccattccggtcactcctgcatgtgtgggtggccacacagactgctgcagggagctgtgtgtccctggagactggggcactgggagcctgaggccatgtctcacacaatcccatccatgaaaatcctccatttcttcctcgacgattggagtatttccagtggatctgtgctctttgtccaaaattgcaccgcagttgccttgattctctgttcctctgactcattgcctcttgtccttgggactgcacatctgttctctgagattcaccagaaagtctccagggcttgaccaggagtggcctggcccacttaggggacagccatccggatgtgaggcctcaattcatgtccgatcttagacttgtttttaatggggaagggtggctgaccgagaccaagaggatttggggaaacaatcaccagagaacaagcgcaatggtgattaacgtatgtgttcagtgtgagacagttttcactgcaatcgctgggcaatcgaggtcggcagcagggacagttgagtgtttcagctcccttcccagggttctggacggagagtgactgtggattccagcgggagtccagtgacgctggacttcgggtctgtgcgtcttgcccctaagcgctggccacgtctgttgctagtacatgctgatctgaaaaccaccacgaccgaaaggggtgggtcccaagcatgtgctcctctccacattggagagaagggtggtggagactgtctccatgctgtctcgacccgcctgcctgcccctgggattcctacttctcctgattcgctgcttctctctccaggagaacacacgctcctccaggagccttcatgaacattcacagacgttccgcaggtctcaggaaccggctggggcttcttatttagtactcatgggtagctggggcctggagagctttcaaagcccctggtttcgccagcagactggggatgaaggggccagggaggggggaaatggcgtgtgaccaggctgagccccgtgtgttggcttcggatgactgtgtaccctcgctccaaggaccttaattggctgatagagcgactgcttcagccaagggcccaattaatacccaacatttgagggttggttttccaaccccagttagatgagtttcttggcataaaaggggtaactgctgtaaatgcaatccatttccttgactctgcgcccgctctgtaatgtaagggtatcgctctgtctggttaattccagacaaggttctgtgagcagatggggaatttgggtttttgaatttgaaaaaaaaaaaaaaaagcctaagtgagtgtgagttttatgcagttacgttgatacttcttccgtctcatggaaaatgtgctaagttccaatatcgcagaaggcggactgtgagagtggagcagagtggagcctgagagggccgaggcctgccctgcttctatgggcagtcggtccagggaacctgccctgagccaggaaaccccggctctgcccctg

SEQ ID NO: 40571 - DNA, 2007 bp, Bovine  19866880407049
atggactgcagcctcccaggctcctccgtccatgggattttctaggcgagagcactggagtggggtgccacattgccacttctctcttagtctataactcgttttttctttgtatcagtgaaaattctctgagtcaaagtataaaatagccaattgagtttttttaaataacctagccatatttccatcagtgtgccaaaatgaaagagagaaacttggttgttgcttttcaaagagttaattctgatcaccatgtagcatctctcttcagcaacaggagcctgtcagcccagctacgaactcaagccctcagcagcagctctgcttctaaacaccgtctcatgtctggctcccttctgctccgttctgtctttcactttatgcaagtgtttctgctttttccaacgtgctcttgggtgtatataaatgtaaataaataaagacacacacacacacacaaacacacacacacatcaaattacacgaagaattaaggaaacgctctaagtgaaagtcacctttatgtccctgtttgtttctgaatatttcaggcaatgaaaatttaattcatataaatattcatgagtttctccatcaatccacatatacatcttaacatgtatcttccttttttctctgtgtttctgttgaaagctttttacttaaaaaaaatcttgtaatacagcattcctttgaatagaaactccattaataggccagaattatgtaggaaataaagtgaactaggactagtattattcacttatacttacagtttaataccatattattaaattttcagttcctattattaaaatgacatttatatcctgttcaactgccaggataaaaaaaaaaatccgctcctgagaagcatggtgtccaaatgtagaataaactataatgcctcgaattaactgctgctattactcaacaaaaataaaagaaataatacaaatgctaaaggttgcagagaacagctgggaaatattgccctcttgatggaagttaccttaattgtgaaataattcccaaaccaggatatcattatttaaatatgcttttctgtcccctgggaaattttttattattctgtgtctgagtaataaagtctccctctgttgtttacttacagttattgctgtcagttgcctggccaataaaatacataaactattatttatcacaagaaatacatgtgttttatagacatctatggtagattttcagtactttttacaggttctgtaaccaataccacatctctaaacatccaaggcacgctctgccccgagggcagcctttcccagctgcgacactaaatgctagtcaccagctattttgtgaaatttatacattaatccatattacgactccgcatctagttagtactccattcattctcttgagcacctacgggatgccaggagctgttttgggataaactaggtctcaccagtgaaagagggctgggcgcttcctcatcatacagacagtgcagaccctgaggctacacctgccagctgaactcaattttaaacagaacttctatacctgtggcggattcatttcgatatttggcaaaactaatacaatattgtaaactttaaaaataaaataaaatttaaaaaataataataaagtaatttggaaaaaaaaataaacagaacttctttactggggaagtaacaagccaactattaaaactaaactaaagtaataattatgacgatgatgcttataataatcataattcgaagaatactgaaagaacgtcaaggatgacatttaatagtgaaaatgttggtcgctcagtcgtgtctgactctttgaaaccccatggtagccgccaggctcctctgtccatgggaattcccagacaagaatactggagtgggttgtcattcccttctcaaggggatcctccccacccaggaatcaaacccaggtctcatgcactggaggcagattcttcaccatctaagccaccagggaagtgctttttaa

SEQ ID NO: 40572 - DNA, 1619 bp, Bovine  19866880426873
ttagaccgtttcagatcgccatctctagactgcttccacgctgccagatgctaggtctgcaggactggtgctcaggtagaagggggggtttactggctaaagcagactcgttgacaatttatccactctgaacattcttgttacatcacagtgttctctcggtataggaggaaaatgggcattattcagaaatgttactgaaaagcccactcagaaccccgaaaagaatccgataaagttcttgactcaagattgtgtggagatggagtttagggctctgctttattcgagacttgggattcgaattcaaggggcccctaattccccactctcaaccgttttgcgggaattttaagttaaattcctggccagtgcaggtggagggccggtctgtgctccatgtaaaagcactttcatggagaaaagggtcaagaaaacgggactggggagagacaagggcttctccttttgtagtctgaagaggcacccggatcgccgcagcctgcgaaggcagggagggtgtgtgtcctgctgccagccagccagtccttgccgagggcttgccgtgtgccgagcgtggtgctgcgtgcgtggagacagatgtgcgtcttcccagtgactccccgcctggcagggcttgcggttcacgagagcgtggaagggatgcccgagcaccatgggacgctgcggcacgggcatcggacttcagctgaggccttgagtaagtgtgggttagaaaggccgggagaattgcaagactcttgcagcacggaccctgagcccaggtatgttcgtggaaactttgaggaatgaagaaatgaagacatatgcagacatgcagattgtgtatccccgaggcgtggcggaccctgcctctcagtctccccttgctcggcctggggtcccggtcaggacgtccaggcccgaccctgagatggctcacggctcggggtgcatcggcagtcaagctcacccccttcccaggaggaagttgtactttgccacccacctagcttccacatcatctcagaagtaataaagcagacaggccagtttgtatttgccaaagtctcttatgctctgagcttgtaatatattggcctgtttctcctccccctgaagaaggaaactttgttctcatatttctttctgagcaagacaaatgcgcagacacatatttcacgggagctgagtgccgggtttcaagtccaagaatgctccttgttttctcctcccccctcacccgggccgatcacacacagatgcctgcagagggcgtggaaagggatcttgctcttcagaagacgaatgaggggcacgtgttcctggcgaccccctggaggctggggtgcggcctcgctcaccaccaaccacgggcttgtctccagagagatatttgcaaccaggctcccttacaaacacctcttcgaatgaagccagtaaagccgccctgagccgcctgctctacattgggcccatgtccctggcagagcgcgtgtcttcaggccctggcctggctcttgcaactggcccggcccctcaggcaggtactgctatgcatctgggccttggactctcatcccaaaatgaggtgtttgcacagatgatttccgaagttc

SEQ ID NO: 40573 - DNA, 1140 bp, Bovine  19866880548550
ctgctgtgtatttaaatcttccctaataaaggcttcttcatctttatttgctttagtgtttcccatcagttttcattcctcctttctcctgggcacactgccttgaggccaccccatcactctccaatccgccttcgttgacagctgtgcgggaagctctcaccctgacccatctgggatgcagagaaaaccttgttttctttaggttgtttgcagcttggaaattgagcagaaataaaccccagtcttcctctttcactggcccaagcaaattccttttttaaagaaaagctattttagcaataagtaatggaagattaaagaaatgtgatactcttaaaaaaaatttttttttcccatagacatgctttatatgacagctggtccctgggaccctggtcttgggactgtgggcgtggtgactgtttcttggccaaaagacagatttcgagcaagtgcttgctttaccccacccaccacgctccagaagcttgctggcctgcaggtgactgacttgtctgtgagtcagcctgtggaaggctgcggggagcgcacacgctgtttttattacaggactgtccttaaaacagagcctgggggcccgtggtgtgagttgtagagtgtctcatgagagttcctggcttctggtttgacaatcatctgtttaaaaatgtagtcttttgtgagcttgtggcccaaaatgatatggtaaaatcgaagctggagactcgcagctgtgtaagttgcagaagttatgcaagtaggagcagagaataaatcagaccaaacgctggaaagatggacattgaagggatgaacactggaggggtggaccaaagagagcttcttcagagaaaccctaaatgctatctatctgcatagtaggggctgaagtggcaacccctccaaaagacgtgtccacgtcttcaatcccagacctgtgactgtgaccttaactggaaaaagggtctttgcagacatgcccaagtgactgatctggataggaggtcctcctggattatctgggtggccctcagtctagtggcaggtgtcctcataggaaatacaaaagggggagaccgaggaggggaggagaggccctgggacggggggcagaggctgcagtatgcggccaaagcc

SEQ ID NO: 40574 - DNA, 1891 bp, Bovine  19866880779542
acggtgagccagggaagctgcacagctgtcacagtctcctctgttggtgtgccaggagacgcaggagtcccaggcagaggcaggcagggataaaaggaaggccaagaaacactcaaaccagtccaccctagaggaaatcaaccctgaatattgattggaaggactgctgctgaagctgaagctccagtactttggccacctgatgggaagaactgactcactgaaaagatcccgatgctgaaaaaattggaggcaggaggagaaggggatgacggacgatgagatggttggatggcatcaccgactccaatggatatgagtctgagaaaactctggatagtgaaggacagagaagcctggcgtggtgcagtccacggtgtcacagagtcagacacgacttagcgactgaaccaagatgcacttccccaggacgccatctgtgctggacagcatggtgctctgcagaaatccatcaccaccctccagcacaaaatcaaggtgggagaaaaccgaggaaatacaagaggcatatcccgtcaaaaccccctgaaaggtctgcctaactggccagttcagtgccgctgtgaatagccgctttcaagtttagaacaatattctaactgaaagtcttcataactcagggctccagatacattgataaagattggttcagatctgtagaaaggttaataataaattacaggtaaacttcatgcttaaaataatctctttgtaataaatatgcacatacattaaaactgtacaaaaatggaaaacagtttctctttcctcttccttttcttgttatcgctcagagtgacggtccacacaactaaaggctgtttctttgcaaagcacatacttgcacagctccaatcacccaagtgatttatggaggaaacgactttgtgcaggtactctaaccaaaacagagcctcactttgtccagtgttcaaggccatgcttaatgaaaacttcaaatttggaagaaaaaaaaaaagtagtactgaaaagagaagaattattaaattttagtatttacctgatttattaacatttcctcgtgcatttctttttataatttgtgccctgcctaatggaggaagaaaaaacaagtgtccttttatttaccggctttgaaaaggtcatgagaataagaaaaggatacacatacattgatggctgtctcagtttccattttactgcacattcagttatgaggttgttacttcaatgtcaccgctggtggtaagtagagtttagcgatttgcaaacattctcgctctttttaacctgatttcttccagggataaaagcacgtggcacagtcaggtgagactcttcctgtcacaggtacagccgtgacagaaatgccacctggggagccctggggcgttgcagatctgctctgcaagcatggagtccccaggaagctggagacactgcaaataacagaagagacacacagggcgagagctggggctcgtgggacctagaaccattggaagatgatggaagtcgagcacacgcacgcaggcgtcacggagtgtgtcagcgtctacccagaaagctgcccgtcatcaaatgaccgaagatgacgctcggggggtaagggcatcctggcaaggcgaggacaggcaagagcagcacacctcccagtcaccaggacaggctgatctcagcgggcacgcggcctgcgggccggtcaccgtaggacaccactatgtggacaaggatatcccttgcttacttgctgggtggtgctgttatgagtgaaggtcctgccactcagacgaggggccaaaaagcactttggggggacttcacacgttgaaaagtacgcacctccacccagccggcagccgtctctgcagtcactggctccaaggcc

SEQ ID NO: 40575 - DNA, 4048 bp, Bovine  19866880865088
attctgaaccttacagtacacgtgactccagcccctcacactgaagatgagaaaaccaagactcggagtgtctgcagcccttgggtcagagtcagcagctcggggctgaggggtacacggccctgcatgtcaggccacacgggccgagccacacgggccaagagacggcaggtacaaacactcaggatttcacgcgtccatccggagataaattccaggagcacatattttattttaataaaaacagctcatgaggtgaaggccctctaggaaatatgatacaagtatttctctgaataattattagctttaaaaaacttgttatgggaaaaatggtatcctgcttttcagaaaaatcactaataactctggagaaagggcaagtgattaattttaccacaagaaagctcacaacattagccatcacctagaactgtcccacatcgttcctttccctgcgtgcagattcgcgtaaccaaagctggacaccgtctccagggactcgctggtgtcccccgcgcggcctgtcagaaagcccagctgcactgtctctgggccgttaacactagatgtgcagtcaggtaatgccccacatccctaccacggaaagttaactttttctcaaacgaaaactggagtattaactgtgcctgctgggtttggagaacgtttcccatcccaaaataagcttataagcacagagacaggaatggtcactctgctgataactgttttaccaccgtctgtcaaattagggaaaatggcagggggaaaaaaaaaaaaacccaacctttatattgtcatttctgtgtgcctgttcttttcaccattgaaaatgacggtggagctggccagaaagtgagccacaggcaggggggcgacacagcctcgtgtctcactggctccttttccagggggcagagttgcacctgacgagggaaggtgccacacacgccgttaacagcatagcccatccactaaagggtgtcactgctcctcgttaacctgccttggtctccatttttagcttttatccttctcttgaaataaaaaatgagcatcccttcacgtctgtgtaccttcgagccgtggcagtcaggctcagcgaggtcgggaaaacaccacgaacagcaatgctcggtgcaggctttctgagtcgctcaggcgtgtccagctcttggtgatcccatggactgcagcacgccaggcctccctgtccttcacaatctaagaaatcctagactgggggcgaggatcagggcgtcacagccctgttcctccagtgctggccgttcctaggcactaaaaagaagtcacttaaagaatcctgcagaagactctaaatcccggtcctgcccacatgctgggcattacttcacacattgctcttatgcactgaagtctgggacaaaaactacaaaaagagacaaaaagacgcccaggctgtcttctctccatagcttgtggatctgagctgccaggtgatatgggggcagggggagatgcacgaaactattattttgtaaaaaaaaaaaaaaaaaaaagtttgtttctaaaaacagtgatttcatatgaaaaagtagcattttagaaaatgaaaactaagtgcacatttgctcaaagcattttagaaacaggactgttacagcatacagatacagtatttcacctccgcagtgcacgcatctgtggaaacacattcactgcccagtgacctctgcctgcactgaagagaccagcctttaaaagcagattcaccttctccactatcgcaggaaacaggaaccgagtgggaagtctcctccagtctaacacttactgatattatttattgttaatttgagtctttattgttgctatatgatcctcttagaaaactggctaatatatatattatagttcatgtatatatttattcttgtttggctgctaagtcgtgcccaactctctgtgaccctgtggaaagtagcctgccaggctcctgtccatgggattctgcaggcaagaatactggtgtgggttccattcctttctccaagggatcttcccaacccaggggttgaacccgtgtctcctgcgttgcaggcagattctttaccacccagccgcacaggagctcttgtgcgtatatacatgtacatgcaaacaaaacccagaacattttccagccacaacaaggaatgaaatcttgccgtttgcagcaacacggatggatgtggacggcgtgacgctgagtgagcgagtcagagaaagacagatggtgtctgccctcacgcaatgggaaaagacacagcaagcagaaaaagggaccgacaggtacagagcgcaggctgctggttgccaggtggggggaggagtgaggataaaggcgacagcaacaggtgagggcggtcaagagccacccagcaggaagacaggggaggcggggggtgcggcagacggcgggtgaggacggtcaacacgcagctgctgcagccttgaaagatgctcagagcagatctcagatgttctcatcataagataaaaaacactgtacctaggcttatcatggtgatcattctgcaacatgtacaaacatcaaatcatgatgctgcacatatatgccggagaaggcgatggtaacccactccagcactcttgcctggaaaatcccatggatggaggagcctggtgggctgcagtccatggggtcgctaagagttggacacgattgagcgacttcactttcacttttcactttcatgcactggagaaggaaatggcaacccactccagtgttcttacctggagaatcccagggacgggggagcctggtgggctgccgtctatggggtcgcacagagtcggacacgactgaagcgacttagcagctatatgccaactagcttgcaattttttttaaaaaggaacaataacaaaaaactatttctacctgaccctaactttaagaaaacttgtactgctgtaaacgtgtccagtccatccacagtcacctcaggcggctgacatgcaaacttggtagctccgtatctaaaagaaattttagaagcaaggtttcttcctcaaagaatagaatgctgtaattctttttaaaagactatattttagttacaggaaaaaataataatactctgtcaaaaatgacaacaatatgcacttttttccaccttggaaactttagacttgaaagccgcccatagtgtaactcttccagcgttccagttgagtcctgagaccaccagagtaacagcagcgctcggaaaccacagggccggcctggctggagtacacacacggccgccggggaccggaaacgcagccagatggttctgctgagggaggcacttttctttataaaaccaaaaaggcagtaataggtcaaacacaaaaatgcagatacggtaaaaccgaaagctagtgtggagactgatgtcaataagacaagcacagctctctgcggtgttcccatcgacagcagtcagtggaggcagggagacaaaggaaggaaaagcaaccccgtcggtccagaccagagactggagtggttcagtggggccaccaaggcctggaaaccaatcacacgtgagggtgttagactggacacttacgaaggatcacaaaaacagcagaaacggacccacgtcccaagtctgctcatgggttgctggcctgtccatctcacccctgtcaggaccccaagaagccctcctgggaaggcactggacacgggtctgggggcagggggcacggcggggacggcagggtgctgggccgagagcttggagccgcccaggctggtcagaaccaggcctccagcgagcaggcacgcggcccaggcaggccctccggggagagtcttgggaggggaagacctgcccccacgagccccagcagagcagagcagggcagggcggccacaggtcagagctcacctgagggtctgcggccttgtcttctgggcaagggcacagggcacgggccaggggttgggggtaactcaaggggcgggtggggccaccgccaacctggggtcactggagggcaagga

SEQ ID NO: 40576 - DNA, 1430 bp, Bovine  19866880881957
tttgtcctttcacaacaggaaacgcatgccataggacaaagctggtattaatttacttaaaaaaaacaacttactctgtttctacaatttagatgccctaaaatgtctaagatctgaaaggataggggaggcctcctttctccaaatcaacacactccccaggtttcaagagctgctctttaggacacagatgagaaaaggcaaggagatccaaccagtctatcctaaaggagatcagtcctgggtgttcattggaaggactgatgttgaaactgaaactccaatactttggccacctgatgcgaagagctgactcatctgaaaataccctgatgctgggaaagattgagggcaggaggagaaggggacgacagaggatgagatggttggatggcatcaccggctcaatggtcatgggtttgggtagactctagcagttggtgatggacagggaggcctggcgtgctgcggttcatggggtcgcaaagagtcggacacgactgagcaactgaactgaactgagaaaaggcagggcattgggaggctctggaatgctctccccttttattttctatttttcaatggaacccactgaatgtggtggcacttctgctgcaaaagaggctggaatctcagttctctcaaagctgctgctgctgcttttggtcactcagccgtgcctgagtctccgcagctccatggacagcagcccaccaggctcctctgtccgtgggattctccaggcaagaacactggagtgggttgccattttattctccaagggatcttcccaacccagggattgaacctgtgcctcctgcattgacaggcggattctttaccactgagccgcctgggaagccctctctcaaagctactagacacataaactgtagattcttgattcacagcagtagggagtggactgtgggagttggggctttgattctgagtgaccaattcttgcaaactcaagtttaaggaaagatactggaagtcatccaaaatcaatcttctctcaatttcattatttcaggacaagcagtggagccttcgcaccgtacggaacaaaatcaataaaagccaagaacaacagggtacactctttcgagatcatctcgtcaagactccgcggaggcaaacacaatgagggatctgtgagctgctagaataacaccattttcactttgttattcacagggccctaatctgagccccatcttcctgtttcaaatgccgtttcaatatttgaaatctccacagctggtaaaatcacaaacacatctgtgaatttctatccccctaaatcagatgagcaagtggccttcctctgtctcaggttcagatattctgcattaacatactgctttctttctgcgtgtattttttgtgtccatctgaggctcaggacccttcccggaaacatcagc

SEQ ID NO: 40577 - DNA, 1701 bp, Bovine  19866881055196
cggctcagagtatcacctgtagctctcgagaggaactaaaggcctttgactttgcttaatgactaaactattattagtcttgttggactgtcttcctttgtttctatagtctctcatttctctaattaaacttatgctttggctaaagtttttccaaggacaaaaggcaggcgaaggacatgcgggggggcaggaccacagagtcctgctccacttcaagcagaagaaatagagggaagcagagagtcactcgctgctgacaaagtgcgagccccaacatgcagggccagcgatacggcatggtttaaggcctcgtccattcccagcgtcagacagctgacaccctgggcttgtacactgttcagagagagaaggctgggtggaaaaacccctaactatactttagttcacaggccacaagctgagactccacgatgctctttctcttctctttgctgttttggaaactgaatgaatcggttacatttttcaaatactagccagaacacatcagctgcttcttttaaaataaacttccaaaatggggcaaagtcaatgccaagtaaggactctgcttctaaatataaacttactacaagcaccgcaggcaaaagtgaaatcattcaagaaacctgagtgctgaatatttagagggagaaagtgtgcttttcatggatttctgagtctttgtagtcaacaggagaacacaaataataactgatattttaaaccccatctggatatatcatactgacaaaacacaacgaagagattaggaagcacattttgtgaatgcttagtttcagtggtagacagcgtgcttgaaaaaagatactgaggttgagagagaatttgtagatttcactttggatccatcatcaacttcctacaggaaaagccaaagatcatttcctttctcaatatcgaggatatcgtcaagcacaggcagcactacggtcaccagacctaagtcggggacaggccaggaactgcaaggtccttggagagacagaagagtgggctgccgtctatggggtcgcacagagtcggacacgactgaagtgacttagcagcagcagcaggcacgtttctatcaaggtagctctaactgaagtccaggtgtttaaaaaaaacagctgaaaattcctcagagggaacaatggctcagtctacaacatgacatggaacagtcagaagcaaccaggcaggcccccaggctcccgccagaaaagcggacccagttttacatctgctgggaaaacagaggcaccaagaacttaatgatcacaattatagttcgatgaggccgttgagagtaacttactttcccctttactttcgtaaaatagttgccaggacctgggatctttaactcacaccctcctccagcagaacagcatgcccagatacagacccggagcgggacagacacacagagagaaggcagccgggtcaaggacagcaattccctgcctggacggaggcagccaggtcaaggacagcagttccctgcctggacggaggcagccaggtcaaggacagcagttccctgcctggacggagcatgccgtggccgcggactcgccggacgttggtgggccccctgtgcttggtgtgactttaacaaggccttgttacttccagcttgctttgaagtcctttatccctgtcactgcatagtctaaactaagtgtttaaaaa

SEQ ID NO: 40578 - DNA, 1039 bp, Bovine  19866881081553
ttagcttatttccttcttgtgaggacacttgtcggggtggaaactggaagtgagttaagtggaattttatttattctccttcccaactggacacagcttggaccaaacatggaaaggtaccacagaaaggcaggggcaggtagaacattctaactgaggactcagtcagaggcaagaagattaaaccagattttataattattttcccacatgacatatttataaatttctataaggagggatttccttgtgcccaaatacacttgcaggcatttcttttggttatttaaactatcatagaaatcacttacaaaatcttcatctacaccagcaaggtagcacagcccacagagcggtgtcagtgagcaccacgagggtttccttctttgcttaaaacaagcatccatcgcagcattttctaacacctggaacatggtggccaagtaacacatggcctcagcgggagctgtttaccaaaccacctgagacaaagcagctttccaatagatgtgcacagcccccagggtgtgcatgcacactcactgtgcacagacactcctgctctcagagcagccaggctctgccctgacgccaggacacgtgtgtcctggaggagcagcccctgggcgaagccccctgtgcacaagggtcccagacccaccggtgggagggaggccgggacaccctcctcactgaggccggtgagctgttcccagtcccggggtggttgggaaagagctccaaagtataaatagagcccaggacaaggactatatttacttaggggtgactacagcacagaataatttaggtcagctgacgcaagagctgagaggctgaaccgtgacagcaactgccccgggtcccccgcggtcacccagccaggcggggctgcccggggttcggtcgctggcctgcgcagctctgctctgtcctccccaccctggctgatgcgggcccgacaggatgagtttccggcccgtgagcggcccccgcggtaacgacgggccctgtgggtgaacctcctgtacctgtgctg

SEQ ID NO: 40579 - DNA, 1273 bp, Bovine  19866881082773
tgccggctgctatttaaacgcgagctcctgccagcccaagggggctctggggggccacagcggcaggaaaccagggcatttatgactgagttcctgttattgacttactcgcagacgaaacgccaagtttctcagacacagcgcagcagccccagcgtgcaagccccgtgtgtgccgctgtggcgttaggctgcagtttctgtttcacgtgtcaggacttttttaagatgacttttaaaacgtccctcccacgttttctgtagtggtttaggggaagtcgttgactctaaaatgaatgttttgtgtttgttcacttacatgcagagtacatcaggtgaaattgggctagatgaaacacaagctggaatcaagattgctgggagaaatattaacaaccttagatatgcagatgacactactctaaaggcagaaagtgaagaagaactaaagaccttcttgacgagagtgaaaaagctggctttaaactcaacattcaaaaaactaatatcatggcatctagtcccatcacttcatagcaaatagacagggaaaaagtggaagcagtgacagattttattttcttgggttctgaaatcactgtggacagcaattgcagccatgaaattaaaagacgcttgctccttggaaggaaacctattccaaacctagacggcatattaaaaagcagagacatcactttgccagcaaaggtctgcatattccaagctatggtttttccagtagtcatgtatgggtgtgagagttggacagtgaagaaggctgagcaccaaagaattgatgcttttgaactgtggtgctggagaagactcttcagagtcccttggactgcaaggagatcaaaccagtcaatcctaaaggaaatcagtcctgaacatacattggaaggactgatgctgaagctgaagctccaatactttggccacctgatgtggagagcctactcattggaaaaggccctgatgctgggaaacattgagggcggcgggaggagaaggggacaacagaggatgagatggttggatggcatcaccgactcgatggacatgagtttgtgtaaactccaggagatagtggaggacagaggagcctgatgtgctgcaggccatggggtcacaaagagttggacacaacttagcgactgcacgacaactaaccacgtgcccaagtcacacacggcgacagtggcctccggtgctggcttccccggtggcacactttgacagacggcctctggcacccttctgggccaagg

SEQ ID NO: 40580 - DNA, 794 bp, Bovine  19866881108302
taaaatgcactagaaattcactccagtcctcatcagtagacacttttacacttttacacgacagaggtgcgtctgttctatttcgtgctttctttactgtcacgtgctcactcccaccagcagcagagatgcgctgctctgacattttctaggctaaagtcgtctccacaaactcagaggcacagatccatgtgcttcaacaaaattaaagcttttgtttgagagagaaaaaaaatggtctccaagtttcctgtaaccaaccttctaaagaagttgagtggctttctatttcaaagagaagacagacatcttgctgtcatatcagaggatcaacttcccctccttttatcatcttaagaactgaagcgtctctttcctgtctcatggaacttaaagctctgtcttcatactcctaggtttccatagggagctcactggtcgaggctttgagatggttccgcgtcacgctgtttgattttatgaagcactgatttggaactggtttggaatgtatgctttctctttctcccattgtgttctatatccacttagacattctaagaaataatgcttgtttctaagcagggagcacacatgacccagcaaacgtccctgtgtgctgcagtctgcacacccctgccgctctgcaaggcagtgtggtcaggtggacggctctgatgcggcccacggcgttccagagtacagttcccaaagtgtgattgggcagccctgggaggtcccccaagcctgagaccctggagccccgggtccagccaaaatcatttctctaataa

SEQ ID NO: 40581 - DNA, 707 bp, Bovine  19866881656425
tgggcgctacacccgtagccttaggccttttctgaggtcacagtaacgtgaccatttctacaaaaaggggactcagggagcacgtgtgtgctcccggaacgcggcgtgctgtcggcagccctgcgtggagggggcgctggggcggaggtggaggtgccccggatggaggtcacagcgagcacgctctcggggagcggggagcacagacagaaagagggcgcagaatgcctcctcatttaaagcgcggctggtctcttcaggcagctcaccgtgaataacgaacctgggagttaaaagctttaaacctgttaaagaagcaatattaggtttggtataaatatagctgaaataatccagacagttttatgaccttacaccccaaataaaggtgaaatgctgaattctttccctagaaatagtggtaaacacagctaacagatggaagagctgcatggaaatttcagtaacgagggccacaaagaagcatttgtgagctcaggggcgcacgctttagaaaaagaagctgaaaaatggagctttgtttgattttgatagagtgccaaaacagcactgcattccttacagggcgaataaaggctcaagaccggcctctcaacacctcccgaaaggccccgcgggccccattttgccaggacgactatttatatgacaggtaaggggagtagttctgctggattcagttacag

SEQ ID NO: 40582 - DNA, 1349 bp, Bovine  19866881738884
aacatcatttgcagattacctatgatttaagaccttgtcttactgtaataaatcttagaggaaagtgatgttcttttgaataacagaaatgctgaaacttgaaattactggcactcactagttttctaggtcatccacttttcaaggcgtcataaatatgcctaagctttctgcatccagacacaaagcagttctgctcggaatacagccctgcgtgcgccccgggccgcgtgcacttgctgagccccctgctcctgccagggcaggctcagggcggcgaactcaggccgcctctgactctggggacctggcttgtatccagctctcgttccctggtccatcagccttccccacctctctccctcccttcactgcatctgtgtgtttggggcgacattcctggctctgtgctagctgttgaagattgaagaaacccaagtctcacaaaatgtggccgttctttcgtgtgtacttttgctgtggtgtttctgggcgtcttttctaaaaactttgcctgtcttcagtcgccacagtttggatttcactgactgcttatttccagtattttcagtctttttcactctgttattgtttcattttgcctgttttcaaaatttttttcctccttttagctgatgttattaattttttggtctctttgggatatatatgaagtcaacattaaagagatattaaggggaaatatttaaggtcattttcagaatgtgctattattttcatttcctcttgtgtaaattctctcttgaattgtagatcttggttctctgtttagcatgagtaaataattgtttttgaattatttaaactaaggtgtttgaacttcatctgaacgctgtgaggagccattctacttcaagaagaatgtggcctgattagattttacattttgggaagatcattctggtagcgtggaagatggagtgtagaaaggccaggaccagaggctgggagatgtgtttggaacattgagtctgtgcaaaggtcatgatgagagacccgggtgttcgggggtagactcagcatggacataggggtcacgaggagcagctgcgttgtgcagggtggggtgcccaggctgcctggacgcccttctccttcaaggccagccctctttcctgctgcacctctggccacgttactcactggctgcttggaatagaacgtggagcctttgtttcccttgcttccactgaccatcatgtcagtcaagaggatggttgctggacacgtgtgtggtgtcctcagatatacagaggaataagcctggaaaggactgtatgtgggagaaagggactgaggcttaggttgtgacaaaacgaggaggaaag

SEQ ID NO: 40583 - DNA, 849 bp, Bovine  19866881854668
tggggacagggtcctatgggccacttggccaatggggtccacctgggagcagccactaggcaggggtcaccccccgcctctgtctgcagggcccacgccctctcctgcctcgaatgtgggtgttcctggcgaatagtttccgtctcagtgtggagctgtgcatctgcctggcccaatttctgcccacgttcggtgtgcaccatgaaaggccatttttctttttgaagcagatccaaaataatacacatgatgaagtgcaggcaggatgcttgtggaaaaaggcaacttctcccaattttttcagtggaacggatggctgagccctgtgagccgcatctgtcggaggagcaaagcttccccccttcaagtcagggtatcagccgcagaggggagtccagagcaccccgacggcagggccacatggccgaggcccgcagctcccagcggacggaacgcccgcaccagtgctgagctgtgcctcggtttactttgtccccaaaggagaataacatgtgtcttttacttagaagacagatttttatcaaatgatctcaatggagaacccttggaatgcctttgaaaaagtcaactgtaaatacaggaaatcgaagaacggtgattacaaatagcggttgggtctctgagcatctggttaaagccattggactttcaggtttctgctccgaccagcgcacaccgacgggactgtgtgttcaagtctgtttctgcagatgaagagcttgactggccacggaggactgaccgcgggcagaggggcctgaaggccagtactggcgatggaatgcgtctgagccttctcgctgagcttcagaggagacagagctccca

SEQ ID NO: 40584 - DNA, 1298 bp, Bovine  19866880348430
tatagttgtacgtaaatatactcatgtatattcactctgggagcgatctgaccagagaaagggtgctgacaccatgcagtgggataggccttgcaaattccacctggttatagtatccaagatggtgttccggtgaggattctctcagcaagccgtgtgcagagcaatgattgtttacaaagattattcaaattctagcccttctgctcctggctttgtgcttcattccagctagtcaatgtgcagaagagcaatggggaaaaaatgtagctgagatctgaatatattcccttaaatacacctgattacccaaggccccaaacttctgctttacattaaacatgaatttaatgagtttgtgatgaatttctaaagaagctctaaatgaaatgttttctaccttacctattttaaggttttcacctcaaactttggtggtggaatagaaaaaaaaaaaaaaaagaataacaacaagctttttcacttggagaatcttgatagtccaatgtatagcatttttccagctgcctctcttcctctcacccactcccatcaaaggcataaactttacaatgaaatgcctactggagagctcttcattgactttgccaaaagccttccttctgtttactcacctaacttcagggccaagggaaccaagttctgcctttaaagattagctaaaaatcctatttttgtgccctctatgagatagttaaataatgtttgatgataaagagtgattggtcacttgggaagtagatctgaaaaaagatcatatcagcctgcaaattctaggaagtatcaaactgcagaatgaccaacaagttggcctgtcatataattgcagagagaggtaggtggcagataaagaaaagatcccaggagatgcttgcattgattgtcacattactggcttagctgaaatctcccctgtctaaatcctctgtctttttctatttctaatagctttcactctccatccccatcagactgtacttgccctctattggttgctgccaaatgaatgttgttggctaggctttgtgaaacaggtgcctgcttgattatttgcaccaatgtgatgtatgtgttattatgaaatgagatgaaccataactagtgcatctggaccacaggataataaggaggagaaaaaaatcttgcctcttcacaactaggggagaaaactgtcacttataaatgaagatttttttttagaatggatcattggtaaggcattcaagagtccataccaggagttatttttaaatcctttcttcagttaaaatcattaa

SEQ ID NO: 40585 - DNA, 2832 bp, Bovine  19866880469051
cctagacttggcttcttgcctcttgttcaggcaccaaacagctgggattactgacaacctccctgagacaccctgggacacactcgcttactttagcactacttaaatctctctagatagtgtattgctttgtttcctccaagccaattattgctttaatctcacttcttatcctttgcctccctgagactaaaggaacaagaaagagtacagatcagaggctattaacctgggttctacaaaccccaatgtgaatagacttagggccaacctcgaacaaaatccctgacctctcaaagggtaagaggtccagaccctcttaatttcttgaggatccaggtagattaaaaagcaaatatacctcaagagggctgtaaaaacagttgtttatttttaactgtttattatactaaatgaatttttttagcacaaaacaatatacagcaatatatgtgtgcaaagtctggggtacttaacagtgtttattacaaaatatgaattcagagtgcattcaggtggtatggttataaggttaaggctgtgtggtgaatgttttatttatttatttttttttcagtcctcagaatgtgtctctgtgagtggtgtgtgtaatctcattttacaaagaaggttcagggacttccctggcagtcccagtgggttaagactttgccttccagtgctggcggtgcagcttggatcagggagctaagatttcctatgccccctggccaaaacccaaaacataagacagaaacaatattgcaacaatttcagtaaagacttttaaattgtccacattaaaaaaaaaaaaagaaaaaaaagaaagaaggttcatagtccaaatgtgagtatggctgggaatgtgcgtccctggccacgtgatctccctgctgcctttttattcagctcttcctcagaggctttgtccctgacattgaatgtgaacttttatgttcatgtattcattgcctggattttctccaagcagtccattctcccccaaattaagaactacttgtctcagaaatagcctaacctgcaaagagttggacacgactgaggaactgaactgaactgaactgaactgatgaagcccagaccaatgaaaagagcttctcatttctgagatacagaatactcttcttttaaattgtgaaaatattttagccttgcaatttaatttcatattaaaagcgcttttaaatgacttgctgcgttttcaaatgtgtaataatcttaaaattcttcttgttttctttatttgccacctctccattcctattccagaatccataaggtttaaaacaggacactgactgttctgaatagtcaggggtctaaccctcaccttgctgtgtgaccccgtggaagtgctttccctcttgatactcagtttctacgtctttaagatgagatggtgattccatttcacaagctccttttagttttaaaaactatgatttctcttcccaaatactttaagatccaatctccaaagccactgtcatggtgtcctggccaacttggttagacataaaataatttgctctttactacaaccaaaggcagtactcactagctatggattcagacttacttttccccttaacccgatggcaactagatgtttactttgtcatcttggtgaacagatcatttctgataatactcaagaactttaaaacaaagatgaaaaaaatcctgacctttggcccaaatggtgcagtggtagagtccgcctgccaatgcaggagacacgagagacgcggttcgatccctgggtccggaagattccctggagtagtaggaaatggcaacccattccagtatttttgcctggaaaattccatggacagaggagcctggcggtctacagtccatgggttcccagagaatcggacacgactgaacacgcacacgcgtgcgcacacacacacacacacttacacacaagttgctggatatagtcctgcactgatagtttgaggacactagatggcgatatgagtgcatcaaataacaagcacatccagcattaaaatcccaatgattgaggccagagtaggttaatacattagttaaagaaacaaagttaaatataatcaggtgttggagtgttagctaatactctgaatgtgttcagtaacctgattcttagcgaaagaaaagagtgttagattagaaattattttatgctactgctgagtctatcttcacgctaattcttggggcaagagctggcaataaacccatgtatcccataaaatgtatctaattcacacttttctctccatttttggttttcatcttttaaaaatagcagttgtttggaatggagtgtgccctgtatatattattcatagatgaagtactacattctcattaggaatgtgagtcctaagacattggtgtttgaaaggggaaatggctgacttactgtaagccgttgcctgggccattattgactggcaggatcaactggaagcactttgttagtggattaggttgccctggaaatgccttcctgaaactctaatgatgcacttaagggaaccctctgggacaggagtaaaatgtctctttgcaggcgtgtcttccaccagagtcctcttgggatgagatgggagggggcgggggcacatccagagagaagcttcgtaaggaaacagacccagaaaaaagttgcaggtaacgatgtcttacgtggaagccaagataatgacttactgatagaaaccctgtttttttccgagggtaccagttcttcctatagtcttgggaaggagcatcagaaattccagagagactgaaggtatggatgtatatatt

SEQ ID NO: 40586 - DNA, 1875 bp, Bovine  19866880508808
ggattcctgcctgcagtagtagatacaatggtcatctgagttaaattcacccattccagtccatttcagttcgctgattcctagaatgtcgacattcactcttgccatctcttgtttgaccacttccaaatttgccttgattcatggacctgacattccaggttcctatgcaatattgctcttcacagcatcggaccttgcttctatcaccagtcacatccacagctgggtattgtttttgctttggctccgtctcttcattttttctggagttatttctccaccgatctccagtagcatgttgggcacctaacaacctggggagttcatctttcagtgttctatctttttgccttttcatactgttcatggggttctcaaggcaagagtactgaagtggtttgccattcccttctccagtggaccacattttgtcagaactctctaccatgacccatctgtcttgttgtagataattaccttgatcttagtagttaatttcaaccaccatttataaaaactggcaaagtagatattctggaaattgcatgacatttcctgcctgtcagggatatcaaatttgggtgttgacataattctgaggcatgtttactttacttggctttttagacagtatgctggctatgactactcgcaccaaggccggtttgtccccgcagacatgatgcagccacaacagccatacaccgggcagattttccagccaactcagacatatactccaactacacctcagccattctatggaaacaactttgaggatgaaccacctttattagaaggtacagttggttgcaactcttgatagtactctataatatccagatggtgaaagtaaatctttgtttggaggaattcctcttgtctttaaaagaataaggttgtaggaaaaaggtttctactaagtgactcatttcaaacaacactgagccagaaagaaccagatttttttaatagatctttatattagtgataataaagtatgtcagtatgtgagcaaagtaacctttggaagataacctttggaagtccagtgaaagctatgcatactcttctcagaaaaatgcacatatatacatagaagacatagttttgtatacgtttttgcagggcctcctgtgtttctgaagccccggatatagagccctttactatgaatgctgtctgtgtattctttgctataaagtcatagctcacagtgtctgattcattatgtccttaccttcttctaacaccaaaccagagatttgatatttgtggaataagcactgtaatcagtaaagatggattgaggactcactaaaataatatcatctgatgttgctagatcacttttttgatactggttgtttcattttcttttttcaccctgttacaacataaattctggtaaactgaaagtatatcacaaatcctaattgactttcttattttctttttctttagaattgggtatcaattttgaccacatctggcaaaaaacactcacagttttacaccccttgaaggtagcagatggcagcatcatgaatgagactgatttggcaggaccaatggttttttgccttgcttttggagctacattgttactggtaagattctagttggaactctcagtgtgagattaaagaatggaatttaaatattccaccaagagcctttattaagacttttcttttacatcaagttttgatgtgtcttaaaaggtgttggaatttttaagtttatacatatttgtcacttcaccattgataatatggtatatttagaaatcatttcttgttctaataagtggtccaattattagggaaaattggtaataaataacatgtagctttagtcgctcatcagaat

SEQ ID NO: 40587 - DNA, 1534 bp, Bovine  19866880619376
tataaataaaagtttataaacttttcaataatgattatgctttatggtgtgtctaagtagtttccaaagtctttttgataatttaaaaacttaaagttatattgagataaataaaataattgatattcactgagtatctagatcattttaagataaaatcctgaaatattaactattgaacatgatttaacctcctttatcttccctttacagaaggactttgggtatattattaaacatgacttgtgaaatattggaaaacttaatatgaagaagaacgtacttccagaaattataaaatgtgtttataaatttgccaatccacataattctattgcaacaaacaatccacagtttcttacctctctgctgtcttagctcagtcggtagagaatctgccggaagtgcaggagtcctgggttcaattcctgtcaggaagattccctggagaaggaaatggcaacccgctccagtattcttgcctgggaaatcccatggacagaggagcctggaggactatactcctcaggttgcaagaatcagatatgacttagtgactaaaaccaccacctgccttcttaggcaggaacaattatctacaactaaaaagcaaggacattgggatacagaagacctaaagaaggtattcagtgtcacacagcccatacgtgctgtagcttaaattcaaaccaggccatctgaccagagctcacaacttttaccactaagtcaaccttatccttcttggagaacccaccatctttggcaaatgcttagaatctctccttgggagtgatgaggagtttcatgaatcatccttattttcttgcgtggctcaccttgtgaccagaaaaatagattttacaatgagtacacacaaagcatgtatgccaagaaacataaatcagtgggtgaaaatgcaaggggggaaattcatacttaataaggagcagatggactaaaatatctttgttgtaggacagggaatataagtcagcaaagaggttaaataaagagttgattcaatgacttcttcccaaagatgagcagagcatccaactgctggctattaaaagaaatggcaactagaaatcttgagtgctcagctgggcttgagctttgtgcacaatgcctattaagcatgacactgaagctgaaattttacacactaggtgggcaattataataaattcatttttgtgttacagatttttttccccaagaagaaaaaaaaaatactgagatggggaagggtgtcaggtcaaagccttgatgttcttttattaagattttttttaagcccattagagtctcagggttttgaggcgattgtacagtttttgataaaacattacccaagcgaattatttataaagctgcaggaaactgcaaactctggtgaacaaatctttttgatgtcctcatctcctgcaggcctgttttggtgccaccctctgtccccttctgcagatattctttggctatggctgcccatttgcctcaaaaggcagcccagccaccaaagaaaagcaaa

SEQ ID NO: 40588 - DNA, 1026 bp, Bovine  19866880674378
aaattccctgaaacacaattttaataggttgatttttatacaatgtgattcaaacttccttgcactcctagtttgtaatacattgtgtgatagatagtagaagcttatgttctctttgttgaatggatgaaaaagtgttagccttgggaatttttaataatttggatacatcacatgtagatttattcataattaacctacaggcactttaaatcacctatttagtatataaatagataaatttagtatgttaactatgaagcaatgatgataaatacaaaaaaagaaactctcctgactgcctcttcactcttggccccaggaccttggcatatactcttgctttgtcttaaagaagtttccttctccttttgtcatctctcattcaactcaaatcccatctcctccacagtattttctctacttggtttagttatgtttgccttttatttgcatgaatctgcttttattaaagcagggaaggtcattgccatacatctaaggatctttttagttcaatgcatgctgctgttgctaagtcgcttcagtcgtgtccgactctgtgtgaccccatagatgtcagcccaccaggctccgctgtccctgggattctccaggcaaaaacactgagtaggttgccatttccttctccaatgcatgaaagtgaaaagtgaaagtgaaggtgctcagccgtgtctgacttttagcgaccccatggaccgaagcctactagactcctccgtctatgggattttccaggcaagagtactggagtggggtgtctatgccttctccgcaatgcatgctagggatggtctacttctttattctccaatctagaagaagttcagtttaaataaccacatcagaaaacaaaaggaatggaagccagagaggatgagagggaagatgaacacaggtaatataactttttttttttgtaattttgttttttacataggcaccctgcagctgtttaataaaaccatccccttgcagtgataaattacttgcaaattatatcaa

SEQ ID NO: 40589 - DNA, 1334 bp, Bovine  19866880785713
gagtaggatgattattcgttaaaattatttttactctccaaacatacacttggaataaatagcacatgaggacacaggaaaggccatctggtgactctgtgtctgtttgtgtgccctttggattggttgtcccatagggctcagctttgtctatgctgatactgccccaccaggacatactgtctaggagggaggcattacttacatgttagaaaggacaaaccagtgcaatagcaaggcattgcaacacgaatctcactttattaaaatcaaactttaatcatgaattgtggaatagaacataggcagttaggaactgctaaaatattaacacatcaattgaaacagaaacccaggcactttattatcctcatgaccagctctgggatttaataattaagtctttcagtttgatttatttagactctaagcaaactttcaaagtgagtttgaggggctttgtacttggaacatgaatgcattgcatttcccaaggcagtttggaactggggtttcatcacttcaacaccctgctcagaagcgggtattctgagaaacttctcctgagcacaattactcattaattgtgagaaggacttcagacatctcccttaagaaattaatcttcaggaaggagggagtaagggaaagatataatactgaggagggaaacttgtattagtcacagcatattaatttctcttggtactacaaagtagacacctctctcatctaagcctttagctggttctacatagttcctcattggccagagtgagtggaaagatgcacccctttagcatttagaaacattagtcctttgacttgatagtgtggaacgttgaaactaacataatcctgagattaatcatgtggcaaattctgagataaactgagcctgaacatacaatgtaacatcaacccatctcaaggaacaggattggtaaatcaaagaaaagaatgagacctaaatacagtacagatttaagggtagcattttattcagtggcacataataatcttcgtttgagagaagtcaaggaagggagaaagggagtgaatcacacagaaagatgtctgcaactagttttaatacaagagagtgagaacaacagagaggagggaaggagaaaaggagagagaagaagagaatacagagaaaacagaaagagaaagaagagagcactgctacagcaaagcatagtatccaagcttcaaaatatgctttggggatatttgagcattggaaaatgaccagttgacttagtcatttgccaaatcatgcgacaaacaggatctaaatgaaaaattgtgtctcatcactgtgatgatag

SEQ ID NO: 40590 - DNA, 970 bp, Bovine  19866880865180
ctgattgtggtatttatgacataatactggcagtctcccatctttagtgcatggtcaagatagagagctgtgagctacagttatgtcataggctttggaatcaatatacagtttataatttacaaaattagtaaatgttttttttgaatgaacaaatctttagtggtttcactactccgtgttgtagaataagtgtgtgtgcatgcttggttgtgtccaactccttgcgaccccatggactgtagctcaccaggcccctctgttcatgggatttcccacggaggattactggagtgggttgctgattcctcctccagaggatcttcccaactcagggattgaacctgcttcttctgcatctcctgcattgacaggaggattctttaccattgggcaggtagaataagtattgatatataaatatgcagagctggatttgagatctgtcagtaggtctgtggaaactctgtgtatctcacaattgtcatctgtgagctaaagggattgtcctagatgactttgtaggtccattctatccttaacatttaatatgtgtccccagtgggtaaatgtgtgtgaaaaacatttcacgcctcttggactttttggtgagtttaaaagcaatccatccatttactagttatagaagtcaatctgtagaaaactagtagaaattttatacactgtcatttctttaatgtccttctagttatttcatctgtattttcttctctgtggggtcagtgctgtatagtatggtaaaataaatctatcttctgattgatagtatgaaaattgctacatagcctcagaacccaaatgggttgtcatgacaactgatgacatttctttcctgcagactgtactgggagtccatggcctgtgtgtccctgcaaactgttccatgttatttgtgcagtgggaaagctggagccagtaatggtgtgaaggtaggacattatccaactca

SEQ ID NO: 40591 - DNA, 1375 bp, Bovine  19866880898322
taatcttcagccagattccccaaatgaatcaaattgttttcttattttttgccaccaccttccaacaaaataacttttacccttaaatcagtgatgtagagatttttgttgttagctgtcttttatttaacccccaaataatcagttgcaaaactattttattattagctattttgtcaaaacagctatacagtggagttgcctttgatgtaagtaagagttgagctcatgaagagtcatatgtagccaaaatttcccctttgtaaaactcaaatcaaaaatacagtatatatagccatatttgtgcatacttaaaaaacagatatactgtgtctcaagaatgccatgtggtaacttttttctactggttcagttaagtatcaggaagagcatatggtttgcttttacacccattttatgccaaaacatgcttgtacctttaaatactggagatgctcacagcattactaaaagcttgcctgttcactgtctctgagtaaaactgtctgggagtggagtttgcaggttcactcactcaagctagtgtgtcgtttatgcaagcacgtgtatgccaaggacatgcagttgattttacatatagtgtaaatgtgtattttacaactttgctgtaatactgcatttaccaatggatgtttcaagagctgtataacaaagcttatagaaataggcattctttcgccagatatagtcatgcagataatgaaaaattctgtaaatctttaaatattaactatcctcggatgctacccatccagtcaaagagaattgtttaaaatatatctaatgacttgatattggataggatctaagtactatgcatatgacatttcacaactctaataggcattgctcaaaatatacttataaaatatactaaatattatcaaaactaaggacaattacgtctataatgttatcttacagggtactcttatgcaatcatggagaattatgggcatcacgataacattttgagatctgctgttttcatatagagcaggtctaatgtaatgactcagacagtttgcttaacttgccctgtgggaggaaaaatatataagtgacacagtgcttggcctttcataaagtggggccaaaggttttccaaaaaacacagcttggtacacagatcatagcatgaatagaatagcactggaccttccttcaaaactttagctagagcaagcttcctccccaaatcatggccccaagtgaaatttatcctcccaagtatccactaattcatttggtagtgtcagattccaattactggtcaccaaatgaactcgtttattaaaaatcttaatttatttgggaaaaaagacttaaagtatttctcaagcaatttgtatct

SEQ ID NO: 40592 - DNA, 1549 bp, Bovine  19866880903336
attcttactgaggctcctcctgggtgttcagcactggggtagttactggaaaaagttatgtgtgagactgaccaaggcaaatcagtaatccttaaagttaaaataataatcatgacatcattataaaatcattataaaaggagactataggtataattataaagtatgtttagaattgattactgttcatctaaggctatcatttggcttctaattttgcacatatactttcacaagacaaaggtttgatggaagggagaaatgaagagtttaaaaatgaagatattggctcctaatcaaaattattcatactggaaatgatggaattaactaaatgagaaatggagcaatggctaatgattttcagatactcctaagccatcctaggatagaatttctatgactctatcagtcagctagtatcttaaagtcaacagatgcattaggattttagcattttctcctctaagcattaatataaaatgtggttaaatttcctgacaccccaagttcaaattagaagtttcctctctacccttttatcaatttacacttctttattgcatgagattgaaattgcccattaactagttcaatctcttcttaaactacatgctccacgagaacactgatgaccaaatgcatctcatttacaggtgaatctctggaactgcgtgcatcctcatgtgcatagtaggtgtttgaaatatattctagaaggaatgtataagccaaccataagacgtttaggaacctagcacacgcaaaagcaaaggctcagcaaggccccagggactggcatatactcacacaaccagaaggtagcaaacagaattctgtacaagcaacagaggctagatatagaatctaccaattaaaggaggtcattctaaaatgccatttgcagcaacatgaatggacctagagactgtcatattgagtgaagtaagtcagactgagaaggagaaatatcatatgacatcccttatatgtggaatctaaaaagaaatgatacaaatgaacttacttaaaagacagaaaaagacacagatttagagagtaagcttatggttgtggggtgagggaaggatggggggaagggatagttagagagtttggatggacatgtacacacggctatatttaaaatggataaccaaggactactgtgtagcatagggaacactgcttaatgctatgtagcagcctggatgggagaggagtttgggagagaatgcatatgtatggttgagtccctttgctgctcacctgaaactatcacaacattgttcgtttatcggctacaccccaacacaaaataaaaagattttaaaaaataaacaaaggaggtcattctaaggaagggatgacacaatcttggtataaaactaaattgtacttcacatgatgctttgttctttgtgcagatgatggaagatttcaagggcctgcagtttccaatccatgaggcctgtgcacaatgtgaatcacttccctggcagattgtgggagaagtactagagaatcatgagcatgaggaatttgtgaa

SEQ ID NO: 40593 - DNA, 1203 bp, Bovine  19866880916912
tgtttgaaggccagtaaaaaaaaaaagaaaaaaattgccactgcagccaggatttgtgagagtgatatttcagaaaaaggaagctcactgaggtgaggtgtaaagcctaacaccactttcctgcttgggagaatttttaacatttttttttttaacagaaaatgagagtctgaggagccaaaatagagtcagcaactacagatagacaagtcatcaggattttggcagttttcaggaaaaggaaaacaaaaactcaagttggaggatgtcaaggctgttagtataagaggaaataagatttttcagaggacagagggtagatacataagcctaaaagtgttagtcacttagtcatgtctgactgttcacagcgctgtagcccaacaggctcctctgtccataggattctccaggcaagaatactggagtgggttgccatttccttctctagaggatcttcctgacccagagacggaactcatgtctcttgtgtctcctgtattgcaggcagattctttacatgtggagccactggggaagctacataagcctacaactcagtattttcccattgagacatctgctagttcttaagctgtgtctttacatctaacacaaaaccactttgttgccactaaagcttctttcctctattaagtctgaagaacagagaatatcctatgctcctacttgatttcaggagatagaaatcaaatgattacggagctcatacagctgatgaaaatgaatgaagtacttatgtggaaaacagtagggactggtggggtctgcagtaagctggaaaggacacactgcatctaaagaaggcaacaactgaggaccaagaaatgtgtggtttttaggaacaagaattctgtatgtttaacacaggagagtagctctgagtaaataaaattggagatgaggatcccaaggaggagggaccatgacaagaactcctgcctttcagttggaaattctggagacctacaccttaggaatacttatcttttttattaaagaacaagtgttttttttaatatctattcatttttattttttgctgcatcaggtcttggttgcagcatgtgggatcctcgttctctaaccaggcaacaaacctcagttacctgcattggaaggcagattgttaaccactggaccacagggaaaatccttaggaatacttatctttacactcat

SEQ ID NO: 40594 - DNA, 958 bp, Bovine  19866880930868
acgggctggggagcaacggtgcagtctctgccttgggtaatgctgaggcaccagatagcttgttggaggacatgttgaaataaatatatgtagcttttattgaggtaaccgtttttctatcaaggacacgtgtttgtgtgtgtgcaggcaagtgggcatatatgtgttgctagcatcaatttgggtaggtaaatggaaacacgtgattattccacagtactgcaaggatgatggaaacaatatgctttttaaataagcagatatcgcatggaagcaggacccaggtgcttcctttctgaaggaaactcccaacacacactgagatccactattaacaatgaacacatatcgacagaaaagcccagagattctcaaatcaaattctttaaggcttataatactgtagattcagctttaagggggagaaattaaaaagcaatcattttaattattatgtttatgtcaagttaagctaactgctacagtaatatcacttggcttagtctactgtaattaattcagtgaatgtacaaagaaaacaaattagaactatttatagcactgaaactgagtggaaatgagatattgcccaagtgctattacaataaatataggttgttgacactccttcaaactatgctttaggactttcagccatttatgttattcttcaatggtaaaaacctccatgaaataaagaaaattccaatagtggatctcatcaatcttattttcagatgtgcatgtcacgttgagtaaccaggcacttgttttatttgagccaaattaaataaatctcattaaggaaatgttactagtatgcaaacactgaatgcattaaaaaaaaaaaaaagctgtctctgcaattagatacaaatattacatgactttatgagttagtcccacagaggaaaatcaggtcaagtttcctctcatttaacggcatagattctcccca

SEQ ID NO: 40595 - DNA, 1000 bp, Bovine  19866881235205
cataactacacagctgaggcagaaagatgcatgttaaatgaatttaaaaactgcagcttacctaggtggttttgaatagctaagcatggtgatttcttatttattgtctagtttaaccatgtcatgccttaatttctatgtaccatgaggaaattagaataaagtcactactagactctagtgttcatattaattacttagggagtttctgaaaaatccatcttcacagtctccattgaaaacattaatccacatggtctagaatggagacccagaatgtatacatttttaacaccctcaggtgattttaaagttgttgtaccatgagtcacattttgaggatttctagaaaaaaagattttcaaaagtcccttccaatcataattgagcagaaatgagatcactggcttccccagatacagtacggaggttttgttaggaatcggcattttttttaacatatggaacgcccgtgatctccattatctgcctatggttgacccttttcttcccctgaaactagagtggaaaaaaaaagcttatgaagagaaaaataaccattttcaatttttaagaattgtcagtcagctctgaaattattctaagccataatacttatatcctatcatagatagtaaatgagctgcacagaagaaatcacaaatgtgagaaacagtttataattttaatgaaactaagaaaactccataatgtattcttcttccaaatgtcttttccctttagccctctgcttgcagattgtggacttttggagagaatgcacatagtcttaaactttaaaagtttacctttgggtggcttccacatcctgcctattgtaaatagtactgcaatgaacattggaatgtatgtatcttttcatggttttcttggggtatatgcccagtagcggaatttccaggtcatagggtagttttatctttttcttaaggaaactccatacagcttttcataggactgtatcaatttacattaccac

SEQ ID NO: 40596 - DNA, 751 bp, Bovine  19866881237910
attttgaaaagctctatttcactcttatcaagtcacacatgtacctctgatatcttggttaccatcagagccactttttgagtcaagttgtccaaagcagtaacatcagagccatataagctgtttgagatagagttctgtttgtgtcagcctatcgtgaagcccctggaagtctttgcttaagctgtgacatgacattcccataacactgacagagaagctgaacaggagttccagacaagaacgtagaagaaacagaagtcagacttattcgggaacttataagacttcccaaagtgcaagctgtttaagcaggtcagctctggtgaaacgtatcaaatgcatagtcctggcagcacacttgtcacaacagagatatctgagctaacctttaatgagttggaatagttttaccaccttagggaagttgggtggaactggaaataaaaatttcatcttaacttgcagtatctatgacccagaaatgtatacaagtcaaacacttggggtttggtggcagagaatagacctacagccaccagctgtgatagtgcatacgttattttctatggcttggttccttcatctataaaatgaagataaattgtcaacttgtaagtcagaatcaaagggtataacatttatagcccagtgactgggcacaaaacaagcatgtaataaagagtagttactatcacagtttttaatattcattcatccattcattccaataaatattgattatctacta

SEQ ID NO: 40597 - DNA, 877 bp, Bovine  19866881279332
atctgagcctcaagcacatctcccaattaccctagggtctctccaaacgacaggctggtttgcaatatgtggttccaaagactgccagaggacatcaggcaattgtttgaaaatgcaaccagtgtcatatatcttcatgataaattgggtttccattccatcaggaaaaacaatgtctatgacattaaaaaagaaaaagatttatgtatctgatagaaactggattcaacctgatgcctcttgaccaaccccttgaatttttcatatatgtaaatgagatcttgagagctgttacatactgctactctgttgtagtaccatcctattgaacacagaggctaagattacccctagataggatattaaataaaattataaatttaaatggaaaattagagaaagaactatggatggaacagagatggaattctaatttgcaccaaagacagtaagcaaatgcatttctcttattgccattttgcccaaggacatttgtacatataggtctaaagaaagaaagagaaagtaactccaatgaaagtgaccaaggggttggagcccagtttgagaacatcagtgctttgtcactagctaatcagagtccagagagagtcctttcccagaagcccaatgagttaatgacaactaaggttgtttggagttcaacaaaaaaagcttttgaatcgtagttctgttccatgtctcttataatcatttatttactcaaatatttaatcaaatatttacatggtctgtttgtacaaagaactatgtcagacactatagaagctgcaacgattaatgggacctagaagttgccctcaacaagctgatgatccagtagggcaacacagcttactctgtgtccgaattggag

SEQ ID NO: 40598 - DNA, 1221 bp, Bovine  19866881534026
aaaagagaatgagacttttaaaagcttcatttttatcactttacttagtggaaaattttgggaacattttaatacagttgactcttcaaacaccctgaagttctatttctgagataccaatgaatattaataagacttcaaatgatttgctggaaaaactagaaaaaaaggcaacagattgcaacatggtgaaggtacagttcaaaataaagaaatagttatttcagtttcatattaaagtataaactttactaaagctctatctcctatactgatcttttttttttttttttttcaaaaacacaaaacctgagagtttaaaataaaacccacagacttccattaagtaagcctgggcttgacgcttccagagtagacaccaacaacatacacacacctacatggtatagactgatgactttaggggttagaagagtttcattgtgaatttgccaaggactcattatgtgattatgtgaactcagatccattttcttcttttcatctccttttcttggcaacactttctactttcacaagaagttaactccccctctttcttttccccaacccaaccaaacttgccaccatttctttttgctgttgttattacctttttaaaaaggatttttaaaattatttaatttattttaattggaagatagttactttacaatgttgtggtggtttttgccatacatcgatatgaaccagccatgggtgcacatgtgtccccccaccctgaacccccttcccacctcccttcacagcccagcccactgggttgttccagagcaccagctttgagtgccctgcttcatacatcaaacttgcactggtcatttattttacatacggtaatatacatgtttcaacactattctctcaaatcatcccaccctccccttctcccacacagtccaaaagtctgttctttacatctgtgtctcttttgctgtcttgtatatagaattgttgttaccatctttataaatcccatatatatgcattaatatactatatcggtgtttctctttctgacttacttcactctgtataagaggctccagtttcatccacctcattaaaactgactcaagtgtgttcttcttatagctgagtaatattccactgtgtatatgtaccagagcttccttacccattcatttgccaatgtatatctaggttgcttccatgtcctagctattgaacagtgctgca

SEQ ID NO: 40599 - DNA, 791 bp, Bovine  19866881728988
aagaaaaaaaaaaaaaataaacctttggaaagaatccttaaaacaaaagagagttgcaagaggtaccgggacttagaagcttttcagaaagcccagaagcaagacagatgctccctgctggggtcccaggtagccaccccacctgccggcaaggacaagcgggctcccatgttcccagccaggtgggagcgggcggccgccgcggcgcagagatgccggcgcggggctcaggctcgggcttctccggtggaggagctgggtggttccacagttcccagtgcagttcggatgctgttgtttcagcagtgcaggcaagaaaccatccagggaaatgactattacatcatcttaaaggaatatggcttggagagagcggaggcagctccgagtcacgtccgcctcggtgacaggtcgtcgggactgcacggggacgccgcgctccggccgtgggcacgcgagtcccccgggcgctccaggctcggggcggggacgcagcgcggcgcagccgcttccctcccggtcctgtccgggagtctggagtttccaagggcctttgctttgccctttcgtgctgtctctagacctccacagccaccaccatgccccagaaacaacccctcaacccagatgaacacggcggtttttcatttttaaaaatcaacaaacgattcctttgcatgtgcactaaatttctgctaaagggcaaattgccccctctaaagcttgcttaaaagaaaaaaaagcatactcaatgaccccaatgttcaagctacaaagtgggtttttctctc

SEQ ID NO: 40600 - DNA, 993 bp, Bovine  19866881751376
tactgaagctgaagctccaatactttggtcacctaatgagaagagccaactcattagaaaagactctgatcctgggaaagattgaaggcaggaggaaaggggcatgacagaggatgagatggttggatggcatcactgactcaatggacataagtttgagcaaactcctggaggtagcgaaggacaaggaagcctggcatgctgaagttcatggggtcacaaagagtcggacatgacttagcaactaaacaacaacaaaggcagtttattttatgcattacagttttttgcaatatgcgtatctatacaaaaagctaatgatctttttaatttctaacaaattcccaaatgatgctgatgttgctgctcagggaccatactttgagaaccaccgaactaggggggtctcaccacaattcctcacttagcttatgtgataacatgttgtgagttacatgcaactgaattgcggcagaggctgttcacagttttgagacattttggatggtgaattctaaataagtgttaacaggagagcagtggtgtgaataatccaccaccatggataatccaaaagccatttcagcttgattttggaaggtgttcaagtcggattttaattttgcaggagcactggttttgccttagcaaataggttttttgctgaggccaatgttaaaactgagtgactgcttcctgggtaaaaacacatgttttccaagtgaggaagggaagccagagagcctggcatgatagctgtgaagacaaacctggcactcataattcacaaagcagacaaaggctaactgagagctgagtccatgtaagacatataaaaaaattgtagttcctaaaaatatgcatgaaagttgggaagatttgggggaaactcatcacttcctctttctatacatactaaactctgtagcttatggaattcaaagtatttcccttttaccctgtgatcaacacctacacacacacacccctgtg

SEQ ID NO: 40601 - DNA, 837 bp, Bovine  19866881878234
tgtgctccccagcatttaactaggaggtggtttacttaatatatcattatactgttcaagaagtaatcttaaggaaataaatatctcttactgagtgttccaattattttccttggtaacttcaaatatgagagttgaaccataaagaaagccaagtgtcaaagaattgatgcttttgaactgtgatgttggagaagactcttgtgagtcccttggactgcaaggagatcaaaccagtcaatactaaaagaaatcaaccctgaatatgcattggaaggactgatgatgaagctgaagctccaatggttctgccacctgatgcgaagaactgactcattagaaaagaccctgaatgctgggaaagattgaaggcaggaagagaaggggacaacaggggatgatggttggatggaatcatcgactcaatggacatgagtttgagcaagctccgggagttggtgatggacagggaagcctggtgtactgcagtccatggggtcacaaagagtcaaacacaactgagcaactgaactgaacttatcttcaaataagcttcccatcctcttttctatcttctttcccttaatttttttggtccctttcttctcctaccccagtcacattgacccatttcgttcccttctgcttctgtatttgtgataaaatatttcctgtatatcttctgcttctttgacttaaatattattcatgtctccttgatgtagcaatttaattactctttcaagaacaaaaccatacctaatcttaattttccctccttcctcataattggataattgcacatttggtagcttaatcattcaattgtgcatgtga

SEQ ID NO: 40602 - DNA, 2575 bp, Bovine  19866880378770
tgcttattcttctactaacatatctctgcagatgtctttacatccaattcactatctttgccaaattgttgtttggggagcatgtaagagcaaaaagacatgtacctttgagaagcttaaagttttaaatcttaaagaaatagaggcaaatatatagctggttatatgagcaactgtgaggctaagtaacatctcataacgcaggatattgatatgcttcagaacctacaactcaaatacactttataatagccattatataaacaggttaccttatgaaaagaacagtaataaaccaggtgtcctttatctcatttcaaaattgaggggcaaagatagttaggtcttacactagtagaagaaagagtgggttaaagtaggaaagacttctcagagaaattcagacctaatgggtaaatgactcagggcttaaatgaagcctattgttttggtgagtggaacagattttggtggctgacaaaggtctctgtgtaggtggaggagttacagacagcttggttacaagatgaggcaaaagcatactgaaggatgaaaacagatatatgagtgggtggaaatttatagtttatcttctttcaatgaagtcgattgtccggtaaaattcctagatttacttaatttacttaccaattcaataaggtccttgaagacaaaaaggatgttgcattctgacaaaatgtaatcataatgcaaataatttctatctatggactgttttataattcacacaaataactcagataatgtattacaagcatttctaaacaatatactcttcctctaaaatctgtatatctaagagtggtgtcatctattagcagtccttagacttgctgagtcactctattaatcctcttgcagctcagccatcattcagagccccagtaggttgaaagttggcaactgcttaactctacatccctaacatcctttacaggaatgttgcaagactgtgagcctcaggagggcaaaggtcatatccatcacaaggattcgtgcatcctcagaaacaggtgcagtgttttacacatagtaggcacaaaacaagtatttgttggatgataaatgaaagagtaaaatgaaatgaagtttgagacttctgaaatgcacatcttttctatattgtgtattctagggtcatctcaggatttaattcctagatttgttcactttagttctcatagtttaacttgatcttacttgattgaagaattagcaaatttaaaagactgggatttgggacttccctggtggtacagtggataagaatccacctgccattgaaagggacacaacattcaatccctggtccatgccacagagcatctaagcccttgcaccacaactgctgagcctgtgctctggagcccaagatccacaactactgagcccatataccgcaactactgaagcccatgcacctagagcttgtgctctgcagcaaaggaagcccacacactgcaacaaagagtagccccagctcactgcaactagagaaagccagtgcatagcaacaaagacccagcacagccaaaaagcaaagactgggatttggaagtggggaggagtacatgggggtgagtcaagaagaaaaagcaatgatatacaagtgccaacatttgtcaaagttagttaaaaaaattgcctattacaagattacttattatatttctcatagattcgatcccagggtcatgaagatcccctggaggagggcatacttagcaacccactccagtagtcttgcctggagaatcccatgaacagaggagcctggtgggttatagtccatagggtcgcaaagagttagatacttactgaagcaacttagcacccacgcacatgtacgcttcccatctcttccccttggtaatgtatacatcccccagtggtttgggctgtttttcccaacttgagtgtcttgtgcctttgaagtgccatagtatcttgagatttctttcataatttttgaccaaaaattttgctttagagatgctggaaagtaacaagacagtgtaaagacatgagtcagaaaatcatgattacatgtagaaatagctacttgaatatagcatagtttaaaaacatggattctgaaacaagactgcttggattcaaatcatggcttttcccttatgagctgtttgatttttgtcattacttaatttctccatgccttagttttctatttggaaaatgggttgtgaggattaaataaatattatggttagagtagctccaagcacatagtaagtcccgtgttaatcttagcttttatcctgatcttgggtaagtcatctaccaggtttagagtttctatgtataaaatgagaggctttgactagactctaagcctctccaggacctgcttttttcaagcaatgacagttcatgcatttttctaccatacgtgtgtgtggctagggatggagaaatgcatgattagttagtaaatactttccttgattgatggcagagggaactattgggaaattgagataagcttcttcactagacactaaattccttagagtaagaagcatatcttttcctc

SEQ ID NO: 40603 - DNA, 1711 bp, Bovine  19866880430833
atgagttgtcaagctgtctcaattctgtcttaaacttaagttcctagattttatccaatatgtcttaaaactctcccatatgctgctctagtgcaggattcccaggtggccaccttcctgtcttgcccagcctgctgaagctgcctctagctgtcctttctgaccttgacctccagtgctctgtacacctgaagtctgaggggtttttacaaaataaaactcaatgtgtgtgacctgtgtaaaactctccagtgatttctcatcaccctcagaagtcctccctaaggaattaaaagtcagaccctttaagaagtcttcaggaccttgcgagaggaagtccctgcctctatctagaatcaacagctcttaccctacccccaccatggccagccccccacccccaccagcatatatcagagttacactccacttacagccttgcaggacttctttctgttcctctaatcttctgtgctttcctgacaagtctgcagggtgtgtctgatgctgagattactctccccctctgttgcttcacttttctctgaagttgtgttagtcactcattcgtgtccgaccccatggactgtagcccaccaggttcctctgtccataggattctccagacaagaatactggagtgggttgccatccccttttccagggaggcttcccaacccagggattgaacctgggtcttctgttttgcaggcagattctttactgactcagctacttctagctcccatttcttctttttttcttagcttaaatgtaattttctctcagggagtcctcttcaccccataaactaaattaaaaaatgctatttttttctgtaatacttcctatctctttggcatttcacttgttacattcgcatgcctttttcagtaaattctaagccccatgaaggcatagatatgtctgtcttgttctacactgtatcgtaattaccaggcccacagtaggatcttgaatgttttttgaatgaatgaacatgttcaaatcaaccccatattagtgtttgccagccacacatgcatttcagccatccccttttgttgacttaaattagctttgcttaattgtactaactatatataaacatgaaataaaatatatactctttatgcttatagcttttatatagctgttaaaccatttttaaaaatcaccaataaatgcaaaaactattaaacaattaaaatttaaattaatgaatgctttttttgctgagtcttaatcacttatgtttatttattttaaataatataaagttgttgccttgggtcctaataaatacttaatgcgtaacaaccttttgattttgataatagtaattcagaaaatacctgttggcaataaatatattattcaaaatcacattatggacttgaaggccttgcttgctatctcaggaccatcagactgcagctgtgtcagtgagcagtccttgaattacagttttaatgattttaatgatttccaatttctttgctagtgtagttagtgtcttatacattcaaagactagtattcacaggtactgaattgacatcaaacatacattcaattcaatgattactagagtcaagaaaaggagcacaatgtttgtgaaatttagttcttacagatttttagtttcagcatacagccaagtgtcagactgttgaaggaagtcaatagatagtggaaatgactcatttaca

SEQ ID NO: 40604 - DNA, 1413 bp, Bovine  19866880471065
ttcacaatttgttaaggacaaacaactctgggaaaagttttcccatgacccactcccttatgaacatttttaatatttcaaaaatgcttagaaactggaacaaagcaatttaaaactctcaaagggccagagcaactagaattagctgaagaatgcattatacatgaaagacaccaaggctctataaacagggcatcttcttcacaccaaagcacaagaaaacaaaggaaaaactaaactaacacagaccacagaaaatatcacatgaaaggaaattcacgtctggcctagcctacaaaagaagaaacgcaataaacaggcttggtttctgtgggctccctgggagcaaggagcagaaagaggagaatcatttcagtcttgaaggtgaaacttccaaggatttctaggattattaaggaggcaaacagaggcagagggtcccctgcctccatctcagtccattatccgttcactgcaatgcacaatctacattctgtgtctgcctctagttctttctccaggggccaaagatgggaagactattgacatggatgatcatttatttcatcaacacttgtatcacacttattatgtgtcaggcactattctaaatgtctcacaaataagaacccacttaatcataactactgcacaagttaggcaccctgagttttcgtgctttacacacaggaaactgaggcatggaaatgtcagctataaaatttgctcgaagtcaaacagcactagtaagtgataaagctgaaatctgaacccacttttaatcatctgagctacaaaaagctataaagtttattgcaattttcttctttatttcttatattttcacattttcctgtaatgaggacttactacttttatactaataaaaaactaaaatatcatttttactttgaagtatcaaaccaaaaaaataaatgtaaacaaggctttgaatatctcatgtatgaaatcacacctcatctgtcagaagctaagaggttaggtcagatgatcctctttggatcatctgccacaagatttcaattctatgccctgttttccattacacaggcagtaagggctgcagaaaatgtagacaaggcagcaattatgaacacatggtctggaaaactgatctgagatctagttccagtttgcaaactatagaatctggaataaatgcttaagccctgtaaacttcagttttctgataactgagtatagataactatacctgtctgccagagttagctcatgtaaactacttaaaaatataaatgtgcctggcatggagtaagagatcaaaaaattgtcaaatacaggaaaactaagctgtccagatatttgcctatgtaaatgattcctgggccagagcaatcaaataaaccaaataaagtgaaagtcgctcagttg

SEQ ID NO: 40605 - DNA, 1924 bp, Bovine  19866880632426
atggtgaagaattttgtcaaaggcagacctaaaaagaatcactcatgacttttctgagcctccacattgggttaacttagatgatgatgtcaaacatcatgaaaccaatcttgtttcatttaatagtttaggggttttcaagccactttcacacacctgtcatgtgatgcccataaccatgaccaggagttcgtggtcagacacgattgtcctcagttgccaagagaagaagctgaggcacagggagttaatgatacacagttaacggatctgtgttgaaggtttggatggtgtcaaagctctttccctaacctgtgcaaaacagctcgaggacaaaaaagcaggaatcatctgtgttctgcagacatggaaataattttctgtaagcattcatgccctcaaacccttaaaattcaaaagtcaaaatctccaaaacataaaattctaaatgaatagaggagactgctgacatcttcaaggctgaaaggcaacaaatgcagtatcaccatgataaaaaatgattaagtgctaatcataccagctgggatatcatcaaattttgcattagcagcatagtagagttattaagtacattatgttaaaagtgcatcctgccagaatctttgcatttttccaccaaaaataaaaaggaccttaaatcaacgttaaaaggatagaaagtaaaaagataaaatgatgtcatttacacacagagttggggaagtggcctcaatgaacaggcagttgaggcctgcagtttccaaatgtcaatttggagaatgtattaggcagaggtggggcggcggccaagaggagcaacccaacatccaaggagcagtggctgcatgggtgcaggagggctgagaggagctactccacattcaaggtcagcaggggtggcggtgaggagatacccctcgtccaaggtaagagaaacccaagtaagatggtaggtgttgcaagagggcatcagagggcagacacattgaaaccatactcacagaaaactagtcaatctgatcacacagaccacagccttgtctaactcaatgaaactaagccatgccatgtgtggccaccctagatggacgggtcatggtgggagaggtctgatagaatgtagtccactggaggagagactggcaaaccatctcaatattcttgctttgagaaccccatgaacagtatgaaaagacaaaatgataggatacttaaaggggaactccccgggtttggaggtgcccaatatgctccgggagattagtggagaaataactccacaaagaatgaagggatggagccaaagaaaaaccaatacccagctgtagatgtgactggtgatagaagcaaggtccaatgctgtaaagagcaatattgcatacaaacctggaatgtcaggtccatgaatcaaggcaaatcggaagtggtcaaacaggagatggcaagagtgaaggtcgacattctaggaatcagtgaactaaaacggactggaatgggtgaatttaactcagatgaccattatatctactactgtgggcaggaatcccttagaagaaatggggtagccatcatggtgaacaaaagagaacgaaatgcagtacttggatgcaatctcaaaaatgacagaatattctctgttcgtttccaaggcaaaccattcaatatcacagtaatccaagtctatgccccaaccagtaatgctgaagaagttgaagttgaatggttctatcaagacctccaagaccttttagaactaacacccaaaaaaggtgtcctttccattataagggactagaatccaaaagtaggaagtcaagaaacacctggagtaacaggcaaatttggcctaggagtacagaatgaagcagggcaaagactaatagagttttgccaagagaacacacggtcatagcaaacactctct

SEQ ID NO: 40606 - DNA, 1706 bp, Bovine  19866880674329
aaaacacatttccttaagtgcctagttcatctgagaaataagagattagtaccattaacaaaggctttgatcattttattactaagaaagttgttaaacatgcttgctatctctgatactgctggtgggtgagtgggccttatctgtggtcaaatctgttatgtgaaccatgaaaagcatccatccttgcaaagctgctccccacctctgcctcaaaagcaaacaaacaacctgacctaaagagagtatttgatcactccaaagtaaagccagtctgggtcaggtccatggtcttccctatctaagcaaatcacaagaaggcaaatatcacagattggagctgtagacacttaatctgttacccatgaccacaggtttatgaatctgagcaaattttgtaaagtatggcttacctttggggtttacacaaatcatttaaaaatagaatgtaaagaaaaataaaaactataaagctgatggctgaggtgatggtaccctactgtgcgaagagagttaagaccagttgccttcatctctcatctggacggcattttaataacttgtccatgaagaagcctccagtacgccttaggaaaccactatatacctgtccggaaatgtgaccgttggttaaggctacattttttacacgactgagagcttgtaagaaatgtgtgactaaaataagccttgccatttcctttacctgttcctcccccataaatctgcatgaaatagtcattcagatctccctctgcccacgttgctggcactcacacacagtttgatgggtgcttattttttactttaaggtagatagggacttgaaagtgcttcctaaccggtttgctgggagcttaaaatgcttaaaaagaattcgaaagtgaagtttagccttaactctttgaaatatctgtctgggatgtgggctaggtgtccgtggcacccaaagctaggtaaagagcaaggttttgaaggtactaaaatccgatgtataccgtgggtgggggagggaagaactggcagagggagagaagaaaggaattagcttctacagagcacatcctaaggttcctgagtcgctaactccatccctagccgtgtcgtcgctgagaaccagctggaaagggaaagaccagcgagcctgggtttgtgtcgaaagcattggtcttggtctcaatcgccggcctagacacctggtttctggggcccgcgagatccagcgaaaccctctctcccctcgggtcctgctggggagcaggcatcgcgctctcgttcccttcggagacctaattcctctctctccccaaagtgctaacttcaggggctcgggggtggtgaggaagagcagaccagtaggtaaagaccctgaggtctcagggaggtttaaggttgaaaagaacgacgatctccccttgcgtggccccgttttctcctggtcccccagccccatccccccaagtccgcagaacctgccgcgctgcgcttggcgccaggctggggtctctcacccgacgctgggctggcgcggaatgggtggggtaaggattggcgggtccccgagctccggcagcggatggctccagggaccacacgccgggcaggagcccacagtccgcccgcccgagagcggggggaaggcagggacgcgaacgaggcggggcgagtcgtggctccagcacacctagaggaccgagccggcggtc

SEQ ID NO: 40607 - DNA, 1297 bp, Bovine  19866880748921
aaataatatttccaaattatattactcaaagagctttcataatgtcattagtgagaaggaaagcagcagtaacatccaataaacgtccatttcctttgcctggagaatacaatgttcaattccagcacgagatttttattcttagcccacaggttagaaaaatgaaatgcttatctttgtttgccacatctaactcatgacacaaaatggagcagttttgtcagcacacagaacagtgcatgacaaatatttgaagaacatttcacgtattttaaaaaagtttgcatttcttctttcactgaagcctttggggaatcagtcattggtctcggaagtacatcctcttatcagattcagtcttgaactggatggctcccaacattatattagtttctgtacgagaaataaaaggattaaaaggaggaaatatgggagaaattcctgtctttatcatttcctcttttctttctacccatatcctagtcatgcatagatgaatatgtctagttttaataaaatgggaatttactatgcttttttaaaagctatttatccagagagagatgaaagactatagaaatgtttgatagtaaaatagttatgtctaaacttgctgcttttcacacaaaatatcacattaacttctattcccctactaatgcttcagtttgttgaaaatcatattaagccctactaagtcctgcagtctcataagattgcaatttcagtaagagagaacactttcttcccaaagatgaaataggatgaggcaaactacactttgaatcaacctggaggaatcatcttcaggaagaagtacacaaagtgtacactgagtctattacaaagtggactgttatggcacgaggaatatgaccacaagttggtgacgtgggagatacacgcccttagagagaagtgttgtacaaggtttgacaatgcagtggagcgtccagcccttagttgagtatctgatataggagaccaccagtatatatttgctgagaaagtggatgagtctagaactgacacggatgctagcccttccaactcagagttgcatagttctgggcgtggatctttcctagggataaagttaaggacagtgattacagtgatgggcagcaacaaactttctgttgtgtttaatatgcaattctattccaaaaatgtcaaagatattacttatttcagttgtcaccttaaactaacacaatattataaagtttaaaaataaaataaaatttgaaaataaataaataaataaattcagcttggggaaaaaaaaaattgtcac

SEQ ID NO: 40608 - DNA, 1630 bp, Bovine  19866880844477
tctgaaaaaccagatctctgcagtcctcccatttgcccagtgtggctgtaagtttgccctgttctgtgcctcccctgtactttgcattaaccaggtaagagcgattttcttaccatgtcataataatacacttattgcttgtcatctaccatttgagcaggagctctttgcgggaccatttctatctgcttctccatggtgcctgacgcatgttttttttaaaattctgagtgaatgtcatgaaaggttgttctagggaaggtgttgattacataatttcattcctctgtctcctgaaagccaaggacaacagtgaaaaggtccttccttcaacagccaagccttaaccaagagcacagtcagtggataacagtgtgatagagacagagatttgaagatgaaagattctgttagctctgtcacttaattggctcaggaaggtcacttaagatttttgtgcctcaggtttcctcatatccttgggcaatagtaatgcctagttcactgggttattgtgagaatcagttgagacattttatggaaaagtagcttgcaaactggaaagcgctgcaaacatgagaagagaccttagaatctggtagaaagaacaggtggtttggccttaaataagattttcagtccagactccaccactaattatttgacttgcacaatttaactcctgagagcctatgtctttgcttgtcaaaggaaagcgataacacttaggcagcttaaagtaatgttgtgaaggttagatggaatccaggcaatgttccatttatagtccatcggtgtatgttcaacggttagcaaccagcgcttttgcacattgtatattcatacctctgcaccctcttttctatggcagattttaccccagggagagcaggcccttcctctcaggccagggagaggacagtaagggcaggctgctggaggaagttactgaatctcccggcctgtgaccccagctggcctgggtgtgccttgggacaggggtgaggcaaagcctcagtgtggtgtcccagcacattcctagggcagctgtttctactgcagcttcttttaccatttctttttgaagctccttattgaagttaaagcatgcataccaaaaaggtacatagcctaagtgtatagatcacgttttataaattgaatacacccatgtaaccagatcattcattctcattactgcctgatgttccactttgtaaatgcaccacatctgatttttctgttctagtgctgatggacgtttggaaaatctacagtttaggggtgttgcagagtgcctttgtgattgctaattcatgtcttttgatgggtatatgtatttctcatgggtgtatacttagcagtgggagtgctgggccatagagtgtgcatatattcagtttgggtaaatattaaaaaaaattttcccagcatatttgtataaattcatactcccaccagaagtgtttgacttctaattgctccacatcctcacctcttcagtattatctgtatttttaattttaggagttataagactgtgtagcattttggaggtggaatcattccctcagcccccaaagcttcaaatttaatatgttcattttcaggaaagtgctgtgtacagaag

SEQ ID NO: 40609 - DNA, 1270 bp, Bovine  19866880865261
aaataaagttctaggaaagaaaaaatatcagtttgaataacccatcataccaagggaatcctaactaaggcatatttttgttaccagatataacagggattttgaaacagtgcttctctcacagcatccaccaccatgatgagatgagaaaggttgatctttaaaattattttcaccatcaaatgatttttgctttatattccccaaagagtgaagtagaatggtgacatgttgtacacagaagctttataaaacatatcttagatgaggtcttcattttaagcctccccactggtactatctgctgttatattaggattctgaatttcaccgtaaacaataggctaatctaagtaagaatttctgagtctccatctgtaaattcagatttggcaaaggagaaatctactagagatcctgggtggtatgggacaaaggattaggggagagaggcagaagcaaggattcagggcctgtaatccaactattctgggggcttccctggtggtccagtggttaagattccaagctcccaatgcagggggcctggattcaatcccagtttgcatgctgcaacaaaagatctcacacatagtaactaagatcctacgtactgcaactaagccccggcaaagccaaataaatgtttttaaaaatgaactactccgaaatcactaatttttaccacctgtgctttccagtgaactgcctatgagtattttcagttgaaggccatttgccatggagttgatgctgatggttctaaaccagagaagcaattgagtatgaagcaaaactaaaagtgaggatcaactccaaccagcaagctccgatgtcccaaactcttctcagtgtgactctgctggacagtttgctcctggccattggcttagtctataaggatttttttgtaggtgatttcaagttatttaagtcattctcttggctttttcccctctaattcagaaagcaggaaatgtctttcctgtgtagcagtcacagagcagtcccctagggtttccagggggcttatcttccagttcctgttgctggtttctaactgttaactctatatttggtaacagcttgaccatgggctgttttggatttggtcataataagataacctggagtcacggagcagagatctaaagcaatcttatttttccaggaaagcagcgtgttgaccttttcaggatttcgtctattttattgaattatttgaataggatgggggatagcacaaggttgggtgtttatgctattggcc

SEQ ID NO: 40610 - DNA, 1644 bp, Bovine  19866880914435
ttcaactttgaacattaacacaaatttagcaatagttggtaaaaacaacagctgctaagcgtggtaaacccaaagagattattaggtcaaaaatcacacaaatacacagagaacatttcaaaattcccagcacaataacaacaaagcaccaaaataaatctcgttaagaaacaaaatgttttcagaaagaattttttttttgtaagactgcaccatgtgtaacatctccaaggacttcacttgaaaggaaaaacacagaatcaaaagggagaactacagaatggtttccttcctctattccctttcccctctcatcatcctctactgcacataccaggtaactctctgcattcttacaactcattctctgttcacacacacattgatagagactgaagaaaacaaacaaacaaaaaatcatttttcaaaaatgagatattgttagaataaactttctcttatctagacgctttaaggaaactaccagtcactgattcagtcaccttcatgcacaagacaagaaacaaaggagttccaaggcttctaacaaatagcaatggggattttataccatctagacttacgtggctttcatcagtatgttacccatgctgatcaattagcatgaaagacttttcaaagttaaggtttacatatcacaaaaaatatgcattaaaaatgtgaagcagcataatttttttacctgttcatttgctgaataattcaaggttgaatttcagagaatgtgaagattgaacaaatctcaggctaaaacaaagacttcaggcttttccaatctcctcctgggacagctataatttcttctaacactgtagtgttttttgtacagacaaattctttgtagtgttcctatacaatcaataactatccaaaagcctaatcttcaaggcttaagtaatttgaaactaaaaataaccagaaaaaagttcatctaaagcctagttaggtgaaacaacttactataaatcatcaaaagacaaatgaaatgggactggccctaatagttcctcctaggtagataagacaaaacaagcccagtgttctgtgaagcccttatataagtagctgatgtgaggctgaagtagtcaaattcactacacatactgtaacactcagtcatggaagctgatgctcatcgaagataatcatatgttacatattctactaagcctttcatatcaatgaacttattcatgctcccaacaacgccatgaggctatctccactttacacatggggcaactgagacagttatggaatttatctatgtcagcacaacaggcaaactcagaagactagccagaatgtgcataatcttcaaagagacatttgaggggaataaaaagtagctcagcattaacctagacagcatcttaaaaagcagagacattactttgctgacaaaggtctgtctagttaaagctatggcttttccagtagtcatgtatggatgtgaaagttggattataaagaaagctgagtgccgaagatttgatgcttttgaactgtggtattggagaaggctcttgagagtcccttggacagcaagtagatccaaccagtccatcctaaaggaaatcagtccgaatattcattggaaggactgatgctgaagctgaaact

SEQ ID NO: 40611 - DNA, 1024 bp, Bovine  19866881002886
ccaggctcccccgtccctgggattctccaggcaagaacactggagtgggttgccatttccttctccaatgtatgaaagtgaaaagtggaagtgaagtcgctcaatcatgaccaactcttcgagaccccatggactgcatgcccaccaggctcctccatccatgggattttccaggcaagagtactggagtggggtgtcaccaccttctccgagaaatctcatctagtcacttctaattcaatagagggaaataaaggaaaatctctactttcaaacttcatagaattttagtacactttactcatttagcagtaacaggcatttagcatttttgaagtgtgtgctaagttttgtaaatcctgacagtgcaaatttcctcctaagacacaatcttcctactgaacattcactcatcttttaacgaatcgttatgactactggcctagtacctgcactctgttagtcacatggaatacaacggtggaaaaatggacctggttctaaagcaatggctcctatggccaagtaggggagacagacacactaatcaggttattcggaaacactgtcacgaatgcttaagatggggatagacttggggctgtctggaagcaataggagctacaccttatccagtactgggaaggcaggaatgctcggctccccagggcagtaaggagctttgacaaggttccacagcccttgaaagtcctttgaaggtaatgcaagacaagaccagtaactctcttcagatgcagttccaacaagattatgacactgtcacagttttgtgctttcatcaatatatcattctcagttagatatgcagtaatggtcattccacactcagcaaccagtcacgcacgagtatttgaattaaatctgtccataaatgcaaagtgaaatattcctattttagtaaatttacttatcagaaattttattctcctctcttagttttgaacatatccacacaacaacatgcctctcttttttcctaaaaataagaaaatttaaaattaaa

SEQ ID NO: 40612 - DNA, 903 bp, Bovine  19866881025284
ttactcaataccaaagcctctaattcaacaaaaaataactcagctagtttcttataactcatcactcaatacagtcagggtcttttggaataaagaactcagaattcaaataaagagtcaaacaaatctgaatagccctaaggttttctgattccaaatttcctaacttaaatactatacatagtatgacaacattaacactaacacatccaaagactaaacaatgactgaaacaaggcagaatttcctttttacattggtacttaagatgggtgacaaaaaactgagatgcattcccttaatgtattttagatcaaatgaaagaggatactcaccattaaagctctgataagtatttctgcaagcagagtgtgtataatctatgaagacacatttaacagaaaggaattagtgcaatattagcaaaaatcttgaattatatacccctttactaaaaacaaacacaatttttaaactgccattaactcagctatctgcaaaaacagggcgttaataattatatataattcatagaggaaaatatatatccctttcatttcactatctccccaaatggcaggtttatcatccaaatcatagcattgtaaaaattagttaataaaacctgatatataattacagccaaaaaaggagatccagtactgatttacacagcataacaaaagggaaggcagataaattatatatcaaacaatgcaaaaaacagggacatgtgagaatttattctatatatttttttcccaacttactatttctcttagcacttaatttgctctctgaagagttcaagatcttatttgagaaatgcacatgcatatatgtgtacacctgtgtgtgctatttctatccaggatgtggcatcatcaccaaagatcataattt

SEQ ID NO: 40613 - DNA, 1038 bp, Bovine  19866881120065
gaagattctgatttaatgatgaatctaaaaccgttatcaatgttgattttcaagacacttgtaaaagatgatatcagaatcagttttctgtttcagtaacttgtatttctcaaggagatgctgagtctagaaaaaaactttatagattgaatagccacacatttactgatcgatccctgtgtgtgaaactgtataacaactacaccctgaatcagggctggcacagacacatacacatctttcagctctaaaatctggcttggttccagtattccctctaactaccctgcagcccttgggaggtaattagctaatgactgtacagagcttttaaactgaaacatgttgtattatgctaaacacaggaagcacacaaaggattccaccgtctgccaatacttttcaaccagaaacagttgatgtatctttcagaaagtttctcttgcaactaaaatcttcctaatctgtttctaaacaaaaggagttcttttttcaaaagtgcccttcctacaaatcaaagacctaagaaaattacccctttgctctctctaaagtaaggttcctgcctcaacaaaacatgatacagtagtatggtttgtgtgaatgatgtttaggcagttgctaggtttgcttggatcattgaaggcaaagggaatcataccgagtgatctagtattagtcctgacaccaccctacacactgtctttggctttaaagcacataatttgtgcacatggtaatcaagtagtataaaaaaaattccagtgaaaaactataacattgtcttctcttgcttagttagcttcaattctctctacagaggaaaaaggtttacctggagttagatcactcagtctttacttttgctgcattctttctctctcttcttggattaccaactttgtgtgtggggtgtgcttagtcacttcagtcgtgtccaactctttgcaaccctgtggactgtagcctgccaggctcctctgtccttgggattcttcaggccagaatactggagtgggttgccatgcccttcttctg

SEQ ID NO: 40614 - DNA, 1769 bp, Bovine  19866881132639
ctctttgagagaaggtatgcatttgatgtactctaatggcacccctgactgaggggccatatggagccctggatgctgcataatttcatcttacttctcagttgagaccacctttctgccaaaaccatagcgtcatttaggtcaagcagttgccactggtatttcctactgttctcagaaggggaaaagttaaaaatataaggaggaccctggcaactgatcctggtacagcttttataattagagtctggcaaaatttgagcattatagagccttctggaaatgtatcatttcaaatacagagatagtcaaggttaacccgttatgtcacgggacagacagaggtggcctgtagaagaggtggcctgtagaataagtggcctgtagatgcactatgagaactctcaccagctcatactgctcgctgggagtacccacactgatttaaacagctaagtcatatgcctggccccaaaggaatttggggttttaggcactgtttaggcactggcactttttaagtggctttttaagaaatatctctaaaacagattgcactaatctgccaggagaaatatcaataacatcagatatgcagatgacaccacccttatggcagaaagtgaagaggaactaaagagcctcttgatgaaattgaaagaggagagtgaaaatttggcttaaagctcagcattcaggaaactaagattatggcatctggtcccaacacttcatgggaaatagatagggaagcagtgtcagactttattcttctgggctccaaaatcactgcagatggtgattgcacccatgaaattaagacacttactccttggaaggacagcatattaaaaagcagaaacattactttgtcaacaaaggtctctctagtcaaggctatggtttttccagtggtcatgtatggatgtgagagttgggccataaagaaagctgaacactgaagaattgatgcttttgaactgtggtgttggagaagactcttgagagtcccttgggctgcaaggagatccacacagttcatcctaaaggagatcagttctgggtattcattggaaggactgatgttgaatctgacactccaatacttcggccacctgatgcgaagagctgattcactggaaaagaccctgatgctgggaaagattgagggcaggaagagaaggggacgacagagaatgagatggttggatggcatcactgactcaatagacgggtttgggtggactctgggagttgttgatggacagggaggcctggtgtgctgcggttcatgggatcacatagagtcagacacgactgagtgactgaactgaactgcagatgtcattcaatatgtgaatggacaaatagtggtacattcatacaatgaaatattattcggtgatacaaaaaaatgagctctcaagccatgatacaacagagatgaatctgaaatgcatatttctaagtgaaagaagccaatctgaaaagagtgcatattgtatgattccaactctatggcattttggaaaagataaaactttagagacagtaaaaagtttatcagttgtcaggggttgtggaggagagatggtgaaaatatgaataggtggaacagagagtcttttgtataatgtaatgattgtgcataactttacatacttggaaaaacctgagttttttcagttttttcattaagagtgaagcttaatacaaacaatggacctttagttaataacaatgtgtcaactggttcaacaattgtaaca

SEQ ID NO: 40615 - DNA, 2045 bp, Bovine  19866881190675
atttttttctttataacatttaaataataataatatgattataacatgctttataaaatttcttttatcttaagaactgaggtgtaacactttaaatactgtcgtccaccattgtttagcttatgtgatttacatgataaataatacacggaaataaaattagctgtttttaattagcttaatagaataggtaactggtaactaagaaaaaacttttcccaatatgaagatgtaaaattatttacttaccatatattctacctaattgacaaaagatattttttccttcactcaaaccaaatgtgttctttcagaaggggcaattagttttcctgctttggggctgctttttgaaatttcaaaatcataaataactaaaagcaaacaagcagaacaataagagactcctggactctaaagaaattaaaattctgagatttcttaaacactttcttagttgtagttaataagccagcgacccatatggccttctcttattactgggcatctgtattcttatctgaaaacatttaaaaatgttggtttaagattgtttctaatttggagcaataaaaaaggagcatttttttttaacattcaaaacacgtttgagacacattagacagcctctaggtaacaccaaaggtgtgctccctctcctataatccaggatggggtactcacaagtaaaagagatgctggaaataattagttttaattgatttgctccttaaattccttaattagggcaacagtaggctgttctgtttattgcagtgacattatggggagagctgttaagtaaaaaagttaaacaaaatgttattaatgtgattatgttattagataccctttcaggataaataaaatcatcttcaagttcaggtacaagggctgactgaaacagtcactgacaacagatttatttcaaagattttgtttctaaattttaaatatccacatgttaattagagatgagtgtggcatttatctttagttgttgctttgtagattccttgggatatggaatcctaatttcaaacacaaagtctgtaagtagacatacttttacttcttcctttccaatctttatgtcttcaatttttttcgtccttattgtactggctgctaagtcgcttcagtcatgtccgactctgtgccaccccatagacggcagcccaccaggctctcccatccctgggattctccagacaagaacactggagtgggttgccatttccttctccaatgcatgtaagtgaaaagtgaaagtgaagtcgctcagtcgtgtccgactcttagtgaccccatggactgcggcccaccagggtactccgtccatgggatcctccaggcaagagtaccagagtggggtgccattgccttctcctacaaaatatggtataatgctaaagggggagaagacttatctttggaaaccagctaaagagctaatcagttaacttaggcaagaatccaatgaccttgaacccacattttttatctagcctaacaataatatctaaccatccactatgcttataaaatgtccctagtcgggatgaatttttaaactacttctgacctaccagaagtcttttacatgtaaaactaaaataaaactgtaacacagactcaaaaatgatttgtccaaaaagtgttttctaacagtttcttcagtctactagttatccatcaccatctccataggattaactttacttttgccctaatggcatgtagttagtctttttccatcttgcatttcattcatttattcattcaacaaatatttaccgatcctttgtgaacatattaggtactactgtaaatactggtgatatagaaatgaacacaacaaaacaaacaaaagtctagtatattttatgtttgttttatttatttttcttcaaggtacaatcctatactttccttaagtgaatttcagtgctcagttttgattatttccttcatttttattttgccaagctcatttccaactacttgcttcaatactacattatgcaccatggggccacatacag

SEQ ID NO: 40616 - DNA, 1334 bp, Bovine  19866881198140
tttgttatttggctgcactgggtctttgttgcagtatggggatcttttattaatagttgcaatctcttagctgctgtgtgagaactgttagttgcagcatttgggatctggccacggatggaacccgggtccctgcattgggagcttggagccttagccacgggaccatcagggaagtccccaaggagtaattgttgttccctaccactcttagaaaaacaggttaagctcattttgaacgcttcccaaataatgtgattgggccattaatttaacacatgacatcatggaaatattcaaggagatgatagtaccaaagtatccattgcgttgtcagatcaacttgccttctgagtctaaagttctcatttatgggactgtaagagcactagagcttaagaatcctttaagtatattaataatagtttatttttcattttatgttttcaaagagagacatgaaacaagaaattctatttaagccatttgtttcttagtatatattttagattctttgcattcagatcagtgtgatgtattattgactaaaagctgtagagtaaggggtaaggtttgattagaagtcaagacaccactggctgtgttccttgggcaagtcacctaatctctctccactcaagtttttactcataaaatgagagttatggagtggatgacttctgaaagagcctttcagattctctgaacagttataacccacctctgagtttctttcaattaaatagatttctgtagaaccatataatcatggtcttctttagtggatttttctttaaaaaaaaattatcatgtatactgcaattgcagagtaaaatacaatccagagtcatgctctcctaagagagaaataaatcacttttatataattaggaaatctggctttttgtcctgttttttatttccatctttgcattgctaaaggaaaagtaattcgttttataattgatgttttgagcatattctgatgactttattttgattggtactgctgaaagaacccataaataaatcatggtattcctgtgctctttctgtcttgcacttctctgcactggccttggctgtgccagtgtcaaggccctgcaccgtgggatcttcctcccgtgacaatacttagacacccactttgcttttataatcattatttccaaaccaaaaggcaatcacccctcctatctttatcagaattactagttactcagtaatttattcagcaaatattgagtgcctaccatatgtcaagcattactttctaggtgctgggacacatcaatatacaaaataaaattgaaaagaaaattcctgtcatcatg

SEQ ID NO: 40617 - DNA, 887 bp, Bovine  19866881235147
cacaccacaactagagagtccatgcaccacaacgaaagattgctcatgatgcaacaaagatcccacatactgcaactaagagccgatgcagccaatacataaatttaaaaaagaaaaggcagtatttatatgaaagaacaaaaagaaagatgtaccagaacgtgtgtttatcttgggggttatggcatatcaggacacaggattgccaaaactagcacgtacctgagggtttttttaaaggtaaagtccagcatctaattaaatctgtttcagcattttccaggctagctttagtagatggagtaaaactctgggccctcaattacacatttgttttgacatttgaacagattctaaagtattttctgagttgaaatctgggcccatctatagatgctctcgtggcttctgttcaagcaaagacagagcctttctctccaggtaggcttccttgctcagctttcacaagttgccccttgcttaactgtctgttaaaatagacataactattaatgtggcactatataccagctgctctgcaggtacttttcaggaactacatcttatcaaatatttcagctaaaagaaatgacttttgcaagaatttcctggagaagagaatcaaccatgatctcatggttctactcctgggttacaccaggtcacagagcactaggacagcacagtttcagctggccgtggtgaaaagtctttactgaaattgcaaattggcaagatgtaactggcacatcttcagggactgagtttaggtgatatggatgcacttgaaagcaaagacttgagaaatatttaggtaataaaatattttggtcttggggacgattggatgaagagaaagaaagagagaaccgatttcttttttaagt

SEQ ID NO: 40618 - DNA, 876 bp, Bovine  19866881245746
tatatatcacataaatatatggatatttattgattcattattaactcagaggatatgggtatgattgtctttaattgcatatacttgtgatagcatttattcagcaaacctttgcacaacacaccttccaaacagtagctacatccttttacatttatgtacaatagtcctgtagagtcagatctaattagggggagggcactggtgtgctattacaagtggcattctattaccaatattgatgataaaagagaacagggctagagaaagcaccaaaacaagtgattttaaattaccctctcaattccaggatcaactttcattcaagtcattttactgacaggctggtatttctaaaaccactgtgttgatgagaactctggcctgcacagcagggtagctcacagctcccctcttctcagctgtgtgcccgtgcttcagatatggtccataaacaaggagcaggaaccagacgagctggaaggtctctttacgactcaaaatcggattctcttttttaacagaaacattattataaaatgaagaaaaacaaacctaagagaaatgagaggaacgctgtacgtaagagaatgagctttgaaataaagactagtttcaaattccacttgccccacttcttgtgattttttttttttttttgggggaaaatcacataacctctcatgcttcagttacctcatccctaaagtggaaacaagtccatcttccactcaggactgttttgcagattaaatgagaatgcatgtaaattccagggcatgggtttggaattatcagtaaatgcctaataaatgatggttgttattacctaggagtattccataaactcttgacctaagtttaaaaaactagtta

SEQ ID NO: 40619 - DNA, 1753 bp, Bovine  19866881276092
cagaatagattagtctccatgattgagttctttttttaagtgtgttttagaaggttaaagaagatttcttagtacaagttgttaatccataatgccctaaaacagcacaaagatttattcacaagtttcacttcctgacaggatcctccaggatttccatctgtggactagagtccctggaagaacaaacagtggaatctaaagaattttccttcttcccagcaacggtgcaagtaaatctgcacccatttttctcaacactacaaacaggcttccacactgaggaaaaaaacaagacacttatagcattaagctaactaacgaaggggaaaatttttaaattcactttatatctgaaagcaacctaagtgttaaaaatttaaagttatactagttgagaaagacatggtccagatcacgttgggatgacaatcctaaggactgggataaaacctgatgaatcaaaagattatcttccccataaaatgttggaattccaggaacaatgggctatccctgggatgattgagggaaaaaatgattttaaaaatcccctttcaggctaaaagtctagactcagctagacacagagctctgctaaaaatcacctctcttctctcagagagggcgtatatacaacagattaaacaatggaaggattcttccccaaaagagcagataaaacttaaagacagcagcactagaaggaagggtcacagcactggtctggggttgtgtcctgctcagggaaagaaaggctaaaacacagcccacactgctctccaagcagcgtgcctggtggagcagatgtggcccccgctgccaccaacttcacacggaagggttgtgggggcagtgtcaagtggtgccaagcacaccaactccccatgagcaaagcaagctggtgtccagagccatctcggagctggaggccatcatgcataacccctcaaaacaatgctgtgctctggagaggggcagggaagagtcttggtttgtacaacggaaacattttcaattttcctggtttactttatgatgccagctgttctatctcccttcctttcctcactctatattctcctttcatttacactccaattctccttctgcagaagccacgagttgacgtgcacacgagggatggcaagacaatagcccccgcctacccacagaggttctgcactgcttctaaatgtgtatcagatcacaattttcccttctcaggtaaggcctcctctttctcatttctctcctattaccccccaaatcaattctaagatacaaagaaatcttcctcttctcttctgggatagatgatctttcttcacctccagcggctcttactctgtgttcggtatttctagggccacttgcctcccacagctgtatcttctacctgctttgctcccgtactctacatatttctccctcaatcattactccttagaaggaaaaccccatcaaatacatctactctggatataataaatcaaatttaaagagcagaaattattacattgacaagtatggggattttggtttgctttgttctgctttctgtgtgtatgtgggggggggtggaaggcaggggcagggggttacacaaaacaatgacatcaagttttcatttgtttcaactttttaaaagtgtattatgctttttgttgaatcctctgcttccatttacctggccactaaagagctatctatactactaagggcctaagaatcacaggctctatccaaccca

SEQ ID NO: 40620 - DNA, 852 bp, Bovine  19866881372446
aatgaaataaaatacagcatcataatggaccgagactttgaaccctgtgattttttttgtcacaaagaagggaacaacagattatttatattgatggcatttgaagagtatttgaaactagtaaatgatgcaaagttccactgtaattaatagtatatccaaagccagtgatatggaagggagaaaccagatgcttttagggacccattcttcgtgtgagagctgaatccccagagcaaaaatgaatactaatgaagagaaccggctagcaaaatagatgactggagctatcatacagcagttggttcagttccaactcaaacagcagatcaatttgtggcactctaatatctttctacagcctggcaccaggcaacaaatagcccatctgtattgctgagatggcaccaatgagagcagacatctatttacataaggacagattttaacggctaaaattactctatgtttggcatggtttgctcgtaaaaactgagcatgtaatatgccagtgggctataattggttctatgaattgttttcttcatgcatggtaaattttcagtatttttcaagagtctaaatttacaatttgcaagggcccaaattgttttaacttaaagcaagctaactagaaaagttattttacatgtttttggaatataactatatatggccctttgtactcaaaaaatatatatttactatttccttccaaaatcaagggttttttaaaagttttttctttttggttgatgaactgggtttttttgggttctggttttgtttttaaggcaaggactatggagtcctatggatatggattataaactactttccagtccttactag

SEQ ID NO: 40621 - DNA, 1120 bp, Bovine  19866881810388
ccctgaggctgcaagagctaaacaagccttatttgtctaccattaactttgacaagcccctggagaactgaaatttatgaacaaatacataaaagggcagtttctatatgcaaatcacagaatggaaattaactatttccagctgctcttactcctggatttaccctgaggtacttagagggccctgttctttcatgatggtaggatctctggatctttgcagactctgggctaccaaaaagctacttcttgtagagaaaagcccaaccaaacaggaagcaggatgaataatcctctccaattctgtttttatttttttcccttacggatttagatacagggaatattactgtgggaaaaggcatgggaatgagcaagaagtttggagtcagggggacaaagatttgaaatctatccaccaatgattattaactaaaaccttagaccatttccataacatgcctgtactcacttgtccatttttaacacagagtcaatactactgtgagagggttcagataaggacttaaaaattgcaaggtatataaaacgcttggcatacatttcaggggctgcacaccaaggctttatttcctcaccatttagtgggagggtgacaattacctctaagtgagggaacatgatgaaggagagcttcccacagctcagcttccaaaggatgatagaaaagcaaagataagggggaggatgcaaaagtgactaatacaggaagaggtcacagctgagctatcaagtaagcgaaaattaccttggttcatgatcagtaagaggaggccccagtacagcttagtgaggctgcttgggttttatattcagaaaaccagacttcctctcccagctctgctgcttgctggggagctggggcaagtcatttcccttctcagttcttatagggaaaatgtagttaataatacctgccttttaggtttattgtgagaatgtactgagctgcaagagtcccagtaagactcttaaacatagtagctcttctcaaccagttgagagcagctgagtcagcaactgatgagcaggaccgatgaacaggaacttcagttacttagcatttcagtcagcaaggttacattaggctgtgtcacaa

SEQ ID NO: 40622 - DNA, 1751 bp, Bovine  19866881901438
taacctgctaatgcaggagacataggagacatgggtttgatccctgggttgagaagattccctgaagcagggcatggcaacccccctcccagattcttgcctggagaatccaatggacagagcggcctggcaggttacagtcctttgggttgcaaagggtgcaaagactgaagcaacttagcacacaaaccatcatcagccactaacacttctttaatcgatttaaccggggcagagtttaaagggttaacaagaggagcgataagactgaaaggatgcaaaaggtcttctcccctccgctgagagtttggagctgtgggacactgaagggaaatatagggtcactgaagataaaaactcactgcaaatggaatacatctgagagaaaacccatagaaatattaaaaatttgcatatgcagagtacatgttactttgcattacatcttaaagtacatgtccattgttctagttgcatcataaaatcaaaataataatacaaaataatagtgaataataggtgggtctgattttgtcagaaatcaaatatcagaagtggtcatctaatcaatcattagtatcattgtgtcaagtattctatctaatccagctgtgatttctgaacctacttctgctgatatggataaggaatcactttttaaggaaaattttttaagttctcccagaaacttctatcagaccttaaaaaaaattgaaatgtcctatgctaaaaaattttcttgcatgacaaattaaagcaatgtgaaacccaagagattagaaatatggttcaatcatgttacctatcttggctggcactgaaaaagcagatattagactaaactttaaagcattttgttagaatgtaatagatctaaatttttctcaaatgtctttgttataacttccgcactgttcatatgacaatgaaatctctgtaaaatttggttttgggggttattaacttgtcagattgcattgatatttctaggtctgaaagcataacttctattttaggagattaggagagttttgtgaagaaaatcaccactttcaaatatttctgtgatattcacatggcacaccatttggaattgctggtgttactgagagagtaacttatatgttaatatattctgaattaggaagacacagtgaaaaagtgattttgaacttcaactaaacattcactgtttagttaggtgcctaatttatcatttaagtagaattgtagtcctgatgaatagcaatttctctttcaattcagttcagttcagtcgctcagtcatgtccaacacttttcgaccccatggaccgtaccaggcttccctgaccatcaccaactcccaaaacttgctcaaactcatgtccatcgagtcagtgatgccatccaaccatctcatcctctgtcttcccattctcctcctgccttcaatctttcccagcatcagggtattttccagtgagtcagttcttcccatcaggtgaccaaaatattggagtttcagcttcagcatcagtctttcagtgaatattcaggactcacttcctcaagggttgattggtttgatctccttgcagtccaagggactctcaagagtcttctccaacaccacagttcaaaagcatcaattcttcggcactcagctttctttaactccaactctcacatccatacatgacaactgtaaaaatcatagctttgactagatggacctttgttggtaaagtaatgtctctgctttttaatat

SEQ ID NO: 40623 - DNA, 1244 bp, Bovine  19866882171948
acttgcttgtattctgtatatatattaaataatctcagaatgtcatcattttacataaatttcccacccatattgagaatgcactatgtatggctttaatcttcatgcctttgtgttaagtcccctaccccacccctttctttaatttcaaatgaaatggatcatgtagcatttccttggtgactgtcccttcattgacagtctctcatgagctatggggtccactgtgtggggcatggtttctacagagctaatagttcagttcttcagtctcttaggagttgaatgaaatgatgctcacttgtgcatttcctgggacctagcgtgaattaggccttttttttccccccaaatgtcttggacctctcctacttccgtttcttgatttctaaatctaccaggaaggcaaacagttctaccaagggaaaagcaatttctcaacattaaaaaaattagaaatgataatttatgcttaaaaaaataatgttagtccaagttttttgctctcttccctcttccttctccgctgttctttatcctgccgtgtgtttgcaaaccattctcatgaccttctgccggagcggcatatttgtagcagggccagattatacatacactactgactttttcatctgacctctaaattcagcctctgagccccttcatttctttgagttttgctaacaaagtcttcttgttgaaaggaatatcatttcccatggaaccttactgatggtccatgcaataataggatcatgctttttgaaattcagatggaaggtcctaaaatcttaaacatatccagtttactgttgcttactttacttagttcagtcttggcatttcaggtccagaggcagttactacccagtgggcactctcagcccctccctgaaaattaaagggagcacaaaaataaaaccaaacttcttgtttttcttcacctctctgttaatttaactgagtcagttggcttgccctcatttgcccttttcacagctcccaaattaatggtatgtgcaaatttgattataacagggtggacaattcctaagttacttttgactacaaactgaatactgttccttgtggttcttttcttcatcacactggtatatataacccggtgtttttctttccagcctgcttaactcctgtgtggatctggtagccacttaagtttcagttgatttggagatcctgattgtatgggacactgtatcaaatgcttcatcaagatcaaa

SEQ ID NO: 40624 - DNA, 1576 bp, Bovine  19866880349186
cccttcccctcccctgcccgtcccccttcccccacctggtcagcaacctttgcatctttcccctcttctctgacctctttgggagcatcctgctggtgatgtccattccccccctctgtgcctggtgctgactccacttagcctctgtcttagtctgttcaagctgctgtaacaccacagactgggtagcgtataaacaacagaaacttacttcccacagttctggaggttgggaagtccaagatcaaggtgtcggaagatatggtgtcaggtgaggtcctgcttcctggttcacagacagctgtgtcttcttgctgcatcctctcatggcagaagggctgggggagctggctggtgtctttgttatgagggcaaatcccattcatgtgggattcattcaaccccattcaccctcacgatctaatcacctcccagaggccccatcatttgggggagctgggtttcaacatatggattttggtgagggggagacacaaatattcaatctatagcaacctctttcattgtctagtttacatgttttgtctctctcttctaaacgataagattctggaaggtctgaaccatgttttcttcattcactacctgccttactccatcagcaagcagtgcttgtcgctcctgtgtccacatccattcatctttgtagacttaatgttgagcaccctgcctttgaccaagaaatgaatccactgctattcagagattttcctgtcttctgactcctctttctcttccccaaccaagttgctttgggaactaagggaactagcttcccctcctctcgtagtgagagaggtctggaagtcagtctcatgggtaaactgaggcttccctagatgcctgctgtttcacataacaaattctcccagaaaaaccagttaagacattctggtctaaccacatctctctagaaagccctatacagagagtgctagcttcctatgtggtatccactctctttctttcttagagacagagatacaatgtaattccaggtggcatgtagtcagtcaaaggactatgattttctgcctcttttgtagaagatgaaagcagaaattgttggatgaaacttctgggaaagacattcttgcccttccatcctacctgccttgtttggggtgtggatgtgatggctggagctgcaagaaccatattgagttcacaaagaagagactaaaagaatcacaaagactcggtcctaattttcttgattctaattgattcataagccactgatctaatgccagtaattacccacactttcatttcacattaaacaatacatagaccattgtgtttaagtcactgtaaccagtcctcttactagcaactaacagcaatttctagctgatacactgaattagatgataaactcgaaggccttagttacagggagttgagctcttataaaggcaccgttctcagaaattcttcctttgctgacaagccctggtgtcaatactctctgagttaagtgaaatcttttttggtgttcccaaatttaacttcttcagtgaaagtgaaaaatgaaagctgctgggctccctcc

SEQ ID NO: 40625 - DNA, 1284 bp, Bovine  19866880492902
gggaagtccccaagcttactcatgttgtcttgcctctgttggagttcactttcattgttgtggtctagatctgtcttcctgtgaatggaagaaaaatcaaactgaagaaaaatctcaaaacagtatcataagtaactttttagaataatatgttattagttattggcaggactggtgggggcagcataggtgggaatgaaaattagaactgagtttaaccctaaattttacagatcaacagcaatagtatgcataaatagataacttctctaagtataatacaaagagtgctgtgtgggtctttgtggaatggaaattattaatagtatttcaaattttgccagccggttctgcttttttacatgttgtagaaatgaccatgttttaggatgaaggaatcaatccatttcatattagttctgaacatatgcaattgaataaacattctaggcaagtctactgatcattggaatagcaactatcacatgtctgtgaaacactattttgtgcctgctttacttcactaatctactgttagaatctaggaatgtacttcagctagcttcaaccatcctagaatgctttttacatcttagagtgaaaatgagatttccttaaaattaaattttaagaaatttgggaaactaaatttggtgtttcctcaaatgtagtatgctagtatcttggatcatgttttctcttacagtagaagatttcttttctggctaaatttcctttcttgggttcttcccctgctttaccttttttaaaggcaagagacctgtgaaagctaaaccttttagagctcagagttgttgaatgtactttctcccatccaagtaactaaccaggcctgaccctgcttagcttccaagatcagacgagatcgggtgtgttcagggtggttggccatagacgaacttactttctgtccttatagttgccaagaactgctgacaacttaaaagctatcatatgagtgaataccagttgtctggttttttgatttttggacaagtgtgaatcaggatttcctgtaatttttcttcctcttctggggctgtgttgcctctatctctgagcagttttacacttggaaagaaaaagcaaggtcactggatctaaattacttttacttctgtgccagatgaaactttccttctgttatgtgttacagtttgggtatcttttggcatctagagagcttacatttggaaaggggagcatggggggtgtttaggagaggagttttgttgttttagcttaatcctcactttttctgta

SEQ ID NO: 40626 - DNA, 989 bp, Bovine  19866880506793
ctttttaaacttttaaaaaaatacactccttcgggtttagaaaaagatcttttacatgtccttatcctacgacagtacccaagtcgttcatttgtgcgctaagaatgcactacatgcaacacaccccgagagtctaccaattttgatttataaatatcccgccccatccttccaagccactataagtatcttaagcggtccagagcggtctcggcaacaaccccatacacaaaaaggtccaactcagcgtaggcaggaatgcgcccatccacccgactccatgctccgggctttgcgcaggacccgtcactcaagtgacgcgcggccccgcccctgcaccaagctagttcgacgcgtacaaacagatgatgtcattgtatccacaagcgcgtgacccgggatctctgcgccgcattgccattcgctgcgccgctcaatcgtcaagccatgccgcgctctgactggccgcggccacctgtctccaggccccagacacccctctccgcccccggcctccgcccccccttcaaataataaacaatcgagtaaaattcgatggaagggaggagaggacagagagacggcgaacccagaagccaatccttcgcgtgctgacggaagggagagttaaaaggaggagggtttgaaaggaccgggttgtagggggaaggagcagacctgaggcgatgtgtcccgcctcgttgaggtggcatcaggggaggaaagttggagagcactctgcggggcacgcctggtaacgcaggggggctctagggccccggagcggccgggctcgggactctggggtggtgcgctgccagccgaaggggcggagattgggcctcgctagcgctgcgcaggcggagctggcagacacgtgcgggaggagggcggacgcgcgcctcacgggctcgccctgggcacgcggctccgggagacgcgcgcgcttgtttaccagcgcacgtgggtgttatttttaaatggaatgt

SEQ ID NO: 40627 - DNA, 3424 bp, Bovine  19866880602804
ataattgtattagttttgccaaatatcaaaatgaatctgccacaggtatacatgtgatccttcttgatgaaagtgaaagaggagagtgaaaaagttggcttaaagctcaacattcagaaaactaaggtcatggcatctggtcccatcacttcatgggaaatagatggggaaacagtggaaacagtgtcagactttatttttgggggctccaaaatcaccgcagatggtgattgcagccatgaaattaaaagacgcttactccttggaaggaaagttatgaccaacctagatagcatattaaaaggcagagatattactttcaataaaggtccgtttttctagtggtcatgtttgggtgtgagagttggactgtgaagaaagctgagcgtcgaagaattgtgagtcccttgaactgcaaggagatccaaccagtccatcctaaaggagactagtccagggtgttcattggaaggactgatgctgaggctgaaactccaatactttggccacctcatgtgaagagctgactcattggaaaagaccctgatgccaggagggattgggggcaggaggagaaggggacgacagaggatgagatggctggatggcatcaccgactcgatgcacatgagtttgggtgaactctgggagttggtgatggacagggaggcctggcatgctgtgattcatggggtcgcaaagagttggacatgactgggtgactgaactgaactgaaaatcagaaaaaagaatgcttaggtagaataaaatgctacaatttatgatattaatatattttctttatattaacacaattgtaagctataactcttcacgttttttaatggagaaatgagccctcaaaggcaaaagtggtagagtcatggaagtcaaaatgcaaccctggcagtggtagaagtgggccagaacccaataaataacattttcaggattagcagaagtaggggagttgacagaggagtctgagaaggcctggctcatgacatcagaggaagactggagagagctgtgctttagaagctaagggcagacaggcttcaagaaggacacactgtttcaaatgctgctaaggcgtcaggttgtaaggggactgagacatatctatgggattcagtggcaaggtccatggtgctcttgatgagagcagtctcagtggtgagatgagaaagaaggcagagggcagtttttaaggagtgatggaaggtaaggacatggaaatggctggtgcagagtttggctctgaaaagggggctctttaaatggggcagtggctagtttaccctgtctccacacaagtatctgtctggttccagatatatgcagaattgtttcaaactataatactagggggactacaggctcctggtaccttatagcttcagagggacatgtctggagaagggagtgcctgcctaggagtccatgagctagcagagtgatgaagacaggagccaggctggagctgttcacctggagcctctatcatacccttccaactccagtcctaaatgtgtgactcacaaggaaaaacagccagttggagtatttgttcaaactggtttcaatggaccacccctcccttaatgtctgttgtacttctaaaattaaaagaaattgatataccattgatcatgggatttcctgtgaaagaaagcactttggagagggtctgactggctactgctgcttcactgctgctcccatgtggcatgagcacagtcctgggacgctgggagaggctatgggacagacgaagctctctagtccatctcccagatagaaaggtccttcagtacaacacaccactggtcaagtatgtagactgttcaccaagaatacctgtgtatttttgtctggtgtggcttgctgttctgggagaccctccatgatcgtatgatagttactcagaagaacatcttccattagcagttgcatgcctgccagctctccatgagccaccttgaggtcatggccactcagtccacaaaagcatagctaaaaacaaaaaggaacaaaaccaaaccaaaacacccattttgaacacttctatgtttcctttacatgtggtcctggggggagaaaactaggagtagttgtgtttacaagccccatgctctcaattatttaaaaaatccataaaaatcagagtaacatttttagttcaaaatcctccttgaacatattagacatttggctctgtatggaagtccaagttccccaaacgttatggtggtggtgtctgtatacggttgtatggatagtgtgatacacataagcacagggaaaacacaggagaaaaaccaatatgatctgtaaccatatcccaaagtgggggactctgattaatatttttaaaccatttttactattttacttaaaaaaaaaactttacttttggaaaattctgagcatatgcaaaggcaaacagaacagttcccatcactcagtcccaaaaccaccaacctatggccagttctgccccatcctcatcactccccacctccccattatttttaagcaaatgcatcattgattttcatgttgttgataatacttttaaaagtattttctattttaaaaaatgaaaatacaataatacttgcttgaacaatcagaggtaaacatacatttgaaagaaattctccttctgagttctgcttaaggagttctctttctgccactgtaggtgggtcacgagtcacacatctctgaactgccagtctgggagttaatctacgaggcccagagagtgaccggaaatggatgaccactccctgagatcattattagccaggagaatttcagctgattcaagtctgattccagctgcaaacatgattttcttctgtcataagaacacatgattcaccccacagtactgggtttatagcttcataatcaaaaaaacaccttgcttatctcatattaataaattattcaccactggctagagtatgaaggattagacctatggatgcagtgacatctgctctgcaatctgtattcagttctctctgtgacaagcaggaagaacaatcttacctgcatgtgatattctagggtatctgggctgctacttgtaactggaaatggtcctccatcttccagaaacgctctccaagggaacagcacaaatgcctaaaagaatcaaataataaatataataatggtgcataataacgtccaccaagtaataggcatttgtatatgaataagatgtcttcatctctacactaaaacattatgggattacttctctcattatatagaaatagttcttgatgaatagtctctgatgatgcagaggagagagtaataatcttgttttttaaactgatttttcagaaagcaactaaacatagaaaggtattaaagtttcagtgtaaatagtcagcaatagtgt

SEQ ID NO: 40628 - DNA, 1389 bp, Bovine  19866880628861
tggtgttggagaggactcttgagagtgacttggactgcaaggcagacccaaccagtccatcctaaatgagatcagtccatgggtgttcattggaaggactgatgttgaagctgaaaccaatatttaggccatctcatgcgaagagttgactcattggaaaagactctgatactgggagggattaggggcaggaggagaaggggacgacagaggatgagatggctggatggtatcactgactcgatggacgtgagtctgagtgaactccaggagttggtgatggacagggaggcctggcatctgcgattcatggggtagcagagaatcggacatgactgagcgactgaactgaactgaactgaactgaacctctatgaggcaagaaggaagctgttttagaatcatttactaaatctttaatgagagagtcattttaagttttgacacaggaaatgggagcagtgtaatttcagagaaaaattttagttgatcaaattactgtagatttttaatgatgattgccttgagtaaacagatcacactttttctttcttctgtatcctttctcagtttttatttctgtggtctgataagcatgcatgctctcatttctctagtttccttatgaatcactagtttttacaagtttagagagatccttcttccctgcctttgacacacaggattagttcagaggcttcaatcagtttaaaatgagctttttctaactaagtctccaggttcttaaggctttttgttttagtttctttatcctatagtggctgaatttagcgcttggttttcaatattttaccgtaagaaatgacaagttgcttttgaccatttcttaagccagaattccttacatttagataattaaacattcataagatgaagatttactatttcgtcattgcttgctagtacagctatagtttgttttattttgaaagtttatgcatatccctaatgttttcaagtgccttaattgtttaatatctctggcttcaaaggtttctgggaaaaggtaggcttacctcacatttttgtgtctcagtagtaacagtctaggtacctcacaaaaaattttattatggtaccatggctgttagtttttagtgagtgcaatcccagggacggggatgcctggtgagctgccgtctatggggtcgcacagagtcggacatgactgaagtgacttagcagtagcataaaagataagattcagttgaaaatatttagaaatttcattctcccaaagtggtacaaattagctgcaatagcataattatcatttacctagataggaatacctttgtgttgctttgctaagtcacttcagatatgtccgactctgtgaccctatgggctgtagcctgccaggctctt

SEQ ID NO: 40629 - DNA, 1280 bp, Bovine  19866880635705
agtaggcgcttggagccccatcctctggtgtccttcagttcaagaggcaattcaggaggcatttcagcctcagaggtactcagattggaagactgttgctgggcagtatctgcagtcacgaggcttgtgcaaataccagcctctccccacatcctgcttaccttcccggttcatgtaggttcgcagctcttggtccagctgccactgtttctcctccaagttcagctcctgcactctgtggagggcaggaatagaaaaggctcagatgcctagggtgagcaaagccctggctggggcctgcctgactcaatgccactgtcccccactccccaaccctgacaccccttacgtgatcatgagctcagcctcctcggccactaggctgtttttcttctggacgagctgtagcagctgttccacccataatgccttttgcttttcaggggaacctgataaggaaaaaagggggccagtcaggcctccagccaggatcataggagtcatggcatgaggaatagagcctgctgtgagccagacctagcagtttgggggttgctgggggcagaacacagtgccaggaggcagaggtctcctagttttatccctcccctatctttactcactgctttggctcctcaaagccagctccagctctgtgcccctggcctccagctcccttagagcagcctcgatctcatttagtcgccgctggatggcctgaggagtacaagacggggcccaggagtctcatgatcgctcaagaacagagtcccaggggagctcttatccccagtctcaggattctaaccccatcagaacctcggaaccctgaggccacacctgagccttgcagaaccgcttcatctcctcctccttggcccggcgcagcagagtccgacgccacgttggataattgttcatggtgcctgagttctcagccaagttcctcagaaactgtgacagagtcagtggataggggttggggaagctccatttaagaaggaccagaaagaccctagactggaagtggggtaagtctgatagaaaaggtagaggcttagggacatgaaagagtcagaccacgtgagaaggtaatttgggctcagaagaggctgggtgctgtgggtttctcctgggtgaggggaggcgtgtgttgagtggatgtgtgctggcttgggcagaataggtggccaggttcttcccactcccatgttccatgtctgagtccaaaggcacatcttcctcttcctctgtttcctcttcacggaggaggacctctc

SEQ ID NO: 40630 - DNA, 3213 bp, Bovine  19866880640838
cccgcagccgtcacctcccccctgcgcttctcgtcctcaggggcattccctacctgagcaagcatcgcgccgaccgcgtgaagcgcctgggagactttctaaacatggagagcttcgacctagctctactggaggaggtggggtgcggaaccaggctgcaggggggcagcggcagtgggggcgctctcccagggggaagggccgggaaggtatctttaaccccttcccccaggtgtggagtgaacaggacttccagtacttgagacagaagctgttgcccacctacccagctgcacactacttcaggaggtgagcagccaactggcctggaagcctagtttcagaccttgaggtgcttggcctgccagcccctcctccctatgctgcctgcaccctgcttcctcttccccagcatcctctcctctgggtgtggaagcagaaggtagaatgaggaaaatctagctctgcagctcatcagacttactctcaggccatcctatcaccccacacaaacaactaacactttgtgagcttccatcagctgcaaaaagagaaaaaaaagctgataagagctgggggaaggggctgggtatttctctccctgcttttgtgaccgctaaccaggatttggctttcagtggcatcattggcagtggtctctgtgtcttctccaaacacccaatccaggaattcacccagcatgtcttcaccctcaatggctacccctacatggtgagcctgatctcgaactcatccaccaccctcccccacctccactaacacatggtaaaggaggtaaccttcccaggactgcaagggatgggcagagagagggttgcagtgctctgagttctgtcccactcctgcctgcagatccatcattgtgactggttctgtgggaaggctgtggggctgctggtactccatctaagtggattggtgctcaatgcctacgtgacccacgtgagtgaagcccacagtgcttagggctgggagaggcagcctggtcctgggagggagagaggggacacctttggtggagtctccttggggtgagttgtaggggcaggattcctaaggtcagtaggcagagttcacacattttaccaagcaccatgccaaatgacaaacttgatttacatctgcccttgggaccttgagtctcacctgttactgtctcctctatctttcgcagctccatgccgagtacaatcgacagaaggacacctacctagcacatcgcgtggcccaagcttgggaactggcccagttcatccagtgtgtgagcctgggcttaacaggggaaatagggtgggatcgagggattgagtggtggctgtaaggtcccactcttagggcagaactgatgagggaagaattcctgcctcaccatcttggttcctccagccacacatccaagaaggctgatgtggttctcttgtgtggggacctcaacttgcacccaaaggacctgggctgccgcctgctgaaagagtggaccgggctgcatgatgcctatctggagacccgggacttcaaggtgaggatctgtctaattatttccccacctacgccctcagcctctttccctcctccttcccctgcatcctcactcaagcccactcttcacctagggttctgaagaaggctgtacaatggtacccaagaactgctatgtcaagcaccaggagctggggccatttcccttaggcatccgcatcgactatgtactttataaggtcaggcctctccccgccgcacccaccatgtctcttcatctctcaccaggctgtgctgatcctttgtccagctggtctagtcttacgtcactggcagctggaaaatggatagccaggaactggttctctggaaacatacttccaaatagaagtttctctttggcccttttcctaggcagtgtctgggctatacatcttctgtaagactttcaaaactactacaggccatgacccttacagcggcccccccttctctgatcatgaggccctgatggctaccctgtgtgtgagacacagccccccgcagcacaaccccagccctacccatggtgagtcatccgcatccttttctttggcacttccgcaccacaggtacgccctccactctgactgttattctgcctccccactctcctgccttgtaggaccagcagagagctcgccgttgaccagtgtgctaagggaggcctgggcagaagtggaccagggcatggcccaggctcactggtgggccaccatggccggctatgcagttggtctagggcttcttctcctagcgttgctgtgtgccctggcggccggaggatggatcagggaagctgctctactgctctggacccccagcgtaggactggtgctgggggcaggtgccttctacctcttccacgtgcaggaggccaagggcttgtgtaggacccgggccgagcttcagcatgtgctgggaagggcaagagaggcccaggatctgggcccagagtctcagccagccctgctcctagggcagcaggagagagagagagctgaggaacaataaagcttgacacttttgtggctcggcctttttccttgtagaggcagtgactggggccaggggtcagtgtgattgtcacagtgtagacctttgggctcccacccgtctgccctccctgctcagtccccacctcacacctgcagctagccagaagtcctgtttatgtcagaaactttttattgtaaacactgaggcactctcccaggcagcccagatgaacacagggtagcactgtcctggggtaaggcggtcttcctggcagataagtcaggcagcctgccctcttctagccctggaccccgggctccgaggccagctcactgagcctgcgctcctcctggaggcggatgagagcatctcgctggttcaccacatccagtagcttcctcaggacctggtcctcagcctgccgatcggcagctgtctttagggtttctgaagggaggagatgaagcttagaggacagaggatgcggcagagaggcccaagaggcacagcctaatcctagcctgtgtgacttctataacccctgctgtttcccaccctgtgaaattggcttatcaacactaatggttttctagcattgttagctgcaacatcattcttaaaggaaatctggtgtaaaagctgagttgtgcagctcgactgaaggtgcagagtagg

SEQ ID NO: 40631 - DNA, 1830 bp, Bovine  19866880709871
tctaaaagaagaaaccctgaaggagaaaagagagcaaaaatttgtcaacattcttgcttctttataagtaacataattctaaaaattaaattgaagaagtgaaaaaagtagaggacaaataagagaaacgatctcaatgtacccaaaacatgctgttgaaaggaaaaaagtgcttagcaggcaagctatatataagaaacaggaagatatcaactagaggaggaaaatctagacaaaattagtaagcagaagtaatattataaaccagaattcattccaaataaaaaatgttttaaatgacaatagggcatttttttcaagaagcttaaactacataaatctaacaaatcccactcccattcttaaaggagttgtttggtttaatggctgaaatcattgttatgtgtgtctaatcaattattaaatatttctattctgaagaatagatctacatatctacagtactttaattcactttcaatttctttagttaataaaaaaaaattcaaggtttaatatgtggccaatgaaagtgtaattacaccttttgccctgactagtattctattaaaagatatctattctttttcatgaattgactatatttttaaaagtctaatgggtttagggaagccacttggtcaagagagcatacaatttgagatttatctcctgaatttcaaaaacaagagtataaggcatcatttcctttctcaagtgcatggtggttgcatgcttagtcatgtctgactctttgtgaccacgtggactatagcctgccagattcctctatccttgggatttcccaggcaagaatacttgagtgggttgccatttcctactccaggggatcttctcgacccagggattgaacccatgactcctgtgtctcttggatcagcaggtggattctttaccactgtatcaccctacgtagccccaagagagacaaatccaccttcatccctgcactttgcttcatttccattgttcttcagaacaccatcttgcctttgccacagttacctcaacaatcttcataacacatctttgtacctctagttttgcctgaaccttagctgaaatgcaaatttgatgtcattacattctttaaaacttttagtaactccacagtactcttaagaatgaaatttattgtctttaatgaatcttaaacaaggtccctccttactgtttgacctaaactccatccattactctccaaactctctgctctagacaccagtgagtgagtgagtgagtgaaagtttctcaattaaatccagtctttgcttcccccatggactatacagtccatggaattctccaggccagaatactggagtgcatagctgttcccttctccaggggatcttcccaacccagggatcaaacccaggtctcccgcattgcaagtggattctttaccagcagagccagcagggaagccctccagacaccagttgttgttgttgtgttactcgctcagtcgtgtctgattctttgcgaccccatggattgtagcccactaggctcctctgttcatgggattctccaggcaagaatactagagtgggttgccattcccttctccaccagacaccagtgaacttcctttattcagcttccctctcccctgcctctgggcctttgcacagtgctagtttctttgcgtagaactctgtctttactctcccaaacactccaccaattttctttccaaggcctctctattaatcctctaagccctagctcagatatcacttacttcaagaagcccatcttgaaccaccagtccaagtctggactctaatgcttcatgggtctctg

SEQ ID NO: 40632 - DNA, 952 bp, Bovine  19866880791528
agtaaatgattctaaaacaacttctttcttacctcataaaagttacattttaaaaaagctcagtggaaatcttaaggtacaacagttaggaaacttttttgaagtatgaaggaaaatatgattaaatcaactttatactttttaacagccataataaaaatttagggtggttcaatagctgaaggcttttgacttcctataaattgtttaagttactcggacttgaaataaagtaggtaagttttcagttaaatactaacagtgtagtatcttagagcagattttttattgcccacatcaacagttacatcctcagaccaacttctcccttctttaatgtgaaatagcaaatcaccagcattttaggttaagtctagactttaagggattattctttaatttctaagtgatacaaagtgctttataagtatgaacaataatgtgttatactttactatttttttgtcctttccattcattttttaaaatctggaacatggcatctttttttccatgtagaaaaaactgttatcaagcacaaaattttactctaaggatactaaattttaaaatttattccactttttaaatgatagccaaaaatccacctgattgatgctcatttagcaccttctcaattctggtcactaaaggtacatcctgggtttgaataaaaataatgcatctttcaggctttaaaatgactactttttaaaaaattttaattggaggctaattactttacaatattgggcttccgtggtggctccacggtaaagaatctgcctgcagtgcaggagatccaggttcggttcctaggttgggaaaatcccctggaaaagggaatggcaacccactctagtaatcttgcctagggactgctaagtgacttttcctgcacctgcaaaagggttatgaggctgtctgcacaggacagtgttttcccttccag

SEQ ID NO: 40633 - DNA, 3342 bp, Bovine  19866880797830
aatgctgttaattggactgttctaacaaatagtgaataaaggcatgttccttcttattctaccagctgggaaaagaaggaaaaaaaaaaaaaaaccaaggtaatacagaccaagatgcaaacatatgatgggtgcgattaacaagtccttgattggaaacaaatgctgacagaaaactccagaccagctatcacacacggtaaaaattctagaaaaaataaacagcaaaactgacttgtaaattacgctgaatttcaaaagaattaccaacaagaagttctaatgcaaagatgtcgagagagtgtttttactttatgagaccattacagcattagaggtaaaactgcattaaaaaaaaaattgagtaaaatagaagtgaaaattaaaaagagaaaggagaggaaggtgagagatggctttaaatatcattcagccaaactttatgtgaaatatggaactgaggcaattatttagataatttatgatgaaggaactatcattttttagaaattatgacactttgggggaaaaaaagcagttctgagatttgaattatgtgaattaatggcttaactctccatttgctctttttaatgtaataccaattttcaaggagacatctaagaagctgtactggatataattctatgccccccttcaacttcaggtttatacccagagttgtatctttacaagtccacaaggccaaggccaccttctctgtaactgcctttggccccaccacgctccccacacccgggcctcactcagttatcaggcagagcccttctgcctgctccacatttatcacagggtttcagtctatcttctggacactctccagacactactcacctatctttactctgaaactgagagttctaaaattttttccagcacacacatgggattagccttctgcaagctgtattttatctcagggcacatgggtgctgtattcctgtggccaattaaaaccatcattttaggtccagtcatacatattctaccttgaagacaaaagcagtaagtgccttaataagataaatcctttaacctggccagcagcttgcattttgcaagattttctgtctgtcttgctttaaacctgttagtaactgcaatggaaagggtcaaccacctcacaaaatatgcttaatacctttaatttttgagatctcattgggcttcgaccacacttctgccacaaaccttttataaatgtctttttttccctgaaatccatctttcttggtggtattatctccatccatctacctacctgaagcctacagaagtacagatataccctgttctcccaaggcagaaatttctgagagataatagcccagccctaaggatttccacacactatagtatcactctttttgtcctgaacactagtacattatctgacctatagtaaaccatggttaaacagtggtttactaaagcagcatccaaacagaaatacaaatccccaaattaaattgctccactaagagcccaggcactgattagattcttaaaattattcactcaggcaaaatcaagggcaggagcctaaatcatgggtctgtgtctactcccctccaacaccgagaggtatcagttaccccaagtgagccacagtccagaagataaacattcaggacagcattctgaaagatttccatcaggactgatggtaatacatacaaagaatgcggcacacagtagcaactttttcaatggcagctatttaattttattgttgtattcacccccaggcaaagtcccaccacactcaggaggcagcaaagcgtagcagaaaactgacgttcaaagaaaccttcctctgaatcccaagcaattaaatttctctgaactattttcttgtctctaaattgggtttatacttaaatgcttaacatgtaggatcaatattagatgtaaaaaatctacctgagtaattggcatatgatagtgttcaataaatcatagctactattattattataactaggcctcagaatatcttgtgtcaactcctctttttatcataaaaaccaaactgtgtttccaattgatttataaccctggctcccttttcccaaaatactattttgaaatatgagcataaacagatgcaattctaattctgaaatacttctgaacaattcaacccaaacaccttcacggaacctagaaaacacctgttgctacctgaatgaggactaccactctatgctccctcaggatggctgggttttgtagacataaatgtatagaggggatgggagcctgaaggctcgagtgttgacactttgaaagggcctgaactaagcacaggaggaaccaaggagactccagagacattctgattacccttactgccaccatggacggcagtgaacctgatggggcgataccttctcaagcctgactgggctggggaagagagaattcttcaaccttcttccgctgaggacccaggctgctccctccctgaaagactgactaccacagaccaaagctctcagctagaccttggccttaaacctcaagtccacactccccgagtacagccattccaccagcttcacgaaataggccacgaagtagaaagtgagtaagaagggtgggaagcttaggagcgagcccaaaatacacgctaaacggagggcggagggctcgctgcagcagcttgcactgggaaatcaggggaattcacacctcccttctgtgcctaacagcaggatgaagaagaaatttaagttaccagaaagtagcctaggagtgattacattttaattttaatctaaatataactttggagggagagggcaaaatgggtgaagcgggtcaagagagacaaacttccaattactaagtcagtcagtcctggggatgcaatatacagcttggtgaatacagttaatacctaggtatctgaaagttgctcagagagtaaatattaaaaagttctcaatataagaaaaaaaaaaaagaaaaatgttaactagacttacagtgatgatcattttgcaacatgtataaataccaaatcattatgttgtacacttgacactaatattgttatgtcaattatatctcaattttaaaaataaaataaaaccttcttttcctcttctgcaacccttcatgttcctctcttccatccctgtgcgcctatgtgtttcctagggctaccatgacaaattactacaaactcaggggcttcaaacaataaaaacgtattctcttacagtgctggaggctagaagtccacattcaaggtgtgggcagcaccatgctcctactgaaggctgcagcggagggtcctgcccggcctctgcccag

SEQ ID NO: 40634 - DNA, 988 bp, Bovine  19866880857571
cttggcgtaacagactctgataagtgctgaaagaatgaattttgtgtatgtgaaatgctttggaatctgtaaagtgttatacaatatatttttttttctagtcctctagtacttcttccttaaatatttactttcctcttcctactttggaggaggaaataataattttccccacatttttcttgttgatgggctgccatacacagcagcaaaacagaaatgctggatcttaaattacttcagaccagcacagcatcttaggttcctgttccctttggcccaggtgactagttggataagatttgttttcctctttcccaagagatagaagtgatttccagaaacagaaaccgcacaccacatcctgatgtgagtgttttaatctttggtggctcagattttgctccacctgagctttacttggacattgagacttttgaactgatctttgaaatgtaccccagtcgtccagcaacttttaaactggaattattacttcctagaactatttttgtttcagttctaggaaatgtttctccaaggccagcttggattatagacacatgcacactttggacccgttatagtctcttcgtgtacagagctgtcacccagggactcagcaatcagtctgcagcccttatctttgtcctgagaggttagcattgcctttgtcttaaaagttggaaggctacgttgataattggcagagatttcatttttctgggacttatttttaaatttaatcacgttatgacttagtgtatttttggagaacatagaaacaaaaatctcaaaaaaagaaagaaggaaagaaagaaaacccctctctagtgacaaatgaactgtcacctgcacacacctctttgagtgttttttgatcactcaggagaggagcttagcaggaaactgtggccagccgcttcccccgtccaccaggggggagatgctgcttggaaccaggtagcaccaaagctgatggctgctg

SEQ ID NO: 40635 - DNA, 2499 bp, Bovine  19866880865670
aggcatttgggttctgtgctgagtcggagagggtgggcgggaagagccagctccacaagggcaaagcagcaggagctggaaagaatgaacaagctaagggctttttgtgccgcccgcccggtcaggggtgcagaccaaggccaaggccgaaaaaaggagcgagctcagccaaacgctcacagcacccactgggaatgtggctgccgaggggctgggaagacagccacagggccctcctgccaggctggaggaggagggcaagcggggagccaagtcaccatataaaggcgccggggaaggggtggaggcgcctccctcgccaatcctctgtggccccaaagaggatggaggagggggagaaaggtcgcgctatcctctggcctgctgctcggctgtggttgcactgaagaggaacagctccaaaaggggccaatgttttttgctttcagccctaccctctccagacattccgagtcccgttttcaacagcaggatgcctgagcactctgaatcagacagcgttcacatgccttgaagaccgccgcttgccctggacgagagaggctcagcttaacaagcagtacaagcacggacacgctgggggattcccagacagcgttctctgaggctgacgattgccctgcatcgggaagttctgtttcacaaaagaagcacaaggaactgagtgtatctaaaagtggggaggattagacagatagctgtttaatggacaggagtgatgggaatgtagataaaggttattattttttttttttggactgtgacctttgcaaaacattgccagacttacaagtcttatttgagggattttacctgatctcctgcccagtagatatttatagaagaaatgggggaaaatccttctgtgctatccaaaaaaacaaacccaaacatattttggtgagctgctaaatgtggcgacgctgatgtcagaagcacccctgaggcaggtctgctttgcaaggctgccacagaccccgctcacgccttccacactgggcccatctgcttgcacatttggttgtaccaaatgcagtttacaccataaagcatacaatatgtgcacagttcttaaatgagatttgtcatttcactgaatttcggtcagcattttaaatagatacatttctttgtgctctagtcgaacttacaaactgcacccggctgactgcagtgctgtgttttggtctcagtttttgtgtgtgtgggaactgggagttaccagttggaccatggatcctggacaaatcaacctcacagacagacatgagccaaagaagttgcccttgttctccctgaggaagtcctttgtgagagctgggaggagtggattccttttctctgagactgccgatgaaacccttggcttgtaccacagccatcatattctgacaagctcgcgtcactgaagggctatgggtgaacagagttgttgtgaacccaaccatgcgttatttaaaatgaacaaattgtcctcagctttgttgcaaacttaacaaaggttagatatggagatatactgaaatttctcaaagcaaaaataaaattcggtggttgcttcattagcaaatgagtcaagaacaacttgtggcttgtctagctaaccaaggataaggaatcctcccttccactgccagttcaaggatccccagggctcacttctcctcagtagcccagtgtgaccagtgtcggaagccccatttgtgcaatggcttgttctcagtgtcatctgttttgacacaagtctggcagagaaagtccctggaagggtcgaacggcccatctccttttctctggctaagaaagtgctccttggttaccttgtgcctcagcaaaaggcacaaggcgggtggttatcaccacttactggggaaatctacaccaacacctggcctgtcttgctgatttggttcctactttgtaagggagattcactttcagccacatgcctgaagatgaagattgaccctgtgtggctgctttgattaatcactttaaaatctcttgaggatttgtacaaaaccctccgctgtcaattttggggaaaacaatttgttttaaggggccatcttaataatttacaccacaggttcccacacctgctcttcacctgaggtacctattaaaaataggttcttgggctctgtcccagacctgaatcaggctctcccagggtgaggcctgagaacctgtatttttaaaactcctcaagtttaggagacaatgattcaatgattcaaatcaagaaagaattcaatatctcaccactttaatacctagtgtttttatatcatgttaaaaaactatgaatccatgtttcttttaaataattctcacaacacagacaggtagaaaataaaggtgaaaatgctctccccaccacctttcattatcaactgacctaataactgagacagattaagggcactccaaaaagaccaattttcatatgcgaagtcagacttttccttaaaagag

SEQ ID NO: 40636 - DNA, 733 bp, Bovine  19866881009468
cttcttgcagatattctcctgctactcttgtcttagctatctccgaagtggatgataaccaaattggcaaatttagtttttatacaaaggaagccattcttaaggtaaattatttttttttctaaaaaggaaacgaaagtaaaattaagcaacttgtttgtgtattccttaaaaagtataatgtttaattcacattagtttgaccccgtatacaagaaaagatttcaccttcataaataatgatgatggctttccttgtctgacatataatacctcttgagataacctctgcttggtattaaaaagaaacccatgttgggacttccccagcagtccagagatattttcaaacctggtgttatttttccctgccactcagatggacttctttgcttctgtgtgtgtgtgtgcaggtttgtatttgtgtgtgtatgttttaaacattaatctaatgttggcagttttacaagagcctgcctttgagcgtatgtttgctagttcatcagagcctatgtatcctgtatctgacaactggggaaacctgatggtgtccagatacagagcaattcggcctagagcctgccctcacaggatgaaatactgcttagggagaaaccagctttaggcctgtcgctgaggagcaagggtctcagcaaatccaacagtttgatccatgtatttacgtgttgagtgagtggtgatccccaccctcaacttaatctctttctgtaag

SEQ ID NO: 40637 - DNA, 670 bp, Bovine  19866881013093
ggtgtcctgtccctctgaacccttccctggagaggaaacgggaggttagggcaggggagacacagcagaaagcttggctagtgaccacacagctcaagcttcaccaccttatggggaccctgggataaaacagggattccctacctccaggggcttgtgcaactagttgagcctgagcgaaatagagaatttcttgtcttggaatctgacagaagctaaaaggaacctaagaaattttttaacaatttcacacctgaaagacagcttagtaaattctagacttcactgtctgcttacacttcgctgcagtgccatgcccaatgcaagttggtttggatcccttaacatttgtaagcacttgtactttatggacacttcacagtaagcagcagtgttcagtcctctctggaataaccagagaggctcagtggaaactcctctcaatggaacaagtccaggaaccaccctggaatcccctgggaggagggagtgatggaaggacccacatggggctggctctggggaacacctgatagcagggaagggggcagatctgggggacttgggggaggttttggctgtactgaaattctcacttgtggggcagctggaccaggctccgtgatggcctgttttaggcatgggtctccatcttacagctggtcagaag

SEQ ID NO: 40638 - DNA, 1752 bp, Bovine  19866881106766
tgaagaatcgatgcttttgaaatgtggttctggaaaagactcttgagagttccttggacagtatagagatcaaaccagtcaatcctagaggaaatcaactctgaatattaatcagaaggactgatgctgaagctgaaactccaatactttggccacctgatgcaaagagctgactcattggaaaacaccctgatgctgggaaagactgaaggcaggagtagatggggacgacagaggatgagatggttggatggcatcaccgactcaatggacatgagtttaagtaaactctaggagatggtgaaggacagggaggcttggtgaaggactgtgctgcagtccatagggttgcaaagagttggacatgacttagtgtctgaacaacaataggactgttaaataggcttatttaaacacaaaccagctaactaattgtccagatttctatataatactgctgtttattgagttcagagtcagaaatcagaatgtatagtttacatatattatactcacttctggcaatattcaactataacatctctcttgactttcccaatttcatcctgtgataaaagagaatgatagttttcctattagacaattggctataagaatttcccaagctaatacacgtgcacaaacttatagccaacttaaagtgggagtaggtcacacagttgagatgttctttctgaaggtcaacctactgggaggtactccccctgtgggtcttttctactcctgcacatcttgtgagtacaccaagaattcaacgccctgactattctttacctgaaccatttctcagggttatgtttgcagagagcagtctggaggaatgaggtaatgtctccctccatgaaatagagcaagtttgctataatagaggtagattcctaaactcagtattcttcaactctgacacaaaactgtgttcaacctcggctcctccatgttgcccctgggacttgggaggcaaagggaaatgacacaaacgtgaggcttatgatgctggctctgctgtgagtaacaaagtcgtttttctctgacctaagagtctagtgttctctgtcagcatcctcagagcagtaacaggctaccttcttagcttataagtgggctaaaatcccagaccttgacaaaactaacaattatcttgcctgaatcctttctaatctgataggcattggatattcctgaagggcagttaatgagctaatacattttcacttggtcagtatttttttaatattataaagagtaatttatgtatcaaagtaatttacttaagtacttatcagaaggagtcgtttgcccacatcattgctgagcagtaatctagaagccctagcttccatcatatccaatttgtagaactgaattaggtaaattgaagtccttccttttcagtaataaaagaacaaagcctagagattataaacctcgtcatttcattcccaaataactatatattagcctaaggactccctcatcaaaaaagtaatgaataatgaaatgatattcataaaaataagcaacacttttaattgactaaaggtttaaattttatggagaaggaaatggcaccccaaaggttgctgctgctgctgctaagtcacttcagtcatgtctgactctgtgcgacaccatagatggcagcccaccaggctcccctgtccctgggattttacaggtaagaacactggagtgagttgccatttccttctccaatgcataaagtaaaaataa

SEQ ID NO: 40639 - DNA, 790 bp, Bovine  19866881119990
attatgggattggaggatgcctaaacttccgagtgaccagcatgtgttaaaaattttaagaccttgtctgaaaacattgtatgaacactaagaaggcttagcttctaatacgctccagtctatgaaggagagtcaacagttcccaatttcaacctcttttctcttctccctcttttcctttatctttctcttcctgtcttcccctccttccctctctatttttcaaactccaaagaaggtagaacataaggaagaagagtatgagcatgtccaagttttccacttctattttaaacagaaaaggacagaactaccctcactatcctaccaagggtttttccattgcttagaataatagaatggtaactgtcagagaggcagggcctctgcagatatgtatctgtaaactagggacatcctgttatatcctgatctcatctcactgtgacgaagaaagaggtttgtattctgtaacaattacgaatactctgaataactgaggcataccaatgacactctagtctaatcctggcaaatttagaatgaaaaagaaaatgacaggcaaatcttctctgctcctcaagatgccattaatctgacacatggccagagttcaagtgtcctaaatccacacttcagtgtgtggatgggagatttaagaccgatgtgtctagtcaagaggacccttacaaggccacatcaatccagggaccccctacagttcagaccaggaaggtacaaagggacactgggagtacaaacactgggccaggctatgaagtttgggagt

SEQ ID NO: 40640 - DNA, 1379 bp, Bovine  19866881141913
attggagaaggaaatggcaacccactccagtgttcttgcctggagaatcccagggatgggggagcctggtgggctgccgtctatggggtcgcacagagtcagacacaactgaagtgacttagcagtaacagtaatcttggcagaaatcatctttaaactggcaaggggcattatgattctgtccctttgagataattagctgagaccacttttagagctacatctgggactgctccaagaaatcatttcacttaatcatctgaggcggtctattaaatattggctgttctgaaaaactggcctgcaatctgccaatactggtgacttattagaattgataaaagacaatcacctacaggatagatgtggatcccattaacccctctctggctgtgatgcaaatattgaacacgaggacctggagtaatgaggtgggggttgggatgggatcttcaaatgccaccacctattgattcccagggaattgattttgtccttagcaaagcacatagcaagataggctctgtgtcccttgtggcaatttgatgaaagtcatcttctatgcaggaggtcatcagcaaacactgggtgggggacctcaggctccaggggagatgttcagggattctccatcctgaactggagttagtgtccccttctccactccttagctatgaacctacacagactcccagccatgaccaagctcagaaggtgaaactgaacaactttaacactccactcataggtcctgactgctttttgggttcgttcaaggagtgctggagagaaagaagactttgttgaccagtgacagagtctctccatatacccaggcaaggaaaaccttcctaaatcctttctatactgccaggtcattccagaacaatgtcctctgagatgtatgtgggtcattctacctggaccaagttccgttgcctggggcaacagtgttttctgaaccaatatgggggctgggcgatctctaggtctggtatgttgcagtgtaaatggaggtcagacaagttggggctggctgagtcttggaagctgagggtcaccgtaaccacatctcacagtgtctctcctcctggaccaatatctgaatggtacacagctggcatctcaacacccttctacaggggcagcagtttgttttaagggcagaatgactggagttctgccactttgtggcacactttcaattattcataagtaaaatcaatgataaatcagatcacacttcacattagagcctagattcccatccacataagggtttcaggttatttttaagaaaaatctaaatacccacattcttaaaacgaagaaaattataccacgaccctaatttcccactctccaccttccccacccca

SEQ ID NO: 40641 - DNA, 731 bp, Bovine  19866881203999
gtagacgaacatttttggcagctggaaatacttctgcctaccagtctgtcatagacggcatgtaccatgggttgccatcactgagcaactctccaatgaagagcatttttgcttcccagctcagcctaccacaaccactggatccacagagcctccaggtgtgttgagagctatttttgtactgagatgtgttgagagcacattttgtaataaaatgtgcattgtgcataggaggctcttcatgccgaagtacccattggccttggtaagctccccttcactcatacagtagagagggcccctatagcttgctgttatttctagtcaggagctctgtctccaaaccgcttaacaggctaattgggataacagattatctgctcacagctggtagcaaaaccaacacctgatctctttcatgtaataaataataatgatagcaattatgatacataaattaggtcagcagctgagttttgaacagcccaataacaatatgtgttatcaaatgtaatcctggaaactattattgctcctaggcaccaactctattacccacctgctacaactaaagagatcagactgctatgcagtcctggcaacactaggtcacaaactgtattagctttttatggcttcagagcaaattacccccaaatatagcatatttgatgcttttgaactgtggtgttggagaagactcttgagagtcccttggactgcaaggagat

SEQ ID NO: 40642 - DNA, 781 bp, Bovine  19866881254229
ttctggaatttcttcttctggttggacccactccactatgatttctcagaccagaacttatttcctacaatatttcaaaccaaagtgaattaaatttgttgaatttgtaagtcttgtggtactgacagtaaaattatctaacagctataactgatcccaaatacatgtaaatggcctggtaccctaggggtgagagagagtagaagggagagaagagaagagaacaagtaagggagcacatggaagagataccactttgtacaatgaaagggtgaagcactaaatgtgactatttacagaacagagttgtctaaagtgctctccgaaaaatttctccatcttacaaggtggctagttggagtgctttgtataggggcctctcaagaaatacagctgatgaacttcagggtacaagatctgaagaatcatctcagggtgccattctggtacgacctaagcagatggaggtgggctgtataagctgccctgtacaatgtattaatgaaggagggagaggtggagggatgatgggcaagaggggaaggaagagtgggaagaaaaaaagggaaatctgtatcttccaatattcctattatttatggaggataaatacaaggaaagatagatgggattcttttacatttttctaaaatactaactaaaagaaaaacattaagccttcaaaggaaagcccattctttttcaaagaaagaaggctttccacagctgaattactgaaggaaaggaaaatgaggcaaaagaaaaaaaatcttgagttaaa

SEQ ID NO: 40643 - DNA, 778 bp, Bovine  19866881299424
cttttaagactattttccttgttttactgatctgacattctatatagtttagagacgttcaaatttctgctgaactgatacatataatagccacaactggaagaatcagttgcctactcgttttatcaaggtaactgacatagatagatagatagtgaagtcgctcagtcgtgtccgactctttgcaaccccatagatggcagcccaccagcctcccctgtccctgggattctccaggcaagaacactggagtgggttgccatttccttctccaggggatcttcccaacccagagatagaacccgggtctcccgcattgtaggcagacactttaccgtctgagccaccagggaagtccaactgacatagtggtggtgaatggagaaacaataataaacataggcagacattaagtagagtctcaaaataggagggcgctaggatttgaggagggcagaatcattgcccgctgaagtaggacccctgtggtaggaatgtgccagccaggcactaagcgttactgaggattgtgaactagtattactttcacatacatgtatcttaactccagtgaaaggccgaggaatatttgggactagcagtttcatgtatataatggcatcttataattggtttcttttatctcagccagaactgtactattcatattaatatatgagacaatatgaaactccttgggttaccacagaggctctggttttggcatatatgtggtctcagttgggcacaaatccagaaaatgaatatgctctcatta

SEQ ID NO: 40644 - DNA, 1420 bp, Bovine  19866881329925
cttttcggccccatggactgcagcacgccaggctccctgtcctttaccatctcctggagcctgctccaattaatgtctgttgagtcagtgatgctaatggctcaccttcattgaaagcttactgtacgctgcacagtgttctaagtatttcacctgctcatttcatcctcacaacagtcttatgaggtaaataccattattatcctctttttctaaagaaggcaattcaagctaagttggtcttcaaggtagtcagcttggccccagggtccactccttaaccactaggcaataatgcccctgatgaatggacaaaggctcggcgactcatgctggtaataagacaactgggtttttcttgcttgtttagggacaatgatagttactggggtttccaagtcagagggagagaaaactctaatactgagaatggccctttagtcattcatttattcattttgttcatccgttatttcaccagtccaacaactgattcatgcgacaaatgtttcctgagcactctatctaggtaaggcactgtgctgtgcatcctcacagacagagaacaggatgcgtctaggtgagtgatgggattgggcatatagcagcgtcttatgatggggcttttaatacaatatgattaccgttactgccaccaccaacagtacttgtgcagcatcagcgtgtaccaagtgctgttttaaaagatttacctggattagtttattctgtcctcacgataattctctgaagtaaatactacttcagaatagtatcttcgatttgtatgtgacaaaactgaggcacagagaagtaaactaaggggtagaccaggattccagcccaaacaatcttgctccacggtccagaatgtttagttctgagaaaatgcaccacatccttaccttgaaatcataaaagttatcaatgagagttatgaatctccgagcttgggtcctctttgccagggtaaattgtggaatgtttcgtaaaaatactgtatcaaaattctttgacagttccaaatagtcactggctccaagtggctataattaaaatgaaatagagaacagaaaattgaaataagtcaattctggttgaaaatatctctttttctcatcatggtgtgatctaggtatcgctttgaggtaactttaccaaacacagtggtgttctcagagcaggctgaggacacgtgtacaccctacttactagggatataagcagaagggaagagagaagacgagcacatggtgggccgtgaagaacaattccacgccacctcagctggcatcctgtaggcccacatcctaaatctggtcttcatcgttttatttctatgacatgattttgctgctaagtcacttcagtcgtttccgactctgtgtgactccatagacggcagcccaccaggctcccc

SEQ ID NO: 40645 - DNA, 1609 bp, Bovine  19866881382655
catcaatctccaaggcatcactaacagatagtcactgagtgtaaaagtcttgtaagaatcgagaagttctcctaaaactaaatgctaaatatgattgttctccaaatgcaaataagaatgaatgtaaacacttcaaagggatccatttcaccggcagactctcattccaatagctatattccaatcttatcctccctctcttcccttgtttctgaatcctcaaatctttaaaaataataataataatgctcccaactgctctcaccttgactattcacccaaacaatttattcttgctgctaccttctatcttctaccattaaaagatgtgtactccttggaagaaaagctatgaccaacctagacagcatattaaaaagcagagacattactttaccaacacaggtccatctagtcaaagctatggtttttccagtagtcatgtatggatgtctgacttggactataaagaactgatacttttgaactgtgatgttggagaagactcttgagaatcctttgcacttcaaggagatcaaaccagtcaatcctaaaggaaatcagtcctaaatattcattggaaggactgaagctgaagctccactactttggccacctgatatgaagagttgactcactggaaaagaccgatgctgggaaagattgaaggcaggaggagaaggggacaacagaggatgagatagttggatggcatcactgactagatggacatgagttggatcaagctctgggagttggtgatggatagggaagcctggtgtgctgcagtccatggggttacaaagagtcagacatgactgagtgactgaactgactgactgatcttctaccacaccacatcagcccaaagtgctactcttttcacagcccaatccacccatcaagatgtcttcctaaacaccgtgaaactgatacaatataggcatgtcatatattctctatttgcctctctaaatcatctctctgacctatggactgtatcactggggttcccttgccatttggcttataatttcactcttccagtgagaggcactaacaaattaaaaggcagggggaagaaggtcagggtatttattcttccacttactctctgccaggctgagggctagcaatgaatatattcctctactgaaggccacgattcctgttaagcgggcagacttttcctatagctgtaaatttcatggagttccagtaacttcttccagaccttgtccctttacgttcatagctagttcaaaatgattattatcttgttggtttcccttaactctgcccacaccttcattaaattctcttcagacaccccatctgagtgtgccatcatttcctgccagaatcctggctgattcagcagggaggaaaagaaactaattaaaaattatattggcatccttagagagattacagagaatgaaatattcataatacaagaattggttgttctgagaaaggaacaatcagagaataagaaagagttcttgaaaattaaaaacattactaatgaataaaccaggggcttccctcgtagctcagatgggtaaagaatctgcctgcaatgaaggagacccaggtttgattcctg

SEQ ID NO: 40646 - DNA, 1283 bp, Bovine  19866881538120
atcagtcagaatttagtgtctcctgatgtatagaacagtcttgtggactctgtgggagagggagagggtgggatgatttgggagaatggcattgaaatatgtataatatcatatatgaaacgagtcgctagtccaggttcgatgcacgatactggatgcttggagctggtgcactgggacgacccagagggacggtatggggagggaggagggaggagggttcaggatggggaacaccatgtatacctgtggcagattcattttgatatatggcaaaaccaatacaatattgtaaagttaaataaaattaaaaaaaaagaatttagtgtctcatcttttgtaaatcagaaagtgtatgtaaaaaaaaatgtacagcctcattttaggtatgcagttatatataattaagctcactctttatgcatggatatgatttctatcagtataactacatgcccagggaaaatcattatcagaagtgcactgaagtgcctagggcagctgaaaaatcagaattctgcccactcagctatttttacaaattatatacctttgtcagtaggctctgcatttgccattaggctggcaaatatccctttccttcatatccctaagataattatgtgctcattcatataaagaaaactaagcttaacagttatctatctcctttaagaacaatggtcactgaggggtggggagttattgtttaatgggtacagaattttagtttaggatgctgcaaaggttctagagatggagtgttgtgatgtttgcccaacatgagtataattaatgccactgatctgtatacttttaaaaaatgattaaaatggtatattttatgttatgtattacttaaccacagtcacaaatagtctttaaataaaggagagcttattcgttgcaaaagaaatttcaatttaggctatcgagaaatatcacctttttctctaaaatcatgaaaaagaagaatgaaatgtactaatcaaagaaggatgtcttttccccaaagaaaacagctccagaaaggttaaaattaatttaaaatataaaggtttttctttttttttttttaataggtatttaaaagagtgtgttttcttattccagcttcaatattgaagtgtctaagaaatgacactcaacaaagatccctaggattgaatttggggagagataggggtttcttattaatgagaaacactatttttcattacttacgtagctgtgaatgaaaataccatagaaactttggaattatggtctgtcaggtctagtgt

SEQ ID NO: 40647 - DNA, 1432 bp, Bovine  19866881545588
ggagatagtgaaggacagggaagcctggtttgttgcagtccataaggtcgcaaagagttggacatgactgagcaactgaacaccagatgtctggcaattccacaaagaaagaatacgtagtctgtgcaaaggacctgtggccagagaagcacggtacccagaggaaatcaaaagaatacatgaatggctgggacacagtaatccaggtggaaagtggtaccaaaaaaaagtaacccaaggtttttcaacgttggcattattgacattttgggcctgataattctttattgtgagagactgtcttgtgcactgtggaatatttggaagcatccctggcctctacccactagatgccagtagcacctcccctaagttataataaccaaaaaagtctccagacatggccaaatgtcctctgagggcaaaaatcacatttggttcaaaaccactggaaagagataggcagggagcagaccatgcaggtccttttatggagttttgttttgtactatgagcaatgggaagcctttagaggctttagatgttaaaggggagaatggataacataatctaagctccatttctaaaagatcctctgctagtagtgaataaaatggaggggagaaaaagcccatgccagaaggaaaatggacagaccatttaacaggctaaaccagtttagaagctgctggactagttctagtgccagatggtgacagcttggactagggtggtgggtggtgtcattgcagttggatggatttgagacataggaagtaaaatcaacaggacttagtgatagattggacatgtagggtgagatagaaagagatatctggaatgattcgtgctagaggaagtagatgggtggtggtgatgtttactaagtggggaagctggaggtggcttaggttcatgggggagagcacatgatttgatcatgttaaatttgaggggcttttgagatgcccaggaacagatgttaaatagataattggatatgtgggtctggaattctaggaggtctggattgggatataaactggggagcaaattgtctaaagatggttatctcagctgtgaaagtgtacaatctccaagtgaaggactattggaagaaaagatggaagtcctaggagcttgagtgtgggccactatttgatgacctgataaagaagaaatggctgaaaaattggtgatagcaaggaaaatgtggagtcccagaaagccaatgcagaaagtgggtcaataagcagggaatgctaaaccatgtccaatcttcctgagagagtacataaagatgactatagaaagtctgctggatggtcattgttggtctttgtaaaattggttcgggtggcttgatggagacaggagctagatgggtgaggagtaggaggtaaggagaaggagacagatatttttaggaggg

SEQ ID NO: 40648 - DNA, 1570 bp, Bovine  19866882173542
tttttcctagtactatttgtcttttatagtatgcttgagcatcagaaggtcttctctctactcaaaatgatcacatagtcatctctgccagtcaaaacactcatccttcaagtttttccaaatgtccccactctgtgctgccctttctggttccccagatgtgagctctctttttttaaaagtcctcctatagcttgttgaacctctattattccttgtatttaaaccacttatgagcctgtccccattttatacaccagatataatttctctagtattcttgcctggagaattccatggacagagaagcctggcaggctacagtccatgggatcacaaagagctggacacgactaagtgacaaacactttcattttcacttcatgaatcagacctcagtattatctgatgagcctaacttaaagtatgtactgaattaagacttgaggggttgaatttttaaaaatcaatataacttactctatccctattttctacttcagtatttgatttctatgggaattagtatttggcagtagaagtgaagattgaatattcttgccatacttatgaatgtatactcttttattaatgtaaagagtgaaaatagagaaatgtgctaaggggtaaaatgtggtaagctgtataggattcatatatcaagaatatagatgctgggaaagactgagggcaggaggagaagcaggagagaagatgaaatggttggatggcatcaccgactctacagacatgagtttgagcaaactctgggagatagtgaaggtcagggaagcctcgagtgctgcagtccatggggtcacaaagagtcagatatgactcagcgactgaacaacaacaatatagaattcataaggcttagagaatgtttaagaccatctggaaagttgacttcctaaagttatatttaattttgcacctaaattatattcacaagtatacacacataagagtgaactatataaagttgtttttggaaatggggggaaatctctgtgaattaattcagagtgatttctaggatatactgttaagtggaaaaaaatgccttagagtattatatacagataaaatcgaaaaccccttcatgataaaatcatcaaaaagctatgaataaaagtgaatgtcctcaacttggtaaaaaaaaaattatctaagaaaaactcatagctaacatcatatgtaatggttaaagattgaaagctttcctcctaagataaggaataagacaataatatccattctcactgtttctattcaaccttgtactacagtgtctagctagggcaattggacaagaaaaggtaacaaaaggcatccagaatgaaaagagaatgttaaatttatctctatttgcagaagacataatcttttacatagaagatcctaaggaatttacaagcttagcaagattgcaaaataaaagatcaattgtatttctataaattaataatgaacactgaaaatgaaactaacaattccatttacaataatttacaaataataaaatgttttggaattaatttaacaagagaagtatagaacctgtaca

SEQ ID NO: 40649 - DNA, 960 bp, Bovine  19866880345223
acagttcgaaagcatcaattctttggtgttcagccttctttatggtccaactctcacatctgtgtatgactactggaaaaatcatagctttgactatatggacctttgtcagcaaagtgatgtctctgccttttaatacacgtaactaaaattaatatctatcctgacaatgttttaaaactattttaagcatacacattcaaaagaaaaaaaaagaagtgtataacagaatccaggtaacttccagccaacttcaaataattctggaattatagccaatattgtttcagctgtacccacttcctacccccagattgtttggaaggaatactcagacatctgatcatatttgaagatgtagttagcggaaagtttctacacagatccaggtgtgagttatctggatgcaagagcagaggttggcagacaattgtaaagaacaaaagaggcagaaggggcttctggtaggatttggaagcttgtagatcagagggcgtctggcaaagctaagcatgactgtggccaaggagatctgctggagattccaaagcatctggaagggacaatgtacaagcacactgctcagccatgacaaaaaagtgctaaagctccaccaacaagtaagagtgagcattcagcaaaatatttgggttaaccaggacaccgagtctcacttctcatcagtgcagtcttcttatccatggatggttccccccaccccgccccccgtggatctccaggttagcaaaggacatcgcaagacgaacgggctgaactgtgaccaagcttcagaagctgaatctggctgaagtcgaggggcataattaactctgtggacacctcgccaggcttgtcatttttgcttgatgccccttgcactggcagaaagaaaagtggcaatcgtcctctctaaaaccctctctgacttagaacaaaatgaactttcgtgcaaggaaaggt

SEQ ID NO: 40650 - DNA, 1572 bp, Bovine  19866880506657
aaatggaaagcaaaaaggtttacaccagtcttgccatggacgcttccatagttagtatttacattctaaatgaggatcacagctgacaggttttgttgtaattttagccataaggcaattcactgtaccaagcactgaatatatatatatatatacacacacatatatgtatattcacgtatatataaatataaaatatatatttaatatataataaatataagtataatacacatgtaaaaaagaattacatcaaaatttatctgggaaattaaaacttgatgttcaagttgatttaagttccaaaaatctagccacttgtcaaaatttcacaagatacatgctggacactgaaagtgtttagcatagcatcttttttagaaacttgagttcagtttacttctttttaaactaaacattcctaaattcttatcaagcaaaaataatcaaacagtaatgacaaatatttttcatgcgcccaggccacccaggagaagcaacataattgagattttcagacttaagaactcttacatacacagcagaaagtgttgtcctaaaggtccacccatgaagggaaaactagcatttttttctcttggttcttgaaagcatgctaaattagaatgagatattttatgtgataaacaagcagtttagcacattaagtacatttcacattcactggttactctatgtgaataaagtcattacaggtcatcctcaggatgactgagcctgagaaggactggaggctttaactataaagtttcttcctccactggctttatgcgggataatgacttttctcaggttgccttggcaattatctaacagtttggctcattgactcaaagctggtcaaaaagccaatttaataaaccacagaaatgtctttggctaagtgatggccccagatgaagggaccggaaactactcaagtggatctgacgacagccactgtgccacggtccactgtgctttgttcccagtccaactcagatgccccccggacagaaaacttcaggccactcagaacaaagccctgacttcagaaaagggtgatatttacaaaaagtaaggcttaaagcattcaagtgtcattggtttctgtagccttaaaaatatacaaatcactaacaaaagagaaagacttagagaatgaactcatggttgccatggagagaagggatagttagggagttctggatcgacatgtacacactgctatatttaaaatgcataaccaacaatgacctgctgtacagcacatggagctctgctctgtgttacgtggtagcctggatgggaggggagtttggagagaatggatacatgtatatggatggctgagtccctttgttgcccatctggaactatcacaacattgttaatcagatataccccaatacaaaacaaaaagtttaaaaaatataaaataaaaataatcttttaaaaaataaaaatatacaaactaagagagccacttttcctgcatataattatatataatggtctagaatttaaatatctatgtatacatatgctacttatattttcccaagagggggt

SEQ ID NO: 40651 - DNA, 757 bp, Bovine  19866880567026
aatagttttaaaactatttaggaaccaaaacctttcttctaaaccacggaaagtgactctacactaataatgtctgacagtgacctaattatagtaatttgcatactaatgagactttgaaggagataagcaatagcatgcttgtaatagataattaatttgtatttcaaaataagctatggctatttaacaacaactcaaatgacacatcaaattaaaagagttgttcaagttacttcttaacaataaatgcctgttacagcttttcaattttgcttaaacttcaagcggatgaacagatcccaagaatcaatttgtattcataaggtgactcttcattaagtgcttaattctcaaattcatcttcaaaataatatctctttgccaagaaattcagagtgatttatgtagcattaattagaatgttttctacctccatagtaaagtgcctctgaatagtacaatgcacttttcaagtaatcttacatcatctcccagggtcctaagtcccatgttttagttgtagaaatggtcacactgagagttatagcgattggggcaaattaaaatgagtcaggctgctggggcagccttctgcacttcgtattttgtctcctaacacgaaatgagatgtccaggaccttgaataaactgaccaggacaactaataaaacttgttctatacatccagtatactgtctcttattgatctttgaaagcataaaacatgtagactcactcaccagtaactgcattt

SEQ ID NO: 40652 - DNA, 605 bp, Bovine  19866880576227
gaaatctctgacattctgcacaattacatgaacactccatgggttttgttgtttttaaacgaagcttcttgtgcttgtccacgagaccataaaatgtggaacagagctggaggcctctgctatttttatctgaagtgcacagaaagtatgacttttttttttaaaaggaaatgtcattttggtgatgtgttgctagctcctatctcacacacaaggtgacttttcaagcagtattttaaagtgcccaaagtcagaaactcagaattttcagcatcctgaaagaagcttaatgattaagacaatatttctccagtaaaaacttaaataagtaaaaacttatggttttatagttgtaataaatgctcatcagagttggcagactagctatctgaaagtgtgtatcagtggaacagggtgtataaattctgaacaaggcattgaatgagttaggattctgaaatctaaacacaagtgcataggaaacttggatgtcttttgggggaaaagatggatcgttacagaatggtaccggttcacctaagtctctgtctgaaagtcaaacttagattacttttatgtttggaaatatgtgagatattttagca

SEQ ID NO: 40653 - DNA, 756 bp, Bovine  19866880588795
ctgagattctgagggacattctctactctctacagatgtacctggatcataaccaaataaggggttcagaaaacgtctgaactcagtttatctttgaaaagaaggcatctttctcaacctcactagggagagccctgcggtgttctggcatgatgtaagggcctgacttctcagggctccgtgtcttggcacataaggcagacagataccaacttagcaatttacgagggcagtgttacaaaggtttgaaaaatgaaatgtagtgtgacagcaaaagcattaacacatgagtttcatagcctctcccctttcattccccattaaagataattctatttttgccagtcttgtgcagggttttatgtgcagattggccacagtggggtgtaggggggcaggttggaaggggagaaaattaaagaaaggcaaacacaaattgattgtgttggaaaaggtagagaattactcctagagaataaaacacgtagaaagtggaactggagataaacataggagcaatactactgtgttttagagaggtgagtgacttgggggtttgaaagagatagcacagctttgccaaagggagtggaaaataaaaggatggaggagggaaatggggtctttcgaaaaaatgttttaacattgcatgtgtctatgatcttctcagaaacaacactaaatatttaaagtgtttaaaaaagctctttagatataggattggggattttattgtaatgcaatgttttataaata

SEQ ID NO: 40654 - DNA, 1056 bp, Bovine  19866880592566
ttctaaatgtaattatttctttatgcatgctcagtcgtgtgggactctttgcaaccccatgcactgtggccctctaggctcctctgtccatgggattctccaggcaagaatgctggagtgggttgccatttccttctccaggggatctttccgacctgctgcgtctacagcgactcctgcatgggcaggcagattttttaccaccaagccacctgagaagcctcagaaatatttcttacttggttttgagcacattattattattactattattgttatcatattttgccttctgaccgtattttgaggctcatggtttaagctgatatttttcctcctgctccagctctatatttgaaatggaaattgtgcacaacgagaaatgctttcatcgtgccttttattcacagtaattcgaaaacttgctcagagatgaatgagttggttctccctgcagcagtacacgtgggccctctgtgggccgggtggagtggggacacagcctctgaagcccctacacctgctggagcctggatctttggtaggtgggctggggagatggttcttaactgactggcttcccagcggaaacaaagacaataatttgctctattagatcatggcttgtcttggaaataatccagcttgggaaacgctttaatttttgccagcattgtgaagagttcatcagtgaaaggggatactgtgtgcatgggcgattcaggaattaaaagaacaatggcaaataacagactagctcggaactgcaaagcatgtgaaatattccgagaggaaatgtctcagaagtataaccgtacctctcacagcaaaaaacatcactaaatgatcgtatcaaccaagaattaggaagctacccagaggtatcagcattgttttaagaagagattgaatcacatatttatctagaaaaggaaaacttcatgcctcatttttgctatccgtttgttcatattgatttttttatcataatttagaaacagagtcaaaccctcctaaacacaaaagcagaataaacctcgctttcttattacacca

SEQ ID NO: 40655 - DNA, 2625 bp, Bovine  19866880599922
agctcacaagccttttgggcaacacagtagttctggttttagttttttaaggatccttcatactgttctctgtagtggtggattttaataacatcttgctttgattttttccatcaagattcctcttggtttatagaacttgacttaaaaaaaaaatgtatgatttgaacatttcacaaaaccccagtaaaatcagtggatgttacagccagttttggatagaatgacattcttatctgatggggggggcggaaatgggctgttgataaaatatccatttggattttttcctgtaatatcaacaaatattaaaggcacttaaagctattttaataggtatttaataaaactgatataattgacctatgtatttaatataaaataattaaataatatacttaatatttaatataacattgtgtgagagtatgtgtgtgaaagttgatcagttgtgtccgactctttgagaccccatggactgtatagttcatggaattctccaggccagattactggagtgggtagctcttcccttctgcagggaaccttcccaattcagggattgaacccaagtctcccacattgcaggcagattctctaccagctgagccaccaaggatattaaacccacaaaacaacaagctgataagttgtcagtttttatgagcaatctgatttttgtttaaaattacataattacaaaacatttctggctgtagatttgggaggatgggactccatgacactgttgtcttcccttcgtatatgtttgaaacttttcgtgaagaaaagacaaacaatatgtgactatacatatctctttccaaagaagacaaaaatatgggaagaaacaaaaataacattgtcttatttatacttttactaaaacttgtatctgcatatgaacatcttgagaattttcaaaggtccattaacagtcaatggtctttccttttgagatcaaccagggaagcatagattagattacaacaaatctgtgatattttttcagcattttgacaatagagtctgtcaaaatgctattagtttgaaaatatgacctggattcttagtctatgacttgcgtcctcttcaaaggtcctgactcatttctagcctgtggtttacctgccagtgacattttcgcacttaaaatacaactacttgagcttttagcaatacatgccttccactcatttttctagaagaaaaatgtcaacatcaagagattagacatacaatgtgctgaaatctatggcatattttgcatggctgcttaaaagataacccaagcacaatgcatgcagtcacttgacttgtaactccgctggatgagagaaaatgtgtttttatccacaaagcattcaggagtgtttgtgtaagatatgcacagtccaagtaacatctctgaccaagaatttgacttcccataatggcatcccgcttgaggcatatatcaagaaaaatatgcttcctggatcaatttagatatggtaaaacaggttgcacacacattactatgaggagggaactcagccttcataaaccatgtagcctagtggaatgattgttgtgccacagtgcacagttggtgaaaaaatactcagtgaggagccattatttgtatggcatgatcccggatgctgccttgggtaccaacataaattaaagaacatgcattgccctccagcaccttttattctgtttgggagatgtcatacataaactaaattaatagctttcataaaacaaaatagactaagtagaaatatagtaactgtgtacatgaaaatcatgtttctcctacaatatggctttgctccatgtgcagcaaacaactggttttagagtggaggataattcatggaaaatgcatttttgattaattttgtttttataaaggaaggttttagcttccttcagatggacatgggcatgtaagatagtgggatcaggtcatagaaaaagtaggcaaaaaattatgagatataatctcaatatggaagagaaaataaagtaattggatttcattattagtactgagatgtgtcataagaagatgaggccttaggtgacacatattatagtttattatttcttcctctgctatttttcttgatgagttatcttcccaactagtacaaatacaaaagtacccaccagatattgaaaccagatgaaacctttgaacacaaactgtgcattttgccccttctgtacttattatgagctgaattgcctcctttccaaaatttttatgtgaaagtactaacccttaaaacctcagagtgtgattgcattcaaatgtaaaatctttaaagaagtcccttgaactgcaaggagatcaaatcagtcaatcctaaaggaaatcgatcctgaatattcattggaaggactgatgctgaaactggaattccaatatttttgccacctgatatgaagaaccaattcactggaaaagaccctgatgctgtggaagattgaaggcaaaaggagaagagggtgacagaagatgagatggttagagagcatcaccaactcaatggacatgaatttgagcaaactccaagagatagtgaaggacaggggagcctggtggctacagtccatgggatcacaaagagt

SEQ ID NO: 40656 - DNA, 1403 bp, Bovine  19866880614017
tgaactgtggtgttggagaacgctgttgagagtcccttgggactgcaaggagatccaaccagtcaatactcaagtaaatcagtcctgaatattcgttggaaggactgaggctgaagctgaagctctaatactttggctacatgatgcgaagagatgattcattagaaaagaccctgatgctaggaaacattgaaggcaggaggagaaggggacaacagaggatgagatggctgaatggcatcactgactcaatggacatgagtttgagtaagctccaggagatggtgatggacagggaggcctggcgcgctgcagtccatggggttgcagggtcagacacgactgaaggactgaacaacagcaacaaagcaagtgaagcaaaggatcacacatcatacaggcagaacgaacagtcctgtaacacacacagaccaaaagagaaattacagttgagaagaacaaccatctcctaacaacactttcagagattatccttctatgtattcttttttagcagtttccaaagatataaaatagtatttattttatattacataaaaagtatatgttgtaataaacataaataagacactgtacagaagaggacatttaaacccaacctgttaacacctcttttggtgttatcaagttgttggtctataatggagattccctatatctttttcactaaaaaaaaaaaaaaaatggcttgaaaatttttctagccggttcttcatgtcctgcaatgtaatatttataggtttcttgacagcagctctttcttctgctctgctttctctgaaatcccacctcttgaataagagtatggaaactggcagtgcctccaagaacgcagtgttgagatttcttaggctttattgttggtttccaatgctgatttttaattcaggtgtttgtatttcactgtccccataagactataagttgaaagtcacagtcctgctagcaataattagggttcaggagtacccagtttgggttccaacaagtagtagaggtgataaatagtaaatgactctaattaatgtgggatgtttcgtggagtgcattagaagacaaacaagacaaaatattattagagaagtgcccaaagctaaatgccatcaatgcagcaagcaatataaatcagaaaactctatttgcaaatatggtgacttgaatactgaataataaagataagagagcaacagagagaataacaagttagtctggataagacaccattttataaagggtactgcttatctgctttaattttctctccccccaaatcaaaacaagtcgggcaggaatagtttggtgtacgaatctacccataaaattattttgaaatgtgtttctaaaaataacatgggtatcatgtgagcaggactgaatataca

SEQ ID NO: 40657 - DNA, 1667 bp, Bovine  19866880622606
aacctccataaaacagctttactagttcttaagagaattggtttctttgtctagatatttcatacactaattgttcaatacgtcacccctttaattagcttattcatttctttaactgcagaggtcaaggaaggcagtctttaggacagtgtattttaaattaactcaatggtgttccatgattttggagaatttttctgtattcatctctggacagaagagtctaacaagtgagtcttcaactggagtaacaattcttgggatttttaacactgagtcagcaactattgtttttctcatgtctcaagcctgtacttcaatttgtggaccagaagcatataacttagactgtggagaacatttatagagaaggagttgaaatagtagcagggtactcccttacctgtgagtaaagccttttccttgcacactctacagtggagtttccgctattgtgaaaattctgagtctctaacttggaagattcatatatcatcgagacgatattgacaaatattgtaatacccactctcactgttctactataaaacatcccattcctctaaagccctattaaatattaaaaagaatggcaaccacatggtaaaatgaggttactagaatgtaaaatagaatttaaatattttagaaagacatattgctaacctttagcaaagtgctgcctcttaaaaaagaagacaaggtctctatcctgaaaaataattctttcaaattagcatctccatggctaaagtcaaaatgagtgagatgagggttaaatgtccaattagacagcacacagttttcacgattatcagaaagttgcactggcaaaagattttggtcttggctgtgttccatacgtctgaaatgaggcgactgtcttctacaaatcccagactcagtgggttttggtaaaaagttactgggttattatttatttctctcctgtaacatagggaaatggaaagatttcatcagtgatgtaggggaggaaaaatgattttccctctacccttctaggttcttggctgagaatcctctgtaattaaaaaaaaaaaaaaaaaagcagaacaggagaaaaacagaagtttaatagcataaataccttctgtacacatgagaaatatccaggaaagcttaagtaactctcttaaatgatacaaaccaccactttaaagaccatcttcagctaaagacacaagaaggtactggggtagggaagccggttatgggagattatcaggcaaagcacagtgaacaaggacatgggcactcagttcagttcagttgctcagttgtgtctgactgtttgtgaccccatgatgcttttgaactgtggtgttggagaagactcttgagagtcccttggactgcaaggagatccaaccagtcaatcctaaatgagatcagtcctgggtcttcattagaaagacggatgttgaagctgaaacttcagtactttggccacctgatgagaagaactgactcatttccttgatgctgggaaagactgagggcaggaggagaaaagggtgacagaggatgagatggttggacggcatcaccaactcaatggacatgggtttgggtgaactccaggagttggtgatggacagggaggcctggtgtgctgcagtccatgggcattaggcagatctaaggtt

SEQ ID NO: 40658 - DNA, 1772 bp, Bovine  19866880731843
tgaattgaacaccaactttaaataagggcaggactatgtgcctgtccaaaggatcagaaaatagaagtgccaagttcagccttgtcgtagaaaaattaagcaagtgaaatatcaatcaactatggggaattcagggcttcccaggtagctctgatggcaaaatatctccctgcaatgcaggagacctgggttcgacccctgattcctatccctgggtcaggaaaattccctggagaaggaaatggcaacccactccactattcttgcctggagagttccctggacagaggagactggcaggctacattcaatgggatcacaaaaaattggacacgacagagcgactaactgcatacacacacacacaggaaattcaagactcgtatacgaccaaaattcactgtgaatgacatcacggggattcctcatgtctccatctgggggataatctgcttgatgtaaggagtgatgaatcaagactttcacgaaatccatcttatagcatctccaggacaggaggcactaaaacccatcattttgccaacacagattaaaaccttaacatggatattaactcctgagatcattattcaggaaaaataattattcatgttgacataatggatatttgaaaggaagaagtatgattagatcatcaagtttattttccacaggccagagcaagagaagcttttcaacagtcacctggcctcatgttttctaaggaagttcctggcttctcctaattgggatgactgaatatgttccaaatagattgtttgttatcttcttcacaaatgatcacagagaatatgatgattcaaagtgacttccaaatgcaaataactcaattagggaagacacgattccaagaaaaataatatggttgcaattcataagttagtcaccaaaaatactcatttttcctgtaccggtgttttgaaagtgctaaaaagtaacttcatccttttcattgacatagccaccgatgagcattgtgttaaagatattacttcttaaactgaatattttacttttttttcccctttactgcaattgctagcttttctattgccaggaaatttcccaatttgaggctgagcatagcattagagtggagctgttgtctgcataacaatatttttgaaaattaattagtcattgagatgatgatcctttttttctctccttaggagtctcacttgctgagaaatagtgtgaactgttgtttttttttccccccaaatggagtggtggcttttacagaacaatgcgaaggctggttcagtgtgggtgtcttttgttttaaagtggtgtcttctattgtgaaattaaattaagcaagccatgttcaatattcatgctatttccctttccttaataggttcagatttaccacagtgtgaaaaaatatctggtttacattggtcagtggatctcttatttacaaaaatgtaagtttattaatctgttcctcaggttctaatgtcaggagactaaaaagtaggtatgagttatgatttttttttccctcctcagtgagtaggtagctgcaaggagtgacttagccagctttttaaatcagtctttctccactaagctgccaagaagactcctcctaccccagaatattctgaagtcattgatctggaaggatgcttggtgtggcattttgttaagctccctagatcagacccaccacccacatttcagccaagcaagcccacccttcatgtgtccacgtgttctaaggtctgcattaagtgttccca

SEQ ID NO: 40659 - DNA, 1318 bp, Bovine  19866880737757
tagaattagcagaagctttgaatgtttcttttatatgttaacatatttcagctttcaagggactaaagcaggagcataaatctagtgtttaactggtagagttaatgtgatcaaattgtaaagccaattgacttaattatcaaatgtttgtttgctgggtaatcagagtaaggagaggtttattttgaaactccatcagaacctagacaacaatgttgccattccatgtattagaaagagttcacacgtgtggaggagaaaaaaacagaacaacccgcagtgccttcggagacttcaaatgggaccgacacggggaaccaggatgaaactgtgctggtcagagggcagagttggtgggtggaggaaagggctagggatcaattaggagatcacaaggcattacatctaggcttggagtttttcatctttactgaagaacatatttagttattacttctgaccttggggttatagtgtgccaattatttccattcgttcattttgtaaaattcgctatgattgactatataataggaaaatgttagattttcaactatgtagaggaatagatgttctttacttctttaagacgttctgaaagattataaaaggttaaatgtgattacacttgagtttaaataaatgcagattctgtatttagaagaaatgtagtgtgacataacaccctgatgcaagacgaaaggtggaacctattaatgtcaattattaggactatctacaaggtaccacactgtcttatgccgttttcacttacacgtttaacagtaggagatgcgtattcaataaagaatggggattccttttggtcactagtaactgattaatgtacttcatccactgaagtcatctggagtttttcagatgtctgttgtgattctagaattccttatattaaaacaaacaaagttcatagagcaaatagtttaacagcaagtcaaatgttcctgaagtataaaggtgctaggcaatgtatgccttagaaaaccctctgattacaactgatataagttttaaaaataaccagactttaatagactaattgtgaaagattagtctatttatctgagcttgttaaacactgcagtagactggaaccaattaaataaataactctaattctatattattaacttcaaaagtccctagttcccatcattgcagtgctatgataggtaattttttttcaaagcacaattcttttcccccacaaaaggaagtgtaattggcacatttttgagtgagtctacatatatcagactaaatacggtcaattgaatttgccatattagccccaagg

SEQ ID NO: 40660 - DNA, 1066 bp, Bovine  19866880803046
tttaaaaatgtaataggagggagattcctataatttaaaattgtattgaaaacataggcacatttttcctcttggcataaaaattcaaacatagttttagctgcctgcctgttgaatacttggcctttccaaggcaatccattatgtgtaatgtgtaagcaatggcaaatggtaactatcattaccaggtggttatttgcaatgcaaattctaaaccctaactcatagatggttggctctagcagttgccaaacagctgggttttgaacccttaacccatagaatagccaacactataattccacaagaatttctccaaaaatattaatttttctcagtgtcattcatcatgattatccacggcacctagtaatccagtgtggtgttagagacaccatacaattgaattagataggcagggtcctttttccttgggaaataattttcaaataaaatataacacatgaaaaattgaggatattcattaaatatatctgctatttataaatttaaatttgtctttatttgtcatacaaatgctccacagttacttttgttttggcattttccctataatattactaaaattacctgcaaatattattgacaacttaatgaccagcattagctcttaaccttcttgattcgtctgcaggtactatgattgaccatcccttctttctttccttcttcttttgtttgagaatttttttttcctgcacttttcaaggataatctctcaggacacagaagttgctgtttatttctcccaacatttaaaaaaaaaaaaaaaaagactttccagtcttattgaagtgtaattaacaaaattgtaaaatattgactatttaaaatgtacaatgtaatgatttggtaggcattatgaaaagatttttttccccattgagttaattaacccatccatcccctcacgtacagttgatccttgaacaacagagttttgaactgtgtgggtcaacttatatgtagatatttttcactaaatatgtgcttcagtactacatgatctgtggttggttgtcccacatccatgatttcaattctt

SEQ ID NO: 40661 - DNA, 3317 bp, Bovine  19866880843220
agaataaatgattctatatggtttccaagatgattttctttaaatatgtttaataacttaatttaaaatatgttcctgacctcaccaccacagaatcccataagaattcaaaagttcaaaaatagtacagaaagaaaaatgaaaacagagcactagtcacagactctgcatcattgctcagaatatgcgtctgatacaaatgtgaggcttgttcagctattaggacattcactgttgcctaaacagtgtgaacactaacatttttatctcagaactaattgagaactcagaggctaaattccagaactgaactttctctactctgtcttggttaagctagaaaacagtaaatatactactgatatcttaaaatgaggatttaaaagaaaatgatttccatgagaaatatttgttaattatttgaatgatgtggtttgatattaaatattaagacaaatgtcctttacagatgactaatatgatagtaactaaaatgttcctagaattgagttaaaaagaaaatttggatatttgttgcctagatttacttttcaaaatctggtctccctaaccttctctctctctctctctcatccatctcacaaatgtgaatttcagagctgcttttccataagttctgatgacaaatacattttagttgaaattcttccttcccagggaaattttgcaaatcagaaattaaaagctgaaagtttctggacattatagttaaaagcaagggctttttctgatacttctttcatctctttttatccacctgaattagattccagatccaactgtgataatgttgaaccatgttcatccatgtgtcagaagctaacattgcttcattgaaaatttctttcaaggctcctatgccctttgctatagagtattttatttttgaaaaaaattaaaattaaaaaaaaaggagagagagagagataatttgactattaaattcttcctttgaccaaggccagtgaaattcatctgcaacatgaattagagatgcaggagacacgagtttgatccctgggtggggaagattccctggaggagggcatggcaacccaccccagtattcttgcctgcagaatcacattgacgtaagcacctggctggctactgtctatagggttgcagactgaagtgactgagcatggtgaaatcctagagcccttgaggaaactgtccaggccctggtgtcatgtcctgcgcccagaagcttctgtccatgtgagtttccacagcttcctggaagcaggcagtgatgcaaccagagatgcttgtatcagcctgtatctggctcacaacatttttattctcccaagtactgagtacctgtacatgtccaaaaacccttgaagaaaggagtaagtgagttttaatatgttgaccaaaaatgcaatgtttttaaacaaggtactttattatggagcttccctggtggctcagaggtaaagaattggtctgtaatgcaggagaccagggtttgatccctgggtcaggaagatcctcaggagaagggaatagtaacccactctagtattcctgcctggagaattccatgaactgagaagcttggcaggttaccgtccatggggtagcaaagagttggacatgactgagcaactaacatttgcacttttctttctttttgtcatgcattgacaaactggagcaaaggggtaaaaaataaaagaaaaaaaaaaaggaaatctgtttgttatcaaatggaaggtctttgtccttttctggaaaataaagatgagcagaaaaaaatgggattacaagaaaacaggaaataacagcctttatgtactgggggaagtattatttagaaaatgtcatctcttaaaggaacaagttcacattttgagatgagaattaatgagtagtttagatagacttcttaagactaacccatgactcctttgggtaatgtcctaatgtttcttttgagaaaaagcccaaagatactaattcatggtcatcatgctgaccctttcatcctaaatcatgtatgtcaaatgtcagctgattaactctttgctcattttctagagaggacactccagaggtggcagggggcggcggggtggggtggggtgggggggtgggcatagaaagggcttatagacagtaatcggtgtcccagactctgggaaacagatcaactttcaaccaagtctgttaacttactttaaaatatttcttcattcttttactattacaactatggtttttaggcagttgactttgcattattggaccaggcactgggaaataaaccactagggaaatgtcatgtaagtttaataatttacactgtaaaacttgcccaggttaatttactaactttttagattcccctctgagaccatgagtccctgtttagagtacagcgctaaattagttagtgagtattttaatttgtgttctatatttagtttctaaatcaactttcttgtaaatagaatgactttcttcgcttctgttgctgttatttaatttaaaactgcttagcaaaatttctaataagttttgctttaattctgtagttgtcattttttgacactgcttttcaaggcaaatagagtctagtgcctgattccaactttataacaatattcctttcagtctgtacactgtgaactctcagttttagactctttgtgattaggagatgctggccttcatgtggggggatctgcaatgacccaaaggttcctctcgttagaacggactctgtgccaacgagtttgtgatttgtaaaatcgattcagtctcaatattggtactaagtgacagtgagatcctaacagtttggtgtgttctatcgtgttccatcatgactctgtgtgactccatgaactgtaccccactaggctcctccatctatgggattgtccaggaaagaatactggagcaggtggccatttcttagtccagaggatcttcccaaaccagagctgaaatctgcatcttctgcattggtaaggaagactttttaccactgtgccatctgggaagccctcctaaaaaacataaaaatcagcacttttaaaaacttattaacagacttctcttctcttgaaaagtcagcaaagtaattaatgtttcaactggaaggcaaaattatttcaactacatatttataaatataaattatattaatgaatattcattaaatatggtacattatattcattatcactttatattaatttcacacaagacatttataatgttatctgatctgaatcatgcagaagaaagattacattgtaataacttttcatatgtactaa

SEQ ID NO: 40662 - DNA, 757 bp, Bovine  19866880924426
gcaaatatttatgctttgtgagagaatatcattgggtttctctcaaagtttaggttaaaattagtactatgccctttttccctcactggttaaacattttggttggaatatgaaaagatttaataagtcctttgacattctggtgaccaccttaaagcaccaagacaataaaataataatagagaaatgaaaacaaagaagacagcaaaacagctcgtctaaaattttgcttggctataaaatttataatcctataagaacatatctctattggaaatcataggaacttgggagtaacatttccacagaatgtgcttaatgtaaggcttctttatctacatacttgcatgctcaagcacacacacacacacacacacacacagagttttctttataatggttaacagcatttttcaaactggaacttgtacaaaactggacttgtggattgcacctgcattcacattctactctggttatgtaaataggaataaaatcttttctttttaaaaaaaaaaaaatcaaagcataactgtaatatttttcgtgtttatttttgtcctatttttgaaaaccatcaaatctattttttaattcaatatcagtgtaatttattttagagcactgattcttaggatattcatatattttttaaaattcttaatggtagagtgtatagcactgtgagatacataatttgatgatttttttttgatggcaaagataattaatttcacttcaataagaacattttgtt

SEQ ID NO: 40663 - DNA, 746 bp, Bovine  19866880957622
tgtgatgctaaatattgaccatttaaaacctaataagatgctgagtggaagagattaataaatcagatgtattaacattgcaaatgtctgtgaatgttgcaggttgccatcagagcacggcttttatttgactccatggtaccattatgctagctgctgctctaaactcagctcatcgaatgcctgacgaaatgccatgtacggcaagtccattataagcacatccactcttgcatctgcagcctgcaagtttagacagttgttctttcaaagaactcttaatgggctttagcgtttgataagctgtgaactagtttacccaggacaaggctcttctagtcaaacaagcgtctttcctcttctaatgtaaagatcacagcaaattcaaacaaagcactggcacttatatcaaactctctataaattatatacaatatatatttattatatatttatagatatccaatataagaatccatgtactcaaataaaatataaaatcacaatgccaattctatttatttaaaagtacagaagcctctaataatagctgtagtagcagcagaacttgtagtagtagtataaatagctagtagtagttgtaacagatttccttatggaatacttaggttaagggaaaggctggcatcgtcaagacattaaacctcacagcaactcttcggggtaggtactatttcccttcttacaactaaggagattaaactccaaataaatcaattactttt

SEQ ID NO: 40664 - DNA, 893 bp, Bovine  19866881038371
tgcctcagaggcacagcttgacagtttcttaaggcctaataatgtcagagttatagtttttcagaatccatctgatttgctcccaaaaatgggacatgttttgaatgcaactgacaattggaggttctggaatattaagttggaaatttctgctaatttatgtcaccaagagttctgatttgagactagcctttgaccataggaactgcgtaattaacttcttatcaattacttaattgaatttatagattgaacttgtttttcttaccaaaatctgagatttactacttataattaatcataatccccttaaaatgtagtacaatgtatagaaacattataatttaataagtatgttatatctttgacttttattttcagagttaacaagatatgtttttaacaaaagattgagtttagataagttacatcaattcagttcggttggcatttcataagcaataagttcagacagtttaaagttactttttattttttaaagaaatattattggcaacttatttatgtagtacttccttcacatagttctttcacataaagacttcattggtggatttacagtaaaaatattgaccagaagtagacttgtgttcaagactaacctctcctactttgacataaggcatagtatttctggtgcattgtctccacgaatctaaatataatgacggaaccaacattatttggatttttaagagattcaaaggaaatattacatgcaaaatatgcaacaaaaattatactgactcccttttggtaaaaaaaaaaaaagaaagtccatttggattcagttcagttcagtcactcagtcttgtccgactctttgcgatcctaggaacctcagcactccaggactccctgtccatcaccaa

SEQ ID NO: 40665 - DNA, 2106 bp, Bovine  19866881155714
cccatgagtcagttagttcttcacatcaagtggccaaaggattggggcttcagctttagcatagtctttccaatgaatattcagggttggtttcttctgggattgattaggttgatctccttgctgtctgtccaagggactctcgagaggctactccagcaccacaatttgaaagcatcaatcctttagcactcagccttctttatagtacaaatctcacatccttacatgactagtggaaaaatcataattttgactatatgcacatttgtcggcaaagtgatgcctctgctttttaatatactgtctaggtttgtcacagctttaattccaaggaacaagcatcttttaatttcatggctgcagtcaacatttgcagtggttttggagcccaagaaaataaaagctgccactgtttccacttttcctccatctatttgcaatgaagtgatggaattagatgccaggatcttagttttatcaatgttgagttttcagcaggctttttcaccctcctctttcaccctcatcaagagaccccttaattgatatttgctttcttttttttttttcacatcacctaggccagaccacagctttgtgagttctccagacaattatagcctcagggcctttgtctgcacttttttctttgcctggaacccacttcccatggatacatacatagaaccaccttcattcccttcatgtttccgaacacattctgcctcatagcatgagttaatagccaatattcagtattaatttccatcttccctcatggttaattgtctcttcctaatgatagcaatttctttctgtacttaatattttattcctaatctggatggttcttgacaaatgttatccactcctataaatatttaatgaataaatgaacaaataaagaaatgaaagcaataagtctcagaggttttcaaatgggaaatccttgcagtagttggatttctctaaattgtagacaaccattttcttcaattgcaataaaaaaggaaatggagaggtgagttactgatgcataactgatgagttactgatgagttactgttttagtttttaaaatgacttttaaagaaggcaatggtaaacatatagaatgacactttctcattacctttaagcctaccatcttctttgaataatttctacatcacagtatttctaggtatgtttttaaaatatcccataaattataattgtgaaaataattcctgtccatgaaacgtttagataaatcctcttcatttaatgagctgactgcatctgtgtattacagttgaacctcatatttgcttgactagagagctcagatattgattttgccctgtttaatagttaaatctctagttacttcagagactacttacttaccttcatgatatccacccttggagaaaagagatcaataaggcactcctgtctgtgatcctcagagttgaatttctgccattttccccaaaggacacacatatctggaactcatttcctcttcgttacaacaaagctaaggtccttggccttcggggaactactcaatattaatttgtttagttaagcttttacctaactgatgaggtggaaagagtaattgaattggtagcaaattctaatacatattcatattgctgtacttctgaacatagtcatacatttccaccacagcttcattttattatttagattttacaatgatgactactcagtatttccttaaaatctaccgtgaatgtatttctcatttctgaaattctatttttcaaacatcctgggcagattttacaaggcacagctaggttattaaggtttctgctgtgttatgcatttaaatccatcatggggtattttatacatttacattagtaaagaaagaatctgatgggacataattttgctataaaataatagccatgctgtcctgaaaacctagtgttactatggttcttcactatatttaaaaatacaacaggaaccaaagtgatatttagttcagtagaagactactaaacatggggccttccatggtcaaacatgatttcattcgaaaaattatttattagacgtataggaaagccagttgcattatga

SEQ ID NO: 40666 - DNA, 1206 bp, Bovine  19866881164809
tacttatattttctatagtgattgatctattaccctagaactttgaacttggaattgcatgatcagcctgctcagtaccacagggtctcaaaatcatgtcctatggacaagtcattgatccaactaaaatgaaaaactgcagtgtagccaaggtctaatcactcccaaacgtgtcaggattttcagaatgtttttcatgaggaaataaaaagctgcagaggatatcaaagagctttttgagcagtgtgccacacacctaataactcagctgcttgctcttcagttgagatgagaaaatgctaatgtttacgtaaaccaagtccacgcagaatgataagcagtagtccacaaaatggctagaaagtgaaaacttaaggcagataactggaggagtctttctattttttagctacttatgactatcaaaagcattctggtacatatgaacttgctatgggaatttaaaaatcaactttcataggaattttgtacacaattgtaattttttatttagttgattcaacacttcattctgacccactctttgacttgcaaaagtcagaatcttaatgtgaggagttacaccacttagtaaataatgctgctttgatttatttaaaattaacccatatttctctatatctcaaagtcaaggtctagacagtggaggtggaaaacgacattagaaaatgatttaaaagtacatgtgtagaatcctatcttccttgtgactcttcttctcagaatatgaagaaattggcatcatttttttttttccatcatgtagtttgtccttaactgtttgttgttctgtttcacagacttcctcctaaacttctggaaaggaagtaaattatgtatgagtataaagaaagaacatttgtagtcaaaacgaaattaattgcattttcagattatgactgtttaatttgggggaggaagcaaaacaatagccaaaatcttctaaaatcagcattaactaatcttcatagatttttccatatatgttttaggtcttatttttatttcttatggttctagttcatagcaattatagatttaaaatatattttacccttgtgactatatttgtaagtttcttaagatttgaaaatataggaaaaccaataggtaaagttattagtacctaagtttgaaccatatagtgtaaaaatttcaatactataataatatgaggggcaaaat

SEQ ID NO: 40667 - DNA, 2162 bp, Bovine  19866881273693
ctgcagtggcagtaccaagtcctaaccagtggccccactagagaattcccaaataacttcttttcttaatggaaaagtaaagggatgaatgtattcaacctgaagaacttaaggaaacccatttattgtgcaaagctcacagttcaaaggtagaagttttcagggattagctgtgaggtattttctcttgtattgcacttctgcttgcagagtttaggtgttttaaaaacagttgcagtcttacaaacttcctagacaagtcatagcagaagaaagtatcaagaaactaactcaagcccattttagaaaaagaaaatttaattacacaaataaaattgtagtaagagcgaaactgtaagtagttaaagtgacttgagcagtaaaacatctaagccaagtggtggcccagccctgagctactagaaaagttcccacatgttgtgcttagtgaaaaattaggtaggctatgtgtggtcagaaggaaaattccttctggtctagtattacacattttaggtgaattatgggcctcatttttcttaagcgtttaccatcagccacctagagttaatggtaagtgttagatcattaatctaggttacatgagcatttaaattaattggattacactgagatttacatgattagaacttggaagtcaggttctagattcctggttaaaagactcttaaccctctaaagtaggtcagccctaacattttaggttttggttttaaatgattgttgacattaattttatttataaagaatacaaggccttgtcctgggagccacttattcagcaactaaaataaatgaatttagatttaatgctttattttaaaactataatgtttactgaagactaataaagaatagcatcatacacaataaagcatttaaaatgaaatatatacatatattacatgcataggtatgtatatatgcatgcatgcaaatatatgcacatgtatactccaaacataaaatagaaatctaaaaacatgaaagaaacatacttagaactttagaataatgtttatctctaagcagagagaggaagaatttgctaaggaatggataaaggcattttagctgtttattgtgatgtttcacttaaaaaaaaaaaaaaagatatataaagaacaaattaaaaaaaagaaagttggtgagtcacattgcagaattctgaaaataatttaggaacgtatgtcaatagaatgaaatcagtttattatggcagacatacgccacttttattcattatacatggcatggatgagaataaagcttagaggtgaaaatatcttaattattcttccttcaatgccctatattcttgctcaatattgatattcttgcccaatatcaatctctgcctaaggagaattgtgtgctacctgaacatacatctgttattctaggtaatgggataattctgaagaaaacacatcaaagaatgactttaacataagagaatgcttgttttttcagtggacctgcctttctttaaaggatggaatgtttgctatattttctctatctacattttgctcttctcctggcaaagaaacaacaacatatttactcttatcctggcaaagaattgaaagttacttcttttacaaattagtgtactacaaaaatcaaaaaataaatccaaaatttttagtgtaagcttttactctgaatataagggttttgtggagcgaaaagaaaagattcaagagctctcatccactgatgctcacctaggtgaagagagaaagggcagagacacgcattaaatcatatccatctctttctctaataaacacgcctgatgtgaatttaggttcttttattttcaaggcggccggtcacaagtagtcaaaattaagtatcagagaattgtgtagggcattttcaatgaaaatctgcagctgtgggtcttgcgttctcctggcagtttgcctaaacctaagtttggagactggtgcatgacacgtcatcccctaccctttcttgactggagcctaaatcaggaatgctttctttataatagccagaggtggttatcaagaaggatggcggcggtgtctgctgtctgggttggaaagctatagattaatgtgttggtttaaagtatgtaatgtgcccataggctgtagcaataaggaaat

SEQ ID NO: 40668 - DNA, 1368 bp, Bovine  19866881273717
ctagtttacataaacatatacttttatgttaaactttctctaagttatagtaggattatagtattcagaggtagaaaaatttgcacctatggaaattaggcttttccagagtttcaataattgcaggttaaaaaacaatctttatgattataaaaattatctgatattacaaatatttttgttgactatctttttacattggatctgttaattgtgatcctactgtatctcatcacaatctaaccttctacactttgcagctgagttctgataaagtagttcagaatctgacacaaagctttactgtatgtttcaaagacttacaagtgtcttgggaagtatataattttaactaatatttaagatatttccataaaattccctgatgatttcttatatagaagaataccagcctttagaaagaacatgaataaatacatatataatacattattatagtaaataaatttataaataaattcagtacttggatattaaaataatacataatttaaaaccacttctataaaatgcttaaaaaggaaatcttatctccaaacttgtacaatactgttataaattaatacctttaaaaagccactcactcataaaataagtagattattttctttaaaaattatattgtctctggatataactgatatattatcaacttaaaaaaaaaagataaatttgccctctaagctaatgaagtagtatttccactttatgtcactaaatgccttaggccatatcctgaacttttcaaccatatgttcatcttgaccaagatctggtacacactgagggtttctgaaatatttgtgtgccctcttgattctcagcagagacaaactctcagacaaaatctcatttgcttagcaatattaggagaatttgtacagagtaagttattaagcaaaatcttaataaaatttatactgaaataacagttgtcatgaaaaatagtctctttcaagcgagtgacataacaacttttatttatccttcacttttgagaaaatatcaggcgaattatgatttggaagacactcataaaaatgagttgggagatcattagcccaagatctaaacgtatttcaaatatactttaatatatgatgtgaataatttattatttaaatatgtatgttttcagctgtttgccatttgacatgttttatattgtccttgacattgaaaattttatgattaacatgatcaacattaggcaaacattactaaatggaaaatagctttctaagtataaccactggctgtagaatctcactgccacaatggttatgatatgtttatgtatacaatactacttttataaacctgcaaaacattaggctcctaatgggt

SEQ ID NO: 40669 - DNA, 757 bp, Bovine  19866881349011
tgaactgtgtagggatctgagaaatttgggtgttttcaagttctttttgaggttacgaaagcttcctaaaggaaatatattgtggctttacaaatttgaaggtgacaattatttcagtatgccaagatcaccatggttttctgttggtattacttctcggtatatgaaagggaagacgggaaacaggaaacagtttttccctaaaactgtgcactctgggttggcgaaatcagccagtgttatcctacaatccaaatacagcatttcgtgcatcactgtagttttttttttgaagtaacatgcagatttaaccagagcaggccactgatagcaatggttgccatacagaaatcttcccaagggtattactgaatataggaacagtgtgtttttgaacaatcacacattgaataaatgtcttttgaaagatattttttaaaggaccaggaagatggattaggtttaaaataaattgtgtatttcttacaaacttcctcctcccccattcagtcactgtgagagtctatctaacttaagtcttccctcaatgctcccatttggattttgtgttcctataacaccttgccttaatatttgaatatccctagatacttgcctatttccctccctagatgttgagagccttaataatagggactgcacgttattcctgaacatagcaaactccttccttgtaggagatagaaacagctattgtttattgactagagggaacacatcttattggattcaatta

SEQ ID NO: 40670 - DNA, 1550 bp, Bovine  19866881354541
gctaagtgacatgcatatcatcagagggtaaaccgaccgaagtttcaggatttggcccgataactagaatgaccttgagatttaatcgcaagtcttgactttcacccttttaggggctgttaactgaagtgtggataagtgaaccgactcccccatctcagtgatgaatgtccttgaggtcagctgaacatccatctgcccctgcaaatcagacatgtttccttgtctctaaagtaacttgatgcggatgcttgtaaatcagcgtattggcatttggcctcatttagtgtgagaagaacttagaggagtgcctgattctggtttattttaactttcaattttcttaatcctctcccttccccctcccccatcttctttctgggaactcaaagagtttggcctcccagagtagagccattctgaggaattcacgcccacccttttagcatatgcatgaatcccagaaagtctcaagatttgattctgtccacaagggaatgagcattaattacatcagttacagatctgccccctgctgttcagggagtccaaagtccaagttcttgggtgcgttgagccattaaaggattttacaatgtagaacaaaagccatggaaactcaattgctagaataatttaagagctcttcacaccacttcagctaaatacccccatcctccactgataagctctagggcagttaattaaaaccttcacctttgcaatcttggagagtattgaacccagatgatttctttcccaaatgaattaattttaagggacagggaaaagaaggaaacagaagtcatattattgcccattaaaaaaaaaaaatcagacatgcatttttttaagccaaaaagaaaatttcagaatagatttttaatttataagtgcagagcatacttgttaagggaaaaaaaaaaaaagatatcagtgttaaattttgaatgcttaccctcaatccacctgtaaagtatataacttccccaaaacttttagtcagtaacagcttctttattattagacctttttatgggtttgaaatgtattctatatgcttagtgatcctaagtcaaacgtctctgattgccactttatgtaaactatgtgaagtctgaaccaccagtaaatcaaaattcaatccctttttatacaggtctggacacttccatatttcaacttagttcacatcaatcacctttttcaacatcttgcctctctataatttctaatacatttagccttcaaccatatcctggctcttactcctaaaactgaccctcccaactcagtttcttatctctgttttcatatttttgattgttttataaagtgcctagtttgcaaagtttcattaaaaaaaaaaaataataaaacctcctagatgcaatatcagagctatttgttttcagaatatcgcatattttccaatgtttttttgttttgttttcatagcactcctgtaaaaccaagatattataatacgcaatttacattaagccattcacacagaagatgttaagagatatggcaaagttaatgcaaat

SEQ ID NO: 40671 - DNA, 1859 bp, Bovine  19866881392946
tttgtagaggttctattagcaaccattgcctgaaaagcatagtggcccccacctgccacctccccccagctctttcacttctcccagccgactggaccagaagtgcagcccaaggccaagtccacctgacctgtctaaaaggactcaggggcttctagctcgttgttggaaactgacttgaagccggtggctgagcaatgcccttctctaacagaaggatttctcaagcacagagtgtagagggcatgttccttctggaacacaagaggaggtttgttctctgctgcttcccagcaatgtcctcattgagcgtggtggtttagatcttgtgttcatattgcattatgaaaatagttactcctaccacccttcgttggaatttctcaagtgtttttctgtattttgtaaccaaagaatcttgactagtgctgatgtgtaggatgaagccaagtcatggtgagtcaggaaagctgagcagaggaattgtgtttagttgtaataaggaatgacaccatcaaagcctttgaataggaacccgaagtgatcaaagttgttttaagaaagagggagttggcagtagtattcaggattgattagatgatcccagaatcatataagccagctcaggggttcatgcagcgtatggagaatcagatttgtaaatgtgatatacatttatttagatgtgatacacatctagataaaattaatactcattattacagaagtaacagctaccagatgatgagaatttattaaacaccaagcactgtacttgctaagaactttaagtatattaatgcattctatttttacaatcaatattacccttttatcttatagcaatttaataagtttaacaagaacaaacatctagttcagttcttcaacggggacttaaacccaattctatcctgtaccaagaaccattccccttcatttcccagattttcaataaaatggacatgattgtaacatacatcttgtctcacatcctagaacctggtttagatgctggcatgtaaaagtgaaccaccgtggcactctgagaagttcataccaactgcagtgcttttccaaggaacattaccaaaaaatctttgtgtatgaagtttttgtcattttatgtaaaacaatagaacgccttaggataattggctcaaaaaacttcgaatgtaattatcatgtgtaattatcacatctccagagaagaacagcatttacaaagaaaaacacttaattacgcttatttgaaagagttttcttgaaataacaggcaagaccacaaagggagaccaaggttgtagaaaagcaggtgatgggaggggttaagtaaagactccagttctggaggacgtgacaaacccagagtaggtgcttgagttctcttgggagtgggtacaagcatgagaagggacatgggtgagtctcaaaatctatcatgcagctctatgaaggagtccttatgagccaaaactccaatactttggccacctgatgtgaacagccaactcactgcagaagctctctcacctccaatctggccagaatttatacttagattctgggctttgatcacctttatagatgccccaaaccaagaatggccatagctactcaaaaaaatacaagtgaaaaaaattaagatagctatagaatatatgctacaacaaccaaaccagacaacctagaacaggaggtacgattaatacaccagatagattatgaataaaataatacaacccaagaatgacaaatatcttttagtgaaaagaaccagatatcttaaaaatgaacaaagaacaaatattaatcagcttcagaatttgcagcttaccagagataagtcttaaaacttt

SEQ ID NO: 40672 - DNA, 1003 bp, Bovine  19866881457108
ctgaaccctcctccctcctcccttcctaccatccctctgggtcgtcccagtgcaccagccccaagcatccagtattgtgcatcgaacctggactggcgactcttttcatatatgatattatacatatttcaatgccattctcccaaatcatcccaccctctccctctcccacagagtaagtttaaaaatttgactcaatttcaagcatcctttctcaaatccttgtaaagtcaaacaaaaatcatatcaaaattatacttttctaagcatattaattatgtactaaaaggaacatgagatttgaccaaaagatgagacaaagaaagtcattcaaaagctctagcattgtgagaggaatctgcccttcagctcagcttctagactatagagaatttaggcaatctgagcaacagaaatggatgttttttcccatagaaataatttccttaggctataaaattgcaaattgctttgaactgccttttttgctcagtagggataatcaaaataatattgcctgaacagtgttatcacacacaaagcatactctttaaaaataataataattctgtgccttggtagaatttttaatcccaattcatgatcattaaacattcatccatcttgagaacacaggtaaaatatgcaggtgagggatactaatttcagcttgcaaaacaggaagagaaaacaaatcctgagaaacaataaaagccaggcaagtgactttttatgttgatttgatggctcaagaagtctttttctcatctaaggccatagctctttattttgagaggggtaccagccagactttggaagatcacttagtaatccaggggaggctttcatggtccaagattcacgtaagggaaaagcaagtggagaggtgagaatagccctggtttaagagataaaactgggagaaggcaatggcaccccactccagtactcttgcctggaaaatcccatggacagaggagcctggtgggctgcagtccgtggg

SEQ ID NO: 40673 - DNA, 1426 bp, Bovine  19866881568348
actcataatattcttttgaccaataaatggccgacttacaaaataagccacaacatgagagtggtaagctaagttttatttggggcaaaatgaagactatagcccaggacacagcatctcaagtagctccgagaaactgctcccaaagaggtagagaagaaggtcagtatagacgtgattttggtgaagggttagcacatattttttgcagaaggtttctgttccctgtaggttgctgctagtcctaagaagtctcaccgtaaaggatttcggtgcttttctagatatgagaagactcaagaattggactcataaaattggctactgaaaatatttatctgaaggcctgttctgccagtttttcccaggctacagagtggcttgtttcttatcttcacatgaactactttcaggggtattgaaagtcagcagctgcagcaggacatgatttaatccttctagaggtagttgggaagtgccaatttgtagttgacaaaaccaccatgctccttgacagttcctcccttctgcatttttaaataatagtgattttcactgaaaattgataggcacttctctctctgagatgtgtttgtttatgtaattactagaagtatacaatttggaaaaccaatccaccactgtctcaaatcctgccccacttacgcagttgaaaatgaatcgagctatagaactcaagtgctctgtcattcagtcttgtctgactcttttgcaaccccataaactgtagcagccagggacctctgtccatgagattatcctgccaagaagacgggagtgggttgccatttccttctttaggagaactccttaagggcctcaggtaaatttcactgaattgtaattcaatatttttatttcaggccacacaactagatgtattggtgagattggacactctcatcatcacagtaaattgcaatgtctcatctctgaattaaatttaaattgaatttgaaaagactttccagcccataaaagaaggatcagggaaaatgcttcatttatctccatcttagaaactgaagggaataggttgctgagtgttttatcatcaaaagttcatattctataaatctgaattgggaaatgtgaaaaaatcaagccatttaaaatttattaggaaaaggaggagaaaaagctagtcaaaatgtacagctaatcattttcagtgattagctgactataccctgattccagaagcacacacgaaaaatcattcctcattctttcttcaattgtgctgtgaaaggatacattttaaaatatatcttttgctccttaaaaaaaaaaaaaaaagctgtcctgtcaaaataagagctgcctttcaaatttccagattacaggtgttcccgtgatgtaattaacttaaacaactgtctttctgccatgatgacaaaggtgg

SEQ ID NO: 40674 - DNA, 721 bp, Bovine  19866881798701
tagggaatttaattaatgatattttctattggcctctattttatatacttgaactgtctataaatgcaattttaaagttcccaagtgtagcaagtaggccagatatgaatttcaagtgtctcattagtgagaatcgtctttgaagttgcaaatgggggaaaaaaaacacatttatttgcacatagaatctttccaacagaggatctcaaaacatatttaattgtgacatgatttatgtaaagcaagaacagtgccaagaaaagtctttatttttttcttaggcaagagcatgttacaagaacaaacgatcactgaatatctgcttcacaaactactagctcagtttagaaacatttttcaccccaggaagtctgcgctctaatacttaatgctgccttctcttctcatttctgatttcttccataactcattagacagctgatggaactacacatggaataaagtagctgtgcttcttccctcatattaaataataaaggtcatttgcctcgttttttttttttttttttatgctgccaatcaatttttcttgtgaaattctaaaacaatgaagaaactcagactatgggtataattttcaaacaaaattcatatcatttcttaactgatacaatgtgttcaatctactttcttttccctttttattgcagtatagaatggtttttttaaaaagagtccaattaatagttttgaagtagca

SEQ ID NO: 40675 - DNA, 741 bp, Bovine  19866881808974
taagtatacatttaggaaacggacacaaattcagcaaattttacattacatatttatagagcctttgtctgcaatttcttcaactggtaaccataaagtcttcatgctgatatgacaggtaatggatgcttttatttgcagtttgataattcatcttagttcccgtgtcatttaaactctgcaagaatatcactgcattcacgaagggttttgaaatgttttaacttttgatgttatgatctgcaaggatctctgatgaaatgtttcatttaaatgtgctcagattcatggacatgaaattttgtgtcagttgatagaaaacagcttacaagcttgacctatgctgaaggccctgtgctgattaatcaagaagagactgcacctcctcctgctaatgacctcatcaacagtgggtgtatttttaagatgaaaaaataaaaggtgcatcctgattataattattttcagtttgatttgctccttagcttccatggtgaggctctggagaaagaccgtctgggttcagagactaatggtaacaactcacatttactgaatcattgttactaccaggcactatacagaacactgtgtaaataaatcatataattaaattatcacaacaatactaggaggttggtgttattactaccattgttttatagacaaacagatcagatcataggaaagctacctaactagttcaaaacaatctgtctagttcatggcagaagcaggatt

SEQ ID NO: 40676 - DNA, 824 bp, Bovine  19866880450207
accgtgaccttgatcttgtggaggtgatggggcgttcaccacgggagcagcctcagaaggggagtagtcgacaagaatggtaaccacctgcttcataagggcggactcgccagggctctgggcagagaaaaccatgctgaaggagaaggtcgttgggtggagagctgatgcaggaatcttggtgagaggatttccaagagggctgtcagcagtgaggaaccgtgggtgggggggcccaagaacccccttgaagctgagttctcatagcggggagtccactgagctttctggaaatctctttgacaccttctcttaggagacagaaggcctgccaagccacaaagcttttcttttctttttttttaagctccaacttgaaaacaaaatctctgaccccagacctgtgctttatctctgatatcagaaacagaatggacaacaggtggatcaaggtgtaagaaaaaagaaaaaaaggaaaaaaaaaaaacaaaaaactagaaaatgctttcaaaaccttccccagtgtcccatcctggaggctggagttcccagcggccaaggcgggctttagatggttcctgataaagtcccgggagagaagtggcctgtgtttgtcgaaggcttagagagctttagccgcgtctgcacacaaaggggccctctgtcaacagtccttcaggccactaatagggctgaacaaacaccagggtaacaagctcttcacacctgtggggcttgggaaaggccggggcccctttgtcaagacagagtacaaaagagctctctcccccacccagccagaccctcctgggcttctgaagcag

SEQ ID NO: 40677 - DNA, 2674 bp, Bovine  19866880457432
aattttgttggggtttttttcccctcaagacaaaaaaaaaaaaattacagtgataaatttggctgtttaaatagtcgaagtttcatcatgccctcattgaggctgttttgcacccagcagtaggaggacagctgtcatggaccgctttcatctgattttaccgcctccgggtaaactgagacaaactctagtggtaaaaacctagagtggttgggaatctccaggcaaacagtttggtttggtttctgaggctgtgtgtggaagaatcaaatctgcagtttccttgaaacggagcagaaacatttcacggtcagtgctgtggattgtccccagacctccgatctcctttctcagaaatcacctccgcccctctgtcccagtggtcctggtcatgccgtgcctccggtgtgtggctcttatccacgcatgtctctctcaaccatcctgtcatttcctggcacttctcacgtctcctaccacactcatcatttacaacctcccacttggagaaggcaatggcaccccactccagtactcttgcctggaaaatcccatggacggaggagcctggtaggctgcagtccatggggtctctaagagtcagatatgactgagcgacttcactttcacttttcactttcatgcattggagaaggcactggcacccccactccagtcctcttgcctggaaaacccccatggacggaggagcctggtaggctgcagtccatggggtctctaagagtcagatatgactgagcgacttcactttcactttcatgcattggagaaggaaatggcaacccactccagtgttcttgcctggagaatcccagggacggggggagcctggtgagctgccgtctatggggtcgcacagagtcggacacgactgaagcgacttagcaacagcagcagcaacaggtctgagtctctgacctgtattatttcctctctctgaagaacttttaatatttctcatatggcagggctactggcaataactttctccaatttttatttatatgagaaagtctttatttcttctttaattttgaaggataatttcacaaggtacagaattctaggtgggaggggtatttctctatcaatatttaaaatatgttcactccactctcttttgtttgcacagtttctgaggagaatacagatgtaattcttatctttgtaagtaagatgctttgtttctctggctctcctcaggatgcttttcttcattttttatttcgtttgaatatgatttgcctgaatctggttgatatgccccctagtagttgtttgtttgacatttatcctgcctggtgttctccaagtctccctgaactttggtttggttttgacattaatttgggggaaatttccagtcattattgtttcaaatatttcttcttatctcttttctttttctttccttctgtgtttccattaatgcattgcaacttttgtatttgtcccacagtccttagacactctatttttaaaaatcttttttctctttgctattcaatttttgaaagttctactgatatgtcctctaaatcatagattctttccacagcattaattattaataaactattcataagctcattaagggtgtttttcatttctgttccagtttttttgatccctagtactcttgcctggaaaatcccatggacagaggagcctggtaggctgcagttctgggatcgaaaagagtcggacatgactgagcgacttcactttcacttttcactttcacgcattggagaaggaaatggcaacccactccagtgttcttgcctggagaatcccaggacgggggagcctggtgggctgccgtctatggggtcgcacagagtcggacacgactgaagtgacttagcagcagcagcagcagtggtattgctttatggtcctttcttagagtttctatctctctgtttacgttgctcatttgctcttgtatgttgtctgcttatccattaaagcccttagcatattaatcatgttgtagttgttcagccctgtctgactctttgccaccccatggactgcagcacatcaggcttctctgttcttcaccatcttctggaatttgctcagactcatgtccattgagttggtgatgtcatccaaccatcttgtcctctgtcatccccttctcctcctgccttcaatctttcccggaatcaggatcttttctaatgaattggctcttcacatcaggtggccaaagtattggagcttctgtatcagtccttccaatgaatattcagggttgatttcttttagcattgactggttggatctccttgcagcccaagggactctcaagagtcttctccagcaccacagtttgaaggcatcagttctttggtgcacagccttttttattgtccagctctcacatctatacatgactattggaaaagtcatagctttgactatagggacctttgttgacaaagtaatgtttctgctgtttaatgctgctgtctaggtttgtcatagcttttcttcctaggagtaagtgtcttttaatttcatgtctgcaatcactgtccacagtgattttggagcccaagaaaataaagtctgtcattgtttccattgtttcctcttctatttgccatgacgtgatgggaccagatgccatgatcttagtttt

SEQ ID NO: 40678 - DNA, 1548 bp, Bovine  19866880474392
tgggagacgtagcgagcacagagggttgtgggtcttatgatggtctttggggcagcaactgcaaacgctaatctgaaaccccagaagtggtgggggaaggctgggaaaccaactgaaatagcgtttgatctttggcctctctgatcttaaactgggccgcgcccccagctgggttcacgaaggccactgaacagctgtccggatgataacggctttcagagttgtcagcagtattcggttagagccagggatggggctgttccctctctgcggaggtggaaaaagagtccatgtttcccttcgtttctacctctgccggggctatcctaaatgaggaagtcatctggatttgtaaaaataatcacttcttggcgtgttcttggagtctgttgaaatgttatttcggaaacgagaatttggatgcccggaggtcacaggaggaaatgaatctggcaatttgaaagtgcacctgctgaagttccaggccctctcagtgttaaaataattcatccatccttccaaacatcttttgtgtcttttatttaaaaaaaaaaaaaaagaattctaagttattacttagtatgaatcagaaaacagccctgcttcttcagctgtggactctgaggggttttctccagcactttttcacaattcaacaaatgcaaacttaagagttgacctgatacctacacagtgttctgtgaagcatgtgtgtgtcagtcaggacatcttgggctgcctgaaacagaaagtccaactccaactggatttaaaagtagaaacttgtctcatgtgaggagaaattcaggagtagctccagggggcagctgattagaggttcgcaaagtcacttagcaaccaggttccttccacctctgtactagtctcctatctctactgtaacacgtgaccagagacttactggcttcaaacaccatgttatcttacagaactggaggtgggaagtctgagctgggcctcgctgggttgaaatcagtgtgttggtagggctgaagcttcttctgaaagccccagagaagagcctatgtccctgctttgccagtgtctagaggctgcctgcacgccatggctcatggccccttccaccttcaagtccagcaatggctggcggagtccttctcacatcactctgacactggctctccacctccctcttccacttttaaggacctttgtatgtcgggcccatgcagatcatccaaaataatctcatcttggggcctgtacccctagtcacatctccaagtcccccttttctgtgtaaagtaagagagtcataggttccagggaccaggacatgaactttggggccactactcggcctgaaaaatctctgtccttccagcctcagcaaaggcttcagcctcctaaagtcacagaatggtaattagaagaggttctgagagtcatgtgagttacctgatgaaagtgaaagtggagagtgaaaaagttggcttaaagctcaacattcagaaaacgaagatcatggcatctggtcccatcacttcatgggaaatagatggggaa

SEQ ID NO: 40679 - DNA, 1043 bp, Bovine  19866880488029
tttttggcctggagaattccatggactatatagtccatggggtcacaaagagtcggacatgaccgagtgactttcactcctaagagagaccaaatgagcaagaacatatcaatgtttgtggaaatcggggttctcactgcaggaaaaggaaaacattaatttggaatggggaagttacaaagaaacctgtgatgctggattagaatcaaaggaattggcatggactcaggatttgctcaaaaaaaccttgccaaatcccaccactgtcttttttacagcccgaaagcaaaggatgatcatgtttaaacgtaaaatgtaaaaaaagaaaaaagactatcatcgtttttttgagaatggttactcaaagaggtgagaacttgcctcttgttctgcagagcctgatagatttaccacctgggggacagtgtaccaactctggaactagactataaaactgtcagcagcttttaagataaaataggagaaattaaagagatgccctgcttcatttggtctcagtgattaagttaacaatgaatggattggttgtaatgtccatttgacctatggcaacccactccaatattcttgcctggagaattccatggacagaggggtctggtgggcctacagtgcatggagtcacagagagtcagacacgactgagtgactgacacacacaggttgttacacatacagcctctgaaaggggagagttttcagacctcagagctcaaacaaatcctctgaagggcccagtctctcctggccttaccttggttgtattttcaccatttctttcatactgatttcgctgctgaattttctcggcaatctcttgtgcaatttggcaggtagaatcgtaggtggagaacctgcgtcagagtcataaagggacagacatgttgaaagttccttaaaggaaatgtcagcgtaatctaaagttgcagtgtgtaattctagtcatgacagtgaacaggcagggaggatgataagaggggcagtgaaggcgtacacgcagtgaatggtaactcactatggga

SEQ ID NO: 40680 - DNA, 2585 bp, Bovine  19866880777304
ccaaggcagccagctggagggatgtggaggcgaaggtggctccccagcctggcacctaaacttggcccatgaattttctccttgtcgtctgtgcagggcagagggagtgttcctcatgctttctacatccttctttcttcgccccccaccccttagactcttgcttttggactcattttctccatctgaacccgaggctgcacctggtggttttccttggactcaagtcttgggaggaggtggaacccagagaccttggcatgcctggtccctttggtacaccaccagggagtcctcttacccatcccacagggcctctagaatgttccatctccaccctcttcccaaggcttgtgtaggtgacgtttacctaaacccaagtggagagttgtgaccaaaataaaaatcttcctggaatttctaggcactgagagaacagaaagaaatatccctagagtaaaaaaaataaaaaattccccaaatcgcatttgacattttcagagatgctctggaccagaagaaggagaatctacagcttaaccaagagtctgcagtcctgtcttggacgctgccctgtgtgaccctggccaggggcttggttttttcgctcatagaaccagagttctggctctataatcccccagcaccttctggcagtagtaacatgactcgaagtggttcccttctgttgttacctagagcaacataaatcgagagctgagattaatacccttagttaagtctctggagaactcagacctgaggaaattgaaacacactccagccaccgtgggactgggtttacagtgggtccattgaagacctcgttcaaggcatcgtgacttgagaggctccggagtggctggggaacctggaccttattaaaaggcattttctgtaagatcccagaaagcctgtccttgagggaggcgcagtcagaaagggagatggagcctccacggggcgcagtggaaagaatgcaagttagaattgttagtttcaggtgtgcctcctggtcccctcatggctgctgctttctggttattttcattgtccccatcacttttcctctcagggaggaagtagtcccttctggccccagcattgagcgaccttgtgaatttcatcacgcctacggttctcttggttctaaggtttgtgcataagttaaaaggaaaacgcaagtgaaatcaggagccaaactgcgtccctctcggtatacatcttcccaatctctgatgactccagatctttagcttccacatcatttttactgtcacctcctgtgaagcgcgtttgatcactcacatgtggcctgtgacttttttttttttaatttttctttattttttggctgcactgggtctttgttgcgacccatagacttttccctagttggggtgcatgggcttcttattgctggcttgtcttattgtggagcacaggcgttagggtgcgcgggtttcaatcagcgtggcacatgggctcagtagttgtggttctcgagcacaggctcagttgctctgaagcatgtgggatcttcccggaccagggatcgaacctgtgtttcctgaattggcaggtgaatactttaccactgagccaccagggaagccccaggagtttctgatcttatttggagatctctgtccctgagagctgtagctggggtggccacctacctcctgggcagacctgccactggctgcccttcaaactcaaccgccctgggctgaatccatctgctcccctagacctgtccccactgtgggtttcctcttggtccttgacatctctcggtccctaaagacctcagggcatctcagatgtctcccccttcttcatgagctggtgtccaacctcaagatggaagctgttgtttaacctctgcctaaatccttccagtggctgtaccattctgattcaagcccccagtccacaccatcccacccaagttggcagggccttgtggcacaggggttattcttatctatcatgagagtggtgtcccaattagcttagtgtcttgaacttttttttatctctgcccgtatttcctgtctgttttctgactgactctttgcaaccctgtggactgtagcctgccaggctcttctgtccatgcggattctctaggcaagaatactggagtgggttgctgtgccctcctccaggggatcttcccaactcagggattgtacccaggtctcccgcattgcaggcggattctttaccgtctgaaccaccagggaagcccaagaatactggagtgggtagcctatcccttctccaggggatcttccccaacccaggaatcaaaccggggtctcctgcattgcaggcagattgtttaccagctgagccaccagggaagctgtttccaacagtgacctccatgctattcctccagactgccaggcacattcctgccactgggactttgcactggctgttccttctcctgcagtgctcctcccctgtgtgtatctatgtggctcacacctcagctgttttaaggtcttcactcacaggtcacctagcgggttaccacctctgtgatactcacagcatacctctcagacact

SEQ ID NO: 40681 - DNA, 2779 bp, Bovine  19866880781246
taatacatgaaatgtaaaataatgacgcaaacgaagttatgcatggaacagaaacagacacagacacagagaacaaactggtggctgcctagggggagaaggctcgggggagggatggattaggagcttggtattagatggtgcaaactattacacacgggatggacaaacaacaaggtccaacagtacagcacaaagaaatatatgcaatatcctataataaaccattgtgaaaaagaatatatctataactgaatcagggcttccctgatggcttggttgtaaagactcaacctgccaatgcaggagacgcaggttcgatccttgatcaggaagataccccggagaagaaaacagcaaccctactccagtattcttgcctgagaaactgcatggacagagaagcctggcggattacagtccacagggttgcaaaagagtcagactcaactcagcaactaagcaatgacaataactgaatcatcatgctgtacagcagaaattaacacaacactgttgatcaactatacttcaataaatttttaaattaaaaaaaataaaaataaaggacagataaataaataaagctctcacagagcttccagtagctagaagtgtaggaaaaataggcacatacacggcattcacaagaacactaaccacaaacacgaagcatgtgccaggcaccagaagatgtccacacagaccaactcatttaatcctcacatcatccctgttttacatccccattttacagataaagacactgagacacagaaatgtgaagtcatctgtccgtgtatcatggtagaagcagagtcagggttcagacggaaacagccaggtcccagggtttgagagctcaaccactcggctctacatactgccaggctcctctgtccatgggattctccaggaaaggatactggagtggtctgccatttccttctccaggggatcttcccaactcagggattgaacccaggtctcttgcactgcaggcagattcttggcaccaaccgagctaccggggaagccaggtaccaggacaaggcattgtaaaagcaggtttctctaactgcccacagcatctcccactgttcaggggacagggtggtgctcagtcattaaactatgatctgtgaacaggaggcctctacaggatctcctcttcagcatccagctactgcctggtcatcaccaaagtcactgtcatcgttggcatcgttgtcagaaaagaaagagctgctgagtgtggcccaggccatattaagccctgcccaaggtgtggctacacagctcttgggagtctgggcagaccacccagcaggcttccacccacaagttccctaaagctcaggaagtggaatctggagacaagctgcccgaaggagggcaccggaggacggtctgtcttagagactgtcatggcaatagcccagggaggggagcagggaaggggcgtcccttacttgctggaccttggtgtcctttcccacatttccaccctggatttcccacctcgggaaggaaaaagcaaggatcgtgcccggcactcccaattatggaaggaaagcatctgggagtcagataacatgattcagcagaaccggattgctgattttttaagaaaaatggatatgactatgagatgtgggaatggagggacctgggctgacacagacctgcctttccgggggctcgggcgctgtgcgaggctgaggggcaagggataagccccatgctgcccacagacctgagccctcgaaagctcagaagacaaagtcattgtacttcaggatccagagaaacaagctttaaaaaacttcagtgagtgtcctacatacaaaaccttcaagttgcgaactttcaaaagaagctaacgtgcgatctcatatccaatcacataagttagttcacgtgtcaggcgtacactgtcatgtgagggcatcctctacaagaggttgtgctattgtgtgctgtacagtactgtacagagtcctaagggaagtcaaccctgaatattcattggaaggactgttgctgaagtcaaagctccaatactttggccacctgatgcgaagagccaactcattggaaaagacgctgatgctaggggaaattgagggcaggaggaggaaagggtgacagaggatgaggtggttggatggcatcactgactcagtggacatgaatctgagcaaactccaggagatagtggaggatagggaagcctggtgtgctgcagtccatgcggtcacaaagagtcagacacatcctagcgactgaacaacaacaacactgtatagcgtacagaagtatggcatctttatttcaagcccaggatgtctggaagcaagtataaaagcagcagtatatagctggttatgttaggtgagtacttaggcttacattgttgtatttgcaaacaaatgcacttaatgaatgcactctaggaacagaactccttcgtatgtaggggacttactgtatgaatgtgttactctcaccagggaggatggtgattataactatattcaaaaacttggtacagcaacatgaatactcctttgctggtatacagatcaccaagcctcctgaagttttacagtgtatcctgagccccaagagtcaaaacagtatgaactggcataagaatagagacaaaacctaatcaaacagggagtctaaaataagatttgcttatatccagcaagtataaggcaaaagttgaggcaaaaaagtcgaggaggaaaagtagaggcaaaaaagacagata

SEQ ID NO: 40682 - DNA, 1732 bp, Bovine  19866880798456
ttctaatttattgagccaaattgctgctgaagtctgggggaagtgttctctctcagctggaagcaacctggtgtcacatttctgggttttaaaggagatgatcctcaaggacgcgcaattactttgaacaggtgtgacattccaggctgatggggattcgtacctgtcaacagctgtgcattagcatttcaaaacccttctgactttttcactagagcactcagcgtgttgcagagatgggaagactgagtgcaaaccagggttaaaaccctttctgtcaggaagtggtcaccaaagagatgttaaagacccagctgccgaacatggctttacagacctataggcccaaccctgccgcatcaggaaatgggaagaacaccgctttaagtgctcaagtggggactctgagcggtattgaccgtacctagtgcaaagagcgtgaggacgagatgggatatatgataatacttgcttgtcaaggtttttcaccttcagaatcacttgtttattcatttccactcattcctacaaggtcacggctagaaatggcgaggcggggagacggacccagaataatgaaatgtctgttttaaatcaggcacccatcccccaccatccttctttccattcttccttccctttcctcctcttcattcattcaataaacaccgactaagcctccctgctgtgccccccaaacccccgactcaggcactatgctgagtgatggttcttcttctacactgtggatgctctgagcccagggaccaggtctactagacatcctggaaaccttgcacagttccccagagcacagaacagacgccccctcggagacggacatggtgggcatgaggctcaggtccggcgcaccatgggtgtccatcacagcccagacctggggagtcagggaagacttcagtcgcccaggttctcaacgtgaacatcagaatcacctggaaaactttaaaatcccaatgttctgtattccagagcaatgaaatcagaatttagagggaaggggaatccaggcaacgggaattaaacaaacaaacaaaaacctctccagatgattctgatttgtctggaactgctgttctagatccttcctgcttggtgggtggcccttggagcagcagtgtccacgctttctgggagtgagtcagacacgcagcaaccggaaccccactccagaccctcagaatcagaatctgcattttgatgagcttctcaggggccacgtatgagctgctctgggagatgtgctatccacactgaatgctgaaggcctagaaagccagcagaggggaatgaagaacagaaagcagcttgtgttctgtggggagagagagtgagagagagagagagagtgtgtgtgtgtgtgtgtgtagactgcatgtgtgcatgctgggggcactgtatcaagcaagtgtgtgtgtgtctgtgagagagagagagagtgtgtgtgtgtgtacactgcatgtgcgcatgctgggggcagtgtgccagaaggtcagggaccagatttgctaggctacgaaaccacattctgggctctggactttatcccctgaaggatcataagctggggagagacttgatcagattcccctgaagacccaccgttttctccacttgtgctccatccactcactccactccctgagcctgaagtttcttaacccagtgccaatcatccgtgtcccacccatcttgtctgcaataactcaaa

SEQ ID NO: 40683 - DNA, 1789 bp, Bovine  19866880837542
ctaactggttttccattttccagtgtgccccgctactgtgtgttcttcatgctgcagccagagggatcttttcagaaaggaaataagattgcatcaccctccctgctttaatttcctcagcagcttcctgttgcatttacaacagaatccagactcctatacagctgacggggccctaactggctgacccaccaacagctctgcctggtttctgcccctcactcatgattctcagtcacgccgggctgctttctcttcctttaatggccaagggtgtcaagaaggcacccacgacccagcaagaccacagctggctgttggccggagagaggagcttgccctgctcttcatctgacctgattgagaccaggaaagatctttttctatgtctggatggagtcaaagctcctcctgaaacttgctctcagaaaattgggctgcctgcagagggctggctgtgaatgcttgaaggtagaagagcagagctgttggactatttggcacaaactttattttcgctttccaagaaggaaatagactgcccctgtgtacctctgaacaatttttctttctgaggctatttctgtttcaaacatatgaaagccatgtagctcaatttatttgaaactagaacaggaaacatgaggaccactttcttttctgttaatgtaacaaatgttttcatctggtgaatagggcatctttttactatcctgtggacagtgtgacaccagcaatattttgggcagtttatcttacagaaaatgccactcttgcaggattaagaaagggactgaggctggggagaggaccaggaacctaacatctattaagcacctactatgtgccaggcaggataccctcatctctttttatttaaatgatgactccctgagctgacgtaatactcctcttccttttaggtgtggaacaaggctcagggagatagtcaggatcactcggctagcagggtagccccagcctggtccgacctgcctgatacaccatgctttgtgagtgaccctccattgcctctcaccccagcctcgtttggaattttctctttacatacccctccttggacggtcctgtatgcagccgctcccaacgcatgctgccttatcatcttttttagattttctttttttttttaatgtggaccattttcaaagaattgcttctgttttagttattttggccctgaggcatgtgggatcttagctccccaaccagggatcgaatccaaaccccctgtattggaagttcttacccaccggactgtcagggaagtcccactgccctatcatcctgatggagaagcagcctgggtcattgtgaggtctttggttgtgaggaatggcagccaatcagccaactcaaacaacaaaggaattagttggaaggcaaagggcaggtgtgaagaatggaaatgaaggctggagaccaggcttggaactgtcttgagccagatagctctgggtgtggggaagggtggtcagtggcaggaatggctcaatcctctggcctggacacttctgccagagttcgcagtttgcggcctgtaggtcagtctgcctgtgattgacatgaagagcagggacatctcatccatcctgcttggatcacataccagtctctttggtgagggaggaaaggatccctgatgaaagagccttgccccctccccccggactgaattcagcattcccaaagtgagggctactctcagtgaagaggaaaccatcctgggcagccccaaatgcccacgtctgctctgcatccatggtct

SEQ ID NO: 40684 - DNA, 991 bp, Bovine  19866880844065
cctagtgggctcagtcctggtattgcaaagagttggacatgactaagttactgagtgtgcacacacgccctgagtgtgagcacagattgtgggcagtgtgttatcagtaacaggcagaccagaggcagaaatggatttagccaatcagcagaactttttcagtaggaagcacagaatgattaaataactgtatttaaaaggacttccagccaaaataatttttacgtgcgtgctaaaaactcgctcctgtattggcaggtaggttctctaccgatagcatcagctgggatttttcgtgtgaaaattatgatggaatctcttttttcaggatgaaaaccacgttccccataattggaatgactgtgttttctttgtaagcgaatagggtgatttacatgttctagaaaccttgacagcagacacgtactttccagcagtgacaaacatctcgtcgcggcacttggagaagatgactgtggtggcgttcccgacattgaggccggctgcggggctgccacagatggcctctctcttggctatgctccagacaaccacactgctcagacgaaaggacaaagagaatcagggggaaacgggctttcaaaataagaaatggctcttttagccgttctagaaggaaagaaatacaagaggttactcacaaagaaatgaaagaattatattgaccatcccccctaacccccaagacagctaagtctcttactaaaataaagagatttttgagacaggcagggcataaaagtttaccactcatttatcgcttgtaaaaaattcccttggggaaatactccagcaaaaaaaaaaaaaaattgttaattagaagcaataaaagagaatgacatagggatgttttcaaacttcaccatgccatgtagctgattcagctggaggacttgccaaagcaggaagtgctaggacctgcccccagacgttctgattcagtaggtctggggtggagtctgagaatctg

SEQ ID NO: 40685 - DNA, 933 bp, Bovine  19866880900388
ggctaggtgagcaagtgtgatgcctgtcgagatgctgggtccttggccagacccgttgtgaccttctctgggtctccggatgcctgggatctctcatgctctccccagggaacttgggccagatccggatcacgggctttgggactctggggtctgccacagcaaaggccttgcttgcctcgtctcagcaggagggaagttgtgggcaggaggccagggggccccctgggaagcggggcctgggagctcagtccatccgagcctgtcgattcttgcagtgtttgaatagggaaggcctccatgctgggctgcctgagaaaagcttgtttacttttgcctgaggaacgaaggagaattaataaagccgagaatttgtcctgaaagctgatggacataaccttaccctgaacccacccatccccttgaagggccagttctctctgggaatgctgtccacctgctcactgagccagctggtaccccattctggggggaagggaggcaaggaaccgtgtgcctgtgggagacctggggctgggagggagataaagaccacccgcttcaaacccaccgatttgtagttgtagtgacctctacccctgcgtccccttgccatgcatcagctccaagatatcggtctatctgcatgtttggtttgtagaggctcctgggtttagcagaataagcactgtctcaaagccaggagatctggggttgatccagcattgacagtgaagccttgaacagagcaaagactgctttctgcctccttgaaggatgaaaggatgggaccactggtcctgggcctccctgccctgcgtcttctgggaggaatgaacttctgctaagctttcttcttccgtgtcaacacctgctcactcccctgctccctgtggtgatctgcttctcccacgagcctcgcatgcccccgtg

SEQ ID NO: 40686 - DNA, 1371 bp, Bovine  19866880907649
ttgccccaacagccctcagatagctctgagccccgctccagttttcatccttggtgatgacaggcgtgcggcccgaagaaatgtttgaactcgcgttcttgaaagttcagtttctgcaggtgagctggcacaccctgtgatacggctgctctcagggtataaatttctccagcccacagaatttccttttcaccacgcccagctcattcccaatattagttcaccaaactcagagccttctggttttgattggccagtcaaggttcatggaggcaaattctttcctgagatgggcccatatgttctggaaagggagtgtttgcgagccgcccaggcggtcacggagacgcgaagccagaagacagcatcatgttgccattttcagcaactcccggtggacagccaagcgggatgattaatatttgagcgtctttgttcttgctgttccgttagaaaaccagcgctgtttaaatcactctgaaaataacacgcctgacatttccacggtttaaaaaagaaaaacaacctggggaagtaatccaccccgcctattaccgaggaagtgttttcagtgagaaaggagagaaaattgtctgacttgggggagaaggctaattccgaagagcttcatggcagagaatacattaaaacctatgaagctcagaggcgtgacccagcgtgtgtatttaagaggctgagattggcctcaggaggcacttaagctccatctctggtccctgcgtccggccaccgagcttgtgttgaatgtgtattatgcgcccacttctgacaccatttgctggagacatgcacctgagatttttcagcccatgaagccatttgggaatgcgtgttatattgaagcagtaccagaggccagagaacacagtttaatttcatatttaagaattttgtttccttcttgtgttgctctgtaaatctaaagggaaagtacgacctactcgggtgtgtgtggcatgcagctaagtttgagacctgcttttagggaccacattgagctgtggacctggacgcactaaccatttgcctcatgtcgtagctgtgttcttaaaataattgcatgtcataattgaaagatcataattacggatctcaatttagatcaccccagtgtatcgttctatttataaggttgccttcattgcttcagaaaatgagcttcgactctttctgataattgcctcttgcagctggtgatttttaggaatcagatttaaggaagctgcagagcatatatgacaactgtctgcaagcagcatgtttcagtcccatgataaataaaatatttaactttggggagttaacattattttgattcagaagagagaaattaatacaaaaaaaaagtct

SEQ ID NO: 40687 - DNA, 1110 bp, Bovine  19866880918428
cgtgtgtccgcgggtggctgggtttgcagttccatgccgtggtgaaaactgtgcttcttaaactgagggctgttgccttaaccaggggcctctcactttacagagtgctggtcaccagctgggggctttagtcaagaggaagcaaggtgtggggggtggcgggggggttggaggtaggagtcagatgacagagcagacacaagatgtcaccccaaatttgggtgaatttgggtaaatgcgtttcagctgacgtggggctggttagcacattccttgtgctttgggtcactctgtcatcttgaagtcatactggccccccacctaatttctgtttttctctgtcacctccaaggtgacagggactatatataaccaagagccacagtggggaggacagaaggatgaccgctaagagctgtgggagaaatgaaaactgagggctggggcgagcagccaggagtggtcatttcacttgaagagccaagtctcttaccagagaaccagaatgacgtcctggtccctcagcttgtctgcgcagtccgtccccatcaacgaggcagcccaatgagccctactgtgagctggaggtcactctggctttcaagccacagccattaagtgatcgcaaattctctgtcccaccacctcccagcgccggacgtggtacttcccaaccgtgcagcagagggatgggggacgggcgtggacacacgctttccctccttgggaggccgcagagcggaagagccagagctgcaccgtgggtggagacgccagatggctcgcattcaaatcacaactctgtcactcggggaaggaaccaatcctttgagccccaagtcgggagaattctaaccctgagctcccagggttgtcatggagacgccacgaggtaaaaggcctggcaccgagcacatgacctggtccacggcacgttcttgagtgacactggctgctgttatcacctcctataaactggtgtggctacgagcatggcactcagggtcctcaacctttggccaggagacactttgctctgtccctcatctgtgaccccctttagcctccagtgctgcctagcctcctccagctcacaataccaacacccag

SEQ ID NO: 40688 - DNA, 1657 bp, Bovine  19866880944931
tttcctgggtcacggatttgcctgttctaagcatttcatataaatggaatcatatgagacacggcttttcatgtctggtttctttcacctagcatgatactttcaaggcttcccatgcataaggcatacacccactggtactgcatccctttttacagctgaagaacttaccagtgcaaggataagaccagattttttttattttggatattatttgggttgtttctggccattatgaaaatgctgctatgaacattcatgtataagtttttgtgtggacatgttttcagctctcttggataggtatctaggtgtggaattgctgggtcatgtgccacacattcttttttatttcctacctgaaccatttgctactaatttgtggttccacctaacagccaataagtcaacatcttcaaagtaacattttgtcttcctgtctcctttgtcttttgatttttatgggacttcaacttactggcagtgtgaacgactgtctaacccacttggcatttgccaaaattctaagagattactggtatgaaaaactgctgagaaataagatgtgttgtataataaagtgttacagtaacattacaaattaaaatgaattcttggaaaggaaaaaatacaacccccacagaaatagattaatagtaagatttacagtcttgatcaacagcctttaccaaaccagtcaatcctaaaggaaatcaagtctgaatagtcactggaaggactgatgctgaagcttcaatactttggccacctgatgtgaagagctgacttatccgaaaagaccccgacactgggaaagactgaaggcaggagaagagggaagcagagaatgagatggttagatagcatcaccaactcaatggacatgaacttgagcaaactccaggccacagcggaggacagggaagccagcccatggggtcacagagtcagacacgactgagcaactgaaaaataacaacaacccttccattaagagagggtctgttaaagaaaaattatacagccaaaataaaaaacatgaaaacacacacaactaattcaatcaactgaatgtgccaaataaacgcatctttttaatctcacatttgttcaacacagatggatagatgaaaacagactaatgttttcagatgcagaagtttcttagggcaacttttattaactgagaattatcagagttgctctctctggggagttagaaaagtacccaattatttgtaacaaagaaaagctcagagaatgcttttaaaaagtgttctactggaaaactgatccggaaactcacattagctcctggtgtaataaagttaagtgggaatctactcatttaaagaaaaattaaaaccagaaatcaagaaaagtgccgactatttggcaaatgaatccaaaagctcaaatcctggtttaatcctccaagctgggcttgcaaacataataaaacgtttatacacacgaattctttgtcaaaagagcttaaaaacaactcccagctctcctgggtttcagctgacactctcaaaagacagtggcatttctcttaaaaataaaagttatttcagattgtttttctactaatccatgaactcagttgtcctttttgcaaattaagtcaccactgcccatgttcatcctcttg

SEQ ID NO: 40689 - DNA, 1151 bp, Bovine  19866881093477
tgatttgagtggagcagaatttttagccctttttctgtttcttattagcaagataacctttaggtggttgaggcaggtaatgagtcgaggttaagtgaaaagagtgtaatgtaggtatttttcattcataatctgtgtctctgctaggtaaagcagctccagggctttgataattttttttttttcctaattgaagatcatagaggaatctcctgttttcttcttatatattgttttaccttttaattcatactgacacttgaccctcagttgtatatatagattatttgggagatgcatttagagttttccagtaacatcggtcatcctatagcagcactaggttgatgatagatttttcttggagtccatccaagaggttgttactgaagaccaaaaggacctcattataaagtgattttgctataaaatggtcccatggaatgatccctagagatagcaggtcatttgtatggttaaaaaaagagcacatcgtgtcaaaaaatgttactaaggggtccttaccccacaccattagtttaaataaattccagatgaattaacaagttgagtgtaatggcttaattccataaaaaaaaaaaaaatctagaagaaaacctaggaaaaactatgcaaggaaatgttaatgtgatcttgggcagaaggacctttgtgatttctgcttttatagatgggccatcatgtgaaacagacgttttaaaaaccccaacaagtgaagctgcgaatggcagagggctcggtggaaagagtcgttcgactcggccttggagagttctttccagtgcacctgtgggcagaggaaaaaagtacagggatggaggctgcctagagttaagaaaaacaaactttaaagatcttgagtaacttaagtgcttttctctttgaaaatcttaaaatccagaaaaataacacattacaacaagattttttttggccacacgatgtggcgtgcaggatcttagttctccaagcagggatcaaacccatggcccttgaagtggaagcacagagtcttactggaccgccaggaagatccccaaaaataacatgttttttaaaagcaaaaatattcttttactattgtatatattggtttgtattctactttttttttttacttaataatgtta

SEQ ID NO: 40690 - DNA, 1877 bp, Bovine  19866881105321
gttattcctatcagtcccgctctaaagttattcctatcagtcctacctcctggccccacacagctgagcatcttggtttctatctgctttcagaagatatccccagcctcctgtccatcctgtgagcttccagaatctttgtaataaatttcactttgcttacatcgaagaattggtttctgaagtttgtgaccaaagaaccctgtatgacacatcacccaaccagcataaggtaggcgaagcccacagtccagagttctgaatgctccaggatgtccctgggtgtggtgtgctcagtcactccagcagcgtccaactctgtgcaaccctatggattacagcctgccaggctccaccatccactggattctccaggcaagaatactggagtgggttgccatttccttctccaggggatcttcctgacccgggatcgaacctgtgtctcttaagtctcctgcatcgacagatgggttctttaccactagcgccacctgggaagccagaggtaatgcctcagggtactcagcgtcactgcttcaccccagggtgctggggcacagaataagaaaatgtactcagtgacgcacgaagcagactgacatgctttaatttcatccttcccacaacctggtaatacagggatttgttgatggtggtggtggtgtttagttgctaagttgtgtccgacccttagtgatcccatggactgcagcctgccaggctcctctgtccatggaattctctaggcaagaatgctggagtgggtagccattcccttctccaggggatgtttccccacccagggattgaacctggacctccagcattgcagggggattctttgccatctgagtcactagggaagcccatagtgaagcacagggaatttcaagtcaaagtcctggattcacagcaccgtttgccacttattggctgcattgttttggcaagacacctgccacacatccaagataattttaaggataaagttcagcagcagcagaactcatatacaaaggtttcagttcagttaaactgctcagtcatggctgactctttgtgaccccatagactgcaacatgcctgccctccctgtccgtcaccaactcctggagtttactcagactcatgtccatcaagtcgatgatgccatctaaccatctcatcctctgtcatccccttctcctcctgccctcaatctttcccagtatgaggggcttttccaatgaatcagccctttgcatcaggtggccaaagtattagaatttcagcttcaacatcagtccttccaatgaacactcaggactgatctccttcagaatggactgggttggatctccttgcagtccaagggactctcaagagtcttctccaacaccacagttcaaaagcatcaattcttcggtgctcagccttcttcacaatccaactctcacatccatacatgaccactggcaaaaccatagctttgactaggcgggggtcaaaaatatgtaaagtgataatgattatcttccatgtaatgtcatgtttctaaatacatttttttaaaaaattgggttggccaaaaagtttgtttgggtttttccatgcatgcgtgtgtgctctggtgctcggtcatgcctgactctttgtgaccccatggacagtagcccaccaggctcctctgttaatgagctttttcaggcaagaaacctggagtgggttgccatttcctgctccagaggatcttcccgactcagggatcaaacccacatccccctgtcattggcaggcaaattctttaccactttgccaactggaaagcctattacatcttaccaaaaagctaaaatgacctctttggtcaacccaatagtacagcagatctaatc

SEQ ID NO: 40691 - DNA, 1221 bp, Bovine  19866881109069
cgactgcccgacacagtaaggaaatgtggtttccaaatattcacattaaaaaagtcaccccacattaattatgcctcaagaaaaaggattaaaaagtcactctcttggcgatttatggacacacatttttctaagaattacaacatccataaagtatacctaataaaccacagtgaagactgtttaatctttctgatgattaagaagggtcttgaggatttgcattataaacaagatttgtcttggcattacagcaacacgccaagtaatagggaattctcgctgaggacaggtcatgtgacggtggactgtattctatcactaaagtagaattcagcttttaaacaactggctttgggtccagacagccctgcattggaatcttggctttccatttctcagcggcggggacttaggcaagttacttaagctcttaaagattcttctcctgggtgtgaagaaaattcctctgctggaatgctgaaagtaaaagttattaatttacattagtgacttgaggcacaagctggccttggcctcagtaccttttttgtaaagaagggaaagaacccacccaaacagtctaataataggagcctaccaggcctgacaagttgctatatgatacatcttaaatctggatgataactgccctagaattatctcagataaccaccacagaattatcttaaatgtttgggaagaggaaggtcagggagagggaagatgtaagaaacaagactaattaaatagaggcctgagtaatacagaagctacctccttcttcccggtctaagaaaccgtctccctgaaaaatccagaggttaatgagcgccccctggtggctcagatagtaaagactctgcctgcagtgcaggagacgcgggttggaaaggtcccctggagaaggaaacagcaaccgactctagtattcttgcctggagaattccacgggcagattagcctggcggactacagtccatggggtcgctaagagtgggacaggactgagtgactaacactttcactttcccatagggcgattctctaaattccatccctagctgtggttgccgttccagtagaaagaggctctattattttatttaaaaacaaaacagaatcttcaagaaaagttgttatattccagttgagtgcttgatttctcctaggaaagtctaaattattcacatgatggtccttaaatactttcataatata

SEQ ID NO: 40692 - DNA, 1744 bp, Bovine  19866881139529
gcgctgctggaacttgcgcagccgccgcgcccatgtgtcccgccactggatcaccaggctgctcttgtccgccacgatgccgctctggtcgggtgagtcctccgcgttgccgagcagcaggtacttcttgaggggcttgattttcgggcacttgcaggcgatgtcccgcgagcggatccacaggttctggtcaccccggcggatgcggctggtgccctgcttgtacacggagatgatgttcaccgtgaacttccaccagtccccggccttgtctgccttcaggatgtggatctggacggctgcaaggaagcacaggcagggcatgggcctcggctgccgcctgggccccctggctcctgccgccaagaggccccgggatggggcggcctgtttgatggagaaggaataggagatccagtgttgggaggtgactgcagcaggagccccactgggggaatggtgtgtggaggcaaagctgaccctagaatcctgcctgctgatacgtcggccaaggccactgctcggataagtcttacttcctgcctgtgttgaaggtgccacccagccctgtctttggggacaatccccctcagagtccaggaagacactataggaactgaccacaccccatgaattctgggcagaatccagctgtttgggcaggtgccctccatgagcacagtgctggccactggggtggaccaaagcgggcagtacctcctgggcatttccagagaccccaccacctaacatcaagcctcatgacacccccagacaaacaccttgctcttgatctaatctcagactggggtctcagtgcccaggggccatgcaccctgaacagccctccaaggcggccacagcaccttttctgaagtccagggtccttgtactatcccctcccatccctgccaggcctccgtgtcctctggaccctccccaagcccccaggccattcccttccctttcagttctctgctactgtttccctgagtatgggggctctctagctagggcaggcatcagaatcccctggacggcttgtcacacacacatcactggcctcgccccgatttccgattcaccagctgtggagtggggcccaggaaggcacacttctgactaactcccagatggtgctgatccaaggaacacactttaagaatcaatgccctagtgaatgtcaacagatgctatttctgcaggatataaggtatattataagagaaaaacatttttaaagggtgggggatggattttgttcaaaccactaggtgaaatagtgggttaaagtcaaaaagttttcttactgagggacttttcagagcctttaatctacaaattatgtgcacctgcacagctgtgggcttcccaaacaactctgactgcagggccctttgggtggttatctcaagtcaccagagccccacagggcctagctgaggaacattctgggtgcacgggacacataccattccaggggctaagtgcagaagtctacactggactaatgtccagccaaaggaaacttgcactcctcctccatccccatggtcagaacccggcaccctcccctccacccctggtcaggctgaagcttctcctagcagctgtgcagacctgaaccctgctgagaaaggggcttgtctctacaggtgaagacaccgagacaaggtgggctcagtggctccaggagccacgcagacgtgcacccaagggaaggccgagcagtctcacctgccct

SEQ ID NO: 40693 - DNA, 1588 bp, Bovine  19866881198422
gggagcagcccctcttcccacttggaacaagagggtgccaggagtccccagcacgctctttcttcttgctgaacaagatggattggaaaacaaattggctcaaataaagcatgtaattagattaaagcctcttgcccagagcctgggggactgcaaaagccctcccgactggaggcgggagacctcggcaagctcaaccagtgcctggacatcgagaattttctctcagccctcagctgcccatccccagtccttcccagctggggcgaagtacaccgaggggcttcgtcctatcccagaggtggtccccagtcctgtgctgccaccagccccgcaggcctggggtcccctctctcctgcctgcagaccccacctcagcctcagagggaggctgtgtccgatactcaagccccacgggagctcagctgaacagctgagtgggtgctatacctggacagtacccgccagagcactttccacccatgaccccatttgagctgtacaatgaccagtaagaagccaggcaggtggtattaggaccaccatttccactacacaggagaacacaggcccacagtgttctgcatcccaggtcacgtccactggggacactttccctgtcaccaactgcccctcactccaggttagggccacccagaggggtctttgtccacaaagccttgggcaacctgatgactgagcactgacccttaacctccccctacctctgatgcaggggccgcccctcctcaagggaccacactctcggcttcctgtcctcaggcagaatccctctgcccagaccccccccaccctcagacatcccatcacagcccttcccatagagccagcatccatcaccatgcccagtccttcctcccaccagccatgcccttaggaaacacaacctggggctgtgatcacaggttgccagaggaaggcaggagcaggcagaccaagtcaagaagctgctgcacccagagagtagattgcttttcctgcaactgcttctgatgtagttccccatcaaaataggagatgagcttctggcccttagaagcgaatgaaagccttggcagagaaagcaggcaggacactctggagtcctagtttgaaaaggcttgatgaggagcaacttatctctagaataaacacaacggctgcccaagaagacagtgattgggagcaagcgtgaaagcaaaaaaagcaatcagacagcatgcatgcttaatttccatgtccaagctcatggcagacattactaatcaacctcagaacccagaggcccagaactcaatcatgtgctcttgctgctcagtgagaaagctgtcacactcctaccaggtggcgttagtggtaaagaacctgcctgccaattcaagagacgcaggtttgacccctgagttgggaagatcccttagagaaggaaatggcaaccctctccagtattctggcctggagaacctcatggatagagaagcctggtgggcctagagtccagggggtagcaaagagtcagacacgactgagcaactgagcactcctgccattcctggtttattctgccactttgtcaccaactgataga

SEQ ID NO: 40694 - DNA, 902 bp, Bovine  19866881202990
tggtcggtgcaccaggttgtatcctggggtcccaggcagaggcatcctgtcctacggacactctacttcccaaggagaatgggcaaagccttcatatccagagctcagggtgctgtttccggtatcagctgcgcctcctggcagaggcatcaggacctaccccccccgatttctggagtcactcaagccctcgccagcccaaatcatgccctctttgttgtcgaagagcttagcagatttaaaagatgcctgaatgcccaggctttctcatgggtgtccccagaataatcgagaaggatgcttgtcttttgtttggggagcctgatttggaagtttgtctgagcagtcttggtatctcacagggacaactgcattcagcttttaaaaaaattttttttaattgaaggaaagttgctttacagtgcgttcaccttgttttgcactgtttgtggacacgggcttagcgggtacccagaatttacattccagtgagttccacgggagttcagtggtgacctccccgcaccaggtgctgggaaacaaggttccagttccctgctgggtggggaggcagacagataattctagaccacgtcctgagtgctgagagcatagagggcggcctgctgtgcttgagggcccaagaggaaggctggaaccctctggtggctttgcattatatttacgcagaatccaaaccttatccagccctgccctgaccgtccagctggtgtgacttttcttctctgctcctcccctcgctcactctctgtgaaacttcctggctttcattcggacctggactctgccagggtcgatcctacctcagggtctttgcacaaactgtccttcctgctggaaaccgtcttccccaggcccttgttgtcctggcctccctctca

SEQ ID NO: 40695 - DNA, 1714 bp, Bovine  19866881212468
aaaagtcattggtcacagaaagactaaccaatcaagtcatccaggtctgacagtggagagatgggtaatgctgcaggagcctccaggtttggactgacatggagctcttcctcacatttccattaactgtctcctcttcctgtggttagacctgaccatacgccttgggcttagcagaagcaccactccatgggagtggaatgaagctttctgagaggctgctggggttcagatgatacaaccccaaagttgggggaagaggcggaaatagctctcccaagtggagaaggatggcccatggggaacagaagctaagaagaaggtgcacagagaaaaccccttgctctcccgtggactacgcaaaggcagggctcctctctgcaaaccttccagagatgtgaacatagctgctgagcgaccagttcactgtcagctcagggttaaggctagccagcatcacacggggcatcttcttttgcctctcttccccttctcacccatcctcaccactttggccttgaaagtgaaaggtgttagcttagctgctcagtcgtgtctgactctgtgtgatcccatggtctgtccatggggttctctaggcaagaattctggagtgggtagctattcccttctccaggggaccttcacaacccagggatcgaacccaggtctcctgtattgcacacagattcttaaccatctgagctacgagggaagccagcatcacagggcatcttcttttgtctcccttccccttctcacccatcctaacctttaggcttatacctcctaaataaggtgttaacacttaatccttgtctcaggctctgctttctagagaaacagggctaaggtgcctcccaaaagatcctcgttctttagaaatgaaagacaacagagcagtgtaagtatcagatttagagtatacggaaataagaagtcaaatactgacatacactaaacaaaactcatattggccttcattgtgtgcagtgtgctaagtcacttcagttgtgtccagctctttgtgaccccttggaccacagcccaccaggtttctctgtccatgggattttcctggtaaggatgctcgagtgggttatcatgccttcctccaagggatcttcccgactcagggattgaacctgcgtctcctgcactgcagtcagattctttactgctgagccactggggaagcccttggccttcattactggctggaaataccccttcaaaatccaaatggtaaaatatatcccacacaatatctaaaaagtcagcatctctgcaaaaagaagaactgaatacctaggactgtagcactgtgaagtgattaaacatgcatatctggccttccaattatacacagaacaaaacaattttgtgctatatttcttgaaatgcaactatctgttatacaaataagaggtctcccttcacactagtttagattcttgaacaggctagttattaacaagtcaaaatccagaaattaaacacaaccctcatttttagcaactgagtcaactctgggtggaatggagcactttccagaacagcagagcatgaacagcttcctgataccagaacccccagggttcctgggcctgggcacaggaccacccagcttgacaaaatgcttttgggagccataaactgtgagaagatgaggggagatggggacttccctaagtctcatgctctgatggtcttg

SEQ ID NO: 40696 - DNA, 1666 bp, Bovine  19866881221733
agcagggaaagcctggaaagagtcatggtgttggagagagctggatgtaccagaatgatgctcaccctgcaccatccagcttggccgccgcctccttcaagtgctcaggagtccgtgggaactggtgcagtgggctcctgcctagatctcactctccttgaagatctcctccatggtgtgcaccagggtgaagtagccctcgctgctctccgacaggctgctgccacggggccaggctgcgtggccttgacgaggcggggtgcctgccacccctaggccctccttggtcaagtgcaggagccgcccaccaccaggccagggccgcgccttctgcagcgacccggagttggtcccctcagagagcttcttgggacatttccccaggaatcggaagttcttccccagcacccaggccctgcagcctgagtggtgggctagcaagaagcgggcccactgttttcgcagctcagccttcacctgccaggcgagaagagagcaaggttactgcccgggaatcattgaatcctgcatccactcagcaaatgcgtgttgagtggctactcaggaccaccctacagaaacttgcgttctcactaggggaaaggaacagagaagcaaacagacacatttgagcagagcagagggtagtaacacccaaggctgttaagcaggaccacgggaggaggtaacagtgtctagaaaaggactgtgtcaaggtggcatttgaggcctgcctgatgaatcaagggtccctgtgtgaagatatagaaaaggcagcagtgagcaagacagacgaggttttgctgtcaagcagcgtacattctagtggaaggaggcagagatcaatatttaaacctggggtggggagaggggaaggatgaaagggagctagaaatcccactggctcctaagtcaggagcaaactactccagcctgggcccttccccctttcaagcctctttccaaggagcagagggctgactggggctctgcaacaataataaatgtaaccattgttacgaggcagagaaactttaccaccagcgccccagggtaacactgcagggcagggactgttcctactcccatttacagactgaggttccaagagccatggtgacctaacacacagctcctaagcgggtgagtcttcacagcttgatgcgaatttctggactctagacttgcagctggttccctctatcacactttgatcctcctgcctggcatagctccagcgggaccatggttgggttctgtaaagaaaactcaccccaacaccttgtccccggagcctcagctgcctcttctctccactggacacccgaggtgcccatttgtcccaacacatgctggtcactgcatgtctccccatggcactgtcatataaactgaaccctccagggggcagcaggatgccagccccagcctcgcaggaagctagaagttagcacagaaaacttacctctccattagcaaagcaatactgcgaggccaccagtagcccctggaatgaaaggaagaggtggtgtgaagttctactcagtagaagatgtgtctgagggtcacttggaatgtccgcaggccagccctagtctcagcagcttctacaagaggcaggcagctactcgcttgtgctaactagagttagtctagttagtacgta

SEQ ID NO: 40697 - DNA, 1171 bp, Bovine  19866881255903
tctccctctgcagcctccaggcagtacaaaccccaacactcagctcccggtagcctcaagttcaacccgggactcctcgcccttcaggagacttgcaggagcatcttgctcttaccttccacagatgtgagcagatggtcctccctggtggtaacgggtggtcgtcagacactcgattttgtagtcggatcagacgggtttaaggtccccccattccacgtcttatcacaccccaaacccagaagcaatagaagagctaaagaaaggcatatccaggagcccccacccccctacacccagatctatatataacagtgctgaagttgtcagcctaacgagccactttctggcagtcctgttgccatggcaatgactgctaatgagcccagagctgtgattggcactgcctgaaggcttctccacaaagaactctgcagcaagttctcctttctcaaccacacggccagctgggacacctgggggcagccgagacatggccaggggtgcctgggagccacaggtcccgggaaccactttgttacaggtgcgcccagagcagtcctgaacccaacggcccagagcggcctctactgtcactcaacatgggccaaccaattagagacagggctgcaaaggagccaccaagaggaccaagacctggtcgggccagagactggagactcaagtccagcccacgccttctgctgacatgtgttcagggtggagagagccccacacaaagctgggaacggctacccaaggaaagagcatctttggctacgggttaagaaaccaggcatgaagtggggccccgccttctacactgctgccgccagcccacaggctgtgtctacgagaattcttggcaccttgcctctatctcacaggtgaaagtattgctctctctggttctggcagcctttctgtccatggagagcaactcacagacactaactgggggaggaaagggggacccatgacaacagcacagggcattctgggaagtgtagtcctcacagtacttttataggctggtgggaagaggattggatgttgacagcatgttcatggtcttcgagtggatcttctaggggttagagatttggagacctggccagagtgaaggggaggagggaggaagaggcaaaaaaggtggtggaggaagcggcgg

SEQ ID NO: 40698 - DNA, 1629 bp, Bovine  19866881318677
aaactttgactgtttggtactgacctcgggccactcacctgtatttataatctctgaagcacatttgatgagctttgagcttagaaatgagaagcttgagaattttcaggaagatgaagaaattgaccttgaaaaaaaaagcagatataaataagtgatggactctatgtggctatgactatcaaggtcaccctggaccctgccatcagatccttgtccatggaaatggaatggggctggttggcagtcagccagtcaggtagttaacagtcagggtaatcacctctctcccaaaggccatctcaactgagagcctggagaggattctaaagagtcacttatccttctggttctgggacacccaccacaatagccatctgagaaaggcagacagacatttacatgactatttttaattaaaattattgagggactttcctggtggtccagtggttaagaatccaccttgcaatgcatgggacacaggttcgatccctggtcggggaactaagacccccacatgacacaaggcattgccaaaaatttttttaaataaaaataagtaaaatagaaaagactttaaaatgcctctatgcaatggagaaagagcccatagagatggtggtcaggttacagttaacggaataaagtctctatagacattgagccaacacaatactgatgtccttgtctcaaaccacagattgaaacacaagctgaagaatccaacatgtacctgttattacttgtcttattggcctggggaaaatcgatactcaaagctaagagggcagggtttcaggcaagaggctatgtatccaatctgcaagccaacagggagaagggaaattcccagccaaggaatatttagtaacagaacacttaaaggcaaactaagtgtaaccaagtaatttatcccctttaatgggatatctgtttttcatcacaaagagaaaacgctgtgtccttggcttagtggcttgttgaacttgagcatttttcttacaaagtaagcctaacagggaaaggcacatatttcagggaattaatttcaaccaggactgtctcgtaggaaatgaaggttgtgatgaatgtgttgattcattgttctttgcgtcttccagagaccagacaagagaaaatgggcatcaaccactgacatggagtgaaacaccagcctagtggaccacagaacctccatccatccaggtgccccagaactcagggctcagcagtcacagtgggatggggcggtttctcatctgtacaccatctggaaaggggctgaaggagggctttttttttttttttaacaagtttctttttcttttggctgcactgcgtctccattactgtgtaccggctttcccaagtcacagtgagcgggggctactttgtgtcgtggtgcgcaggcttctcgtcgtcgcggtggcttccctctctcggggcacaggccccagggcacgtgggctcagtagctgcagctcccaggctctagagtgcaggcttccatagttatggcacacgggcttcactgctctgtggcatgtggactcttcccagatcagggattgaacctgcgtgccctgcattcgtgggcggattcttctccactctgccaccagggtc

SEQ ID NO: 40699 - DNA, 2049 bp, Bovine  19866881376320
tgagatagataggtgcagaacctgaaagaagctttgaaatccaaagtttagtagaaacagccctgtaactttctgggggcactggaaataacagcacttattctgtccaattaccctttgatggtaggctttttattttggtttgtagatcaaagtctcttattggacttttaacctgaattgttaggaattctgcaaatataaacaatgaacaatttctacatcttgctcatgacttaaaatgtcagctgaggctaaagtttaagatctagttattagattagaaaaaaatgacagatagtcttgtaaatcaaagagcacatgtcacttacacatggcaactggactgcccaaatgctggaatggatgtgattacaaatcacaaagccacaggccttgagctttgaagatgcaaaaaaaaaaaaaagtgtgattctgacccctaattgaggacacctgggatatcctgaatatacaccagtgatgagggtttgatcgaactagtcaatgaacattgcaaattgcagtgtggccttgggtgcaccatagacgtgttgtttctccccacaacccttgatggaagtctgtgctaacagtggcaggaggaaatcactagaaaacagcagggcaagcagactttgatggtctctacttaccagactgaacttgtcctttgcaggccctgtgtctgccagcagctttgtcctggggttcatttttaaaatatctccagtggtggtgccaaggtagaaaaagctatcgtcattagccatctggggatgagagagacaaggaaacctgaagacctggtttgcccagttgatgcccaggagcccctgatcagggaggggatgagttttctctgaaccctatgaagacctccaaaagtccttgaggtgacttctgtctcctcagactcgaagatgggtaagaacaccttcaaggggagcagaatcagggccaaattcagaactgtatgaaacatcggactccaatcagcgtgaatttcactgaaatggacttgtgtctgctattagcatgcactccctgaggcatctccgaagggctcctagggtgaaggtgtgctcctccagagagaatatgtatttgctttatttcctatttcccaaagtctacattcataaaacgagtggagaatggggttatatgcatgaatatctgaatccacattaaagacacatgaataatccctctttgtggaggagactgcatttcaacaaggagtttcattgttagaaactttatttcttgtgcagaaataacatgagtggcaacaggaggtgctgtgggccttgagcacctcctggctaccctgcttcccaccaggtgaggcagattcctggggtctgatggcagttcaggtccactgaaacagattcccccagagctgtgtctaggcagcctgtccagcttcccacgggagctcctgaagtgagactctctcacctgtgcctccccaggcagtgccctccatgtccagggctcccctccccacccccagcccaaagaacatgtacttacacacatgcacacatacacacacacacacatacccctgtcttgctcagtacttttaacaaggacttgtactaatatttacataaaataacagagtaattcttactgagatgctcatgactattcttttcatctgtcctgtttggcactcagttggccagatctttctgtttgggagatccagttcccatactcgaattgtcccgctagagaaaagaaacaatcaactggagacccatttaataaatccttcatctcttctctgttttctgcagtcttttgaaggagaagctgaaaggaagagaactaggtatttttgaggatttgttatggcctggtggtctccccaagatacagttgtcatttggatgcccgaagtactagcatctgcaggctttctcatttgatttggtataatgaattcctgaagttggaattgtcacagagaatccagtatagatgggtaccaaaccagaaatcttattgaagagcagtaactttttctttctg

SEQ ID NO: 40700 - DNA, 2763 bp, Bovine  19866881376652
ctttttttgttctcactatgtggcatgtgggatcttagttccccaaccaggcagggattgaacctgtgccccctgcagtggaagcacagagtcttaaccactggactgactaccaaggaagtcccctcagcatgcttttacacttgtttatgcttttagtctgaaaaccgaaatttattgttaaagcgatccagcatcaatagaaattataaaaaaaaaaagaaaagaaaaaaattttaaatagcatacacaatttctagctaaattcagaggaacatagattcctggtgttcatgactgaaatacagcaagtttccatcaacacgaaagacagagaaagttccgggtgtaatacatacctaagttcccactcccaatttccggtcaagggcacttttgtttagaaagaaattttatttttgaacagggttgtacattgacaaggttcaaagttcaaaaaagtataaaagcagtatattcagagaaaaaccgtcgctctttgagctcctgtctcctatccacccctaacctagtttcagggcccaggaaggtggcaggggtaatataatcagtttctgtttaaacccgtccctgcaaaatcttctgttgctttgagtctgaagagaaggtggggataagtgtggggtgaggaagaaggagggccagctacagcgagagctgactttgtaaggcccagtctccagaattttgcagaaccgctcgttctccaagctgaaggccctaaagaaatttcatttcccctcctgccaagcctaaagaaagctttgctctcctcctttaagtgcagaattgtgcactggccggtttcttcttccctttacagcttcctccaggctcaatctgctccatctaaccaaaaagcgctctctgtctcaatccagtttaccagcatatcaacatctctttaaatagaatgcaaatttaaaagccactcctaaaaatattaaaatgatttctccatcccctgccttagcctatttataatgtcagccgatacatcatcccctgagtatatttctgctgcctgctatataaagtagaaccttcttttgttggcgtgtgcttggatgattccactgagctgaatcctgccccatgcttcgttctccaattccagattgcttactgggaagtgttcgacggctcagtcatcagagagttggacggttccttgtccggggctgtcaacggcatggacatcacagtggaaggggtgcattttgttacaggtcagtcctggaatcagagaagaaagccaagcttaacttatttaaatggaaacctggaattccctggccagggggcaactgcagtgaccccagaagggtctaaagggcaacgaggttagattcaggcctgtgcgctgcagcctatgtggctaggaaagaaaaatccagaagtcacatttcaatgagaagacacatttgcctacgagcctgaggggcacaaataaaagctaagcttccactgtttgctttttctttgtgatgggcagcaatgatatgtgctaagttacttcagtcgtgtctgactctttgcaaccccatggaccgtagcccaccaggctgctctgtccataggattctccagacaagaatactgaagtgggttgccatgccctcctccagggaatcttcccaacccagggattgaacccaggtctcctgcatagcaggcagattgttttctgtctgagctacccagacagaatatgtacacacaacttttcaaatattacacagcaagttaacagtattcccagagcaattttggtcttcagtgggatgaacatgcttccacgggcaattcaaggccccactccccagggttagagcctcactacccccaaggtggccctatgttgtttagctcctaagctgtgtctgactctttggcaacgacctggactgtaggctgccaggatcctctgcccatgggacttcccaggcaagaccactggagtgggttgccatttccttctccaggggatccatccagattagggatcgatcccacgtctcccgcattggcaagaggattctttacagctgacttaccagggaagaagcccaactggccctatataccacccaaattaactctacaactttttttttctccctctccaaatctgtcttaataaagcattccagtttccaaaactgacatacatgtgcctgagatccacattcttagacaagtaagctcctgatgattccaccttaaaattctctatcttctccatcttatattgataagcgtatcaccttatattgataagatatattctacctaactctaaaaggatatgctgagttttaatgtgcagatttgttttcaaaatctagtgcaaaatttccatttccttgttttctctgaactggtcaaagaccaggtactggagggtacaagaagtcgtgttaatattatccttaccctcacaggatgcactcagtagataaacaatctctaagacaaaatcaataccctttctcactcattccaagaagagcctgctatccgaggaacctgctccgtagagatgctagaacaggtcttttgtttacaaacttggcctcataactggagcagctctttcagatgatatcatttctccctttaatgaagctattattcacactgttcttcttagattttcctttttaagatcatatgataaaccaatgttcattttggaaaacagaaaagtagaaaagagagggaaataacattcacaactat

SEQ ID NO: 40701 - DNA, 1497 bp, Bovine  19866881387308
actgatttcctttaattgactggtttgatctccttgcagtccaagggactctcaagagtcttcttcaacaccacagttcaaaaggatcaattcttcagagctcagctttctttatggttcaactctcacatccatacctgactacctaaaaaacccatagcctttgactagactgacctttgttggcaaagtaatgtctctgctttttaatatgctgtctagttttgcataggtttattttatttttaaagtatctttaaaagagcctaagtttttaattttgataaagtccaatttatcaacttttctctggtcacttcgtagccctctcagttattagccagactgtcttagtacaacagagtttgtgttttaagtgaccttattctacttagtttattggttttagttgctaagttgcatctgattccttgtgaccccatggactgtagcccactaggctcctctgtccatggaatttcaggcaagaatactagagtgggttatcatgccctcctccagaggatctacctgacccaggtatcaaacccatgtctcttatgtctccttcattaacaggtgggttctttaccactgagccacctaggaggccccattctacctaataacggcccccaaaagtagtgatgctggcaatttggatgtgccaaagagaagtcatgatgtgcttcctttaaatgaagagatgaaagctcttgagttaaaaaagaaagaaaaaatatcacatgctgaggttgctaagatctatgaaaagaaccaatcttctatctgtgaaattttagagaatcagtggtgcttgttgtcacacttcaaactgtacaagttatggccaccgtgcatgatgagtgcacagctacaacagaaatggtattaagtgtgtacagttttgaaagacactcacagacacacacacacacacaatatccttaaaaagcaccaattactatgcgtaaagacccccagtgtgttgttagttggaagaacataacacatctcattttccaaaaccccaaagggcagagacttactaacactagccttgtttgggcaaaaattcaaccctctactagaaatacaggtaaacatggccagaaattttgggaagtatttgatttcttagaaatatgatcatttgcagaggagaaggcaatgcctgtgtcctcactgctctaaagagagaacctttccttcctgtcttggaaagtttagcttttcaatcttggtttgcggtctcagttgcctgacctgagcccaaagcaagtggcaggcatttcacaccagctggtgagttcgtcatcaccacgtcccttcagagtcacctggggaacctccccatcagtatggacgccttgaccccaccacatccccactgactcagaatctgtggaaccattcaatatttatgaagtacccactgtatgtgaaggttctgtgcactttaccatcactgtgccagagggtggcagctgttcagat

SEQ ID NO: 40702 - DNA, 2144 bp, Bovine  19866881403577
tggtgactctacatccccaactgttccccatctacccaccctgctccctccatctccatcactaccagtctccatcattcccagtgctgcctcccttcatcaccaaaacaactcatttctttctttctttgtttttttggccgcaggccacggcaggtgagatcagattccctatcagggatcaaactcgtgccaagtacagtggaagctcagattcttaaccactggacagccagggaagtcccaactagccaatttcttaaatggataattagaccacatgctgccttaaactttgaagtggtctcctatggcccttaggctacatacaacccatgctaccagattgcccgtccaactctccagcctcgcctctccccacccttcactacttggcagttctctgttccctgaacttgcatcatctccaccccagaccctttgctgctttttctgcctggaatatcctgtccccaagtatctgaatggccagcttcttgtcactcagctcgcagttcgaatgtcccccctgaaaataagcctcacctgatcattttatctaaggtcggctgcctccccaacctcccaagttatcatttcactcattgttatcacagattgttgcatattatgtgtgtattaagtcccttcccaggtggcgctagtggtaaagaacccgcctgccaatgcaggacacgtaagagatgtgggtttgatccctgggttgggaagatcccctggagaagggcatggcaacccacttcagtattcttgcctgaagaatcccatggacagagaagcctggccagctacagtccaaggatcacacggagttggacccaactgaagtgacttggcaggcacatatgtgtactatctaacacctcccccaatacatgctttcaaactgtgatgctagagaagactcttgagagtcccttggactgcaaggagatcaaaccagtcaatcctaaaggaaatcaaccctgaatattcactggaaggactgatactgaagctgaagctccaatattttggccacctgttgcaaagagctgactctttagaaaagaccttgatgctgggaaagactgagggcaggagaaggggatgacagaggacaagatggttaggtagcatcactgactcaatggacatgaatttgagcaaactccaggagagaatggaggacagaggaacccggggtgctacagtccatgtgggtcgcaaagagttggacatgacttagcatctgaacaacaacaaacccccaatagaatgttagttaataagaacagtggctggggtgtgttcacagctcaagtctcagtacctagaagggggcctggcagagtctatgtaagtttatattttttatatccttcattatgctgggaaatctagaactccaaataatgtgttaaactcagctctctggtaataaagaacaaatcagaaagatctcacccacttctcagcaatggcctggggagatcctaggccttcacattcatgttttatagaaccatcttcaccaatactcctccttcaagcaggatgggaggcccaggagccagcaagaaaggaaagaaatactgaaagttggaaacaacaggagtaagtgcttaactgtgattaataatgggggagacaagggagcttatggtttctgttgttttacaatctcagggtaaacctggcaatgtgaggctggttaccagcatacaagtttgctgaagccttaggcaacacattttaaacataccctattcttacctgtattgtgctttggaagtggctttgcacaaagctttggcccatagaaagtggagctgatggtgacagaaggttctcagaggtcttcctggcttcaggttgaagctgcaaagaaatgaggggaggaaacaaaattagccatgcctcccatcactccactgcatccagaccaacgagactccacctcctcctgggtccacagcatccctttctgggactagacctgcagaaccaggctttccatgttgcttaccataatcttctgctccttcgatccctggacctccccaattccctgagagagtgacagagaaaggaaagagacagaggtaatgtgtgttgtgtgtgtgtgtgtgtgtgtgtgtgtg

SEQ ID NO: 40703 - DNA, 914 bp, Bovine  19866881503778
aggctcagggattcactcagcagagttcaaagagggggaaccagaccaaccgaaggaccggcctgcagtgctggcctacaacacgtggaccaaggaactttcaaggataaggcaacccgggaagaagtcctcgtcctcttccttcctctgaaggtggtcaatgtgtaaggggcttaaagagaccacagaagtacagtcacagaaaggcatgctgaatggccacggggtgccaggggtcacacgttacgagcctgttcaagctgatgacgggtgtttgcctctgacacgctgtgcaaaacgcatggagagtctgcctttcagatgtgagctgtgagggcagatgctacaggtgtctgaggataatattaaaatgatgtcattaatgtctcctcctccactcccccgaaaaaaagtcgaagagacgatttcaggatgtcaggtttggctttgaaatatttgttggcttacatgaaaaaatggtctgtcagatatttcagaaatcatttcaaagcaaaatacaaaaagtggaattctgacacagtcccaaagaaacgatccagctttcccaccccggcctctcactcaacatgcaccctctctcacaccttggcaccttggcagggactgttcgcaccaattctgagccccctgccaacttctacagccggcaccccaacactggcttggggcctcagctcaaaaacattccctcccccagggacacctcctcccgtgtgcccaaggcggtctctgaaccactgtttctgggcggcttctgcatactgaacatgcgcattagagacattgacttaacacttggggaaattaatgactgactgggttcaggctctacctccctaaggccggaaaattctgagaggacagaccttgtgtttccatgtccgtgtctccaa

SEQ ID NO: 40704 - DNA, 1370 bp, Bovine  19866881604766
ttgaccctccctggcccctcctaccagggttgccctcctaattccaggcctgggatgttcaatctgcaaatatattttcgtcataaggcagcaggttttgaatctctgttattaaagtccaaacaaaacactgaagcccttccaaagtccctggagagggaaggcttgccgtctcccgctgtcctgcccaggagaggagctgctctcgccaagctgcggctttttgtgtttcacagcattttccagaattgtctttttccacccttcagaatcctgcttcaggatttgctctcctgctgtttacacagactctgtcctggggcggcttcttccccggcaggcctggggtcttcacccttggactgcggccgtgtggggattgctggggccaagggtcactttgccacatggtgggggcggctgagtcccccgcttattcaacaaatatttattgagagcttgtacgtatcccaggccctggggagagcagtggaaggggcagtggcccctgccttcagggagggaggcagacaaaaagcaaaccatgttgaaaaagtgtgagaccgcactgtgacacgtcctgggggtgggagaccagactgtctcaagatgggtttgtttttgggggcagccaaacatcagtcagtaaatgtgatacatagagtgagaaattaaaaaaaatttttttttaatagggtatgccaagaatacaagattggttttcttgtcatggctcctgaattatagcaaaaataataacaggtaacatttttaagagtttgttaggcttcatcttgttagcacctcaaaggattacatgctcttaccctatttaataaataaggtatatggggaaagagtccaaaaaagagtggtatatgtatagctgattcactttgctatatgcctgaaactaacacaacattgtaaatcaactatactctaacaacaacaacaacaataagtctggataataaaaaataaaataaatgaggactctgaggttcagagatgtgcagtcacaagcccaaggacacacagcttaagagtcaagaagccagtgtttggagttcctccatagcctacctgctgactgctgctccatcccatggccttgatccccatctgttttcccatctgtattttgagatagggcttcccaggtgggttcagtggtaaagaacctgcctaccagtgcaggagtctctggacctgtggggttcagtccctgggttgggaagatcccctggaggaggaaacggcaacccactccagtacacacacacccacacccacacccacacctacacccacacacacccccacccctatcggtcggtgcaccaggttgtatcctggggtcccaggca

SEQ ID NO: 40705 - DNA, 1699 bp, Bovine  19866881669698
taatggatgtcccatgctacctactgagtcctcttctttcagtagcaatcctgttaccccccagtagtgcattctcttctaaagaaagtctgccaactaggaaaggatgtcaattagtacttccttcctctactgtcttccaagataagtctagtgcagtaggatcattttttggcttcaaaactcagaccatggagacttgaacgccagctcaagcattaagacctgggacaggagacaatctctctaagctccagggattccgtctataaaagtgaggatagccctgttgtaaattgcatgtgaacagatcaccagggcatactaccctctcccgccccacctcccccatccagacttaatcccagcacactacactaccctttcctccccaaacaagcacatcacccatcaccacacccataacagctccaaaaattttaataaagaatttatagaaggtttcacactgagacaggttacaatgtaatttgtacaaagcagatcttccctttaaattaaatttttttttaaaagcgctgctttgtcatccgctactctttccccagaagcaccctcgggcttcgtggtcagcctcctggcccatcctggcccaggcagaatctctgcaggtcctctgccctgtcagacaggtgtcgggaagcctaaattcctgggagtcgaagagtattcatttaaaagagaagcagcagcagtatttcaccctgttcaattattccacgcaaagcttgacttagagagttcatggttccttgacttgtttccaagagtgaagatgagcgagcgctccgctctggtttggaatgcctccggtcgccgctgtgctcctcaaagggaaatgtcatgcctgtttatgccggctgttcacagttcagttactggaagcagaaagtcagcactgatactaacagcctccacagccaagttctcttatttagatttcggttatcagagctcccggtaggcttgtcattgggttggtttctccctcctgccagagaaacaagggtttgttttctgcctccagatcacttgcatttatttccattcctttcctggactttttttttttttctctctctctctctgaaacatcatttcaggcttttcgtcaatttgactaataatagtcaacttgattattgactagtgtgtgctacaaggaatacttccaacagggaagatgtattttgttgcaataggcttgaacacggctattggtggctattaatcacataacttctatctgcatggagtttatgggcttcccagatggcacagtggtaaagaatcagcctgccaaatgcaggggacacagagatgtgggttcagtccttgggtagggaagatcccctggagtaggaaatggcaacccgctccaatattctcacctggaaaattccacgaacagaggaggctggtgggctgcagtccatggggtcgcagagagtcagatatgactgaacacacacagcacatacagagtttatggagttaatgcaaggaggttagggaagccccatgttttcctagagtaatcattttattggcatcagtgtctgtacctctagtatttgagaaaattttttaaatcttaaagtatgataacctgtcccccctccccctttcctttcatttgctccctacagggtgaacctcacccatcagaactaaagaa

SEQ ID NO: 40706 - DNA, 1572 bp, Bovine  19866880538886
ggagcaggctgatgtaaaatgaagagtgaaacaccaagcaggcaaatcctgaggggcagagggtccatgatgttacaatttatagtcagagcagccatcattcttgctaaaagttattcatgtatgatgtatttttgaaacaggtctcctgacttctatgaagaagtgaaaattaagctccctgctaagcttacagtaaatcaccacctcctgttcaccttctatcatatcagctgtcagcagaagcaaggaaactcagtagaaagtctcctgggatattcagtgagttgttttcaactggcaaattcacactgtggttgctggtgcgtccagggtacctgcagagataagcaactattctcttcacttgtttttttcctgttagaagtagcagagcggagatgacttgacttagcaaatgacaatttcaggaatgaaaggtagtaggtgatcgatactgaaagaatactcatttataaaaaagcattacaatgtgcattatttccaaagtgtgtgtgtgtgtgtgtgtgtgtgtgtgtgcgtgcttcacatataaaaataactttttcctccaaggagaaagagttatttctttaaaatatataaaagataaactgaaccttaatgtttagacacacacaaacattagccttaaagaaaaaaatgctactagtttggctctgaaagcagtgaatcattgataataccatctcaggagctctcaaggaatttaaaatgcagagaacttgacagaaattactgcccaaaagagccctggtcaatatctaatcatcatttagttgcatttgattattgtgagctagacaaattgccagaattatctgctgtgataaataccattttattctttacatcatctgtttcagtggctgccaattctcttaaatgaacgtcttcaaactggatcctactgtctcccagttgccttggaaaagctgccacccaactactctatgcattctgcagaggtaaccagcaagctggccatcagctgtttcctgtccagccatggtcttggaccacctttccagacccacttcccatttctttatacatgaccaaggatgctcagtgcattttgggcagctgtcatctgtcagcacaggaggtcttcagagagcacattgttctgataggatgggagaaataactgactttacaacctcattcatttaaattattaccaattcagaatgtttgataaattcaaggcagcattgcaccttatattatctatagcagagggattttcagaatagtgtattttaaaagggaagcaaatacagtccactttgctaacagtcactctcagctcccttccttataaaaggttcccatgctagattctatcagtttctcctccgggtcagttgttacagtcctcaggtggatattggggctcttactcctctaaagataccagtgtcaacagtctttccctcctgtttcctgtgctgcctcttttgcccacacactcagctgcagtccattcgttcaaaggagcccagtgaatgctctgttctgcctgcaccagcaccagctctcatgctt

SEQ ID NO: 40707 - DNA, 1290 bp, Bovine  19866880601988
ttcttggtgtcctttgcagctagcgtgctagaacataatgtggttctggttgtatctagaggatcacttacaggagtccctgagttggaagtgagctacgtgaggcagcagcaaggggaggtgatttggcaagcacactggcagatgaacctggttcttctggggctgctcttgcagtttcaggcatccagttcccaatttcactggtgccaaagaatgggaagcagcaaccatggtgccttttttagaaccatactaagacagtggttttcaaagttcactgtacatcagaaccacctagaaaacttgttaaaagattgactgttggccctcattcccagagtttcttcagtgggtcttggaggaggtctgagaattttcattactaccaaatgtccaggtgatgttgatgccactggtctgggagcacactttgagaagcactcttttaagagctgactcctcatttctcctggatatattgggcctgtgtacaatttccaggcctgtgtggccttccaggagattcggtgactcattaacaccctttggtaaacccctttctgcgtaacccagcttgagtagactctgttgcctgcgactaagaacccggatccgtatgcttatcattttctgcagatctttccctctcctcagttgggatctccatgtcaattctctatccctggctctattatagaagtcacatgactcatgctgacacaaacccagtcctaccagatgtccttctgtttcacaatcatcatatctaaataaccccgccttgttctacagtgtcccccatcttccaccttctccaaaactaatcaaaccaaaactaatcaaaccctgttcttcaatgaagaacagggttaggtttattgcttaaaggcaaaaatgtcttgaatttagcactgaagtagccccagagaagaaaagtaatattacaaggaagtctttttatgtgccagagggaaaaaaagccagatgccagctgtctacctcatactaatttttttttttactatttgaacttctttttttcataaagcatcttaatgtgaaatataaaattaaaaaaaaacacaaacaagctaaaagagccctctctgaagagtataagagtggatatgattgataaaatggtatctcgctagacagatctatttaaaaatcagttaaaagatattatttacccaatgaaccataaggagtcagggggaaaaaaaatccaaacacaataatagtccctcaggtaaatgccccttcagacagtttttaaaatggtat

SEQ ID NO: 40708 - DNA, 1292 bp, Bovine  19866880675865
agagatttggggttccctaactcaggtgtggaattattctaaaataaagctatgtacaatgaagactttacctagagcctgagacaggaaggcaggtgtgtgttcatgcatacatacacacacatgggaaggcagaagggaatggcactgcttggtaaaatcatccaagatcagcagatggaaagaagatgggctcttgagaaacttactgcaaatgataagaatgagagaaaattaaaatggagacacatattcaagtaaaatatagtggaatataatcctagacaaagtaaaagctcagcttgcaaacacctgatgaagcctggtgaaacaacctgtttagcatcagatctctgagggaaaagtacatctttcagagtgtttctgtggctgagcctggtgggctacagtccatggggtcacaaagagtaggacacgacttagcaactgagcacacacatgggactcctttaggaatgtaggacttacacggagatatgtttttgtatgtactatgcattttatgatgtttttaagtcatcagccttgtttaggtgaatgtattaaaatacacaaaaataaatgcagttaaatccatttgtactgccgtaggttacaaagagtaataggtcctaaattgttggccttgttatgtccctttgctctctggccccagcagtggcatagtcaaattgactggcaggaaaaagaaccatcctgtggaggagtcagaaggaaatttcaacactcgaatgattcgaggatcaaaggaaatctatggaagagaactgtagggaaccaagtgcttcaatggcagaaatcaaactcaccaagtttaagacaacaaagctaggttctcccaaaaggatggacaactttcgtttgcccagaacttgggagtagagaaccaaaacattctttgccaaatattctgcctcaagttgacaatacacattgggacacttcacagagctggtgccaacaaggtaatttgagcaccaatggtgaggaaccatttatctgagattctatcactatgcttatcctgagcaaaatcagagcatccctgacacagcagctatagttacatccctgacaagctatagttccctcctggaaatgcaagacggtggcccagaaggcaaagcctcagaaaggtataggagaagagagctcctcagtctatgggattttccaggcaagagtctgggaggtggggttgccatttccttttccagaggatcttcccaacccagggattgaacccaggtctcccacattgtaggcagatg

SEQ ID NO: 40709 - DNA, 1068 bp, Bovine  19866880728804
tttaatccttacttgacccacgaagcctggttcaaagtgaatgggtgacttgcgcaaagttttttagctcatgagaggaactagcagttgaccccaggccacttggtttcctaatatgtttccagtttagaactagaagcctatattttaccttcctgtgactggtttgtcacactgtgggaagcctcgtgacctccacgttcctagggtacaaaaggcgagaagtaaatagttctattccccagagcattttctggaaatagatgatgctgttaaattagatgtcaagcatacattttatatggaagtacagatcagtttgcaaatgctggacttccttttatttttatttttgtctcaggaaatgctgaacttgcctcattagctcggagggactttaaataattcagagagcacattgtaccatacacttgttccaaacttattccgcttctagagacaaagaattgcagcatgttaaaatagcctttataatctgttggtttctcttgcctaggcattttatagtcaatgttttggtgcagaatttgtagaagtgataaaagactctgctcctgtggacaaaaccaagttggaccctaacaaggtatgggaatattgcaaaaaatagccatcaggctctgattccctttgttctacccccaaaacataagatgacctcctctgtctggactccacgtcatttcaatgcaaccagatttttgttttgttttgtttacggtttaacggttaagtcttaaaccatactcaatggcagggatcttaataggagccaccatttattaaagaccagctgtatgcctgacactgtattagaccctttacatacactgttgcatttcatcctcctacagctctttgatgtaaatattgttattcccattttacagatgagaaaagtaagatctagaataggtaagcaacttccaagatcatgcaagtgtcaaagccagtattcaaacttggggtctgtgatccttaaacttgcacttctaatcacttctttactgcccttctattaaaactttgaatcctcagtttaaagta

SEQ ID NO: 40710 - DNA, 932 bp, Bovine  19866880735163
caaagggattgtcagagctcagcaaggaacagaggtagattccacagagtgcaagcctccccacctgagggatccttaggtttgatctcctttgcaatatttcagattttccaagttcatctttcttagttttccaaaccttgaacttaacactactgaaattgcctgaatttgttctgtgaggctcttgctgttgtcagaatcctgtctggctctgtgttacctcccctttgtcattttccttctcaactactagcctcacacaatttcttccagcattgagcaataaggcagaaatctcattgcctgctctatcctgggttctggcaggtgaatttaggaacacatccattaatagatgggaaaagactcaaaacaaaaaataaacaggagaaatgtggaccaacataccagggaagacaacatggttgtacttgtcttcaaattaaaatttccagctatagccaatgccacattctgattaattgcactggtcccttcttgttcttcatctgagccattggcacgattttttccacctcgagcttctgcagctgcaatcaaaatattattgaccttactacatgatccagcaatcatgcttcctagtatttacccaaaggagttgaaaactgatgtccacacaaaaatctgcacacagatgcttacagcagctttattcataattgctacaacttggaagtaacctagatgtccttcaataggtgaatggataaaaaactgtggcatattcagacaataaaatattattcagtgctaaaaagaaatgagctattaagccatgaaaaatcatggaggaaacttaaatgcatattactaagtgaaagaagtccatctggaaaggcaaaactatggagacaggaaaaaagttcacccctccttttctcacttggtacccatacatctgttcc

SEQ ID NO: 40711 - DNA, 1077 bp, Bovine  19866880735426
aattaggactttggaagagcttctcttatttcccattctgattgactggtgccagaatgacctgtggaagagaatttgaaatgatcactatcatctatgcctaagtgttcactgaagcttagtagcctttggaattcagccttattacagcacagtcttagttggtctagattttggtgtgctgttttgcagtttacatttgtggtcatgttaatgagcgtgttcaactatattcaaagataatttggtccatggaagaaaggcagggtcctcagaatgtattaggtatagctattgaaaagcctttaggacatttatcagagccccttggaatcaccatatttttccatgggcctagaaggaaaggagaaacagaacgtcactgcctacccagagtccagaaatctcagaaatcttgcccatgtagattctgctcctctttgaagtttaaataaagttccaagaagaggaatcttggcacgaaaggagacattctgtaacccagctgtgtaggaacctttcagcgttactgcacagagctggcccagtgctcaatgaaaatttaaagggagctgacagatttatgtcagagcaatacccatttaaaccatttaaacaacaatatgaatcatgagcaaagtatggctcacatttcattgggaaaaaaggaaatgattgagcttgggtaaaggaaacactagacagttattgctgtctggctctacctcctccgattatctcctagctgactgcttcttgtttgttccaccattttttccctgactcagaactttgcaagagtaaagatgcaagtaaccatgtctctggcatctttggtgggaaaagcacaagactttaatgaggaatacctgagaagatccttgaggacaattttggcctacgcggaagaggacacagccatgcagaccactccttttcccatgcaggtagaccgaagaacatgctttgtctcatacgtgggtctggggtcagccagttttaaacctctgtgtgtgtgtacacacatacatatacatatatatatacacacacaaacatacatatatatgtgtgtgt

SEQ ID NO: 40712 - DNA, 1362 bp, Bovine  19866880739552
ctttgttaatagtgatgctttctaagacccttgacttcacattcctgaatgtctggctctaggtgagtgatcacaccatcatgattatctgggtcatgaagatttttttgtacaacacctaataaagatttgaatgaaaaggaggggcacatgaccctcactttaagatgactgtcagttggtcaagtcgtacaaaatggcatcaaacttctgttgaagtcagatttaatgctttcctttaccatcagatagcagcagccagactttcttggccagaaatgttgctgaaattccatactgcagcactttgatctctgggatgatatagccacaacatgtgattgtctagataattgtgcttccccttgaggttctaagagaagttaaaagaatcaatggcttattaattatactgttaatcttaaaaggaaagttgaatggataatattttaaaactggctagagaagatagataattactaggagaagataattacttattatatatactataactggtgcagatgggaggtttcatgcaaaataaagcagtttatcatttttgtttttttaataacttctactttcaaatgcaagtgtagcaacctttagggcacaaagcacagccttcctttcaaatgggacttttcataattctgtatctacacattgactgtctgtgtgtgatgagactggggggcatttcctttcttataagctacatagagggtttaacttagaattgattaccacagagaaagctgtcttggtgcctcattaaaaaatataatgaaagtaagtattttagcaaagcaaatatgatgagagaaaacagacttttctttccacatattatgagtttctgtaccattttgtaaccaatcttgactttttttacacactcattttttctgtcccataagaaaataaagaaatgaaagatttatgggtattaataaaataataatacttgttatactttttcctgccattcaagcttagtaccagctgtgccactcctaattaataaattctctttgcccatcttgaaaaatccatattgctgaacctggtctggggacccccaaaagttcattctagctcatttttctagtgctcatgttggaatatgttttaggtgtgtttaacaacccaagaaaaccccaaatcaaactgccttatacagtaagaaaatgttatctttttcataacttaagtccagagagcagcttttgaggttggttcagtagcccagtgatatcagaagcccagtctgttaatgtcatctcactgttattcaccgtctgctggtttatcctctgcttggtggcagaatggctgcagaagtgccgagcaccacat

SEQ ID NO: 40713 - DNA, 1129 bp, Bovine  19866880837686
tcttacattcactatttctttgttcctactgaccttcaaacaaaatcaatatcttggattggttggtgcaggatttcaaacctggcctagcggcgcggtgctgttctgccgttgggtgagacgcggagggaagtagaaggccgcccgggtggggccaggcggacccgaaattaaaaaaaaaaaaaaaaaaatcaatatctttttttcccaagaatatcttaattcataaaatgtttttattttttaataaaaaatattaaagttaatatacccaaaggaaagtgcataaatcatgagtatacagcctgacgaacgatcataaagctgaccctaacaggtcagctacataaggctaggagcaagcttgctgtcgggggtgcccagcccctctcaggcctctccttcccctttctaatgggaacacccctcggacttccaacactcattcattcaactcggatttatcagccagggaccggaactcttcagtcctggcaggtgctacaaacccaagcaggaaagctgatcttatcaatcttcctgtcagagggctggcttttccggggagggacatatttcagacagggtttggtggcgtgtgttgggaggagaactctctgaactttctgagacccttattgatgtgttgcctttattacctatttaagcacattcagcatttcataacagagcagatggagtcagagccagaatctctttgctgcctgacacatgagaagtaagtggcccgccctgctggcatgagatcccggacagccagtattgagctgtccctggaacccctgggcaaagcagctcctgcccacctgcagctcaggggttttctcttcctccccttcatagtggttctagggctgggttaactggatctgagttggggaatggggaacaaatgtttttccccaggtataagaatgccatttggtcttaggagtattttttatgcagcttctattatctgaaagttagggatatggtgcccattcccttgcctatgaaatcaatagtcttgatggagaggcagaggacagctggtttcctaaaatgccagcccttcctcaaatgtcctcaaaattaggctacaccggatttgccttccagcttctct

SEQ ID NO: 40714 - DNA, 1380 bp, Bovine  19866880841215
ctggggcatggtgggattgtggtttccgaacccagaaggaggaaagggagctggtggagcccatgcctccaaaactggccagcctgggccttcggaactcaccaggtgccacctgcatggtgactctctcctgctcaagtcttctccgggtctccatcagtgtcttggtgacatgaaggttgtgctttgggagttgtggtgatggtggtggcagctgtcggctttctgggatggtaagaaaagtaggagaggtctccagaggggcaggtggctttgagattggggttgatgtaacttggcttcggcctaggaggaatctggggcactgcctgttgtcatcactgttggaggatgagagggattcagtagaagtccacacgccgtgctggccaggtgcagccctggagtctgggcatggcccagatggcttccgtctcttctggatgttcactttcttgatggtgtttcctttctgtatgtcatccacgtatttgaggaaatctaagtctagttggtaaccatagggggtctccacaaaatagggatctttttgttccctgtcttgttctccattcagaatatcatttgctttgcctaagagagaaagaggggagattattataatgtcattaacacatacaatgataaaaactagtatttgtgtatgttgtagcacggtaagcaaatatgatttaagagctgacaaatctatgttctaatcctgaatctacaacttaacaaatgggtgttaacaaacctctcagaacttcagttcacctctgagtaaaaatggaaatacaagtatttaaatcataaggctgttaaaaatgatttttaagagccaggcacatagtaagttcttaccaagtactttgagttttttaaagaatcattgaagacttgaaagcattttcaagtagataatttcattttctgtctacagtcttttgaagtatagcagtcactaagacggctattttataaagtgtactctgaggcagagaaagtgagaagtcttaaaataacggaacaagtcagtggagagccaggaagcctggacatgagtttgcccacctactgctcttttggaaactacacagtctttctaaaccatggctgaggtactgcagagcctgaccacccctacaagatcatcatttgcctagacactttccttgtagagaatgctggggcacatgggacagtgagtgactaactccagcagcaagggggcaagaacagtctgtggatagacttcaactatattctgtggcttcctatttaaaaacaaaacaacctctatcccaacagaggaggagaagttgtttttgttttttttcccccctttgacttcttctggacaaaacatccactatttta

SEQ ID NO: 40715 - DNA, 2031 bp, Bovine  19866880844710
acagagagttgtacatgtctcccaggggtgattaaatgctgaggggaagttgaataactatagaattcattgggtgcaagtgcattccaatggcaggagcattctgtttgccggttataggacaggtttctaaaaagatacacacagcatccataagcaaacatcctcatctccctctagggaatggagaacagaaactactgcatcccaggaatgcttatctatctaggagcgagacttgggaatcagaactctcttacactgcgggcatgactgctaactgacacaactttggaaacaagcggtagggtaaataaaactgaaagtacatattactgtgatccaataattagggaacttttcatatacgtgcacagagacacaaagacaacaattctcactgcacagtgtttacaagagcccaacactgaaaaaaatatcaatacgaaaataggaaatagataaaaatatgacctctttacagaaaggaacactatatagtagtttaaaagaatgacgaaacaaaaacacacaaaactacgaaatgtcatttctagtggagaaaatgtacttattacaatattcttctctttgttaaaaaaaatcttctcaaaataaaagtatatgagcagcaatacttctggcagatggatgctgacaagctccctctgagcccccatgtgaaagacctccgagaaactgaagcaacctaaccttttggacctttactgccttagctccatgccatccaatatggtagccactagccacatgtaggtacttgaatttgaattcaaattaattaaagttaaatgaaatgataattttagttcctacactgcagtgggtacatttcaaatgctgaatggccacgtgtggctagtggctaccatatagaacatgtctatcgttcctctaaagtctactgacagagcggatcttgagctaaaaacctgtctttcagataacctgaactcttttagtcattactctttccccaatatatccttctgcccataagaaaaccaaggtaacgattaaggaggatttttttgtttgtttctagaaggaatatgcccactataattctatatttcaattatgactgaactaacattttcttgtggaaaaaaaaaaattgagataaatcatctttagaaagtgatccagccattatctgtaattttgtaagcatcatatttcatttccccaaaacttagcaagtaggaaaatagatcaaagaatgatgaaagtgttaccaaacaagactcaaaattgtagttcagtggatttccaagagcctttattcttacctgtacacagtatgagggacatatacttctcggattggaaattccagtatctctttgtgtgggcgtccccggttttcaggaaagggcctcactggcagcatttcaggagtcagacagcaattgatggtctctggagccagagatatctccagtttgagcaagcctaaatttggggagaaaataggtctgtcttagtgaagacatcatatacaaaggatcaagaaagactgctatactatatttcttttatgaaaatgaggataagttgtacaagtatgagaattttggcatgctcagattatttcctatagtttgagaaaaagcatgtcatgacgatttttgagatttggtttctagaacttaaaaaagcaagaaattgtaaaaatgagtaagaacattagaggatctctaaagtcccttctagaactactacaccataagtgcataattcagtaatttctcttcatcacaagcactaaaaattggtgattttcacagtgggttccctggtacccccagggagctgcagaagtgcctcaggggctgtcaggctgagaataagggagggtacaccctcaccttccaccaaggcacttcactgttttcttatgctaagagttccatacaatatgataaaagaggcttctctgttcacacagttatctgattttctgagtgagcaaatataaagcatgatgtttatttatttattaaacaa

SEQ ID NO: 40716 - DNA, 1467 bp, Bovine  19866880861467
cttagaggcaaatgtttattcccctccttactggcatagcactgctggcatcctctccacacataaactggattttgattgtgatgttccgggcagatgctagtttgttagcaaagttcagcctctgtgggtagacatacagaaggtttctggaaaagaaaagatgaggagccaatcagtaagacctagagtctattttaaccaagttgttcaggggatgctgaagtctgcactcataaggtgactgttctgaaggagattttcctctcagaagtgaactacctttggagaataaatgcattattgttgattctttgtcttcaactgcagtgatctgataataaccaacactgttctctgttttgctacacagacagaggtgtctgctgcagctgagaaagtcctggaatgtggaaatctgcccagaggtaactatatgtctgatacaaagataagaaaacaaaaaggttccgctcattttaaaaagaaatcatggccacaggcaatggcctaatttcatttctcctttctaatcccacgtagcacttttctaaaaaagaatcttaattgggctgcaccaggctacatgcagtatcttagtttccagaccagggattgaacctgtgccccctggttcaagtggaagagcagtcttaaccactggacgaccagggaagtacccacagtttcaatttttttattgtcatgacatattacactggtttaactttcttttcttttataagatgacagttcatctaagcccaattagctatgtaacataataatacaacactatgaataatatactcatccattcaacaactataggacaaatactaggctgactataactttgtatattttttctttctatttgcattactactactataatccactaaaaagtaagctccatgagggcagagatttttatctgatgtttttgattcactgatgtattcccagcactacactggtgcctgggacatagtaggtgctaaaaaaattacttgttgaacaaaagaatgaatgtgtatacattcaattaatcatattcctgactttaagcaacaacagcagtactaatatttataagtatcattaatatttatccacagactggtttcaaataggaaaaggagtatgtcaagcatgtatattgtcaccctgcttatttaagttatatgcagagtacatcatgagaaacgctgggctagaagaagcacaagctggaatcaagattgccagaagaaatatcaataacctcagatatgcagatgacaccacccttatggcagaaagtgaagaggaactaaaaagcctcttgatgaaagtgaaagaggagagtgaaaaagttgaaagctcaacattcagaaaactaagaacatggcatctggtcccatcacttcatgggaaatagatggggaaacagggaaacagtgtcagactttatttttttgggct

SEQ ID NO: 40717 - DNA, 1973 bp, Bovine  19866881148128
tccctcattggatacagttgacttgctgcttcctgggatgaggccacagcataggcgggaatgaataatttttaaattatgaagcaatttctttgttacaaacctgggtgcagacaatgtaaattctaatcatttcttttccccagtatagcgccctttgaacttggaaagggcattcatttttccctccttctacccttagtgggcagagagtcaggcatgtctcatccttggaggtcactggtgtttttcctgctcttacaaaggcataatcccctgagactccttcctgccatcctgaagtctcactaaagacctgtattgtatttaaaatggtaaaattctccccagggtgaattagccctttctacagccctcttttacactgcctccaacctgggttatctgtttctgctcatttcaccaaggtctgcgcctctcaggagataagggtttttccctttgaactgtctatggttttgagctgagccagcctaatgaatcaatgggatttgatttcaggggcatcaggaaaccgtttccttcctgttaattcaatcgcttcctccattgtctttgatgtggcctaaaatgccactgttagggatcttatcccttgtctttgttccctggtaaagcatatattcttgtggggaagtttaacactttaggcagtaacagttttttagagttgagttgagcttaaatacatccatagaatcctatcctgagaggaagccgtgtaaggcagagaggagtggagtgaggagactaagcccagctctggtggggcaggggccacactgaacagacccagagagcagacaccccttagccttcccacttgactagtatggtttgaaatagctacatatttaacatactttatacattataatatataatattataatatatagtaatataaaactaattcatactaatatattataatgctaatactattataatactaatatttatactaatacataatatactaatatatatttcaaaccatactaataaattctctatttatatatatattccaagatgcttcatattaaaaaattattcctgatcataaagcattaatgtgaaaatattaaaacactcataatcctacagttctgatgtacctagtctttttttgtattttcatatagtcagtatcatactttatataaaattattctttattctgtctttttcaattaacattatgttgtgtacattttctcctggtggatttttcacggctgcatagtattccatttatttaaccagtttcccatcaatctttgctgttagcaacgataatagccaacattcgtaaaatgttctaggtcctcttctaaattaaaccaacacattcaattcctcttcacaagaagagcccactaaggaggtacaggttttactagcagccactgagaggtagtaacagatccaagactcaaaccccactgttttgcctccagggtctggactgtcagtatttctgtagaaatctgatctgcggggtcgcaaaagagtcagaaatgacttagcgactaaccaacaataaatctgatcattttattattaggataggttgcctaggagtattactttctgtaaaaatgactcatttggcaacgaatttttattttcgttccttccttgatgtttacattttgcctcctgtggacgactgccctcaggcggagggacctgagaaagaaaggttagtctgcgcaggcgccctgaagtccttgaataactgcacctctaagatttgtgaaagcacgcttagatcaggcgcatcctgggcctggcctccctgttccccgagttgccttggatatgaagcggattatcagtatcactcctgtgggctgctgtttttaccgtgggtttgggagtcaatgacaggatgcctccccagccctgtatctcctgagaacagtgtgtgtactgggacgctggca

SEQ ID NO: 40718 - DNA, 1219 bp, Bovine  19866881277012
ttgaaaaaattatttgtaatgtacttatatgatcctgtatacatttcccgagagatctggctcttctctaggagggaaatttaattcatggctctctttcatttatgaatttaaattaacataatgaaaattattttaattttagtaggaaaacctagagattataatccagatggaagaaagaaatacagataacatctatgaaatactttgttataaaatttgttaaaatataaagttactttatacaaatatgagtctttttcattctacctattaatatatttgtctttttaaaacactatgtgtatctgtagatattatgtcttctgataacaaagatcgtggagagtatagttacttctgaagtatgcagagtagtccatccccaagttagcaattcacttctacaggcctctcatctgccaaggttacaaaactgggccttgaaactgatttcattttacacatgggtggtagctcataattgttagttaaggggcaataaaaaaataataaggggtgatgtagatttctcaggattcaaagactatatacctccccttcctacctcttccctgaaacctttgatatacaaccttgggtatactacaatttgcttcaattaatgtcagacttaaaaaataggtgaaaatccagttgcagaaagcttctagggtgcatcgaatcaaacttttcttctaaagcagcctgattccatgatgaagctgtgtccataggtttaatgttgcttaggccaggtggctttcccctgccccacagctacatgccacctgattactttgtcatcctgaacatgtgttcagtgctaatagggaggatttgatagcaaggcctgggtatccttgttgttgctgttcagttgctaagtcatgtcccattgtttgttaccccatagactgtagccctccagcctcctctgttcatgggatttcccaggcaagaatactggagtggtttccatttctttctccaggggatcttccctaccagggattgaacccacatctcctgcatttgcagggaagttctttaccactgagtcaccagggaggcccaggtatccccagttacactacccaaatcaagcaccactattaggaaaacagtttaaatcatgttgatcatgggaatccaatgcacctgaatcatactaatcattgttgtagttcagtcactaagtcatgtccaactcttg

SEQ ID NO: 40719 - DNA, 913 bp, Bovine  19866881310749
ctgtggatgcagtctgagactaggaaatggccttctcaggggcaagctattgacccatctaattacatcagcattatttctgtccccgtaccattctccaggcctctgttttcatgaatatggaaccagctctttctaatggaacaaactgtaaatcctagtgtgtggactgatggaaaaactgtgggttgagcacaaaatgctcttcctatctttatcaagctcaatgactgtcacctattttcacatcaaaaacagtatccactaaagccggaggttagtgaatgggcaaaatcttactgtactgacttcttatgatataagtgggatcttaaagtctaaagttcagagcaataatgctccacctttaaagctgctgtaactcaagaggtgttgatagatctaggaatagaatatcacttacactgttctggagaccccaatcttcgggaaaggtagaaaaaagttaatgacataattaaaagacacccgtgtaagctaactcaggaaacacaagacagttggtttatagttctatccatagcttccctggtggctcagatgataaagcgttattctgatgtccaccagggtcatgggtcggacagtgactccatgttatccccattactgggagaacagtaggtgatctgcctcttcttcctgcaacacttgtcttgacaacatataacttagacatgccaggtacatactgtatgaatctagaataattgaactcttccattgtgctagatatatgacataattgcccatactgctaaattaaatgagtcaaatgaataaacataaatcaggattctgaatccaattaggtaaaatattctaatttgcatgttatgggaattgaccttactctgggatgttttggtgtcagaagctttgcggatttctt

SEQ ID NO: 40720 - DNA, 1016 bp, Bovine  19866881345892
ggtgaaggttaaattcatccttaggatttcatgttaaatttctgcagcttcttcaccttaagggactgctttttcattttccatctgacaaattcattgactatcactgcttttataccttgtcctatttctaaatacctttggagaaggaaatggcacccacttgcagttaagtctagaaacccagtttaacattactggaaactaaagtaccgagtcagtaaggaacttggccaggttagcagaactcttcgttcagtgacaattatctgagacttactaaaagattccttagtttgcctattgtttttataggtaataagcttggaccaggcacaatactagcaaatggaatgctggggactgacagctaacagccccacaggccaaaaaccaccatgcatgtcaggtcaaccttccatatgaaatgaggatggagacatggctgacaggcagagtaataaggcaacctaattacactcagtctggagtagcaaaacgagcacatacaggacagagaggacctattttagagaaaaataattgtgaataattcaaagaaacaacgaaagtgcattattcttctacggactcatggaattaacatttctgtgaagaatgatcttatgtatgggcttctttctctttgctcagccacaattcccagaaaagtgggaaagactacacatctgatttctgctggtaggtctagaagatgaaatcaaacagacactcaggtcacagacttgcagccgaaagcatgttcttcccttagtgtaccagaactgtctccactggccctcctggcttttcaagcctagtcatcactccagggcctggagtatacaattcctcttttatctagaaggattcttcagtgacctttaaacccaggaaagctcaggcctgctggttccagctacctcttgatagggtcaaggggggatggaaatcacttaacattacctgatacaggagactgaactttgtcaaccagctactatagtaaaccaaca

SEQ ID NO: 40721 - DNA, 1291 bp, Bovine  19866881355977
gactgcctgcctcagcacaagaatggaaggggactctgggaatgagtcacaattgttcctcagtcacctctgtgctccgagggctaggctgcaatgtcttgtataaacgctggtattgtattctggacactggggacctctaccctctcacctccacaaaaagcaaatgcagttaagaagccagagacaaaatgttaccatattgtttagaaacactacaatgatccaacatgctctctccacactcgtcatgttaaattagtacactcaaaaacagacttcgaatgagagagagagaaacagaaaacaacagcaaactctaggacttgtcattacactactgttaaagacttacggcaggggcggggaggaactgtcgacactttctcatggatggactacaatttgaacatcaaatatgaggtctttgtatagaatacctattataactacaaagaatccgtctttgaacttgaactaactaaatgttcacagctcctgtatttcagactaccttttctattacatcaatcctcatcccttctttttttcccccatcccttcttttatgagatagattaaaagttgctctttagtgagagcttggtaagccagtattcttataaaataaagcaggacctcaagctgggacaaagagaatgctaccttttagaaagagttaaaagcatctgagctctccataaaacccacttacttgttgagaaaaagttcagttggttttcaatcacaaaagacctaaagggaaagttgggatatttatggtcttaggttttatctagatgaggttcccaatgaaaagaatcacaaatacccaagcatttgaaacatgctggagaaaactgactgctttaagaacaaaatatatctccctccaactttgcttgaaacgtttttttaaagatattttgtctagctgaaattttaccagttaagatatccacattaccaaatactttttttgaaactctgcttagcagattgaacatattatgtggtttatatatcattcactctcactttagtatgaattagtttactcagttcctgctcttcttacaaaaaggttagatttatggactgtagtgtgagtggagaaaggaaataaaaaggacgacaggagatttctcttgggggtccggttcaggctccttgcttctgatgcagagggcatgagtttgatccctggctggggaactataaccccatatgtgtcacacacacacacacacacacacaaaggattcagttcagttcagttgctcagtcgtgt

SEQ ID NO: 40722 - DNA, 977 bp, Bovine  19866881357016
ttctccccccctgattttgcttttcagatgcggggaagccgtagagaaaaacaaacgtctcatcacggcagatcagagggagtatcagcaggaactcaagaagaactacaacaagctgagagagaacctccggccaatgatcgagcggaaaattccggaactctacaagccaatattcagagttgacagtcaaaagaggtaagaagaaggcagggcagggtaaaggacagtcagaactgcagagcccctgggggtgggcgcgggtcctggaatcagagaagctgcccgagcgtgatctgtctgccctgctggcgtcccgatcctcctgcgccttctccttgacctctcggggcccctccgtgtggccttctgccagcatcttcccagggcctaattattgcctgggtttctcctggcatagtgcagaggcatggccgcacttccccttgcttacttatttactgagttccccatgacagatgtccttttctagtgaatgattttccccctccctctctttaaaaggctaactgatctttctttcctctgttctcttccctccttaatttcagagactccttccacagatctagtttcaggaaatgtgaaacccagttgtcacagggcagctaagaaaaactatcctcacccaggaagactggaggctctgtgaccctggagaaggacccgctggtgcctaaaacaggatatttgccacacaggacacaccacacactccctgagcggatgtactctgaaagctttgggacccaagtgaccgtgggagttatacgcaaatagggtgcgaccagacttcagacatttggcagatggagatgctggaggctggttcatcaggggtgcctgtgttatttgttaaggcgtgctttttcacataattgtacaaaacaaggcataaataacatctcctgctgagtggtcaggcactgcctagccaagggatgacttcctcccat

SEQ ID NO: 40723 - DNA, 938 bp, Bovine  19866880621057
aatcccatggggttgctaagagtcggacacgactgagcgacttcactttcacttttcactttcatgcattggagaaggaaatggcagcccactcccagtgttcttgcctggagaatcccagggatgggggggcctggtgggctgccgtctatggggtcgcacagagtcggacacaactgaagcgacttagcatagcatagcatagcatagggatacttaaatttcatctagaatgaacatttataagaaagcctttccttgctccctgcagattcaacactaagaagtagccaaaagctgaggtctcgtgtgcttgaaacctgggccaaacaggagttccaggacctagaagacccctcccctcagcctctgaaaactgggcctctgagtatcctgagaaacagtgtaacactcatttttgtgtttctccggttcttttggtctcaccttgatttgctttagcaggctacagaatccagccactcagttaatgagagggaattgttatgatttaaagacttttgggcaaggaagaggggggcatgaggagatgacagatgaaagaagtgccttctaattggttacctttagaggtgtttccatgggcctcacctagggctatagttaggatcaaatggaaagatgggatcattaactcagccctggaatgcagtctagcagcactgatgagatgattgctaccctctccattcctctgggctggctgctcacagagggtttgtgttgttagaagtggtgagcattttgtgaatttctgcagtgttcctaccacttctgttttcttgatagttttaactacctttccctctttatgggggaaacaaaacaaacaaacaaaaacggacctttttcttttatggtgcctctaatctcagattagtttttggactttaaagatttccttcccaggccatatg

SEQ ID NO: 40724 - DNA, 1558 bp, Bovine  19866880834461
gtgtggcttgggacacagcacagcacctctctgagcttcaggtgccttatctgtgtgatagccatcttatctacctcatctacctattaatctgtgaagattaatgaagacagtgaccgtgacggtacctgccccagcgcttggcagtatcagccattcagtcctcctcccagcccagtgcttagctgtgaacatgtgagaaagagctgtatcaagcttcagcccgattaatggaactgtttgtatggtatggcctgtgagtgtgtgccctgtcgtctgggtataagacccctgtgactgccctcaggtaacacttgccaggctgggaagacagttccaaccctgcccgttggctgtggtacagagtgatgcttggtctgataacccagagacgccaagcccagggccttccctgggctgctgaacacagactccccccaaaaactaaatgagcaaagctgacatcgtgtggcccatctctcgtcaagatggattgggatgctttgtctagacagaagtctcccttgggaaatcacagttgctctaagagaaggcacatggtctcctgttaggaatataaaacaggcctgtgagctgttgatgggggaaggaggggggctgccgtgaggtatgtgggcctgtggaacagagcctgaagaaaggagctgtcgggttctacaggcactggtgtcacaggtacaccgtcgaggtggtggccttctccttcatatgcgaagtgtcaacagagcccacagtccgtgggaagcaaccctgttagccttcccagagtcacgattctgaggagcgcttggaagaactgaaaggtaatccttgaatgtaaattacctgttgaaaagtaggcagttgtctctttgcagctcgttgcttagtgtgatggtgtctgtggttcccctctgtaggctttgtgtgtgtgtgcgtgtgtgtgtgtgtattagtcattcagtcatgtccaactctttgggaccccatggactgcagcactccaggttcctctgtccatggaattctccaggcaagactactggagtgggttgccatttcctcctctaggggatcttcccaacccagggattgaacccaggtctcctgcatcacaggcagattctttaccatctgagccaccagggaagcctgcaggctgttaaggtgagtgttttattaatacatggaagagtgaggtggctccagaaatagacagatttgggttcaaatcctggcagtgtcatgactttggccaagttacttagcatctagtgttagtttcctcatcaaaaagggagataataaagacttttatctggttgctgtgaggattcgatgttatcgtgtgtataaaaagcttagcttacttccaggcacaaagctgatattcagtaaatgatcctttgtattaaacaggacaaatcaggatgttgagtttatttctgatgaacctcacccatattgatctttgagtcttagttccccccacttgccagctgtgtgccttggacaagctatctaacctctcccagtcagtatttttatgtgttaaatg

SEQ ID NO: 40725 - DNA, 1807 bp, Bovine  19866880936100
taagcgtcttttaatttctggctgcagtcaccatctgaggactgtaaaaggagtctaatctgctcacaattacagctcaggacatactgcagggagtgccctccgcttcggtcatcagctacaatggactaagcatatttcttagtttttagaaatgtatgtaattgtaccggatccttccttcccaaggataattatctctcaaaattgagttactgcttatgaaaatacctcgattcttagtgagaaggggactcaaatggttttgtacttgaggcagatgaagtatgcagtgtggaatgctaaatttcctctccaagggagagcagcttcatgttttactagatgcgtctgcttttcctcattattcccctgttagtcaaaaaggctgccttgagctaatttctttctaaatgaaatctttctaatcagattttccactctatatggatttcatatgaaaatgatccttatcttgaaaattaaaaatattttctcctgtatttcagtgtgcggtggagataacagcctagaaggccttaaagcaaaagacagagtgacagctgattcatttgaatttgttacagcagattatgtatttgacatgccatgggtaaaaagagacaggggacaggggtcttgaactaaaagctcaggatttgaggtcaggtttgaagttcctatctcagtggtaccactattagcctagttaccttaggtaagttctttaacctctctgagcttcagtttcctctttttaaaagtgagggtgatgtcatcaatctcgcagggccattgtgaagactaaggagaaataagaggggctaatgtttaatgagcacttactgtgtgcctggtaatgtgctaagtccattatatgaatcctcttctttagctatcacaacagccttattaggtgagttcaatcatggtcttcattttacaggttaagaagttgaggtttaggttaattaacttataaatttacacagaaactgtggtcggcaatagggcttgataatgtggatctgtttaattcccaaacttcatactttttctgaaccactatgctacccgttctgaaagtttgtatttatatctttgtttacatctatgatgggtttcctgggtggctcagtagtaaacaatctgcctgtaatgcagaagccacaggagcctcaggcttgatccctgggttgggaagatccactggaggaggaaatggcagcccactccagtattcttgcctgagaatcctatggacagaggagcctgttgtgctacagtccatagggtggcaaagatctggacgtgactgacgcgactgagcatacacttagcccacacatctatgatatgtatacacattcctatacccatttttatgtctcagatataactgtctcatgtcatctgtctacctatcatatctggcacacaagtcatacagaagctagtacagtgcatgctcaaagctatgttggtaaatgtgataagaattcagagaaggaagatcacactggactttgatggtcaatagtgcttcaagaaagagatgaaactaaacccgagcttgaaggatgttgtgaccagcgtgctgctcactctatcatccattcttcccttcctcctcagtaacagaacgccctgttgaaggatatggttacagcctcccttgcagctatagggctgcagctagatgtgactaagtttggccagggacatgtaaatgaacatgtcatatagtaattccaggaagtcttttaatgggagaagtgcattactttttaatcctttcctccattat

SEQ ID NO: 40726 - DNA, 2551 bp, Bovine  19866880996289
tgccacattagcaaaatgttgattctggtacactggaaagttcttgggaggattaaaaactatagtgtctgtgtgtgtgtgtgttagtggctcagtcgtgtccaactctttgagactgcatggactgtaacccaccagactcctctgtccatgcaattctccaggcaagaatcctggagtgggcagccattcccttctccaacagtgtccatgaaagggccttaaaaaccgcaaaatcccttgcagactgcaggtatgcaaagttctttttgctgcaggtttgacagaaggcctagatctttaattttgcatctgaatgatttgtcttttcctcttttttaaactacctaccaaaaatagaaatcacctaataaaggctgactgagtgactgacgttaggaaatcacaggagttgataaaagagcaattgaatattctcagagaaggtggcatctcatttgaaattctaagtgaggctgagcaaggaacacacaattcttgaaggatttctgaagtttaattggtctgtctgaaggtgactagagctataaagagaaaaaccaaaggaaaactgagaaaggtgaggtgtcatcattggcttcaagtgattcagatgaaacatgtaatttaatgatttaacagtttcctgcctctttcccctcttttccatcctcccgcccaacattttaagaatctgaccttcagggacagagggataattacaaagagtatgatggcaggtgtccttttaaaaaatagacgttttcctggtatagcatgtgtaattgaatttttatagattgaacactccaaattaagttatatttaaataccctcagagagctgactctaggaaaattgaaatagaaacatttgtataataatagataacaatgatcaagttagctactgaacatgagaccctttgtgtacactatcctaattctgcaataacacgcaggataggaaatatttccattttacagatgatggaatggaagcatggagtaagaaatttgtccttggccacagagacagtaagtgataaaacaaaatttaaactggtttcgagaccagtctactacaccacagttgccttgagatgagaaaagttttgaaaattttcaaagtgattcttctctgaattttcacagaaaataactgattttttttggcacctaggtgacttggaattttccacgagcttccttccagtcagtcctcctgaagctcattcccttgtctactcaccaaagtgcatctctgaatgtgggtcagcaggctctctcagcaactgctgctgttgctgctgctgctgctgctgctgtcgcttcagttgtgtccaactctgtgcgaccccagagatggcagcccaccaggctcccccatccctgggattctccaggcaagaacactggagtgggttgccatttccttctccaatgcatgaaagtgaaaagtgaaagtgaagtcgctcagtcgtgtccgactctgtgcgaccccatggattgcagcccaccaggctcttccatccatgggattttccaggcaagagtactggagtggggtgccattgccttctccgtctcagtgactaggcgaatatatcacctcctcacttactcttattggcttctcactgcctataggattgtgtcaattttgattctagtcaaagccctgttaagtaacaagattataccccaggtggagtcactcctgctcagccccatgccagcaaaccaagatttaactcattttctatgcaaagtgctcccagagaaggaaggaaggaaggtctaggtcagccagtcagtacttgcctgctcagcacgttacctaagcagactccaggactgccctgtgcttcatataaggaaggttaccctgctttaacctattagcagataactttctgttcctgctctttggtctataaaaatctcttgccctgtaaagctctttcaagctcctttctatcagctagatgggatgctccctgattcataaattgtcaataaaacccataggatgtttaaaatggactcagttgaattttgctccgtaacagtctttaggatctcccctgacctagctctctagtcttgcctcttctgctgctgctgctgctaagtcgcttcagttcagttcagttcagtcgcttcagtcatgtccaactctgtgtgaccccatagacggcagcccaccagattttccagacaagagtactggagtggggtgccattgccttctccatgcctcttctacttccctataaagctctaactgtggtttccaaagtgctctagccttggtctcacctttgcctggagtgatttcttcctcgtcagtctggtaaactcctcttaagccttacctcaaggattcaggtctaaaaccaccttctctggggaagcctgtgtgaccttgccacacagaagctccttcccttctgtgacacttggctgagtgctcatgtctttcctggggtcttactgtgtccccactagaaaataaacaacttgaggaagacaggtactgaggtcttcgg

SEQ ID NO: 40727 - DNA, 944 bp, Bovine  19866881253902
cctggactgtggttggactcagcggccaggagttttctggttttcattaaaattctctggctgtctttcgggactgctcccgttggctatgactctgcactagggctggttgtactgttctctcttcagctacacacacccatcaaatctcagcggcccggaggatgagagaaaattgcaggtggggaataggctggctaaggggtcttgctcggcagtctttgtgataagggatccccatctgcagtgtcagaacttgacctttgcaaagtctttaagtactgatggggaggtagacaaaggtcagctgggaatgagtggctgagagaatcctcttggagcttactcctgaagacaaacttgcccttgagagcagataaatgtttcttggcagctgtcagaggatccccaagtgcttaatgaataaaatcagcctggtcaaatcccttttctaaggtgctgataccctcatatgccccagggattggggttgaatggcacttctctgagggtgagagatggcgtgagagtaaagaagattctggtcttgaatgttattttctggcagttgaagaaatcttatttgaggttgaaacttaaatctgaaaacctaggttcagcctagcaaactaagttgctaattgagttgctttgtgaccttgaataagtgacttccctgggtctcagcttcccagtgaggttgtgaggattaaatgagaaaactctgttaagctcttggcatatcgtatgttctcagtagatggtagatgctgagataaatttggctagttttgacctgtcactcggctcaccaagatatatcccaggtctgtcatctaaaatctttgttctgcatctgtctcagctctgtgtcttttaagaattcaaggtaaatgtgtttcctagggcaagcggatttcctttcatggaaaaatacttcaaaa

SEQ ID NO: 40728 - DNA, 847 bp, Bovine  19866881343265
ccttgcagacacggctctagaggaagaatatgcttcagggccggcctcctgtgagcacatgggctgtttcctgtctaaactaggttgctgttcaactctgtcttgcagtgagagcttttaagaaaatcgtagaattgagacacctccttgaaattgctgagagcaactataaacatttgggaggaataacagaagaagatataaagcagaagaaagaacagctcgagtctgcaaagtaatgtcctcaaaactctagtaatttgtttttacttacctttctacatgtcacgtgagggtttgttgctgaagaacttgttttttcatcccaccaaagggtttgagtttccaacctgttttcctcttaaactctcagatggagaaggtgttaagattttttaaaaattgtggtaaaatatgcgtaacatagaatatgtcaccttaaccgtttttaaggtagaattcagtcatgttatgtacattgacattttcacacaaccgttctccagaactttctatcttgcaaaactaaaacataaggaggagttgttgtttttgagacagctctgcgcgattttcagccaacacagtctctagccatccctgtcatattggacttcctgttcacaagtgtgtgacccagtcctgtgttcatggatggtggtgccccccagaatgctcgcaagcctggaggcagtgagggccccctcgcctttcacttcctgaacccaaggtcggctctcggcacatctggcccctctctagttgatgaacagctgctgagacagagggtgtcaagtgcttactcctcccactgctgctactgctagtctgtctcctttacacagtg

SEQ ID NO: 40729 - DNA, 734 bp, Bovine  19866881419079
ttatacaatgctgttttcactgaacatatcttgagcatttctcttttcagtaaatattcttttaagttataccattttcatgactaaaatactctacttatggacaggttttatatttaaataatgacttgtaatggttgataacagtgatattgtcttgattaggtaatctattatgagtgttgttaacattctcctttcaagagggatccacgtttctcaccatgagcttccaagtccaggaccaatgcatgtgtatcaaaagttaactccctttgttctaaaggagttatgtccactcgcctcatatcatatccttccttggttttggtggtgaagaagtctgaaaggagaattatttttctgtagttaacagaagcatcacactctagcttctaaagcatttcccccataaacctataatatagttccagctcttctgctcaggaattctgtaatttcaagcaagataactcctgagtccattgttcttttatctgaaaaaagtctccaacattattctgtacctagaaaacaatcaataaatgttttcttttagtattctgaaattttaagagtcagtttaagtaatataatatatatcaaggactttggatattactgccacaaaactgcccaactctcctcagaagtctttcatagagctataataattgtttatacatatgcccccatactaaagtagttttctatcctcccactgttaaacatcc

SEQ ID NO: 40730 - DNA, 2217 bp, Bovine  19866880350646
cttacctgcctccttagaaatctgtatgcaggtcaagaagcaacagttagaactggacatggaacaacagactggttccaaattgggaaaggagtatgtcaaggctgcttgtttattttacttatatgcagagtacatcatgtgaaatgcccagctggatgaagcataagcaggaatcaagattgccaggagaaatatcagtaacctcatatgcagatgataccacccttatggcagagagcaaagaagaactaaagagcctcttgatgaaagtgaaagaggagagtgaaaagttggctaaaaattcaaccttcagaaaactaagatcatggcatccggtcccatcacttcatgggaaatagatggagaaacaatggaaacagtgagagactattttcttgggctccaaaatcactgcaatggtgactgcagccatgaaattaaaagacacttgttccttggaagaaaagccatgaccaacctagacagcatattaaaaagcagagacattactttgccaataaagatccatcgagtcaaagctttggtttttctagtagtcatgtatggatgtgagagttggaccataaagaaaactgagtgccgaagaatggacttttgaactgtggtgttggagaagactcttgagagtcccttggatagcaaggagacgcaaccagtcaatcctaaaggaaatcagtcctgaatattcattggaaggactgatgctgaagctgaaactccaatactttggccacgtgatgtgaagaactgactcatttgaaaagaccctgatactggaaaagattgaaggcgggagaagaaggggacgacaggggataaaatggttggatggtatcaccgactcaatggacatgagtttaagcaaactccaggagctggtgatggacagagaagcctggtgtactgcaatccatggggtggcagagagtcagacatgactgactgaactgaatgaaagattatatcttctctaaaaaatttatttatttgtgccaagtcttagttgcggcatgtgggatctagtttcctggtaagggatagaacttgggccccctgcattgggagtgtggcgtctcagtcactggaccagcaggaaagtcctgagattacatcccatttaactcagttttgtcagtgtaataaccacagtagcaacaacaaacatttagtgcctgcttgctatatacttgagctcatctaatctccagccagactttatccccattttaaagatggggaaactgaggcatagagaaattcagtctgcccaaacctacataactggcaagtggctgagtcaggatttgaagccactaaagaatctgtgttcccattctctcttctattgtcatcttacaatcttggtaccaacagaatgtattcaagtcaatccccgttggcataaccagtgtcactgggcagaagaacaaccgtgaagaagaagaaacagcaatacagaaagtgaatggtggcatggaattgtcatcaagtgctccaagtggctccaggggtccagtgctgagcatcctttccagtctgctagctggaatacagagtgtatgggagttccgcagttagtagagtagttatttggtctgagtgcctgatgcaactttcctcccaaatcccaattttctatctgccaagataggtgatggaggtttatggttcatgttctagcacatctgccctggccagggacctacaactctgaatttctggcctgctcccttccagccaaaagtgaatctagatttacttcccttcagcaacaagcaccatctctatgccctgtgagatcctagttttagaagattcagcttttatcctggggatatcaatctatgtgtagaagtccttattctgtggaagaagagagactgaaacaaaaaataagtgaaaacttcttatccaggcagatgacaaataaaatttcagtatttcttatattaagccacctcttatacctctgttcttttatgaatataagagcatgggtgggcgaaaagtcaaacaaacagacttagttcctgtcttggtgcattcaggctgctctagcaaaatgccatagaccaggtagttcgtaaacaatgtttatttttcacatgtctggagactaggatcatcacctaagatcatggtgccagcatggctgatatgggtcctaattctgtgtaagttgggtccttctca

SEQ ID NO: 40731 - DNA, 1487 bp, Bovine  19866880412490
ggcagcggataaagcccggtgtcctcccccggagggaacagacaatcagcgggccccaggcagggtggatctcttggccaaaggcaggaacaggtgcactggcagggcacatggctgagccttggcacaaacgtgtcctgaaaggctgccagcttctgatccggggtaggttgacccagcagggcgggacggaagccggctgcacctccacccaaaatcagcccaccggccggcctggcacaatcccagcacgggagatgagctgcaaagagtgtcagggtgcacagatctggctctggaagcctaactgaaggctttaggtgggggcgctccaaccacacagacagaacacgtatgcaccgagactgggctctctcttcataaagagaaaagaaaatgcaagcaagtcacagggggtacttagttcagacacagagctcttgcaggacagcaggcacttgacacagaaaatgtccccccccactccacaccagggctggtggcagactgcgatggggccagacatgaaagcgcccccgtggcgcactaatgccaccttgttgttcggacttgactcttgttcttcaagagcagaataaagaagcccccgctgggaaccagccagaggcctggccctcttccattgcgccgccgatatcaagaacaaaggtcgttggcactgtccatggggcttgcggcagactctcttttgatttcctttttaagacagggaggggaagtgctcccctttcctggtgaacaaacctcagcccggcaaatagctggtttcgcgggtggatggagccccccctcccattgtcagtgactttgactcttagaaaaggttttcttctgcattatgcctttattagactggttctcaccccaaaagtaatggtctgaaggagatgcggaaaaacaaaacccactgcgctgttcctgaacccagtgactactgagaaggaacaacaaaagaaagaaaagctgtttcgcattttaagggtatgttcgggcaccctaagaactcagccagttcataaatgacttgatttgaaaacttccagcttgcgattcagtcattcttcaatgagaaatatgtgatttgccaaacatgaaatggaatcattaagccctgacaaaatcaatcggaggcaaagcaaaactgtggctgcttgtgccccgtgttgccttctccttaacaaattaggaatccccgcggaaggcattccagacagatgctagcatggggccctgcctggaagagggatacacgctgatcatcaaaacgcatgcagcttgactatttcggaggtttaactgcccatcccaccctacccccaaagtgcacagtcacacacacacacatacacacacacacacacacacacacagaaagagagaaaggggattcttcttctagatttttctacatttaaagcactgctcagacataagccagacacagaagaggactataaaataaaatg

SEQ ID NO: 40732 - DNA, 1671 bp, Bovine  19866880415483
tatttcagacagagaaatcattttgtggaattttaaaaagttgttcgattggatggatcttggtcttctaaaggatgtgcagcattttttcctaagaaggcactgttcagtgggcagtgacagtgggattagtcctccttgttaagtcagtccagcgtgtgatttatgtgcttgtacttccaccagactcagggaagcaactcccctttgaaacatacaaaataactttgccaaaaaagaggaaaatcagagtttcagaagaaagtaagttgtttggattagaactgaaaaccatgtggggcccagaaattttgtaatattttacccattaataagtaaatgtgcatgtacagaaggagtgggggagctcatctatttagattcaaaagcatgtcagcctaattgtattagacaacggtgagctcaataattccactttcgatccattgcggtgtgaagttcatcattatctgcttcaaattattgttcatttcaagagccacacggtgaaaaagcatgtaaggactttgaaagaggacttgtgccttccccgaaagcttggtgaagcatttctttggaaacatttctgctgaggctgtgcactggtggtgagtgggtgtagggggtgagcgtctgtgcttccccttttcaaatttgtttagctttgatacgtctccatggaaacaagacccacttctgaactgtctttagggttgtccataagaggaatgaatagaaacataaagatagctaaaattctcatatgatccaaaaatatcagtcaaggagagggaaactgaggttcattgagcccctctttgggactgataattttaaataaggtttttcctttaaccctgagagttgcactatctctgttttacatataaagggccttgaactgctgaacatttactcaaacagtaagtaacaaactcagatttgaactcaggtccgtctgattctgagacccacgctttttctataaaaccacattaccagtagtgttgaccttccctcccacctccctcaagcgttttccagaactatataaaaatgggccatgcttgatgctacctttttttgggtaaataaaatgcctgtgaagaaagagatactaggaagaaaaaaaaaaattaactggcctggataagccaagcgtgaactcagcagtagcaccagccgcatgctgaacagttgccgccaaaagttttggaatcctaatctgatccagtaaagctacatttagctaacaatccctctggtagagaacctccatttaccaaactgttagctgcattccactttgcagagaagataaggtgatggacagtaaagagtcctgcagatctggttcgaatctcaacacctacttgtgggagcccgtactaggccttgaacaacttctctgagccacagacatcaacagggtttcctgatggcacaggacttggcccccaggtgtttcaaccggtggcgataggcaacagccttcacatatccactttcatccacaatctacctcagatatttacaaaatttcagtttgtaggaagggtccacaagggctaagaaggaactcaccctaagggaagtgatctcatgtggtgagatggggccagaaaccagcctgggaatggaaaacagatgtagactcattactgtcttggg

SEQ ID NO: 40733 - DNA, 1034 bp, Bovine  19866880427600
tacccattcagaaatggcaatgtcatcattattatttaatttctaaaagattcacatgttcaaaaaggttaagaaacctgctgtaaatggccaacaagagcctctgaggatgtaaagcagggcttgatgtgatcagattgtggagaggctgtgtgcctaagaaaatcttcctaataactcttattagaaattgaaagccttttgcttcacagaagtctcaactcatgattttcattcatcctgatgcctccctttttaatgaaagtatccctttcattttctactgcgtcctagttaaggttaataaaatgtatatgagattgaaaaagtttattttccttaaagactatgtaagtctataaggaaaatgaactctaattctagaattaaaagaaataaagagatcactgaaagtaagtcacagaacaggcttcaggaaggtgaacttgagaaacaaaaataaatatttaccctttgctttccaattgtgtttgattttatacaggattctttggccctgagaattttatttcctttttctttctttttaggtccaagtaaagcaaagcttgaggagcgcatgacaaccactccagtattcttgcctggtggagaatcccatggacaaggagcctggcaggctacagtccgaagggtcacgaagagtcccagacatgactaaagtgacttagcatgctttcacacaaacaagcttaacatatgcagcacttcaggaaggcgaaagaagaaaaatgataaaccatttactctaatgatgtgaaatgcaaatggaatcaaacatacctttggtaagaagaatgtgtacaggtcatataatttctttttctttttataatataaacaagataaagcaagttaacactacctatacagggacttccctggtggtccgctggctaagcctccacgctccaatacaggtttgatccctggtcaggaaactagatgccacatgccgcaactaaagatcctgcatgccacaactaagacctcgcacagtcaagtaagtaaat

SEQ ID NO: 40734 - DNA, 3711 bp, Bovine  19866880470763
ccgtaagattgggggtccagacagtgccccagtctgtcctctggtcttcttcctcctcttgtcccttcttacctctcctgggatttgggaggactctctctcttccctttctgcccttctgtcctactttgatcccttacccctttctcctcccataacctcttctggaaagacccaaacaaacttttttgccaacccaatatttgccctccttttcctgaggcaaaaatcgaggaagggctgtaggaagagaaaggagaccattgaaagttgaaaacacattggcaaggttttcctaaacattatcccttccttagacccacctttgaattctttcattaataattttagtggattgaggacttcctaggtggctcagtggtaaagaatcctcctgtcactgaattagacatgggttcaatccctggtctgggaagatcccacatgccatggggcagctaagctcatgggccaccaactactgagtctgtgctctatagcccagcagccacaatcactgaacccacttgtggcagctactgcagcccgagcgccctagagacagtgctctgcagtaagagaaaaccaccagtgagaagcccatgcaccgcaactagagagcagccgcctgctcgctgcaaccagaggaaagcctggacagcaacaaagacccaatatagccagcaaatagataaaattatgaaaaaaagagggaggggatatataaaaataaataaataaataaatacataatgttagtgaattgaatggtggttcctgggaaagatatgtctgcatcttaagccctttgaatgtgaccttatttggaaaaagttaagtgtagatgtaactaagtaaaagatgtcaaaatgtgatcatcctgcgtggtgtaggtgggctctaactccagtgacaaatgtcctcatatgagatacagagagaagagcagaaggccatgtgaagatggggacaatgacctgatgatgcagttacaagctaagggtcacaaggaatttccttggagtcaccaggagctggaagaggtaaggaagaattctcccctagaatctccagagggaccacaaccctactgatatcctgattttgacagtctgacctccagaacagtgagggaataatattctgctgttctaagccaccccgtgtggaataatttgtaaggcaactctaggaaactaatttagatggataatgagcatgaaatacttttgacattaatataataacaagaaagaaaagcacggagcctgtagaggactcggtgtgtgggaactctattctagtaactatttttgttttaatgggagccgacagccttttccggtgcctctggggaccacgctgtcttgaccttcttagcaagtttgcaaatccctccacctgttctctttgctaatatagctattttttctgtcacgcccgtggacacccgggacactgacagagttcagaatcgctgtctctagatactgatcgtgcaataaaaatggcaagctgattagtcagccggggagcagaagccttttttcccattataagcatgatctaatgctgtaatcacctagtctgcagccagcagccaagtgcttgtggtcaggccgaggccccacaacaggtgaaccctgttaaaaggcatcctgctacatggtttcagctgtcctgtagacccgcctgtctcattccctgcaacgtaataactacatagaactcatatgtcccggagtttattacaatctccagggtcatctttaaaaaaaaagtgaaaaaaataactccaacttccaacacataaggctccaggaaacccaggaatccgctatggactgtagacatagtcttgttggctacttattttccatcagactggtgtccctgacctcaaaatagactcagtgtcttccttcatccccaaggcattgttttctggcttgacttaaaatttgaaggaatttcagtgcacagaagggaaacttaagctcagagctggccatgactatacccaagacgctgggctatatcccatgccatgcagtccctactgctgctcttccttgacacagaatcccaacatgttgctgaggacagctctcttccctcctcacctccacagaggagctcattacgaccgtgtctttcatccccagtggctagccccagggtcctctttcctctacctcagaaggggaagctccatgtccattcatatgggaacgactccccagtcttctccttgggtatacacagaacttaagaatctccttgtctaggctttcccagttcagaacggaatctccttttacacagataaaagcccaattaagtgttttttcccttcgagaaagccttggcccccacagaccaattcgggtttccatttttagcagcacaaagaattggcagaagcttcgaaattacagtctctccttaaaggctctgaagagcctagatccaattctgagatagaatcaaagcccgcatatgtactgaattccccttccttttcctccagcccatagggaacttggtctttatacagtatttgaggcatttcttcttccatgtaccagcgctgcgtgacttggaagaagattaacttgtctgaacctcagactctctatctgtaaaataggattaataataccttttgaagaaggttattgtaagatgatttaaagaaagaacttaagaaaattatttagcatggcgcctggcaataaaaaatattcaagaaaccctagactctacttcttcctctctttgtgattaagcagtggtttgcttttgttgtctcacacaggtattgtactgtagtgctaaggatgatataaagtttcagaaactagttaaaaaagatacattaagcctccagagaagcaaaaatgccctgctttattgaacatccttttagctctgtctttgcactgtaattatttaagattaattcctagatatggaattggtggacaaagggtacagacatttttgggacttctgctacatactcctgaattgccctccagaaggtctgttcccgtttacattctccacagcacttgtgtcaaagtgtctttttcttgaaatcttgagttttacctaaaatttattgacaggttaaaaaaaactatctcactgtgatccttaaactgattttcagacctggaaaacaaggactgactcaagtccaactcttgtattttaaagataaagatcttaaggtttagaaagattaagtgacttgactgattagggggcagccaaaattcatatcccatgtttcctgactctggaattctttccattatagtactctggagaggaagagttagcctggggtgaaaccactcagggcctacttactaacagggctcaattagaccagaatgaatgtgtggtagagtgaagagtcaatgaaggaaatgttaattagtgtctggctaatttatcattcaataaggaggaccagcactctccgtgttagcgccacctactgtgaaaatttcagcttgcacaggagtttctctaaaattgaagactgaatgaaggaagtcactgggagaaccggacggatttaaattgtcttcatcactttgccaacaaaggtccatatagtcaagactatggtctttcaactagtcatgtatggatgtgagagctgaaccagaaggaaggcagagtgctgaagaacttatg

SEQ ID NO: 40735 - DNA, 1479 bp, Bovine  19866880523188
ttccatggatagaggagcctggtggactacagtccatagggtcgcaaagagttggacacaactgaccaactaacactaatactttagaaaataagaataaggataactttagccaaaaagcaaacactacccacttggattccccagcgttcacagtactgaagaggctctgaactcacctttcatacagttcccggaggatggagatgttattagaatggattgttgggtcaatttccaagaaatccagaatatgatgtgggattatagcaccttcctctattagcagtgccaggttaaaaaatccctgaaaacaagccacaaaccaaactcattctttccttataataaaacttagacgtacactcatcagaatataaacttttacaacctctggatttttcctcagtctttagagccagatggctttgtcatcttcattgataaattgtttccctaaatatatgcatctgagaaacttatttgcaggagaaccaggaggctttcagaggctacagcgtcccatctgctcagaagccagtcaaccgggggaatctgtcctcctgctcactctctcaagacagaactttctggaaaacatgcccttgagttatcaacaaaaccagaacactgagtcaaaggcaatctgcatcattacattactaccctgggtcaccatcggcatgtcagaaattgaacaagctgtggctgtgggtgctgatggagagggtctctgatacacatagtcatgtatgagtgtttgactcatctttcctaggctagtgaggaaaatctcctcttctgattcctcttggcacaaatcctctactctggcatgcttccctacctctcccttattaaaatcttcttcttgacccacagaggtagggactaccatattacgctgtgcaggtgcaataaaatcacacagttaggagcctgatggttgagatgcttcataaagaatgacaactattatagtacctggaggagatgcaccatccatcatgagctgagcatgtggccagaccaagaaataaacaatgatgcataacttatcattagggctttacagagtccaaagagttgttgcccttcaaagaattaagtcatactttaatgacttatatcctcccttttctttcatttagttgattctaaataaaagtcaccaacccttggtttgtaaacagcaggagtctcacaagcgtgctatgatcacgataaaataacagagccagcatttctgagtgctgttgtatatgaggcttggtctgttttatatatattaactcaatcctcatagcaacaaatcaagataggctctattaccctgtatactactattactaggaagctgagacacagaaaaggttaaggaatttgccctatgtcatgcagctggaaaggggattcaaatgcaagcagaccggattcacagtcccaaatcttaagctccactatgctgacaaataattt

SEQ ID NO: 40736 - DNA, 1001 bp, Bovine  19866880546863
tactggaaacaggaaatactagaaacctcactagaaaatcaggtccatttctggcctagttttgccacagttttgataagcatccaaacttttgcttgtttattcaaattaagcttctgaatctcttgagattcaccccttgcagtgggtaagccaacagcctgcagggggaaaaaaaaaatcacacattttctggccaacccttggaaaaatgtcttttctctctgccaggtttactaatttacacgtgtcccaaagctgaggccaactggttgaaactgaagattttttaacaatgaacaatccaacagtgtgaattatttagattattccaataccaaactaaatcttatttattcttatttaaagttatgaaggaatatgtacattattaaaagatacatagattgagtttcaaaattacagtttaacatttatagtgattgggtcgtagaatcagaggacctagaagggaacttttaagtatgaacattcctgataggttatcttccattttcttgggtcagtgagtgttactgtcaatatggtttagttgttaatccaatgttagaaaatccttggcacacaacaaggatgcatgtgtttagagaaaagtaatcactaatattataagaaaaaacatgacatgaaaatatccttttgtaagaatttggtgttgattcaaattgtgaggctagttacttgaacttgggcaaggtatttaacttttctgagcttattttcccatctgtatggagttcaactttttctgttctccccaacctgttggttaaaaagggctcaatttaagggtgacaaggcatattcaactaatttctattgtatctagttgatggcatagtcaaatgtttctgagcgttggagtgtcttgcattaactcccaggcaaactcccttagttgtcatgttgactgccatgtggagtacatgtttctctttagttttccccttttgatgggcattgtcatatctctggctcct

SEQ ID NO: 40737 - DNA, 948 bp, Bovine  19866880558065
atcccctggaggaggcatggcaacccactccaggatttttgcctgaagaatcccatggacagaggagcttggtggactacattagtccatagggtcgcgaagagttggacacaattgagccactaagtgcgtgcacacacacacacacacacacatatgttaagcatttcacaggaaagtcattgttttaaattgctactgtcttaaagcaacggttggcccagatgctgttctggggccagcaaggtgtgaccaagaacccggaagcagctatcgagtggtatgccaagggtgccctggagactgaggaccccgcattaatatacgactacgccattgtattatttaaggtaagaatcactcaatttgtgctgaggttgcaaaattcctatcagatttcctgagcagtttgatgtaggcatgcaggcaaacagggagcctgtaacccaagaacctcggaatctgcttctgtcaggctggatggaaaggcgtatttgctgaaaaggcagagtcagaagcagttccctggtcttgtttttaatcattagccttaggtttggcacctggattctctttgcttttgcaagcattgtggcattctggaggagacaccccatattttacggattggtacatggctggcagcccccaaaggtgctgcaagttctcttatcaggcagagctctcgttgagttacagctgagatgaaatgcgtctttggctggatcccaacagtctctctgatcaaaacaaagatcttggttttaagccaacaggagagcaggggaatgggtgagaagaccattagcccaggagacagaagatggaattcaaatccctcctcggcaaccagcagctacatccttgaacttatctgacctcatgggacactggtaatgaccacaggttgagtgaaagaacctaaagaagggactccaagaacggcaa

SEQ ID NO: 40738 - DNA, 1532 bp, Bovine  19866880583648
attgaacacataatgacacatttattttttcattaaatatttttctacaatagtggtttttgaatcttttcagcagtgaactttttttaaaaaatgaaatcttaacgactatctattgctatgtaacaaaccatttgaaacttagtggctcacaaatattacaattgtttattctttcaggattctgcacattctagaggttccacaaggaagaacttgtttctgctgaatgcaatgccagatgtggaggctgtgggagccactttgaaggtggcttcactcactactcacttggggactcacctagggccctgaaatccattcattggaagaactttggcttttgccctttgtgagatgggaagccactggaggattttgggcacaggagtgacatgatctaacttagtgttcacaggattaccttggctgctctgttgagaataaactttaaaaagggggtggtctggcaaagggaggagcagggagaccacttaggaagcgattgccttacccaggtgagagtgcatggcggcttggacaaatgtgacagcaaggggaggggacgaggtgattgatttggcttaatattcatctgtgctttctcctacttattttatggaattatcatgctatatggggttaattgagtgtaagtttgaggtagtcatcaacttgactaatatttcttgaccgtatttcttcatcttgtggtttcacagtgcaggaaaccactggcgattcaagacgtatctggagttttgatctgagtgagtagcttagctcaggtaatatctgagcacctgctcataaattcactggtcttctccttgatagtgacgtgacactgattgtggtgtggtttagttgcttagtcatgcccgattcttgcgaccccatggactgtagcccacaaggtttgtctgtctatgggacttcccaggctagaatactggacaggttgccatttccttttccaggggatcttcctgaccccgggagcaaacccaggtctcctgtgctgcagatggtctcctgcattgcaggtggattctttactgactaacccaccagggaagcccgtgacactgatcagggctttgcaatttagacttcttcacagtaaacccagctcttctccagtcaggagtgtacccctgcagtggcaggaactttatctaaatgacccttttgggccaccatcttcccctcacagctgccctgtgagggctcaacagacaggggtttgactaaattgcctcccattggcctccatgcaggttggagcaatatggaaattcctaagaacagatccaattcttgaaagcctctgagcactggcatactctcctgggctacttttggcctttttcttttctctctttcccccatcagggagccccagtgttctgcagctgttacatcagccggatgccagatgagcagaacaaaagatgtaacttggtgactattcacatctgtacttctcctaagcaaacagaacagatgcccttagcaacggggctctccgg

SEQ ID NO: 40739 - DNA, 1003 bp, Bovine  19866880648047
ctgttctcatcctggaagaaaaattggtgcgtgggactcaatgaaagatgctaaggatgctactccactataaaattatttctactgttattctttgtaactgtatagtatttcaggtctgtattaagttacatgggctaacctgggcatctaataatcatctgaagcatcatcctgtgttcccttacctctctgcttttccctggctgatctctcttcctggcttgctctgattgcttctttgactggcaaatgtctacttgtctttcaaaatccagctcaggcaggcagcacccctcctggaagcctttctttatccactctggctgaattgaacatcctgctctataccccatggagtgcattgctttgtgtggtcacagtcccctaacttgtctggttccttccctgttagggttgattccttgagggtaggatggtaagtttatctccataatccctgatgactttgaacaagcatttatcgaacagatatgatagtgtttgagcatatgctgctctctacctgggatgatgttcccttctctaatatattcattctctctctttctctctgcaatctgaacggtattcatctttagtcttcagttaaagcctctgctccagatcctgcagctacatacacggacacacccatactttggcttctccaagactcatcagttaagttattgctttcttagcatttgtctttctggcctgacagtcagccccacagggacaaagcttcatctgctgccccttccagcgctgatcacaacattaggcacccaataggcttccaatcactgtttgtttaataaatgaacaaacaaaggagtcagtgagcaattatattttgagtctccaaagtcaaaacttccatttgtggccaaatactgggattactatccagagctaggatgaatgagggaaaagaagggcaagggcactagatgtgagaaggagctcacttctgatgccagctgtgctcttgcaggag

SEQ ID NO: 40740 - DNA, 1667 bp, Bovine  19866880744060
acacttgaattgtggtagtcaactggtctcaatcctaatgaggaggtgttggccaaaatatccactgctactgaacttcccaggactcagccacagtcaggaatcaacaacaggaaagagagcacgacaagtgactgtgaagggcgctgccctcacccacaggcaagttgagcaaatctatccatctctaggtgtctcacatatcaaacaaggattatggcaccagtaggacggttagcactgcaatgaggaagtgttgggaggtgaagaaagccagcaagttccctcttctgtgagcggcggggcggcacggacatctcaccacactggtttccactgtttgcttgttggctggctcgtgcatgcttcatgctgtctgtccactaatggcctgcacctacttaattgcgtgtggccacacatctgtggtggtgagtggctgtcaatgcacttaaagggtaggggaggggtttcgacagggaagtgttctccaaaattctggagagggaactggggagtgcaaaatgccctgggcttggccagacacagtgccctgggggtctgtgctgattggataggggcacagaggtttctgtttagaagaaaaacacttctagggaaagcaggcatggatttggcctttccatttccttctggagaatgctgtttataataataaccttcgcaggattgggcaaagctgcatttgttgactgagtaagtaaataagtgaacacatttagtaaacatctggcccaaggcgaaactgggaaacagataaagctggtcatgggtgcttccagattctatgttcaactcttttcttgctttttaataagttcaacaaatattgaatgagcaactcctaggctccaggccctgtgctgtggggtaagagggcagaagtgtatatgtttaaagccatccttacaattttatttgtcaatcataccttggtgacgctggaagaaacggagtgctggaatgataaaacacagcctttaccctcaagtagctcaccattgtgtcctgcgacagatggagacagctggggacagctgggtctctgtaggatgagtgaacaatagaggcatggaggcagccaccatcatgcttgctttgtcatgccacatgggcgagacttttagttctcagacgctagatcccagatgaattcatgcaacacctagtatatgtaggacactgttctttaactgggtaaatagcaatggactgaaaaaggataaaaataaaatctctgttcttgggggtcttgtggggtgaggcccacaatacaaaaataattaggcaaattatacagtagatcgtatagagaaatacaaggcaagcaagagaaacaggggacagggctgcactttcatggggtagtcagggaaggactcatatttgaacaaacaccagaaagagctgaaaggtcagttatctctggaaggaacatggcaagcagagaaattagcaacttcaaagatcctggggtagaggcgtagcatttgagggatcatggacggtagggccaggctaagtgtagagcaagctgagaggaaagcaggaggcaaggtccagctgggaggccagatgtgcagaacttggcaggttatggggaacacttcagtttttaatctatgtgtgatggtatatgctatcgt

SEQ ID NO: 40741 - DNA, 965 bp, Bovine  19866880778732
cttagcagcagcagtagcagcaaggtgatttttagctaaaaaactcggaatccgatggcttcagtgtttccacatatccctttccaactctcacaatctctgatttaattggatttagaattgatttgtttctgagatagatttttttttttttaacctgagtaaaaatgaaatgacaccttcctttcagccggactaatcccaagccagcagctcagaaatgaggaaagaagtgtcaagtagacaaatggaagtgagggcaaccatggcaggggcgttctgaaacctgtctccttcagccacaggtgatccttgggccaattactctcaaccatgtgcttgctgataggaagggaagactcacaaccttggtctgatagaactcaggcaaggtgatgagcaatctattgttaaaatgtggatttcctcacatacttgtttttagattcatttttgaagaaagcagactgctttggggtgtcttgttcctgatcaagctcttcctagaactctaggcaggatgtcatgtctccatccccaacctggcctcactcatggtgggtggtgggtgctccaggggcagaaacataagtttttgaaaaaacactgcatacagtaaatcctgcattaggatttaattcttgatctgtttacaatatgtgtgtgtgtgtgtgtgtgtacctgtgagggtgtggtagttaaataatgcaattgatttctgttttacttttagaagttatatgcccaaatgatcagacacctgggatagctatgtgcttatcctaacaatgccaccatagagaaataattttgagaattctctattcattcttgctttttgagttgaagatacagtcttcaaattgtcctcagtggtagagaaacagtctcttaggagtgattttgagtttaaataaccttaagtaattcagaggaagagcttgcggaataaggtaggttctcca

SEQ ID NO: 40742 - DNA, 1153 bp, Bovine  19866880789297
aaaccaacagggcataaaatcagaaagactgtcaagaaattctttatcacttaaaacactgactaaggttctatactgaaagtgcgttccagtcatgtaataaatctaagaaaaatgaagccttcaactgtctctaaactagccttagttttatatcaactctacaactaatttaaaaaaagctgtgatgcaagaaaatagcaaatccaatataaacattaagattatttctaccatgtgatgatgaaatcatattttaaacattccaatattgccaccacctaaaaaaatcagctaatgaatcaaatcttcatcttcagagacttctgcagtaatataataatcaaacagaagataatcatcaatttaaaaattacagacaaatgaaaagaaattaaaggaaggaagggaaggaaagaatatcaccgaattaacagaagaaaaattaattatatacctttacagtagtatgtaaatcgatgtttttaacttggacagatggtcaacatgtcccaatcagtgaaaagtctgaaatcaagtggtcagctttcagagtttaacagctgctatgaaagcatactttatgaaacaatgtgcctttattttctaatctttcccagtagctgctgctgctgctgctaagtcgcttcagtcgtgtccaactctgtgcgaccccatagacagcagcccaccaggctcccctgtccctgggattctccaggcaagaacactggagtgggttaccatttccttctccagtgcatgcaagtgaaaagtgaaagtgaagtcgctcagtcatgtcccacccttagcgaccccatggacagcagccttccaggctcctccgtccatgggattttccaggcaagagtactggagtggagtgccactgccttctccagtagctacatcttagcaacttaggcaaacaatgcttttatctaccacttggtggcgatatgcacacatttatgattttattcatttcctaagtcaaacaatcagtctttattttcagagaatgattcaacaacttttccctcaaatcctaagatgaggtctggaaaataccttacagattcaaagaagtctttttattcagcccaatacataatatcagacaaaatctaaacacatcatttacattatctgt

SEQ ID NO: 40743 - DNA, 1811 bp, Bovine  19866880845313
tggtccttcttcttatctctggaaaagtccctctgactgtgagccgaaaaaaaaaaaaatgcctatgctcataaattggcaaaatgcacctcttgctacaagggacaagattgattctcggggtggggctgggggcggccttttggataacttcccctaaagctctctgcatctctttgtctttctgtcatccttacagcctacaccaacattgtccaggcctcaaagatacgatgatgagctggttcttttttagttcattagctcttctgctgtattagtagattatcaaaagcagtttcagtatgtcataaaatctgtttggtattaacttgatacatgatgtgtttttctccatccagctaaatagtttccttcaaatctggaccagatgagcatcctgggacttgcatgagctcatatgtgtgtctgtgtggaatgcagccctgggtccccttggacatgtggagcatgtttttggcccaaatggaaacatccttaggcactgatgcctcaattaggggaaagataaagatgcaggatcagatatggcatctgtaaaatgttaatatcctgggtgatgcaccctagttaagtttatttttcagtttcgtttgatggctagtttaggcaaaatcgtgacacgtgtgaaattgcctttatttagctccctttggggatagcctctcaaccctgcccctgctgactgccttgttgctgccttaagctcaccccagccccacggagcactcctgcgcatctctttggagcacctattatgttctgggtgtaggggaaggggaagaataagagcaacttcacttgcaggatgtagaggaaggcacagaaatgggagcagatgcttgtcctactgcaggataaacgtgtgatcaggtgctgctggagcaggtgaaggctccaggccgctctgagggagggcctgcctggagaaagcacctggggcagaactctgaagaacacccaggagttagggcggctgctggccccgcaggcacctttgggtgaataagagaaaggcgctccttctgacaagaggcctctcttgctgggcgcacagttgcgcaggccaagtatgtgcatttagtccccactcaggtctcacctcggtaccctagtgacgtcagcaacctgcacagtccccagcagcccccgaggggatcctgtgtgtttcagtttcctaagggctgctgtaaaaaatggtcacaaaccaggtggctcaaaagtagaaatttattctctctcagttccacaggctagatgtccaaaattaaggtgtgggcaggcctcgctccctctggaggccctaggagaatcttcgcctgcctcttccagctcctggtggctccatatgatccttggctgtggctgcatcactccagtctctgcctctgtcttccaatggccttctcctctgtgtctctgtgtcaaatcttcctctgcctttctcttctaaggacacccgtcattgaattcagaaccaccccgtggatggtgactgcagtcatgaaattaagagactcttgctccttgaaagaaaagctatgacaaacctaaatagcatattaaaaagcagagacatcacttgccgacaaatgtccatatagtcaaagccatggtttttccagtagtcacgtatggatgtgagagttggaccacaaagaaggctgagcaccgaagaattgatgcttttgaactatgatgctggagaagactcttgagagtcctttggacagcaaggaggtaaaaccagtccatcctaaaagaaatcaacccgaatattcatggaagga

SEQ ID NO: 40744 - DNA, 971 bp, Bovine  19866880870613
ctgtgtactcctgtggccttgaagagcaatactggtgtaatttgaaggttttaatagcctctgcatggaatacatggatgtgtggttgttgggagtattttcattctgttatttttatggcctgagatattttagccagcatccctgtgcctagagtacccaagcagaccccaaaagcccaattactgtcttgaggaatctggttaccctgtaactcaaaagactgtaagcagcagctgtcccaggagtcagggctgtgccccttccctccactcagaatcatggagtgggctcctgacttgaaaggagaacatcctttgtctcttggcaatatcatttgcattcaatgtaaaatcagaaatggatggaaattttgcccagttggaaaacaccaacaaaaatgcaagccagtaactggtatttccacccaattccttccactctgacacaaaatttctaaattccctgctaagatccagccttactttgtagctggggctgttatcaaggtaagacttgggtttggacggtcctcatctcatgggttggtcaggtccatctctacagttctccatagggacaaagtcccagtctttggatctttgtagctcctgcaggtctcacaagttccaggcatgtaggtgtgcccaggaaatcctcatggaggggtaggtaggtcactgctcttggaaagggggaagaataaaatagaacagggcatttccaccttattaaagcacagaaagatggagacccaggttcgattcctgggtcaggaagatcccctggagaagggaaatggcaacccactccagtactcttgcctggagaatcccatggacagaggagcctggcgggctgtagtgaatggggtcacagagagtcggacacgactagagactaaacaacagcaacaacaaagatcatctcagtggaagcagtgctgatttaccacaaagcctgagcagggg

SEQ ID NO: 40745 - DNA, 2277 bp, Bovine  19866880877694
atgctgctgctgctgctgtgtctcttcagtcgtgtccgactctgtacgacccccatagacggcagcccaccaggcttcccgtccctgggattctataccttattgccataaggactaaatgaattaatgcatattccgttcttagaacagtgtttggtttgtctacatactgattagatgttagctattactactagtgacctggcttactatggtaatgtattgatttatcaatttctggggcctggctggcaggactgatgaaagcatttgtttctgggatgccctacggctcacttttagaccccaggagcttatgaaaatagctaaaactttgaagccagaaaactgaggagtcacatggtcctgccagttcccagttgcggagcgagcttgggcaagttacttaacctctctgagctgcagtttctctgtcaaatgggggtaatatgacatgtggctagtacagtggtcatgctttgtgggaacaattgctagttcgcctttaagcagtgctcttaagttctgcagtccttgagtcagtaggtgggatcatttttaaaggttcccaaatgtccatcctgaaatgtaccaacttgcagaagatgccaccagatgttgatcatctgacttctggataaactcttcaagatttccacctctgagaggctattctaaacaaatcaggaatgggctccaaagcctctgacctttttgaatatgtaaaggaattcttcaaggaaccctctccaatatctacagaagactttgtgaatccagagactgttctgaaagaacaaaacagtggtggtggtggtgcagggtggggggtggtgcccaggtgttatgtaatgatgtgacacttctaggccagagtcatcactccggcaggtgacctaaccatggcagagactgtgatacccggtgattcggtagaaagaccatttggagtcaggagacctgttctaggcaaatcacatttatcaatcactagtaggcaactttggggtatatactgaatggcagacatttcagtcctaagatgatgcttgaatctcacaggccttggtttcctcatctgtaaattgaggggcttggatcacatggtgtccaagaccttctcaggaccaaagatttatccttctgatgattctttgaggaagttaatgaagtactaagtcacctatttttccatttcaagctcagggaaatgtttaaatcaccatggtaacaagataaatcagcaatcagttttctgattaaaacaaaaaagggccaatgtgtaaatgtagaaagaatgcataattagcattgccaccactgaaatcttgttagaacataataaaaatgctcaatgtttcagcagtaaatttgctattatccatgtgagaactcttccattttcatcaggagtttgcaatcattggacaagccttgtcccctacagtgggtcataattttagaatggcctctttgtctccactcacctggaatccattctaatttgattaacggactagaatcaaggtaaccaggaaaaccagcgtgctgcttaaaaaattgcagagtgcattccagagccaaatagaagtgatttttggattatttgttgtgtgggggaccatttcctgttcattagtgagaaaaatcaagagttggccctgggttggcagactgcagtccatggacctaatgtgacttgctgcctgtttttgtatagtttgcaatccaaggatggtttttgcattttgaaatggttgaataaaaatcaaaagagtactattttatgatatgtgagaagtatatgagatttaaatagtcacgtccacagtagcattttattgaagaccagtctcatcatttgttttccagtatcatcaatggatgcttttgaactatagtgaaagttaaatagttgtgacagagatggccctcaaaggcccaaatgtttattatctggcccttttcagaaaaagttcaccaacctctgtcgtggaccattgtaggaaaaaaacctgcttgccagctcaccagatgtgagcacaaagaaaagaagaatagtagagaatatattgggtgaattgggagataattgaatatttacaaagacaggggaggtaggtgcaagtaaggaggtgagggagggaaactgaaaatctggagattaaatctacttcatttgagcctctggctccagcagggcccagcccatgtagaaaacccatgtcatttaaacatttctcatgagtaaagataccagtagggcaccaagggtaa

SEQ ID NO: 40746 - DNA, 1580 bp, Bovine  19866880898740
acaaaatcaaaccaaaaaccaaccaaccaaaaataacggctgaaaaaaatagatttccagaagtttgtacatttagatgttttttgtttgtttgttttgttttactgtggcttctgcacttcaaatcagcacttgcaggtaatggggtttttgaatagtataacctggtatgaaaagttttcccaagaaaccacaaaagattgttcatttttttcttttttttgtcaacattttgccgcactcaagtcagtgtaagtcctagcaaaaagacggtagttaggacacaactgttgctgtagatgatgtgacactggttgaatttgtgctgacgtttgtgtaacttccctcgctgtttgtgtttgattcattagggggcacttggcttgagttggctcgaaggattgctcccgctgcactgcagtgtggccgtggccctggttctggggtataggtaaaggtaaggctggtggaataaatgattccatcattacggaccaaagttactggaacctggactggctgccggacccatctccagccttctcggaatgcagaaatgtctgggacaacacagagcatactctctccacatctgaggaggaaatagaaatcacttaaaagcatggcaaattttataaatgaaacttaaaaacaaggttgcttaatacaggacaatcaacctcttaatacaggactcttgggaaagagtctcacatacccacccccatcaaaaactctggataatgtaaaaaattgtattaagtacctgtacatagtttcagcttctacatccccaaaccacactcgtaaatttggagtgaaattctgtcctgtaagttcaagcattgctacgtccccaccgccattcaactgcaattcacagaaaatcagaacaacattgaggaaacttttcatttttcactaaagtatacagatgagtttttcactcaactatcatgtgcaaaaaaaaaaagacaattaaaatacttcctttaaataacatgattataaagacaaagtgaactaaaactcgatatacaagctgatttacatttaaattttcttgctaaaattatgtgtgctcctctgattttcttcttcttcactgtgtaaaaaaccctccaaagcacaggatttgaagaaaaatcaaatttattgtgaagtaaaattactccatgtcatagatgaacagttgcaaaaagctgaagtcaacttgtaagaggtctcacctgaagactttctacgacaggcacaggtgtgactggggcgaggacagggcccatcccctcataaaatgtatactctgccttatccgtactaatgattgtccaggaagctccatcatttatcatctctttatttggttcttttgggcatggagtggccttagaaaaaaagaatggttataaattatatacattgcggtattataagacaattttaacaaagtaacactcatgaagagaatttagtacaaatttacaaacttcccaggcaccatacttttccaacccctaattccaaatagaatattaatatggaaacctcacataaggctagttttattttaatatgaacta

SEQ ID NO: 40747 - DNA, 1050 bp, Bovine  19866880945133
tctctgagaagggagcagctgtgagctcttagcagcccctggtcagggggacatgggtggggtaccaaaagcatctactcccagagggaaggaagagccatgtaggtggtcttgacctcttccaaggggggcagattgcagcttgtcgttgctggaaacgaaagggcaaatcggattctctaatggaaaatgcattaggctgtctagaaagagcagctaagcaaagggtgagaacaacgggagattaccagcggtttgactgagggtgagaccaaagaggtgggtcatcaaccacgaagaaaagaggctcaccgtccagaattaatcagagataaagggagtggggttggagtagcattgcagcaagcgtcaggcaaggcagggaccgggctatgccaacatcttaaaaataaataattctcccccgtttctatccgaggtgctcaaggtaatttgcaaatatttgcaggcaagttttcactaggctgaactgcaggcagagctcccactgacttcacagagcgctcccaggggacaggcagtaaggtgaggcttcggttctgggtaattaagacttacggcaccctcgttagtgaagaaatcccggtgcacatcattgaaatgcagcgggctctgcagccctacggcccctcggcggccttggccgtcagaagcccactgaagccatcattaattttgctatccttcactttctgaaatcaaaggatgacatcactttgattaagaggaacaagcacgttacaggcaatcagtggagtcagtttgcattggtcagtgtccttagagtcgcttactgatggtggccttggggctcccgcagggattatgaattctgtgataggctgaaagcccacagtcaccttctgagcaggcgaaattctctccagaacccacctgcactacttccttagttgcagtattcttttctgcttcccttcctaacaccgtctctgagacacaaaggtgctcattgggtggtcaatcccagacagtaagaaatgtctctagaacactctgatccctcctctg

SEQ ID NO: 40748 - DNA, 1200 bp, Bovine  19866880945977
cccaatgccatctgccattttccagatgctgctttttctgcaaattaatgtatagggcaggcttcccaggtggctcagtggttaaaaaaaaaaaaaatctggccactatacaggagacccaggtttgatccctgggtatggaagaaccactggagaaggagatggctacctactcctgtattcttgcctgggaaacccatggacagaggagcctgatcaggctacatccatggggctgcagaaagagctggacacgacttagtgactaagcaaaaacaacaacaaacagggtgcacatgactggggtcgggggtgggggtatggaaggggggtcagaatatgcaggtgtgctctgcccctaggctccccgaagggggcaagagggaggctgcccactctgctctgccattagtcctagcctcaggctgcccagagtgggggggagaagagggccagggacaatgggtcatatttttataacttacacacaagaaccttacggtctaggactggccccaaggaaaaccaaggcaaaaatttcaaagactaggcacacccaaaaacccttgctcttagtccctgtaaagttttggacagcctcacgttttcccccttattttccctgagaattcttggggaaacagtaggtctaagagaatcgagctggcaagttgactcggtcctgccccccagttaggtggcggcatggtcacctctctcccttcctcccagtctctccctccactagcacctccctttcccataaagaagcggccctgcctggagccccacaccagcaggaagcccatgcaggctagttcctcaaggttagagagaccacgaacaagaacaaggaaaaggagaagtgctggaaatcagtttcttttaggcttgtctgatatcctctgggctctgagtttggcagggcataaatagataatcaaagattttcactttcccaggttggaattatgtaaccaggagcggcttctaactttgttttcctgaaacttctcttgaaggaaattcctcttttgttctcaatcacaacgagtgttttcccctgcgcttttacttggagatcttcaagtcagcagcctctgaagctaatcagataattctgtgtgaattaatgcacacactggagttttaaaaatatatccttcatgatcctttggagtgcgtgcgtgtgtgtgtgtg

SEQ ID NO: 40749 - DNA, 1010 bp, Bovine  19866881054404
catagaattattcaacagctatcagcaacttgggcacacttccccttggacgaggctttgaatctgtgacctcgaggcagaggcatcatagccaatttcaaatccctgatgtatccaaaccaatatccagtaagcttaagtctgacgcctatttctggttcatcttagaggaagggatttagggagcaagcccttcccccctaacggtacctggggcttacctttcctataggcaacctccgaaattcctacctggacctgaaactcagatacggacggccctcgatgtgcagagccttcccctgggagaaggagctgagagccaagcatcgaagtttgttccaggccttgttggagctgagtttggtgacaggtaattgagtccatgccttgtctttggacattggttagaaaggtccctgtttttctgctttccctcaccttctttagtgatttatgccttgaagttatttttaacactagtgttctagcttaatttcaaatttaaattctgcccttgtatgtccaccactctcaatatacctgtgcacatttgtgacactaaatagaaaaacttaaatttaggaatcacttgagcaagtctttatgtaaagccaaggccaaaaacaaagagccgacagccagacctgacccccaaatgtggttgctctggcatacacattgttgtcaatttttaaaaaattagttaccagtttctaaaaacatacaaaaacacaaatttctagcttttgtcaaaatatccaaagatctggtgatgctgggcctcaattcctgagtggcagcaagctcagaggtgagtggttggcacagacaggttttgtccatctgcagcccctcctgcctctagttgagcacttcctgtctaactctgtcatggatctcacctgcctgggcccttgggcacttgaacttgagaccccctgacttgaagtattttcaagcagcttccaggagtctgtgtgatttctcaaatgggccagcttagtcca

SEQ ID NO: 40750 - DNA, 1456 bp, Bovine  19866881061330
ctccccacccactttgagcttttgctcttaagtacattcaggttccaagcctgaccatgcttgtttaatctaattaccatactcttccaggtcttttctggtccaaggctggaactgttctttttattttattatttttttaaaagctgaagtcttatgacttttcttgaatggaaggtgttttgatttcagcaagtcaaatcttgtaaaggcctgcattcatatttcttttaagattatatgaagtctgtgcaaaagctttaaaaaaaaaaatgcctctgccttgcctgcaatacattcaatgtacttagtctctattctcaaataccgttgatagttatttctctgtgttactttttttttttaatgtatttatagtggtaatctaagaggttctaacatttacctgaaattaaatgtggccatttagtcattaatgagttaatggcatggaacatgttggtttttacagtgttccctccccttttcctgtgcagaaatgtatctactcagtcaacatttgttcaggtttcctccccctccttatcttgtacataacttgtattatgtgtaagttaaacattttattttgaacttggaatattcccagtgatttcattcagcagggtgtttttctgccttgttggcatatgataacaaaaaagtatcatgctaagtatttgctaccagttggtagatggtgcccttattgtataatgaggaaaaaaatctcagcaaaagcatggttttatttacttttttttggtgggggggcgggggtagcctaggtcaaaacatcactgtaaccttgaaacaggatgctcttactagatgaccaactaaaatagctggaagacaatactttagaaatggatagttgtaagattataaaaatgcaaaaaatcccttttttttggcttcttctccccaacactgagtgtcttcgcaaatgtcacccactcagaaaacatttcctctccatttaagatttggttgcattccgggttgtgtgctccctatctgtgctggactcacctcttttacattggttttgttcctgcactttggttatacctttgtttggtttcttagaaattgcagcagactcattgggctacatttagtacaggatctatgtgtgtaatgttacaggacgtggtctagtaatacaatcatctttcttcgagtaaaaactacctctagattgtggtaagcttttactgtcccatgaaacagaagccacaagtaccttaaggatgcaaaactgtaacttcctgcatatctttccgtacagaaattgtctttttggtgtcctgggctattttgaaaagtttccacctgtaggctttttaaaacatcatcattagtagcttccccccattcccaccccacagctttgataaatcttcattactcattctttgctcagactatgccatgtaaatatagttcctaa

SEQ ID NO: 40751 - DNA, 731 bp, Bovine  19866881168572
ttaatgtcaaagaagtcttaacaaaatagactgaactaccaagatcctggtccttggaggagctgttctttctgagaaaagcctgaggtctcgtgctggttgtagaagtttatagatttgcggtgaaaatggagaacttaccattcaaagatttccttggctacactggattatctggagaaaaattgggaaaacaaacaaacaaaaaacccccaaaagtcagttgcctaggtattttggctacataatgacaaacatatattaaatagcttttcttcaagttttgcatatgactgcctgaactttttatcatccagattcacagtcatgcacactgttgagttcaaacctgcattaccatcagggaacaatttgtttctacctggcatatagttggaaattcaaagcacagattttggtgattactagcttaatgaatgaacatagctgaatatgaaacatcacaactcatagaatcaaaaatcacagaagagaaaggattaaagcaatccagctgcaacttatcatcagagccagcatattgttggcataacgagatatattttaaaccaaacataatcatttgaagttttggtataatggcagggtctctggaacgctaagccctgagttctactgattactaacaggaaggaacatccacacataacatgcaggtcaaggattcacactcatctgtctggagagttcagccaagaaatccctggtgc

SEQ ID NO: 40752 - DNA, 757 bp, Bovine  19866881191508
ttgcagctgcatgtagccatatgattaaattttagccaatttaagcaaaagtgtcatatggctcttttaggaacttcccttaaaagatatgtgagcatctttttctctatgcgttcctccacccacctaccaggaacacaggtgggatgtctggagctctagctgcaatcctgtgccaggagggcaatactgacaaaccctggggaagttagaggaatgagctggaaggagctgagtccctggaggcattaccaagcaccacaccagccctagacttctgacttcccagtttttatgtaaggaagaaattaacagctgtcttatgtaagctgctgggtttttttgttgtggtttttttttttttttttggatctctgttgcttccaaccagaagtaatcctaactgatacagcacaaagaaagtggagagggagcctcagagacaatgttggcctttaacacagaagtggccagggatggccttgattcttagaaccaaccagaaaggccctggagagcccggcagttggagctgtcaggaagacagatgttgagtgggtcttgccagccaccacttgccctgacttgcccccaggttcctctgccaggcctgcctgcccatccgttccatggcatccttttcggctgcctgcaaagacatgacagctccacacaggcagcctcctccaggtggatggaactggtgcatcagcaaactataaaaaggaaacctctgaagctctgggttctcttccca

SEQ ID NO: 40753 - DNA, 958 bp, Bovine  19866881202347
cctgggcatggctataaatctctctgcccaaggggtgaccatgggccaggctgctctggatgactggcttcggggcactcaggaggaaccaagtcctttgttgaggcccttatatccaaacttcaactcataggatatgggctagaaatgagagtattgtttgcattttaggtgaaggcaaggagctacaatattgagctggctaagttggatgatttaacccgtgtaagcttgctggatttccaggaaatgacaagaacaaacataatatatgtaattgttgagcataaaatcatttctatagaatgttaacactgcagggctcttcaaggtcctctagtctaattcacttattgaatgcaggagcaccggagtctgggggcactgactttccacaccaagctagtgcagactgtcaggactccccacactgagctcctcacaccacatgatgccgccgttgttaaagcttgcttcagcccagctctcaaacagaactgtgaggacgaatataacagcacgagctgcacgtcagtctgaagatggccatttgcaaaaagcccaggcaacctcgaggtagattggaaagcataaatgtgtcaagaaaacacttctcctgaccttatgaccccgtttaccaaatgccctgttactcttacttcctttctagacacttggttacaagagatatttgtacctgttgtttgctttcatttttactgcctatgacaacgtaaaatttcctagctaggaatctctttaagtccctctcatttggcttatgtttccaccactttgctgaagctgctttgacaaaggtcactaatgagttcacatcaccaaagctgatggcagatttccacatcttttcttgctaaaactctctgtgacaatggccttctcctacatcttgaagttctgccgtgttttctgtgatgtcacttcttctttctctcct

SEQ ID NO: 40754 - DNA, 963 bp, Bovine  19866881277410
tatttagagtgagttccatggctgagggcagaggccacctgtgttaatgacccatctggaacacctcaagccatttcagaggccctaggagagtagcttacaagcaatcctgcttgcttttcttggtctgtgctccagttctgccccagaggacatgatgaggtggggtctgaagggcccatatcaccaattggtgagagtcagtacaagagtccaagaacatagcacagcccctcctggtagcaggatttgagacaaagaaagtgaagtcactcagttgcgtctgaatatttgcaaccccatggactgtagcccaccagcctcctccatccacggaattttccaggcaaaagtactggagtgggttgccatatccttctccagaggatcttcttgacacagggattgaacctgggtctcctgcactgcggacagatgctttaccatctgagccaccagggaagctgaagtgccaggcaagaagctggagacaactaggaccacctgagattgctctgcatccaagatggagagagaggtgggcctgggggacaagagagcaccagtccacaagccaggacacccaacagggggggccggctcaggggtcagtcaggcaactgctagcttctaaagagccagagaagggaacacattacaacagaagggtgtgtgggagatggtcactccccaaggaatgtgtccatggggctgggggcggggcacagtagagccctaacacgcatgttaagtcctctggacattgcctgtcacataggtgaactcaacacaaggaagttccttggctcctggggcaaaggggaaccaggattcaatggcgaggctgacaccaggaagaagcaatgagcaaaccagaagcccaacactcaggcctctctgatcatacaacacttggcatccacagtgggccaggcttccctgctggagatgcagagcttccag

SEQ ID NO: 40755 - DNA, 1496 bp, Bovine  19866881279939
caatcaatgcccaggacattctggggagtctggatcagcacatggggtattggaagtgacctcagtcacttgggacctgaactaagcccacgtagccctgtaaaggtagtgaaaattgtcttttgggtcctgaacctcattttctatattcttcccccttgtttgtcttcacaattggacatcaaggtccttatgctgaagctccttgtggatagcctaatggttgggagaaagggccagactcacatcccagctgagttccttaccctacatttgcataaacactttctgagcatcaagacatttcataatccagttttagttcactgcttcaatagtcccatggagtaggtggttattggttgaactgtgtcctctaaaaagacaggttggagtactaacccctggtacctgtcagtatgactttatttgaaaatagagtttttgcagatgatttccagttaaggtgagatcataagaggggccctaatccagtactactgctgtactcagagaagacggaaatctgaacataggcatgcacagagggatggcagtgtgaagacgcagagggaagacggccgtgtgaagacatcagtagagactggagttttgctaccacgaaccaaggaatgactgggtctaccagaaactggaagagacaaggaaggatccttgtctagaggcttcaaaaggagcatggctttgccagagctcagattttggactcttgccttctggaactgtaagactattgtaatgtctattgtttcaagccacccagtttgtgacatatttgttctagtggagctagaaaactaacatataagtgttatcatttttcttattttttttaattccatgtctttgggtccttactgtgtcccaggctctgtgctgagctctggaacctggacacaaagctttaagtaaatacggagcaaatctgagaccatgagccatctggtgaatttccacactcatgcccttgtgtctcgggctcaatccagccatcccccacctgtctggtgtgtgctggttcccacatctggctaggggacagacgatactggcactggaagtgcttgggaggtctcctgacccgtcttcctgcttttctggttttccaggggtgcccgctgaggttccaagggatcttgccacctgcagaaaggcagccttgggctccaccacatcttttccctccctgactctgattaattcatgttatgaataaattcaacaaacaacaaatgtttgtcgaatgaacactaaattattaatgactggtaaagagaatgcgttatgcttcccagaggtatttgaatgtggaacaatgctttcacccagagaagggaatttccgggcgtgggatgggggtgggagtagggtggaccaagcagagtggggatttggggacgagtgcagtcttctgcaggtcttttatcttatatctcgaaagtaacttctgtgtctgttcaggatgcggctggctg

SEQ ID NO: 40756 - DNA, 1169 bp, Bovine  19866881303141
tgcttggaaaattccaagggacagaggaaacctggagggctataatcctgggagtcacagagtcagacaagaccgagcaactgagcacacgtgcacacacaccaaaactatactttgtgtgtcttaaaactcaggtccaaggctccctctggcacaaagtcttcctgtttatcccagtcaagcatgtgggatgataaagaagctcttgtgatgaataacatacccagtcacttagattcagagggaggggccgagaaggctaatggagccagcgtttcggctagtgtggcttcccctagtcagtagttcttttctgaactagggtggggcggtccttctagctgggtttagagtccaggcgtatcgcctcattagctgtgtgacttatgaacagttattcaccttcctgatcctctaatttctcgtcagtaaataaagttataacagtagctacttctcagggctgttaggagggctcagtgaaaaaaaatactcatggcactaaaatgacaactgtagttcaatgttagatgttatgtttatttggtatataaaaccctcttgataaagttcgctgtggtgtctgtctttcctatgagaccatcagctgagtcagaggaaggccttggtctcatcatttatgacctcacactgagtaggtgctcacgtttgcgaacgcctctcagtagagaattcccaattccccaccacctgggaagctataccaggaccgaattatgcatgaagaccggcagggacatttacaaatggatacattaggactggacatggcgtttgagcatcggcacagccgctgtttgtgtagcaaataatgaaaagcaaaaggagtgcatttcagcacatattcgatggtgagatggaagtcactcttctgagaggctaatacagagtcattttccctgattacctgaggaggttaataaggaaccatcaaaaacccttccaggtctgatgccctgtagcatgccggctgataaattttcctcatgcaaattctgtcccgtccctaaatttgttgccaggtagagcacatttattttgcatcttgtcagtgttttccatttcaaattatctttgtcatttttactctgtagaaatattgttatgattattacaaatgcaattccgttagaggagctgaaaattgt

SEQ ID NO: 40757 - DNA, 1283 bp, Bovine  19866881349112
cttaactatttgtccaaaatcctatgatttctcccatgtctgaatgcctgttgggagttattgtcaatactcagtctttgcacttggcctctgatgattggctacagttgtttaaatttttcttgagggaaaagaccattattgtatgattttttcccctctgttttacagaatgcatagccatgttgggcatgcttcaagtcatactggattgctaaatgtttgggtctcttgtttatgcacctaagaacatggagcttctctttcatctttgtggtgtttgaccaaagtttgcccccaaccttacccaattacaggaaaaatagtgttcaaagtaggaagcaagttctgtgaatccacatttcctttgttgggcaatgatctagctgcatgtggcataacttttgctgacacatagggtactcactcttttctttctttttttttcttttcatgtcagaaaaaaagactatttccattcaagtcacaagtggtaaggggtggcggtggtttctctgtgaccttgggcgagtcatttcaacaccatcagttgcagtttcctcttctacaacttttccagctccaatgttcagagattctatggctttgtggccacttatcacgtctcattcaaaagatttgtttatatgacaaagggaaggcctccctaagttccctcttttttctctgctctggatctcatgatgaaggaaggagctggtgaagttaataattagaagtctggctgggcccctcctccacagtaactgtggttgcttttatctcactagtcaggactcagagcccaccttgaggataatggcttaacttgtccacaaggacatctagacgtttggggaaatcatcctgctaagtctctcttcctaccaccatgtttatcctccagggtacagaattgtctgcctgtggttttacagcacggaccacatcaagtcttctgtaaaagccttcagaaaattcaagacaaattctcatgatgctaaaggctttattagatgccttttctctttcttttgtggttgatggcaacaaggactgtttaccactgttagccataattttatgagttgttattttggtaaccttatgtttctgccatatcatttgaggtgttgcatcttgaggacagatgttttgggtaagacatgagtttgattttcactgatcaaaagttggccctttgtgttaaagggagtagaggaaactatactgtattaaggttttcaaatgcatgcttacctccctagaaagctagtctgatt

SEQ ID NO: 40758 - DNA, 1076 bp, Bovine  19866881374296
gcgctcggcagaggcggtgtcaaaggccctccaggcgttggcgctgaaaatgggcatccagcacaggaagaagaggaccacgaatgccatgagcatgcggatgacgcgcttcttggccatgaggctggccgcggggctgctgctcctgatgcggtcggcccggccggcgctgccggtggacagctgggcgcagctccagcttccttgggtgcttgggccgctgcaggcagcacccgggcgctgtccgcgtacctgccgctgctggccgagctccgtttcctttctgggtgggcaagccacgtcacttatttttggggatgggtcatgccagacagagggcacgggatccctgcaccctccatccaggggctaaaccacacttgaactgtattacttgacaggccaccttgggcctgcactaatatgggtaggtattgatctatactactcaaatgaagtgctacttataactaataaaaaaatgtgtagtataaaatgtgcatagtttaaaatagtaaaataatattttatgtgtgtagactataaggataaaaatttgttaaagaatgagtattcacactcttcttccagctcctcaaggcggggagttttctgcttgcttgggaaacctccagattgcttttactgcataatgagcaaaaatcaacaaaagccaggcaagaccctaggtgtatatgtggtaaacagctgagcagaaggatggagtgagaggggtggtgagtgatgtcaacaaaggtgtggggtaagttccagtgaagaaaagaaaaaaaaaaaaaaaggaaaaaaaaaaaaattgtggcacatgggagctatttccctgtccagggatcaaacccaggccccctgtagtgggaattcgaagtcttagccactggagcaccatgcaagtcccaaaatcagctatgccttgtaacacatttcctttacctgtaaggaaaaggtctccagttgtatcaagaggaatggttttacatggttaaaaagactgttaagtttcctttattataaaaatacaaatctattgcggaaaaaattttggaaactatagaaaagaa

SEQ ID NO: 40759 - DNA, 1071 bp, Bovine  19866881476107
tctccaggcaagaacactggagtgggttgccatttcccctctccaatgcatgaaagtgaaaagtgaaagtgaagtcactcagttgtgtccatggggtcgcaaagagtcagacatgacttagagactaaacaacagcaacaacatatggtcgctgatgtcagaaatcccttcctttttaaggctgactaagatcctattgtatgtatataccacattttgtttattatctcatctgtcagtggatgcttggcttgcttccattggttagctattgtgatcaattctgccgtgaacatggatgtacaaatatctcttcaagaccctgcttacaacccagaggtagaattgctggatcatatagtagatctccttcttgaatcagcatcttccagcaatgagagatatttcaagtctttttcaggatttaaaagcttctttttctttctttttcaagattatattatttttgtgacctaagcaaaataacctgtacagtacaatttagaagtttcttgaattttttgtctttggctacaatttgtacctttaaaaatgggctgtgactttgctgtttatgatagaattttgccacaatcagctctgacaaagtcaaaaaaaccatttaaaaattagtcatttttccttcctgggcttaatagacacctatttatgcaaagagagagaatgaatctttgtattttcagaaaatagggacaattatgagactgtcataatggccccatagtggccccagacagcacagtggctaacagaattttatgccattcaggaaatagggaagcaacatgagcaaggtaaagagcaaattatggatgaatttctttccctaacaaagtgtctgaagaattagacaaggaacattaagctccataagaagaatgaagaataatttgaccggttggcataatagactctgaaaattattgggaaatgaggaaggtttaactttggcccgtccagcatcctccttttattaatgaccatctctaatattttcccagcactttgcaatttacatagagcttttcttactggtggcaccctcctcct

SEQ ID NO: 40760 - DNA, 1042 bp, Bovine  19866881644313
ctggagattgtaaagacctcatcagacctactcccataatttacattttaagataacacggtcctcaggcaagacacatccttgtaaagaccaggtctactcccataattaacattttaagataacagaaggttgaatccaaagactgtccttaggcaggatacattattggtatataatcctaaggaatgtggagaaagaaaaaaagtttgtcctttcttcctccttgagaattccagacccctctctccttggggacccctagactccttatcaacctgcctaggaaatgactctctcattacgtgccagagtcctcaagcagaggcacctgcccgccattctagctgccattccccccgggcatctatcactttacctcccatcctagtcccactgtggacgtgtgctacccatgcagccacctggaatcccaccgtgaggacaccactggctatggaaaggatagtgtttccatttaacccagcagtggccagtgcttggtccaacgtgggaagccaacacccaaatggctctgtttggatcagaacctcagaaaaccttctatgaaaactcttcatcacccccagtcctcgaatcccgtccaacggctgccctgaccctccatctccctatctcccactctcctgctgtgctcccccacccaaaggcctttctcttcccagagataaaagatggcccccagagatcttagtggctgcaaagagctgaatgcgcctccctgaggtggtgggaggtctgtgaccaacctctgccaactgaatgtcctgctcccttattgtcattattctagatgttccagttatgccagctgctgcacaccattaggtcactaaaaacccagggttcacatgcctcagaggtgtggggccccagcaacactgctcttccgggaacctcttagagagttgtgcctgctggtatctgctccacccacgtgtccactagctatttggggattgtaacagctactgaatccattaaatggccccaaagtgaaagccatcgggaagcacaagtg

SEQ ID NO: 40761 - DNA, 727 bp, Bovine  19866881720511
tattatacagagattctcggacactagccaagtcccagcgctgcagcacatcaggtacctcaagcacataaagcgtaaggaggaatttaggataaaagaccaaggcagagctttttcctccctatcactggagagaagcagtaaaggaatcttgtaaccctttgtatcaaggggatcatgtaatccttccagtattgaatggaagtcaagactgccagcgcaggaaactccagggaaatgcaaggaattagaaaaggagaagaagaggaaggaagaggaggagaattcagaaaaaaggctgttggaaatcgtacactgacaactggagcagctatgttaagggggattaaggtgcaaacgcgaagtaacctcattttatttttatacaggaaaccagagggatagctaagaaacaagctcattatttctgattcttggcttgttctagctcttaggggacactcccttcctcagtcagagagctgtttttatgacaaaggactcatatgttttctcatagctacattttccttgaatcatggttggcaattaggcattcaaatttgacatattaacctctgggacttctctgggtatgtgaagaattccctcatctgttttgctcaagatgtgggcagaagaagaagtgacaacagacagatattgcctctatttggctggagttaggaaggaaccaccgcaatcgccaaggaaatattcgccagca

SEQ ID NO: 40762 - DNA, 5048 bp, Bovine  19866880101762
acgaacctttgttggcaagtaatgtctctgcttttaatatgctgtctaggttggtcataactttccttccaaggagtaagtgtcttttaatttcatggctacaatcaccatctgcagtgattttggagtcccagaaaataaagtctgacactgtttccactgtttccccatctatttcccatgaagtgatgggaccggatgccatgatcttcattttctgaatgttgagctttaagccaactttttcactctcctctttcactttcatcaaaaggctttttattcctcttcactttctgccatcagggtggtgtcttctgcatatctgaggttattgatatttctcccggcaatctcaattccagcttgtgcttcttccagcctagggtttctcatgatgtactctgcatataagttaaataagcagggtgacaatatacagccttgacatactccttttcctatttggaagcagtttgttgttccatgtccagttctaactgttgcttcctgacctgcatataggtttctcaaaaggcaggtcaggtggtctggtattcctatctctttcagaattttccacagtttattgtgatccacacagtcaaaattcctaggaagacacaaaccacctaaacagactgaagaagaaacagaatatctgaacagagctacaacaaagaaagaaattcaatccgtaattcttaaactttgcacaaacagaagtacaggcacagatggctttaagggtgaattctaccaaacatttcaagaagaattaataccaattttcataaattcttataaaaatagaagaagagggaatattcaaaacttatctgatgaagtcagtaacagtctagtatcaaaaccagataaagatattacaagaaaataatacatcatatatcttacgaatatacattaaaaagccctcagtaaagtactgctaaaatgaatccagcgatatataaaaacaattataaaccatgatgaagtggcatttgtttcagaaatgcaaggctactttcatattcaaaaatcaatgattgcaatgtattaataaaataaaggacaacacaacatgaatatctcagtagatgcaaaaagcacttgttaaaatccaacacctttacatgataacccaacaaacaaaaaatagaaggaaatttccacaatctaatgaatggcatctatgaaagaaccacagctaacatcatacataactgtgaaagtcttcctaagatcaggaataagacaagcatatctgctgttcctgcttttattcaacagtgtaccggaggttctagttagggcaattagacaggagaaagaaatgaaaattatccagattggaaaggaagaattaaaactctattttccaatggtatgatcctgtatatataaaatcataaggaacaattaaagtaaatgagttcaacaaggttgtacaagatcaaaatacaaaaaccgaatgcactgctatacaaaaagcaatgaaaaatccaagaatgaaagaaaaattccatttacaatagcacaaaaaaatgggaacaaggcaagaaagatgatggaagagagatattattaacaaataattctgttcatcaaaaatggtaagaaagactttattcaagactattgcaacagggacttccctggcagttcagtggttaagagtgtatgcttccaatgacggtgcatgggtttgatccgtggtaggggaactaagatcccacacaccatgtggtgcagaaaaaaaaaagaaaaagactactgcaatagaggatagagattaagctcaactctgaatataacaaggaaaagtgggatgatgtcagcaacatagtagcataagacattgtttcttttctccctccttttaagcaactagttagacatctatccatgaacaagagtctctctgttagaattttggggtccagcatcatatgccaagggccctggaaggattctcatccacttgtacattggtaacaggcagacagaccatcacatgggctgtagaatcagcaggactggtgatctgccccaacccctcttggccatggtggggttagggaaaatctgaatagtgctgacttgggcaggcacccaaggacaaaagagaattagtagaagttcagccttgctgagggagagtccagcatgccacttgagcaaaacaaaacaaatttgaggctggatttccatgactgtggggagatggaatgaaggagatcaggaaagaagcagataagaatattaaacattattaaaggatatggctcctgatgattgtgttcaggacttcagcagaaagtccattcacaagtttatgggaaaccctcactccatgatcccttcaccagttccacaatcacctgcaatgcccagagtgcaagactcacacctccccctactctccagctatttccttatacatactcctgagttcagtggcaagagcaagctccaatagaaagagtgctctcaaagtatcttaccagggtctatgtgcaagggagaaactataaacgagttgtagtgctatcttcagcaaaacaaaagagatgtttctagcagacaccctggtgagctgtaagaccagagaagacacaaaagcttaaaaattatgccataagaggaagcaagaagcatggagcatggtatgtcaacacaaagtcagagaaaatcccagatataacagatttatgagtagaatttcccacctcaagggaactaataaagatgtgaagagatgtctgatacttcttatatgaaagcagtgacacaaaacttcaaggaacattaagaattaagaaaacacatgacatcaacaaaagataatcattcaccaatagccaaaatcaaagacatgaaattttgtgatttagctgataaaagaattcaaaagagcagttttgaagaaaccaaagagcaacaagaaaacatagaaagacaattcaacaaaataaggaaaacagtacatgaacaaaatctgaatcttaatgaagagatagaaatcatgcaaaagaatcaaacagaaattctagagttgaagaattcaatgagtgaaatgaaaaacgcaatacagagcatctatctcagaatagactgagtggaagatagaacaaatgagctagaggataggaaatctgacgttaaaggataacaaagaaaaagtaatggaaaagagtgaagaaagcctatgtgatatataggattccattagacatacaaatattataataactggggttccagagggaaaagagagggatcaaagacagaaaagtagctgagaacttcccaaacttgaggagagacttgaacttcaaaattcatgattctaatcaccctattatcttaatgcaaaaagactttattaagataaatcataatgatattttcaaaaacaaagataaagagaaatcctaaaagcagccaaagaaaaagattgtgacctaaaaaagaatccccattaggttatgagcagttttctcagctgaaactctacaagccaggagagagtagaatgacacattcaaaatgttgaacgaaaaacattgccagccaagaatagtacagaaaagttatccttcagatatgaaggaggaatacagatattaccagacaaacaaaatctgaaggatttcatcaccaccagactcacatgcagaaatgctgaaaggaaaagatgttagtgacatgaaaacatataaaactgtataatacactggtaaaggtaaatacgttgatttcgaagattaattctgtaatatgatggtgtgttaaaaactatagtataaaagttaaagcaaaagagtattaaaaataactacagctactgtaatttgttaatgaatacacaatataaaaagaggcaaaatgtgatagcaaaaatacaagagggacagaaaatgggtggagcttttgtatgcaaaattaagctgctatcagttttaaatgggctgctttatctataatattctttatttaagcccagtggaagccataaaacaaaaatctatatcagactctcagaagacaaagaaaggggaaatagaggacactactacagaaaatcaccagtttttaaaaagtaagcataaatagaggaaaaaaggaacaattaaactataaaacagccagaaagcaatgaattagattcaatcagtaagtctttttatatcaataattaatcaaactataaatagattgaattcaccagtcaaaaggcacagagtggttggacagattagaaaaaaaaaaaaggaagatccaactatatactgcctccaagagactcacttcagactgaagtacacacagagactcaaagtgaaggaatgggaaaacatattccatgcaagtggaaaccaaaagaaagtggggataactatacttaatataacacaaaataagactgtacagccttttctttctctagggtatcttcccaacccagggatcaaacccagttctcccacattgcaggcagagtctttaccagctgagaaacaagggaagcctcccaaaatggtatcaagagataaataaggtcattataaaataataaagtggtcttttcactacgaagatataacactcacaatgatatgatcaaacaacatcagagaacctaattatcttcggctaatattgaaagatctgaagagagaaatagacaatacaataatattcagttcagttcagttgctcagtcgtgtcagtctctttacaaccccatgaatcacagcacgccaggcctacctgtccatcaccaactcccaaagttcacccaaactcatgtgcatcgagttggtgatgccatccagccatctcatcctctgtcacccccttctcctcctgccccaatccctcccagcatcagtcttttccaatgagtcaactcttcacatgaggtggccaaagtattggagtttcagcctcagcatcagtccttccaatgaacacccaggactgatctcctaggatggactgggtttggtctccttgcagtcctagggattcacaagagtctt

SEQ ID NO: 40763 - DNA, 3117 bp, Bovine  19866880354907
gaggtttctatatatggctaccagaacacaatcctaaagaaaaaaatgataaactgaattccattaaaattaaaaacctatccttcagagaatgaagacacaagaaaatatctgcagactccatatctgataaaggacttgtatccagaataatatattaaaacctccctaaatttaataataaaaaaggaataatgtaatttttaagagcaaaaatttatagacacttcaccataaagatggatggataggaagtaagcacataaaaagatgttctgcatcattagtcattacagacatgcaaattaaaaccacaatgagataacactacacacattaatctggctaaaatttaaaagactgatcatatcaagtgttgacaagggtttgaaagaatcgtaacctccatacaatgctgattagaaatgaaaaattgttacaaccattttggtacgcagtttgtcgatgccttaaaatgttaaacacacatctatcatatgaatcagcaatacactcccagctgtttccccaagggaaatgaaagcatgtgtccataaaaaaaaggtgcagttgttcatagcagtattatttgcaataaccccaaactacaaacaactcatgcatctatcagaagggtagatgaacagcagtgtatccacacaatggttgctgcttggcgataaaggggtgcagtcctgacacatctgcgacatgtgcgagcctcggagtaactgtgctctgtagagggagccagacaaaaggggtaaatactgtatgagtccattgatcaaaatgctcaagaacgcagactaggctgtagtaagagacatgaagggaggaagggtccttggggagaggggtatacatatgcctaagtcttacgcacttaaaattatgtacagttcattgtatgtcaattataactcagtaacactatttaaaaatgagcacagttctggaaagactttcgagtgagctgggctgtctcagcgtgtgcacgtcctcagcttccatgcctctgcgtccctggtcatggtccccccacccccagactggaatgcccttcctctgcttgccaaagtcctcttgctcccttagccccatctcaaatgcccttgtcttccagaagtatttcctgatccttgcaatctagcagccttccttggataatctgcacttctttaatggcacacctgttctgccatgcattataattattttggttctgtccccctcactagactgtaaatggtttggacgacatccagctgctctttgtatcccaccccacatcatgcctagaaggctcctgtatccatgtatgagtatttaactatttcttttttaagaaattattttattattcttattgttattttacttatttttaatttttggccttgctgtagggcatgaaggatgctaattacccaaccagggatcgaacccacacctctgcattggaagtgttgagtcttaacccctggagccaaggaagtctcatatatggatactgtggaattcaatatctggaggacccacttctccaaagacacacacattaatccataaagccagtggtcatggtagaatgcactttcctctgctgaagtgtgaccttagttctaaggttctctccttgcgtttccatcgcacgcacctctgtacccacagacatgtcctagctggccgctctccctcccgccccctcccgccccactctcatgccaggagcagaaagctgtaattcctttatttgcaacaatttcccagttccactattttaacatgtattttctctaaaagaaaaaactaatgaagtcaaaacaaagccaaacagatctaacccacagctttgctgctgctcagagagactgagtctcctcgcacctcgctctgcaccttggcattccctgtgagaaggcggaaggctgactctcgtgtagagtggcctttggaagtgagggctggtcatctgcatgattctgattttcaccctcgcttgcaaccagcgcggaattgcatgacaatttgaaacttgtctggatagttcagatatacgttttttttacatagcaattttgtgggtagctgatttatttgtttctgctggtttaaatccttcacgtaatgaaaatgattattgctatctacacaagaggtgaaagtgtctttgagcagaggcttcgtggagaaaataattatgaagctgtcattttcataaatactttgacagtgaagtatctgcagatactctgtgggcttccctggtgtctagtagtgaagagtctgcccccaattcaggggccacagattcggtccttggtccggggagacccaacacgccccagagcagctcagcccacatgcctcgatcctgagctggcactggaagccccagtcgtgactgctgacccggatacagaaaccaagacgctgagaagcccactcgccgcaatagagacagcgtgcacgtagcaacgagtacccagcgcagccaataaataaatactcacataaatttattttttttaactacgaggttgttattattattattaaaaacactgtaatgaatgtttcaaatacagaaaaagctactggcctcaaattcaggacaaatccttggggaaatggtaagggaagttacatttgcctctagcacaccacctttctccgttctttccctgctctctgagtgtggataaatgcggtgctgggagcttgcttctaggctcagtagcactactacctgtgtgaccttggctgagccccttctctttttccaggagttagggttttggttttttatgtttaaagtgagtggttgcattaaatgatgtctaacaggtcaggaagcaagagttagaactggacatggaacaacaggctggttccaaataggagaaaggagttcgtcaaggctgtatatcatcaccctgcttatttaacttatatgcagagaacatcatgagaaacgctgggcctggaagaagcacaagctggaatcaagattgccgggagaaatatcaataacctcagatatgcagatgacaccacccttatggcagaaagtgaagaggaactaaaaaacctcttgatgaaagtgaaagtgag

SEQ ID NO: 40764 - DNA, 661 bp, Bovine  19866880550861
tagaaataaaaatacattagaattccaccatctagcagtagccactattaaaggtgtgctacggatttgtctcttgggaagttttttatcaaccactggcttcacagatttgtgaaacaggaaacaaacgcggtctgagtcgccccttgactcccagtgatcgctgcaagtccacaggacacgttttcctgacccccttggtctgttttctccaacttcccattggatgggagagggcacctgaaaccttccttgccaggtagcaagttacatttcatttacgagcattgcgttaggagccttccagctttgtgtgtccatccacgtttccaaacaggggaagcagaggatgctgggaaacattgtttggctttgtgagagcctttgagagactgagaggggaagaaaattactcttttattatgaggtttgccaagtgatctctgagaagctgtgatatcactcacaggcccgccaagctgcgtggaaacggcgcgtcttggcagacgtctcgacagcgcctgattgctcggggctggtgtgggcctctatcagaaatggttccataggcagtatttacataaccgtggtggcgtgtgagaataaacacagctgtggcactgccctaaatatttctattcagcagggaattaaaggagaa

SEQ ID NO: 40765 - DNA, 1639 bp, Bovine  19866880560831
tccaagtattgttcaaatacctatcattggaaaatcctacctcataactaccatgtaaagaaattcagctcaaataggcttcttgaatgcagataaaactgtagaaatgagtaacaacagtgctaagctgacaaccaaaatccagcacaactaatttagggaaaagttagtcctgtgaccattgggactatatgtggccctgtaattatggaatcacatttgacctcaatcacactagtttactatatttctccctgttgaattgatgttccaagcaaggcacaagaactcatccaaaatccccattatcaagctatgtcttcctaaaaagttatccatccaaagatatatagttaccactgagatcagcgtatatttaaatgttcttcctgctctgtttcacacagtgaagcaagccctgtttcacactcacacttgcaatctgaagcttatgaatcagaaaataatttattaatggtattagaatattcaaataatttaaaatgtaagttgttctaaaataaaatagtgctgtataatagtgaataatttttaatcctaaaattcaaaactatgatgggtactttcacaatgaaaacatagctaaattctgaactcttaaatattttattaggcaagggttcttgggcaaattatttcatctgtcttagcctctatccccccctttgtaaaacaatgacaataacataccctttattgtagagattaaatgagatagcatacgtgaaagcacctaggtgacacatgtaaaattaactaagtcatgtgatactaattaaataaatgtgaaattctgtttttaaataaaaggaaaacaatggtccatgctttaaatgaaagaacacacacatacacacatacaaatcaaaaaacaaaaaacttactttggctttcaccccattacaattctaaatcatcctcatactgttacttaagttaatataattatgtgcaaggaaaggaagaggcatttactaagcatataatgcataaaaacatgacctcctctaactcattggatcctgaaagcaatttaagtttggttttacaccatctgcaacctgtcagacttcagaagctttgaatcagcactgcaccaccttgccatacattgggcacaagtataaaaataaagagaaaaatcaaaccatgactctggactctctccagggtcttgtcttgaagttaaagtcttagaaaatgtctctcttctgcaaaataaaggagtaatcatgcccttgcccatgtgggacctctgcagtcccttcaaggttgtcctgctccactgtaaactccctgaccccaaatcacgaccctgctggtctttgtgatgttcttccctctgcctttcaaagcatgtcctcactcccttcagtttagtcaaacatcttcagtgcttcccttttattccaattacccatcaacagccatagctgattcataagtgtctcgtctccagcaaacaatacaggataactaaacactatcacaaagggaaagactggtaaggggaaaagtaagattaaggacttctgttcatcaaaaagtaacactaagacggtaaaaatgctgcaagtgtatatttgcattacataaatgtgacaaagaggagaaggca

SEQ ID NO: 40766 - DNA, 2323 bp, Bovine  19866880724865
accgaataaagttctattgtgaagttctagatgttaggacttcaaccccacaaacgtgggagggacataaattaacccgcagcacacatattccagatgtatctattttcaaatatattgctctgttgcattcacgtagtacttttttctgttttctaaaactttacatattttccaggtagattatatattacctccattttataggtatggagtacaaggagcataaagaagataattgatattcctaaatttacacattgttgtcaacgctcatttcctccaaagtgagactatatttcctcttttccatacatgatttatttttctaacaacactttcatttctgttgctttcattcctatccaaactgaatgcttaaaagccacttaatcttgcctgttttctgtgcctataaaaattccaacttgagtctttgttattgtgtttgatctcaagaacaagatacattattcccagagactgacgctgggttctgagtcttcctgaaggcaaacgaaatgattgaaccagaagctttggttccttggagtaataggagtatccctgagcatctagctgatggattctctataattctccaggggtaaaccatacagacagtagaaaaagctaaaaaattggaagtgagacaagatttgtctaaagccccaccatggccacatagtagttgtaagtaacatctcagacttcataatacaatcttagtagcataatgggattcgtcaaaatacatataaaagatccaataaattagaaagggtttcccaggggctcagtggtaaaaaatcctcttaccaatgcagcagacagaggagactcaggtttgaaccctgagttgggaagatctcctagaggaggaaatggcaacctactccgtatccttgctgggaaaatcctatggacagacgaggttgcaaagagtgggacatgactaagcacaaacacaagcatgtcttgctttgtgctgcaagcgagaggcaggcagaggcatagtctatttcatgcgggtacccttcaggaatttcacaagccagtagcacacagagctgtttttgttgttcggtcacccaggcatgtccgactccatttgaccccacggactgcagcatgccaggcctccctgtccctcaccatctcccgaagtttgcccaagttcatgtccattgcatcggtgatgccatccagccatctcatcctcgtgcttgggttagcagggctgtttctttctagaactgagagactgtgcctgcaccttgagcgctttcaaggacatggttggagagcagagtcacatttcagaggccttctccttagaagctaagaaggctggggatatcgaagggagagaggagcagatggatggggcatgggttgggggcctggctgttcaggcagtgccgaggaggaagtgttttacgaggcagggttggcatgaggcacaggaggagctagaggtgatggtgtgggcaatggaggggcattttactggccagcctggtgcctggggcagcactaccccagggcacctgcactggctgagttcagtgggcatcccagctcccctaggagcaagggatggccctggagcgagggctggaaaataacctgagttcacagtcccgggcgtgacattagtctggagaagaggtgagcgtaggtttggtcagataggtcagtgcgtgagctgagcctgtttagatgcggataacacaggtggtcatttcagagtccctgccatcgggggacagagggacccagatgacatttttcctgcatggacggtaggctctgttagcaggtccaggcatgtggatttcacagtctagcttgatcaggaacacaagatcctgggcactgaacttgagtcatcagctcttcctttctttgagtcaggaagacatctaaaaaccaccttctccacttagcatcactttcggaaaccgaggacttcccaccattatgagggaggaaggaacagcgcccagaggcaaggccagtgctttacttttagtaagaacacatgtcttctttacttttctcattttgcttcaaaccaacgcaaactccgtggagcggcagctgcccagagcctgtggcttcaaggcggcaattaacccgaggcccggcaacgctcacctgttggccgtgtggccgccctccggagggccctggccttctaattaatggggacatagatgcctttgtggctccctcacagaggggctgaggtgattggaggcaggtgactgctggacttaacacagtgatttgatgtgtgacctttactcctcattttaag

SEQ ID NO: 40767 - DNA, 818 bp, Bovine  19866880845539
agaaaaatctgaattagaaacacttgaattatcattgtgtgtatgtgttttgttattgtcagtttttgcacaaacgtataacaaatattaacagacctcataatcaggaataaatagaaaaacctgccagagccttcagtatggaaccaagaaaatatattccatttttgttatcttctgagcatatggaatatgttaaaataagtgaacccaacaaatacttgtaaatcacatttgtttttcttgtttccctgcccccaaaacaaaaacaaacaaaaacccactcataaatcatccattttatatataagcacagttgtaccttctccttggctgcttctgatggtgcgaactggccaaggtaagtccagctgttactggcataaagaattcagctgactccagctcggatatgtcttgggttcactaggtgtatatgtgtctctctcccactagaaagaaaagaccttgagtgcagggactgactttttttgctgctgtatcttcagcatctagttcagtgcctgacatacagaggtgcttgatcaatgatgaaggaacgaatgagaatttgagttttcacaacaggacacacagccagttttcttccccatatgattatccagttttcgacagatttttttcctctgctgtgagtatttttcaaaggccacaaacactaaagcatcatttttcacttttagataacacagctccacataagacagttttgcagtgagtatgaaatggatttacacatgtggggattttagcatttacatcctcaataagctaaagattgcattatttatttataa

SEQ ID NO: 40768 - DNA, 1260 bp, Bovine  19866880855544
aagcatagtgagccaactgaagcctctgacaacatcaccactgtgtggtcacacagtccggctggtgcctcagagaaactgattatattgtagagacgggtcttccacagagcatagaactccccctgccatgccaggctgcactaaatgatcatattcatgaggtccacacagtctttcttgtttgagagtctgagagctcaccccacacctgggtccttaaacacttggtttatggcctcttagcttccctggtggctcagatagtaaagaatctgcctgcaatgtgggagacccgggttcgatccctggatcaggaagatctcctggagaagggaatggcaaccctctccagtattcttgcgtggagaattccatggacagaggagcctggtgggctatagtccagggggttgcaaagagtcagatgcaactcagacatttcacaacagaaactggaggatcagcccagctcctctccaggaagtagttaccagagaagttccccaatgtatcaaaagaatcagaatggactgagcttggtggattacagtaagtgatcttgcctttcgatattacccaaaattttcaggaagagctaaagtcagattctggagctgtagcctcattcaaggatgtaagcaggctcagacgtagtctgtgatggatgttggacaacttaatccttcattattctaatactggtggaaactgcagcttcttcattgtgtaaaacttaatttctttgcatatgtcaagagagagcagttatatctacaaagaagcaactcagatttttatagaactgcaataatcttatcacccttggctgttctgtttacagaacagaattatttctctgattttcaccccatctggctaattccaaccctctctgatgaaaatcagctccctgttctgatcccagctctaagttccacgtctcttttcttctctttcatattatcttgttctgttcctccaatgtacatatgtaattatatgtataatatataattatacttggtcatctggttatttgtttaaagtatatctttcccagcatttctctgcataaagatcaccagaaagacaattaaaatgtagacttctggatatcctcgcagactttcagaattatggttgagggaggttggtctcaccttttttattgagtaggtgataggtctcatattttttattgacactgaagtttgagaactgcttttctaactctgtctgtgagggcagaggtcatgt

SEQ ID NO: 40769 - DNA, 1120 bp, Bovine  19866881001085
tctaccagttttcaggcttcaaaggaaaatgcctgtttgtgaggagtgtccacagtgagccatgttttcaacttgcctccttagcgcagtaggcagcgcatcagtctcataatctgaaggtcctgagttcaaacctcagagggggcacttgtgttttgccttcatcacttcctaagagaattttcagagtaattttttttttagctattttacgttcctcttagtaactttacttgttttgacaaatattagttaataatattgaaaatgaaagtgaagaggtggccaatatcaaaggagaagccaactgaatgttgcaattataatatcactagatttcaaaatttatgtcatacatttcattaaagacatcatctcataaaggaaatgctccatggattgaaattataaaatattaattgaacatgaaactaaatatgttttataggagaaactggttgtaaagcaagataaatatactttaaaaaaaatatctttgtaagacaaccctgtggagggagtgcactcctttgataccaggaagggtactagtggtttagaaacgtatgtgtgggtattttaaggggatgtttttgaaccttaaggaacacatactgaccaagaagaaatctgtgtgtacgtgtgtatctgtatgggtgtttgagagagtgggaaagcaggcagagacctggtagggttcaatgtgtgttcaattgcaaacacagatactgggccaagtggccaatatgcttaaatatgcattaggattagcataagcaatcattctcaggcttttaagaaatggagctgtctttaaaaaggaacgttgggcaatcagtaaaaataatcaaaggaatgtgcaaaggcttcctctctatcccaactctttcacccaatcatcgggctttctttttgccccagttactctggtttgaagagatgcagaataggttgaagagaaatggagtgttctggaaaaatgtgaatggagtctgaggattaggaggtggaattaattaatcatatttttttttttctttaaaaaagtgattgagttgaaggtccatctcagtagtggtcatagtttgggatatttctaaaaagcccttgtatgatgata

SEQ ID NO: 40770 - DNA, 1094 bp, Bovine  19866881093594
catttggacttcatttacttttccactacagctcagctattgagtgggctcttggagcttccaaaaaccacttttattttgtgagtgggaggcttagataaccaggaatgcttaattaaatgcaatatatttttccaatgaatcccctatggtgtactcctttttaacagcattttaagcttctttaactgtaggacaactggtcttgaattgactagcagacagactcaccatagaggcatataactctgctaagaccaaagatgctctccaggggctcttcacatgttgtatttttccctcttggggtctcaataagttggagaaaatgaaaatgttctcactgcacggaggctctgttataaacttcagtcttaagagctactcaattcatgtcacagaaatcctcttgaaatactaaattctggaatcttctactagtgagaaaataacagcccatggctgatatatttttttccctgagacttttaaatgaaatgattaaccttccaatacatttgaaggacttcctaaaagggggaatgttcatgtttatctcaaggagaagctgtttgagtacctttcatatgatggctcaaattccattgactggaaggaaactgccttttcattattgcactataaacagaataatgatagttaattatttcagagttattgttagttaacatttgtccagtgctggcgttttgagaaacactagatgatagtcccattagtttctttataaagtgaaaatagtccaagttatagagtgatgaaatgtatgctaatttaacttggtgccttcaaaaattgtttagaagcaggttacttgaaaatttgagtagaaagatacattaaataccattattagtatagtctatgaagaggttttttgtttattattgtcctgtgattgtttaggagaaaggtcatgcatgtgaaaagtgctctgtaaatttcacctatgttacatgaggcagcatagcgtacaggttataagcacagactcacctgtaccccttcaggcatggaattgtgaggctaccccattcaccagctgtgtgacctgagaaagtcagttaatctct

SEQ ID NO: 40771 - DNA, 1446 bp, Bovine  19866881237383
gtgttggataaactgtaatgttgagttcagatagtggctgctttcagctcagtttctggagggaagaagacacggagcaggaccagaacccaaccccttcatggacacacatgagagagaaatcaccctttttaagtcactaggatttgggggtccatcgcgactacagtacaactttagtcaactgataacagaaaggtaattgatacagttgattgatggagaaggctcaatgcaaagtggccttctgttgacctcagtgagtgctgaacactgaagatatgttcagagttttctggagttgctggcagtttcttccattttaaaacaagaaaagctgttctctactgtgtaaatgggccttttgattatgtcccgaacagaccaaatttgagagttcctgcatcaccccaaatatcattcctaggggtttcttttgtaagcatcaatgttgttttatttgaccatttggccattttactctgaccaaaccagggtggagacgcaagcatgagcaacctgcagggtggccagcaagccttcttagtggcattgtataaatgctttggtagtcagaaggaatgctgccactggagtgttcagatctcctccagaaaatatctgatcaagatacatgaggaaataacatgagtttgcaggagttcaaagtcatacagaagaaggggcaaaggatataactgagtcatgctaacagtgaataagagagtaaggtttagcaagcttgggctgctgaagatataagcagtttacttggctactagaaatgttgctaagggaaatctgtgtatatcctgatcttagtgaggctgtcatggtggttcttcctggattgccatgaaactttaactttccttcttccttgctctccctagtgctgacagcacagataatattttcatcatccttccttctctgcattcctttcaatgccaccccttttccattccaagatatgaaccagcatgtccctgttcttgaaaccacaaaatgctttaacacaggccagaaaggacaacaaaggctaattacaaatatcataattgacaatagcaaaaccacacacgcgaagttaaaattcctctctattttgagtgtggagcttctgggtccagctcgtcaagaaccttgcaccatttgccttcccctaaatgaaactgctttgcattggcatggacttttaatttgtctgaattttgttttgttttgggaagttggcttgaatctcctcataaaaaaagtatttcctcttacttcatgtggtttgtcccacatccagagagcatcctttgtattttgcttctgagccaatatttctttttcttctgtttttaaagctgttgttaaaagtgttgtggctctttcctcttcacctctgttaggagggattcttgtaccctggaacttcattagcctgtgaattaactc

SEQ ID NO: 40772 - DNA, 592 bp, Bovine  19866881272241
ctgtagtaacacccgagtaaaagccctggcgatgtcttacttaagactcagcagtttaaatatacctaacaacaaagacatttaccaagaagtaaagaaatatctttttctatttattgaaataattaaataaccaagagtaaaatttttaaacatacacaaaaatattaactttaaaaattaaaatatagtaaaactgtaagtatacaaactaaaattacattaactgagcaacttcaaaactatgtaagtacagggtatttatgaaattccttagaaatggaacattaattctttgaataaagtttgaaatgtgtaattttcaaactaaggaaggaagtggtatataatagatccgtccaatttataatcatccaaagggaatgattctgtgttatttcttccttgctttttctaacacccattcaattacctacggggagaaaaaatatgattatggtacattcttttgaaaacaaaagcgatagaaaaatacattgttcaaaagagcatggtagaaaatttaagacaaaaaatagcacatcagactcttaaaaaatacattttatcttaaaagtaccctttactggtg

SEQ ID NO: 40773 - DNA, 875 bp, Bovine  19866881325876
acacctgttacacaacacgatatgcatttcctcaaggtttaaatggctctgcctcgggcacaacaacagccgcagattttgttcccgtgctgtagaggaggctgtagaaagtgatgaatgaaaaatgttctcaggaaagatcagattactgggatgcctttaagggagaaaagattcaattttgatgtgcatgtttagactgctgaccatgacttgaatgtttggaaacagaaagggagcaaagtccagcttccgctttaagtgtagttccatcaatgtttaattatggattaaactactggcatcatcctaaaataataaactctcctacgcagtgttacctcatatgtgctgtccagagggaatacactcaggccaacacttctttcaacagagggaaatgctgatgtaatggactctagctgttcagtgaatctgaattatgtgagaagagtcatatgagtttgggtggagtaaagtgggtcacagtgtgattttgtgcttgatatctctgtctcagataacggaacttcttttctctcttcaaacaaaacaaatttagttatatacaatttagttataaattatttgacttaaacgttgctcaactccagtgcttagcaaaaggtgtagaatttaataggtatttaataagagtgccgcattgtgtcgaattgcaaatgaattgatgcctcttcatcttcctccttcactcctcaacacaaaagaagaaacttaacctgctgctcggattattccatgaatataataatagtgaactatttataactttataaatagctgttttaaaaagcatagttataaaaaagcttttaaaaagtttcactttatgcttttatgatgcaaaagatttt

SEQ ID NO: 40774 - DNA, 875 bp, Bovine  19866881331792
gctctttgagaaagaagcatgatggtggatatgaaggttctctaatgggaccaagtggtgggacaagatttcttacctttccagctctgttctggagggaccacccaaggtgagatgtgatttttaatctctgggcctactgtgatcttggcctttctgcgtaaactgtcaacaagggtgctaacgactgctaactgttatggaaaaaaacaggagtccaggcagaactgagctgagctaactgcttcatttcgctggaagcactaaatcactttctgcggccagcagctttcatctaacctcagcgtaagccgggttgaaccaatgacccacgaggcagagttaccaagcatcacattaccaagccaggaggtctgggatcacacagcctggtttacatctctcaggctgtgccccactaatgacaccactcacactgagctgggtttttcctctggtctgtgagcttagtgtcacctttcactgttgcgtccttttaaagggtgaaatctgccactggaaactactatggttcattagatgatccgcactgtattatattgtatgaatttagaaactattatcttctttccaccctttgtcttatactaagtcgcttacatgatttagagaggtagacagataaattttgtggaaaagcttaaaagcctcttagtttgaagaccagcaaaagttctctaggaactattactttgaagtgtttatattcaaaaagtgtcactgctgtcacgaggaccactcacttttttttacgaattccagtgaattcatactatatcatttgaatgagtgtgacataaactaaaggtttcctcatacagcctaaatatttaaggacaattttccagagaatt

SEQ ID NO: 40775 - DNA, 989 bp, Bovine  19866881356188
ggcagggggattctttgacagttgtcagattgtgtctagagaggatagagcgaactccttaataggaagttgaagggggaaaaaggaaattggggaacttccctggtgggccaggggttaggactctgctcttccactgcagggggcacaagttctatccttggtcagggaactaagattccccatgccacgtggcccccctccccccgccaaaaaaggaaattggggtgacatttgtttaacacagatatgattattgggtagcctacatacaataaatgtcacaaagcaccctcaggcttgtcttcctggtctagcttcaggggagcccgacagaaagaagcagtcaggagaggagtgctagaacaaaagccaaaaagctcttaacccagcttgtctactgaacttgtggccctgggaggtagccagcattgcccctgaccctgtctcagcagcaatctgcctcttcaagaaggataaggacaggcaggagcttgtgatgctcacgctgtgaggccaggaggtccaagtgagggaaggttgagcgttggggacactgtggcctgggaccatggccgcaaaccagtgccaaatttcccacgactgagacatggtggagggggaacccaactgattgctgtcttagtcttaagggtcaagacttttctgcttcggcataattaaattgccttaagactgtttctaaagggaagaaaaagaaatggaaacatggattcataaggctgcacctttccctctgtgcatattccctggggaaggtgatccattagaaacagaggcagacatgccaagagcaataaagaggcaggctctgtgcattaagcaggctgtagttaaaggctttccctgagaatcctgctcattcattaattctagccttggaagggggccaagctgtgtggtttcaccacagcaaggggcaagatcctaacgattaaatgctctttgttgccttgcgtttcactttt

SEQ ID NO: 40776 - DNA, 840 bp, Bovine  19866881497393
ctgtatcccttcttctttcctctgacatcccagagccttttattactgaggtttctatcctgttataatagtactgatacaactaaaaaacttttgtcagtatggtgtgtgaaaattgaaactcatagttcacttaattggcatttcttttattattagagaacctgcatatttatgttaggtatattctgctcctatctattacttctgtgatttgactatttacaactactgagtatattttaaaattaaagtgttgattaatttttattttagaagaaatatttatatactaagactattcatcttgcataatgtattttgaaaatatttttcctgtttgtctttggattcaattcatgcatagtacttttttgtgctacagatgtttctaattggtatgcagtcaaatatatcaataatgttctttaagatgcttcctttgtttaacttcaaaagactttccccaccctgagttcagaaaaatcttgcctatattttattttatttggtttattgtttcattttttaaacattgaattctttaatctgcctcaaactaacgttgatttatgttcagtggtagaaatttacccctccttccatagtgaaactgagtatcaagtaacatttattaaaagtatattctgatttaaatccattaagggtatgtttcttcccccattgtagagcgttgatatgatgtggagtaaagaacatagactcgacaatccaaatgaccttgccttacctttctattataatttgctagctgacggccaagacaatttacttaaaattctcatttacttcatagtattaagtaagcctaatagtatt

SEQ ID NO: 40777 - DNA, 1149 bp, Bovine  19866881595968
agttgggactccctgagaaaatctggctgcaggcttttcatccaagaggcacccgttctgctcaggctagcagcaccctggccccagccagtgcgtcgtcgtggagaagccctcctccagccccaggcgcgagagccgagatcaaagcgcaaagcacaaatgctgctctgatcaaaacacagctttcggcgtttgatgtggcccagcctctattgaggtaaggacaatggagtagtgtggccaggggactttggcaataagtataaagcaaggtgcactccatcaaataagaacgagagaaagcgagagagacagaaagagaggaggagagaaaaggaatgaagggagcaggaagaagggaagtaaaccgaagtcagctaggaccccggggagcagctaggggacctccagcaaaggaaagcactgtatacttgcccagggtccctttctgtggaggaacggtctgagcaatcagatgagcgagtcttcatcccagtctcactctgccattagccaccaagctggctttaccagtcgcgcaccttctaggtcaactccccagaggccgactccagccctttccagccatctaacacttagagtccatggctactgacaggagatgctgcttcatcctggcaaaccaccttctttcttggaggaaaggatctctgatatcctgtgtggcaatgagacaaagggagggtgtctgagccagtccttaaatctccctgaggtagtacctggccctgctcacttccactttcaaaactctcaatatgctatggaattaagatatagcaaagcaggatgaccaaaactctcaaatagtctaaaacacacatacttcacaattacccttatttactaccaaaataaaacctcatttggggacaatgtcaggagactcaacgtgaggccttttatgaacacgaggccggagctgaacagcccacctgctcttcctcctaagcctggccatttctgcaccccaggagcttagcacgttgctgtcacatggtgggtaataaagaagtacatgcaaaatgaatcaaagcacacaggggatgcatcaacggtctgcacgcctttgggctctgcacacttcattaggaaaacgataagaaggcaatatagttatctgagaag

SEQ ID NO: 40778 - DNA, 1065 bp, Bovine  19866881715984
cagtttactagtcctaatattttatttgtgaattctttaggtttttctctatataatatcacgtcctctagagatagttttactacttcttattctatttgtatatccttttatttctttctttcctctctccttccttgctttcttccttcttctccccatccctgaacaattgtcctggctcaaacttccagtaaaatatttattacttatcttgttactgatttgaggcataaagttttaacatgaagtatggctgatgaagatttctcatagatgcactttattaggttgatacagtttccttctctttccagttacttgaacgttttcagctctcttgactacacagcctcaagtgcagcaccctagtgcgcagtcagaggcggagggtcagggagggtaaagtgtccccaaaacgaatcagaattatgccgtctctagtttttaccacatataacttgagaggcttaattagtttagctcctgccaaaatggagagcgtcctcaagtcacagagagaaaggtctgccttgttatcactcacctatctgtgttgagtgttgtgactcacatggcaaggcatagctgaaagtctgctgaaattctaaaaatgaataatgcacgatacagtgctgtgtcccagaacttgttttattatctaaattttgcacacattaatatgcctcccaagaaggtgacttgtttctgaaatatcacaagaaaatgcaagagaaacaagaactgcatagggaataaaaggttatgccaaattattgcactgctttggtaagtgaatttgaattagtaactgaatctatttcagtataaattttatttagagaaaaatctgtttcttcctacccaaataagtagctattgaacatttgtctgaaataccaaattattagctactgagattgcctgcatggcttgctgtgaacctgcagaaaaatctaagaagtaagcagtgaaatgatggaacgaggttgtgtggacctgttccccccctgtgtgagttgcaaattatgcctagggttcttgggaacaaagacaccacttaag

SEQ ID NO: 40779 - DNA, 1116 bp, Bovine  19866881879193
cagtataggcatattattcagaatattagaatacgtattctagtttgtaaaaatatgtatcccgtattttaaatagtctgcccacactgctattagaatattctaaataatatgcctatattgcgatatattctaatattctggggaacaggagagaagatatgagggagggtaggtgaaggaatgctataaacatgaattattttgacttagaaaaattctaaaaatgaagtagagaacagagcaaaaaagaaaagccattaacttgatcttctacgcagacgaaagggtgttgcagacgaaagtgcatgaggcgcagggccccaaagaaccatttaattcctgggttttccgttcccctctccttgtgtggtcctcccgggcacgtcacctcttctgggaagcactcctttccacttcatatggacttagtaccttcagatattccctaagttctgttacaagatttcctcctttgcaatttatatgcttatagaacttatctgtaatttatataaatgcagtttattactctacacctgtctccccctccaggctgttccattttagaagagcaggaatttcatttcattcctctatagatttctgcttcaatctaccaacaaggtccaccttactaaccatcctaagacaaatggttttcttcctttgtttctgctttggttgcaccgggtctctgccgcagcgtgcgagctctctctctcggcagcgctgggctcctctggtcgcaggggctccacagggtctctttagttgcagcaccggctgcacggaggggcttggctccccgaccagggatcgaatagacccacaccccctgcatcggaaggtggattcttagccactggaccaccaggaaagtgccgaaaaattattttaacgactagttgtgtaacaattttacaccgtaactcgtaattcaaactgcctccccttttttttcttcttcttcatattttatcatctctgaattggggaatggccttaaagtttctgaaggcctggatggaaaccaagttcttacatagagtattcataatttttcctctcattcatcaagggccctcccagtctgaggacactttagattatcta

SEQ ID NO: 40780 - DNA, 660 bp, Bovine  19866881973245
ggaagtatttacatgtatatatgaaatctgcatgcagtgggggagacccaggtctgatccctgggccaggaagatcccctggagaagggcagggctacccactccagtattcctgcctgtgaatgacaagagtcagacatgcctgagtgaccgacacacacgtacacgggtcctaaagggacgcgtaggctgcagatcactcaggactgagtcaaccctgcttccatttcagggcacgctgggaataaaaaatctccttggcaacataatcttactcctgcccacatgcaattctataacccagaaagaaaaggagaaccctgctgaagggagaggcatccagtggcacgctggctcacagtaggtctacactcagtaagtggactgagcgcttagtgaggaaaaacaatccagacaacttctttgagagtggacgagcccgacgtttctggagctggggggacggggcgggggaaggagcagccagccaggccgcggacggggctattttcagcaggccgggccttcctaacggcggtcttgttcccagctgaactgcccaccgcttgatgaattgtgtttatctgtagttcagcgataaagttctcctttaattccctgctgaatagaaatatttagggcaggccacagctttcagca

SEQ ID NO: 40781 - DNA, 1234 bp, Bovine  19866880362906
actgcagctcccagcagcgagccgggcctgcctccctgagtccccgggcagcaggccctggcagaggccagcgagctccatcccagaagtcacaaacctctagaggagatggttagaaaaaacgttttttaagaaccagtggaaagatgccggcaacccttcaccagtgacacaaccttcgctagtgtaacaacacacaaatgcagtgcatagggcaaaaactcctgtcttcccaacaatactggcagtaatttttaaccagcattctgcagcaaaaggtcatctattccacatacttttgcgtgaacttatcattttctctccgactcagagaagctaccgcctgatctgtatttttctgaggggaagccaggggtcctgtgcagggatttctgtgcccgtggatgcgcatgtactggctaggaaaaagaccctgctggtatcagtggtgacttctgccactaggaaatggatcacaggctcttccggagagtggggacttcttcccagccagaccagtcatcacagaatcctgtgcaggtcgccttcgtctcccagattaacttctaaagtgccctcccctgaaatcagaccactcaacaccccgggcagctaaaacagtccaggcctgattctcgccaagaaatgttttcttgaaggagaggaggaggaggagatgaaataggggtgaaagatacaagaggcgtgtgtgtctgtgaattactgataggagttcacactgggggaaaacaacatgtgaaaagccaccaaaccaaccctggttcacggtttacgttttatgatgatgaacgggggagtctgctatttgcttaatggcctcaggtaagacaaatccttcaggtttccaaatgggtggctcctctccatccagggttctatagaatttttttttttccccaaggagtccatctgtacttaagagagtcatcaattccagtcagtagctgccacatccctccctgcaccctcagggctattaatatcagggttccgattgttaatgattttactcaaagttccctgcagcagttaaaaccaggcaacaagctaaaacacaaaggggctgcttttcttcacccataataacgcattctgcaatccagtgaacttcctggggtttcatgtctgccgagattttcacctctatcttttgttttggaatgcccataagccctccctgcacggaccggcacggccttcctttctggatgca

SEQ ID NO: 40782 - DNA, 1220 bp, Bovine  19866880472693
ctacttctctgggcactaaaaggaaaaactattcaagaaggtctacacaagtatctctcagatagctgttaatgtctgggaagacccacacatctctgaaatctaacaagccaacacttaaaggaaccataatctatgcaattctgtgaaaattaaaactcttaccatttatctcatcacaaggatccttacatccctggatgatggctttcttgtgactttttcaaagcccacagcctacatctttattctaaaagagaaatatggataacacattaacaggaacaaacttattcattcccaagaacataatttaaaacgttgagcctcagcaagttagaattcctcacaacagaagtcttttcagacagggataactttaaatcatcctcagctcaaccagtaaggaacatttctaaatctcaatcaactttaaagctcaagttccaagtctcccttttacccgtgaatgcagtggcatccactttggtttcaaagagcgacacctagtggccccaattacactggcacagagaccatcctcatttctggattctgggtaggacccccaactggtcctgagtcagccaggattcagagctgcggtgtgtggcaggctttaagaccatctcggctttctcatttctgttgcccacccaagttcctgcctacatgcatccttacctatttcagacttccattcgttacttctaagcaggtctgctgctcaccgtctctgcagatgccaaagaaagcctgtggacaataaaaacgtaagcatgttaagggtcgctataaaactgcagccttccaaacaaagtctaccacgccactgattatcagctgtagaattaagtgaaaattgattggggctgtcctctacgctctccaacaggaagccaaatatttagacgttaataccctggatgcgagcttgccccgtgggaggacctgggggccagcagggccgctgagcctggaagctcagcgcttgggtggccgtgaggcctgggaggtgcgcaggatggaagagacgctctcccccaggagggacgctccgatgccaaaggtgggcttgggctctctctcccttcagtaacaaaaactcacaccctttggaaagtgttttctcacctcagttaatcctcccaaccacctatgggggtgggggttgggggaaccaggcctagcgtcactatttcgccttcaagcagcggaag

SEQ ID NO: 40783 - DNA, 863 bp, Bovine  19866880535591
tgtgagaggagtccctgcaccactgctcgctacttcacagatatactggtgaggacaaatgaggtgatgggtctgaaaatacattggaaaaaagcatcatagtgaaggacagctatgaaaaacgcaatctggctttaaatggggaatctctgactttggagatcttacacggcaataagaatactaatttctacttggctggtgaacaccaacatgcagagcatgtccatttgtcgggtttcctttaatgccacaaccaggtgggtattatgatgaggaggtaacaggggctatttattgagcacttactataggatctcataaatccttgggataccattctgaggttggcactgtttttatctccatatcctcaatgaggaattgctgcccaaggctgcccagcggagtgggtagcaggaccaggaaggagccggagcagctcccacattgatgacttccccagtccatctcagaggctgctctgctggggatggtggcctgggacccagcgggtccgctgcccaacaacacccagcaccacgttatggccccaaggaaggacggtcctgccaggtccctcttctgagccgtgagagtctaagggcctgcactctgccccttcatcctggggtctctcccaggcccctgtgtttactcctgaccctctcagtcccggcctgcgctgctgctgggagaagcctcagcggccagccttggggagtttctcagcttccagaggcatctgggcttccaagagagcctgaaataggcctgtctgcgttgggggaaggcggcagttacaactgggaggggagccttcctggagcatgggtgctccctctgggactcttcctgcaggg

SEQ ID NO: 40784 - DNA, 1834 bp, Bovine  19866880845656
ctccatgagaagagtcctaacaggtcatcaggtggcaatgtgctcccagccaagagatcggagtgggctgggtgggtagtggtggcgatgctctggactatggcaacagcatatgtgacagcagagagggaaaacacaggatccgggagcagagaggtgggtctttagcaaagattcccacgtttacattggatatggtaatttgagagtcactgtagggtcctgcgctagggaacgtcatgaagacttgttgctgttgttgtcatgccacgtagcttatgctttgctcgcgggatcttagttccccaaccagggcaaactcctactcatcctccaaaaccccatgtcaaatgtctcttctttttgccaacactttcactaatcaccttatctattccaggcagaatgtgtttataactcttaaacctaattctgttaaagcatatattgaaatatgagttatttgcttatacatttatttccactgatagattaggaaacactcaaacaggagccactgactgatttagctttatttccctggagcctattgaggtcttcagaaaatgttaattgattgaataaattaaagaaagagaacgaaacacaaacttgcctgtcttaatgatatcctaagtccagaaaggaattcatgagcagacctctttccacatctagctggttgatttatccaaagagcaactgggaggctggctgcctctccccaccttgccctgcccccaggagctctttttcatggtccctgttattttaattggttgcaatacttccctgtcccatgtctactagtttagctaatttttctaaatctgtcacttcttgtggagttggcggaatgagattttcttaaaaatgggagaaaatggcgagcaggagagaggcctggttgcagccccagctggagccagagagtaggtacagaggcaggggtggggctaggtagggaaactgagtcagggagaagaagtctgtctgccctcctggggcttctccccggcctgggcagagcctcctgagacaggagagcttcctgagctctgagcatcacagaaacaactcctggcctccagcccctccctatcccccacccccaccgccacccccaagcctttgaaaccctagtgtgtgcttagctgctcagtcatacctgactctttgcaaccccatggacaacggagactggcgggctacagtccatggggattctccaggcaagaatactagagagagttgccatgccctcctccaggggatcttccccaacccagggattgaacccaggtctcccgcattgtaggtggattctttaccatctgagccaccagggaagcccaagaatattggagtgggtagcctatcctttctctaggggatcttcctgatccagggatcaaaccggggtctcctgcgttgcaagtggattatttaccagctgagcccccagggaagcccagaggggagatcattttgttttgcagccagcaaagacttgtccttacaatggtcagattttcacactcaagaatccatgagctttctggatagaaaacccccacctcttttaagatgcaccagatactgattaagaattttgtgggtattgagggggttgggtggacataccatgtcacatctacacatttgattaaagtatacatcccaggactcccctggcagtccagcggttaagactccgtggttccatggcagggtgcgcggcttagatccctggtgggggaaccaagattacacacgccaggtggcccccccaaaagggggaaaaaaaaaaaaaaaagtatatcccgattacaga

SEQ ID NO: 40785 - DNA, 782 bp, Bovine  19866880863244
gaagcaggtgaggtactcgacccagggccagtggatggggtagatgtacagccagatgaccagcgaggcaaagaggccggcgaagaccaccagcgacaccaggatgagggcgcgcttgcggtacttgtcgctcgtgccgaaggtgatgtagggcaggaaggcgaaggccagcagcagcccgctgaggaagccgaagatgtgggcgatgttgtcgatccagggcaggaggccgcagatgaagaggaacagcacgatggccgacaggttcaggaaggccttccagggccgctccagcagctgccagctctggaagagctccacgaagaggcaggccaggaggccgaactgcgaccctgcagggcccacctggggcgggtgggcggggcacggacacggtcacttccaggcgccgggtgggagcccgcggggagccctgggcacagccaggctggagccctgggacccaggtcatcctgtccgtgaggccctcccagggtgcggaccccgaagctgagggctgaggtgcagccagcgccgccggaacccagctggactcgttccgcccaccctacgtgcacagtgggcacagcaagcaggacagccagcctgctccgggcagcgcacgtggcggggacagacgctgaatcagcccggagcgtgaggtggaactgacccacaaaccctgctttcttagcaagaaaggccacacgagggcgacttcatatgacccagcctgtagctaaggggcgtgctggccggcggtggttgtgatcactgggaga

SEQ ID NO: 40786 - DNA, 1707 bp, Bovine  19866881194281
tgtggggatcccaattccaaaacccagctggaactgcccaagccacacagccccccatcctaaggtgtgggccgctgttggtaacatacgggggacaggcattattgggagggaaatgccaccagatggccccaaccgaccacgatgctgtgccctgtccaccacagtgccctccccaaggccccactggcctccaggagctgctgatggaagcagaccagggacacagctgggcagagaccttccagacctcaggaaagtagtagcctctagcagctgggggccgaaggctgctcaaggacaacagcgggaagggatggagtggctgggtcctgagatgctctgcccggcagcctggcctcctctgggaaggtggtctattccctcctggttctactgctcctggagcatagccagaaggctctggtccatccaggctggataccagggcacaggagggagcctgagggggtgggggtacctgcaccaccgggcaccacactcacccagacctgtcgtgaaccaggctttgctccagacactcctgaggagtgtgcctctctcggaatcttcaggcactgggagctgggtttccactggtcctcggaaccggtaggacctagcagacgctcagtggtgggaggggatgggtgcaacacgggtcggggaggaggagaggcccacatccctcccgccaggggctccagaccccgaggcgtttgcagacacaaccaaccccggcacacagaacaggcctctgtggtgtgctcgcgagggcggaggccacccagtttccatccccgccttgtggcctggctccagacaatgagaacgctgtcctactcggggagacggggtcagaggcccggccctgagcgctgtgtgatattaagcaagccacttggcgtctctgagcttcggtgtgttatggggtcgccctgggaggctggggagccgagggacaaagcctgatattccacagagaggttaaacgcttcgcccgctgtcactcagccactgtcgggccctgggctgcctggggtcgctcacctcaacacgctcaggacagggtgcagggtgccccacactcctggaggctggggtcggccgttagcacagagtgaagatgccaggcagacacttttcagcttgtaaacagtcattaaggagctaataaaccagacttcccagaatcctgccctggggcttgctccgtccctggaagaagctggccccagtcccgatgcctgctgcgagggctctgggacacgtagacgtgggccagccaggcccctcagaccagaggggctctccacacgcattaccagctctatctctccaccttgctttggagccactgaggtcctctcattgagaaatgggagctgagggggctcatactctagcttggccacctatccactggaagaatgagcaagttatgacttctgagcctcagtgttctctgctgtgaaatggggtgatgcagcagagatgacatgagatcgtgaatgcccagtgcctgggaaaattggtggagggtaatgtgtagcttcttttattcctggctggcctccgccaccatggctgacttggtttctacatctgagccaagtgccccggaggcagcagatctttgacaggtggggaaactgaggctcggagaggtaaaggcaactgtccgaggtcacacggttaggccgtggg

SEQ ID NO: 40787 - DNA, 870 bp, Bovine  19866881492097
agccgggttcggctgatgcctaggtcaggtcgcagggctgtggccagggcaggactcatccacagtggcccccacgtggtccccaagaaagggtctgcagtgccactgcccccactcttagggatttcagcaccagtgaggggctggcttttatgcctggctggctccccagatagacaggctccatgcaaccggggttgggggggtcaccctgggcagtggggagggattctctcagtccagctgggctagaagggatgcggagagagaatgaggtccactccttgtgtgaaattgaatcagactgctgggggtggcatatgtatatttaatagcttgtctgctgtaagacagtactgaaaaccccaaaatatgacccgttctgggaaattcagttggtgggccaggcagagaagcagttcctctggggctggcctctgctagccagtgccagtgtgaaggcagagagccccttcgtggtggatattgcagctagcagaaccccagagttaatctgggccacagcccctgcggaggggcttctcctggtcacccccacccccacccctcagccccaagcctcacctccaccttccctgagcagtcagggaacttggggtcactaggtgcgtcacactggtcccgccggccttcagacactgcagagagagaaggccagcttgctgaggacctgggcccgggaaggagcccggcagagaaagcgcaaggcgggtgggaaggggaagcgtgggcacacatagtgcccttgacctgagttttcttccctgaaaggccacctgccagtggtggcctgggcatgagttgccccctctgccaccatgcccaccctccttaggcggttcaggccaa

SEQ ID NO: 40788 - DNA, 1429 bp, Bovine  19866881672112
tggcctcctgctttttctcccagtttgccactgcatggagcacttgcagatttttaaataaaatcttattatcatgtctccagcggggttttgtttttgtgttaaacctgagggagggaattccctggtgggccagtgcttaggactctgagctttcactgccaaggctctgggttcagtccctaaacttggggaacttagatcccacgagcctaaacagactaaattattaaacaacaacaaaaaaaacggaattggatctaaataagttaaaacttgaggtaaaatcaacaagctaacctttttgcaagtggctaccccagcgctgcacacgtgcccggctcccgggaggcctgtctgcgtcccgggcctttaaaccccagagccctgttgtccacgtgctgctagcccaagcgtcactggggcggcattaagagggatggtttctgggcagacagtgaaatcctgaggctcttgcgactctgtctgaagtccctgcccgctgcagctgatgcccctgttatgttctttgtgtctccaagcagcctggcacttgcttaaatgtgacagaagtggaggacccacattcctttctgtcatctcttccgcattctctggggtctggttggaatcccgtgggggctattcgggtgtcctaatcagatgaatcgaccagattggatcatgcatttctgagccctagttgtcctttccagcctcagatttctcttcttgccttgtttccattgttgtagacttatatctgcccctggggtatggttttgtatttgtactctataaggaaagtctttagagaaggccctgccgttatttcagcctggggccctgggggttctgcttgtaacctttcattcccctttgcagcagccgtgctgtctacctgctgatcacaggcggttgtacttttccttgacaggattagggacacttgtggaggccgtgctcacccctaagctgaagctctccctgaggtggctcctgtggcagctgttggcagccactcacctcagtcttcctgtcttctgctcctaccttctcctttgtcttctttgaatttggataatcctctctggcccaagctcatgcctccggtcaaatgctgttttttctctgctaaccgagactagattgtcaagaagttaaaaaaaattcagcatgctcagcgaagcactgaaggccgctgtgacatcaggtgagaaggttctgtgcttctttaaaacctcgccggtcgaccacctgcaagcctggagggctgtggtcctttgaacgccttgtcgccttgctggagttggtgaggggctcccaccatccgcatgtggccggctgcacgcaagcaagagacgccaagagtggtgagtggactctgagtcctatgtgaaccagttatgtaaacgaaggaccacgagag

SEQ ID NO: 40789 - DNA, 1738 bp, Bovine  19866881704401
gctctgggctcaggctgaaggggaaggcatgccacacaaagatggacggacagctggatccagaggaggtgtgaggctggaggaagctggaggtagggacgcagatgcagcactgatggggtgggagggcacagggggtagcaggcctggggagccaggaaataggccaggtgtgctgtgggtggggctgaaggtccatcccaagcctgcgaaagatgcctgggggtggggcagggcctgaggctttggaagcaagtccacggtctggagtcgcagtcatgctgggggaggtttcaggaaatgcccaaagtgaagagagttggaacaagcaaaagggagacaattcaacccaaggtccaggtggtccctgcagcctccgaccatagtccccaagggtggaagggagagggaatttgggaaagctaataggaggcctcaacagggtcccccagcctggccttccctcaggccccccaccctttctgcccagagggacaaggttgacccctcacacatcactccccactctgtggaccgttcaatgggccatcgagcaagtatcaccccgcttcctctgtcatataccccagagggcccctcctggtcccaagaaggacaagggccctctctccatctggctcagatctggtcttgcacagagcaagggacctctgaccacctgctcctgggccactcagtgggacccttgtaccaacccccagctgtttggccactgtgctgccatgcgcccctgggaggagcatgaggagcctgcctggggtgggcaccaggtgcttggcagagtctcccccctccctagacctacacaccaatctgccctgcccacgtcccagtcaaggaagaaggcttcagttcgggggcgtcgaagggatggagggtcactggagctcggaatctgctggtgctttctcctgcagtggggagggccagccgggcggtcaccctcacagacagtcctggcacaaggccacctggcccttgcggaagtctcggcaggggcagagccgccgatatttcgtgctggagccggcacagctgaagagcagaggttccttctgcaggaagcactcctggccgggctgggcaaaggccgggtacaggtggttcatctctgactcaatgccgtcgcagggcacctgcagcctgggtgggcaccaccggaggcggtcactcagtgggcactgcccattccccccaccccggcccacccattctggacccagggatgtttctaggaggcgctgggataaacgctggggtgggcagctcctgacagtgggcaggagggcagggccacaggctgatgcatcaggagaaatcgggcagtttctgcagcctggacctagaagatgcccagacagcctgggcaggggtgtagagctgcaatgtggaaacctgcctggaaggtcccttccagatccttcctctctgggaagcactgagtccccctcacccttgctggcaggccagggggcaaggcagtcaagggagtgaggggctacaggtgaggtcagctgggccgggtcaggcagggggctcactcacttctggaaggcgtcctggctgttgaggaaagggaagaaagagggctcacagatcagcccgtggtccaggcaggcgtccgtgcaggccctccccgcagcagccagccaggcccggagggagtgcgctgaggccaggcccccggggccaagcggcattgcgggcccattcaagg

SEQ ID NO: 40790 - DNA, 751 bp, Bovine  19866881738069
cgggagctcccagtgcatcagctgtgccgtggtgggcaacgggggcatcctgaacaactcccacgtgggcccagagatagacagccacgactacgtgttccggtgagcctgcacctgccccaacccccacccttctcctgcagagcagggctcttccgggagatctcagagggtgctccctgcctggatccagaagctgtggaggagggtcctgggctggctagtgccacccccccatcccttcttccttccccgaccatctccatgcatcatccggaagccctcatgtgctccgattttgtctttcgggctaggctgagtggagccatcattaaaggctatgaacacgatgtgggtactcggacctccttctacggctttaccgccttctctctgacccagtcactccttatactgggcagtcggggtttcccgcatgcgcctctggggcaggtgagcaaagaggagcgggtctggccacccacagactttggatacgggaggatgcaggtgagacagggagacggacagggagaccgggagcattctgagtctagagcctgttgtcggtacagtctccgggcatgtgaggggcaagggcggggagggcagccatgccagactggaggagagcaagcaggcggtctggggtcaaagtcaggccaccccactgaaggcaggactcctggaccacacactgtccttggtcctcaggacgtccgctacctgcacttcctggaaggcacccggg

SEQ ID NO: 40791 - DNA, 750 bp, Bovine  19866881928632
ggcttgttgggtttatgatcagagcaggaaagggtgttcaacgtgttgtcatcacagaattaaagttataaacaggaccaggttcttacaaatttgtccccatctttcccaccacgtacgtgacccctgagtcagaagtttctcgctctctcaaaggcttcataattaacagcctcatattttggacctggagacattaggtgggtgatcctgttagcagccaggaataaatgcagaggtggtgcatctggtctttgggatctgtttaggtttctaaataactctggtttaaatacttagaggttgaccagcaggttccatctcttgccctctcgatttacctgcttgccttcatctgtctccaaattcaactaaagtgttataaaaataagagggggctgtcgaggacgcatccagtgaatttccaggttggactgcgggagggaagggcaccagcaggtgaaggcggaggagcctcaccagcgccagcaggcgcagaggagtgggccatcaactggagtcgtaccgttggctctcagaatcctcccttaagtgggtgtgatcagggaatcctgtttacttgtctacagaccagtcatcccttcctaactccctgggatggtcatgtggctttactctagaaggctggtcccctattttgtctttgcccaattttttgcattctaaaaggccaaccaaaactcgtgtagattggatggaacttctgcccatttcctagtatcagtctac

SEQ ID NO: 40792 - DNA, 1068 bp, Bovine  19866880690725
catctatgattgtgctatttcagaaggctctcttgtctctgagtgatagcatttaaaaaaaatatactattcagtttatattaaatggctactgttctaaggcatttcttctgttgcttatttaataagtaactggtatttaactcaactggattactaactccttgaaattggcactttgcaatatactttttttctattttccatagtacctaacacaatgctgtgtgtttaaaagtatttaaattcttattaattaataaaagaagctattcctcagtatatctggatgggcagagacttctttatatgtataaatttactattttaactaacttaagaagtcactgttctctgaaaactgtaataaaaaataggaacagaaaaaatgaacaaaccaaatacctaggaaaaagagattattattttccaggcatggcctaattttagtttaccttcagcatttgatgagagattttggggggtcacattggatatatttttaaaacctaatgttgaatatcattccctttcagagtagtgtgtttaatacttgtccttccagattgagcagtttaatgctgaagaggaggcatttggttggctaccttcaatatatcctcagcgtaaaaaaatccaagatggtttgaacccttatctccgtctctatgaaactgctgtagaatttagcaccaaatatagagcatggacagaaggaccatataacaaggtgaatccagaccaagtagaaacagacgttggaaattactggagaggactctataagctggagaaaacctttcacgattctcccaatgcgttggcaatgaccaaaaaagtaagagcaaaggtggaagatttcaagcagcacattcctctcattcaagtgatttgtaatcctggtttgcgccccaggcactgggaggccatgtccagcatcgttggttatccgctgcagccagcagatgattccactgtcttctctttcttagatatgaatctggagccatatttagataggtttgagggtattagtgaagcagctagcaaagaatattctctcgaaaa

SEQ ID NO: 40793 - DNA, 1017 bp, Bovine  19866880716743
attcttgataactggattcttttagtgtgtagggggggggaagagaattcttatcctttagacgaaatttctagttactaaaaaatatttttacaggcttctatgttagagagccaatgaagaagttatgggattggatcttagcaaaatttatagctgtttggacagcctgtgaaagtgattctttgaaaaactgtgtgtgtagcagatgttcaataaatattggccagatgattgatctaaggaagaagccaaagaaagaggaataattcctttgtatccagtagaatattcagtagaattacatagataaagtaatataaatcaagaagttgcaaagcttcatttttatttagtgtccttttggatcagtggtcaacctgaatggccatggatttgcctgacacagggaacatgggtttgttcgagcttaatataaatataggtgtttgtaaagaaagtgttctaatctttgttgtggaaagagtaaaagataaggcaggttcctgaagacaaggttgggtttaaaagcggaagaataaatagtgaatttaagagcaccctgaaaatcatggtataagtttgggcccattttgtccatgcacatggttatttttttaacctctcattatttgggaagaataaagtcaccaaatccagcattattttgaccatgtgaatttgccttcctaattaaagctaattactgcttcactgataatccagataagaaagttaaagcttggtgcctttaataaacactgctgaatttagaagaagactagattagccaaaatcttattttataacttgaaattctaaaaagcaatagaaaatcagccccttagcatttcctgaaatattccagtccatctgcttaaaaaaattactgccaaatactttaatttgttagttagaaataaaacatgttcactcttaaagctgtgaactccttcaccttccattgaggtgtatatagaaccacctctgcaggaagggtgttaggatgccaggcaa

SEQ ID NO: 40794 - DNA, 1412 bp, Bovine  19866880822842
cttagttccccgaccgggatagaacctgcaccccctgcattggcaagcagattcttaaccctggaccaccagggaagtcccctaaaaagtattatttatggaacagtatttcatgctatttcttagaatagctttaatgtagatgacacgtaagtaggttttgaggtaagtagtccattagagtccacttaatttcgcttgcacaaattttagttagatttttcttttaaaatgggtcatcgctagaagcaattcatttatttggcaggatattcttagcatatggatttactgcaaaagtgagaattctaaaatgcttctttaattttaaaacttgttttcctgatatttgctgggggaaataaactataagctgcttaaattttatttaaagaaaacaaaatttatttattattgatattttgaaatatatataaaagtagtttttaaacagcatgattttgaaagtagggaatgtaattcagcatatcacagtataatatagtattgtgactgttggaatgtactatgtatcatttccctttgctatcttgaaagacatgtttaaatctataacagattatctttaattgttcacagccagttgatactatttttgaataaagttaactttattttgaatttttggtttccttattattaattttaccctgtcagttgttaaagatcattcattaacatatttgaagctgttcttagcagaaagcagtttttggtcagaaaataaagattaaaaagtgaggagtcagtttttgagggattttcattagttttgtgaaatcaaatgttagtttggttacaataacgcctgtttccattggaagtgagttttaaagttgagaaagttgacctttaattctctttgctcatttagtcttctactttctttgatgataaggacataagaaattaaaaaagagaagaactttttttttttttgattcagcatctctaaaatgtgttcatttgttccataagaattcttgcttcatttgctgtttcttggggctgagtgccaaaagagaatatgtatgccatctgctttgtcatcatcaatgtagattaaattcccccaatttaggttgtgttcccagtgatttaacaggaagcttttggtgctttttattcttggtctttggattcactggcttattttgtgggtgagttgaagatgatctttacatgcacaaagatgcatgaggttacgcagctatccgtcttgtagacacttaggttggactttgttgttaactgggtgggaagcactgggctaaagacagctttgaattttactgcaggatttctcaactttctctgaagaaacagttgaaatcttgcttcaaaaaaaattgaaaacacagaaattagcacatagctcaatgtattcgcta

SEQ ID NO: 40795 - DNA, 769 bp, Bovine  19866880839562
agataaattacgctgaagagatcaaagacaagagagcggatccccccggggttttactctcggtctggccatcatgatcaaggatgaagagagactttgtttttgtctttattgggaaaaatgtttgagctcggttttaccatttttttatattcattaaaaaaatcttattttcctattcaggaaaatttgatactttccgtctttctaaaaacattttcttttcttggactctggtctgctgtggggtgtcaaataatccaaaagcacacgcacacgggaaggaaaagcttaactctgcaaagctggcgccgtaggacctccgggagctgagtgggcggaaactacctatcccggcgtgcctggctcgcgagcacaatggagccctgtcgtcatccgggtcacggggctgtgcgttccgtgcgcgccgctggattccggcttggatcccgcccggggcggagggccctgtagggccgggaaaactgcgattcccggcatgccctgccacgggtgcgcctgcgtacgggagctactgcgccggggagcgggtaggtataaagtggagtcttagttccatggaaaccaacctgcctgctgccggacagagccgcgggcggcagaaggactgttggctgaggctgcggggccctgggaggtgcggggtccgcggaggcgagtcggtggctcagataaggcccccgtcatctctcctgccgccctctctcctcgctggcggagttagtctcgccctctagacctcaggacc

SEQ ID NO: 40796 - DNA, 1943 bp, Bovine  19866880847115
tgcaagttaataatccataagaaggaacaactccaagaattttcctcctgttcatcagttactcattaaattggatatactactaaggtgcttttctcattttggatatattaagttattaaaatgaacaaccaactgttaatttctttaaatcctaaaattttagtattacatctgtgtaatgcaaataccagtactgaaacaaatgcatggaaacagcacaaagagaggacgtaatttcagcaggaaagtacccgtctttcttaaatacaatctagagaccaaattatgagtccaacagaattcagatgtagccaggagtctacagccacaccaccctgaatgcacccgatctcctcagaggcagccaggagggcgccatttatccatacactgacgcaacgccatgcctcatgtccaggtgcctgaaactccaattacttattattaatccacatacgcatgtaagcaagctctcccacaattctctcctgatgtttctaattcaactttatccaattatatctatatatcacccaggaatatttttctttttctgcccctaatgttttctgcaagggtaagtaataaggaagtttccctcccccacctccaacctgcttaagacgacccaatggctaattaatctcttggcttactttttaaaactgcttaaaatatatgtttcctatgaataatcaccctcagttacccaaatatatgaacaaggggaggatttgtgcacaacagtatttccaaatgattaatttaatatttctacaaattgctcatagcacctttcagctcttttgtcagaattcgcccaaactaaccactcagcattttagccttttaaatgcatactctctctcccctcttatgtcctaccatttttaaaacacagagagccaaaaggatcagcttcttgccatgatcatatataagaaagtgaacagagaggtgaatcagaacgaaaagcaataaggcagaaagatgtattttccagtatgttcttaaatgcagtatttactattattaatatcattgtttaccaaaatgctttgttctcacagagtaatattgctttaagggattatagaaacttaaatagagtttaaattacatccagctgatgattggccatgggcatcactcagctctctgaatttaggctgcataactttcctagcatccctagtcctcacccatgtctcctttaagtgctatgtgtttcttgaaagtgaaggaaatgaaatatctttcaaatccccagataatcatcatactcccaaaaaaatagtaacttctgaaattaataacacttctctggatatccctaagagaaaaaacaggaccttgtacttaataacttaaaatgttacaaataaataaaaaacagtataatacatggagctaaagcttttctaagagattctacctatttgttacaatctctatatgtgtaataattgaaatatttgtgtaatgattaattacacaataattgaatatttgtgtaataattgaaaattcatgccgtcattaggcaaatttaaagtttttctattgtatacccagttgtccataacacctggatttctttccctttatttactctccccagctgccctttcatctggtggaacagtgccagccgggagacgacagctaagcactttccagactgtatctgctcggtcgagtggcagctgccagctcccttcttctggggtcctgggcatctatcctttaagtcccgtgggtcctatcacccttgaaccctttggtcaaggtaagccctttagttagcagttcctcacttggtgggagagcctcgtccaccctctggtaccggctaacatcctggcgaactgaaggcagcgatcgcagtggctggtggccgttggattgacaacctaggattaaaggtaaacagttaccta

SEQ ID NO: 40797 - DNA, 1860 bp, Bovine  19866880904729
ccatattttatactcagatagggccctggggatcctttatcatgagaaaggaatgacttctagctgtgagatatttttctctcatctgggagttcccctcttgctggtcctggtcctcattctgccatcaaactgtggcttttctgcatctggattgtcataaagaggcactagtggccaagtcaggtgttaggctccctgtaacttgtccctaccctcagcttcatattgagctgcattccatacttctactcccttgcccattccaaaggcactttcagttccatccagttgagttcatcaatgtgatttaagcacagattactagcctagagaggaaagttcattaagatgtatcaggtagtgctgttctcaagatgttgacagcaagtgtctctagaataggacactagagaaagttataattcagtgtaaaatataaagcataggagtgtgtaggttgacgtagagttccactgaggagaggcagttgtttagtccctaagtcgtgtccgactctttgtgaccccatggattgcagtgcaccaggatcctctgtccatgggatttcccagccaataatactggagtgggctggcatttccttctccagcagatcttcccgacccagggcttaaattggcaggcatattctttacgctgagccaccagggaagcctcagggagagacagtgtattaattccaagtatgggatttggagtcagatagaccaggcttcaaatcctggctctgctactaattaaaagacgcttgcttcttggtagaaaagctatgacaaatctagacagggtattaaaaagcaaagacatcactttgctgacaaaggtccatatagtcaaagctatggtttttccagtagtcatgtatggatgtgagagttggactaaaaagaaagctgagcactgaagaattgatgcttttgaactgtggtgtttgagaagacaatgagaatctcttgaactgcgaggagatcaaaccagtgaatcataaaaggaaatcagtcctgagtattcattggaaggactgatgctgaagctgatactttggccacctgatgcgaagaaccgactcattaaaaaagaccctgatgctgggaaagattgaggggaggagggaaagggggcgacagaggatgagatggctggatggtatcagcgactctatggacatgagtttgagcaaactcaggagatagtgaaggacagggaactctggcgtgctgcagtccatggggtcacaaagagttggacacgaatgaaccactgaacaaccaaagatcaaattaaaaaacaaatatttttgagggaaatattgtagacaaaggaacattttcttcaagcacattccccaactccttaacaagcttaaaccagaggcttgagcccagttgcaagcttcgagtcctggaagctgggagggtccagatcaggtcccgcctactcccgcgctcatacccacgcctcccggaagaagcctggattagaggctcctgcggaacctgagcgcggcggcttcggcgcaggccgagccagtttcccagaaggactttgggtccttgcttttagcggctcggcgcagggttagcgtctgggagcctctgctcttccgtttctctgtcgttcctgagactgcgtagcagaaccccgcaagcatgtcggggttcagcccggagctcatcgactatctggaagggaagatttcctttgaggagttcgaaaggagaagagaggagagaaaaacccgcgagaagaaagtgaggagatgataggcctggatgctctcactgtcttgtcgccttaatacacttaagagatgtgaaggacccgactaaattcacc

SEQ ID NO: 40798 - DNA, 969 bp, Bovine  19866880910782
cgtgtatattttatgtgtgaagattttcagtttgtagaaactggtgtcctatgaaatacatttccctttggtgtttaaactctaattttttctattctttttttaattgctagtttcaactgaattaatcttataaaccacaaatgaattccaactcacaagctgaaaagcagtgctttagttgcatgataaatatacaacaatcagaatattttactaaccagaaaataaacaacaaaatattgtcttctccattttccaatatttatatgtatttctccatagaaataggagtatctcttgggttttttttatcccttgtctctaattttttcctttctctaaatgaggtaaacacaaattgttttatcaaagctctacagtgggattagcacatattgcattacagtttttcttaagtaacagtctttttatcaccagaaaacttcctagaagaaataatttctgagtatataccaataatttaattttaccttggtaagaaatatgcttgaatttccagaaatattacaaaaatactttgcatatcatatttaagagtctacagaaagaaacaactgtttctaagtttgaattgcacactttcacactggacatagtgtttaaagatatccttacctgacaaagtaaagctaacaagcttccgagaatgctgatttcctgaagcccctccttccatgccttctgcccccatctgcagagaaaaaaacacatatctgaagtttcagtggaatataataccttcctagggaaccacatatgtttgcaaatatgattatttttgtatcaaacatgtattgtagtacatgacttcatttgctacaaaacttggaatggacacacaaaagcaaattctcaaaagatgaaagaagagatcatacctaaatttaatctttacccaaaatgtaaccaacatgaacttttaaattccctggaataggaatcaac

SEQ ID NO: 40799 - DNA, 1192 bp, Bovine  19866880917185
gctgtgtgcgccagtattttctttgtgttcttttttgcccaccttttcaaatgcttcttgcaacttacaaatgagtcttgactgcagtttggaaaacagacttatatagtaggaaggtgagggtaacaaatttgaccctgcatttcttagaaagttaaccattagggagaaacaaaaacatgtttttgggcagtcataacatgtatgaagaatggaagtgagatggtatgtctataaacttttcatggtgactttgatctttgttaaactgctgtgaagttcccttggtctcacctaactgcagtgttactctgtagctaaggagacaactgtcccaggagaagcacctacgggaatctcttgagaaatctggatcagccttgctactgagaatacaagaaatggaagcaacagtggaggtggaacggaaacaggtagtgagattttctctccttgtttatgttggggaagtgaaaccaaaagggaaaagccagtgttttggctacaaacctatagttttgcttatttcctctagatttattaaattctttcctttagtaatccgctattaacactcttactacaacttaaaaaattttagtccaaaataagcactctgatgccgttcagtccaatacttactttatgaatggggaagcaaaggacaaagaagttattatgtgtcagggtttatagaggtgaactcttagctcctgggagggaatcattcccctaccacatactctgtgttccaggaattgactttggaaggtattgccctagtctcgtattatatgtacatgatgtagatagaaaagaaggattaaaccgagctgacatttgaagcaaagaataccagtaagtcaagtaatcaggaatgtgtttacattgctgttttcagttctcgttatctattttagcataatatttttgcctccaaaagttgttatttgaagtacctatatgtatggctcaagattgtaaagaatctgcctgcagtgccaaagacccaggtttgatccctgggtgggaaagattccttggagaagggaatggccacccactccagtattcttgcctggagaattccacagacagaggagcctggcaggctccagtccatgggatcgcaaagagtcagacatgactgagtttgtcactcaagttcactcacgcatatgtaatttcagtt

SEQ ID NO: 40800 - DNA, 1346 bp, Bovine  19866880964300
cacgtgtgctcagtcgcttcagtcatgtccaattctttgtgaccctatggactgtatgtagcccgccaagctcctctgtccgtgggattctctaggcaagaataatggaatgggtcgtcatttcctcccccaggtgatcttcccgacccagggatcaaatccatgtctcttatgtctcctataatgccaggcgggttccttaccactagtgccacctgggacagctatctcaatccaaccatccatgtacaatggaatgcattttgtgaaactgttagattctaaagttagttggtgaagtgaaaaatcacaaaattgtgaaaagtaattcttaagaaagtaccatattggaaatggatatactctcctgcataagtccaacacaatcagtttcctccaaagctaaactagatatctgcttccttaattgaggactggtaaagaggttggcttctgttgagtagccatactgaaaatacgtgtggtacctgtaggcactagaggctcaactcagcatcaagagggacttggcactaagaccttccaaaggaatagcacattcacaatccccatctcacactctctttgtggtgaagcttgctaagctgactggcaggtagactcactcactatttaaattgcttttttttcccctctcttttacccactgagttcatggaaactaaattcacataagatgcaatgccaccatttcctaccaaccagccaccccaacaaagtttaaaaaactttccatgatggccactcactaatttccttcatgagaaggttccctagagagttgactatatacagaattattaatcaagccatattttcccactgatttgtattatggagttagttaagccatcctgtaagttatttcctttcccaaaacggcgcccacgctgttatgtgtttcctttttcattgtttcccataaccttgccagagctgcagaggcaaaaatagaaaccgaggcctctggaactgtggcttgaggaagtgggcatggaggggcactcaccatcacagctgggttcttcaccgtgatgcaaggggtcgtggctcgcagggctccactgatgccgtggtagtatttgaaacagatttttatctcggctgcaagttgattggagaagaacaataatttaaatgcagaaacaagtcctttgggcctcacctgaggaaattcaacaggctgcttctaggcaaatcacactcgggactctgaatgacccctccttttccagtcagaggcaatagattataccaagtcttgtttgattttataggcttctctgaaaatttctaagaacagcccaaacatattagaaaaacag

SEQ ID NO: 40801 - DNA, 1043 bp, Bovine  19866880971321
taatatcccatagcagtatgcacttagcatcaattaagagaagcccaaatgtccaatcaggtgatttttttctaagatcctaacttgatgactgtctcttaagaatatttcctaaacacaggggccatgttccttcctgctctcttcactctgaatccagtctaagcgttgcttcctgtgttctggtctgtcccgagggaggaaggagtaattctcccgaagatttgaaattacgagaaaacagagctaaggttattgctgcaaagtgggtctcttcctgaatgtgtgaaatgatacgacaagtctgtggcatgtatggactgttgactcagtggattgcttcctaggcattttttgttgaccacaactcccgaaccaccactttcatcgatccccgactcccgcttcagagcagcagacccacgagcgcactggtgcatcgacaacacctgacccggcagcgcagccacagcgcaggcgaggtgagtcccagctgtagcaagtgacctgttggttggtaggaatgcaggatgtgggatttattgaattctgctggctctttcatattgctttgtttttctagtttgaggctgtcatttggaggctgaaaagtactggaatgttgacagggcttctctggaaacaaatagaacctaaattgcaaatttaaaagtaagacattagaggaaaggttgaagaaattagatttttttttttttttaaagttcagtgggtgatgagagaagattcataatgcaatacagtgttcaagagagggtgatggggagccctttggcatacctgatagcaacttcataggaagaaatgaacatagcttttgctccgtcactcagtcgtgtctgacttttgcgactgtagcctgccaggcttctctgtccctgagattttaattggggattaaaattgggttaaaggtagggacatttcttaagtgaggattgtgggattagatgaaaatctccggcctaagctatcaggttgtgatcctctctaatcttctttaaaattagggtatataagag

SEQ ID NO: 40802 - DNA, 1030 bp, Bovine  19866881111649
atagatcccctgaaggagggaatggcaacccactccagtattcttgcctggagaatcccatggacagaagagcctggcgagctacagtccatggggtcgcaaagaattggacatgactgagctactaacactatactactatctacattatcctatgtgagatttcaaattagtaggaaaaaagttgcatactgtgttcagctgtgcagcatattacattcaaagttgattaagcaattactgggcacttactgactaccctcaaagagctggtgttgagaaacaattatatacaaaacactaaagtcagttgtagaaatctgcaaatgttttaatcttggcacttgattgaacagcttgagagagatgtcatagaaagagatgtttgaactgcatattaaatttgaaggaattcaccaaaattatggaagagtacagatgaaagctaagagatgtgaaaatatgtcatttgttacatgtactgccagctgccatgtattcccatctaaccctcatcccatgcataatctctgtatctctctttaaacaaataagctcaaagacagcagaggccaagtctgtattttcatgctgtgttttcagtggcacatgccagctgcaaaataaatatttgtaagatgaatgaatgaacaaagaaatgagaaaatgaaacaaacactgaaccagaagtagttctgcccaaggaaggctcaaataacgataagttttgctctaaatgcaaagaatttttttcacagagttaatgcaaagccattaaaagctcctctaaaactgatttcttttttaaaaaattaaaaagtattcttttatttttccagctttattgaagtgtgaactggttaacttatcagaatattaacatgaataacattctacacacaccttgaccactggtgtagctaatacagatatacctttattttctagaacattggctttcaaactttttatttaagcagcaggatacttttttcaaagaagattctatcttaaagctcaatataaacaa

SEQ ID NO: 40803 - DNA, 2926 bp, Bovine  19866881115854
caccattttgaaaagtatgtttagtatacccttctaggagcctactaatttataatattatactgtcttctgattaacaaagcaaaacaataccagggactcactgtctctgtaaatttcatgtttcttgaggataactcccaagtataattatactttaggaaaaaagaatttaaataagattacaagaataaaagttactacctttattttacataaaattttaaaatagtgtttcagttcagttctgttcagttgttcagtagtgtctgactctttgcgaccccgtggacttcagcatgccaggcttccctgtccatcatcaactcccagagctcactcaaactcctgtccatcgcgtcagtgatgccatccaaccatttcatcctcctttgtccccttctcctcctgccttcaatctttcccagcatcagggccttttccaatgagttggttcttcacatcaggtggccaacatattggagtttcagcttcagcatcaatccttccaatgaatattcagaactgatttcctttaggattgacaggttggatctccctgcagtccaagggactctcaagagtcttctccaacaccgcagttcaaaagcatcaattttttggtgctcagcttacttactatgtgtaggtactgagttttgtgctttcccctgagaatgatatcatttagttttcacaatattcgaaacaggttagatgctactttgactttaaatgtcatagttattgtagaaaataggaaaatcctgaaaaataaagaggaaaatatttattagcaatccagccatttagaggtaacctatgagaaaaattaatttgctcctttttcctctggggtttatatggatgcaggagtttttttatgtggtgtgtgtatgtgtattctttgtgataaacttaggacctgaatcggagaaggcaatggcaccccactccagtactcttgcctggaaaatcccatggaccgaggagcctggagggttacagtccatagggtcgctaagagtcggacacggctgagtgacttcactttcacttttcactttcctgcattggagaaggaaatggcaacccactctagtgttcttgcctggagaatcccagggacgggggagcctggtgggctgccgtctatgggatcgcacagagtcggacatgactgaagcgacttagcagcagcagcaaccagtaggaccttaatgtatatgttgtcttgaaataagcgttttattattttaacaatctatggtgttatgaacacttccccatgccattacatattcttctataatatcattttcataatttcccctacttattgtaaagggaataaagctcattgttatttagttcatcaattcagaaatataaagaaacagaatcatggttttgtgtttatgttttgagacttttttcctttcttgatctcctttaaaagagctatttttacatgtggctcttttttttttttttaaatgtgggaggaaatatttgtcagaattatgatctgacatgccttaactcttcctggtgtttattctaagcaggaaattgggtgttttgttgttttgaatgtaagaagggatttgtttctgttccttgtaatacacccttgagagatgggattatattagagaatatgagccaactgactttcatgcatatagctctattgctcaatgtggtaatggtagtcttagtggatatttcccaatcttagaatgtgtacgtgcactttcccattttaaagacaaaacatagtaagcggggtttcacaaacattatggtccttgaaactattccatttgttaatttgtaattccaagactataccttttttaaaaaaacaaaatgaaacaaaaactaaggcttgtttacgttttactagccagctaatataacaatacaagtgtcatgaaagacccaaggacttctgttaaagctggtgcattttggatagatgttactgctctgtactcctgagaataccacctagtaaatacactgatctaatagaattgtggttttgtatgaaaatttttatctcctaacaatatcaaattatttaagccatgcatttatggttatactacagttttgaggtgactaaattcatccaacatttggtccgtatcttagaagacatttatgtcaaattctctgacaagatgttgcctagcatgggattataattttaagacagttatttggagaccgtttctgcaggtgctgtgatggaataggccactttctttccctggagagtggcatgcaattctacttcaaggctaaggtctcaacatcagcatattggtatattaataagcaaaatctgtatagtgttaactttttctaagaataaacatggggcctttgttcatgagctaatctgaacattatcaccagagattgatgatgtaatgatagttacccatctttcatggcaccacttcggcaataatagcagtttatttaaatcttctgtttgaggatttaatattagctctgctttcctaatgaggaaacaagtagaagtaaagctgctaaatttctctgaacttatatgtggaatcacatggaccaggggtggacactgagctttctattcttgtttaatagttactttggatgctgggtcccagtctttgttaccaagttacaatatccttccattcattaaacctgtctaaaaatagggcagagtatgcgttaataattaagggtgcttcatcccacgtgttctcttcccatttctgtcccttgcagaggaaggctgccacccacaccctgggccctgggaggatgctcagtgttgctgctgagtttatttttctattatgaacactcatttgtgtaatgctggcagagggcacgggcttgaggcttttccagaatcatagttttt

SEQ ID NO: 40804 - DNA, 1643 bp, Bovine  19866881166723
ttgtctgtgacattgggtaagtttcatagcttctttgagtctcaggtacctcatgaagaaaaatgggtgccatggtagggtctatctcatggagttgtaaggaaaatcccataagttaatgaataaaagtacttcataagatacctgacaccgaaggaagtactgaataattaattattattattccaagccctggctgtgctagaactaaggttttaaaaaatccaaagaggtaatgaaaaatcagaaggcatctcagaagtgtagaatgagcagtgtagtccatggcagtgtccatccagtcactgtccagggagaggatgtgctggctcgagatgagggctgtgtggtcccaagggccagatgtacatgtatcagatgggagtagccagagacttttaaccatctgaagttgttcctctacttttgatttcttgctaccaaacttctagggacattagactttctgtgtagttttcctagaagaccagaagatgcagaaattagacccccttcaagctgcttttttctttgtcaacttagtctgcagttctgattctaactaacttgtaggagcctgacaagaccaaacttcttgcagaaccaggaggaatatccacaataatgggaatttcaagtcacagtctcaaactgtagtcctcaggctatatgtagtaaagagtcccctgatcaagtcagtttaagataccatggatgtcagaaggcttctgggagtatttatattgatatttgccaatgaatgttatgaacctccaaggggcagcctgttgtgtctatcttatttgaccaggagccgcttttcctagtagcttctcaaagcactaaggtttctcaagatgcactttagaaaatactgcactaaggaaatgtctctctgtaaggcttcttggtagtacatccatttgccagcaatggacagttccacagtacaacagttaatttcatgcatggaatgttcttcagttaatggcatgaggtcgctgtgccatatggagagagaaaccagacacaggtgaaaaatttgtcccgaatggcccatgaagtgactaactcacgacagattgcacttcaatcacaatttattatgtaccaatctatccatgcttccagttctaggaacttgctttcctgttggctagaaaggttatacttctggtgagtttttcacaggggtgcttttcatcatggcagtagccacgccctcagtgctagtctttccagccaacaggagccaacatataacatatgataatcaaaaagcagctctgtggattgtgactcttgagtctgagaaataaacacaagtagtaaccctaatggtttcacttctgcaaaactgccagaatattttgcttttgatacacagaaaagttcagtcctcattacatttttctaggtttcttatatattgaatatcatacatatgattagatgctataaatacattaaggaaaaagaaaataggtatatgtttaaagcccataggtaaggatcagatagtatagcatgggagtgaaacgcatgtactctgaagccaagcatctgaattgaagtgtgaccctgctactaatcagctgtgtgcctgtgggcacattatgcaatctctttgtgcctcagtttca

SEQ ID NO: 40805 - DNA, 1276 bp, Bovine  19866881178452
aaaatttaggttgccatttctatttgtgatgcacaaatcaattatgtcacaaaagtagatcacgttcccacaggatatcctaagtagctcaagtcagtaacaaagctgactgactacttttctttttctttttttaatttaatttgggtcactttttatgtcattattcttgagtggtctgcttttatttatgaaattttctaccaggtattaataaatactgcctgagtaaacagtatgttgagaatgcagactgcatcgaaaaagcaattgtatccaaaaatgaatctttttcagattagccactagctaagcaaattttgaaaacatagagtctctactgttaagtttcattaaggaaattcactcaagcttccccgtgctggaccaactagaactaacaatataataaaaaactgaaaggaatgcaaatatccaaattcaaatctcattttaaaaacttctaccctttcactgcttcagggcatggtcagagttagaaaatatgagctggttggagccaagtggtattttagtgaggccaaacaaaatacacttctctctttacacaattctttttttaagtttctattattttaagaaaagaaaaagccatcagtatttgtgaagaaataccaacctcaggctcaacaaatctaagtcacagaagtttgaaattgtttccagttaacattttgccaaaccaggaatccatattaaaagaccatgtaaacaaaataaaacaaaaagcacttgtaactatgctacagaaagacatcaaatcttctttctttccctaaaagaacgacagtttaaagattagacgtgctacatactgaatctgttctaacttctactttatcaactctataaaatattaaaatgctcaaaaaagttaattgtaatctaatttctataaagactttaatttactcacacattctctcccttctaaaatataaatctcctctcagctcctggtcccctctctagcatttccccaattataaggaataaacatgctattattttctctacattatatcccagacagatctctgttaccaaatgatagatgaaaagacctgaatgatgtagtttattataagtaaaaaacaatcatgctaacattttctaccttttggttcatttgaaggaatgaatggtcctaaatatctcatgacatctgtatcaatcacaaaaaagctaaagaaagttattttgttaaattgttatgatcagagagctaaagtgagagaaaaacagggacacaagg

SEQ ID NO: 40806 - DNA, 1038 bp, Bovine  19866881258362
taggtaattaaagatgcaattcttgcctatacacaaaatgaacgaattaactgggtaagagagtggcctggacaaacagtgctctgtgtatcccaaaccttttggacgttagaagtacagacagctattgcaaaaggacaagaggtaggtttttatagacccaaggtttttcagcatttctttaatagtgattattgccaaaatacaattattctaaaaaattaagaccatccacccaaaatccaaggatactggagcctcaatcttgttattatatacatttttatgctttcaaaaatagtgatagtaggacaaagaaacttcctaaacttagaaggattaggaggaattacataatataattctcttttatgccctcaataaaactacactatgaagtatgctgtgctaagttgcttcagtcatgtctgactctttgcaagcctatggactgtagcctgccaggctcctctgtccatgggattctccaggcaagaatactggagtgagttgccatttcctgctccaggggatcatatacccatgtgaatgcagagttccaaagaatagcaagaagagataagaaagccttcctcagtgatcaatgcaaagaaatagaggaaaaaacagaatgtgaaagactagagatctcttcaagaaaactagagataccaagggaacatttcatgcaaagatgggctcaataaaggacagaaatggtatggacctaacagaagcagaagatattaagaagaggtggcaagaatacacagaagcactgtacaaaaaagattttcatgacccagataatcacaatggtgtgatcactcacctagggccagatatcctgaaatgtgaagttaagtgggccttagaaagcagcactacgaacaaagctagtggaggtgatggaattccagttgagctatttcaaatcctgaaagatgatgctgtgaaagtgctgccctcaatatgccagcaaattggaaaactcagcagggccacaggacaggaaaaggtcagttttcattccaatcc

SEQ ID NO: 40807 - DNA, 1301 bp, Bovine  19866881263522
cgtagtaggaggggaatcctttcagagggtacaacttcaattaatattagttgtttgggttttttttgaccttgcctatagagatggtcagaagtatggatctacattgatcatagtagtaagcagtttggctatatgatcaaggacttagaagaaacaagattgaaagattggtaataaggagatctatcaggaatcacagaatgactagaatatgagtatatttgtgctccatgtaaatgtttaataaaaggtagtgctgccaaaggaggcacttaatagagttgaccagttgatctgtttgtgaatgtcaaccagcatacgccattgtatgcacagtgagctgtgaaatggaaaaatcacataatatattgcccaaactgcagaacgtctgaaagtcagagcaattaataagtaagccaggaaagcaagcataagccagaactctccgcatcaaactgggaatatgtggtcacccaggctacaagcaaagaagtcataatggcagagatgggaattatggacgtatttgtcatcatgggctgtcccttacccaacactgcagagcatccaagctgccaacatcagaaacaaacaaaatgcttctgacacaggatcacacctgaagggaccaggcagccatttagaaggaattaaatacagtgcacctgtttcaaaatagaagggatcagtgatttgtctgcaccagaggactttcctttcttttccaagtttctgccaacactgtcattcattgacttactgaatgacttattgtctcagtttccatacgatactgcttctgctatggaattcacattacagaggaaatgaggcagttgactgatactctttaagatttacagatcctaatgtgaacattgaccttataaaaagtggaatgtctcatgttgaagactcagttgctatatgagcaggaagaaaagagcttgtgagtttggcatgcagttctagaggatacatagcccatattctcaaccagctcccataggcacagttcatggatctgggaattaaggagtgaaaatgatgttgacttttcatactagttcacccaataaacgactcacaacagttctgcttcccaacttttggtcttgctagttgaaatatcttagtatccaggggataaatgcttctgtatgggacatagcagtagtttcattgagcaggaagttcttgatttactcactttacccttttacctctctgtccttataactttgcaccttacttactctattctagccacgctagcttccttttttgaatcacacatg

SEQ ID NO: 40808 - DNA, 1548 bp, Bovine  19866881312822
aaaaagagaataattattaatacccaagtatctatttcagtatgggacagtattgcatacaaactattttttaagccttactttattcatctataaattgcatatatggatctctaactcaaagaaagttttagagaaaacatcaagtacatattctcatgtaagcacaaaatgagataatgtttaagggcaggggaaaaaaaaagcactgttagtggtactgtaatataataagaattattcaactttgtgaaagaagcaaaattacaagctttccggtcttaacaactctgattaagaaatgaagataaaaagagttttcactgaaatatgttgatatttgggtctttgggttaattgtataatcttcatttctatttcattataatgttttctttttctttcagaagtctggtggttttaaaactacagatgaagcttctcactagaaaaattcagtcttgatcatggctaagtttttgtgtgtgtttccctctccacttttatcagtctgttatgattttattctgtatttccagatttacatgtaaatagtttgagctttgggacatatgtgacttatgtgcatggttttttccccactcaataatcatagatatcaatatagcactgcatatatttgcaagggttacaaaaacaccataaagtcaaaggaaattcctttcagctgtgttctatgtttcttttttatcatcagtgtttttatttgaaagggacattgatcatttttactttagttaattatctgtaacaggaatttgggtttaaaatgtatctttttcctacaaagaatatacatttctattaaaagaccccacagtcttagtttcatgtcaagagagagtaagtaatgaatatccacaattaagttgaaatggaagacaaagaaacatgggattttaggagttgctcaggcctctgggagatgttctctgccatgatgttcagaggtggctatattgtgctatagcagatatcctggtttagtctcttaagtcgggtctgacttgcaaccccatggactgtagcctgccaggcttctttgtccatgcgattccccaagcaagagtactggagtcggttgccatttccttctccaggggatcttcccaacccagggatcaaacccagatctcctaaattgcaggtagattctttaccaactgagctacaagggaaaccccacagcagatatcttaggaacctacaaccataggaagagagggtagatacaggcagatttcccttctttcataaccagtgctcttcctccaccagccctccccaactcaggctgaattggtctgattctcatattcttatttgtaacagctacttttctttatgaagggctgtatcattttctctgatttctgcaaaaacaaaaaccaaaaccataacatcgtgccagaagcaaacattgtaatcctaatgacactagtctgtacattccaaagtagttttatgtggcttttttggtggatgattgaatatgaataataaaatatgcaagaacagggtatatat

SEQ ID NO: 40809 - DNA, 1134 bp, Bovine  19866881354689
acatcctcagtacctcagcagactctctcctctcacttctgtggatagctgccctcctgcctcccccacagggaacttttattctattgccatcctttatgtttttaaaagtttccattataaatctaaacctttgcagggaagaatttatcctgtatttgtgctttgaacttatttatcttaaagtcttgattacaaattcttttaattatgtataatttacatatcataaaattcacttttaaagcatataattcaacagcttttagaatattcacaatgttgtgcaaccattaccaccatctaattctagatctttttcaacacctcccaaagaaaccctatacccattagcagtcactccttactatttcctactccatgtccccacagcctctggcaaccattaatctactttctatcactatgcatttgcttattccagacatttcatataaatggaaaaatattatattgtattggccttttgtgtcttgcttctttcacttagtgtaatgttttctaggtttgttcatgttgtaacatatatcagtatttctttttagggctgaaaagagctccattgtgtgtatgtatacacacacacacacacacagagcccacattcgtttgtctgttcatcagccaatgtatatttgaattgtttccattttttggctattatgaataagtctgctaacactcatgaactaacaaaaaacaaaagtatttctgtctcaaaattatttgaagtcaaactgaaaggattaaagtcacttaaaggagacttaaaatgatagctcctttgaaacagcctataaatcaatagaaagtcctgaaaatcagagataaagcatcttaagtgtcatagaatatgttagtgtgaagtattttaaaaaattatcctgaccattgaccttcataatgccaaatagtggaatgcatttcaacaattgctggatatttcttcacccagtttttggcatggtaaaatctttgtttcttgcataatcatgttttagtagcacagagatttacctcatgaacccaaagacgtttaatcacttctttggtctctgctgtttctggtcttgacaaacatacaccctgaatgacacgggagaaatctcggag

SEQ ID NO: 40810 - DNA, 2614 bp, Bovine  19866881417488
gggtggagggggcgttggaactgtagaggggaagtcagaagtgaatagagtgagaagaaaccactgaagaagaaaatgtgactatcaggaagacttttaaaatatggggcttgaagtcatacctgcgtttatatgacattaagacttcctttcacctcaataatgccataaaaactgaaataaaaaataactgctctctgagtcaggagggaaacagtaaccatggaactcatgcagttgcccgtccactagttagtggaccccttcacacaaagaccttttacattaacttaatgtttaaaataaaaagcttttaataagtctgctcatctaattttaccttataactttcagcctctatttaagtagataacagattggaattatgaagtaggtggctactaaaagttgttggactaaaaatctgcagctgaaaacagtgggaagagtcagaattactaactcaatacaccctgacagtgtcctaaaaacctcagtatcccctgatggaataattgacattagtccaaatcaaaaggatcaaattatatttaaaatattctgttctacaaaacagaaatagatatagtattttaaaaattataaattttagtgtgcttaaggtggtaagtgtagctatatctggaacattctcttatgtgaagtgctttatttatcagtaattgctgacaaaagcgttattgttcattgctggaatatattgtttcacattaaaaaaaatactttggatattttaatagatttttgagctgttttaagtttttagaaaaattgcacataggcagagttcccatataccctttctccccacccccagagtttctgttattattaaacattttgtattagtctggtgcctttgatttgttatatttgattatgaaccagaattgatacattattactaagtccacagtttagattgtttcattttttaatttattacagtatacaaaagagtttcacttcactgccctaaaaataccctctgctttacacactcatcaccaccaccctctttttcccaagcacctggcagctaccaatgttttcattgtctctgtagttggaatcatacaatatgttgcctttttggactgccttctttcacttatttagcatatgcatttaaattctccatgtcttttcattgtttaatagatcatttatttttatcactgaagaaaaatcaattgtctggatgtaccaaagtttatcccttcacctactgaaggatgtcttggttccttccaagtttagcaatcatgaattgctataaacattcatgtgcaggtcttttttttattttgggacatgttgttaacttgcttggataaatacctaggagcatgattgatggatcctatggtaagcttgtgtttagatgtctaaaaaactgccaacctgccctgcaatgactgtaccatgttgcacttccaccagcaatgaaagagagttcctactgtcccacatcctcaccagtgttttgagtttttaccattctaatagatgtatgtatagtagtattttgttttaatttttcagttctctgataatgtgattatttagcatcttttcatatgttaatttgccatctgtttatcttatttggtgaggtatctgagaccatttccccatttgcagctgggccttttttttttttttaatcttattggtgagtcttaggacttccttttatattttggataccagtcctttatccatatgtgttttacaaatattttctcccaatccatagtttgtcttttctcttaacagtgtcttttgcagagcagaaggttttcattttaataaagttcaacttaccacttttttcatggattatacttttggtaattatatctaaaatattgccaaacccatagtcacctagatttttatgcagtattatcttagaagttgtatagctttgcattttacatttaggttttgaattgctaattttgtgaaaggtgtaaggtctgtatctagattctttatatgagtttgtgtatgtccagtggatccaacaccaatttgttgaaaaaactatcctttctccattggattgccacttagtgttgtttttttattggaaaagtcttaattcttggtgctgtggtaaaatcttgaattttcgttgaacttgttgaggacctaagaaggactgtatgagtcaaacatgaacgtcttgagggtatgtggagcaaggaggatgtgttctgctggggctaccacacactgccacacattagacttaaacaatggaagtttttgtttcactgttctggaggcaacaagtccaggatgaagatatcagcaagcttggttttttcttgagtcctttctccttggcttgcaggtggctgcctttttctctgtgtcctcacatggtcttttttctgtgcacacatccctggtgtctctgtgtacagatttcctcttataaggacaccagtcacgttggcttgggcccgcctcagtgacctcattactgaaatgaccctttaaaggctttatctccgtttatggtcatattttgagatactggggttaggcttcaacatggaatttggggggatacagttcaacc

SEQ ID NO: 40811 - DNA, 1331 bp, Bovine  19866881545401
ttagatttaatctataaggtagtttatttggctttcacgatcaagttcagcagaattggaaggccctcgttgtatggtttctgggaaacataggaaaagtaaacttatacatgaaatttttatgtggagtggccttgggcaggtgatatctttctatccaattttcttttaagatattacaaccctgagcagtgttgataggtatggtgtatgattcaggctgaatcaaatattactgatgcagctaaggaatcagtaaactatttctggttactatcaccttctataagaaaggatggataatgttcaagaaataccttggaaggactaaccaggaaacacacaaaactgaatgttcttttaggaccttaatgcactaaaagatggtattacaacctatttttctttatatggtatcataagtaaaatttgagcctgttaatatgttggaaagtgcataatatcacatgtttttataatagggatgcaggcattccaaagtaaatgaataaagacacatgcatctctcttgcctcttactgaaagtattaacctaattttataataatgactactttttaatatttaggctctgtaaaaagagaaaaagccacatttatgtccaagatttcagtggagcacaggtggtgtatttttttaagccttcaaatttcttttcacaaattccacccattgtgtctattacaccatgtcacaattagtagctatgtttctatttttgttgagtttatttaagcctcatatttattcaatgttacttttaatagagaacaataatgggaagtatttgctattgacattgagattatacagctctcatttcaccttatatttaaatttcatctttttttctccaagcaaataatgcagactgttgacatcctagaaatgaatcatgggtgatcttaaatggagcctgggactctgaaatgtagacttgtttgttttctggaaagtctgtattcttatccttacctgaacccctgacttttgtgttgtatttttttatgattctgaaatgctttgagggaaagatattttatgtgtacaatttgttttattttcatactgatctctatttttgtttaaaaccatgttgcatcatgaaatcacttaatccaaaataaatcttctttaaaaaaatagattatgatttttctgtgatacatttggggaggaaaaaaactcaagaggaaagagagcaaagtagggataaaggtctcatgggattagtatgcagctttgtggatacaggaagttctcttttcatatatttataattaggaatcttcgttatccctaaaagatat

SEQ ID NO: 40812 - DNA, 1585 bp, Bovine  19866880339676
tatgcagataatagtatcctaatggcagaaagggaagaggaactaaagagcctctcgatgaaggtgaaacagaagagtgggaaaagatggcttaaaattcaacatttaaaaaatgaaaataatggcatctggccccatcacttcatggcaaatagatgggggaaaaatacaaatagtggcagattttattttcttgggctcaaaaattactgtggatggtgattacagccatgaaattaaaagacatgtgttccctggaagaaaagctatgacaaatctagagagtgtattaaaaagcagagacatccctttgctgacaaaggtctatatagttaaaactatggtttttccaatagacatgcatggatttgagagttggaccataaataaggctgagtgccaaagaattgatgcttttgaactgtgatgctggagaagactcttgagagtcccttggactgcaagaagatccaaccagtccatcttaaaggagatcagtcctgaatattcattgggaggactaactctggagttccaatactttggccacctgatgcaaagagctgactcattgaaaaagaccctgatgctggaaaagattgagagcaggagtagaagggggtgacagaggatgagatggttggatggtatcactgactcaatggacatgagtttgagcaaactctgggagatatccagaatttgcctgcaatgcaggagaccctagtttgattcctgggttgggaagatccactggagaagggataggctacccactccagtattcttgggattcccttgttgctcagccaataaagaatctgcctgtaatgcgggagacctgggcttaatccctgggttgggaagatcccctggaagagggcatggcaacccactccagtattcttgcctggagaatcccatagacagaggaaattggtggactacagtccatggggtcacaaacagttggacatgactgagtgactaagcagagcacagcacatgacagacacccttgttgttgtcattccattgctggcaaatgttcttgggaagtgccaatttatagtcgacaggaagagccaatttgtagttgacacaccctatgggtagacaaattaatgagacggtggcattttgcctttatcctataagcttcaactgtgatattttcttggaaccctcagatagattccctcttcatcctcaacccaaccccatgtcaacagaactctgacctgattccatcaagtagtgagaacttgcttctctccatctttgttttcttgcctggccagcattttgcaggatttggctaagattcctggtgtgctccccggagtcagaaggtttgctggcttcaagtctgtctgttcatttcaagtgttctggtgagacgaaattagagggacttgtgcttagttgagaatgaaatttcatcaactgggagagaggatgaaggaagaagagaacagggacagaaaagtacgataaaagccctgaggtcatggttgggctgggaaagaggatccacaaggagcagggttaagggaaacaaaacctcaatcaaatcccagcattg

SEQ ID NO: 40813 - DNA, 782 bp, Bovine  19866880390381
ggtaggcaaagttgaagtgttgtacacagcagcttcccacgagttatttcacacgtggtagtgtatatatggtcagtgctaatctcccaattcactccactgtccccttcccccagtgggccctcatgtctgctctctacttctgtgtctctcgtcctgccctgcaaatatgtttatcagggggctcagctcagtgctctgtgatgacctagataggtgggatggggggagcgtggaagggagacccaggagggaggggatatatgtatacagataactgattcacttcattgtatagcagaaacaacattgtaaagcaattatactccaatttaaagaaaaaaaaagtagtttgctttacctgggagaatataagaggttaattaacaaactatctgattacacttaggtagtttatttctttgaagcaagctctttgttatatttctctttattcctatagggatgatctaatttatgcttttattttaataaagagagctttaaaaatcattaattacacacacaaatgagcactttttctttgtaaaaattaagaacctatctttgacaactgccctcgatttcagagtccttcctttatgtagctattgatatttttttggtggataaccttacagtattattcccctttgtacaggtatttggagatattgcagatttaggctcagtccattgtgacaaagtgaatatgcagtaaagcgaatcacctgatttttttcccattgcatataaaagttatgcttatgttatatactaca

SEQ ID NO: 40814 - DNA, 2470 bp, Bovine  19866880410828
gaaacggtggggaaaagaagagaagcaaagtgagaaaaagatgaaagctcctgggctcatcccaggacacggtaacttctccaacttgttctccttgcactaaggataaggcccccaagtggcagactctggcttcttcagagaataagagaatgtagagcccaaatgcctaaggacaggacctcagaagtcactctgtccatcccctccctgattctctcttgtgacaaagggatttctcctacatttacactccttcccatgagcaacaggcccagcccagcccatccaagctttagatgggccagtggaaacctgaccctaagaaaaatgttcagagacatcctgggatcaagaacccataggacttttaagtgaaagaggaatttgaggttaggagcccagtagctgccaattcaaaacagccatggccacaaattctggttctgctcttctctctctagaaccatctaagaatgagatggagagattccagaagtggtgagttccccttgcctggacacactcaagcctgcatagtccagcaaggagctaactgacagcgatgtttttaaatagttccaggcatcagagagtcaagacccagctgaggacagcttcagtgaagcaacacagcaaggccttcacagaatcttttaaactccaggccaaggaaaggggaagccagaaactaagcctggaagagcaaccaggaagcacagaaatctgctctgatggtctcagcacagagagcctttctctctgcccagctgaccctggaaaggactgtatttttggctggccccatcccttgtctcctgaccaaactggcaggctaccaagcatgaggtgtttttcagagagcagcttctagaagctaaataataatagtaataataaatactaagtttgttcctctaagctaggaaagtgtcaggattactaaaactgagtgagtctgagtgagccaaggagttgggacccctgggcctgcaacctgtagatccatgatctgagtccccacccctgtcctgtgctgcaggagtgatgatccaacagcttggggtcgaggggtccccttcagatttcttccccaagaagactggaaggagcagagggaatgagagcaccttaagaaagagataaaagccagactcagagcgagggtaggtggtctcaggtttatgcctccaggccaccttcctgtgccttcaagaacacggtgaagaactcacaggtccccaaccctgagggaggccaaaggaggtcacccggcactggccctgggtcaccttggcacttcccagacctactgagagcttctctggtggctcagtggtaaagaatccacctgcaatgcaggagacagaggagactcatgttcgatccctaggttgggaagatcccctggaggaggacatagcctcccactccagttttcttgcctggaaaatcccatggacagaggagcctggtgggctacagtccatggaattgcaaaagagtttaacacaacttaacaactaaatggcaacaaacccactggcctctctttccaagggcaaggttagattccaaacccctacatgccctcataagccctcctcacacacacacacacacacacacacacacacacacacacacacacacgcctggaactggagacagaaacagtatcaggccttagaaatagtgcccagggacccatataaccctggtttgtccacctgtgaaccgggtcctggaggtcgcccagagtccatcaacagaaagggacaaggagaccagaggttagtggcgtggaaagactgacttttcactacatgcctttttgtagaatgtttctcacatgcacatactgccttttcaaaaaactaattctgctctcctttctggaacacacaaacaggatctgttctttgtcctggccacctgaagtcagaaaactaatttctagttcttatctgccactaatactaaagcagtgtgatgtcagcctgttcctacacatcctgcactgtggttccttgggctgtaaaatgggggtgataaaacctacccgaccttcctcatgggtaatttaggagtttgatgaggtccaacagtagtagcagtgataataattaaatgtcttgagtgctcatcatggattatctcaaccctgaaacaatcctatgagatggcaactaagacaagcctcagtttaaaagaaaagaaagggacttccttggtggtccagtggctaagacttctcactcccaatgcagggggcctcggttcgatccttggtcagagaactagatcccacatgccaacccttaagatcccacaaatcgcaattaaagttcctatgtgcagcaactaaaacctggcacagcaaataaataaataaatatgaaagaaaattaaaacaaataaaagacaataaaaataaaacagagagaagtagcctgctcaagtcatgcaa

SEQ ID NO: 40815 - DNA, 1344 bp, Bovine  19866880442190
tcgcctgaggtggacagcaggctgaaagacagacattattcaaggtatcaagttcaggtcaggaaattcccagcgacctccccacccaaccctccaatctgcaaagtgagtacatcctgtcaagtggtgtctggtgactatgtggtatttttctaattcaggttttcagctgtttaaaaacaaaaaaacacaaaaaaaaccctaatcttattttgcatcccaactcttaccattattttggatgcttaaattcactattccttcacctcaaccccaggcatgctttaaaacccagataagcgccacctacccccaattcatgcacaatacattcttcatccataaaccttcactggtttctatgttagccagactctggagatgaaaagacaattatgatccaaatcctgccctctggcagctttatgcatgtgagggtaggcaagatgtttagtataatacaacataccaagtgctcccatacgaggagggacaaagtgctttgaaaggacagtggaatctctccatctacatccagctatccattcgtccatcactcattcacagagcacctgctatgtcacgatctggagcacgatgctaggggttcagcagggaacaagacgagcgtggttgctgctctggtcttcctggagatgaccaaacaacaggagagactgaggtcttactgataatctcacaaaacaagtgagctcaaatgtgagaaacactatcagtggaaaagtagacgatcctatcaagtacctggtagttaggaaaaagtgacatttaaggagaaatcctgaaggatgaataggctgtgttcggggagtccaagcagagggaacaagaatgttctgacactgtaagacaggaccaggagtaggcaccacaagtggggactgagagggacccctctcctggggagggtactgagaccagggatgataaggtcatcccagaggtgacggaggcccaggcagccaagatccagttcgtatcaccctttcttaggaattagggaaaaagagaagcagcatagaaatgatgtgatcctgactgcattttttaaaacattctggccagatgcgatgaacaagtggaggaagggcaagaaatagtcctgtttagccatcatctgatcatgcaatgatcctgtgggttcttgtatccatcaatgcatgtttgtgagaccgaaattctcaaaaataggtgtctattgcacatgatatacaattcgaaaacatttcttgggtaattattctgtgataacaaactctatgtctttcttataacgaacaactccttgcctctgccctctgaaagattccctcctgtccccaa

SEQ ID NO: 40816 - DNA, 1627 bp, Bovine  19866880453079
caccaggctcctccgtccatgggattttccaggcaagagtactggagtgggttgccattgccttctccaaactccaagtataatcttttataaatggccttccagctgtgttatctctaactttgcaaaacctcacacaaggtgttcattttttttaacccaccctttaaaaatcagataccagtaaaccgtgatattatgatagaatcatacagatggttctgccatgtattcaccatatgtccttcattaagttactcaagttctctgagccactgtttcttcacttgctaaatccaaagacatacctcacaggattgctgggccataaagattaaatgatagtgcaggcgacgtttggcatagaaccctgcacatagcaagtgctcagtaaatattaacttttaacgtctaccctgcagacagacacaaaatgtgaaacctacacagaaaactcatatggaacttcttatattgtatttaaaacataaggggattaaggcccagagaggacaagagctttgttcaaggtctcacagtgatgacgtggtgacagtgtgactaggacccaagtgttttgcgctattgtgcagggtacccccttcatgcctgtgctcctcccatccatcccacgcccaccatcaccggtcgttaccctctgccggggctcggtagtcgtggagaccatgacagagttgcagatggttaaggcaaggaagaagtcagcaacggaggaggcagtggcaagggaaggcttggggggtctgccgtctgacagggtctccagccacagagctgcgtctcgcaccttggacaggagatttttatctggagtcacgtctttttcctgggagagaaaggctagagtcagagtttttcctgaagggactggggaggaaggccccctgcagcagattcgctcatgcccgggaaaggctgatacagtcctccgcgcatcctgcacccagcatgtctcccctactctgggcctgctcaccttagagtctgatttggctccttctcttccctcaagcccacgtgtccatcagttatatagactctggtggttctgcccccacagcatcttcccaccatttacccctcattcctgatgcttccagccaggctcagaccctctagccctccagcctgggtttccacatgcatgcatgtgtgcatgcttgctcagctgcttcagtcatgtctgattcttacaaccccatggactgtagcccaccaggctcctctgtccatgggattttccagggaagaatactggagtgggttgccatgccctcctccaggggatctttccaacccagggatcgaatccacatctcctacattgtaggcagattctttaccactgagtcccccaggaagccctctggatttccaattaagcctttaaagtgaggtgactgcctttcacctcatttagtttgaacccttcatatgtatatcacccatacatccttctaagacaccatttccctcaaggtattcttgagactaaaaaatcttcagatcttcactgtgaacatgatcatttcagtctggcatctaaattgtttcccagtttgcatttctcctgttgatttccaccactctgcatgtggtccttcag

SEQ ID NO: 40817 - DNA, 2487 bp, Bovine  19866880459245
ttctttggccctcagctttctttatagcccaactctcacatccatacatgactactggaaaaaccatagccttgactagatggacctttgttggcaaagtaatgtctcagctttttaatatgctatctaggttggtcataactttccctccaaggagtaagcatcttttaatttcatggctgtaatcaccatctgcagtgattttggagcccagaaaaataaagtcagccactatttccactctttccccatctatttgccataaagtaatgggaccgaatgccatgatcttcattttctgaatgttaaggtttaagccaactttttgactctcctctttcactttcatcaagaggctgctttagttcctcttcactttctgccataaaggcggtgtcatctgcatatctgaggttattgatatttccccctatcagaatggctatcatcaaaaagaacacaaataacaaatgttggtaaggatgaggagaaaagggaactcttgtacaccttttggtgggaatgtaaattggtgcagccagtatggaaaactatattcctcaaaaaactaaaaccagaactaccatgtggtccagcagttccactcctgggtatacatattcagaaaaaaatcaaaatattaactcaagaaaatacatgccacctcagttttcatagcagcactatttacaataggcaagctatggaagcagcccaaatgtccatcaacagacaaatggataaagaagatgtgatgtgtacacacacacacacccccacacacactggaatactactgagccataaaaagaatgaaattctactctttgcagcaatgtggatggatctatacaatacaatccttagtgaaacaagtccagcagaaatagacgaatactgtatgatgtcacttatatgtggaatctaaaaaataaaacgaatgtatatagcaaaacagaaacacactcacagatacagaaaacaaacgagagattgtcagtggggagaaggaaggggaaggaacatggtacaggtataagattaagagatagaaactactatgtataaaatagataagcaacaaacatatattctatagcacagggaattataaccattattttgcaataacttttaatggagtattatctataaaaatactaaatcactatactctacacttgaagctaatactgtaaatcaactaagtcatttttttaaaagtgtgatctcagaatctcaagaatttaatgccagccgatatatttgacacataagccaaaactgattcaccatttctaactatagaagtttgtcaaaggtttgcagaatcttaaggaaagatttctgtcacccatgtagtttccacttaggagaaagtagagacttaggcaattatatacaataagaatagtgactactttaggctttgagcttgctgcagaactcctccattctatattctttacataattcctcaggagaaatttaaaaatgagatactaggcactacagattaacttctgaggattgtgtactcttaccaaagagtttttattttagctctttagtaatctgaggctaatgattagcttgtagaagccagcctacttcagcaaaagattagatgcttagctactcaatgaagatccccaggagttcttttccttcctttagtgctgaccatttagcatttcaagtggtgaagaaatggcacttggaatgaatacctcacttaggcagcacactctttcctttcagattttaggataagtggcattaggaagcagtcagttatggacaatttgggaccctgcaaataactgtggaagttaaattgaccctgtgtgtaagagaaataatctcctggaagacatctattcaaataaacccattgtgcatggccatggatgcagccaaaaagatcattaacaggcccagtcaaatgactgtggtaataggaggaagaaaggagctggatcatttagataactggatctgcaaagactctcttgctgtattcaactaacaggtcccagatcagcatcagtcccagtgaacaagaactgtaaccacatttattagcaataagatcgtgcttttaatgcttgactgttaaattcaagaaagaagtaagaaaattgtcatttccacccagattgatgtgaaaactattatgcaaattcaaggaacatataaatagagtctgctagtccagaggcttcctaaattattaccgggctctgagggcaatcagccatcccctgctacctactaggaacaagcaaaagcacctaatgcctctttggtttggggagttattagaatgacctggtgattgagcatcattcagcagcaggactcagttgcaaggtcctgattcagattagcagttgtgagttggggcatctctttccatcagacagaatgcacctttaggtttgcatcaacaattaaacaatgtttttatactgctgctgctgctgc

SEQ ID NO: 40818 - DNA, 3011 bp, Bovine  19866880546633
tggatctgctttgtaggaagacagttgtttttgttattaaattctgcattatattttacctttggaatcaaagagatctgggtttgagaaacagttctactacttaatagatatgtgattttaggcaagttactgtactaccctaagttgctatcttatggagatactaacagtatacatttcataggcatgttgtaaagattaaatgaaaacgcaagcaacattttaagcttagtggctggcatattactggtgcttaacaaatgagttactatcacacataattctgttcctcaagaaaaaaatgtaaatgacataggtcccagtcactgccctctgtaagcgaatcacaccaggatattcaggcagtcattttttgctaaaggattaacaaacaggcagcataccaaattctaaagtctgaccaaaaaatatccacgacaggaatttcagcagccaaccatcaataaggtcattaaaaaaaagctaaagggtatatatataagaaatagttacacaagatgaaagtaagaacaaagttcacagaaaaaaagtggaaacttcttcgctaaacagatacactcaatgcggccccaccatgtcactgatttatctcagatgcatcattactaaagcaataaggacacagatgggcaagtcactctttaccacaaatgatgcaatctatgataacagtatcaatcaaatttagcactttacagaagtttatgtggcaaatcatgcacactaaatagaatatttacctttttctcttcatctggcatgttcttctccagctccattagatattcttcatctagttcagagggattcatatcatcctcaggtttgttctcaagcttgtcggctcccggctcctccgtctcaaatgaggcactggcgtcatgaaagcactcctcctccccctggtcctcctggggctgggcgtcgacatccttgagcagctcgctctgggaatgctgctctttgccactggatactggagggtgaagacactctgcttcctggggatctgtaactttcaaaccagtgaacagatcctctggaaccctacagttcgacttttcccccattgctcaatcagtgagggaggtgaagccgaaactgcgaaagagaaaataggttaagtaatgctatctacctgcctatccaatcctaactatcacatttaaacaaacttctgcatcaaatcacatccgaacttcttttcattgattcaattatatattcatacataaagggttgcataagcccacaaataatgccaaatgtaattctaactgctacccttttcagaacttcttacaagccaataggagacaccgcttttaatgtgattcttccatctcctattgctcccagtttttcagggttgcaaaaaattggcagaagcgaaaacaatggcaagaaaaacgatgcgtttctaatttttattcagattgaataaccacgtcgtaaataatttccagcaccaccgcaggaagctcaaaaataagtttctggtagagttcaaaatataatccgtgccaacacagcaatcatcaacttcacccacttgcatgtgatacagcccacgcaggttacagtggaagggaggccttggctctggtagccctaatcaggattcccgaaggggtcagaattagccatgaaaagcgtggttcttaaccctggacgcacaacgttaacactcaaaacgctttagcaagtcttgctgaccagactgtatactctacagattctgatttactagtctggcgtggagccagggcatctgtagttttaaaacggcatcccaggtgacttttcaggtgcagccaattgagaactagtgctgtagacgctgagtcagaccgtcagcagctccactcctccggtcgcagtaaaatcacgcagactcttgggttgcgataaaacccgaattcgcccctatttcgtcccaagaaaactttaaacagcacgattttaatacggagactttgcctccacagcaacgttttgtttttcccagctcccaggcctagtgtaagaacacaggagtctgaggctcctgagttaaggagggccacccctacacatcccaaacgttcctcccctagctgtgtccctcaccgccaagactaaagacccatgtggctactcacagcttcactgttcctctcgtcctcaccttcctcgcctctgagatctctacttccgctcagtcaggtgctcttccgtcggcgccggccaatatcgtcggcgttggcaaagcatcctgggaaatgtagtaaaacctcagggagagggtgcggcactgtcgctctatcacgtcattgtacggactgaaaatgagcgatggttgccatcttgggttacggcgagactccgcgataccgggctctggagaaaaaaaggaaaacagaaaggctgtttctataatgttccttttactcctctgctctgacctctcaaatgccagctgtgctgtgtacagaagcatgaacctgttcaaaaatagttttccctctaatgtttctcaaagtgtatttttgtcgaaaggggtctacagctagatcaaaacagtgttgataaattgttaaatggcaacccactccagtactcttgcctggaaaattacatggatggagaagcctggtgggctacagtccatggggtcgcaaagagtcggacacgactgacttcactttcacttttcactttatactcctctcatgaatgtacaatggatttttccagaggatatgtgtcctgtgatagcgcaatggattgaacgcaggagcaatgagaatccaggtgtcttttattaagccagagatttgcaaaaatgtaagacaatgccactcttcactatatgtacattttttgttttggaaaacttagttatctattgagagattgtttatgttcgcatataatgggtgtattgttattttaagtgaattaataaactgatattacagtaatttcagttatagatagaacccaca

SEQ ID NO: 40819 - DNA, 1035 bp, Bovine  19866880847119
ctctgggttgttttattctcccctcgccttatcctctttacatcctcttcttcccaccttcaccctcagaaacacagggcttctcccaggttacctagacactgggttccagcagaggagtgtctggtacaaaggcctttatttctctccttttcttggagatatgaactatttcttgtccacacagctaaatgtatctctcttaggctgatgacttaacagttactgaataatttacctaaagtgcccatgtgttatatgacaatttgaagaaacaaggctcagtgtaaccccagagtgactcttgagtgccatttatttcacaaacatttactaaatgccatcaacgtgctagatttagcctctggtgctgaaccacgtgggtcagagttactttctggcagaggaagggcgaagaataaaaccaacaagtatacacatagacaatctcaggtgaggataaatgtcagggagacagtaacaccaggtgagagtgtggaaaggtggggttcgtgcaggtggcattcttggaggagttgtagccaagcttccctccagccagctgccttggagttcattcctcagaagatctccaagagaaaggtatcataatccttattttactgagaacgaatgaggtttccagaagttaaagaacttgctctgagttgcagagtttgtaaatagacagctgggatttgaacccgagtctgtagacttctctggcatggtgctggctttgctgtgaaacgagtggcttagattaaggctgctaaaaatctttcccctaaaatggtatacatataatgttgcaactgacacctctaagagcaactgacacctggtggcaactgacacctctaagagcaggtgctctggctattttctgtctacacaaggaataaaatacgaattatgacacaaaaactgggaaggccaggttgacttatttgctgcctgtccattgagtttcagagagagcatatcaggtttagcagctgcggcaggtcagcagtcaagataccaaatgcaaat

SEQ ID NO: 40820 - DNA, 1666 bp, Bovine  19866880886708
agttggacaggactgagtgactgagcagcacacccccactaagcagtgagtttcagaggggaaaggagcacataggaaggcctcggaatatagtatttgtggactaaaggaaatgaatggagccaagggttcccttagagtgggaacatccacatttctccaagttgcccttaatgcagaggagcacataccctacagtgaccagctgcagtcacattagaccagctgcagtcacattaccttgatatctaatcagattttgccttcgtcgctgcattacgttactgtcctattttattacagggggcccttccccattctttgatttcccgctgatgcttcaagaagaccatgcccattttctccagtggctttgtctgtccctggcacactgctgtgaacccttcatcaccatcatgcagttccaaacacatggcattagagtttttagcattctgccttgttttccaccctgccacctgccacctgctgttatctataatccctgtgccagctttgggtttacagcctttcaatttgtgattttctctaccttggaccagctggctttcccctgtgatataggggatcttggcttgctgggagactggcctgcttgctacttcaaagtcccaaatcagcacgcagctctctttggtcttgggaggagctgggggctggcgagacgtccctgtcagtggaaggcagcacggacgtcgcatttcggggggccctcggggagtctgcgccgtggcctctggcttgctgctgtctgtgatctgtggtctgcatcgagggccctggggcggaggacttggatttccacggggccaccgaggctccagcgtctgtctggggagctggggtgggaggtgttcactggggacttgtttgtgcagcggctgccacggcagaggggggagcctttcagacagagaggcagacccctgacacacccgcatgtctgagggcggcagccagcctcgagtggcaggaatggatttctcaggacacctgccatatgctcaggggccccaggcaagaaaagtttccatgacagcctgaaatcctattcattcctccttcgcctctccccaggccaactgtcggccacaagggaggtcaccttgctcaggaggttctgagttctgctcatttcctagcaaataattaattcccagcataagaagggtgacagttcttgggtttttgcagctgcttccaggtgagggtcttgcatagatggaaccctctcacccacatgcactttctctgctcccataaaacaggagccggtcgagaacccatgtctccagactgtggaaggaggaagaaaagcaagagtttgtgggctggtccatggcggaccagtggcagggccgccctttgcctctctgtgatcaagttttatttatttatttttcatcccctgcattgctaagtagattcttaaccactggaccaccagagaagtccctgtatgaccaagttaacttcatttccttccttaacagaggagagactcctgttgttgttcagttgctaagtcgtgtctgactctcttgtgaccccgtagactgtgtagcccaccagtctcctttgtccatgggatttcccaggcaagagtactggagtggggtgccatttcctccttcaagggatcttc

SEQ ID NO: 40821 - DNA, 1484 bp, Bovine  19866880944629
accaaagccagcaaactaaagagccccacgtggcgtacacactccagctcgagccagagcagtcctctcctcttcaaaccattcctggtttcactagaggaagtgagccttttagacaagggtagaaacagctcacacccaccacgtcagccagattttcttaagacactagaaataatcatccccatgaaaggggttcttggataagcttcatagcaaacatggttttacaaaagggaaaaaaagccctctgggtgacaaagtcacatgaatgggtgaacgacaagtcttccatccagccctctctgaactgcaagacgattggtgtgtttcaacagtaaataacacagggttcccaaagacaccaagtgagtgaatcaagcaaatcctcaatcttctcctcatcccagatttctcttttcccagtggcattatcatcttacttagaaaatcctttctgggcccttctgctctacagagcaagactgtcacttaaaagcctgtttactaactggaattgctcttctgtggctgcaaataaaaaccacgggcagctgggacaagtttatcatgggagctgattaattagcagttacagagccctgaaaatcgaattccatttcattaacacagatatgtaactttggagtgaacattgttatgatttaaacacatttgttccatggtggggaagctatttgaggtagtagaaaaatgggaagtcttgtctgtttatttgaagtgtgagaaaagatgaagggggttttttaataatagcatcaataatagctaacactgagctaggatctgtcccacctgtgtctgtattgagtgcttatgtgtacctgcctgattgggcctcaggaccatcctaggagacaaacaccattattgcttgcattttacacaggatgaaatagaggcccacggctactgaaaggtggagccagggttaacactcaggcaggtagaaccagactggtggttctcaattgggatgacagtgggcatggacgttggcctccaggagtacgtgcagtgtctgcacataattttgattgtcatgagtagtctgggctgctaaaggaatctggtagacagagaccagggatgctgctaagcatcctacaatgcacaggacagtccccaaagcaaagaattttatcagtcccaaaatatagatggtactggggaggagaaatcctactccagagcctcatccacgtctctgagggctatgctcaggaaacagggcttcctatacaagaggcaggtctccagcagtgaccccttccctacgtactagagaggtacacgtgctccttcctggccagtcacctcggcagcagcaacacccatacacaaggctaatgctaccatccttgcctgaggtcttggatgtgaccctcttgaaagcctatgagatttcagattccctatcaagagctatgaactctctagaaataatactaattaaacatatg

SEQ ID NO: 40822 - DNA, 1514 bp, Bovine  19866880964366
catgccaagcagagagcacattcacacacttgtcctagagtggggggggtcttcacaatcatgtggtggagtggcctagagccttaacaatggagtacgatcaatgggtttgcatcctgattctgacaatatctgtgtgtatgacattaggtgggctccttggcctcactgtgccttgggctctccttgtaaaataagagaatatcgtcttcaagtgcttaaaataaaaagcacgaccaagtgaagggctctgcagacagtgtttatcaaatggtggttctatctatttctgctgctcagcaagacagcatgatgacaaagattaggacttggcaatcagtatgcgtgcatctgaatattggctcttccacctattagctttgtgattcggggcagatgactcaaccactctgagcctcagttttggggtaaaagtacctacctcccagggttgctgtgagaataagataaatatgcagagcagttagcttggtgctccagtaacggctggctttgtgttcactgtaattcctgcagcacacttgagtcttgtaatatagtataatggccaggaatcctgacttctccatgagtgactcagaaacaaattcctcttctctgctgttagttttcacatctctacaaaggatcagctcagctggctccctccggctctgaaatgtcggacttctgagtccttcctgggcttcatcgctgacactacctggcaccctctgcaaggaaactcaccttctaaggaaagaggaaagatccctgtctgtctctccagctctgctcccttggccttatcaaagctggctcactccattactcatcccctctgggggtctctgtgcttcctgtttccagtgggtgctaatgggttaatcagaggcactaatggaacccacaggaactcagtgttagctgactaatgggtcgccccatctgccctccctgtaacacaacgccttcactctgtaaaaggcactcagagattttctgttggctccaatctgctggcttctgacatcttgaaaggccaaagcctggagagggagagagggagggagggggactggggaagtggagtcctggagggagaagctctgtgtcagcaggcaggacatccgggctcccatcccagctctgacactgatctgctgggtgagctaacacaaatccatccccttttctgggcctcagtttcctccttccccatttcctgggcaggttgggctgtaaagactttactggagctgtaataactttctggaatgatcaagtcctgtcacttttgcagcggaggcgtaaatgtcctttcagcctcagtcactgtccaaaaactatagagggcctacgatgtgtcagcctgaggctggtgtagagtgaggcagctttccccggggggctctcgagctctgctcatcctactattgtttctctgtttgacacgtgagagagaataggaaggcctccgtgcttactgagtatcccatgtgtgctagcgggca

SEQ ID NO: 40823 - DNA, 2129 bp, Bovine  19866880978001
ccactgagttttagggtagttctttctgtgtatgtgattattaactgaaaccatatatatcctcacacatattacctattcaaaactaagagcatcttccttgttaacacacagggatggtgctaaatgttaaatgtgcggtatctcaatgattccttgcgagttcactgtatctccatttcacagatgagaaaactgaagctctgagagtttctttggttacttgtccacgatcacacctcaagaaaagaagccctatgggacttctctggtggtttagtggctaagactccacgtctgcaatgcaggggacccaggttcaatccctggtcagggaactagatccctcatgccacaagatcccatatgccacaatgaaaccaaagatcctgcagggcataactaatacccagcagggccaaatgaatacttttaaaaaaataaacattaaaagaaaaatatggccctgagataagaaacaaggaggcctctaacgtctcagggctactgtacctcctgggaccctgctctcactctttcccactatgggcctcaccctctccggtgaggggttggggagaggtgagagttggaaactcacagcccacaggggcctggtcagtaacacagagggccaaggtgggcatggtggactcagcttctgaaagccggctcagagtagctagatccttggatttttaaaatagaatccaaaaatcagatttttatgcacaatctatttttgttttaaagttagcaactagtcttttttttttttaacttagtagactgaaaagcaaaacaaagacagaagcctgtgggtttgcctctctggactagaagatctccaaggagtcttctgcacagacatcctgactttcagcagagcctcactggggagacggtgcaattcccaggaggctcagatctgagaaaggagaggggtggtgaagacagagatgccccagcctctccagcggtggtgaggggaggcagggggtgccaggaaaccaggccacagggagccacagcagtgctggagggcagctgagcctgcggtcagctgcccagagctgcccacctcccccagctcagtctgctccgtgggaccgagggaggcagccagggcaccaggggagactgaatttccgttgcaatgggaaaccacctccgcccacactagccgttttctccacctctcctgctcaccctgctgcttttccaatgggaaccctgtccccctcctcctgtgaccgaccctccttagcggaagaggatcgatcccctcctcagccatctccttgggcctctctccccaccccccactccctagtgtcttcgattccctcctgagcctgctgcccattccatcttcagctgactagtcttcctctgagatccagcctgacagagcgcagcagagtgattgatgagctagggagctctggctggcaggacagccagccagagacagggctctcacaagatagctgagctgcccagggaaagcccccagctaccagtgtgctccctgaggttcccccctgccccccgatccccgtgcagcccagactgacatggcagccactctggacagagcagataaccacaagggccgctgggtatacagtatctggcacacagcagtccctcagccagtgagagcactctgctctctctctgttcgaaaaacagagacccaaggcgatgaagacggtgagcttcttagggctggaaatgttctcattcagccatgcctctcagttcaggtgtttataatttgtacctcgttcattcattcatgcagccatgagagttttgctaggagcaactaagataattgctagtgtgatcaaaccactgggacacgggggtttgaatccaggctccatcacttcctagctgtgtgaacttgggtgtatcactttacctcgttggtggttcagccactaagttttgtctgactcttgcgactcccatgaactgtagcccaccaagcttctctgtccgtgggattctccagacaagaatactggagtgggttgctgtttccttctttaggagatcttccccacccaggaattgaacccaggtctcctgcattgcatttctactcttctaaaaagctg

SEQ ID NO: 40824 - DNA, 1372 bp, Bovine  19866880993021
tattagaaatgtcaaaaagtgaatgacagaattgaggcaatcttgagtcatccatttcagataataatgaagactcctgcagttagaagcgtaaaaccagagacttgaacccacaatgcttggttctaccccaagatccccccatttagtagctggcagaggagcccagtgggctacagtctgtggggtcacaaagactcagcctcgacttggcaactaaatagcaacaacaaaaggtcattgcatctgatgcttgctcaggcaggtcaggccgttccctctatcacagtgctgacacacagcgttctttcaaatcctcaactagcaggacctcggcagatggagcctcctaccacaattcccatctgttgattttttgctccatggcccagctcctgaattttgctgacatgttttaatctttaaaatatatgtgactgacattctactcattaacattgtatgaacacagaaacaatatgtttttcttagccaaatctttgaataatattgaagtttgatgggaaatgggccatggccttgggtgagcagaacacattgataaagtcaatccatttgcttgtgtgtttccaattagtcaaccacagcttgcctcttggcaaatatgggtaacagatgaaaaggtactttctgggtcagcattaatgcatcactgaaagcaagttagtgacaatttgtaagatgaagcataaatctaagagaaagccaccagtatcatcaggctgaaatctttggtgcatgcatgctcagttgctcagtcatgtctaactctttacgaccccatggactgtagcctgccagtctcctctgtccatgggattctccaggcaagaacactggaatggttgccatgcccttctccaggggatctctccaagccagggattgaacccacgtctcttatggctcctgcattggcaggtgggttctttaccactagtgccaccagagtgactcaactgattgaccttggaactgaaatctggacaaggtgagacagtagagaggtattaggattcaggacttcaaggattattggggtctgggttctagagggagaaaactaataaactgagtttatggatggggtgagaccatggtaagggagatggggtgattggaagatgggaagtcaaggaacaagaggccagaatcttggaaggtacatctatctgcttggatattaaaaatacaaaaattaaaatagaagttggttagagagagtgacagtgagccagacaggcattaaaatcctcaagcaaagaagtcatggcctagtggtcaggaggtgactgccataaggaaaggtgacaggagctgcactctatgacaagggttccaagccagaagc

SEQ ID NO: 40825 - DNA, 637 bp, Bovine  19866881063937
caaagatcgaaccccgtctcctgcattgcaggcagattgtctattgctaagccagtgggaagccccccaaatagctgagcaacataaaatcgtctatgtgggcattatctcttccttgctgttccttaactctgctgagttatttttcttaggcttcccttaaactgtactgctaagtgttcagacagccaatataatcagcaattcagtagtcctcctgctaaagcagcacgagattcaaatgacattttttgatagatagcatcagatttcagatttacatgggactcttctcagaataagcttcatgacctaggaggaaatcagcggcattttttgcctggatcttcttacgaactctgcccttggatgtacatttgaaagaacatgataaaaattcctctctcaaaggaactgatctgatccctgactaaaatatcttcaactctgaaattagtagagatctatgaccaatatgaatgatggcttgatcccagatgctggagcttcttgatggggaaagggcaagactcagagcaggaagaggtaacaattaatcattgctgaaacagaaccagatgaggaagactcaaagagattcatctacaaagtcatttatccactgtttaaaaggaaa

SEQ ID NO: 40826 - DNA, 1422 bp, Bovine  19866881096046
aaacctatagattaagagacataaggtatcctaatgaatgagcaaagctagctgtagtgtttagggaatgcacactgagtgagaaaactaaaaggaaattcaacaaattattgcaatggaccaaatgtttatatctcctgctcccctctctaattgctgaaatcttatcttgcagtgtgatagtgtaagaaggtggggtctttgagatgtggttaggtcatgagggtagagccctcatgaatgaggttagtggcctatgaaagggatcctagagagccttcttgccctcaatccaccatgcaaggacccaatgagaagttaatttgcaacctgaagaggaccctctccaaaaccagccatgctggcaccctgatctcagacttccagcccccagaactgtgagaaataaatttctgtcatctataagccaccagatctacagcagtctgttacagcagcctgaattgattaagaggtgtttccccaaaagtcaagatcacagtaacttttggtcggtgtctgtgattggatgtggactgtgggtggacttctgagactggtgtgactttctatgtctgtgtttcattatttttaccataacaagtaataaaaagagagaaggatcaaggggacctgaagtcctaacgaaatactgaatactaatactaaagccaatataattctagcttacgtttttgaacacatgccttatgcaaggtgctatgctcaatacttcaccacagttgtcatgtgtgctgatctagagtcaagtggcttggttaatttctttaactagctgtgtgattttaggcaagtaagtaattctttttgtgcctctgtattctcatctgtaaaatgggatgacagtagtatatctcttgtaaggctgttaggataagtgagttttgcttgtaaagcccctgacacagtgactaattcatagaatgtgcttaaccaactgtaactactgctgcatcccagggaggttgctattaatactctcaaattatgggtgaaaaaattaaaaattggagaggttaactcatagaattattcagtgttgaagctaggctctcaactttttccttctgttttcccaactcattaacttccttccaaagaaagatagtgaaatagcaaatgacagcaacctggcttggatccacagctctgttttgaaggatatctggggtcttgtttcctcccttgccccgacacatggtgttgcaatttcatgacaagacagagcatccggcagtgctgtctgaagcacgtctctctgaagcaatcttggaagagggagtaaaggcgagaaggatgcagggctatgtatccccttcagcagaggcataaacaagccccattcccagagggagccaggagcccagtgaggcagcggcggatgcgtcacacaccttccag

SEQ ID NO: 40827 - DNA, 1252 bp, Bovine  19866881103727
ggaagaaggggaatgagaaacgggactggagagcttaaattgatttttctgcataggagcccagagttgttagccaactaaactgtactccttaaggtggtatttcccatagtattgtcacccgagattattttaaaggatacatgaacggacttaaaaaagttaccgtgtatttaatgtacagtttaaaaacatgtatctagcaagctctgcgtagaataaatgatgctgattttccatttattgtaacgatatagcagttcctttaaatataagtttttttaagtaagagtagtaacatggtataaagaacagttaggttaatgctagactaaggcgtatgtagttatggcccaccccaaatatatctaggatgggactgagattttagtgtttctaagattttagaaacactagtctaaaggagaggctacaaaactaggagaatgtggggagaaaaccagcactcccctgccagtgtgcctccactggcagaagatggggacagctgagagagatctctgctctccccaaccccttaaagggagaggtgctgatgggctctgggaaggtggcggagtccaggtgggttagaggtatggcctgtgtatcttgtctcctgtccctgagctgagactgggaagggtggtttggggaacaggtgtgtagtaaaaggtgtatattggtttcctagggctgctggacaagctaccacaaacctggagacttaataaaaatgtgctctctcacaattctggaagctggaagtccgaaattaaggtgttagcagggccatgttactccttggctttccttggctggtagatgcatcactctgtctctgcctcttgtcacacggtgttctgtcggtatgtctgtctgtgcctctgttttctcgctttataaggacaccattcgttggaatgagggctgcttgacctcatcttaatttaactaattacatcagaaaagaccctatttccaaataaagccattcctgaggttctgggtggacatgaattttggggggacactgtccaacctagtatggggagggggaggtctccttagtggagttcctgggtccctgcatagacaggtcccacatccactgcatttgcacccaatgtctggagttctgcttaaaaagtcattagctattcagagttttttcctcatgagggggtagctgtattccagtccaattatcttatctttgttcctgtacctactaggcaatactactgttttg

SEQ ID NO: 40828 - DNA, 1927 bp, Bovine  19866881137146
ttgagatcacatgtatcaggagcagctggttaatatttttgcctcacctgtctttaacaagtgtcttaaaacagactactgagtactgtgaaaagtgaaagtgaagtcgctcagtcatgtccgattctttgagaccccgtggactgtagcctaccaggcttcctctgtccgtgggattctccaggcaagaatactggactgggttaccatttccttctccaggggatcttcccgacccagggatcgaacccaggtctcccacattggaggcagacactttaacctctgagccaccagggaagcttttgagtactgtgaggaagggtactttgcaagaggtcatgatgctaatataacagctcaggtgctgccgtcctcttcccctcctttcagagcaagcactagctttgtaggttataacttggtagcatgttgacctttgtacatgtgtttacaaactgtaggtcagtgcatcccagactgagaggatttggctgtgaaagacgacttcagcatgtgaattagcactgcatttcagtaattgttttaatgtgtattaggaaaaaaacaactagtatacttgatgtcaaactgttgtgtgtggttttaggacaaagatgtcttttttttaaaaaaactgagttgagtaagagaaatgctaagtgcaagtattgcaaggatatagcaaaaatgatgggaacgtgacagaactgaaatgtgggaagccttgtcctagtaatttcctctaggcatgcacgtgtgatgtaggagtaaatcaagactctacaagcttccattttggcccaccaccatcatggactgcctaccagttccagactagagaattatccacggtgggcatctaaattccttgactgtctttgactgcctcttaccccagtgttgtgtatttgaggaacacagattggtttttaatattaacccaataatttaggtaacactgatggaaaatcacatttccaaaagccaaaaatggcttctaggattagtttctattctgggtgatttatgcccattttctcttctattaggttaggttgggctattgagtcaattagctctgaattaactctactctggggcttccctggtgactcagtagtaaagaatacacctgcagtgcaggggactcagctttgatctctgggtggagaagatcccttggacaaggaaatggcaacctactccagtatttttgcatgggaaatctcacggagaaagaagcttggtgggctacacagtccttgggattgcaaaagagttggacatgacttaactgactgaaaacagactgtgctctgcattttgataaatttatgctaatttttgtgctaatacttgtatttcagccttaacttttgagccatgatactagaattgattgctgaattgtatttgtgtgtgattttgagaatgagggattatggtttcttagaaattgaaaacaaatttaaaatgtggtgaagcaatcccatgtcttgaagaatctctccaaactcttgtactaatcagttgacaaggcttccactcttactaatggatttttcttgggtttgttttagattactgagaagactgttaaagcaaaaagttcggttcctgcctcggatgacacctatccagaaatagaaaaattctttcccttcaatccattaggtactcttggtattgtccaaatgctttagctttcagtttctcttaggatccaattcaactgtaacttgatatggctctgaatatgatttgtgatctaaaactataacaaggctgtctgaatctggggtgctttggacagataacttgtggttttatttttaaggcatcatcttaagtcagaagaggaatcagagcaaagatgggaaaacattcttgtcctcaaaagctaaaaccatccagggggagatta

SEQ ID NO: 40829 - DNA, 1667 bp, Bovine  19866881168962
ttaatctttaagcctcttatgaagtaacaactgtctatttgtcaagtggataactaaggcctacagtgaacaactgagctatccaagatgacacagctggtgagtagaaccagggcttctgacttcctgaacagagcttttaatacaataacatctcaaggcagagggattatggaccagtgaatagaataattctgaaggatggggccacattagtaggttgacaggtaggatgtaaaagtgatcagtcatatcaaccagctgcacttcgaacttgaaacctaggatgtaaggcatgaaaaggttcggagattagagtaatggttctcaaactggcctggggaccctggggagttcctcagatgttttcaagaggtttatgtcaaaactattttcataataatgttaaaatgatatttgctcctcttctattcttattctctcataagtacacagtagagtttccagaggccacaggacatgtgacactcaacaaaaagaatgcagaaggaaatatgagaatctagctatcttctgttaagctagatatgaaagaactttgcagaaatgtcaaacaatgccactcttcttacaagttatttttgttgttgtttggaaaatacaattatttctttaaaaatattttatgtttatgtgaacacatagtacttttaatgttcttgaaaataaatttataaatatttttttttcagttttaactttgaatacagtacgcgtggatagatataacctacacagacaagcatagtttaggtcctcagtatttttaagagtgtaaaatcattttaaggatataatgtttgagaactgctgggttaaaggataactgcaattttcaattaaacttctttcagaagattcattcgggcaagcctagtttctttttggcttctgacacctagactccaggaacaaagttcaatgtgaactggagatttagccactgatgggttgtatgatcagcatggtttaaaccaatttatacaactctggccaaaagttccttttgggatcagaatgaatttgttgcctactttgaccaaattgactagaaattgactggctctgttcattactatgtagatacataaagcaactggggaacaggtgtcactctggtggcaagtagcagaaggtgactctgccagagaagctgtttactgaaaggatcttgggagctgtcagatttgttaggagaaagggagagtcaggcttgaagctaagcttctaagagcagtgaaaacatcacttcgtagacctggactgagagggaccgctgcccctgctgtggtggaagcaccaccaagacctcaaggaaaccacactgaccctcttccagaatgccaaccttgtaaacattgtcatcccaaaactcaggcttcttgccaccattctgccagcaaaatggatctcctggaaatctctttccttaagttcctctctttggaatcaaagtttaaaggagtgtatctgattggcagaacccgagacatgtctttattcatgttgcaagaaaggctggaatttgatttgagatttctaagttctgctttggaggagtaggatgcacaggcaagaaatgatcccaaacatagcaaaaaacatttaagaagagctaagaagtcagtcagaacacaaaactgatg

SEQ ID NO: 40830 - DNA, 1151 bp, Bovine  19866881171594
tgtgctctggatgtagcctgtcaggcaatgatgagcctcaagatggaaccctacaagcagtgaagagaggctctgccttaatcctagatgcctctatctgaagaccaaggagcataaatgattaattcctgctattccatttttaaggaaaagaacttctcaaaaaccctcattcaattttatcaagactaagaagcctaatattaagaagttgtaatcatttatgttttattaagtagtcatcaacagcaatatcctaaaagtcagtcacatttcacagctagagggaatcatggcccccggctgccatctctcccgggctgcccatgagcatcagttaagaggggcctctgctccactgctgcttccagaccacacaccctgcccctctgccctgaaaccccagctcgcaatctctcatcatcagaatacaccatccattgccagttttgttgcaaatgcctgggtcagtccctcccctgcgtgaagaatttaactactagctcactgccattctctctaaaaccactccttctttctgtttattccttctaagatcccgctctcaaaattcccatagttctcttccaatgcgcttggcttccactacctgagtcactgactgctgtggtcatctcctggatgatatcactaccaacaacttcaaactgtctataatctgatcctcaggcaccccaggctcccgcttcctggctcagtgataccctgtccccaacaaccctttagtcccccagggaccaacacttcagatccaactcatttcctcaaactcatggctctcatgattctacatgatttagtccctgcctacctctctggcattgtctcccagtcctctccctattattcacaacccaccagcccttctgacccctctgcattttctcaaacaagtccattcctagctcagggcctctgtacttgctctcttctctgcctagacagtcctactaaaggcgcatgtcctcaagactcctcccttacctctttcaaatttttgttcataagtaccttctcaatgtgaccatctataatctatttaagatttcaacccatcaacccaaaggacatacactctcttccctactttacttttttcatgccacttatcactacagcatacgggataa

SEQ ID NO: 40831 - DNA, 859 bp, Bovine  19866881305876
aacaacgaagtgttagtaatagaaaaggcctgaaaacaagttaggctagcacaaacatctatgctgtgaatatatgcacatatatgtgcagaatatatatgtacaaagacatgtgtgttttttaaaagacaaatagaatcatatgtatgtttctgcagcttgctttcattttatttttcatttactaatgttttgaccatcttccccatgattacagctaaatctacctccttataaaatcctgctctctctgctttggctcttactttctcatcatccttgctgaatacagcagtcagaataatctttttaaaatgtaaatcaggtcttattacctccaagcttaaaaaccttcagtggcctcccattactcttaagacaaaggccaaactgcccaatctgatctcttaaggccttaggtaaccttgctcctcactccctccctggactcacctctggcagccacatcggctgctctcattccttaaaggcaccaggctccttcctgtaccttagagccttccaaagtgctctgccctctcattgagatgcccccgcatacatgcacacacatctacatacatatagcacacatttgcactcattcttagttacacatgcattcatacacatacaccacactagtcttaaaagttcagctcaaacatcacaacatgtttctcctaccccgccccccaccacaacttccaacaccactccagactgtaacagatctattgcttgctagattgttagtcactcagtcatgtttgactctgcaacaccatggactctagcctgccaggctcctctgtccatgggaaattctgcaggcaagagtactggaatgggttaccat

SEQ ID NO: 40832 - DNA, 832 bp, Bovine  19866881313672
taaaccaggagagtgattcctgctccctgcctcccaggtatcctgggagaaaataggtatgggtatcctccttccgtctcccgggcctctgattgtggagtggggaagggtcttggcgggcatcctagttggctggggaagtctgtgctccctaagtgaagggaggacagttaagacttccggttggctctgtgcccttgcccttgacttgttctttgtcttcctaaaccacacagccacttgggtaaagggagtgcagccagcaattctctctgagagaacctgccagaaagaggtgacattgttggtctgctgtttcttccttttctttctctctcttcttttggccatgctgcgcaacttgcaggatcttagttccctgaccagggattgaacccatgctcctgcagtggaagcactgagtcctaaccactggatggccagggatttcccttcattttttaaaaaaagttattaaacacacaaagtactttttttgtttctctaggaaactacgaaaataaatacaagcaaacagaagaaagtaatattccccccacaaccccactcctcagagtaatctgttaacgttttagtgtaggttcttctgttcttgtgtgtgtgtgtcatcacatttctgtagagcttttatttagtgaagatggaaaatatcttttcttaaaacactgttgatttcataatatatcatgctcacatttccatatcgttcttcttcacccagtcctgattattggacttttgcaaaaaattgaaacaattcattgtgtttatttagaatagacaatataagaacatgtaagaaagaaacaaa

SEQ ID NO: 40833 - DNA, 1707 bp, Bovine  19866881394679
atggatatgggaatgtgcatctgaggatgtagagagaattgtgcctgacattgaacagtaatgtgagttaaataaggaaacacataaatatttgacataggtctcgtgtttctctgacttcctcttcttcctcttttgggttctttgaaccaaaccatcaaacctcttttgggggattttcacttgtggtgaccaccaagttcagaaaggtctaaaagaagtggtgggaacctttttccttgggggcatctaaaaattgtatctggacaaagtgttagagccaagctttggagtagacagaccgggcccctagggagcaaggcaaggaagtgatgtcatagagtgatctctggcttctttggcagaggtgactgggcaggacccagggatcggggtggacatgtttgggaaatgtgtgtgagatcacgtcaggccccgtggacatggtggaggagggaggcctgtgagaaagaagcagttggctttgcccatctcgatcgtgtcctgaggaacgctgggacaggaaatgcccagcgtttctttactgtttactggacgccagacccacagatttggaaggttgccttgggagtcatgaaaagatgaagggagaaggaggaggagcattggttttctgccttttgtgggactgccctggtaagtgctcggggatagggtatgtggaagattttgtagaaacttctagatagggggttccctggtggctcagacagtagtaaagaatccacctgcaatgcggaagacctgggtttgacccctgggttgggaagatcccctggaggatggcatggcaacccactccagtattcttgcctggcgaatccccatggacagaggagcctgtcaggctacagtccatagggtcgcgaagagctggacatgactaagtgactgagcacatagcacagagcagttagggcatggtgtgaattacaagttcttggaaaagcttccaaatatttccctaattctttagagtactatccgtttagacataagcattgccctcttccaatagccctatgttaattaactatgagtatagttatgcatcaagcctgtgtcaggctaattcacaggcatcatcttatttaaccctgcatacaacacttttgtagaagacactattggctctaattcacaggtgaggaaactgaggataagagtgatttattaatttgctcaagattattcagagatgggattagaacagatatggtttgacttaaaggtggcacttttcacctctcagataacctgagtttgactgtaggctgacctcacagataaagtgacaggaatttctgggtatctcagcaggtcagagaccttggtcagagagacagaatttgttctgatctgtgtgctaccacacaatgtgggtccttctctgggtgagatctgaggactgcatctttcctgctaacccctccctgggaacctcaagtgagggcaagagcttgtatcaggcttgagccttacttcttccaagaagaagcgtaggggacctgatttaaaaattgcctttaaggactgcaaaagttattaatcttatgatggaaatcaactgttgtctgtctatctcagagagagagacagagagagcagatatagcctcctaagacagcatgaaagatatcatttagacctaaggaagtagcttattaaacatcgggattaaattca

SEQ ID NO: 40834 - DNA, 1406 bp, Bovine  19866881470112
ctggcctcgctcctgttcccagacacatctgagcacagcgcaaggtgtgcggggtttgccacctctgccaaggtcagtgcctctgtgctgggggtgagggaggggtctgcatgcctggactccgggcagccctgcctcctgtgtgtaacttggtttggggcttcatgtaggtcgtgattcccttgtccctggtctttctcggagccctgcccctctcaggcggtcctctttctgctttggaagcctctggaagagcccttgggcaggcaggagagtgtttctaaaggactccagcctgtcttgacacccatcaccttcctctcctccaggatggcacctctggggtttctcaccctgggactgtcccccaaccgtcttggttacccccagggaagggtataggaccaggtaagggagatctaggggaggagggcagagaaggctccaggtggagggaagtccccccagttggtgttgcttgggttgtacctgtgttcatcacagaacactccattcattcattaatacattcatcccctcattcaccagatgttcatttgcccttaactgtaccagatccagatcagtccctggctcgggaatatcccctggaggagggcatggcaaccattccactattcttgcctgggaaattccatgaacagaggagcctggtgtccatggggtcgcaaaagaatcagacacgacttagcgactaaacaacaactgagatagcaaaagcaggtttttttgctgttttttttttaaaggtggagtcccacctacctgccctccccaaccccatcacaaccatctgtctttgtgcccccacctgctcaaactgggcaatcaaccttctgggagggcagataaaagctctcccgtctggctcaggtgataaaggtctagggagggagagtttcaggaagcctctgcctgcccctccaccctgccccttctcagtgtggcttttgtgccggccacactgatgctgcccctggccccattgtgagcaggatcaccctgcctggcctgttcctgccccctttccgccctcgccagcagctgcctgcctgcctgccaagtgcctgcctaatccaggagcgcttcctgagccgcccctcgctggctgcccttttgtttctggaattcaggcagctcagcagaggggctggcttcgtgcacccagctgcttcgagctgccttaggtcaagagtgctccgagaggaatgcgatccttagagcaaagcccttgtaatggatgccttcccccgctccccggcaccccccctcacaattgggttaggggaataattggccagactctcaacaaacagggtaggcatgctggcgtcctggttttgttgttcatttcccaaagaatcaccctgctctgaggtgctgag

SEQ ID NO: 40835 - DNA, 1334 bp, Bovine  19866881534606
tgttgactttggggatagcctcagtttatccatctttaaaatgggacaagaaagccaatttgttatctgcagggaacaaaaaaaagggtatacattccatttgtcctattgtacaagagcagtctgatgtgtaggcaagggttgatgtaagggtcttttaaagaaagagcctctttgccaaaggtattcatctccccctgtgccttaccaccctgcatgaagaactcctgtgtctgttgcttcttctgttttaaccccaaactattgttaaaataggtgaattaacaagatgggatctcacattaggtcatgatgttcattaatactgtggtctgaatgacatcctctagttaatcctgagccagttgatggatggtgaggctaggagggtgacctgagggcctgcttggaagggcaccatggacccatttggtaaatcaccctttgagggtacatgggtaccccagaggttccattttcaacatggaacagatcttctaatcactgtcctctagccaccagggccaattgagggtggcagaggtgactctcaacctctagcaagttcacgtttcttctttcggccttgtatccctctctggttccgtgctctttaaaaagaggacaactttgctagaaacctagcaagcattaagttccctgtactctcttcttgaaagctaagtcttcctgatagtctttgtaaatatttatgtatgtatttgctgcattgggccttagctgtggcgcatgggatcctcattgtggcgtgtgggctcttccgttgcggcacatggcatgcaggctccagggcacagttggggcgttgcaggcttctccgtgcaagctcagtagttgtggtatgtaggcttagttgccccaaggcatgtggtatcttagttcccccaaccaggggttgaaccctcatcccctgcagtagaaggcagattcttaaccactggaccacaagggaagtcctgctaatctgttataaatggggaaagcaaacgtgcgtttctctttacacttttgtcttttgcatccagtaaaagggacaaatgatgctttgtgtgtgtgtagagggggacggggaggagaatgtgagttctcttaaaggcaagatttgaggctcagaagctgcagttggtggggcttcagaatcctgtttctgcttctgaggaccagagaactcagaggtgacttctcactggaagaggcccatccttcacccccaggcagccctttcacaaacagggtgatatgaagagttctggattgattccatagtcaaacagatctaggctgctgtgtggtctgatatttttaaatattac

SEQ ID NO: 40836 - DNA, 1146 bp, Bovine  19866881594887
tcacaactgcacatatttggatctttgttagtttagaagacatggttatttgagtggcacaatctcaagtttgcctttgaaatatctttgaagattgtggttaccaaatgccaaaccataggctttccatattagaattccttggggttgtcattgaaaacagattcctggaaacttagcacagatataacaaatcacttggggtgggaacccagggaattcatatttttaactagctggtcaagtgattctgctgggaagctgtgactgggaacaaccactgttaacaacttaactttcagtcaacttgaaggaggatatataaatattctgaagagtaaatctctcatgcaacattcaggaatgcatacactaccaatattttcagtatacaaaaagatataaggccctccatttgataccacatttgggggggcctcatctcaaagtaactgcatatgctttagactaactcattgcatttctttctgtgtattccttaattaagtctcttcagtaatttacctttagtctaaagctttgataaatatcaacgagtaacatgccaagctaaagctaagcagtctgcagaaaatcatcagtcaaaggtccctttttttttttttttcctctttacctcccaccctaggtgagctcatccggtcctgttgcttaaatagcatctatgtgctgatgactcacaaatttctatctccattgtgagcctctcatctgcactttagggtcatatacccaactgtctccttgtcatctctagttggcatctcatacgaatctcaattttaagaatgctgaaaagtactgaactcttaaatcattccacctaagcttttcctctccaagtccaatcttctcaacctcagcaaatggtaccaccatttacccagacactctagccaaaaacctaggggagatcagtcttgagccctccctcttcctaaccacccccttccacatttatttctaaatcctgtgactcttacttcacaaatgtattccaaatctgcctgtgactcttcacctctacttctatgaccctgatcccagccaccatcatcttctgctttatttaacaggaactgggacgatttcttctccaagacactcgaccactgtagtcagagg

SEQ ID NO: 40837 - DNA, 671 bp, Bovine  19866881654875
ctatttcccagccaaagccagccagagaatgttaattatctcattcctttttctccatcctcggtgaattattgactttcagggcatgctgtctttaattgtgaggtattccagaatgagcaggttatcaaaaatgtgcaggggggagagcttcggttcaaccctgggaagctaaggtggggaaatttatccttctttatttacatagtaataggatgagattttgccagctggctaatggattcttaaagagaaacaagcttcctgtggcctagttagaacgattggttgccctgctaccacataaaacactagatcaagaaagcagtggctccttttttctagaatagtcttctgtttaggggactatctgaattattttcatgggagaggtatttgtaatttatagtgggaggtggaatggtagggtggacatagctgctgtatggtttaaatgcatcagcccttgactctgtaaccaaacagctattgggactcagatggtgcatttaatcacccccaagtctcagttttactatcaatcatgcagggatggttatcatttgctctaaatcaccttagcaagtttgttgtaaagacaagataaaaagaattggttttagagtgctgaatgattgtattttgtatctctgagatgctcatgtgattgt

SEQ ID NO: 40838 - DNA, 1537 bp, Bovine  19866881751802
tttttgccaagctgaaatggttctttccataaagtggtctccctgcacccatcaatcttacctcattcacactattggcacaaagggttaaaaggtcaagagtcagccaggctaggctttaggcttgcttctgtcttgtactgcttggggaaagtttaacctctttatattcatttctgtatccgtaagatgggaattaaaaaaaatacctaacacgtgcatatgttgcaaaatgatttccacaataagtttagtaaacatccatcactttgcaatacagtcgactcttgaacaacacaggtttgaacagcataagttcacttatacacagattttttcactaattacatactatagtactgcatgatatactgttgcttgaatctgtggatatggaacttcagatatggtgggacaactgtaaagttacatgtggattttcccctgtgtggaggattggtgctcctaaaccctaaattgttcaaggatcaactgtgtatgtcaagtcattatgttgtacagcttaaacttatccagtgctctgtgtcaatcatatctaactaaaaaaaaatcttatctaaagggctgtgggaagttaagaaagtacattaaaatcatacaggtgtgtacctggcatgtaattttaagctctatgttttttataattattattgactagtcaaatttaataagaaagctagcgttaccgttttgaattactaaaaagtgatatttggacatactcgatatgttatgtggagacagtcttctaatcttttacccccaattaaatggacagcacagctctgtaacatcgtctcaagtatggtcagtcaaatgtttcccttgtctctcaaacacccatgacttttgaaatcgaaagtacctgttttggcaatacactgcctcattgtattacatgtcttagttatttcatcctgactagatggtgagcaagttgaggcctgcaattctatcttctctacttctttatccctgttgaagtggaccacaggtacgagctcagcatttgtgtttcagtggatcaatgatacggagaaaagcagctcaaatctgaatgcaggtgatggagaggaacacaatttttaggcccaaagggcttgggggcacttacccaggtcttcatttccattgcctggtgcaagaggattgtggcaagggagatggtgttgatggggtgttccaaaggtaaaaacgtcgatatcagagtccttgtaggtctgcagagcaggaacaaacaggcactgtcagctgtgcccagggactgaaggccttagtttggacaagtaaagcaccagtggaggcaggtgtcaagggaggggaaggaatggggagaaagctgtccagctactgtcatgtggaactgactgcagggacagacaggaggaggagtgagttgataggactaaactcttcaaaatgcatttgcaaaggaagccatgaagagtatcccagagctttgcagaatgagtaaacaaaaaattgagtacctaccaggcacaatgccaactgctaa

SEQ ID NO: 40839 - DNA, 1498 bp, Bovine  19866881790758
attaatttaacttcctggaaataaaaccataggaatgataatgtgctttgggcactatatattactgtgtggaattttgagtccctgtaaacaaggaggtaaattaaattcagaaatgtaccagatttggccatgctgcatagccaagcatcactggtttgggaaatgaactcgtattatagatgataataaaattgctcccaggttgaccttagtgaatggaagtttatttgctggggagggaggagagcaggtggaccagttcatgaaaggaagggatgctctagatgaggctgttcagtgaccatgttggtgcagttagaccctttgaggggatgaggcctttagaatgtacctttcccaatggcccacctttgctcaaggccaccacctaagggaagaaggactgctaaaattgggaggaatttgtttttcagatttggactgtatctcaggcagcagaggttagtgggaaaagcaactgcattgaaggcagagaatcttaaattcacatcctctcctagccagttcctcactgaccttggacaacttacttaatctctttgaacctcagtttccccaggctctaagttgaagacaataagtgtttatctctagttttctgtaaggattaaaagaattaagtagaaggtgccttactttttcttcctgctcacctcagtgaaataaatagttggacaaatattacaaaataagagagccctccactataattgatgtcctgatggctgagtactagatactggtagacgcaggatcaacttcagtcaagatggcagaatgaacagaggcaaggagtcctgccctctcaacattagaaatgccaaactaaataatgtttttaatttttaacaaactttttggctgaaaatcaggaaagaaagcagttgccaggaataaagaaagaagacaaaattatttagatgtagcatgtcttacaagggaaagaaatcacaggcttgggtctgcctaaggaactgtggaagttatggctgcccaggacatgacgtctggactgtgaaagttttcaattcacagagagtcatttttttctggtgtgctagcaggaaagtagatagaccatagaaagattaatcctgaaatatccagaaaattctgttacccagaattccccattctgctgttttcatttactcgaggttttaccatgtacaccaggaaatgattgtgctgacttttcctttaacccataatcactcagcgtgtttagctatttctcttttctgtatttctcagctcctttggagggaaatgagagaccctccccaggcaaggatgcaataatctgaccatggttttaagggacagtgagcttctttccagtgcattattaaacactatttacagaaggaaggatgaagacaaaggcttttagggtggagggcataagtgagagtccaagaatgaaggtgcaaagcagtagacagtagtttggtgtggagggaagggttgttca

SEQ ID NO: 40840 - DNA, 1013 bp, Bovine  19866880578578
atttatagtacccagggtaaattacccataattaaaagtagactttatgaacaatttgttaaactaggaattagctagggatgtaaagccacaaactggagaaattccttgcacaactgaaccagaattattttgtcgtcacttgcagattaaattaactgacttcgtcagtgttacctcccttgggaactgaggcatgttgggcctttcctggtgtttcagatcgtaaagaatccacctgtaattcaagagacccagatttgattccggggtcaggaagattccctggagaagggattggctaccgactccagtaatcttgcctgaaaaattccacggacagaggagcctggaggttacagcctatggagtggcaaagagttagaaatgactgagagactaaccctttcacacttcacttgtatttagcaattttttaaaaagtggaaatgaaacaaattaatggtgaaaattgctaaaaaaaaaaaaaagttgacgacctttgaagagaaacctttagatttcccgttatcttcattgggaaatattagggacaaataatttgaaggtttcttacatgcatattttctgtctttaaatggatgtcattaatttgaatatttatgataattgttatattatctaaacatactattgaaaattgaatcatttgaaaatgtgaaaattcttttgattttccattcccactcaactatttgtcatggtatgagaatactgttactcaataactttgaattactctggggtgaatcattgccagagggaagaagtttagaaacacttggtatcccttaaaacaagggagatctacaatggggaaaatattaaaacagcccagaagcatcacatgctggcatctttagaattattttttgtataccatttgatcaattgatcaatgtgtcactgaaaccaaagaacaaataatatttcttatagctggactgtcaatcaatacctatgtaatctggtggtggattagtcaccaagtt

SEQ ID NO: 40841 - DNA, 1320 bp, Bovine  19866880606337
cctgaacagaggtaagattacttatgtaaactgaaatggatcagcctcatacaactccctgacaaacatcttagagcaattcctcaataaagtttgtcatcaagtttaccttcaaaatatgtgaaatagaaaatctaatttattcttatggcagggaatatatgtatgtatgtatatggagctgcactttgcttgtggggaaaatgtaaacatatttctgtcaagataagtattttaactttttattgctaagtataatgaaaaattaaaaaaaaaacacataaaaatatttatgccagtaattgaaatgcagcctatattattatatcagtcagaatgtgttcttaatatactgctgtaaggatatgggggtgcagaaactctaaataatgttgtactagaaaggttttatcacctaatttacaaagtgagagataggtaaattcctgttagggtgaaaaaaagaaaacaaaaaacattgaaaagtccaagagaagttaccatattgcatttgatatgtacattctatatttccaatttaaatgcacatttctttgggaggaaagaaagacattaatttgatgtgaaaaactatggtcttgttctatgcaacctttaagttatagttgtgagagacaaacacctcacttctttaacactgtaagagatgaatttaatagttaatttggttaattaattgaaaggccaaagtgaattttgtctaagccagcttaaggcaaattttgatagcccaaatagttcaactcagcttgctaaccacatttctagaagcagaaacagatgctccaggctaaggactgctcacaaaagattttaatgagatgaaaaagtatgaatataaattgcaccttatctctagtgcttgagagtgaattttctcagaaattatgtttagaaagatattgtgctgtgatgagcataaatgctcatactcaatttcacttattgcaagtgatatttctatttcttctgtctcctaaggaagagcttatatggcaaatctagctagattttggcaataagcagtctttgttttggggaaaacataatttaatatactatcttttttttttcattgatagaagagataagagtgacttaggtaccaggtattaatagaaaaccttcaagtctgtcaagcttcagtcacacaatttctgaaacccttatatcgttctgatgggagttgatatttctacaatggctgcttataaggtttgtgctctgcagctaaattgaaatcatgggttaaggtataaaaactgtaagcactgaaattctctctcccactttcaaaga

SEQ ID NO: 40842 - DNA, 724 bp, Bovine  19866880609619
ctaatacagactatccttctgccgcaagaaaatatcttatctatcagatcacatatagaagaataaaatgcgccctacacttagttatgtttactcccactaaaaccacaacaataacaaaaaagagatgaaatcaaagaccaatttactggttgttcttttataatggcagtaacaggtataatatccaccgtgattaatagtccttgtctacattggaaaatccaaaacaagaacatgttttgcagatattgaggtgctgattcataaaggcttttgattaacctatactaccataagcatttctaatttaaacagtcaatttttaaaatcaattaaatgatattccttgcattcaaacaactactttagaataactatttacaactcagtttttaaaaacttgataatgccctttggtctatggaacgtttcactggaataatttgaagtgatcactataattatccaaaataatagtatcaggttgaaacagaaagaacaattagaggactcctctgattgctcagctcaaatgaacaacattctctctttcaggcactctcagtttctcttctccccttcttgagtctagctcaaatttcatttatttccctgtctctacttcctcacctcatcaaaagtcagtgactcactgtgatatttttactgtagccatcttgtttgccttctcttgctctgacctgctcctgctgtgggaaat

SEQ ID NO: 40843 - DNA, 2513 bp, Bovine  19866880620153
gcagattttttttctttattttacatgttccttatcttgctttcacagccatttacacacaagcggatcagctgtgctcaaaaggccttgaaccagttactgtaataattatgtgaatgacctttccagactcatctgaactctggtggtgaggtgggagggaagaatacattcaatttcctgccccttttagttcctgctcatctctctttcacatagcatttacaaatcattttttgttacactccatcaaatgcctattaggaaacaaggacattaagtaattttttccttttttatacttttattgcaaataagaaaagcaccagttatcaattcacaaagtcattttcgtggtagtttgtgttcccttttcctcagtctttaaccatctcaaatggctcctcttccgtcacattgtaactgtgagaatgacacatattcctctgagactccccaaagcctgcaactggcaaacgttcatcaaagaacctgctctttagttacagattgatgatttattaatactgtttatttgaaactgccagtcactaacgactgcagaaattaaaaaataaattggagttgtgtggtatttgtctatcaaatcaaactcaaattacttaatcattagattgacgaaggatctggggataggagttagttgttgagtctaggaatcaataaatgtttagatatagagaaatggtacatatggattcaagaaaattgcacttatgggctatattggttgcttcagtattgttgaagttaaggacaaatcctcatttcagatggtacctaaaggaaatgggtgctgaaagaaccttaaagattgcatagcctattatcagtttgtagatggaaaaatgagatcctgcagggaaagattagaccaagacacttgggcaagctggccagactaatcatatgatgcttcatcatttgatattctttacattttcaacattcttccttccacagtgccaactatgagagtgctttatttacttatttatttttgctctcagaggtgtcatctatttctagggacacagaaccaatttattactcacactttggagtcacagttaactggcatcatatttctaattcttccagagctggcttaggaatgcttaaactgccttacaagaaaaactgcatgcctgctaaaggtctcacagctaacgtgctgtagaagcagaccaggtcttctgattctaaaactaatgctctttccaacttattgtaacatttttcagttgctaagagtaatttccatttttatcaaagcaactatttttctggatgtattaagtttcccagtgattaggaatattagtatagaggacaagtcaccaaaagcataaagcaagagataatatcaaaattactgagctttatacttggattcttttagaaacacatccaagaaccttactttgggtgaatctccctgtagtttcatagaataacctcttccaccaaaagttgattgagggatattaagtttttataatataaaggtttttagcagtatataacctcatgactacaatttccaaaaacagtctttcttttaatgattacgtatttaagtttgtggtttcctttgggttttttagggaaacctttcagccttaataatcataaatttagaagtcatagtcgagggtctagtaacagaaaatctttatgattatctaaccccatcaattctagtgtaagtcttcttttcaatttagggtttagcctgagattcagaggatgcatcatatctgaatgtctttggtctttttgcctgatacttaatggaggagaaaattttcctttatattaatatctctgatgtcaatgacatacacatagcacactgaagattacatacaaagtttatttgttcactaattaaaaaaaaaaagtctttatctatttatggctgtgctgggtcttgtttgctgtgcaggcttttctctagttgtaacaagccagagttagtctttagttgaggttcacgggcttttcactgcagtggcttctcttgatgtggagctctagggtgcaagggcttcagtagttgtagcccatgggctcagtagttgcagctcccaggctctaaagcaccagctcagtagtcgtggtgcacaggcttagttgctccacagcatctgggatctttctgaaccaggaatagaacccaagtctcctgcactgacaggaagattctttacagttcagccaccagggaagcccttatttgttcatgcttaaatttgagctcttaccaactgagcaaccagagacataattccatctctgtctttggaattttagtgatttttaaaacttggaaacagatgctcttcatttgaggtagggagggtgaatcacatggaaaaggctgttacttaaattgtactttttaacaccatctcctatgcctttatcatacaggtaatattaactaagtttttatttatctttgcaataatatttatggaaaagattac

SEQ ID NO: 40844 - DNA, 1220 bp, Bovine  19866880681073
tgtgttggaatttgtattatttaggcaacattgtttattttatgggatgataccaagatagaatgtattgactgatcactgtgggatactcttgtgtctgttcctttattcttttattccaaatatacttcaatgtggcttgcagtgatatataaaatacagctagaaaatatgaattaaaacacatgaaagtaaggaaaacatgaaacttcaggacataaaatggagctgggtttgaaactaattcagagtatctactgtaaatgtctataaatctgtcataggttagtcccatttggggtaattagttaaagaaaaagaaactttggtcagctatatatttcccactggtttaaggactaaaatgaaatagatagtagaaatgcagctatttccaacactaagattagacaaattttctgaagggccctcattaacagcttactgtttgatgtaacggttagtgacccagacaatattcttgatgtgtacataacaatgagtttcatctgctccaataaagatagatgaaattcaattatcaatagcaaaatgggaagtaattatctaacattgtgctcttttaatctttaatgtgcatacaatcacttgagagccttgttaaaatacaccccctttcaatagatcgggagtgagggccatataagctgcatttatcaaaaccttccaggtaatgcttatgcagctggtctgtggaccatgctcagagtagcaaggctctaggctgcaaactagtttgatataatttgtcttctgttgctcttgtttgatctatatttagaggatcagaaagaatggatagactgagtattttccaagtaatcttccataactgttttctcatctgagcgtttgaaagatcttggctagatgtgactttaagtttgttctccctgataacagcctgacatatggcttttgtcaggtaattccctttaaccttaatagagagtaaaactggtgttgacatgcttttgtgaaaaacaagaaaactaacagagcctgaatagaatgtcattccattcctgctcaagtgaagcccagaagtaccccagatagggttaagatttttctgagcaacataaaagtgtagtttgcagagcaatttgggaaagcaattccactttggtatataccacctggagtaaccctcccacacatgcacaagaaaatataaaagtatgctcactgcaatataa

SEQ ID NO: 40845 - DNA, 4317 bp, Bovine  19866880758644
atctatgatacaaaatggaccagactaagctgcttgattctcctgctccatgtggtgttgatcaaggtcacttggtgacattcagaaggtagctgagctggagtagagaatccaaggcagcttcttttatatatctggtgcctcggtggggaagaatggagagcaaggctctattttcatagtttttccacataatgtttacagcagagagtttaaacttcagcagttgagctgcctagagtgggtgtttcaagaggcaagaagcagaaactgtcgatctctttgggccttgacctataaactggcaaagcatcccttctgccatctcaatgtgttaaagcagttatgaaacctgcccatattcaagggggagaatacatagatgccctcacctctctatgagagaaatgacaacaattttgtcaccataattgatctgtcacagccattctatgaaatttgaattttatcctctagtgcatggtagctactgaaagattttcatctagagaaagacatattagaatcagttgtgacagcatgatataggaaataaagaaaaaaaaaaaacttggaggaaggaatcccagacattcattatcacagaatttttactttgtatttttaagtggttttttttgggggggaaggggcacggttaaagcccattccattgttatgattgtaaacatgattatgtttggtttctaagatattgatataattagaaatggtaagctttcacatgtgttgggtttttatcactccagttagactataagctctttgaaatagaaatcttataaatctatcacaccaagtattttgtaaatgctcagaaaatatttattgattgacagattaaagaaagcaaaacacatgaaactcttcttctgtaaacaaatatttattgtgcttttgaaatgtgccaggcatcattctgttattataattaaaatataatgagatataacattatatattttcaaggtatacattacattgatttaatatagttataaattgcaaaatgactatgaccattccaatagctaacatctccatcacttcacataattatcctttctttgtttaacatcattaaacaaacatttctttgtttaacttgttagtttctttgtttaaacaaacattaaacatttctttgttcaatatcatttctttggttaatatcgagttttttagcaactttcagtatgtttaatatcatcaactataatcaccttgaaatacatggaattcccaaaacttactaatattataattggaagttcttaccctttgtggatataaagttttccccaggtgatttcttgaaaatgctatccattccccactgaatattattgacccttttcaaatattagctgcccacgtatgcagtttcatttctgtgctcttggctgtgttccatttgtcctgtgtctatcttcatgccagtaccacactcttttgactactactgcctggtagtatactttgaaatcagaaagtgtgatgtatctggctttgtttttctttctgaaaattgctttggctctttgggggatcttctgtggtaccatgtaaattttagcattattttttctttttctgtaaaacatgccattataatttttataggaattgcattaatgttatagatggctttgaatattatggactttttgacaatgtccattcttccaatctatgaacacatatatctttccatttatttgaatcatcttccttttattcaacaaagtcctatagttgtcagtgtatagttcttcactctcttggttaaatgtactcccaagtattttattgtttttgatactattgggattgagattgttttatttctttttcagatatctcattgttagtatataaaaatgtgactgatttctatatgctgtttataaactatagagataccctgtaattcttactgaatttgttgattagttctaacagttttggatggaatctttaggattttctatagataaaagtaggagaaggcaatggcaccccactccagtactcttgcttggaaaatcccatggatggaggaggctggtgggctacagtccatggggtcactaagagttggacatgactgagcgacttaactttcacttttcaccttcatgcattggagaaggaaatggcaacccactccagtattcttgcctggagaatcccagggacaggggagcctggtgggctgccatctatggggtcgcacagagtcggacacgactgaagcgacttagcagcagcatagataaaagtatagcatttgccaatacagaaaattttactgcttcttttccaataatcatgtctttttttttgccaaattactctggctagaacttccagtactatgttgaataagaatggtgagagtgggcacctttgtcttgttcctgatcttagagaaaagtttccaaccttttactgtagaatgtaacattaactgtggccttgttttatacagcttttattatgtagaggcaaattccttctatagtcaatttgttgagaatttttattccgaaagaatattatatttttgtcaaatgcttttcatgcattattgagatgataacatgatttttatctttcattctagcattaatatgatatatcacaaactgatttgcacatatttaaccacttttccatcccaagaacaaattctatctgatcatggtgtatgatcttttcaatgtgctattgaattcaagttgctagtatttttttgagaatttttgcatctcaacatgcaaagatgatgagaaatattcatcagaaatattggcctgcaattttctttttttatatgtctttaattggttttggtatcagggcaatactggcctcataaaatgagtttccaagtgttcccgtctcttgaatttttggcaaaaatttgagaagaatcaactttacttctaaaatgttagatataattcaccaatgaaactatctggtcctgaacttttctatgttgagtagtaattactgtttattgggcatttagattttctgtgtctccttgattcaattttaatagattggatgtttctaggaatttatctgcttcctctaatttaactaatttgttggcatataaatgttcatagtagtctcttatgatcctttgtatttttctggtgtcagctctaatgcgtcctcaattatttatatttagactcttctcttttttttttcttatcctacctaaatatttatcaatttggtttatatatttttaaaaagtgctctgagtttcattaatttttgtgttctctatttcatttatctcagctatgctctttgttgttcccttccttctaattttgggctggctcattttttctagttccttgaagggcaaagttaggttgtttcagatctttctttttcattaatgtaagcttttataggtataaacttccttcttaaaactgcttatacagtataccatacatttggtctactgtgttttcatttttgtttgcttcaagtttttttttttaatttttattttcatttcttcgttgacccattggttgttcgtgagcatgttgtttaatttcaacagatttgtgaatctttcagcttttttaaattgcttctaatttcataccattgtgaccagcagagaagaggtattgttcttttatgtttgcaatacatcagtgaataaaacaataatggcttctttaggcaaacattttaaatctacaaaacccataatggatatggaggaccacctgaaaatattctgtaaagaatctataattcttttacacagctctcatctaagtgctgtccctgtaaaacttcaaaaatgttcttgtaaactgcaagtgaccttggagtcagaaattgctttgtctgtgtaaatagacaattattttactcaacactacagggtctataagtcaactaggacaatctagtagcagtagggtatcaatctaaagagagcatcttgcccttgcaggcatttcttcatttgaatgcacagctgcaactactattatgaaagcaaaatcctaattacactcgatcaacaacaaggatatttccatttattgcttgtccaaggtcatttatcttttctgctatctaacctgtgtaagtattcaaaaaatgaaaatgttttgaagtctttggatatacacacattccaaataaaagctctatatgcctgatccaatggactacataattggattgtgaacagacagagacaaagagagaccagaggttatcagcagtataaagattata

SEQ ID NO: 40846 - DNA, 1507 bp, Bovine  19866880768449
ctatatggcaactgcattgccttatgtggtttctacccatctaaaacagtaaaagtccccaaacatttgcacaatttccagtgatctgtgaatttctgtccccccaagcaaccacattcctttacacagatgctacaggaagctgtggagtgggttgataaatactaccatgtgccactgggggaagagacatgtccacaggggaagggcgcccaagtagttagtatataacctggccttagaatccatgggctgaacccagcaggtcccagctctatgtaagacacactgaaaatggccatggcagcaaaccaatagtcttgattctgattcccagaaaaatagacagctgactcattttagtactaattcctgaacttcaactctgatggtggtgttgagtggttgggaggcacaagatgcatatattattgccaagtgttcaggaaacttaaatccaccaggatggcaggtatcctgattttagataaggctttaaacaccttagaaaacaacctagacttctttgggcctcaattttctcattagcaaagtataataaaaatgggtttcttgcagggtcatactgaaaattaaaattatatatgttaaatacctaataatgtggcaggcacaatgttggtaactgattaaagataatattttactttaaatggagcaataacccaggagaaggaaccatactttgtagctttataaaatgtgcaaaggaaattgttgagttttcaatgttcctaaattctttgaatgcctgaaaaaagaacagtttattgtttttttatactcagaagtgaccttcagaacaaaaccactcctgacaagctacttggaaactacctagagagtctgtgagattacattgtgttttaatacaaattatattgtcagaacattcctaaagctagaatatccacccctacatattcctagatgctgctaatatgtgaaactactgaactatgacagtgtaatttaaaaaccagtagcaaattctcaagaaaacttgcattttaataaatatataaataagaacaataatatttccactatggtgtggtgcaggaaacaaaaaattcaaaatttgaatccatatggctattgtcttaaatcatcaaaaattaattaaaacaagtaaaaccaaagcaggctacaactacatataagtccagatttaatgagttgtggaaaatccaatcaactaaacaaatcacacattactactaattaaagggctgtaaaaggattccaggtggcttaggcaaataattattattttgtattttaaaaggaaagattttggtaattatcttgtaaatgtaattgatcttagctacttctatttaaagattctggtatttattccctattgtaaatgattatccagattacttaaaatatgtaatttctcaattccttatatgaagttatacttatctatcatttctcaaatatttaatatcaaactttttattttgctatacgaata

SEQ ID NO: 40847 - DNA, 1688 bp, Bovine  19866880848357
taggagtgattatgataatctgtatggcacacataggaatcataaggtaatatgcctgcttcatatccctggtgtttgtggagtgttaggtaggtaaagggggccagaatataaactccttgttacctcaggatttttcattagctgaaagtcctagcctatgccagtcttcttattatggttacttttgttcctagtttatcttcttaggaattaacacctatttcctaaggagtaaaagtctcagaatagaaaacagtaagtactcgactggcaccattctctttcctgatggataaatataaaaatgaatgaaatcactggatatgcttccaaggtttactcacgcacaaagcacttaggactgagagagcatctgctgcatccgcttcttcagcatgttagcaggtgtaagtcttgaaggcaattcataactaatcagaaaatgtatgaaaagcagagggtcaacaaagtcacacgttctctttggctcattcagctcaatagtaatattcaaacttccaagtagtatggcctcctagacgcttagccctacccctgcctgcatggaaaagggcttgttctccctcatcactcggtttcttgcctcctggatatttgtcttgctctgaatcctgataattcaccaggctgttgtactgtggtagctcagatggtaaaaaaatctgcctgcaatgcaggagactctggtttggttcctgggtcaggaagatcccctggagaaaggcctgacaacccgctccagtattctggcctggagaatccccatagacagaggatcctggtgggctacagtctatgcggtttcaaagagtcagacatgactaagaacggcacacagcacagctgtactctgttgtgatcctttgactgctacacgtttgctttgtagcagttcctcccagtctttcatctaatttaacaaagaaatcacattgtcatgttaataggacagaacagagtaataaccaaccaaagcttgaggctaaaaagaagagaggttacactcaaaagccctacagttttcagatcattccagaaagtgtaccacatccacgctccctttttgtctgcattagagaatatgcctccacccactctcttctcaaagtagtggtagtccttgtagcaaaaaaagaaggcgcaggcttcactttgttcatttaaaggtagtctaccaaaacataccttctgggtatggtattatggtgaccagacagagttttttgttcagttaaagcctccatttttgataccagctttacatagtattatggataatgcaaaagttaacagtttctctgcagtgtgttttagtgcagaaatataggttttcctttttctgtttgttttttgaaacagagagagggaaaataaagcttcttgtagagaaaggcaattttagtgttggccatgctgagaaaaatcagatcaatagtctctgatcatggagaggataaaagcaccatacttcccagagattgtcatcagagccaactgaaatgcttcaggttattggcttgggaaaagtaggcagtgagaaataaaaaacactccattacctcttaatagaatttgctttcgcagattgtagtgaggtgaaagtcactcagtcatatcagactctttgcgaccacatgggatacagtccatgggaattctccagg

SEQ ID NO: 40848 - DNA, 1366 bp, Bovine  19866880850214
cagatttgtccttcccaaataattactgcttttataaactgacccttttatttcctttgtgcccacatgtgtgactcgaatagcttaagaggattatcaatctttttggtactgggcattcatgggggtaaataaataacttcttttgaatattgaaacaccaaggtagtgtttgatttatgaaagatgtagtttttcattaccagctcctttgtattttgtgacatagaggaaaattttgaagcagaagtagaaaattcaccctcgtataagaatgaccaaggaagtgaagagtcaagtaataccaaacaaccataagtgtcctgatgagatatccacgcacttgttgtttagtcactaagttgtgtccaactctttgtgaccccgtggactgtagcccaccaggctcctctgaccatgagattttccagacaagaatactggagtgggttgtcatttccttttccagggcatcttcctgacccgggaatcgaacctgcttctcttacactggctgatggatcctttatctttgagccacttgggaagcccattcgtgcacttagcctctcaaatttgtgatgtgttttcagatagtatatacagtctccatattacttatattaactcttacaatcaaatgtgaggtaggaatctcaagttgcaatttacttgtaggaaactgaggctcagaggctaagtaacatgctaaattcaacccagtaaaggacaatagttgtaacttttgtaactctagtaactcagtaagttacttaagtaagctacttaagtgtagtaataggactggggtttgaacccaggtatgtatgactccaaaactaatgcttttagtcactaccctgtatcatctcatcaggaatgtttttaataataatattttgctactgctttatgttattgtgtgtattattttgtatcatttgttatgcacatggcccaaaaggtcaccgtgagatgaattgtagagctttatgaacatgatatgcatggtaacaccagtgctggctttaaaaaatccaaatttatacattccttgtcaacatttgctttgaaattaaattatagtagccaccatgggttgtttaccctgtttccttaaacttgaaatggtttgcctttagagattcctctttctagctagatagaaaatatgcacattttcaaagacactgaagctgtggctgtaacatatttcatagtaacacttcatttattttggttgactgaaatgtgaaagaatataaggaaaattaaatcaggatagagtctgcctttgttctgacaacaaaagttaaaacagtagtatttaggtgtttgctcactaattaaatttactaacttggaa

SEQ ID NO: 40849 - DNA, 2107 bp, Bovine  19866880930204
aatgatagtaataacccaataaaactttgaaatattgtgagaataaccaaaaatgtgatacagagacacaaagtgagtaaatgttggaaaaatggcatctacagatttattcaacttgtacaatccatggtatctgtgaaacatagtaaagtgaagtactgtaaagcaaggtgtgcctgtatactgagtgaaaaagtcagacaaagaaaactgcatagtgcataattctggttatattggactctagaaaaatgcgtactagtctatagttacagaagagaaatcaaatcagtagctttctgggggtgggaatgaatggatggaaagaaaggaaagattacacctttacatgcagatgtttatgggtactgaagagacatgtgacattcacggggatatacatgtgttaaaatgtatcacattgcatatcttagacatttattgcatgtcaatgctccctcagtaaaacttttaagaagcagtttgaagaaatctttcagcagtacagttagtttatctaaatgaacacttgaattattacatttttttctacacatttaagtcactgaaaatgtatcagaatatttatcctttctagtttactcctttaatccaaaaatgaaaacaaaacaagaacctaatgggggtaaccatcatatatatatctctttaactatcactctttatgtttcttctactttatgttatttgtgacacagactcagtaacaaccagagagttaaaaaatgatgaaacaggtggaggaaggattctcctggactagcttcctttgtattcaactccctctttaaaggtgcttgtgtttggaccttcacagatgacatgattggaagtaactgagatggttaatgctagagtaaatattgttgacttaatataataaaaaatattcacttaacaaccatttccctagtagtttccagttctacagggcagatattttgcttattaactcagattttttaaattaaattgaatataaatgaaagaagactatgttatcactcaggttctgactttatcactaagattagacatataccactttagccttaattactctaattcatcacatccaaggcacttgtgaacatgacacacccttaagaataattaagaaacaaaatactgccaattaaactataacataccatcaattgtaaaatatatctaggcttcatatttgtaagcatttttttcaatatatgcttttgagtgtattatacctatgctttctgtggctaaatgtaatagtattatatgaaggtggaggaggaagatttcttcccctttatttctgtgtagggaaccctgatgcatgttcttctatcagacatgttgaggaagctacatttctctgtagggatgtataaaactagtgacctgatttcataatggatcttcctttgagaaaatggccataaataagacattctaaaagttgtaaccagattgattcgatccccaaaagaaaagtaggggctagaggtgaccaaaagtacttatcacttgcttttctactatgaaacagcagctgacatatgtccccattgagaatcactttttgcgtctactggttatcagttaaatttatcctccaaactaaaacatattattacaaagatttgacatgaaaactattctgtaccacatagctactaacaataacagtgacaggaacagaaggtaggtgttgctatattgcattaaaaaaagaaaataataataaagaaaaaaaatgatgacagaggtttagctgtcttaacattttctatcttgagatactctttctgctgatttaaatatttattcacatacacgtacatccatacccacatttaaatgtttcatttgtacaggcaactccgactgcttaattgcatcatatcctaccatgtgcatgtgactctatcactgaagatcaagcacacagccagggacgatgaatgcaaatagtatcaaatcaaaagagacacactttctattgtcatctgaaatggaaaatgcttacatataatggagaaacaaaaattacctaaggcaaaaaggcatgagctataattcagaagcagtttaattatacatt

SEQ ID NO: 40850 - DNA, 1695 bp, Bovine  19866880950409
ctaggaaattattttcttttgggaaagtgtccatttataaccaacatattatgttcagttttttttttttttttaatttgtatttgcttttaaaatgttctccttcagtggaagaactaccattctactttgtaggtagccaaattttggtaattttaattacaaatttaaaggtgttcaattgaggagatatttatcatagtgaatattacatacactgaaatatttatacttctgaaaattttatattcaagaaaggtaagtttcgtaataagacaagagtatattttgaagttcagcaagttctttagcatgtttacatattacccatggatatttgcaattttgtacataattagaagtgttttgcatctttctcacagaaatgacagccctgttctcacactttttttacctttaacaagaaaacagtactaaatgaattggtctgacagataaattatgaattacaaacacgaaagtttgtgaaaaaggaaagaaattattccacctacaaggcctcagtttcaaaacagacatgtttgaaatttatagttagccattgcactttactaataaatcacttcttagagattcgatggattttttttgcaagttctatcaaaaagcttttaattctcaagataaaataccaaaaaaaaattgttcttgacaattttgtctattagagtaataaaagtggttactgaagttaaactgggaacttcaaatgtctctactttgaatgctaaggaaccctcgggtggagcacagttgatttatactgccaaaacatttcaaaccgagtgacaataatagcactagttatactgtctcatttatatgacattttatagttcacggatcatttttgcatacatttgtacatgtatacataatcacttcatacacagttattatacagattgcatataatagtatatgtgaaagcaatttgttaactggcagcaccatcaaacacagagaagaaagcagtaactgttacatcttgagcagccctaataaattacccttatacctgctctatccttagtatcttaaactgtataaccttagatggctttacggactaattcatcttgagttgaaattgtttcttccttgcaaaccaaagcatcttgccaaaagcagtattcaaatcctgggcaattgttggattaaactagccttctattagagtaatgtcctttggaaaacaattgaaatcaagtgtgagaatcttcatcagttatggattcctgggaacagtttttggataggtcctgaataaatacaccgtacaggtcttcggatttgtttagatgaatatatcaaatattgagaaatatttttatcttgattaatgaacaatgattaggtgtatgtctacgacctgttctaacaccagagttaattaaatgatttttttttactcttctgtatgcttaaataaattcatacatttgagtgtttaacagaatcttcctatccattgtactcttaaaaaaatactaatatacattggagtaggtgaataaaagcttgaatgccgctgctctagaagtggtttgatcttattttccctcattagattgtggagataagtaacttctctgtcgaatgctataaaaataaattaaactcctgttcttatccataaatactgtgattacgtttcagaaaggggcagtcaaa

SEQ ID NO: 40851 - DNA, 2397 bp, Bovine  19866880967084
atgctgggagggattgggggcaggaggagaaggggacgacagaggatgagatggctggatggcatcactgacttgatggacgtgagtctcagtgaactccgggagttggtgatggacagggaggcctggcgtgctgcaattcatggggtcacaaagagtcggacacgactgagcgactgatctaatctgatatatgtgtgtgtatcactgaatcactttgctgtacagcagaaattgacacaagtttgtaaatcaaccacacttcaattaaaaatgcccactttatggaaaagaaacatattttataaaaacaaaagcaccccttaataaacttttaaaagccaatagtaaagttgtaagctgttagtttgcttctaaagaaatctctacttaaatctgaacttttaaaaaatcatatggtttttctataagctactgcaaaagaatacaacaggagagtactatttataccaccttggaaatctctctgcaaatagaattatacaacactgagtacagagagaattcatgaagtgactgtcacatgatatgtttagtattgtttagttcagcaaaggtatgatttcccccaggagggtgggaaatgggaaatgtttaaagaggatccactgggaaacaaaggtgtgtaaggcttgggaaatacagcaaagtgtaaaaatggggaggtgaattaatcactttggaaagaaaaggctgttttagacatatggaagattattatcaagagatcaccacaagctgttctccagtttcaccaaagtggggagagggagaaattccaacaatatgggacaaagccagcgaaattagaataagtataatgtagaagtgtttaaaaaagttattaaaaggcaaacgggctatcagagaggcagtagaagcttagaagctttttccccacactgctgcaataacaaaataagatctgtctgtcttctaacaatttaggtgcaatgttttctgaaaggagagaaatggtactgatcagggttggaaacgaacattttaaaccttctcttttgcctgccactcatctgcccactcagactgaattattaagagtagaaggttagagtcaggcagacttaattggctgccttttggcaactacattattatacaacgttttaaagtggttggtggcatgtgggggaaatagaaatgaagggtgttgccttttcttactcagcattaagcttcatgactttagtttggaaagaagcactgcctttgatatttcccaggttggcttttaaacactggacacagtacttttgaaaggaaatgagagaaaaaaggttaaaggacaatgcaagtaaggactctcttaggaccctaatgaatatttcatttcaacgttatctctaaatatggtgtgcctagagattatcatactaagttagacagagaaagaaaaataccatatgatgacacttacatgtggaatctaaaaaagtgatacaaataaatttatttaccaaacagaaacagactcacagacttagaaaacaaatttatggttaccagaggggaaaggctggaggaggagagggataaattaagagtttcagattaacatatacacactgcatgcatgcgagctaaattgcttcagtcatgtctgaccccttgtgacgctatggactgtagcttgccaggttcctctgtccatgggattctccaagcgagaatactggagtgggtttccatgccctcctctaggggatcttcctgaccaagggatcaaacccaaatctcttatgtctacctgcattgacaggtgggttctttaccgctagtgaagcccctaccgctgtgaagccccaacatatatgcactactatatgtaaaataaatagcaaatatccaccatatagcagagggagctctactcaataatctgtactaacctatatgggaaaagaatctgaaaaagaatagatatatgtatatgtattagggcttcccaggtggtgctgttgcaggaagggggaccccttctagggcctgaaactgggctcttgtctaacactcagaaatgaattgtccgaggagacacatctgctgacaaagcaagagattttattggtaaaaggcacccgggtggagagcagcagggtaagagaacccaggagaacagctctgctgcgtggctcgcagtcttgggttttatggtgatgggattagtttccaggtagtctttggccaatcattctaattcagagtctttcctggtgacgcacgcattgctcagccaacatggatgctagcaagagggattctgggaagtggacaggcacacagtgtctcctttccacctttcctgaactcttccggttggtggggcttatttgttccttattccttacaggatct

SEQ ID NO: 40852 - DNA, 1307 bp, Bovine  19866881023023
tagcaagagcacactttactgatgcaagatataattaaaaataatgtaaagatctgctttattcatctttatgataggatctaaggaattcatcttatatttgtttccagctttggagtcagctctttcatttccatattctaactgtctatatagaaagatagaacataagctgagccaaattttctctgtaaaccttagacatctaagaaataatgctaaaattttagcatttaagtaagttacattaaggcgatcagtttatggaggatcaggacttgaatgtaaacacccctgaagataaatataacattttatgggaagttttatgaagttctatccaatttgatatttttcaatagtataggataccaatttttcctgatatatacttaaactagtttctgaatatttaaagaacaaaatattttccagttcttcatgagaacttacacttagataaatattttcccactggatattataaagtgaattagagaaagaaaagcacagaacaatctatttatgaaccatataatgtgcaacaaagtactcttaatctaatttgtgatccataccagagactataattttctacggtaggttaaaaatgacttatatttgttcatgaataacatgttgaagggctctgtaattaattaaatgtccaatgacaaatgtgattgctctgattccatcttcagaatcagagattgatagaaggcacagggtcaggggaaccatttatcacagtaatagtgaaacggaggattgatgttgtatcagtctggaatgctttatttgaagatgctttgcctctgggagcatcaacaatgccatcttattatatttcagcatttgtgcaaatgttcctgaaagtgcaggagccagttaagtatcgaattaaagaggggatttcaagagttatattccttgagtagaatataactcttcccaaagtgtcagtgtgaaaaatgtaaagccaaagtaagtttgtaaccttaaatttctccataataaaacatggttataaagatataccaagggagagataaagaaaaatatgttagatttaaatgtaagacctgtcaatagaaacactagttataaatgacacccagggtcagatatttggagggtggaaatggaaaagtttagaccagtcttttttccacttaagtaattttgttagaccaaatggttattgtttaaaaactgatgccactcttggttaaattattcagttaactgttcactttagaaagcaacaaaattacaaggacagagaggctgaatgaaacagacca

SEQ ID NO: 40853 - DNA, 1187 bp, Bovine  19866881085141
tacttttaattatggttaatttaccctggttactataaattgctgcacaagttgcctggttatgatctccacataggcacaacttgaacaaatcactagttgcttaaaggcttttgttttccaaatgccgcccccccaaactacaactttcagcttaatttgtccttaagacaaacaatgtctaaaatacttgggaagtcaagcatctacgtacatgctactgactgatccttctccctccccaagtgactcttcagtgactataaaataatgaagagagaagattcctaggatgttcagaaaacaaagtattttatgatggacatttttaccttcctctgagagttacagtcatttcttttcagttttgcataaatcatgatctaattcaactatggttgattcataatgggaattagtggggttgtttacaaattagggcatagacacagcagtcttgaaaacaatgaaaaacaatctgcaggtcatttccataaaagataatctacacatgatatcattagcatgtttgcatttctttgttcaaatgacagaattatttatgagatagttgatagatagctacaaaaatataaggggatcactgtgttcttagatgtatctcgaggtttcagggtaccaatttatttttgtttttctctcttttcatttggagttaggagctccacttcttttcctaaagccaaattgcctagacactgttatatttaattccatttattttagtgaaaacaaaactttgttcaatatatactgaatgtaaaacattatgccaggtcataacaagtaagagagaatcccatccctcaaggtggtacctatctaaagggcaataaaattaactcatagataattataatacagctatttagggaaataataacatagaaatattaacacagggttcttaatagattttacataggtattattaacaggattattaagataacaaaataactaccttttattgagaattggctcttttatatatgcagtacttaatatcaatcctcagaataaggcccctttgtaagggacatataatcaacttcaaccttttaaatgggataataggtcacacacatagcaagctacagagtcagaaagcccaattcttgttcgatttaagcccttctttgtgtattccactctataaaaaataa

SEQ ID NO: 40854 - DNA, 612 bp, Bovine  19866881151908
actctctgtcaaagttatgcctatcctgacagtgcatcatggaaccatcttcaccctgtgttcaaattgttgtcttttctacccatttgtttcctatgccttgtgtagctgaaactgattttgattgccttgacttccccagtgtatgaaggcagtttctagaatataggtagaacaatgtttgaggggaaaaaaacagctatgttaataggtcttttcatgcctttttaattgcacatcctcacaatagcaatttttgagatgcatgtctatcaaacagagtgaacacacactgaccttgtagcccatgacttcagactcgttggctaatggtctgacagggtcccagcccagggaaagctgagagccctgttgctcccacctgaggttgttaggtgcttgactgggggctgcaaaatgaaaagaaaagtgagtgcaagagatatcttaaatacctttattcacttaaattcttgtgagtatttcaatctttttttgtgtttagtagttggctggcaccataggcttccttccagtgagaatcagataaggagggttttgctccaggagtatcattttaatagctactctgctgagcttttgaacccaaat

SEQ ID NO: 40855 - DNA, 2454 bp, Bovine  19866881193667
caaatggatcgtggcctaaagtacaggagtgttcataaactatctttgtaatatattgccttctgtcagtgagaaaggacttatcttaaatcaagagttgaaatactgccagtatctaagatacatttatttctttaaaggtggtaattttttaagccaaacttctcccctgctagattagaatttacatcagtaagtaaaatccagacatatttaagatattaacaatcttgcaaactgtagtaatttagctgtatttaaataaagtgtgtcattagtacaagagaagactggtttgtttataaaaaatataatttttgctttcaaatacatctttttgtaacgtgtatatttctgttactaaaatggaataaatacattatattctatctttatagaaacagtcctaaataataaagagaatttttcattgaccatcctaaatagatggtatatctttagagaccagtgttcttaccaaatgtctcattaatatcccttctagacataaattacagtcaaatcttctattcctagtttggcttgcttctaaatttgtctcccttgtcaacacactgtaaatcaaatttgatccatattgaaagcagtataatgtttttaaactggtttctttatggatgacaatgtcagaaaaattaataatcaatattcagcagcctagaatttaatccaattgttaaaatttcaatactgtccttagccctcagttctggattgattggcaaaattgaatactaatttaaaaacaacatatagggatgttgactaaacagaattagccattattcttataccttaaatagtttaatgttttcatgatgccatggaataaactattcttttcagaaccaggaaaatccaattttagaattttaagtttggtgagagctttggttttctaccaaaagtagcacagacttctttcctaaaagaaggcagtctaaattctagtggcatatcaaataaatcacgatagccatccctgctatgcctaaggttgcttcagtaggctgatgcactggtgaaataacagattatatttcaggagcatacaagggagaaaaggacagaaattctaattaagtttgaaatctgtgtatttctggaatgatgaatacacaggagaatatggtaatccagaatgtcaatctcattttcactaaacttctaaaatttttaataatactctaatttctcaccttcatataagactcaaggtccacttataataaaggtctcaaaagagcccaaaggcaaactcagatatcacatttttctgtttgaaaagtgcagtgtgagcagtccaggttccaggattcaggtttcattgtcacgcccttgctacacaggttgcagtgcaaagaaaccaccataaatcatctcgaggctgtacacaattaattttacgttctgtgcttgtcctcctctatgttttatgctatttcttctgatatttgatttttgaggtcattcttggtttgaggtgaaatacctcaagcttaatattaaaatatcactgggtgttattatagtataagttttaataacaaaattcagggtcacctttttttccacaagttttaaaatgaatgtcataaatgtgtccaaagaaaacctgtaactccctaacccttttaactataagaaggtattatgtgggtttactatataattttttgaagggcaaaatatttctactctccctgcatgttttcacaatgatctttatcttatttattattaccttggaagtggtttcagacttcatcagagtttcttaccacttagatgatttgaagtaaagcaggaaaaaaaaaaaaaaaaccctttttaatgattttcagaatagctattcttccagacgggagtctccggatcctaaatgcttctaaatcagatgagggaaagtacatttgccgaggggaaaatgtctttggctctgctgaaatcacagctacagtatctgtaaaaggtaagaaaatgtgatgaattttctataagcatagtttcatggccttatctgaaagagaataaatgtaacatgcatgtatgtgtgtttgcttgtatatgtgcacatgcttctgttgatgaaatctaattgcaaattaaggacaaacacagtcaaattgtccctttccgttatttaggggactgtgaagaaaggaacatattattggtagaaatttaagtattttgctttgaacaaaatatgtgggagggtaaagagagctttctgaagttttagttggtatctcaaaaatttcaagtatgccagcagaaataaaaatattttcctcaaccaagattaattttagcatcaatcagtaatgctgctgtgttaccacttcaactgggaatttggggcaaaaaagagaagcagaaagaggatatgaacatgtgctgtggagtatgcatcagataagcaacaccaga

SEQ ID NO: 40856 - DNA, 2471 bp, Bovine  19866880225063
atgctttggcattgcctttctttgggattggaatgaaaactgaccttttcagtcctgtggtcactgctgagttttccaaatttactggcatattgagtgcagcactttcacagcatcatctttcaggatttgaaatagctcaactggaatttcatcacctccactaactttgtttgtagtgatgctttctaaggcccacttgacttcacattccaggatgtctggctctaggtgagtgatcacaccatcatggtaatctggtgtggcataagccctcttagaggaggtcaccattaaccccatcatagagctcccagaacttacacaggactggggaaacagactcttggcgggcacaaacaaaagcttgtgtgcatcaggactcaggagaaaggagcagtgaccccacaagagactcacccattcttgcctgtgagtgtccaggagtctccagtggaaacatggttggtggtggcttgctgcagggtcggggctctgagtgtggcagtgtatgcataggacctttgaaggaggtcgctgttatcttcattacctccaccatagttcagtctcagggtccctgctcatggaattctccaggcaagaatactgaaatgggtagccattcccttatccagggagtttcccggccagggatcaaaggtgaatctcctgcattgcaggcagattctttaccatctgagccaccagagaagcccaatataggttattacaaagaatactgagtatagttccctgtgctatacagttggtccttattaggactttatttaatatttgattttctcatgatttttttgaggggggtggtgaattgaaacaatgaactccaacagggacaaaaaaagcttcttgggattttggagtcatcactagcttttttttttaaccaaattaaaatttttattgtgtgttatcacatgcaactgtcaagaaataatacagagagcgcctctgtatatctgtatattttgcccagttttccctagtggaaacatctttgcaaaactctagtactacatcaaaatcaggacattacagactccactgatgtacagatttccagttttaattatactcatctgtgtgtgtgcatcattagttattcagcatagcttacattgttgttatttagtcgttaagtcgtgtctgactccttccatccccatggacatagcccgccaggttcctctctccaggggactttccaagcaagcacactaaagttggttgccatttcctgctccagggaatcttctcgacccagggatcaaacccatgtctcctacactgcaggcggattatttaccactgagccactagggaagcccagcttatattactgatctgctaccagtcattccaacttaaaattgctcatgcatgactgtagatttttcagctctttacaatgtggcagacaaggtgccaaacacctcacgggcatcatgtaaacaaatccccataaccttcttgcctccttcttatggtaatggaagctctgcctcctccactggtcaactcaagtgccttcttctcctctggccaagaggcagcgaagggacttaatgggcctggaagatacagtttctggaatatgaccctgatacaagagccagacttaccacattctgacaagcctgcccacaggtcctccccaaaagacccaagggctctggtctttgtcctgtctgagatcgggttctctgtacttttctctggttctgccagcccctccatgtgcttcctatggaccccctttctgctgaagtcacagagtctgtgtctcttgcctgcaatcaaagaaacccatcaagggcgcgggtgctgtgattaagatgctgtcttgagacgaggaagcaggtctgtggaagtcagggagctgccccaggtcatgcggctgagaaggggcaaggatgcggaacagctggcctgtttccagagctgatgcccgatgcttgtaggaccagagacacaacacagagggcatctgcgactctggtttccttccccggaacatctctgaatggtaagttcagccacggtctgacatgtgcattaagtctccaagcagacattctgtgacggctactttctcatggccagacatgcctgcgtgggactgtgattcatagtcctgctgccattacagaaagactgcagcagactgcacttagcactcgctgattaaaaggatcctttccaatccgcccttccctgaacctctcccccccagggtcccacacaggaaatgttgcttcaccattcttgacattaacggcgaatgtttttaaaaaatgaaagaggagagagggaagcggggaaatgcatacattacacccttgagtcatcgcgatgcatttctcgggcattagctcgtgctttcacaactggtcttcatcaaagggttttcatctgctcgccagcgtgtcatctgtcctaacgactcc

SEQ ID NO: 40857 - DNA, 854 bp, Bovine  19866880348772
aattcgcatcaacagtacgtgagggctttgggttttcctttgtggtcgtgttctttaggggattacaggtggattctgcttgtccctcaaggtgatggctcaaaaagaatgccttatgctgtgcgggttgtgtgctgtgaactccagtggatgcctttcacatcgtcctctacggcaaaggggtgtcctgtagctgttcaatgcacaacctgcccagccgtacgtggtggccccattagtctcaaaccccacagaccctctcatcaaatcaccgcatccatctgtgagtgggctcagcaccatccgctgcaggaacagtgagcggacccatgcaggggagcatctgagtgcaatagacaaaacacaaaacgttatgcagttctgttaaatttctgttgatattggtagacatctaccgcctcataaactttgttttcaattatgtatgctcacaagctgttccatttttgatatatttaggaaaagttcagtcacatattcagaattgtaatgatttcccataaaacatctgattccaaaattttgtatctgtacagcacaaataacataatggcaagccaatcaggctacatattaccttcctttatgctgtagttaaagttattacagctttccaaacagtttttttttccccgatattataaagatcctgggggtacaggctatttaaaaaaatagacatgatttgaaggccctgtatttacatacctttctgatacacactgtatttcttcacagtctaatttcttcaataatatttgtatggaagtggaacctttaaacttgctctcttgcccaggggcccagtacaactataggggcagaacagaatt

SEQ ID NO: 40858 - DNA, 1821 bp, Bovine  19866880402875
cccagggattgaacctgggtttcctacagttatgggcagattctttaccgtctgagccaccagagaagtccaataagtcagtataattaaaaaaaaaaatgagaaagaactcttctaagtttaaaaaaatttaacaaatataagaaatgcgcttcttgactggatactgatactgctcttagcaaaccaactctgaaagttgttaaggacaagagacaattttaactgtgaaccaatagtacataatatttttaaattatttattttgccaagtgtaataatggttattattattaatataactattaatgacagttattgttacattattatataataatatattatagataatatatcaaaagaaatccttaggacttccctagtggttcagtggttaagaatttgcctgtcaacgcacgggacgtgggttcaatacctggtccggaagatcacggttgcctcagggcagctaaggccacacgccacaactacagaggctgagctctagagcctgtgacctgaagctgctgagccctggagcccgagctccgcaataagagaagccaccacaacgcaacaaagagtagcccctgctcaccacaactagagaaagcccacgggcagcagtgaagacacagcccagccaaaaataaatacattttttgggaaaactccttatgttttagagatgcatgctgcagtgtttggaagtatgtcatttactttaaaatactgcagcaaaaaaaaaaaaaaagatgaagcaaaattattcagtctaggtgataggtttatgcgtgtttcatctttatgtttgaaatttcttaataagtaaagttaaagcaggggaagggaacggcttgagatgtgataagcagcttatgaaacagtttcctggaccagcctcgctgcagtcacctgggttctgctgtacatttcaggtgccctgctcagcattctccatgaagatcattaaggcagacccttgatgttaaacttcaaccagccccgtagagcaaataggttgttcggtagaggatgctgcctgcagagcccgtgtgcctggtgggcagatgtgcctgtgaatataaatgcagaacaagcagtcctccccacgctgagcacacacagaaatgagctctgggactgcgggccgggatgcctgcagaaaggggttgtcgttgtgcagtcactcggtcgcgtccgagtctttgtgaccccatggactgcagcatgccaggcttctctgtccttcgctgtctcctgaagtttgctcaaattcatgtccattgagttgatgatgccattcagtcatctcatcctctgtcacccccttctcctctggccttcaatttttcccagcatcagggtcttttgagtcaattctttgcatcaagtggccaaagtattggagcttcaccttcatcgtcagtccttccaatgaatattcaggactaatttcctttaggatggactggttggatctccttgcagtcccagggactctcaagggtcttctccagcaccacagtttgaaagcatcaatttttcggtgctcagccttctttatggtccaactctcacagcagtacatgactacaggaaaacccatagctttgacaaagtgatgtctctgcagatatctcttcaggagggggagcatcctgaaacagagggagccttgggtgcaggtggcaaggcctgagacagtcgagttcttgcccttggaggctggactctctcagggtccagtcggcacagggtagtgttcacagagtcaggcagacacatgaccaacatcttggcagctgtctgactctg

SEQ ID NO: 40859 - DNA, 1448 bp, Bovine  19866880406865
catgggattttccaggcaagagtactggagtggggtgccattgccttctctggtgatattaactaactaggtttaaatcatgaagatgaaggactgggtagacagagcattctgagtaatatttaaataggacaggtccacccgctgtgcttggccttgctgctgcctctctactccacatccttcatcccgggcccatccccccaaaggtgcaggtaactgtcagggccccacacagaggggtccacctctctgaccagcttccccagaggggctgagtctcagcggcccacctcctgtctccggcacctggagatcgttccctcctgtgggtacctggcacagaccacagtttggcagagggatcctgtgacatacttgtggctggagtttcggggaaagtcaggggaacaagtgttgtggcatctggggtcgaccaccaaggctggttgggaagcctgacagagctcactgcgtggagatggtgctccgaagaatgtcagcttcccagatctttgtgctgttgctgcaaaagcagcagaccgtgcgtcaacagagaaattccggagttatgcagtcaactctgtgatcttgcgaggggagaatcagaccggagacaaagctgtattcgatcaactgctccctggcggaagaatcaattgcaaggggggatacaaaagcaactggagtagcaccagcctgggagagtttgagaaagaaaatagggattaaaaatcaagtgaaatatggtgtgaccccagaatacattcagagctaggaatgtggaggaaaagtcgagagtcctgagggacgcccccattagagcccagcagattacagtcctgcagagaaggaacatcctgctttgcttcaaaaagggctgatcaaaagatgggcaggcagggagagctccgtcctggaagagagaagagagggaggaagcaaacaagtcatccttcttcacttgagtctcaaagggggacagataaggagagagaaaggcctggagatcccagtagacagggggattaaagaggaaacagctctttaatggagggaatgaagtccaatgtggaaaataggtcataacgacgagctcagccatggagcttatccttcctttgaaaggactccaagtcaaacgggaagttcaggccgtaagttagttttgtaccgtatcgtatgtctccccaagatgccctgccctccttagcacggtttcagcgcagtgttcctggttctcctggtctctctcttgtttgcacttgctgctgcgtgcctcatcccctgctcccgaggccctagcccaggagtatccccatgaccaacggatgctccacagcactgttgggcacaagtagcaaactgttccaatggtggggagaggatgctgccctcgcccccaagagaagctcagcggctgtgttttgtgatggaacagatgtcca

SEQ ID NO: 40860 - DNA, 3198 bp, Bovine  19866880458546
gaagttttctgaggatggtgggctcatatctccttgacggtgtgggagacagaatattccccgccatgccccccaacccctgccaaatatccactccctaatccccaagacttatgaatatgatgtgtggcatgacagaagggacttggcaggtgtggttacggttacgaaccttgaaatgggttgattagtcctaagttactcacctggagctgaagccccaatactttggccgcctgatgtgaagagccgactcgctggaaaagaccctgatgctgggaaagatggagggcaggaggagaaggggacgacagaggatgagatggttggatggcatcagcaactcaatgggcatgggtttgagcaagctccaggaattggtgatagacagggaagcctagtgtgctgttgtctgtggggtcacaaagagtcggacacgactgagtgactgaacggcagcagacactgggtcccctgagcagaggactttctctgactgctcgcagtagagaggtgcggtagaagtggactcaggctccgaggctggggagggctccacgcccccttgctggcccggagatgtaggagcccacttgctaggaccccagggagctcagggtggcccagctgacagccagcaaggaaacggggacctcggtcctgcagccacagctggattctgccagcgcccccagtaagcccggaaacagattcattccagagcctcccgtgagagcccagctggccagcaccttggctctgagacccaggaacactgggcgtctgacttggagcacagtgagataataaacgtgggtggttttcaattgccaagggcgtggtgatgggttatggcagcagtcgggcgggaatggaggtggtgtggtgagcagcctgggcgagactgggttctctttccagccttggctttgccaggaggcaggttgacctccacatgtccttcgctcttcactccaggccaaactcaaacagggaatgtgggtattggcaccgagacatctttgactcctgggtcttagtcatcatgtggcccttgagcaaatgactcctgcttccttagcctcagtttcctcatctggaaaggggactcaagcctgccttccgcagagaccagtggggattcattgagatagtgtcctcagagcacaaagtgctgaggtcagcatttgagataagccaggcagtccgtgcagcaacgcttttagtaatttttttaatttaatgaattgcagtttagaaatgtggtgacaagcgatttcctctttggattcgacagtcaccatggctgaaggaaggctcttcttgcaaagttaattttctaccagggagtgtgacatttgcttgataatagagattatgacgtgtgtattcagattagctctgagcaatggtaattgctaggaatatggtagtattccaataagtttgggagtgtggagctgcagagagatccttcatgttgcctggaatagcaagcaagctgctactttgggggatgaaaaattacatttgatcgtaagtaaatagaaatgcagacattttcattcaccggagttgcagaaaaacaaaacttaagagcgtattatatttctgcaaatctgattttacttgggaaacattatacacatttttaaatgtattgttgtgccagggtcggcccagaatagcggagtgttatcaggattgcctgagggtgtgtgaattgttctttcgcttgtgttcttgtgacctctgaggatgcaggtagagaaatagtcagtggtgagtcctgagctgggtgcagcccagaagccaagtgcctgtgcccgagggcccctgtgacctctctctgtctctgtctctctctcttctctcttttctccccccttccttctttcctttctcccctccttcctctctcttcgttagactttggatttccatataattacacacagcagttgtaagaagtcatacagagaccccacgtacacatcgccggttttcccccgaggttctatcttgtaaaactccaacagtgtccgaacctggatgtagacgttgaagatacagagcgtctccatcccccccaggacccctcccgtggtccttttgttgccgcacccccctcccatttccctgccccataatccttggcaaccactaatctgacctctatttctgcaattttgtaatttcacgaatgttccgtgaatggcatcttgagtatgtaagctttctggattgcctttttccctcagcataattctccagagtcatcaggttgctgtgtgtatcagcgatttgttccttttctttgctgagtagtgtcccgtgatgttggacgtgccacagatggtttaactgttcattcgttgaaggatgtctggttttggctattgtgagtaaagctgctgtgaacactcatgcacaggttttgtgtgtgtgtgtgtgaacggaaatctccatcttctgggataaatgcctaggagtgcagttgtgttttgtttgtttttaattaaaaaaatttttttggccacattgtgcagtatgtgggatcttagttcccagaccagatattgaacctatgccccctgcattgggaacacagagtctttaagtacctgactgccagggaagtcccaggagtgcaattattgaactgtgtggtggtttggctttttaagacactattaataccagacttttccccagtggcttggccgttttacattcccaccagctgtgtgtatacgtgcctgtttgtgcatgtgcatgggtgtgtgcttgtgtgtgatgtgaaggtgtgtgtacatgcgtgtctgcatgtgtgtgtgtgtgaaggtgtgatgtgcgtgcgtgtgtacttgaaggtatgtgtgtgcatgcatgtgtgcacgtgtgtgcatgtgtatgtgaacgtgtgcaggtgcgtgcgtatgtgcatgtgcatgcgtgtgtgtgtgagatccagtctctccgcatccttactgacacgtgtttctgttttccccagtctgagcggtgtgtcgttggggttggaatttgcgtttccctcactgcagtgcaccttgacggagatcttggtgtaatttgggagacgagccgggctgggtgctgggtggaggcggggggctgctgatggatttggtgagatagttgggtctgctcagggaagggccagaagtccagcttgca

SEQ ID NO: 40861 - DNA, 1645 bp, Bovine  19866880463354
accacccaccctcccatccatccttccatccatatatccatccttctatccatatatccatctttccatccatccatcctttcagtccagaagtatttattgaaatttactatataccaggcactactatcagagaaggcaatggcaccccactccagtactcttgcctggaaaaccccatagacggaggagcctgttaggctgcaatccatggggtcgctaagagtcggacacgactgagcgacttcactttcacttttcactttcatgcattggagaaagaaatggcaacccactccagtgttcttgcctggagaatcccacggacgggggagcctggtgggctaccgtctacggggtcacacagagtcggacacgactaaagtgacttagtactttgcactaggcactactatattctaggtgctggggatttaacagtgaataaaacagacaaaattcatgacccactagagcttaaagtgggtccctctgaatactgttggtcacagagaggcccagaacttacccttgacgttatactgcagcctctgtgccacatgtttagggaaaggaagaagctctgtgtgtgtgtgtgtgtatatgtgtgtgtgtgtgtgtgttatttgtgtgtaagggggcaagtactggcaaaacttcagcagcagtgtcctggggaaaggaggaagctgtgtgtgtgtgtgtgtgtgtgtaaggggggaggtattggctgaatttcagcagcaatgttttcacacatgttctaccacaaataaaatgctggattaacgagcaatgacaggaaataattctctgctgttgtaacataagttgaaggagatttgcagaactaaatgcttaaaaatgggccagccctcctgctacgagaagtcacacggggacaaggctctggactgaggaggcttcagtccccacatgaagcctgaacgcagcaaagcaaccaaggaggcaggtggtggcgagggccctgggaggcagggtggcatggccggcctagtcccatctagtctggaccacggagctccctgggagggccctgggaggcagggtggcatggccggcctagtcccatctagtctggaccacggagctccctgggagcctgaggtgggaagcaagagcatcttcctctgaccagaacccccaagtagatgcccttctcctctttctgaggttcacagctgccacacaagcttactggagataagacacagcaaggtggagagtcaggggcttggcttctggggactcagccttacatcctggggcttccacttgggtatttttgaaaacataagcaattcatttaactttctgagctccatcacctcatctttaagatggctataactacacccacctcacacctttgacggatgaaagaggacaccccagtgccatctagggtccaagtcaactttgcctctgttcatttcctccaaattggatattcaaggaggagaggccacgtggaatggtcttcccagcttgacctctggtttgcatccagcttaagaggagcagacattctacatgcccttgggcagtgactattactatcccaagtctgcactgattgcagacaaatcctttcatttttcagtgagcaaaatctaatcctgtg

SEQ ID NO: 40862 - DNA, 2538 bp, Bovine  19866880479354
tctggatgttgagaagttgatcttagcatttgtataacatgaattatgttatcctcatcaggctttaagctaacacacatcataaactgaattaagattttaaaatatgaattttaaggagaaagtctctggctctgggtcaaggggggtctgagcgttccaactgatatcaaagagcaaaaccgatctctaaggggaaagtcctgcctatttttcacttaacaagcccagaccttcttccttattaactgtgctcatcacacatccaaagagatcgcctctttgaacaataacagcagtaagttttgactctgcacagctgtgggccactctgacctctggattattatatgatagaggttcatggaaccttgcttgtctctgtgcatttttttttaatgtctaaatttaagacctatacttttgacttcaaatatgatttcctactgaaatataatcctgacacataattatagaaaaatgagagatcaaaacccaaatctttatgaaagaaaacccaagcagttgatcaatgccacaatcgtaaagctatcactcaatgcagagcactgagtggccagcacaagactgaccccaaggactgtacagtctgtggaatcctccaggccagaataccagagtgggtagcctttctcttctccaggggatcttcccaccccagggatcgaacccaggtctcccgcattgtaggcggtttctttaccagctgagccagcaggggaagcccaagaatactgaagtgcgtagcttatcccttctccagcggatcttcttgacccaggaattgaatcagggtctcctgtgttgcaggcagattctttatcaactgagccgtgagggaagcccaagggttaaagaggaaacacacaattccgtgaagtctgagcccgaggattgtacgatgggcccacttattccgtaattcccggtgtcactgatctacctggagctcaggttgactcggtaacgtgctgctaagtcgctccagtcgtatctgactctgtgcaaccccagggacagcagcccaccaggctcccccatccctgggattctccaggcaagaacactggagtgggttgccatttccttctccaaagcatgaaagtgaaagtgaagtcactcaggttgtctacttgaaagttacacagtcgtgtccaactcctagcaaccccatggattgcagtctaccaggctcctccatccatgggattttccaggcaagagtactggagtggggtgccattgccttctctggactctgtaatgtaaaaggagctaattgcaatgatgagattgatttagaggaggaattagaagaaaatgtccttgactggttgtctggatatgcctttcatttatcatctgtctttggggacagaagaatggtaatctcactgttcttgtaggctgcttagttctcagataactttgggggctgtttttttttttttttcaatttatttgactgtgctgtgtcttaattgcagtatgtgggatatcattgcctgacaaaggatggaaccagggccccctccattgggagcatagtctcaaccactgggccaccaggggagccccaggatgtctggttttgattccccttggtttgggtcaatacaagcatttgtctattctgagttcactcaagtgcttctcggttactacaaggttcagtcactcctgtgagagctgatgagaccacagtgaataagcttgggcagacagcgaacaaacaaccacatctccaagcaggagaacaaggaaggcgatgtctggggcgctgcagagaatgaaaatgggaggggataacagagggagggaatggggagaggacatttaagaagggcctcccgacgccatgataggggagtccgttccaaggagaggaactgggacaaccaagcccagtgagaaggacgaacttggtgtatttaaggagcagatatgcagcgtggtgggcaaagcttaatctaggagagggtgacataggggcatagctcagggctgagaggtagatggcctagagacctggcaggccatgataaaatttgggttttattgtaaatgtggtttcaagctttggattttaggctgagagaagtattagtaaagcatttaatgctttaatttaattcttttattcttaatatgtattttaccacaaagctctgttgtatttttctgtgtacctatgaaggaactttttgtcaaattattttattacacatactttcttttctgtcccccaccccaccttcaccgctggtttttttttttttttgctacaattcaggtagaacttccccaaccaagacttgaacccatgcctcctgcattggaagcctggagtcttttttttttttttttatggggatgatttttaaagtctctatggaacttattacaatatagctgctgtgttatattttggggttttttttttggccatgaggcatgtgggatcttagctacccaacccgggatcaaacccacacccctcacattggaaggctaagt

SEQ ID NO: 40863 - DNA, 1581 bp, Bovine  19866880485276
cccctacagttgctaaaatgctgtatcaacagttttatttattatcgtttgtgaaactaaatgagagagagctggagagagaaaacttttcttttttaattccaggggaaaaaattgttttgatcattttgagtctcttagcaaatgaaaaataacaaaagaaaaccttatataaatgcttcactgttcatacagatgtacagttctaaatcgttaggatcccaaaatgccaaaattgtaaccaaaaaataatttgatgtttatagctaaattgaattgagtgctaagtgaaacaggataagccccatttagcactgtggaaaacatgatttcagaaaaagagggagtataatttgctgctgcttgtttttcaggctgtcagaatcatgtcttcctggcaaggcagtgttggccagtggtcaggatgagggtggctttggagccaagcagagtcaggttcagtctgtacaggcgtggctgtgtggctttggacaagtcgtttacgctctgtgagtgttttccttttccttgttaggcagttgatagtggtccctataccaccaggtctctgccaagaaaagtaagacagtacacttgacaagcaggtggcatgccgcccgatacactgtgagccaacagacagtagggttaggagggagatgtgcagctgatgaaggtaacaggacatggatagtgttggtggcggtaccttgcttcagccccaaatcaagacgccagagcatatgttatttaatggcttatggtaactcttcccataaggaaaacaagaatcataaatatgtacaaagattatgttctgaaagaaattcaggcaaagctcaggtgtggtaaataccaagtctctgattctttctcttagtttccgtttcctcctattatttcttacctcaatgcgctgtctttatagagaattgttcagtggtctgatcttgccataaagtcatccagaggggacttccctggtggtccagtggttagggcttcaggctgccaatgcagggggcacaggttcaatccctactctgggaactaagatcccacatgccaaaggatttttttttaagttgttttaaaaatcgtccataagctctaatgacatcagccttgagccccatgattccagcccatctagacagactgttcactaaaaaccagagcaagttcttccaggatgtagaagaatccagaatcctatctggatacattctggcttttttcctcaatcttttctctgtatttactttagctctggttgaggaataggtaacttttcaataaaagatattctttttagtaactcagaaaaccctgatcatgaattttaattatgatttttattgtacgatgcattttgttaacgctccaagccatgtgaaagtctttggagcttatttccaaattctcataaaagaaaaccattacccaaatttatatatgaatgattttgtaatttgtggaataataacttgcggtggagtaaatcttcaggagaaaactggactggagcctttgaataccaaatgggtttcactaggaagctcacgaagcctccagcgttag

SEQ ID NO: 40864 - DNA, 2377 bp, Bovine  19866880625963
acatctgtgccctgggcccctcttcatgtccattaactcacacacctaaaccaccaccgctgaacaggcttcctctgaaactatagagtgccacaaagcagctacactggagaaggcagcactgtccagaactcattagcaaggagctgagcacatctgtggctaaaatcctgagtttcatgaacttcctgtcaatggagggctggaccagaggctctgagccctccgcagggtagggcccaccccctcgcccctggttgcagtggctttctgggaagaggcttcttgtcctcagtacagaacggcaagcaatttgttgtctgctttaagaaaatcatgccctcgtttttgtcttcagccctgtttgtttctctgatacattattattcctaaattctggatattttccaagacactcctttttggagctgtctccaagtcttctctggaagaagaagggatataaattagactcacagagaggaaattaaataatttctctattaggaatttgattaatgaaaaggggagcaggactgacctctattttggagcatcattttggcaaactagagctgatgtctgtctgtctattcacctatctgttgatcagtaaaaaatgagtgactgtggatgggagcctaacatacatatcagaggacgctgtgttctgtgcctgaagccatcaatcaccattcactctagcctcaggttttcagctaaaatacactttgtacacttttgttcactcattcactcactcacacacatgctccacaatgtttcttgaaggctgacctgttgctaggggcacagtcatgagctagaacagattagggactccttttcttatgatgctcctagatagaggttcacacctgtgtttcttcaactccagggctcctatgatttccctctttgcacagatacaaaggttttaaatatagtacagtaagcagaatactcacatgtcccaaaaattctctttcttttgagtgtgaacagaacctgtaaacacaatgggctatcattgctacaactaaattacgttatatcgcaaaagggtcttgcagatgcagttgaggctgtgaatctgttgctgtggagctaatccaagggagatcatattaggtagacctgacctaatcagatgcgtccttaaatgaagtcagggggattcaaagcagcatagactgtccttctgaccttgaggaagcaaacaaacatgctgtgaactgcctatggccagaaccacacgacaaggcctgaggacaacctcggggagctgagtgtgccaaccgagacacatcaagacaatggggactttagtactgcagccacaaggagttgaattctgacaataaccagggatcttggaagaggcctctgagctacagatgtgatcacatctgtagaggaactcatctgacaccttgattcagcctggaaagaccctaaacagagggaccaaaactgtaaaataataaataggtattgtttcaagatactaagtatgtgatcatttgctttgcagcaatagaagaataacacagatagttatctgcccagattgtttgagacaggaatactagaccaccttacctgcctcctgagaaatctgtaggcaggtcaaaaagcaacagttagaactggacgtggaacaatagactggctccaaatccggaaaggagtacgtcaaggctgtatattgtcaccctacttatttaacttatatgcagagtacatcatgcgaaatgccaggctagatgaagcacaagctgaaatcaagattgcagggagaaaaaccaataacctcagataaacagagacaccacccttatggcagaaagtgaagaactaaagagcctcttgatgaaagtgaaagaggagagtgaaaaagttggcttaaaactcaacatttagaaaatgaagatcatggcatccgatcccatctatttcatggcgaatagatggggaaactatggaaacagtgacagactttagttttttgggctccacaatcactgcagatggtgactgaagccatgaaattaaaagatgcttgctccttggaagaacagctaccaacctaggcagcatattacaaagcagagagatttctttgccaacaaaggtccatctagccaaagctatggtttttccagtagccgtatatgaatgtgagagttggatgataaagaaagctgagcaccgaagaattgatgcttttgaattgtggtgttggagaagactcttgagagtcccttggactgcaaggagatccagtcactcctaaaggaaatcagtcctgaatattcattggaaggactgatgctgaagcttaagctccaatcctttggccacctgatgtgaagaa

SEQ ID NO: 40865 - DNA, 1234 bp, Bovine  19866880751696
cacaccccaccctccccatcctggaccacgacccagctgcagggtctcttctcagtaccaggtctcctccatcagggccatatcccacggcgggagcaaggccagcctgtgggttgccatggcaacccccttccaaggcacttagcaaatcccaagatcactgccttttttacctgggggcattcccccagaggtgaagaggtccaaggaccagggactgtgcccagcacagagtgagtcctcaagaaaagtttgctgagagatggaggaagatgcttcttatgccactgctagagccaagcccagggggcccaggaggctcccagacaaggcaagaaagaggccacatatttgtgagctttgggaatgcaagccatagatgatgagtgagtcaaaacagactggggctgccagcaggacctttataatgctacttcctggactttctcgggtcccagctggtcgtgaaaatcccccgtctccacacaggagcctagtgaacgctcacatacacgtgcatgtacacacgtgtgcccacacacgtgtcactgcccctgtcccttagagactgcccgggactcactggccaacaggaagcagagctggcccgctggccctcgctgtaactgcccttgacgtccggagcacgctttgcccccagcccgtgctcaatggggcttctgtcagctgctaagggccccacctgaacccctcaggtctgtgccaggagggccatgatcagaggcagctaacccagctcgaatagcaattcaagtcttccttctatcagatgccttgacactgtagcgggagctcgttcacgcatatgatttattaactaatttagcatgtaagaaaagcatctgcatctcgcttttatcatcttgccagcagacaggctgaagacgagacgcggcctgtagacatgcttaatggggccttaagcactcctgcgcttgtccagagctcacacgaggctctggtttcagaacttgtctgagtgggccggcctaacacaaacaaacacgagggtaaacctctcatcagccataaataccgcggggatcagaagagcagccgtaaaatcgtgtgccggagccctctcagagcactctagacatcaggactgtcttggaactgggtaaataaaaaggtgcctcagttatttaaaactattggctgggtctcatcatcttttattattatacatattttaagatttttcagtcaaagg

SEQ ID NO: 40866 - DNA, 897 bp, Bovine  19866880826913
ccttgatggctacaaaatatcccaagtcaacaaaggtatatttttatggatgggggaatgcttatgaattttttttttgccttctgattaatggaatgatacactgccccatcttcttaatgtttctatgtctttaaataatagccaatttcaatgacttagaaaaatcttaatctgaccataaagtggaaataaggtgagtgagcctgcagaaaggaagggaactgcattaaaaatcagaagtggggaccacagccaaatacacacccatcaccacgtctaggttatccttgcaaggacgataatcagtcagagccaaagtcatttatctcaccattgataccagaagctcagaggaacctaatttttcaagcagaacaaaatattaaaatattgtattccagggactccaaaataactagatccctccctggcactaaataaatgcttcaggctgcaagcctggcactcacagggcacgggggagtcatttattgctatgaatatttagaggcaatcttgattaccactttaatattagtgcagtggttccatagtcaggaagatatgagcatcatggaattgagagaggacaaaattgaattagccggagaataacacagtaaggatgagggcactgcagcaccataatgggcgttcctggcttggagacttttagatattatgtaaatgatgataatgtttattcatgagtcattgatacttttctctgatgggaaaagaacattagcaaacctcttgttaaaatgtgcagaatagcacatgttatcctcaggtaagaagtgcttttaaaagatatggggatgtagcttgaagctgtttgtgtgttaaaatgtgagggtattttctgcactggttttttcttactggatttct

SEQ ID NO: 40867 - DNA, 999 bp, Bovine  19866880831914
tattacaatggccccagtcactggatggaaggttcaccccaaagccagtatgacctcatcctgactacacctgcaaagaccttgtttccaaatccagtccgttcagaggttaaggctcgagcacaacttcggagagacacaatctaacccagcacggtgtccccagcaggccgccatcgccgtgagttctcattacactgccctgtaatcatctgggcgtgggtctgtcccctcaagttgatggaggccttcagagggcacctcatcatcaccttccctcccatgcccagcgcagtgcctgccaactgaagaccttcaccaattgttgactgaacgaataaatcatttctcattttgataggcattatatctatgggagaaaatcagaacataccttcctcagacagcttgatcatattccactgatgtttcaaagacattttacttagattcaaaggtctgttaatggcaaagatgcactgggctaaagggaagaaaaattggccacagttcacatccaaaactcctctcggaatgagtcaagctcccaccttctgtggtgggctgaagaacctccaaacactctacctgtgatgaagtcaccagaatgtttccatggcaaccagggagcgggtgaggagtccaccctgtgctatttctcctgagaaggaataggaatcatcactttgacttttatatctgaggctttgttgacaagttaaaaaaaaaagtttgtacaaccattaagttttctgcagagcactgttagatgtgagatgacaattttacctactgcctacattcagatacacatttcccctcaacttctcattattttttattttttaccttgttttgatgatgctggttctcttgccaggcagcattttttactgtggatatgttccctcactattaaaatacattcagataacatcacaatgttaatttgtttatcctatttgtaatacatgttaccaatttttacaaagggcttat

SEQ ID NO: 40868 - DNA, 1411 bp, Bovine  19866880835837
tcatgcccaggcttggcaaattgaaagcgctcctttctgcaactgtttcagagtgagtattaattagagctgctccttaagaaatatctggaactattccagacagaagaaaagtcaatgccaaagttctgctagctcagcgacaccccacgtatagatcaagtggccgtggacttccccaggcaactgccttcactcactggcggacggggcttggaaacagaaagctcagtgggtctgagatacgcagggggtgtgatctaccgccatcagtttccattatcctaaactggaaaagcgcatgtctaagctggcccacctgtccaataaagcattttgatcaaagatgcagatgcacagagcacctgtttgaggaatggcctgggtgtccatggggatccagcagagttatggaacttcacaaagtgggtccccgccgttctagaggcagacagcaacactgtgaaaaatgcttctccggggaagctttgagtttctttaaacattcaattatagctctacaaacacagatttgaaatgaacagcatctgatctttgcacaaattagagatgctagaaggaaaataaaatagattctcctaacaatcaagtaatacaaatcagccctgcttcatgaaaaaatcggtttacaccaagtctgggagtggggttacttaggtgactcccttttcgcatttattttagatgatgacttttatgattggaggcactgagggaactttattttggttctgatttttaagcaggttttaaattaaaatagatttctggatatagtccgtgggtacaggtttttagccccgggaaagctgctggaggccttgctaacatccactgtttccttttgctgaataggaaacacttcaacattcctcattacaactattttcagtttttacagaagctttttttccttcaaattaaaaagttttcctaattttaaggataatttcttgtaaaatattgagaaagtaaatatccaaatctttgtggcattcatggacacaagtgtaaccttaagataaaaactgaatatcatgtaaagtaacaggctgttcacactgactatattatcaacagtttttacattaataaaaatctccattatcatctttagctgtactgctgcatagcgctctatttcatagctgagtcatgacttatttaatcaatctcctatggacatacttttaggtataacattctgcaatgaacatccttagacccgggctgactctccactgtgggctctgaagcaaggtaccaaccaggctccttctgattgctcaggctctatgttctggtgggtgtgaaaatttacatttattttgctttcttgcacatttatctctgcttcatttggataaattcttcattttggatctattgg

SEQ ID NO: 40869 - DNA, 1226 bp, Bovine  19866880837055
ctcaaaagaaaaaaaaaaaaccacaggaaatctggtggcttgaggcggccactgtgccaggagcattgcatggagctctgtatgtgcaggtccttttggatgtagcagcccttcaaggtttactaccatcccagacagtccaacttccctcgtttccttactccgtttccttatcaccttggagtgtgtgcctggaaaccaggtgaatcacctcagttcactgctacttgagcactggtatctggaagacccattagctgcaggaggagctcttgggtgccaagctgaagttgacatcaacaggacccttatcctgggatcccatttaatccccagaacaagaacagcttcttgctaaatcacactgtctctagaaagtcccaagcagttgattatataagtaggattaacgctggtgtagtgaaatgccactcggagaggttcggcttgcaggcagatgcattcaagctctgtgcctttaatgggggttgtttccatcgagcagatggcatatggcccttccatcctgcttgcatgagcatctcctctagcacacccaccaggatcgcaaggacaaaaccatctagtgagagtgttgtcagcagcaattatgagaagtgtatgtcatgtccccaggagttgacacactgattttagtgaagtgctacacagatctttgatctcttggcatgttgtttaaaggatgattgtcatcctcataagatgaacaagaactcatggagccccagatcaaggtggtcctggcattctagaagagcagtagggattcctttttgagagagaaagtgtgtgtgcacaaaacagcagctgcagcagaagccagttctgtgtctgtgcatcttgagatacagcaggttaaaagccaagatgttaatttctcctgcttttagatcctttgtcaagaacacctgggcttcccacgtggctctgtggtaaagagtctgcctgccaacacaggagatgcaagagatgcaggtttgatctctggcttggaaagatctcctggagtaggaaatagcaactcactccatgttcttgcctgggaaattccatggacagaggagtctggtggactgtagtccatggtcacagaattggacaccactgagtgactgagtacacacatatacaagaacaccagggaacttctaaacaagggagcaacttgatggggcttttcaaaactgcacacctttcctgaattg

SEQ ID NO: 40870 - DNA, 1526 bp, Bovine  19866880848934
tttcactttcatgcactggagaaggaaatggcaacccacttcagtgttcttgcctggagaatcccagggacaggggagcttggtgggctgccgtctatggggtcgcacagagtcggacacgactgaagcgacttagcatccatatttaagatgtgcatgccctgtgatgcatcaagttcatttacaggattcaatcccacacatgccccaagagagatgtacacattcacgggtgcttgcttttgttttagaaaaggaaaaaaaattaaaaaattggtatctggtaaatgggtggtgttgattttgttgagaacctcaaagcaaaacctgaaagaccatttggtctctaagtgccctgaacattccttaaatcacccataagttacatacacatgatttgtgtaaacaactcagtacagcactaaaaatgttaaaaatatataatttacactctaatgtataatatgtagttccataaaatggctgcaacaaaaattaaatcactcaagtgctacactgcttagacacccttccacaaaatcgtaaatattcaaagcttccagctttgcctgttgatggataaacatcgccacggtttggttctttcatctgaaaaacggggatacctcaccactgccccagagggtcacagtgaggccgtggtgagttaattccgagcaggcctggcactgtgccagtgcagaatgagccttacaataaacgtggggtgcgttagccttcagagggttgctattctggaagaggagagagaggactgacagttttatagcatgcgatgtgatgagggctctggcagctgtgggcacaggtcttgtggaggacagagaagaagcaggatgaccacccagaggacccctcccactgcctctcaggctaaatgaagttgcctaccaatccctgccctgcgaccggcgccagcgtgctgctccccacagcacagacgccgttcctctctgcctctggtctctaccatcagcacatatgcttaagaattctctgcgtttgttctctggaaagtaaactgttggaaagaaaaatcaatgttcattagcagtgccattacttttaagaaaggcctttctcaaggaaaagtggtggaggacactcctgaggccggtgtccccctgacgtccctgtggggcgcagtgccttactgactcagcttcacggcggtcatctctccccagctggacgctgggggcacacccgcactgctggggcagccgcggcctgtgggtggggctcgggcgaagtggggagcctcctgtggggtggggagaggtgcgtctcagttcagctgatggaagcacccatctggggtcaccagaccttctcgcttttttaagaggaactctacgcctgaatttttgtgtgaaactttccaatttttaaaatattgtcaacaaattcaaagcaaacagtaaaataacactctcagagcccaaccaaataattttgtgggtgaacctcaccccagagccctagttggtaacttttgtgacaca

SEQ ID NO: 40871 - DNA, 1415 bp, Bovine  19866880854133
caggctgggctgggtgctatgaacccatcatgctaaagagagttaactatcagtgtaaagagagccgatcacccaagtgctcacaaatccaaagtggaaaataggagcacctcccactttcttgatgccagtgttgatctctgagtcagtgaacacatggagagcctcagaaccaggaacccggactgggcctcaaggagtcacccaaggggcagccaccagcagtccattggaagccccctctccggagggctgtctcctgaggcctcagaggttgagtgtagcctcttgagcctcgatgcttgctgcctggcacttgccaatgcatgtattacatggaatcatggtcactgtcattctcgaaacaagggggacacattcaatcagagggacagctcaccggtgcctcgcctctgggatcatcgacggtatattctgggcttctgcataaaccgtttgtttgcagaaaggtgccagggagcacaccgtcatccctgctaaaaaagcatcgttgtgtccagggcaattggcctctgagttcttccatgaaattgaatggacaggtttctaaggcggggctctgctcccagctgtgtgtccttgggcaaaccccttagcatcactttcctcatctgaaaatgaggtacttatcccattgggttgtcagagaaagagctgagcacagtcctgactcacagtaagagctgagcgcacaagcttacaatgcctcttcctgcagagagccgtttccagggccccacagccacaaggcaggctggactccttctgtccatggcgtttcccaggcaagaatactggactgggttgctatttccttctccaagggaatcttccagaccccgggatcgaacccaagtctcctgcattggcagacaggtagacaggttctttaccactgagccactagggaagcccatgatataaacacattacgagtttacaaacagtttgtcattgtttagttgctaaatcgtgtctgactcttttgcgaccccgtggaccatggcccaccaggctccactgtccatgggatattccaggtgagaatacaggagtgggttatcatgacctcctccaggggatggatggaggcttccgtgggtctgaccagcatgctgacccagatactcacctacggcttctactctggggctctcaccctgcatttctgggttgttttctaaccataaaggggatagacatcacagtagggacttcaattttcaggaacagtcaatgatagcagagactgctgagcatctgtaatctcaccctttcatagtgtgagaggcagttgataaaaagcaggcaggcttcctgtctgcatgcactcactctcccattccgagctgttttgtgactctccttagagacctcagcctttattcaataca

SEQ ID NO: 40872 - DNA, 830 bp, Bovine  19866881005802
ctataaagaagagtatactgcccaggttcttgacaggtatgattctgatccaattaaagtttcagtgttttcattaaaaaaaaaaaaaagagtaccggagtggattgacatttcctcctccaggggatcttcctggcccagggatttaacctgcatctcttgtgtctcctgaattggcaggtggattctttacccctgcgccacctgggaaggccccactctgacctctcatctggctcaaaactctcccttagccattgaaacagttgctctgcctgcttctgacccaagatgacctgtttgtggagaacaggctgtaggttgaagtaaggacacagaaagatgggggatggaaaagcaagaagatgtgatttgtgtgccagaaggaatgaggaatttcctttaccagatctttcccatgatggcgttggtgaactatagtctgacctgtgggaaaaaatggtcctcaaaattcctgatgaagaattctgtgtctgcctttatcatcctgaaagatattgatctgttcatttaattaaaacctactaggtcatttacaggtgacaaaatatgatagcgtcggccaagtctgagtctttgctgagaacaatacagattcattttctgtaactcataggtagaacattttgcttaaaaggaacaaattactgcgcttggcagagtgtctgaacgatcctaccacacttattgtttttcttgcagtagatatgagctagcaatctttagctgtaatgtaactacattacattagcgataacacacatctatgcacccatttctaatcaccaacgaatcggttaaatctatgc

SEQ ID NO: 40873 - DNA, 754 bp, Bovine  19866881011603
tgtctagcactggggagtggctgaacttgattcactgatttcaagttgcttcaacttgattcaggaagaagtactcagattctctctctccttccttctttctgcctctttctcatctgtgatgaacatatagctgaatgggatattattctgtcctttacaaatcaagtgtcaagccatcaccaccactgctcaggtagttgaaagactagaggaaagggaacctgaccttgggtgcattgtaggcatccagcatttggtttgtttgcttgctgctgttttggtctgtaacatgagtataagcttatctgctcttcctccctcttagggtcatggtaagaatgaaatgaaatgatgtctgtgaaaatacgctggaaactaaaaactaccaccccaatgtaaggtgatactgagagtttaaagtatctttagggaccaatctccaatttcacgtcttgaaaaaaatgaactctgggtccagggaagacatatcaagatggggttgctcctgaattgatctcaatggagctcagcctttgaatactccaggaaatttccaatctctagctttctcgcatgagaatgaaatgatggaaatagtacgtgaaatggaaaataaaaaggcaagggggattagaacatgaaaccaaagcttcctgtagcatattgagagtctgaaatatcaaatagcagctaattaaaacagcagaggtaatgtctgctgcatagactttccgtttgctttttttcctgg

SEQ ID NO: 40874 - DNA, 1788 bp, Bovine  19866881014441
ctggtgaaactggtcacgttagcagacgttttgtctagattggtcagtggcgaccaacagttcagccagtcgtttttgagacaaagaatgggaattgggggtctgtgtctggctttctcgtgggtaaacaaggggggagtctgcaattccgatctaaatcctgtagacaagagtgggtctctgtggtgggccgctccctggaacacaaaaggcaaggggcagtgtttaaccattgctgtttgccagagcaaggggctcaggaaagtttgacctcaccagaagaaacagaagcaggcagcagagggcagtcgttggcagaggggagggtagcttgtgagctggagctggagctggagcaagcaaaccaggcctcaggcagcagtgagtgcggtgggcaggctcccgtcaccctcacatgcacatgtggtgtcgttagccaggcccctgacttccaggagctctttcctccaggacggtcagatccatcaggaagaactgtgtggctgacagactcctcactgggccttcgggtgggcagcttgtccaggcaagaagctttgggctttgaagctgggtggctctgaggctctggcacttgaaagtgaggacccaggagaaagcctgatgttcggtggatgagatcacatgttgggcttgttcaggaccttcagttctctagttaaccgcatctaatggcggagatggaatctgtaagctgttggccttggcacaaacgagacagaaggtgctggtctgtttcctaagttgcatgtttcaattagaaccatgtgctgaactataattttctgtcacattggttggccttttccttgaaagatccatttaattatctttgtttaaaacctacagggtgtaaatgaaagtatctgtagatgaagactcctaaaaaaatcacaagttttaggcaacaaaccaacctcctttcgttttggttgacaaaaggagatttcagttcagttcagtcgctcagttgtgtccgactctttgtgaccccatggactgcagcatgccaggcctccctgtccatcaccaactcccagagtttactcaaactcatgtcctttgaatccgtgatgccatcaaaccgtctcatcctccgtctcgccttcttctcttaacttcaatctttcccagcacagagtcttttcaaattagtcagttcttcacatcaggtggccaaagtattggagcttcagcttcagcatcagtccttccaatgaatattcaggactgatttcctttaggatggactggttggatctccttgcagtccaagggactctcaagagtcttctccaacatcacagttcaaaagcattaactcttttgcgctcagctttctttatagtccagctgtcacatccatccatgactactggaaaaaccatagctttgactagatggacctttgttggcaaagtaatgtctctgttttttaatatgctgtctagtttggtcatcttttaatttcatggctgcagtcaccatctgcagtgattttggagccccccaaaataaagtctttcactgtttcctttgtttccccatctatttcccatgaagtgatgggaccagatgccataatctagttttctgaatgttgagctttaagccaactttttcattctcctctttctctttcatcaagaggctctttagtagttcttcactttctgtcataagcgtggtgtcatctgcgtatctgaggttatcgatatttcttccagcaatcttgattccagcttggcttcttccagcccagcgttt

SEQ ID NO: 40875 - DNA, 1230 bp, Bovine  19866881077639
aaaagcaaagaaaaactcccaggaagaccatctttcagttaacgcacatggcagagtggtgctctctgcatagactgggcataggttctgatgtccacctccaaattcagcccgttccaagactcacatcaatgtgcacatcatgggagtcttctatcttcatggcaggttatatggttttgggcaactctgaaattatggtaaccgatttcctcatgacttttgtttggagcttgcaacaaaatctacatatcgcagcatttttgccctcattttttctctactattaaaagatataggagagaacagaacagcctagtccttcacctgggccaacagagactcaaagactccaggaacccagggtccgagaatcttgcaagggagatagtaaaatatgggaactttccccaaatgctgactgacaagcattatcgttgatgacataaaccatcaacagaaatgctcaacagaggagaacagacgcttcccttgtatttatcaagcctctgcagaggcagtaatttgctaaatgatactgggctggttgaaagaatttagtctcatttcaaaggtgcataatatagtccagactcatgggatcaggctctttatctcccataaaatgttacaaattggtggagtcaaaggaagaaaagtcgaatttttcgattacagaagtatttttaatcaagtaggaccttccgatgagacattgaccatctgaccccagcagcttatctaaggcaagatgaatgccctgagaaagaagtgctggttgaagcggctctcagggctggtggggtcgtggccaaggggactggcacatttctgctgataaaagaaactgtctggggttgcaacgagcacagcaggaccccaggcagaatcacagcggatgggtgctgccccctcacaacgcatggcccaggctcaaagatggctttcaaagaactggagctctgcaggaaggagatgaaagcacatttaattttgcacatgaagtgaaaagctcactgataaattgagtccttggaatttcagtgttcagatgcacctggccttgggttgttcaaatcaccgtttaagtggtgtcattctaatgtcaagacttgaatataaatgaatgtgtgtgattaaggagatacccagaatgtataatgtgtttcgcatatcatcctgtttccttaaggataaagcattgatggccctgtgagggaagggggtggg

SEQ ID NO: 40876 - DNA, 1092 bp, Bovine  19866881084698
tttaactgtgtttgaaaatgggacattacctacaaaatgactgaagcttaatagtaacatttatgatttccatttctttctagccctctgtcctcattcctgggatgtgtgtgtgcgcctgtgttagttgctgagtcatgtccaattctctgtgaccacatggacggtagcctgccaggctcctctgttcgtggtactctctaggcaagaatattatgatttccatctctttttagccctctgccttcatttctgggaaaggaccaggaattctattattttggcttatagaaagtacactgtgaagttgctaatgctgtgcacaaaagcaaactttttccttcaagagctggagtgaatattttacgcttttcaggctatggggtttctgctgcaactactcaactctgcacaagtagtgcaacaatagtcacagaacgatgcataaacgagtgagtgtggatatttcccaataaaactttatttacaagaacaagcagtaggccagatctggcctgcaggctgtaacttactgacgtctcaaagacagatgaaatttgggtgatggaagtgaaaacactacagccaagccacctggtgagatcaaaagtgtggaagcaggaaggcagacgtgtctgaggacacagaattatccattttgtcaaagatggatacgaagcctagcacgtggtatcacacagaattctgaaacacaggttaggaaggatactgcattccaaacagaggctatgcatttatcagccatatttcagagagaactggcctaggagactgtgcagggttgatgtgggtgagagtcagggggtggagtggagagacagcaaaaccagaaggctgctgcagagaaacatgtgccccacattttccatataaagtaaaccatcctccagacttccactgcctctgctcacccaatgtgttcctcccccagcatacaggcaggctcctgtgacagatcacaacccacaccctgtgcgtggggtcatataccgtaaccacatggcaacagtgaagacaggtgctaccctcgcaacatgggagacctggattcgatccctgggtcagaaagat

SEQ ID NO: 40877 - DNA, 1352 bp, Bovine  19866881111321
tctgtaggacagtgttatttccaattaaaataatgtaaggtaaaaacacagaattgcagagtggtaaggaaaaaagtctttatgggaactcgcccaattgcctggattttattttccaaatgatttcccttttatcccccattgcagttcagtaataaacctttcagtgacactaaggatataaatctacttggcaaccagaatgaaagtttattcatcatctataaatcaccatattttgtggttctctaaataatgctgggaaaccctggaactgagcaagcagtgactcccagatcaacagctagccattcagacgtgttctagttttgctgttttatggtgaagtatgacttgagccattgcctagtttctttacatgactaatttaaacttgccattcagcccacacacgcacgtgctcgtgcacacacacacgtacacacacacacattcttaagaaaatgtgaaggccgtatagtaattttatatatttaaaatcctgttttatagccacaaataataacaatgaaaactgaaaactaattataacttgctaatgttctgcaattgtcacttctcgccccagcatccttaggcctagacaatcaaaaatacattcaagagggagaccaattcctttggattattttgtaagctgtattctcttgggaggtttacaatgcccatgtatgttaaaggcactgataagtcctgcaacaatgaagcctgcttaaatttgtttaagcttgttttctctaaacttctttgaccgtgaaatgcttttacctaattctcgagcatccattttagaaacatagctctaggaatctttgcttttaagactatctattgggttggccaaaaggtttattcaggttttgttctaaaagatgtgaaggaaaaaccctaacaaactttttggccaacctaataccatgctttgctaaagaagccccaactggaatttcgatctgccatttcccacaaaaatctgagactgcaggaagaaggtcttattctccttatctgaatccctttggtctggcagagccagaaagcgatgactgaggagcctggggttctctgggcggcagggggtggtgccagtttcacaggctgtggccagcttgcctccctggaagcttgtccactgacaggtgctggacctctctccatgtggggtcccctggaatctgtaacaaggccgtcacactgtcacccaacggagtccagcagagaaagaggagccagtcaaaaccccttcagaaagcactcaccaatgtcacaacatgaaataaccagggagggttgtgttccccacaccaagggcggaaaaggcagagaagcaa

SEQ ID NO: 40878 - DNA, 1132 bp, Bovine  19866881152274
cccgtgataagtgagaaagtacatttctatgaagctcacatgaagcagaatgaactgtcacgagcaccgcccagactgcctggagtctgagtgtcctgccgtttccccagagaccctgcggctggggcaccacccctgggattcaggcactatctcctgctgtgaaccacagtcaggggccctctggacggcttgtggcagagagattatagccccgacaactgcccccccaccccagaggggctgctggtgagcctggccttgctaaggaaagggttggggtctagctgttacttgttcccaagtcatggcagctgctcagcccccaggcaatgcgggcctttcctctccactgtgtggatgggatgccagggatgctggagggtcaggagtccaggctccctgatccagcattgctgctcactggccacctaacgttggatgtgtcactacccccacgtgggtctggactccatcatcagtcagataatgaggctgcactagatcattccctccagccattaggaagaagtctacgatccaatgaagacacagaaagactgcgttttatgctgacagtcagctacgctcaccaccaacaaacccatctgaggtgacactgcaatccctcatggttacagcacaaaagtaatcttatgcaaacctccataattctgtgttagaatcattggcaagtgtctgcaagttttaaaaatagaatttgaagcaccatttctgcagaaaaggcttcagaaaaacaaatgaaccattggcatagctaatcaagattaatatgattccattggaaataattaagcccatcaggaaaaataaattaggttttgaacaattagaatcctcccctcccccaaatcctctgaactaaaacaacagccttctttagttgaaacccactgtatgtgatttcaagagcatgtggtcagtatgtgctgtcttctttgttttaattgcttttggaaatatttcagttcagacacatattctgaatcttggttgtgagagagacagctccgtttgaaacgctaatgaaaaactcttcatgaaggaaggttagtgttaaaattactttgaagatgacaaagtcctttcaaaaaaatccagaacgtcaatt

SEQ ID NO: 40879 - DNA, 748 bp, Bovine  19866881163934
ctctagccccgtgtgggttctcttgtctgtttttattctgtgtggcagccatggggcctggcactgggaaggtgctttgttaacacgcacagaacagaaggatatgtttggacctaagtgctgacaacacgtaggagactttctggaggcccatcctggccttccccagagctgacttttggggtgtaaacagcaggcccatcctggcctccccagagctgactttcggggtgtaaacagcataaacgtcacatgcattgtctcccacaagagatagtgtaggacgcaatttccttagatgtggccagcaaaggtttgagccacagatattttgtcctgtctgaacaacagagagagaaaagacaagggaccaattccaaaattaaatcagccactagtctgcctgtcaaccagcttatactgattgttgagagattaaatttgagaaagaaagatgctagccaaaaagtggttcttattttatatataattttaaatttagtgaaattcactgtgtgctgacttggggggaaagtggggtgagtcagcacatttcttcttgtttcccagcctgattcaatagaaacaaaacccccaaagctgcatccttgtctctccacccaccctccccacccctacccctacgaaagacaataggaggctatgagttccctgagagggtttctgctggaaggacaggctgtcgaggcctgcgggttttctttaagcaaaagcaacagttcactca

SEQ ID NO: 40880 - DNA, 755 bp, Bovine  19866881198845
tcccgcacgctggcctcctgcaggctgctcctcttctgaataatggcttttccgattgtttgtggcagatttttcttcatctctctaatctgtattataaaagagtagaaatgtaatttcccagttagcttatattttacatgaaaaatggctagtttgaatgagacaaaagggaagacatctttcaaagggtaatgacccctgtttagtcaaatggcagctttcccatttcattgcaggagaagggaacaattcatttctcctaaattgctttccttcaggccatcttcctccctacaaaggagcacttctaagaaaaccgagagtgggtaaaaaggagccttccagtctcaggaccctctggtctcaggtctcttcattctcggtgtgagtgagaacgccggtgttcccggagctctgggggcatgtctgaggttggaagcagaaattctcttaaggtgggaaccgcccacgtgtggcaccactttgcattggaaacttggagtgtcctccgtgctggtcggatggaggctttctgggcctcggcaccggtgagaatggaggcaggataaccgtggttgccggggactgtcctgcacgttgtcgggtgaccagctggatccctggcctccgcccaccagatgccccagcctgtccccccagtttttgataagcacagatgtctctcgatgtcgccaactgttccccggggtggggggggagggatgcaagactggtcccccagtcacgggccg

SEQ ID NO: 40881 - DNA, 1102 bp, Bovine  19866881217388
attaagaatctgccttgcagtgcaggggatgtgggtttgactcccagtgagggaagtaaagccccacatgttgcggagcaactaagcctacatgctgaactactgggcccactcaccagaaccagagagagtccaggagccagaggaatgatccacgtgacccaatgaaaatctcacatactaaaatggcccaacaccgccaaataaaaataaataaataaagggcattaagtttattaaaaaataaattaataaataagtctcatttgggcaacctgatacagacataacagtattcccattatataaggaaatctttggcattccccatcctgcactagataattcgtagttgactgacatctaaacactgccttctgctgaaatcaacaagggttgggggaagcctaggatttgggtttgagatcccaagcaatctgctgacctttccccaacaccacttactatattggcttccctggtggctcagacggtaaaacatctgtttgcaatgcaggagacttgggttcgatccctgggttgggaagaagacctggagaaggaaatggcagcccactccagtactcttgcctggaaaatcccatggacggagaagcctggtaggctacagtccatggggtttcaaagagtcagaatcaattgaatggtgggttctaaagagagcaactgaatacatttgtgctttgggaaaaagcaaccaatgtgatcctcaaccatcatttagttagaaggggaaatgccttaaagggagtcgttttctttcaattgcaatataccagcagaacacatatggattctataatataacacaccaaaaccactgtgatttatctgcacaaggtaacgcctgagccaaaagagaatctaaatctcagagcaatcacctttctctgttgggaaagtggaagggccatctgtcctggaggtacaaaccgcataagggttgcagtgccctctggtggtgattgctttttcctgcatcgcaccctcccaggaatccacttgccccatggaatccaagcagctccatgcaatgggtggtgtgggtgatgggaggcccacaggaagagagtatctgaaa

SEQ ID NO: 40882 - DNA, 2018 bp, Bovine  19866881273071
tgtgttttataaaaagtagcaattagctgtaacactgggacagaaaaacttgtttgcactaggcttcacttcggacagaatgacttgatggtgcctccgtgatcgacagcaggattactttttcaaagagtttattatattgcgctaatgtttatttgaaagagattacagtgatgttttataaatggcccttcgtcaacatatgaatgggatagtctctctagaagacagcttgcctgcaaacaaactagcaacttaagctattaacttccactgactgacagtttcgaaatggggttgtaggaaaaaaacggtacgtgaatgtttccagacatcaagttagttagataaatgaactttgaattggaaaccaggccttctagttaataaacacagtgtgtattattttacggctgtgtcttgtaaaactaggcaagtcattccaaaaagcgatgctctgtcctgttttctattataatactccagattatatcagtaagcaaaccttagaaaatgttatctttaaaacttttcacatcaagatgaagagcattcatatgtcctacgttgtgtccacgtgggtcttccagaaccttccaccctcttctgtaacactggtcagacaggaataagatcttccttccatataaaacaagtgttactgaactcagtttcagctgcttgatgctcaaaagccaatattctttctgacttacttcattctgtatgaaaaacaggtattgtatgttaacgcatatatgtgcaatctagagagatggtatagatgatcttatttgcaaagcagaaatagagacacagatgtagagaacaaatgtatggaatccaagcggggaagggaaaggatgggaaaaattggagactggcattgacatgtattcccatgggactgacctgtgtagactagataaccaatgagaacctcctgtatagcgcagggaaccctgctcaatgctctgtgatgtcctaaacaggaaggaaatccaaaaaagaggggatatatgcatgtgctcaatcactcagttgtgtctgactctttgcaaccccatggactgtagcctgccggactctgttgtccatgggattctccaggcaagaatattggagtgggttgccattcccttctccaggggatcttcccaacccagggatccaacctgtgcctcctgcattgcaggcatattctttaccaactgaggcaccagggaagcccctataaacaggccaccaattaatgaatatataatatttctctttgaaaacttgttagcatcttacagaacttagttttattatccccacttagatcaaaatacagaaagcagcaaagggtttcaatttgggtaaaaagcaataaataataagtgaaatggtattttgtcactgtcgttctgggaagtagcagtttcgtttgtgattggatttctgtaataaacatgcatttccatcttgtcacgcacaatggtttccagacagacattttcctctttgtctctcacagcaatcttcctgacgatttcagttttctattgctgttctgccaaactgccacagcttaagtggcttgaaacagtacccctttctgatctctcggttctgaaggtcacaggcgggtggctgagctggatttcctgctttgcatctcactaggttaaaatcaaaggtctctccgagctgcccttcttgatggcaacgtgggggagggtctgtcctgctcatctgagatgctggcagcagtcagttcttagaggttgttgggctaagatccctgtgttctcgctggctgaaggtgaaaggccattcctaacttctcaaggcctctgcttccatggcttgcaaagcccttgctccatcttaaaagtgagctaaacggtcagactttcctgtacatctgtccaaccccagcagtgaaagttacctctgctttttaggaccctcgtgagtacgctgggcccatctgaataaaccaggataatatctccctgtgcctctgtacacgt

SEQ ID NO: 40883 - DNA, 1140 bp, Bovine  19866881281322
cagagggcaaattaggctcactgcccaggcagtcaggctataagacacaagatattgttgctgtttagttgctaagttttgagaccctgcagtctgcagtctgccaggctcctctgttcatgggatttcccaggtaagaacaccggagtgggttgccatttcttcttccaggggatcttcccgacccagggatcgaacctgcgcctcctgcattggcaggcaggttctttaccactgagccaccagagaagccctgtatgacacaagaagcactcattaaaaaaaaaaaaaaaaaaagggaaacaagactcaacaccaccattctatttctccaggctgtgatgcaaccgcaaccacgagatgaaacatcattaactcagtgataaaggcgggaaaccctgtgaaaattttataagccggtctcaagtttgtgtaggctgacacatttaaagcaaagctgcaaagctgctgcccatagttgcaggtgaccggcagactttggcaggtaaataaaagatcaattttaagaatggaagaataatgccatactattgatgccaagattgctgaagcttcgtccttaggaaacaattccatccatccttcattcccagggccttacattcttcactctgaaggctgagtccacattaatcccaccttcaagcgcctgcctgtaaatcataggcatcgaagaaggaaattgtacagacaaatgcttttgagcccttgaccatatgtggtccccaccggtaactactgatcaggtgaaaactggagattttattttctgttcaactgaaggcaacacagctgaagaggcaggaatcctatggaattggatttctgttaaatcacttttttaaaaaaaaaactttcactcaagggttcacttccccttccccacacccagcacttcagaggcctcttgtgttcattaaagctctaaacggggcctgccagcaagggtccccgtccagctccacactcactccctggcccctcagttaggaaaccaagatgatattgcccctttggctctaagagcctgtgaattactggcagaggtccccaactgcccccagggacccgttttgtggaagacagtttttccacggactgcgggcgggggagggggat

SEQ ID NO: 40884 - DNA, 1286 bp, Bovine  19866881307615
ctgtagtccatgtggtcgcagagctggacacagcttagcaactgaacaacagcaacattttttacagtctttatcaacttttattatactattgcttctgttttgtcttttggtttttttggcctcaaggcgtgtgtgacctaagctccctgatcagggattgaacctgtacccacttgtactggaagatgaggtcttaacgactggaccaccggagaagtccctgtgtatttgtaacttttactagaaagatgacattgcctgatagactgttgaaagtatttggtcatttggaaaaagtgacattgcttgaagaaaatatttgttcctatgaaaatggcgatcgtggtttccagtggatggtcttggagagagtgggagtcaaaagcagccctttcaggccttgggtggggcccaccctcaggacactcctgtccctgcagtgctgcagcgatccaggccccggcccctgtttctgtgccattcatctgggtggggcgggtggacctatttcctcgaactgtgccaagccagggcttggcacctgttgagtctcttggcaggaacattgggcttttagcagatggcatcaagttttgacctttgcaaaacatttacaatctgaaaatgatgggaaatgatacaaaagtaatgaaggtggtgcaggattacataattacggagttgacagaaccacggatgtctaggccagaatgcctcctggtccggctggtctcattcccctgcccatttctgtgtgacacttcctggcacggaatagggggttggagggcacagtgggacagaacgaggattttatgcctgatgggtctcggattgcttgctaggtctgggagcttgtcgtctcttgggaagaagagctttgttagttgttcagtcatgtctgactctgcaaccccatagactgcagcccgctgggctcctctgtccatggacttctccgggcaaggatactggagtgggtagccattcctttctccaagggatcttccggacccagggagccatcccgggtcttctgcactgcaggcgggttctttaccatctgagccaccagggaagagctgtgggaccctgaatgtgcaagcttccacagcttggggaactaaggggtgagctctggtgggagggcaggtctttggtttctcagtctcgagatcctctggggacatgagaggccctggagttctgtgtgtgggccgagcagccgaggaagaccggtaccagggatctcacacagccactcctctgtcctagctgtgggg

SEQ ID NO: 40885 - DNA, 1222 bp, Bovine  19866881317008
cgtctgcggccacccaggctaatggctctgcgtgctacaaatgctccgccaaccaaaacaacatcacaatagacacttttaggattgtctccattaaaatccaaacttgacgtgggaaaaaaaaaaatcaagtttaaaaggggccccaaggctcctcaagtattgctgaactactgagaaagcagatatgtgtcacctgcaagcttttttattaaaaagaaaggaaaaaagaaaagtcacgcttctccttggctggtaacccagcacattgcatgtggctgtattcatgtattcacggttcattgtaatccttgtgaaccggaggcagcagcgtacatctaaaagaaatattgctttaaaacttgaataaagcaaaagcttgccgcgagcaccggtgtttccgctccgcgtggagctttgccctgaacctgttctctactttattgcagatcctggtttatgctgcagtctctctcttcctttaattccctgcaaagcatcctttctgcctgcagacccaggaactccttggggcagggacttcattaaggttggtgtcaatcaatgcagagtcacatgcattttccagcacataatgaactctgcacatggcctgactcccctcctttatcttcccccccacgccggccttctctttaagttgcaggaatcagatgcatttaaatgaacccttagaagttaatatattatttgccagacagtgcagttttatttcatagtagtataatgtaatgctcaatgattttttaagcagtaaaggagttactttcaaacttaattaggaaaatttagagactatccaggattcttactgaatttctgaaaactttggaaaaatgcactgagattcctgagacttatccaatggcaaccccagcgagggttttctgaactgttttaaaatcattctcaagtgttcctccgtcttgcagtttcaccaaatctattttactggggggaaaaaataaccaaacaagactgtggctcctatgagaagccaatccacattactgtgtccttcctgtattctttggggaggtccctaggaatcccttatgtttcattaaacagggtacagctgggcccctttgccacgcttcccattttttttcactgtctttcaaattaatataatctcatttaaaagaaaaaagataaaactgttgagtcaaatagaatcttcatcaagaacccaaagcat

SEQ ID NO: 40886 - DNA, 1012 bp, Bovine  19866881350530
tgatcagggcgcctgtggacactggaaagctgtaccctcgccccgtatttcgccaaggataactgctttcgtgtattatcacagagtgagttttaggcaggatgaaaatgtaaaaaaaaaatcatcttatcccaagcctgtgttttaatgccacacagattggtggtaatttatgacatctataaaatagatgggtacacatattatgaatacactttccacttctcagaccttgacgtcctgatgggatattatttgcctctttcatcttaccttgacgtgtgaggtagacgttctcgggctctgtatagaaattacttgtcgttcttagagacgtatggagacctacgtgggctcagtcttatttgcatgttttctctctgtgctatgacctgcgtgtaaagttgacaaggtgcccttctgtttaatgaagctgttgccgtctctgccctttcctctcctcccaggcaacatgaaacggtcatcccaggcgacctcccgctcatacaggaggtcaccacgaccctgcgagaatggtctaccatctggaggcagctctatgtggtgagaagatggggcttttgtgggtgtttcttttaatgggcggataattgcgttatattttgttggcctctgccatacatcagcatgagtcaccacaggtgtaacatatgtgcgctccttcctgaagcgccccctcccacctctcaccccatccttcccctgtgggttgtcacagcactgagttgagcttgcgtcccacaacacattcccactggttgtctattttacgtgtggtaatgtgtatgtttccgtactgttctcttaattcgtccccccctccccttccccttccttctcctctcctgtgtccacatttctcttttctatatctgtgtctcccttgctgccctgcagatagattcatcagttccgtctttctagagtccatgcatgctaagtcgcttcagtgtctgggtctatgtaaccccgtggactgtagtccgccagg

SEQ ID NO: 40887 - DNA, 1513 bp, Bovine  19866881366777
gggcgcctggcaaccctggtcgctggctgggggagtggagggctctgacccagtaatgtcatccccaagggagaacttggaaggagtcagggtgggttgtggggagaatgtctcctcttttcatagctttttctcctctgatggtaaaagtgatactggtctgatgtaggaaacttgaaaagggcaaaaaaaaaaaaaaaaaaaaaaacgagggagagaagaggctgcccattcatactacactgtagtgaaaaggagctaattggagctattaatacatgtgttaacccaaatgggtctcaattacaatgagcaaaaaagcaaatcctagcagagtggaaacaggattatactatctatcaaagtttgacaacatgcagagcagtatcatatattgctaaaggaatcatccttttgtataaacataggtcatgggaaagataaacaccaaattcaaggcagtgcttacctgagggagggggcagatctattaccagctgttttggtgatatttatttttaagctgagtgatgagtttcccttggtgcagttggctattcattacacctctgtctgcctcaaatatgttaggatttttttcataagttctttatttggctgtgttgagtcttagttgcggcatgcagatcttcatttcggcaaaagaactgtgggctcagtagtcgtggagcatgggcttagttgctctgtgtcatgtaggatctcagttccccaactcagggctgaaccctcatcctgtacattgcagggtggactcttaaccgctggactaccaggggagtccctctcatgatttttaagtcataaaaacccctcgcctcagaccaaattattgacgtatttcctacgaacgacccttctcccttattcagagccttcacagagatagctgggccctacagccctacccacccctctcaaagtcaggggtttgggcttgtaaacaaattccttgtctggggtcacacttgggtgcagagatgtgacccagggtttggccatctcggcttttgtgagccctctcccatgcccttcttttcagagatcacaaaacaggttgaaaacagtgtctgagttgccattattgattaagaacccaaaatccatgattcgacccactggaaataaacctgaagcccaccttactcctaaagggttatttgttctcacccagaaacctacagcaaacaagaatttgctggtggggtgtgctcagctggagtgttccacacactggcttaaaaattgaatttcatttccagaaccaggatgaaatgaagaaataatttcacatagtgtacatttattgaaattatatcaaaataagcaatgaaggaaaatttctctgggtaatataatttcaaggatcatttcatgagtttgcagctagaaaagcatctaggtttgataagcatgtggagaaaagagtccatgctctgctttgagcaggaaaggagatgctgtccctttggttcactttgctgggtccacc

SEQ ID NO: 40888 - DNA, 1025 bp, Bovine  19866881377883
atgagctggctctttggctctctgctctccacacagctcagagccgcctgaagtaagggcctgcccctggcaagcggggcgttttgctcaagaactgtgggggccagggggagggggatgagacactgagaccacctgctgagctagagtcccacaagaatggtcagaaacacagacacagccctcgacatcacttcacaaggacccacaccaactaaacacagaaggagacggtgtgtttacaaagacagcaaagaacaaccacggagcgtgacaactacgaccttccggaggtctacacggcggccagcgggccacacggctgggcgcagacactttcaactcccccagccttggccttgcctgctcgtggggcaatgttaaagggtattattattatttaatgctaacaataacaaccactcagagaagacaaaccaaaccaggcgaaccacgggaggaacaccaagaagagatttctaaaggcttttattttaaacacatgtctctaaaacagtcggtgaagattgccaaaaacacagcgttgagtctatttgtcttcttctgtgcacatgatttgctttggaaactgcctataaatgccctagaattcttgtctctcatcaaaaaacaactgaggaatggtacgaggagttctgaagcctaacccggttatttcatgcagtggagtgagagtgaaggaacgggaggatgggaagacacgaccgtgaattgaggggggtgggtgtcaagaaaaaggtttgagtcatcccatcgaatcgcacggaagaggcggccccttgtacggcctttggaaaaccagcccagcctctggcggccctgcaagttggttgcggagggaggagaaagtttcattctggaatgccacggggggccatggcatcatgcaaggaactccactggcattcaatccccaggggttgctgggatattctattcccttcttttggcatgggggccctggaagatctctctataaagccataggaggaaatccacactcg

SEQ ID NO: 40889 - DNA, 970 bp, Bovine  19866881384539
gtttggctgtcctggatcttagttgccgcatgtgggatctagttccctgaccggaattgaacccaggtcccttgcactgggagtgccgagtctcaaccactgaaccactggggacgtccctgaatatacttttgaaaaagaattttggccaagagaaggtagcatggcataaagcaaagtctgcataattgggagtcagaccaatgccccaggcttgaaccctgggaatgaccttgaactagggtccccaagctagtgttcctcatctgtgtcctggttatatgcctgtctcctaggactctatgagggctatgggaggtgtagggtgtgagactccaccctcttgggtcttcccctctcctctttgttcattgaaataattaccagttacgtttacttttaaaagctgctgttgataacatttctagtccccccgacggggagataaggcgccccttgctgaagcactcacaccaaagcacggtcttaaggcagcatcagatggtgcccggcttccctgctctggcggcgaggctccttggcctcgtccccactgctcgcagcctccctgcattgtggccgcccggcccgggggccacttctgattccgagtataccatctggttgaggcagagacccctctgcacagaccctacactgaataatccagcttcccaaatgtgaccgtctcacaactgtgcggagtaccttcatgttctcttgaaagtcagcttgaaaatccaatttttccctcttagccacctgatatggattttgattattaatgtctgttgttgtcatgaattgtgtcccaggggttgtccttaaagctggggcccaagggacagtcatcgtttggactttaacaggataatcaagggccaaaagtagcccatattctggaagcccctgcttggtagcggagggtgcactggggtggggtatgtgggccccatttagactttccccg

SEQ ID NO: 40890 - DNA, 747 bp, Bovine  19866881393607
tttgatatcagatatgtggtcataaaatgggacatctttttgaccgattgagaaaaagccatttcttcacctcttgaaaaatgtgctcctcttttctcaccacagctgggagtttcaaatgtgaataaatcgccaggaatttggcagtaatgggatattcataaatacacatgaaatttggtggggtttggagaaaaatagaattgaaagagcacattgtcaggtttaagcccagacataccttgagacgaaagatgagtttgtttcttaaggttgttcatttgctttgcaaggatggatgccagacgctcagcccaaagagacatgggtactcgcaacctcggggcggcatgttcgcggtctcaggccctgaaacagaagtcgcagggctaacattcagcaaagaagctgggctccggttgcacagttcatgtccacaggcgttgtttttgttcagtcgctaagtcgtgtgcaactctttgcgactccagcatgccaggctcctctatccttcactgtctcctagcgtttgctcagactcatgtcccttgagtcggtgatgctacctaactgtctcatcctctgccgtccccttctcctcctgccttcaatctttcccagcatcaaggtcttttccagtgagtcggctcttcacatcaggtagccaaagtattggagcttcaggttcagcatcaatccatccagtgtatatttctggggttgatttcctttaagaatgactggttt

SEQ ID NO: 40891 - DNA, 1065 bp, Bovine  19866881576929
tttttcggactcaaagttgagttctcagagccagagttcttattatgaaagtgtgtgggggccattcttcccgagaccttgactgtgacaactttgagaggccagggaacagcttccccacttgagcaagactcaaagaatgcctccaaccttggagcagaaatggttgggccattctcagaggctcatgttctcacctgtttggggaagggtgtttgtttcctcaatctcccctcgacccaaatgaaaattgcatccagcaaccagtttcaatgtttctctgattcaaaatcaaacactttgaatatgattttttaactggatagcccagataggtgggaatcatgtggaggtaatttaagcctctctgtgtgtgcagctggtagaaaaggaacctctgcagccatgaaccggccactcccctgtggctttttattattatgtggttaggcgtctctctgagcttgcaattctctgcattcatgagaaaatgtggacttctctgaaaactgccgagacaggaaaatcgggctcttgtgtttgttttcattatctggaattgtgtattttctaaatgatgatccaaggccatttggaactgtcccctggccattcatttcacccctttgcagtcagaaaggtgtaaacatctaagcaaccagggctctctccatgagtttttcgatgggaggttaatttatttttcctttaatagagctgtattttcttctgtaagatgagtctgtgaatggtaaatcagggaattatggggggcagaggcttctgccttccaacccctcgggaaggaggaaccactttaagatggcatctcattttgtgtagaccagcgggcaccaccggggctggtcattttccctttgtgagtaggttggtccccatgaaacatgcctacaacatatagttactaaactgaacttttttccttgtaatgttgttaaagtatgagaaatcatagctttcatggtgctttactcttcctccctccaaaaggtttccagatttcttgaaggaaaggaaagtgtcagtgcttagtcgtgtccagct

SEQ ID NO: 40892 - DNA, 900 bp, Bovine  19866882162804
caggtctcatgcagaagttccctcttacagcagggcaccgcccaagtctgctcgaatgccttcagccgtggttgctcacccacccatcgaggtgcgtgctctggtgttggcactcttgcctgcagcacggtcatcccccccagcacggtcatcccccgccttccagcttctgtaatcagagggaggctacgccctttcctactggataactattcgtctaatgccagagctgcaagaagccttaaaaagcatgtggtcacaaggttcccagatgctggtctatatcagaggcacttggaaaactttcaaaatacagaatgctgggccccactccttaggatcctgatttctcacgtctggaatgctgactggaaatccctgtctgtaaaaatagacttggatcgtgaaggccggcagattgggaagctagtggttcagtccaaccccctcattttacatgttagaatataaagctcagagaatagtacagcttcgccctgagccattcaacccaaggaagccctggaaaaactaaagaagcattttgtataatcggaattataacaattctgctttctggtaattcagactttcaagtgtgaaaagtttctaaaagctacattatcagtaagatgtagtgtttggattaactacaggagaaggttccccccccagaaacctagagactgctgggtataggatattagatgttgttgcagtgaaactcatttcaagaccacctgcttgaaaactaaacttctggagctttgattttattttctgctggagtatcatgttttgaacttacgtccagaaaccacctgcttaatttggctgtgggaagctaccaaaatacattatgtcaggaataatactagttaaggaaaggaagtatttcca

SEQ ID NO: 40893 - DNA, 2191 bp, Bovine  19866880260049
acggcagcccaccaggttccaccgtctctgggattctccaggcaagaacactggagtgggttcccatttccttctccaatgcatgaaagtgaaaagtgaaagtgaagtcgctcagtcatgtccgactcctagcgaccccatggactgtagcccaccaggctcctccatccatgggattttccaggcaagagtactggagtgggttgccattgccgtctccgtaaaattatgtacagtgacattcaatacatttttgttctcttcctttttctcccaccaataatttgttttgcttcctctgaatcagtgtacagcttacactgacctttcaattggaagaacttcatgctaagggtgtttgcgtcttcatttcagttggcatgtcacctgcccttaaactccaaaagtcaaaacaacgaatgtattgagctgtgattttctcgattctgaaggtccctcttcatttctgaggaggtccctgcatttacagtttcttccatcatagggactctcttcttggggagagctggtcaagggtgcccctcttggaaaggcttacaggctctcaagtttatttcacaaagagaggaggtgggggcttataactcagcttaactcagtcagatgctttccctagaatgaaaagtttgtcctgtttctctcagagtgcagtgaggactccatcctcgctaaccacggtggaaattccgtcaggtaggcatgttctgagtggaagcaagtgtctctgttcttttgcaaacactggtgtggaaacccacaaggccttggctggcatttgaaagaggctttgcgggaaaagcacccatggctgcaagggaacttctctttctggctcagacctgctaggaagcaaaacagaatactcactggctacatgaaaaatcacaagtgatttgtttttccttttattaagataaattactcttagtaaaattagtatcttaataaaattattcttattagtgcaataccaatgtgctaataattttctaaaacagtttttgagagaagtggcacagccaagtacctttgctgctgttgtccccagacagcatcgtaactgtctccagtttacagcaaacatagactcagcgaaacaggcagagctggagtcagcagaacttaattttatgtccaattctggagcttgcttattggaagaatttggaaaaagataacaatacatatattccaacaacaataaaacttagattctcggagctatggtccctgagagggaatgggaggtttactcagatggtccatgcatgtaaaactcatcacaagacccaacaacatccacacgacacaacatccctgcatctcatcttgtttaattaggaaatgcaattggaagctgaagcctggggatttattagatccatttcatactgttctcaagagatcccagggtgatccagttgcaaacagcaaaatgctttacctcttacacggcctatgatttatttgcaagaaaacaacaaaaaaatatattgatacttattctgcattatttccacaggatgttgaggtgatctgctcatgtttgttggtatgtgttttgttacctaatttttaattatctagccttaattttattacttttttgaaaggaagtgaatcattgtcatctgcttatagcaaattaagttatagccaatgtgctattagaaaccttgaataagccttgatagtttaaaaaataatacttaaagagcatagatattacaaatttggtctgaagtatttcatgatgtaccagaacaaaaagggccttttattgactttaccaacaaatttttgaagagaaagttacattttattgtatgccattgtatcttgttatgatttaagtaattagtttggtattagaagtacctgattaattcacacatctaaaccagtgagagcagtaattatgtaaatgaagcatgaataattaaaagtgaaaaatagtgagtgtctagatctaaagcttttacaagtattgtgtgcaatctagaaccagcaagctgtgcagagcagtgtctaggagggagaagttaagtagaaaaatcaaatagtagacttctcagtttaatattttttaaaactggagtagttgctttacaatattggattagtttctgctgtacagtatagtgaatcagctatatgtatacatatatcc

SEQ ID NO: 40894 - DNA, 2108 bp, Bovine  19866880455860
tgactcagtttttcacatcaggtggccaaaatactggagtttcagcttcagtgtcagtccttccaatgaatattcaggactgatttcctttagggttgactggttggatctccttattgtccaaggaactcaagagtctctccaacaccacagttcaaaagcatcaattctttggtgctcagctttctttatggtccactctcacatccatacatgacgactggaaaaatcatagctttgactagacagacctttgttggtaaagtaatatctctgctttttaatgtgctgcctaagtgattcatagcgtttcttccaaggaccaaacgtcttttaatttcatggctgcagtcaccatctgcagtgattttagagcccgagaaaacagtctgtcactgtttcccttgataccccatctatttgccacgaagtgatgggactggatgccatgatcttagttttttgaatgctgaattttaagccagctttttcactctcctctttcactttcatcaagcagttctttagttcctcttaaaacttatctatttatttatttgtggctgtgctgggtctttgtggctgcaagggctttttctctagatgtggcaagcagggcctgctctctgcttgctgtgtgtggccttctcattgcactagcttccctggttgtggaacacagctctagggcatgcatgcaggcttcggtagttgtggtgtgtgggctcagtaattgcaactcccaggctctaaagcacagggtcagtagttatggcacatgggctcggttgctccccgccctcctttcccccggactctgcatgtgggatcttcaggatccagggatcaaacccatgcctcctgcattggcaggctaattgtttgccattgagccatcagagaagcctttaccaaaattttttaaaattgaaatatagttgatttacaatattgtattagtttcaggtgtacagcacagtgatttagttatatatatatatatatatatatatatatatatattccttttcagagtattttcccttatagattattacaaaatatagttccctgtgctgtagagtaggtccttgtcgctacctattttatacatagtagtacactactcacccggtcttttaccagaatttgctaggcacttactatgtgccgagtaactgataccaaagtgaatgaaaccaaatcccttctgctacaatgctcacagtcttggatgaggcacgaacagtcatgacggacaactagaagcaggtaacaaagtatcaactcctccacggttcactaagcgaatatctaaaatgattcgttttcatcttcctgagaagaaggcaggtttttacagtgatttacttctggaaaaaagtgtctgtcctccaacaatgaaaaatttctactgtacagcattatttcaattgtgtctctgcaggaaggaacaagtccagaattaccaagacgttggttgtaatcaatgacctctcccaagataccttgaactttcctttgttgatgggaccttctcaaagtgagctgggagtcagactcttctggctggcccccatttcaaacatcacttaatcgcatgatgcgacagcttgttatcagatgaccctgtgctcatatacaaacacagccactatcaggcacagacagaccagaatctggcaaaaccttgatgaaacagaaataaacacaatgtgtagtgcatattaataaactcaggcattctggcacacatgagcattacagacaccctgcaaaggaaagtgccgtgaggctctgcttccggacgtgaatctgaccatcagtatcaacaaagacagataaaggaaagaggtgaatcttttgaaaccttgtatcatttcgatcttagaaataacaaatcttctcctgagaaccagtagtttctgcaatatgtcattttctccaaaggaggggccaaaagtatagcaaagttcttgccctcctgcctgagattttactcatttaaaggtaatcaaatggacttccccagtggtccagtggttaagactctgcatttccaatgcaggggttacatgttcgatcccggttggggagctaagagacca

SEQ ID NO: 40895 - DNA, 1171 bp, Bovine  19866880555450
cttacatcagaaaaataatagattaaaatgtatccttcttcctcaaaaaaaaaaaagacacaggaacatttatttttctttgctcctcaaatttgtcttttagtagttgagagcagatgaaatcttttatcactatatttagacgtcaaccaggcaggtcggtgctatggcaaccactgcacaaagagatgttagcaggacagacactggcaggctgggagaggtgcttacttagtgcatcacaagtggattaaagatatggcctggccacagtaacatgcccggctgctcctgggcccctacaactgggttggcgggccacccaaacaccactgtcgcctggtaccactgaagcccaagaaacagctgaaatgtggatgcaaatgaacctctgggttctagttctcccacctggattcaggctcctctgatccccagtaatgctgccttggccttaataaatcctattcactttgagtctcaggattatcctagatgctcacagtataataagatatggatataataagttcatgctcccacatctgattccatgggatttccacacactgatctgatggaggaagtcatccagtcaaataattgggagcttgccttttgcccgacactgtttcaggcactagagatagaaaagggaaaaaagacagcagggtaccatcttcccagcttcagttcactgggatcgagagacagatgatagaatacaagggtaaacaatgatagtaaacagatagggcatgcatccatacttgcttagctgtgtccaaatcttttgtgatcctttggactatgacccaccaggctcctcagtccatgggattctccatgcaagcatacctgggagtgggttgccatgccttcctcctggggattatcctgacccagggatagaacccatgtcctctgcattggcaggcggattctttacccactgagccgttgcaaaatgctatgtatgcaagcgatgaaaactacccctgggggcagtgttcacatggctgggctggagggaagactgacatgtcaagagctgagacttgagtgatggggggacaggccatccagctggcagaggacagctttccagacaggacagctgggcacagtcccccttccaggaatggacataggtccaatgtggcagaagagg

SEQ ID NO: 40896 - DNA, 1724 bp, Bovine  19866880593056
caccataattcttatacccatgaaatgttgcttccatgtccaatatatgtacagaactcacatgattactgatcgcaaggggaagaaaagttgggttaaaatggaaaagaatcattctgggaatcccctagaggcaagaggtggtctgaagacaccattaggtcttttctaagatgaagatgaagggagagagcatagttagaatatcagtgatggatcttatttagaagggcaagcatgcctttggggaatcagactaaatgggcagtcggaagagatgatggggccactcggtagctcagaccccaggtggtcacctcctgtcctgggttacatgtgacagcacctgctgatggccccactggtgtacatcttcatttggtttcctccttctgggtcttagttttctgcctgtatgatatgattggtcaaaaataatatgggtggggggaggtgggagggaggctcatcagggagggcatataccatacacatattgctgatttgctttgctgtacagcagaaattaacacagcattgtaaaacaattatattacaataaaaataatatctaaggttcttttcatgtttaaaactctgtcactttaagtaacttaaatgtgcattaatttttttttaaacccccatccttgaaaagtagaggaggacaaaaaagaagcaaatgtagaaaaaagtatgggaagcctattgagaatctatattttttgctgtcccccttgactccccactcctgcagcacaagaaagtacaatatagctcccattttcagcaaagttccattaaacatatactgagcctcaaaaacagtgtttggaagtctccaggtccatatgtggaagtctactttctgcagatattaaacaaaaatctttaaaaattaacctttatgttctttcgaaatatagatcctgctcttattatgggcttcccagatgatgctagtggtaaagaatccacctgccaatgtaggagacgcaagagaagcaggttcgatcccagggtcgggaagatcccctggaggaggaaatgacaacccactccagtgttcttgccagaaaaatcccatggacagaggagcctagtgtgctacagtccatggggttgcaaagagtcagacatgactgaatatacaccctcttataaactcttttctgcttatccggcctcagagtatatgcaccagaacatgtgttctcaggtcatcactgtggtgttgtataagtgggtcaaaggggatctgcaaggtgctttccacagttgacggtattcacatccgaaacccaggaactggtattacttagcacatagagaatcttaagcttaattgtataatgcaacttattttgtggcatttccaatttttccaatgaaattaaaccattttcattaaagcccattatctaagtatttgaagctgacgttcaaagtgttccatatcaccgattctaagagatgtgccatatagacttgggaagccagaattccttctgtgcttcatgtggtgaggtccacacagctggagggctaccattagcaaataagaacagtgcttcagaggcttaaaaagaaatatccattatatcaacgagaaggctgttgtcagaactagatttgcttttaaattaaaagcttgtcccgggttacactgtcagtgatttaatatgctggaaattgaattaaactttatacaaagagactgtatc

SEQ ID NO: 40897 - DNA, 1806 bp, Bovine  19866880818937
gaggagaaggggacgacagagatgagatggctggatggcatcaccaactcgatggacataggtttgggtagactccgggagttggtggacagggaggcctggtgtgctgcgattcacggggtcacagagagtcagacatgactgagcgactgaactgaactgaactgaagtttccagaattttaacaaaacatctccaatagtcttagctctgacatatgatatatacactcataattatatcttttaagatcttttgagttcagatgtttattttccaaaattaaaattatgtaataatttacataaacataaaaattggaatcagataatttaaaggaatttcaagtcacctgatacaatgtcttcacttattaagtattcctaattaaagtaactgggagaaggcaatggcacccccagtccagtactcttgcctggaaaatcccgtggatggaggagcctggtaggcagcagtccatgaggtcgctaagagtcgaacacgatgagcgacttccctttcacttttcactttcatgcattggagaaggaaatggcaacccactccagtgttcttgcctggagaatcccagggacgggggagcctggtgggctgccgtctatggggtcccacagagttggacacaactgaagtgacttagcagcagcagcaattaaagtaactaagttccacagatgttaagtaaattttgtaccacccagcaacaaataaaaacagtgctagactatacacagttcctggtgaacataactgagataaactaagtatatttaaagtagtatgatattcagtctaattttgccaggtttccttggagtaaacatcaagaattgattaacaagaaaactaaagtaataaaaaatcagggaaacacactcaaccttatatcaaaaaagagaaaatgaggcagtaaaattcagaactgtgaactttagtaatattatactctagagtgtgaattactctcacccatatttgaaccaaagtatatttcctatcttgatcattcaaataacaatcaaatttagatttaaattttacttatctggtacaatacatatatgttaaatgaatgtctattttttaaaatctactttaaaacaagaaattctacttaagtttcccaacagtaaaaaggcatgttaggctaccaaatcatcttggtagacaatcagttaggaaataaaaatgctggtttaaagaactgaaagatggacaggctgtctttaacaatggcagaagcaactaaatggtaattacaaactacagagctgggaaaaccctagctgttttctgtagagtaactgtatgttagcgcttgtttgaataaagtgaaagaaagctcttcagcttttgctgccttagaaatgcagcaaagagttcaaggagatcaatactcgctaaatgtacaaggaccaaatcaatagggaaagaaattgccttttccaacaactacgatgtgaaaagatgaaaggtataggaacagaaataaaactgaaaataatgaaatatgaagtctgtttaccatatgtttttgcacctctttaaatcactaaaaccttaaccttggaagggagtgttgtaaaaaccatagtagaatctaaagatcatgaactggattcatcttttagtttataacttcaatcaatcaacaccctacaagtcactgagttctactggacctccagggtcagagggaggagtagatggaaatcatagaaagacgtctcggtcctcttctagtctataatctagatgaagcaggaaggccaacacaccaaagag

SEQ ID NO: 40898 - DNA, 1203 bp, Bovine  19866880832635
ttttggtgacacttccgcaaggtatacaaaaatttaatcactacgttgtacatctaaatataattttgtatgccagttaaacttcaatttaagtttaaaaataaaatgtacttttatcataaaaaaagaaaatttggcagttgaaatgtggatatcattcaaaaagtcttcaagttttgtgactgacaaagaagatcaagttaaatggtccctaggatccgccaccccctggagggtcaggtgtgtcagcccaggtgccacttagcactgcaattcctgcatatgcctgacagagtcagtgtgaaatatcaccagactccaggtttcaagtccaccaaaagataagtcaacaaacaaatacataaatacaaggaggagaagaagataaagaaggatgcaggggaagaagagagaagataaaaatacaaagaaaaaagtcatacaaacttgtcctgaaatcaaaatgacacactggcatccatttagctgatggctgataatttgtaggtccacatagacatccaacctgtaaacactgaaaaggcccaagataaacattcctgctctactgcacactcacggtctcgtgccagcccagccagctgagtcttggctccctctgctgcttcctcccactccagcccccactcgtgtttctgcacagacccccatgccagcagagccacctaccagccatctgccaggctgccttcctgccctcattcatctgaaaaagtatcttcaatcccactccatcaggaagactaccccaatttgtgggcaggattttaagaatcggtctcaggaatataaagacaagaatgttttatactttatatgaagagctttaatttcaaactctcacaatctgtacaatagcattataaggtattattgtacctatttttacaaaggaggaaattaaaacttagaaacattatttgtccacattgcctagatagtagagatcaaagttggaactcaaatacaggccttctaatttttgctggtttaaattgttttgaggctttctaggtagctcagtgggaaagaatctgcctgccaaggcaggagatgcaagttcgatcccttggtcgggaagataccctggagaaggaaatggcaacccactccagtattcttgcctggaagatcccaggacaagagagcctggagggctatagtcccatggggtcgtaagag

SEQ ID NO: 40899 - DNA, 1529 bp, Bovine  19866880849393
acactggaatgggttgccatttccttctccaatgcatgaaagtgaaaagtgaaagtgaagtcgctcagtcgtgtccgactcttagcgaccccatggactgcagcttaccaggctcctccgtccatgggattttccaggcaagagtactggagtgggctgcctttgccttctctggagccacaggtctagcggtgctttattcttcaagccacagtgatggtgtcatttcccacaggtatgagtaaatggtagattgaactgtgcttgactttataaaaagctctttctatagttaccttttaactttcaacatcaaatgcagaatcaaactcattgtaaacatagagaaaaaataataattttatctcctttctgctctctcttttttctttccctcagatggcttccatttatgtctcagggcataatccatgcagagattgacttggtcttcaaggtgaggatcaatgacagctgcagtagaagaaagtacaagctgactttggtacaacggacatcaaggacactcccaggtgtccccagagcattcccttccacagcttatgtttcacatcaaattatacacagaagagtgtgtaaggtgtgtctgggcaatgcacaggcactcctgtgagttaacaatcaacccaaggatttgcttccatttaagagttaaagtcacacttttttttcctatcacttataatgtcattaaacagatctattattaactgcacttcacttttatttttgcagaaatacaaataaatcatcaacctgaaatacaagaagcaaatggcaaatgctgttgccacctttttgtctatttaatcatctggaaataatttatttctgttccaagattacctacctcaaacaatttttagtatattctgagtttaaactattgactaaaaaacacttaaaatgattgtagaaacaggtattaagtcatggtctgatttataaactaacaaaagccacattagccacagatgctttttcccttcaataatttaaatatatgggaaaataattatttttcaaagggttaatttctattaattatactcttttttttaccactaactttgcatactgatttctcagttttatttttaagtcttttgagtttagctttttctattagatcttcttcaaatcaacctgtgattgttattaacatgtttacattttaaaggtgatccaagtggggtcggtaaatacatattccttaatatgcatgtcaagtcatcaaacctctatgttttcaaaagtgtttgtactgtgtatgataatttgaaactaggcagggtttaatgctgacattgttgtattcatgaaatcctatattgaccaggatggccactgagatgaagacatgacattcaagctgataattatctttattaatattagaaacttcattttggcttatattttactttttgttttttagttatttacagaggaaaggctttatgtgtattaatataaacagaattttactaatgtactgaaatctttta

SEQ ID NO: 40900 - DNA, 937 bp, Bovine  19866880987662
aaaattgtgtttttgttggagatggcaagaggacgtgatattgatggcatcatattgatgacatctgaaagacaagcaccccttatgtaaactaggggaagagaaaaaatttgaaaaaaagaaacctacttttgtgagtgtgagggatgctcatgtatttaaatgcagcatgcacaaatgtacattactttatgcctggaattacgaggctgatactgaatactcctgacattcccatctaattgaagcctgtgtgaccctgagtgtattcatcacaaagggctttccagacaattagctaatagctcctgtggggcagacccagaacccaaagggtgtgattatcattaagctcttcagacctgaacatgctgtgtagagagacccccactctgtgtttgtcacaagaaaaggactgacatctttaacagctcaagtgaacagaaatgccaaattgacatgccagctgtgaaaaccttcagggttgaattattattattactgcagcagctctttttgtaacgtggctttgaatcatcctccagctttagcagagggtcccgtgccagcagttaattacaaagttcagccccaagactactcccgctactgagatcgccagccggtgaacgcagtcttgaaaatcactttcaaatttgccaactggcctgacatgagcatccttctctagaggatgaaggtgaaattggcaggtgggcttgcagatgaatgtctgctatttatatcatcacgctacctgtttcaacgcttaacaactgataaagaggttttcttcctagtctcacaaagaaaaacaacaagatactcttagatacaggcttgtcaaccttccaaggtgagttttcatccttgctctttttttttctttaccgccaagacaaagggatcaggatctaatctgcttacaatggtgata

SEQ ID NO: 40901 - DNA, 1150 bp, Bovine  19866881038884
tttcctttcttcattgtaggaaaactgcccaatcttttctcttgaacctcagtttcagatactaaggtcacactccctatcacagacttcttctgcctcactctccttggtccaggtgtagggggcctgtagaaacgatgcttcactcgatcctgagttccctgggtggcatctgtgtccagagcagggttctcccagctggtagaactaccagtttcaacatcttgatctttcacttgagtgttcgcctcctccgctagactgtccacctgactaccacctttctccagaggtgagacgtctgcggacaatgaacacgcagtaatctttacaccagatgatcgatcatccgttctccctgggagactgtttatttcacttttttcaccattattggacagatcagctctacagagagtggttgtccattttatggtttcctcctcttttatcttgaatcgaattttcatctcaactgtcatagtaccatcctgattaaaaataattgatttctcaacatcatcttcagaaggatatatcaataaattctgagaatcatttttttctaatgccaagtaattttcagaagcaaaagaatgatctgagtaggaatcattattctgcattttctcagaagaaagagaataaatctgagacgttgggcttgaagatacatgtgtgctcactttcaagattttaaaagtaaaacacaacgtggaagacagagaagtcataaatatccaatagaggacgcagcaaagaaagaaaagaagaaaatgaacgattagtatgaaaaataccctattttctaaatgtcatagtatgttgttaagtttctcacctctatgtattcatttggtcactttaattcatggtaatatctggtacatttctacaacatactcttttaaaaagaacttaaattctactttagagaggaaattcacagaattgtacttaagtcttaatgagtttaataaggtaattttaatacagaaagtataaagtagaaactgctaaggattctagcaaaaataaagaggtttctgtgaggtttggttttgctgtattattctgtttcacagtactggacttggggtgtaatccagtgctgcttacctatccatacaagcaaggggatagatttttt

SEQ ID NO: 40902 - DNA, 2784 bp, Bovine  19866881141513
aaattcgcctacattctcccattttcccctcaatctcagcttctttttcagtccaatctattatcggtccagataatttttcaagccagacattgtcttctcaatatacttgtaaattttactttgcaaaccagaaatgtaggtgtcaattctagatacacaaagatatcaaatatgaatatgctgctggctgaggtgggtcttcataggcaatctgattggatttcggtgtgtacttctagagcctgagagacaataaaaaaggaaaagacagtctcgcacagacaaaaagcactgcattactattattaaactttctttaaatactgaatgcaagtctagtaattactaatcaaacactgttattttcaagcagttataccttggccaagcacttgttccttagagagctgaaatggaatggagagggaaatattaactatctcactcactgacacaaactcagacaagtgcatttattcattctgtcttcatccgtctgctcctttgttctttcaaacgatgccctttggcacctattgtgcaccaaacaccgaggagagcggggaggtgtctctgaaaaagacaccatcgtcttgccatggacctcacagtttatgggaggatggaaccgcacaggcggctgtgacatgtgatacacttacatgagaggtacttacgatgaactgtgcaagtccagaagaaaaaacatttagttgtctggtagctaaggtttcctggctaaagaggagtttgctgagcaggaaaaaggaaagagggacagagcacagagcgggtatggacagagggctcagcctcagtgctgtgaagacacagggtctgctgatgaaaatagagatggtcgggtaggcatgggctgggggccctggtaggggtggggggatttcagttgaggaatgggagaattagggaggatcccacatgccttgctaaatatgactgatatcttcacaaagtgcaccccataactgctggatgctacagttctattttatctatgtagtctggaatagctaaatctaaccctctattaacaacttcctccctcccacttcctccttcagcaactcatacagtatacgaaaacataccagcatcactctgcaataaatctgctgtgtttaacttataagcacagatttgcatgtaaactgaaccaaaacaagaagggaaggaaatggcagaaaaacgtggcttgcagttccacttacccaaagtgcttgaaaagcgtagcttgcagttccagttacccacagttgcaaaatgtgctttatgataaaactactgttctgattaattttaagactcaggtatatcaatcaatgataattagcaagtaacccatgagtgtttcgatcatcttagagctgtacagcataactgaggtcatattgaaaagacggaggctttatgggggcaatccaggaatataaagccagaaggggaatggtcagtgctagggctaaatctccaagttcatggggcagggtctgactggtacaccatgatgtacagttggaaggcaagcatttccttgacagatagcagatcaatgtggtttccccttgtgtgggattattgccaataaatagccaccatgggttttgataagcaagcctccttggacccagcaccgcatgctgttatacaaggtgcttatgaattgccccatcagacagccctgcttctgcagcaggttgcatagaaccaggctcaaatgtaacagccaactctttcctagttccagggtgctggcttctgccccacagtggcctcagctaagctataaatactccaaaaggcagagcctgtggcagcttctgaaatgctcttttcagctggtgaccaagaggagaatgatcatcctgttaactatcaaaaccgatccccacgtcgccgagagaaaccctgagcaacattacgtaatgtctaaatttaaactctgtctccattccaaaggctccccatcgccccctccagacccacttcttttcttcctttctcccttctcactcttggtgtgtatgaagctggtcaaatgcatcatctctgtgaccctgtcctggtctctggcctccctgtctttccccctgcttcacatgctcagggcagctctttatgacaggactacaatttccttcctcactggcccttaatctaaggagttcaattgaaaatgagaactagctgactgaagtaagcaaaggagacaaattagtgagacaattcagtggacaattaagaatattcagatgggtcagcatgacatcacagaaacttggatggtgtagacacagccagcaaacacaaggaaaatggctgtctgaggaggccttataaatagctgtgaaaagaagagaagtgaaaagcagaggagaaaaggaaagatataagcatctgaacgcagagttccaaagaatagcaagaagagataagaaagccttcctcagcgatcaatgcaaagaaatagaggaaaacaacagaatgggaaagactagagatctcttcaacaaaattagagataccaagggaacatttcatgtaaagatgggttcaataaaggacagaaatggtatggacctaacagacgtagaagatattaagaaggggtagcaagaatacacaggagacctgtacaaaaaagattcttcacgacccagataattatgagtggtagtgatcattcacctaaagccagacatcctggaagtgtgaagtcaagtggggcttaggaagcatcactagaacaaagctagtggaggt

SEQ ID NO: 40903 - DNA, 3270 bp, Bovine  19866881172341
aggaaagggaagaatttatgacacaaacctgaagctgtaggaatgagcagttcagtagacaaatgggaaagtttgggagaaatcagcaaagcaattaagaccccaggggattgatttgtgggaagatcagtcctttgatgtctagcctggctaatcaatgattcttttttgccttttttttgatgtggactaagggacaagagaagagtaagagattaagattaataacctagaaatacctggaatacataattttacaggacagacaggaactccttttggattgtccaacataatttagtaaacctaagaagttaattcaaaagtattgtgtcacaattttttaaatcccccagtcagctcttcttatactgaatatacattcactgactctttgttagtttaaaatagaaaaaaaaattacaatttaaattcttactagaaggatgtttgaaatatgaaaacaattgcctttaagaaacaatgaagactcaccacaggagatatttaaaactacatcaacactaacttgaatcagatagagatgaaaggactgaatttgtctcttccatttctggtatataaaaatttttgtgggaaacgtgttttaaatttttcttaacatattctcctattaaacccctctaattagtataagattaaggtttgggggctgtgattctgacaacagaaaaactacttagctcttacttggctttttaaaaaatgaaaaggctgaagttagagaccagagctcaggaactgccttgtagggtcagtaccagcatctcgggaccaggctagtacctgcttccactgccgcccatctggtcatcccctcactccttggactcttctccacatgcctctcgcaggcagaggagccttctataagtatgcattggatcatgtcaccttctccctctgaggcttcccattgtactgggatcaagaccaagccttgaccgcacacctttgaggaccaagcagaccacgatttccctctgcatccctcacttcctttctgaaggcgccctctcccctgcctgatggctcttcccccagatctggaccaagtccacccttcctgtgcccctaccctgcaccccaacccgtctcactcagcagaggtgcccagaccgagcagctacatcgcatggcagcgtacaccctcccttccggatttctgtggagtatttattgctctcctgagtcatattatttatccatgtatgcatttattatttgtcttctccagtgttagttcatcccatggaggagcaaccttgctctctgaagcagcacccccagcatagggcagcatcagacttgtatttgctgaaaggaaggagaggggaaggaaggcagggagggagggaggaaaaagaaagaagaaagggaaggggatttccccggtggtccagtggctgactccttgttctcaatgccaggggccagggtttgatccctggccagggaactagatcccacatgcttcaacaaagagcctgcatagccaaataaataaataaacaaatattttaaaaagagaagaaaaaaggaagggaggaggagtcactcactgtgtggtcacaaggggctctggagagaagcataaatattactatgagtctctgaaaagcagagggtaccgtctttttgtgagcaacgtatatatgcctggtgtctagcacataactcaaagatacttgagagtagaaatttaatagtgggttgacaaccccgttgaggatggtcttacacaggtcaaagtgcagtaacagctctgcagcctggtcctgctctagggtctctgcaagatcagtgctggactaatccttgcagcaacccaaggagaggcaccctgggtgagccctgtttacagctgtggatgcaaaagggccatccacaaaggtagtgtgtgtcccagggcataagagcatgagtacagggccgggtctgaggaaacggcctggctccaggatccatgcacataattgggagcatctcatcactcaatgcggtgtgatctcatcatcatcaggacacgaggctcacagatggggtggtggggagagaatagcccagaaagcaggtgaggagcaggtgggggtgggggagccatgaggcaggtgtggagaggcacaggtggagagatcttcagggtagatggtccgggggagtggtaaagaacccgcctgccaatgcaggagatgcaggagatccctgagtccggaagatcccctggaggaggaaatggcaacccactccggtattctttttttttttcactccaatattcttgcctggagaatccgatggacagagaagcctggcaggcttcagtccatggagtcgaaaagggtcagacacaactgtagcgacttagccagcacagcatatttctaggcaaaataacaggtttttaagaggttgtctgggttgtaacctatagggatgcatcttgaaggctctgttggaggaattcacacatgggagaatgtgttggttccaagggccagcctggcccttgggtgttccctccatgaggagactccgtttctgaaactgagtcaagtcctggctcagactgcgcggaggcagcgaggcctggaatagacctgccttcactcaggcacccggcagggcccctccggcaacctgggcagagtgggcggctgcctcgccactccttggggctcccagagatttccagatgccttatctgggccctggagtcagccctggggcctgactcaccccttctcttgccagcagatcctggtggcccacaatgtgaggaagtcagcagaacacaatcaattggggaggccttttgtgtggccgtgagcttcacttttcctgactgtaaatagcgcctccgcagtggcagcgccatggcaggctcacttctattttcagttctgcaggctgagcttctgtaggttttggttaaaccaaatatccagggatgtttcctttcattaatactgtgacttcatctacaaagtgatgacagcacccactcctttcaggaattgtgaaaagctgccttccactcttatacatcgacacatggccatccaaacattttcatcttaaatttaaatagttgcaaagaataactacaatatatagtgaagctatatgtaaccttgttctatgtattttctgaatctcctgtcagcgtgttaccatacttccataatttaaaacagaaaaagaaaataaataataaataaataaataaaacagaaaaagaaaaaaata

SEQ ID NO: 40904 - DNA, 938 bp, Bovine  19866881276537
aaccgcccattgaaaatgtgatcaatgaccatggaacatgcagtcttgggggaggatccaacaggtaagttagtgccaggtgagccctagaatgaggaagtcaggcatctggcctgagctaccttctccagctcgggcccaacttagtgggccttagcagtgatcaactcatcatgctgaaggcttctcatactggcatcgagagcttactaattaatctctttaaaatttcaggtttcaaagaatgaagcaaaggccatcagagatcaaaggaaaagagaatacaccatggattcagctagagatgatcatgctaagtgaaattaagtcagaaggagaaagacaaatatatgatatcacttatatgtggaatctaacatatgacacagatgagcctagctaggaaacagaaacagattcacagacatggaaaacagactcgtggcttccagggagcggggggtgtggtggagagtaggggaggctggactgggagtatgggggtggtagaggcaaactattacgtatcggatggataaacaaggtcctgcctgtttaacacagggaactacattcaatatcctgggataaaccacaatggaaaagaatgtcaaaagaatgcataaatgggtatagctgaatcactttgttgtacagtaaaacttaacacaacactgtaaatcaactaaacttgaaagaaagaaagagaaaatacaaagttaagttattatttcctgtccaggcaaggaaacacacagcaataaggaaatccagagtacttctctcagggggcaagtcaggggctgaaggtggtggatctaggtgtggtgattatgttaactaaggaatgaaggctagcactctgggaagggcagagtccagagtaaaagaagggtgaaaacaagccgtattggtcaagaaccagtgttcagtgaggg

SEQ ID NO: 40905 - DNA, 724 bp, Bovine  19866881420046
gttaaaatcaggaaacggatccaacatagagtcagattttctgttccctgttacataatctcaatgatatttcttaaaaaagagtggcctagagtgctattctgttggggacagaaagcatttttctgggacctgcatatccacaatcactcaatgtcgtggtcctggagtgactgtcaggctctttcccaggtgggtgcttgggtgggtaggacaggggcggtactgcatactttttgaagatttgtttagttatgagggcagaactctgatctgttccaggcagctgtgggctgaataaggattctaacacccccttctccccccatctccgtttggtactccattagtttgtatacatcattggtgcccaacagatggttggtgagtatctctttcaaaccgtggaggttgttaaattaattcaatctgtcataaactcagtgtatggaaagaacagaacttcatgttgctcatgtcaggaccacaactctttgattttttccctaggttcccagtctgcaggctgtgatcctgagctctggagctgtggtggcagcaggaagggaaccgtttaaaccaggaaattatgacatccaaaagtacttgcttcctgctagattaccaggcatctctcgtcgtgtgtaccccaagggaaatgctaggtcagaaagcagaaaaagtaagtcacttaaatatatagcccttatttttagccctaagt

SEQ ID NO: 40906 - DNA, 1561 bp, Bovine  19866881662064
ggatctccccacccgggatggaacccggtctcctgcattgcaggcagtttctttactgtcggagccccagggaagaccctagaattggaatcgaactgtaaatgtttttgtatcttatttttatttaccatttcatgatgagtgttttcttatatcattaaatagttctcaaaaccatgattttaatgccatattaatatttatgagtgaatatttatataactctcacattgtcactaatgttactgtcaaaatagaatgaagaatcttgtgagtaattttttgtgtgtgtgtatctctttctttaaattcccagaagcataattgctgggtcaaaatatgaaggtttgtaagcctcctgatagtgtttcccaggtggctcagatggtaaagaatctgcctgcaatccaggagatgtgggttcaattcctgggtcaggaagatcccctggagaaagaaatggctgcccactccaatagtcttgcctaggaaatcccatggatagaggagcctggtgggctacagtccatggggtcacagagtcagacaagactgagtgactgagcgcgcgcacacacacacacacacacacacacacacacttcctgattggatgccaccttgcccatcttctaacccgtgtcttcttacaacaaaaaaatctacttaaatgaaaataattcccactctagcaacaaggaaaaaaaagtagttttgaattaaccttagctagaaaattgcctagttaagggaatattaacagaataaggtgctttcaacatgaactatatttatgaaagaggaccttagatgtcagattttccagaggttaatgagtagtaagtttgatagtttaaactctgcttaaagctagatgacagatacagtataattttagagggatctccagagagttttaaggcctgattcaaaatctggtaatatgttcattatgtaccatttatcttcccttcatagaaaaatggcaggttttatatagaccctgtattgaggaaaaaatgaagaaaatattacataggctgtgtattaaatttagcattaaagttttcctgattttttttctatttaacatactagcttttactcttttgaaaaactcttcaaaaaatgtgttattgaatagatctatataagatgcatcaatgtaattactggggacatcccaggcagtcccgaggttaagacaccatgcttccaatacaaggggtatgggtttgatccctgcactgggaagatcccctggagaaggaaatggacacccactccagtattcctgcctgggaaatcccatggacagaggagcctggtgggctacagcccacaggatcgcaaagagtcagatacacctgagtgattaatacacacaggggaactaagatcccacatgccatgtgacatggccaaaacaattaaaacagaattgggtctttaaataaaaatacaaacaacaataataatgtaattattgaacatttgaatggttttcaatttttcattactgggttaagagtcagggaattcatgtatatattctttccat

SEQ ID NO: 40907 - DNA, 951 bp, Bovine  19866881712262
tgtaaaaaaaaaaaaaaaagcttgcttagttatactaatcctaaaacaaaaactaaactaatttcaatttaattaatattaaatctaggattaaggcaagttactccaggaatttttaaatattaaaaaaatagagtgctttgaaaaaaaatgtctattagatgatattaattccagagtcatttatcatcttctgagcagctagagatataccagacagagctccccttaatggccactcaatccatctgtctccattaaaagaaagaggaagtgttttatttatagaagactaaaagtatccatggctgctttcttctgtgctttaaaatggtgaagaaatagaagttgcttcccaaactcttcagcacaaggcagactttattgatcggtcctaagttaaggcttcccaggtgggcgcagttggtaaagaatccgattgcaatgcagagacacaagagacaagggttcgatccctggattgggaagatcccctggaggaggaaatggcaactcactccagtattcttacctgggaaatcccatggacagaggagtctggcaggctacaatccatggggtcacaaagaataggacaggcctgagcacaagcatgcaggtaagtcaaagatatcaaagcctagaaggcagtgaccccagatcaccacctgatgggaccagcctctcagggaaagtcacatgtacttaagtttgaaggactccttgactctgtgacacagggtgtccaacatacagcaacttccttagaataccagggctgaattaggattaaaaaaaaaaaaaaaaaagcttttttgaaatatttatagatcggtaggaaattgccaagatatctcagagaacatctctgtaccttcacccactcccatcctccaccactgttacctctcgggtgaagtatggtatcagaaccagtaagctgacgttgat

SEQ ID NO: 40908 - DNA, 1621 bp, Bovine  19866881715329
tgaacctcaagcccaggctcacttaaggcatcactgtgctcacttcctgcagatcaatacacagatcaccatttcagacacttagatggtgttcaaccaaagtttgtcggattaatgaaataatcaattttgacaattcacaccactttttgtccttgtgatatgatcctggtcagtaagagagatgcctgtcttttgagtgtaggtaaaggagcaggctgggcttcccaggtggctcagtgataaagaatctgcctgccaatgcaggggacctgggttggaacttggaagttactctcccttctgaaaagttatgatccccaaggacagtctctgaaattaaagagcaaacttgccacccttacaacttggtcatatttgagtggattttaaggtgaaaacacattttgcatgttattgaccgataatgaatatggacacactgatcaatcaggcagatgtggtagaggaatgaatccacacagtcgctgatggaaagtattctttattagtaatggaaaacagatagactaagcagggcctatttacacatgaaaatcaaatccagtatcgaagagaattaatatgacacacagttaatgaaagacattaattaaacagagcacataacaggtcacaacaaagaggtttagtataatgaacactgatattaagtaaccagattatactccagcgactggagttaaaatccattcccggccctactgtagtagcacaaagggaaattatacgaagagttattatcatgtcatgatttgtctacacagatcctctcagttgttgttctgtcgctaagttgtgtctgactctttgtgaccccatggactgcagctcgcttccctgtccttcactatcttcctgagcttgctcaaattcatgtccattgagtcggtgatgccatccaaccatctcatactatgtccccccttctcctcctgccctcaatctttcccagcatcagggtcttttccaataagtcagctcttcgcatcaggtggccagagtactggagcttcagcttcagcatcagttcttccaatgaatattcaggattgatttcctttaggattgactggttggatctccttgcagtaaagggactctccagagtcttctcagtcctcttagaaagcacttgaattattaggacacagagaaagatcaatttccaggaataccctgtggttttctgttggggagaaagcttacagcctatgggagattgtcagtcagtaatcagtcctgagtctgatttttaagaactaaagttttcatcttaaatttggaattagtgttatcacagcatatagactttatattaggcaaatgatggttgtgaaaacaggatgggtcgggacaaacatttggtctctagggaaaaatcaagagcgcttaggcaagagctgggtctacatctgatatttgaaagttcaggtttatttttctagttaatttctccaacctctacacttttatttctgatcgcagcaagaggcagatgccaaatcttctgagagaggctgttcacagggtatttctagcctatctgaaaataggaagtgctagaaatttcataggaaagtcagttcttgttagcttt

SEQ ID NO: 40909 - DNA, 1680 bp, Bovine  19866880341638
agtcttttaaatctattctgatttatttactgtgttgggttgaagaaagctaggttgagttgaaaatattcaaatagctatttagtcctatgttagcagacctgttgcattaaaagctttctaagaaacatctttaaaaaccactctatttagatgcatatccttaaaattgtacattatttttttgtctaaaaatgcatctacttttatcaccaaacactgttttatgaaaaaataactttattcctcttatttttttaagttggttcttttttttctggagacttaactagtatttttataatttcatgagaaagtttcttctgaaaccacacggctgaatgactttggaatcaatggggaacagataactttgtaaaataccaagattcttatttcatgcagataattggaataatgagactgaaaatgatagaaaaccttgggtacaaaacttttggtgatcatgtgatggcattggctactgtttaagagaattaaacttttatatttggcataatactatctgtaacccttgatctcttgaaatagtgttatggtttagcttaacactagtggtgtttggctttaatgtgtgggtcagtctttaagcacataatgaagcaaaaagaatggccctataagccttatttggcagttctttctcgtttgtaacttagagtgctggaactcaagatatggatatatgtgtgtgtgagagagtggacacatgccttatttaaaaagaaaaaaatatctttggaaaaaagaaataatatgtatgaagttagcaccaattattacctattcttgctataagttattgggtcaattagtctaaaatataaaagtgattgtcaatttgttgttcaaaggaaacttttttgataacgaaagtaatacgtgaagttttaggaattttgtaaaagaaaagtaaaattaaaaatatcaccagtaatttctaatacaatgacttctttccttctagcctctgttctaaattatgaagatgacagacatatttttgaaagttatgatgatactgtatagatgatttatgtgccatctttgctttgttttgttttatacatttaatgcagttatacatttagtgccatttcctataagacattgaagtttttagagttggacacaactgaagtgactgagcacagcacagctggataaaagtataatacatgtcctctgccacagatagtattataaataaatactgctattgaacattttccctataagcttaaaaaagagttgatttttttcaaagtatagtatgtgtaataaaaagaacatttactatgtacctagttttatgataaatgtttgtaggcattactttgtttacttttttttaaaatattcctttagcttggcattagtttcctaatacttcagttaggaaaccatgatttaaagaggctaaataaaatctttaggtcatgaaactggtataggactgagctggaatttgaatagttatgtcttattgcaaagccctttctcttaagtatttaaaagtaatacctgttttatgcaataaatttggcaaatatatttcaatgtctagtgagtatttaaaacatagctctgtaagcaaaaatgagtagagtgagctgtatatgaatgaagctagtatttcttaatttatgttaatttttt

SEQ ID NO: 40910 - DNA, 2239 bp, Bovine  19866881185564
ccaactggtatcacttaaggaaacatttcttaaaggtctgaattaaaatgcagtcgaacttgctttaaatatggtttcttcttccatgcgagccagtaagtatattactgtggcaactcctatggccccagaacacagcctacaaagtgggacacagtgagagctatctgtccccatgtagataataaggtaggtgcattgcagacaaattgaaaacaacaataaaacttaaagtcttttattattattattattactatcatgcaagggtaattctcaacaatttccatacaaaatactcctccctgaaaacatcttttgtttgactaggttctacataattgctaaaccagtcaattctaaaggtactcaaccctgaatattcattggaaggacttatgatgaagctgaagctccaaaagattggccacctgacacaaagagcctacttgtaagaaaaaaccctgatgctgggaaagattgaaggcagaaggagaaggggatgcagaggatgagatgattggacagcatcaccgacttgatggaatgactttgagcaatctctaggagatggtgaaggacaaggaagcctgatgtgttgcagtcagtggggttgcagagtcggacacaactaagcaacggaacagcaactaaaccaatactgaatcattcataaatgacgtcatatcctgtaaccaaccctatattctgtaatttattctctattctcccctcaatatgtccccagtaaatgtcaaggtttcttcctttctcctattgttgctttactagtcccacttccttttcattcatattgtagggaataaaaaagataggcatatgtgcttttaatagaagagaaatacttattaaaatgtcagactattgatagggtagaatagtaattactttcatatggattgtaagggcaatgggaaaaatgaagggagcagcatatttatagaggtgatgaggaaatagtctagaaactgtagaagaaacagtcaatagtcattggctctctggcctcatcctgggaagtcatccaaatgtactttaaaactctgttggaattggaaaacctaatcacaccccacactgatcaatagtattcaggttgaaatgaagagggtctaaaatcagaaatgatcagagtaacggtgacctgtttgagagtcaatccaaggcctcatctctgttctcatcttttctgaccactcaaccatgactcatagagttgaccactctgtctccattattcctcagctatgcagaggacagactccactggctaccaaaaccttctgctcagtttccccaacattttctttattgatacattgtggttcatttccagacagacaaatctgatctccaaaggtatctgcaacaaaattaaacaatgccagtcacattcgcattcttggttgctgaagatttagtcattgctttcccattcctggttgctgaagatttattaattggaacagaattaaagttatgggctgatctttctatagaatgcatctcaatagtttgtttcataaagtgtatacattttcccatgggcttcccaggtggctcagtggtaatgcagaagatgcaggtgcattcctgggttgggaagatcccccagaggaggaaatggcaagccattccagtattcttgcctggaaaattccatggacagagaagcctggtgggctacagtccatggggtcacaaagagtatgacatgactgagacactgagcatgcacacatacattttcctacttagatttaggaggaatatgtctcctgctctcttccttctttatattaaactataaatgattcaagttgcagagatgcctgctttcagcaacttctcctgggcactactctgaagaaactgatgtatacactcattaaatcctgggctttgactgataaggattttctacgtgccttcttcagtccaatgatattaagacagagttctcaatttgtacctgtggtgatttactgttcctgctccaacagtaatgatggaaaatgcttttccactatcatttaattcgcctggaatcctagtagaaattagtcttccagatgtaccagcagaaaaaagattgagagcagctataaagaaccttgcaccaagactggacaattttaatagcacagcattggtattaaacactatcaataacggtagtaatcctttactataaatgggttagaaacagacatcatta

SEQ ID NO: 40911 - DNA, 1692 bp, Bovine  19866881655213
tgaaaaaatgatacttagatcgctgagcacttgtccaggtcacacaataaggagtcagaagttgaatccctttgtgtctgacggcaaagtcccaagctctaaaatgtaatcactataatataactatgctatagggggctatttatggctttttactcccaccacaaagtgcccccaagagctaattttttaaattctcgaatgatatctctactgattttcctatcatattatcaaaatctaatttatatttctcacagaaattagaaaacaaagcttattaaaaagtatgagcaaattatagctcataaattattactctaggatagcactttatttcaagtcttcttcagtgaaactttagtcttgaaaattatcttaagataatatgtcttattagtgttatagcttatagtatcatttaagataatactatctattctagcaaagtacttccttgaaagaacttgccacactgttttataatcgttgagaaaatgttttcctggttagattatatcctacctggggtaaagaatgagggatgatttgggtttgtattcccatttatagtagatccttgagaaaaatctcccccatgaagcctataaaacacaccaacaatgcccactggaaacaagtttttcttcctgtgggaagctggaggcattagtagaatgttagagtgtatgctaagttgctttagtcatgtccaactctttgtgaccctacggaacatagccctccaggctcctctgaccataggattctccaggcaagaatattggattgggttgccatgcccgcttccagtggatcttcccgatgcagggaattaaacccgtgtctctttcatctcctgcattggcaggtgggttctttaccactagagccacctagggagcccggtagactgtgtatattgtacctactgtcctaaacaagctgcctaggtctgtgtgccattacccaaaactagagtctgcacattgcaataaggaaggagaacaccaaatatcctctagttacctagaaattttttggcttcatatttctgttttaaaatagaaaaatagagataaattttctcagaagcatcacaactgaagtattaataaaaaattatgcttgaatgttatccaaagatccatatctgttcacctaagaaggagccagaaatcgcccctttgcaagttatttaagagaataaggataacttgaagcctagacccactgaaatagctgaacaatctcacctttaggcagagaccagaagtagttaacttctgaatattgtttaagattgaatttgaacagaaaataaatgaacagtaaaaccattttgtctagtctgtgtctcctgatatcctgaaatttctatttcattgtaatttaaaaaatcaaagcagagtgttttccagaaaagtctattatctctgacttgggcaaatgcgagacctatctagagatgacaagtattagctttaactatatctgtgatttattaaattagtgaatgaataaatgaataatggaaatgtaagttgataaagcatgtgtggttggaaaaaagaaaatcaatctgaatttggctttataaaggcagtgtttaatttatatttgaattcaatttgtttaaatgaatataaaccactagacccaagaataggaaaagctgattataaatgttaa

SEQ ID NO: 40912 - DNA, 1568 bp, Bovine  19866881656982
tggtcccatttactctgtcatggttatagacaaaactattttgagctgatatttatgtgtgcttattatgtctacgtaggaatatttttataattgggggaggagtccctcctaagcaattttgtacttatttttgccagtgtcctagaggtttcaccataccagaaataattttcctgttgagcagatgaaacttaaaacctctgtaagtgcagtgattgcatatatatattgctgttcagttgcaaagtggtatcttactcttggcgaccccatggactgcagcatgacaggcttccctgcccttcactatgtcttggagtttgttcaaacttgtgtccattgagtatatatatgtcctacagcccagacacaaaaataaaacaccatcttaacaggcatggtaagcagtttttattcttcatcatctttgtactatttctaatatattcacacagtaggatactatgtagtgatgagaataaaccacttataaatacatgacataatatggaaaatgtcacaaacaatattgataaagaggctcaatacataaaagtaaatgcatccaatttacatccaatttaaaaattaatagaaatgtagatagtggctactatgcttggaggcagcagagtctctgtgggatccgaagaggtgtgtttgggtgtgttaatgtttcttacttagtctgggtgatggctatgcagtttgtgaaaatcatcactttttctacattaactttagcatatattaatgctaataaaaagttaaaatgtaaatttaaaatgtgacccagaaatttcttttgatcaataataaggaaaattaaaacttatggaaattttaaaagattttagaaaatttaaatgatttaaaaagttactttggataaatacatcaaaaatattaacaaaggtctttttgaggtcttatttaaacattgaaacattctctctaggcctggaggcctagcctgaggctgggactgtccctagagcactgtcacaaggtcatgcatatttaattggatagttaattgaaatacacagaggaaaaatactttcccaaggttgacacaatggcaatattttcctttctaattatttgttccaatgtccctactgagactacaatattaatataggtcacacttttagccacagccacttctagttcagttcagtcgctgatactttggccacttgtagttagatgtcttcaattccctaaacccttttgtactacttctccttactaggcacactgacgtcatcggtactagtagctatgtgcttagagagtagatagatgaggatgcaatgcgaccataatccaggttttaaaagacagtcgtactggacaaggcctatacttttcctctttatctttacctaaaaaaaaggattccactgtcaaagtataaaggttttgatccgttgacctgaatacccagtttttaaagatccaagtagctagaaaggctattgatagccatgggtaaactcaccttcaataggaagaaagatactttcctaaattgtgccttcctaattccttgtagttca

SEQ ID NO: 40913 - DNA, 1618 bp, Bovine  19866880417689
cttatcctctgtcgtccccttctcctcctgccctcaatccctcccagcatcagagtcttttccaatgagtcaactcttcgcatgaggtggccaaagtactggagtttcagcttcagcatcattccttccaaagaaatcccaggactgatctcctttaggatggactggttggatctccttgcagtccaagggactctcaagagtcttctgcaacaccacagttcaaaagcatcaattctttggcgctcagcattcttcacagcccaactctcacatccatacatgaccacaggaaaaaccatagccttgactagacggacctttgttggcaaagtaatggtctctgtttttgaatatgctatcgaggttggtcataactttccttccaaggagtaagcatcttttaatttcatggctgcagccaccatttgcacaacttaaaaagcattgaaaaatcataattcacaaggtagtatatacaaagttatattactttataatttaaatgcttttcagggatcaaaccagcattgcaggctacagtccataggatctcaaagaattagacacaactgagaaactaacaacacaaaattcacattcaaaaaatgtaaaaattgaatgtttgagttttacatacagtcatacacacaaaaatgcactttaatatatattcccatgagtcgtggacttcccttggtggtttagatggtaaagaatctgcctgcaatgtgggagactggggtttgatccctgggttgggatgatcccctggcgaaaggaatggcaatcccaatccagtatttcttgcttggaaaagtccatggacagagaagcgtgaaagctatagtccgtgggatcacaaaaagtccgacacgactgaacaactaacacaaacacagtatcaggctgtgatctcagtccttgacacactaacctgaaaatgattattcatccactagatccatataacatttatataattttgtggggaaaaaaagtaattttctgatactgtcaattgtatcccctccagtaaacatagtttacaatggcacaatgaaactctaaatatattctgcagtgggtaacaaatagtgcctgccaaagtgtaatgctagtgtctcccttcaatgaacaagtttcattaatttgctttaaatttggcagagggctggcttttgggaacaggatggcagatacttccttatgagtccagctggtactcataaatagttgaattcaacctagtatatatacaccagacatttgtccttataagactgtatgtcaagtatagacatgcaatctaatagacacatccagaggccaaataggaaatcagttctgtccatcctcttctaacccatgagtaatttaaaggatgttgccccaaagtagcaacatcttcctctgcttcttatgaaagattaaaattaggttttaattaataaattcataatgagatgtgatattcgtccaatatgattccagactcagaatggccacatctgaaatacacagtcacagctgaacacattagaagaaaagtacacagttcctataatgacacatgccagtgtttggtttgcttttatttttgtggcaaatacttaat

SEQ ID NO: 40914 - DNA, 2243 bp, Bovine  19866880717924
ggaactctgtttgaagaataaaaatggtttatggagataataaatctgggagagggggaactgaaaatgtcaaacctctggcctaatgtttttgtaaaatataaaagagaatcttaaacttgaaaaaataggcagttcaaaagaaaactaagaggctatctcattcgctgacactgtccatctcttcaggttgaatccctggctgctagagctggactctggcagaaagctgcacataattctcttgttctcattgtcttagattctcagtgaaaatgacagacaaaaataaaaaaggtattgaaaataaatacaaatttgataaatcctggcttttttcatatttcccatgctaaaacaaccgtgcactctgtgtttcatttattgtccattttcacagcatgcatcatactttaatttttttgcattaactattgagtcacttagcttctcaaatctcatgtagatgtctaagtttatttttcttttttctttttttggctttctggtttcaaaagtagagaaagtttcagcgaaggtgggtagcttagagatacatcagaatttgggggtaaatcttatctaaaagtaatttgcatgcacaaagaataatgtggacagaacacttggaatttgtcctgaaacattagatccctgtgtaggactccaaaccagacaacagttatggcaaagaaaagatatagctcattttttttttttttttactatttttatcattaaattattgagctaatcagtcaagtcaaatcttagaagggtacattcatctttttttttttttttttccttatacgaacctcttggtcagtcttttatttttctgttactattctatctatctaagtttgaatctgtttaacataaacacaaattccactttaaagagtaaacttcaaagcaatttaaaaattagtaagcaaaatcttttatattcctcaggtgaaacatacaacatatatgtggtccaatctgagattatccaatagcactgagagtagtgtacacaattgacaccaactggaaagcctgcttttccttcacttcttccatggtagaagaaaaatttggtgtgtgaacatacatattttcataagagaatttctctaagttaatcaatgcagtagaaaatcccatactgaatttagttaccatatgttattataagttcattttcttaaatgaccctgtttaacatggatttgaacagatggacagaattcttctggatggaagtcagctgaataattaagccatgacacttacttagcaaagtgtctacatggagaaatactagttcacccaaatatcatagatatcattttatactttctttaatagtttttttatagctgaaaattggaaatgattattgcaatgactaccatgaaaattatggccacttggctgtttataattagcaatttgaaaatttaatcatctcaaaccatctgtttttgtttgtttataattgtgaatataaagtttatcatctctcaaggataatggttttaaaaaaagtaagaataaaactagaattgatctttgtattaaataatttaaacttgtttggagtgttacagtacaaagtatgtaatgtagcaaaaatacacactgttaccaatcactacaatggggagaaaatatatgaggaaatattcagttgaaagtaaaacacctcaggtttggttttgtttgaacattttcagtatggtggccaagtgttgatgtaaaaggaatgcaaacctgtgactcaagaaatcttagttctcactctgacacttttgtcctggaccaaagtctgttcttccagaatgacagtgaatgggcaatttgagctccagtgtgtctagtgatggcattaggaatttcagaatacaatttcttttaagtaaaatattactgtaattgatttgttaccttttatctaagaggttagaaattgcacattttataaataattattttaacagatttgtggaatagactaagaaatggaaaaatgctgaaatgtacttttaaagacatatatatttatcctgtgttgacttggttgaaatagcagtgagacattcagatataatgatttgtatttatttatttatttttgtattaatttttttagttaacagacctattgactgtggctaaaagttagattcatgaatttcagacagaagactaatccttataaacattatccctataaacatttcctgaattca

SEQ ID NO: 40915 - DNA, 809 bp, Bovine  19866880837265
tgatatttttaaattttagaaatgtgtaccaataagagattttttataaaaccaatcccaaagaagctaaaactgtgtcatacacaaataaattattttgaaattgatttttattttcttgttaataaagtccatgaagtcattctacacttatttacttcacttaatcataaataagaaaatactgagtttccaaatggctggaggaagccttctgtcttcataattcaggcagtcaaaactgcagattaatcaatagattcataccgctgcctaattttaccactaatcctttttcaatggtctgtatgatctcctttatttctctgccctacatattgaggggccaaatgcttctcagtctgtagattatcaatgcacacatatgcctgacactttagaaagtggaatttcagattagcttttaaatttcctaatactagccttctttacaacagttgtactaagtaaaggggggtgaaaaataagcaaagcatttgtataacaaattgcaaatgatctaaaaacacaatagcattagaaagaatcctaaagagggaagggaacaagaatagcctttcattactgaagtaaatgcaacccttgaatatccatttatacaggccagctcaggatttcagattaagcagtggagtttgtgtggatcattttatgtgcaatacttgttctgatggatgcaattacttgagcattacaacatttatttagaaaaaaatatcaaattaaagtattatgattcaaaaattgcaagttcagaggctttcctcatgcataaatgcacagtacag

SEQ ID NO: 40916 - DNA, 3870 bp, Bovine  19866880371112
cggagagtctgccctggagggcgggggaattggattcctgtgggcagatatctgacttccgtatttgtgcagcactgtatgtttaccaggtgtcaactggatgggacaggccatccctcaagtgaatcttcacacttgtcacattatcacacttgtcacttgagatttctagcctaatcttgaccccatgttgtgggcaggtagatgccatttacagaacaattttatatccactgatataattttacagatgtacagaacaattttacatctgcttctgatcctcacaacagttctgtgatattagttgttgttgttattattattacctctgcattgcagatgagaaaatttggacttccttgctataaaacaggggtaatcaaaacttttgtaaaggggaggatagcaaatgttttaggctttgcagtctgtaaggtgtctgcctctatagcatgaaaacagagatagactctgaataaacaaacagatgtggctgtgtcccaataaaactttatttacaaaagcaggtggtgggccttggtttcctgacttctgctataaagcactgagattgtggaagggaaaagatacctttggcaaatagaaaaccttaatgaggggatttgttgtaatctcaataaacattgctgagcatccacatatgtccagcacataaatcgtaggtaagtcaaggagtatatgatatgcagagcaaagacctatatgaattcacatcactatcatgtaaggctcagagttctcaggaccattagaagaggcctacggaacacagaattcagaacatctggaaccaaaaggagctttctggaggattttatatgttaactgggctttgaggaaccactaggatgaaacacgaaaccttgtccatggggcatcattggtggagggtcagtgtgatcatgtttcccctcctcattctgctctgtccaccgaaagagaccagacatgtttgctgtcagtgttcaggcgagagcccttgtaggactggcatggtgatgaaagggaacctgagctcaggacagtgctcaaggccccatataattgaaaagaataggttcaaattgggccatgcaagagccagttggagtgagacaggtagttacaagcagcggagaaagagaagttggggtgaaaggtgtctcgtggcactgagtcacaggcagggggctgtggctgcctggaactttaggttatatgtcatgaagctgtggctacaactcctgactccttgttctgggctggggggattccccacaccaattacaataaggatgaactccttctgggctagtgcctgtgatgctttgagatcacagggcaccttcacaacaattaatcttcacaacaaatccgatgaggctactactgtcatccccattttataggtagagaagctgaggtccagaataatgcatggttgtgcccaagcagttgaagctagagatgggtgacctagtgcttttctcaccattctctactgccccatagtacatgtgcctggagttagagacagaagagtaaaaggataagaaaatataggtgcagaatcctaatcaagaaaggccactctagtggactcaaggctcaaaagagtgctatggggaaggagatagattcccacctgatcagaagctctgggttcccatgaaatgtgcgtttattcttgcatcactggctggagcgactaagtgattcagctccaggctgtctccttaacatctcagagcatatcatcacccacgtggctgccagctggtggggctggggttgcttttgggctctgccccatttgcttcttgctcttactcttagccttgtctctctggcttatagctctttccagccagcacctttgaattaattatttctttgggtggtttttcaggatatgatattcacatccagccctcaggatgtctacccagaggactgtatgcctaggtctcacattcatgtggagtcctctatgtctatttttaacctcatccctgatcgggggttatacacactgtcttagtgagacactgccaagcctgggagaagactgtcttcataaaacagaaaattgcacctctttgtgagaccagagccctgctggtgcaataaataaattgatcattcctatgattgccttggaagagtaaccaaacatacattgcattgtgcacatggtttaaaagccataattttttaaaaagcaaatatttcagaggtaccagtttatttggccgtgtttttgcatttctttctttttatttaaagcaccaaaagcctcaaacacagaaatgcctaggatatctcttgacccctgaagagccctggtgtgccacaccccagtgttctgggagcaggggtgagctggagaatcctgccacttgccttctgtctagatctcggttaacagaacatctcccagctcagtctcccaagttagaaccccctcttcagtgagtgcttcagcccacactgccactgccttcatctggtcgtcttcatctctcacttggactgttatttaaacattctggaacgtgatctttctgttaccagtttcttcccatgcactccattttccacactgctcttagagtgatctctataaaaagcaaatctaatcatggctggaaaacctcagtaccttggttttactcccagcttagttggggtggggtttctttgctgctgtcatcgcccacgatgacttctcctcacataggagctcaggctggagcttggggagaggaggtataaggcccagcgcccctccagtcccaaagaacagaggcacctaaggctgctcccttcccagggttcccctccccagcctaccccaccaagcctccaccaatcccgtcagccggacaatggacaatggtgtccttttgagagggtctttcctagatctaagaaggggcatacggtatcaaggcacagaatccagacactggttccttgttcttttatgcggcaaaggggggctcctggaccatgtctcccatctgctgatgggtccctatctctgtggcgtcccttccccacacactttcttctgcagtgtggtgtcctcactgctcacttctgcctaggagccatgccacctctctctgagctcacaagctttagtgacacttcaggtttctatgggtcctccagggagaggtgagaatggctctgttcctctaggtgacagcaggtccacaggtccagttcagatgatctctgctgagagcagtgtctgatttctgtgtgtggttacctacaaggcagatatacttcacccaggcagcagtggagttttgctctgtttttagaatgagtccaccccatttgaagtcctagagaggagaaattttcccccccgttagtgtgttttggccttgcttctttgagaagcttaggtgactattatgtctgcttttgactaataagcctggctctccctgtaaaaaagccaggctacctataagtggctgctttctctgctacccagtaaggagagcatggcccagatacacatctgatagaaaaggggtctctggggcacccagcaaaccatcctgaactcctgccacaataaacttcagtccatctgtattaggctcctagggctgctgagacgaaggatcacaaacttggtggcttaaaacaacagaagtagtctctctcatactttgagaagctcggagtgtgaagctaaagttggtgggcccatgcttcctctgcaggctctaggagagttcttccctcctctttgggcttccatggccctgcggtagctgcaccttcccaatctctgcctccatcctcatgtggcctctccttaatgtgtctttcccctctgtc

SEQ ID NO: 40917 - DNA, 1774 bp, Bovine  19866880490688
aaaatttgtactgcaattgctggttggtttgacttttgtattaggccattgatgtaggattttgatggtagtggtcagtttgtggctaaaatctgctttgtcataggaacaaggtgcttctgtgctttttagaagaattatggtgctggtgaagaaacattttgactcacatgcagttgttttctcttgtttttagaggctacagagtctctcataaaggcagtttatacattgtatcagcagagaagccttctcattccagttcggactttgttactgaagtttttcagtaaaatctatcaaaaagaagaactgagagcttacagaatccggtacattccctttgttattttgcttttctttttcttaccaggttactttgtaatctgtataataagatgatagagtgattaaatcttcggagaaattctctctctctatcctttttgctttcattaaaaaaaaatttttttttataaagaggcgtacataatggttccagtaacctttatacacataactgagaaggtacaagtctctttgagcatgtatttccacttgtctgcttaacagctaaaggacatttggaaccacctgtagctgcctcagctttttcttttgcttcccattaaaattatggaggtttaacctctggcccttagtgactattgggacatatggtataagaatgagggcagtagaagaggagaggtgtacaataggtgaaggagattaaaaggtacaaacttaaagtaaataagccatggggatataatatacagcataaagaatatgaccagtaatactacagtaacttttattaggacaggtggttactagacttgtgaccatttgcaatgtgtacagttttcagattattatgtgatatatacctgaaactaacataatactgtgtgtcaaaaatgtttcaataaatttttaaaaaatgggagtattttaaagtgaaaaagttcctggcttagttgggtgctctctggtgacatagacacacacagagtagaactaagcaatcagtttttagatacagtgagtttgaggtttatttgggatagtctggaagagatgtttgggtgaaagataagagattcgggatacctcagcatacataggtagttattaggacatattcgagtctttactgtgagtcaggtgcttttcttaatttttcagtaattctcatactttgatgtaggtatgttggtttctgccttatagaaggaagcttaggttaaataagttggtgagtgtcatgctgctgaagggcagccagactgagacttaagttcaggtctgttagactccaaaggtcatgtgtaaatcactcttgggggatggcaaaagtgattgctgtgtccgagatgagacattagagagttagcaagtatatgaaagaactgaaataacacaagtttgaagccacttaatgtggggcaccctatactgagtgcatcagtgacttaatatagtaaaataattattacaaattagtataaatagttcgcaagaagttaagtagagtctgtgtcctttaagataaaattacaatttacatagtgccccaaattacataaacttttaaaatacagtgccttagagaatgctatagctgaataaatgatgccagccatcttataggctttcaaatgtttaaataaatgtggtgtatttcccttgtctttgatggccttagataccgtagtaaagtgttatcacgttggttggctggtttaccactgcagcttgctcatctcgg

SEQ ID NO: 40918 - DNA, 1980 bp, Bovine  19866880526199
cttatcacctcatcaattctcaaattattagaagataggtctacatttcttcctatttttcttcactagcccttacccacaaatgccttcaaggataacaatgacctcttacatgtcaaatccaacttcattctctaaagtttttgcagtatttaacactgggaatgactttgcctcctgaaaccctttcttcccttggttttctaaccctatgctatcctgtttctcctaagaatctcctggccatgcctcccctgtgttcttccttctcctgtcctatgacaccaggtattccccatggttttacctttggaccacctctttacatcctctcatcctatcctttgataatctagttctttggggcttttttgacatctgggtcacatattttcacctgacaatctcattcataacactaggaactcctcaaaggtacaaactatgttttattcactcttgaacatcaactccccaccttcactatcagtgccgggaacagaggagcgggaggaactcagtgaaagttatctaagccgaactaaacagtatttcccaccaacttctgaaactaaacagacagacacaaaaccaaacagctgtccggccttccacaacccaaaacaaccaaacctaaacttcccggtttcctttaataacattacccacttctaacctccaagccttaaaaatctcagtttcaactctgacatgttctttttccttgccccttatagccaataaattaccacgtgttatgattcttcctttgttatgtttttatacctgtctatacatttagcttctttctttcttaccttcaatccaaggccttaatttcctcccgcatatcttactgtaacagcttcccaactcagtgtctccatctctcctacatactccttccagattaatcttcagttaacacatttctaatggcactactctggatctcaaaaatagttaatatgtagcctcggccttcccctagcatccaaagctcttcataataaggccttcaaaatacctatatgcttaaaaggctagagatctactcaagttatttcaagaaaaggaaacatttcaaagaatgctcactgatcaactgagagttatcagaaaacaagaaagctctaaaactgaaccactctctctttctatcagtgcctctgcttctcttttcagtttcccttctctctattgccctacttcctctggttattcatggtttccattccatcatagactcagctagcatacagcacaacacgaccactcccatgcgtgcacatgtgctaagttgctccagtctgtccgactctttgcaaccctatggactgtagcccagagtgggttgccacgtcctcctccaggtgatcttcctgacccagggatcaaacctgcatctcttacatctcctgcattggcagatgggttctttaccactagcgccacctgggaagccatgaccactcccaataccttctaaaccttggcaactctctcaactctctgttcccactgctaactggatcagtcttttgatttcccagttccaaatcctagagaatccaaatgacctagtccatctttccaggcttttacttccttcagttcagttcagttcagttcagttcagtcgctcagtcgtgtctgactctctgcgaccccatgaactgcagcacaccaggcctccctgtccatcaccaactgctggagtctacccaaacacatatccattgagttggttatgccatccaaccatctcatactctgtcatccccttctcctcctgctctcaatctttcccagcatcagggtcttttcaaatgagtcagctcttcgcataaggtggtcaacgtattggagtttcagcttcaacatcagtccttccaatgaacatccaggactgatctcctttaggatggactagttggatctccttgcagtccaagggactctcaagagtcttctccaaca

SEQ ID NO: 40919 - DNA, 2651 bp, Bovine  19866880575200
tgattttttttttttctcttggtcccctagtgacatctttccagcagttccttggcgcagctgcacagctgatccagttcacttatcatggcagtcaaataaatggacttggttgttctcctgtcagcttcttaatgtgtcacatcagcacagctgaagataaggagcctctgtctctgacccagacgctttggacctggttgcttccattgtatgccagggagagtacaaccctgatggccagaaaaaaccctcccccgcttggctttttgttacattctacagcaacatgaggctccttgtttctgggcctgactccatgaggtcattccaccctggagagggtgggaggatggattaaagggaagagagatgaggcaacacagcctaggagtctgggggctgagggccaggctggatctcctatgggcgagttttgggaccatgtgcaatgcacttcccctttctgggatggtcaccctcccctgtgtgatgaaggatgggacttgatgacctccaaagtaatttccagctctggccttccgtgaattgtgcatgatacatggtacatgaattaccattccactttctgtcaatggctctagatctttccttcacccccattcttcatgtacttgacttgtccccaagagttactcacttcaggtttagacttgattcttccttctgtctctgagaccatctcttccctcctccctcttcattttgattcctctctagtccaattttctgctatctagaagagctggctttagaaacatctgctttcctaatgcatgctgaaagattaatggtagattatggattcagttctcatttcacttgaggaataatacttcaacctcaaaggaagggccctctcacaatagagtccagacgcagagtggagagataggctccaaaagaaaacagggggccagatcatgtaggcttccaaagagaagagaagtttggacttcatccaatggcaacagggagccactgagggcttttcagctgtagctgagctatgtcttcaagtgatcattcaggcatctttttgaaaactggattgaagtgggaagaaagcagaggcagacaagagagtgaattctggatcctggtgagaaagacaaagtgtggtagtagacctgagaggttttagaagaaacactcgtacttgggctccagtgaatttggggatgagagaaagtgagtttagaatgacattgtaaactggcttgcaagtttgttacccagttttgtctgtgactaatatagaaaaaatgctttgcctttctctcccagctcactatgctactgctatggccaaatctgctcccaccttatggcttttgcacttgtgggtttctgtccccaattttagccaaatgtcctctcttttgaggggctcctttgatggccagtctaaggtagtctctctgccctgctcatctcctacctcagtccttattctccccactttttgttcttagctaagacgagttccgtcatctatttgcgtagttccactagaatttaagttccagggctctcatgtgtctccttcatgagtgtgtccctggtacccagaagaggaccaagcacctgcttggctcatagcaggtgcttagtaattgtaagtttaatgaacaggaaggaagcaaaaaaggaagatggctggaatcagatttggcaaattatttccgaagatgactgcaacattgcccatcttgcctgctttttgcaatgacagttgctgcttctttcatcagttggagcctgtttcctttcttttggatctgggctggccccatgacttcctttgacctgtagaatgcagctgcagtgacactgtatggcttcagagtctaggctttcagaggtcgtgcagcttccattttcatcctcttgccatgcttcttcttcttgtgtcttgagacacatcagaaaggccaaagccctgtggggggaaacggagccctccagtcaacagcacctgctgagcccagcccgctgcaggtctgccagctgagtgtggccacaccaataatcccaggcaagaagagttgtgacaggccagacagacaggccagacaggccacggatttgtgagaaacagtacattgttttaaccactaactttcattctccactttgggctttgagtttgaggaactggtgggcatccagatggaggtatactgcaggaatttagtatcagaaattataatatacagttgtatatattgtaattatttatttgtatgcatatgtatattggagaaggcaatggcaacccactccagtactcttgcctggaaaatcccatggatggagaagcctggtaggctgcagtccatggggtcactaagagtcgggcaagactgagcgactttgctttcacttttcactttcatgcattggagaaggaaatggcaacccactccagtgttcttgcctggagaatcctatggacggaggagcctggtgggctgccgtctatgtggttgcacagagtcggacatgactgaagcgacttagcagcagcagcagcatatgtatatatttatgtatgtatctgtgtatatggagaaggaaatggcaacccactccagtgttcttgccggagaatcccagggacggaggag

SEQ ID NO: 40920 - DNA, 1679 bp, Bovine  19866880618130
ttgcatttgagtgacagtccatttatttattttgattttcaatggtaagctaaatgtataactgtgtcctctgtttctacatttattacacccccctttaaaatattttgtgtaatgatcattatgtaactttagtgtctactcacatagtgcttccttctgcaatctttaccaaaatcaaccccctctctcccaaatagtaggtatttggtgaacatccgctatcctagttcaaggctctgtactgatcaacatgggtctctgtgccaaagagtaaacaatataatgttcatttattgggagtagctctatccaaatagcatattgagaaaagttcaagtgtacatagtacatgaacctttgaactctgaaaaatgtggtttagaatcccaacaaatctggtttttggaatggacattccaatttccagtcagaatgaagatattataagaaaaccctggaaggagaggatgagatttgtctatcttagatgaatatcaacaaatggaagaaaatgccagaaatcattggctaaaaagtagtatgtcaagcatttggattgtacaagcaagtctttgtagacaatttaaatttcaaaaaagtttgttcaaaattatgcttaaaacataataaatccccaaaataccaccttaaaaatagtcatatacattaggatggtgcccacaggcctaggactaaagtaaaacctattggccaatatttgctgatgcaccaaactgctgaacagccttagcatataagtacataagaaccagaacaactagcttaagtatctcccactcaacacagttttcctaattctttcttcacagcatcataggctaatgaattcataatcactgaaaatacttaccacaagcccactatatgctaagctttgtgctagggaatttagggcacctctctgccctacacattggacaaaaatatcaaaattctaaataaagacaggattagtattgcttcccaggcagcactagtggtaaagaatccacctgccaatgcaggtgacgcaggttcaatccctggatcaggaagatcccctggaagagggcatggcaatccactctagtattcttgcctaggaaattccatggacaaaggagcctggcaagctacagtgcactgggttgcaaagagtcagacatgactgaatgacttacagtacaatattgtctcaggctctggttatcaataactggagatggcatagctctgttatcaattctacttttgttgaaattttgactttttgttcatcatggatttttcacattaatattttaaatattgtattaaaatgtaatttaatcttgattactgacttttttgatgcttttgaactggtgttggagaagactcttgagaatcccttggactgcaaggagatccaaccagtcaatcctaaaggaaatcagtcctgaatattcattggaaggactgatgttgaagctgaaactccaatactttggccacctgatgcgaagagctgactcactggaaaagaccctgatgctagggaagattgaaggcaggaggagaaggggatgacagaggatgagatggttggatagcatcactggctcaatggacatgagtttgagtaagctctgggagttggcgatggacagggaggcctggcgtgctgtggtccatgg

SEQ ID NO: 40921 - DNA, 832 bp, Bovine  19866880619223
aatgtcataaagatttttggtaatacaagtaggtgaaaaaatatgtatctgttattttctctcctaaaacaaagccttcaattagtgtatgcaaaaatcatcaaggtgattcagcaggcttagggtgaaatgttaagaagaagcggactggtctggatgctaatataggaagtgaggtctcaggggtgtcatctcggagcacaccatctcgaatcctaacttccatttcctgggtgtgggggagacagtgctggtttaagccctttgcgtttcattcctggaacttgagacttcacatcttctgttagtgatgacttgtagtgctgtattagttccactactccccatttgccagagaaaccaagacaaaagatcaaatgacttgtccaaagtacaaaggcgatcacctgaaacttgaaattttcagatgatatgaaaatatggaaattttccctatgaaagatacagatagaatttcacagtttattactttatatatgtctacattagtgctctagtgctacataacaaattactcccaaaagttagttgttaaaaaaaaaaaaaaaaaacattttttatctcacagtgtctgtgggtcagaaactcagaaaaacttagccgggtggttctggtggggtgtttctcgggggggcgtgctattgagacattagctagaccttctgttatcataaggcatgacttgccctggaagatctgctctcaggatggcttgcttgtttggatgacaaattggtgctgactataggcacaaggactcagttccttgccacaatggacctctccataagactgcttgagtatctcacag

SEQ ID NO: 40922 - DNA, 1474 bp, Bovine  19866880626435
cagagaaactttgttagttatgccattcagtatctataagaataaaaaagattaactgctttgaagtagtactaattaaaccaataatttttttcaggtttctttatacatacattgtttaatgtaatcaacaattatcaattacatccttagaggagctataatgacaggttttactggctcttccttacagtatcacttcataaaaattaatggtgtgacccccaatgcagatttttatgggagatagatctgacatgccctctgaaaactagaatgcctcagaaagaagcatgcctggctaggctgcccctgtacctggagatgagggagaagtactctgcaaatcaggatgacattctccttaggaaatattttaaaacttatttttaatatgtgaacaagtaggtacttgaagcctttatgtttcacactatacagcatagcctctattttttttaatcctataaaatgttctggagaaaagaatggcaacccactccagtattcttgtctggagaattccatgggtagaggagactgatgggctacagtctacagggtcacaaagagtcagacacgactgagcaactaatacacatgaaatgtttaggatacgcatttccagtcacactcagggtccaagaattcagcatactgaactaggaggtatccctggaaatttatatataatttgcaaatctacaatatcagtacaaggaagtgaactcaattaactgcattaaaatactacgatcaagaataagacttagtacattaccgccaacagtcatggatctggtcaaagaaggctgtaaaaaagtttcttcatcattaaattgtttcttaagttcttctacagattccagatggagttggagaaattctgctgttgccgctgatgcttcttctttaacaggatctatcattctcttcagaagtcctaggtcatcctttcgcactttcaagcaaagcttctccatttctcggatattggagcggagttgctgtaaaagaaaaaaaaatcgttaaagctaccatctcttaatataaaatatctttacattcagagccaatctgtgataatggctttgaatggaaatgattacaagtattctttagagcagacagtattaattagtacttttctattttttatatctctggccaaatccagcttctttagaactcacatcctcatattctgaatttagcatttatccttcattaaatgtaattattacaaaggtaacaaatattcttcataaaaaatgaaacactgcagaaacacatcaagaaaaacaatgatttcctcacttcatcaagcctaccacttcttttaacccagtctttctgcatacttcaatctgctcatagaaatattagcatatatagaccttttcacaaaaaatgaattgtagattatgcagaataatctataactgacaaactttcactccccaacttaacaata

SEQ ID NO: 40923 - DNA, 1320 bp, Bovine  19866880687678
tatgatcttatatagccttgttcgtgccttcctccaaaataagatacctgatgcctcaacaatatttcttaattagagaaattgaattagtggaaaatagggcaaagagaagtcctgctggctcaacttgccttgctgctattggaggggaaaacttggattacccctatttagctgtgttgatttcagtggggatcacccgtattttccaggtaggatcacttcgtcagaaatggtctatatgctaaatgaaaatgcacctctgtttttataacaaccatgtttagttttctgaaagtgatttaaaagaatctttgatccatatttcttaataagctatgctatgttttaaaatattcaccattaatcttacctattcaagatactggctttttattcttgattttgtccccaaatgaatgctttattttttcctttgtacctacagagttgcatgaggtgcagaaaggatctagtatctcaacaaaaagaaaccccttctgcaaataaaggacatacaaaaaggcattttattaaacaaacaaaaatgccattgcagagttatgattctccctgggaaacttgtatttgttaggtgcactctcttgagaatggcattaaagaagattcacacataagccctactagttcaagtggggtttagttcttggcatgattagcaaagtgggttttccagcacatttattttggtcactttccagccccccacttccctccccctgggtgagtctttaatttggttgccagacctttcagtaattttattgttctgtgttttttctcattgaggatgttatttggataaaacttataggcacattactcagtctggcaagaatgggggataatgatcatttcctgacattcactttttaaggagatttgcttgtttccctatttgatcgagtgcactgaccttcctatgtgttgttacatagtgtaacatctaagaaagactttattctaaagcctgatatttcatccaaacactctcttggtatagctatgtcccctgccatggtaccactcttgaaataaaagcaaacctcctacccttgtcctccttcaccatttaaagcagcccccacccctttttggtagaaacttcctctaaagctaaatttaaaatccttatgtatttttcttctgaatccaggttcatgtgactgactatagatgaaaaaggctcgtgagttagtgtagaacctataccaagtatgaataaagactatttcctccctatagggtagatcctctgaatatatcacctttcaagtggcttaaccttcccctcaaact

SEQ ID NO: 40924 - DNA, 1925 bp, Bovine  19866880692367
aaggaaggaaggaatggtaggcagaatgatgcccccacagccaaagatgttcatgtcctcatccccagaacctgtaaatatattaggatacatgatagaggaggaatgatggttgcagatagcattcaggttgctagtcagctgactctaaaataggaagattatcctggattgttcaggtgggcccaaagcaaccacagaggtccataagagtggaaaagtggggtagaagagagagacccagagagatgctagtgtaatgatttggtcaaacatcaaaacaagaggatttggcctttcaaaatcaaagaaggaggccataagccaaagaatgaggacaacctctagaagcaaggaagggatatggatccttcttggaacccttagaaagaccccttgagtttacccagtgagaaacaatgtggacttctgactcccagaactgtaagatcttaaatttgtattttttaagccactaaattgtggtaatttgttacagcggcaatacagagtggcaaaggaatatcataagtcaagacgcatgacttttgcatggatcaaaacctgacagtatttgtattcttcatctagcactttgcctccaaacacctgtcctatgaaaacaaccagaattctcatgaaggtttatatcaggatgttcattcgcagcattatttatgccagtaaaaagttcagtaagaagggattgatagctatccacacaacacagtattacgtggccataaaaatatcagttccttgaaaaatattcagtgacatgggaaaagctgatgatcgagtttttaaaagcaggatacaaaacaatatatgataccagttttgtgaaagttgaagcaaatgttaatgatggattttaaaaagtgttctaatgttaatgataataatctttgtggaataagattaggggaaatttttggttttctacttatacattttgaatcttccagttgttctataataagcatgattaacttttataattagaaaaacaagcaattttcttatataaagcaagcccctcaggtaacaagaatcacaaaattaatcatgcttttgactgagtattctcattcatgaaaatgtatcccaaggaaacagttcaaaagaagaaaaaaatcttataagtaaaaaggctttcatggcactgttacctataacagtttaaaattgaaagccacctgaatacccagcaagtcaattatgataaagcaaattataatatatttgcttgatagaatattgggagatcatagaaataactaacacaaagactatcttggaatacagaagcgtcagaataatgcaaaccaaacagtttgagggaaaaaaaaagtttacatttataataactccatatacatgtggataaagacaggaaaagaggagttataagtagtttctatgctaaagcaaagaggatttgagcgtaatttgtaaaaagttgttttgatagtaaatacaactatttgataaagacatacaacatcatgtcaatcaagaaacctgaggaataaagactggttaagagaattgaaataataatgataccagaaatagaagccatatctgtgagaaaggacatgtgagaccacccacacagagaccacccacagactttcattcatctacccagtaaatacttattgagcatttcctcacatattaataaaaccataatgaataatgagggaagagaaacacaaaatttagagtttgagctacttttggggaactaggtaagttctgttgaggaggggaacccagatagtttcataaggattgatcattttttaagctatttcttaaactgggtacatggattttttaaaaattattattctgatgtttcacaagtgcttactacaccgtctggcacatattggctcatacaagaaattattgca

SEQ ID NO: 40925 - DNA, 1765 bp, Bovine  19866880694229
ttttactagtagaattgcttgggctcaccaaatttggtttaacgtgtcatcagaggaattgggtgattattagaaaaaggcagcttacccggtttgctggcaattaactttctctgtaggtagctgactggtatttaaaaaaaaaaaaaaagtgatgggaaaatttgaggaagcatgtatatggagaaagtgaagaagattggggcagagctagagggtgagggagaagaaatagcaggtgaaatttgttttccaactctgttgattctcaaacttctcatttcatggagcaccagattagctaaagaactaatcacttgccactgagagaaactatgaaattaaatctctgcgtctagtgcagatttgattgaaacagtcactccatttatgagatcagatacctgaatctcataatctaaaacatctaaaaaaactcataatctaaaacactgtatatagtttcaaattctgaacagtcttctggtcagattgtgctttgactttgtatccattgccaacattaagcagttaaaattaactgtctcactcagtgcctgagtatttcaccaaacatgaagtttctactaggttgtgttaaatccataaatattaacaagtaattgagagggtgggaaaggagaataatgaaaaggaaataactgatttacataagacgttaatagtggggaaagaactgggtttgctctatgtgtggtcttctagctatagactcttttctgtcatcctacatgtttttatcctgtgctctctgggtttttttttttttttcccctgttttcctatttttgcttctggtattcataacagtagtgacagcttatacagaaaaaaaaagaaaagtgatttgcacagaaatttaagtgccttaaaatgctttttcctttaaaaattcaatctgattataaataaattggttggaaacatgagagcagaaattcaggagcaatgccacatttccatgactgagatcaaaatacaaaaatagtttttcatttacagatagaaataagtagaatagaatgttttatgttctctggagaatgaaagaagcctattacgtttagggggaagctgtgatgattttgctctatcttttgtccagattctgagagtttctaaagcacatcttctctgccaatcttgcttgatctgagaaactcccttctgtctcagttgtgtatctagtttcatttttagcatattgcttcccaccaagagaagtgatgagcctccaaatttgatttgtatttagcaaggtgtatcaagtcatatagagcaaatcagtgcttctctctgtctttgtctttcttacttcccatccagctcacacacttcaccagtgcaataggaacagaatcttacaacattttaaacaactattcacaaaagaagagtccaacattaaaactgctgggaacttcagaccagcatgttgaatttgatgaaatactagattttatcacaggtatatgtatactgttattgaacacattgtgaatcatggtagatgtttttatatattacttagaaggtgtcttttgaattgactttaattttcttaaaaatgctcctttggagctaagttaagccatgtctccaaagtcactttatcttgataggtaggtttatatagatgatcagtaaagtaatttcagtatgataaagctgtaggaacatgaaagaattcaggaaatgcttttgaattaacttagatttaaaatggaacttttcctaatgtaaa

SEQ ID NO: 40926 - DNA, 1551 bp, Bovine  19866880724294
cttctttgagtcctcttcccaaccacatgcctcccaaccaaacatttccagatccagatcctgtttctttactactttctgtagtagtgaggccctatatgtcagatcctacatctggacactgtatttccctcccttctatctcttctgccctctcttgaatgcaacatttctaagcattcccatgctcaataacttttagtagttctccattgcttacaaggtcagttctcaactcattaaaatggcatgcaaaaaccatttgcaatttgtccctttgctcttgttctttcctttcaaaagtttatccattcttcaggatcccttatttctacatagactgaaatttagttgtttacatgttcgcctccacattaggtagtagctctttgaggataggaactgagtctaactcatacttgtattctcaaaatggctaggacagcacaaagaaacacttcatgagggtagtatgtttcattcaccagacactcacacagtgtctggctctgacaaacatgtgtctaattatgaatgaataaaaatcagtgttttaaggaagggataatccatcctgcttccagttccccttcaaagaagaggtgctgttgctgctgctaagtcgcttcagtcgtgtccgactctgtgcgaccccatagacggcagcccaccaggcccccccatccctgggattctccaggcaagaacactggagtgggttgccatttcctcctctaatgcatgaaagtgaaaaatcagagtgaagtcgctcagtcgtgtccgactcttggcgaccccatggactgcagcccaccaggctcctccgtccatggggttttccaggcaagagtactggagtggggtgccattgccttctccaaaagaagaggtgatatgtagtcaaatagttgatttaaatgttgactcttctgtagtcttctattgactttggtcttaccactattctctggatcttagtttttgttgctttcataagaagttaagtaatatctaatgggctgtgtgtgtgagagagagaaagagagagaaagagagagaatgtcagggggagggaattccatcagtatttccttggggagagaaataatcttcctcacaattaggcttcatttatataaattaccacagggtgataccaaggccaagagacgttgaagtttagagttcaaagaggttcttttatctcctaaaactggaagaagaattgatttatgtttgcagccttgacttggctccacaatcttgagacctaataatgataaatcacatcaacaactaaactcatcctctatagtttacaaagtacctttgtttgccaacttctttctttctgtttttctttcttgtttcgctacacatattttccaagccctttaaaatctcgaattatttctttggagcttcataaacaccttaagaagtagcttgggaagatatggcaatgatcattttaaattgcatttttggttttataactagtcttttaatttttaaaaacctttttattataaaatattctaaccaggcttg

SEQ ID NO: 40927 - DNA, 1816 bp, Bovine  19866880732581
tattgatttaaggatttctaatgtgtttttacaacatgtaattttgagagcaaattgtacacagcagaaaacatttggtatcataataattaatctgatttctttacaaacataaagcacaagtccactgggaaacatttaaacaacttagagtaaacacattctagatgtcatacaatttattattaaggaccccagagccataactatttaattaaaacaaatctggactatcccttgcttgtattacctaactattacattaaggtattaatagtagttaatgacttcacacgtatttcagtatcaaaaggcaccaaaaagattacatatagcttaaaatacattacatgaaccaccaaaaggaataaaaaccaaaggagaaaagggcctccattcatttactcaacaaatatataataaagacctactatgtattaagtgcagtattcctgagaatattcctggattagtccatctacctgagttaatattaaaaataattccagattggacccctgtccttcaacttatgacagtcttgtgctttagacaaacaccagtttctctattcttcagccttctttaatctgaaaaatgagaataatactgcccttatccagcatccaaatagctggcattctatcgcttactggtctccagaatatatttgacaattagtcacatactgacttatgatacttcttttcctaaagctttaaattattatttaatataattggacataagatctatatatgaaaattaactatatttctatatataccaccaaaagttagaaaacataatttaaaagaaggacaatgtttcacacctccctcaaacacaaagacacaccctaaaacaataaagtatttaagaacaaattaatgaagtagattgaaatagacaaaattaagtgtaagtcctgtattccggtcacctgttgctgcataacaaattcctcctaaaaccaccacttaattttgctaatgattttgcagaccagacattgaagaaatcagctgaagagttcttccctggggtcactcatctaactgagtaaggcattggctgaagttgtattcatttgaaggctcaactgcactgatgtccaagatggctcactcatgtggctagcacttgaggctgcaaattcctaagagctcagttgtggctgtggatatctcctgcatggaggtcttcagatatttggatgtttcacatatggctaatttcctccagtgcaagcatcctcagagaaccactgggagctatttggctttttctaatctagcctcagaagtctagtggcattacttctacctcaggtcagattcaaagggaggggaatgagactccacctgttggtgaggagtaacaaggtcatactgtagaagaccatgtaggatgataaaaaccttggtagatatcttgatagactgtacaatctacaacaatcttatgcataaaactatgaagatacatatataataaagaagttgtaaacaagtacaagaatatcatatatttataggtaggaaaactggacattttaaatatgtcaattttctctaagtagatgaacaaatctaatgtgattcccatatttccaacaagattgtgtataaactttgaaaagcagattgcaaattttatatggattaccaaatggccaagtatagccaaaccactcctgggaaggaaaaataaggtaaccgtattgtcctactagatttgatataacaaggctgtcttaacatagtgtggaccttgaggagaaatagacaaagagaagagaaagaccagagagaga

SEQ ID NO: 40928 - DNA, 1189 bp, Bovine  19866880764556
agtcggacacgactgaagcgacttagcatcgagacaccatatggctggcaaagcctaaactatttactgtccaatcctttgcagaaaaagtttgctgatctctattcagttgaatggaagactcttggattgcttttctaattttctattctcttttctgagagatttcttcagctttattttcaattctttctactaaattctttgtttctactattatgatatttatttcccaagaactttttcttattattttttatagcgttttacctttggacataacaattctttctgcttttctgagacactaaagagctgattgcttgtctcctggtggacttcacttaaatattctttgataggctggcattttccttggagcaacctccaagtatcagtgtcttggaggttgttgtggtttagttttctgaagaagaatcctgttttcctcctagggtaagtaggcacttatttcctaattacagaagcagtgtaggtgaattctgctgtacttccattgttcagtcatgtcagccctgtcccctctctatttgagccctatgccaaatgtttctgaatttgaagtctcaccaaaaaaggcatctttagtcctcttacatttcaaaaaaggttactatggctgcagtatagtcagtagattgggatagaatataatcagtgccagagattatttaggagtggttacagaaatggtgaaggtatagaaaaaaagattaatttgagacttaagtggaaatttgacttgcctttcatatatatgtattttatcagtatttcttgctgcctagattatagccctaatatcagtgactatatctccactaattgtgtatctcagagtgccagctgctcagcaagattcagagtttatggaatggtactgtgcatgttaatgtcaatgagattattatgacttttgtttcttaccatcttcactgtttaacatgttattaaaaatcacttatgactttcttgagacagtggtagggtcaaagtgtttgtttactgattttttaaagtatatatatatatatttacattattgatctccatctgcattagaagttttatgtgtaccattaaaataatgagatttaaactgtttttagatgtaagtattggcttagttttattcatatatgccttgcattttttgtataagctcgtt

SEQ ID NO: 40929 - DNA, 1578 bp, Bovine  19866880765289
tttttacgtaagagaaaccacacaaaaatctgagactgttttatttgaaatgactacaaatggtatttttgcatgattctaaaactaacagaaatcgttttctttcctaagcctatatatcaattttatttattgattttggtacttgctttggtagaaaacccaatgatttactacctgcatgcttgccctactataatgaaaaaaaagtttttttttaatccttcacacaggcaaaatggaaagtagtgttgtaagtatccatacataaggattaaatattaatattttaaccaaagtcaagagcatttttgtctttttctctacttaaaacagagcattaaaaaaaagtgtgtatgtgtgtgtgtgtaggagaggtggggacaggacagcttcttccagacttcctatgaggtacttacagtgctgatcacaatcaactctggcaaagactacttgatttgcatttgggtattcttccttaatgacattggaagcttcctcaaaaattgggtgcaacatctggctgaaacgacacctacgcacagaaaaggataccaattaaaactgaagagtagaagcaataaaattttatttttgttgttatctgtttatatttagtatttattatatgtacaataaacagaattaacaatcacactgttaattcaggattcctgatgtcattcattggagatgaaaacaatttgaaattcaaagactattccatttcagacaaataatttaaagatgatctctcacaaaggcaatgaaacaagtgtgagataagtcctctaaaatgtatctacttggatctgtaattactaagtctcaggcatttataaaggaaattagcttctctgaataatgaacatatttttagactacaaagtctttaaaatgataaatttattgcaaatattagactgattcacctgacaagttcaatcaaatctcacaggcaagttaatatgaaaatggcatatggtacagaccgaactgtttcctctcaaaatttacctctcgttcaaataggcttttgtatgtataagctattaaacatactaagttcaggagcaaaatttttttattctcaaaggagacttcctgtccatgttttctgtctgtagttttttgctctgcctttacttttaaaaggggccacaaaccccacaatattgtagaaacatgagacttctaattctgactgccccttgatcaagccaactacttcacaaatgtatcctctgagtcattaaaggcacctgatgagaaagagaagaatcagaatcagcacacaagcaggtgggctagaatggttattttcatatgaaaaaggtattgagtgtttattaacaacaacaagaagaacacaactataattcctactattgcttccagagcccttttccatcaagaaaggtacctaaatgaagcctgtgaactctaatccacatgtaattagatcaaagaaagaaagttttagtcactcagtcgtgtctgcctctttgcaaccccatggactgtagcccaccaggctcctctgtccatggaattctccaggcaagaatactggag

SEQ ID NO: 40930 - DNA, 1316 bp, Bovine  19866880782977
atgcatctatactaataatgataatacaattagccaacattcataaagttatgttatataagcaccgtcttaaatggtttgtaacatgtgaactcatttaataacaaaacaccacgaagagtttggggttctcttacttccctcattttataggtcaggatacggagatgtggagagattaagtaacttgtctaataaagaacagaactgagattgaagcctgcaagactgattgtaaagtccacgcttttaaatactaaactatagggcctccatgtgtaggtatatatatctacctatacacgcacattcttgtgtataagtacgtagagaaagacaaacataagaggaagacaagaaagttgctgagttctaaaccttgactcatgaaattcttggttatctagtttggacttttctgaacatttttgtgccatgagctcttttggcaatctggtgaactttgtgaacccccttctcagaaacatgtattttaagaccttaaatattacttaataagaatccaaagaaaatcagctgtatcaaaatacatttatcaaagtattttaaaattatgatgtagcaatatacttacattcattttttaaccaaataaatagcaagatctagtggcagatgtagcaactatgataatttgaaaatagcgatgagtgtaaacaatattttaagatagctcaacaatgataatgagataatatgtaaaaatattttgtaaaatctcaggtgccctcaaaatatatgtccctcccatgttgttattctcattttatatcaggacactcagcagttaagcagtttagttgcatagctaataactacacagttgaaactcaaaccaagtcattggattatggatcctatcttctttccattgttcccatgtggcttctataaaaataagcagatagtttttaaatcaccacaaatgtcttcccaagattgtgacaatctgaaagatatgaagtaaaaagcaggtgaaaggagataaatgcatctttgatgccacacaaaggtgacattttagagcaaacaaataagatatctatagggaatgctgaattcacttgtgtgggacggtatgacaccatagctattgtgtagagtggcacaacttcactgcatgtaacaggcattgcctctaaacgctggagttggagctctggcttctgcacgtaccagtctgtacagagactctcctgtttcagctaaccttaaaataaccgactgcagcagagcagtgggtttccagtcatggttccagctcagcttcctgaactgtgtatagactgagcaca

SEQ ID NO: 40931 - DNA, 1535 bp, Bovine  19866880814299
aactagatcccacatgctgcgatgagaattgggcaactgaaagaccccacatgcctcaacaaagagcaaagtcctgcagctgcaactaagacccggtacagccaaataaatagattacttaatttaaaaaaaaagacaaggccagaattaaaatctcaggtttatctgtctctaaaatctgtatcctttttactatattacactatacagtattacaatgaatcaactaaaatatattacccacaatacctctggtattcaattaaattatttgagcttaatgttaacagaaaaatctacacatctataaatgatagtcatagcatgaaaggattttactatgtatgtttgtttctagggcccagtactgagtcctgattcatctgaatctaggacgtaataagctatgttaaaacattaatccactgtattaggttaaacactaagaattgcaactaaaatgatgtctcattcaggaaaagcctcttcattcctcctccaggacaatgggcagcacagaaagtgttcgatttaattagctgtgtatgtagaaagagatgctcatctgtttccatggagtcaaacacatcacgacacacttctccatggaaacagagaagggaaaacggaaaatgctaaagtgaatgaattcatcgagcagttggtgagcaaagattgaaggaaaaaaataattcatctgtagtactatgttactagtttacaaaagaaaaacagcatgtaattaagagatcatcattcatgctacataaaagaacatataagatacactgaaatttaagatgtatcttaatactaaaaaataacatattatttggtgggaatatacaaatgttaggaaataccacagagcaaaggtattactgtctttgaatagaagacaaaaatggcagaattcttaaaaggtgaacaatattacagctcaaagtgagtaatgagtaagggattccttagacaacacaataaaatacatagaactaacttataaatacatttatcagttctgtatttgtttcatatcatgactgcttctttgtttttaaggaattttttcctttggagatataaaattatagaaatatttcaagttttattaggtaacacattaatttgtatgattgagcctatttaagtatttttaatttacaacatactgcacgctttgttcccctcgataattatatttcatgttaaaataatgaaagagttacaaaatatgttttcttgaggagttctgacttaaaaacttttttccaatgaaatttagccctaacttgtctcttaattcaatttaactcaattcagatttaatctcagccctctaaatgattatagacttattgggaagaaagatacttaaaacaatgataattttcattcacttcttcagcaagcatttctcatgtgcctactatgtgccaagcactgtgctggattttgtatgtataactatgactttaacagacctagtctatactcatggaggctattaaattagagaggagagagacattaaa

SEQ ID NO: 40932 - DNA, 2430 bp, Bovine  19866880815359
ctggatattttatcattttttataatagatttttaatgaggtataacacatatatagtactgcatatgtctcaagtatacagagacatctgtatatgagtgtaagataaggaaaccaaaagctgttggtgttgtttcccagaaaagtttcagaggtattctactcttctcctttactttttaaatcattaacatgcaaacatatttttaaaactgaaaaataatatttaattttcacagatgaattgagaattctctttatgaataaaaaaggaacactcaagcacaacctgagtcttctttaatttgtgtatttaacatgatataatttttcaaagtgggtgggtaatcttcatcttcttgaagccaaattaataacctcgtggaagattaaaaatgcataattattgacatttagtgagattgctaaagtttttttttatccttatcaacaaataaatgtatctgttgaaatcagagaaacagtagcttccctgaaccaaaacatttctaacagttagatatcttttgcgagaaacccaggaaaggtatgattgatttctttcttggattaaactgagtgtgctaaatgaaaaacaaactaggtacagacgtagactatattgagattaattttattctcatgtgtatcatttccttagctgcttggactaatagtaatttgtttccagagaagtatgtgtcagaataactaagtcaatcgacacagttcaataaacttttaccatatatgtattttgaaattggataaatgtttctaataaacaaaatggctagcatttgtattaataatgactttctatataagtaacataaaatgtattcattcattcaaccaagacaaatcagacactgtgctagattctgggacattcaaaaataaagaaaacaagtctctcatctggaactccaatctggtgggaaagacacaagtaagtaataattatcatacatatgagacagtggggctccaatagaggtatgaacaaaatgctatgcaaacatgggtttttcctattaatcaacctaagataccacaacatagctcattatcacaaaaaaacccaaaaccataataaataatacatgaaaatggttaatctttgggtcagtaatagtagcaatgactacttacatgttacagctattgagatttacaaaacatttagggtaaattaatatcacatgtaagtatatgtactttacagtagataggccaattttgttacttaataccttttttgttatttaatatctttatccatggtgtttgtgagcactttaagagcaggaatcatgtctttcatcttcgcattccaaggcctagcacagtgcctgtcacacagtaagtttttaacatgtgttgaacgtatgcatgcatgcacatatatatgaatatcaatgttacataagtagcacttttgagttcacagataacagaattaagacagacaatacttgaaaagaatatttggtatccaaaatatcagagaacttcactaaacaaaggcatgtgaagtttaagagggctcagtattgacagtacttatttatagcagacatattattcattttttaatattctctctagatgatgctgttaaagtgctacacttaatatgccagcaaatttggaaaactcagcagtggccacaggactggaaaaggtcagttttcattccaatcccaaagaaaggcaatgccaaagaatgttaaaactacgatacaattgccatcattttacatgctagtacagtagtgctcaaaattctccaaggtaggcttcaaacaatacgtgaactgagagctcccagatgttcaagacagacttagaaaaggcaaaggaaccagagatcaaattgccaacacttgctggatcatagaaaaagtaagaaaattccagaaaaatatctacttctgcttcactgactatgctaaagcctttgactgtgtggaatacaacaaactgtggaacattcttaaaaagatggggataccagaccacctgacctgcctcctgagaaatctatatgcaggtcaagaagcaacagttagaaccagacatggaacaagggactggttccaaattgggaaaggagtacatcaaggctgtatattggtcaccctgcttatttaacttctatgcatagtacatcatgcgaaatgctgggctggaggaagcacaagctggaatcaagactgccgggagaaatatcaataacctcagatatgtaaatgacaccatcctaatgtcacaaagcaaagaggaaatgaagagtctcttgatgaaagtgaaagaggagagtgaaaaaactggcttaaaactcaacattcaaaaaactaagatcatggcaactggtcccatgacttcatggcaaatagatggggaaacaatggaaacaatgaccaa

SEQ ID NO: 40933 - DNA, 854 bp, Bovine  19866880820018
ttattctgtgttcagttagtgaaaggttgtaagatggataggaacagcaaaactcaatgattatttaacaagtaataaaggggccacagtcaaacgcgcttgtcattggaagcgttattctgttatctcaagcgaacatggcagagctcctttatttaattagaaactgtttttactggactccttccaggaggacagtgggtatattctatggcgtgttcggggctcttcaggtttcagagttctcacagataggaattaaataaaaggggacagttaaaataaaaccctgtgacctgttactttctccaagagtaagagcagtgttgactgcttccttccccttcagctgtttgcggatggagacctttcctttatcctcagaaccaggcagataaaaattacatacaaatgtactgagttcttttggtgtttttcccagatttagaagacacacatcttgccatttcttgattaattactacatggaagttgctgagaggcaagcttggctcaacataatgaaggactcacatatgattgtggaaactctgccaggctgaatgaggagggtttgggttctaatcttaagagcagcagtaaattctttgtgagatcttgggcaagttgtttcccttcttgaggctgcagtctcctcacctgggggataagaagtggagccgagctcggccggagcgggagcaggtgagggcggctggccgggcagagctccatcgcgggggacgttcttggccgggaaaggtgcaattgtgtgcagctattcctggcagtaacagagaagaatttcgagacaaaggattttcgagcctctctagagaatggtgttctgttgt

SEQ ID NO: 40934 - DNA, 1580 bp, Bovine  19866880835996
cagctttaaacagatggcagaatgggaataaatgtgttagctcctttctcttacttgggttttcattgtttatatcattaaaaataaggagagtttaaaataacatatatcgtcatgtagcgactcacagagacacgcaaaactagttggaagggaaagactgaatttggtcatactcctggttgttttgaaaataactgggtgaattcaagtaagtaactagctggctatttacaacagaggtttaaacctttaaagacacactgaactggtcaccaaaaactctggataattcagagactggtttaagaacatttctcctgtgttgagaaagtgggtgttgtggattatggagacttatactcccaaagttcaatagacttaatcaattatctagttaaggaataacaaagaaatgcatgagtgtcaacactttctgtttccagacctcaacagatagcacgaacctgttctagaatcattcctgctactagaggtttagtctcagaattcttctctggacagtggatgctgcttgttcatgacaagagtgggtatgtgggagccttttccccatcactgctctcatccaactcattcatttttttcagatgaagagatgggacccaaagatgataaagtgcccagaaatattgatcatggccagaactatactgctttgctctataaatgcttactagtgaagtcaaagtctctcagtcatgtctgactctttgcaacctgtggactatagcctgccaggctcctctgtccctggaattctccaggcaagaacattggagtgggaagctattcccttctccaggggatcttcccaacccagtggtttacaaatacttatttcctatgtgcctggcactgtgctaagcaccctacacaaatcaccccatttgagttcacaacaatcttatagaagcaatttttgtttctatttaaaaaatgaggaatcagagttaggtcaaatactgctcttcttgtcaggatcttagagtaagctcacatgaagtccctttctcttctttgaattcataggaaagttaataaaatacttgaaatgcttaaagcacataagaaataaagggaataatctgtggatcaggaataaaaaatctatttatctatttagtaatatttaggagtcaaagtggggccgtggaaataggaactgcatatgagctccccccaaattttggggggctctgaagtatgtctgagcttgcactgtaagctacatacacccacctctatcaaaaagtttcttatgaaatcaggaacgtgttacggaggggagtgaatttgtgctgcaccgagaccattttgtgaggtgtggacagacaacctgcctcagaggacttgggttcacatgtccattcttgcctctttgggaatgtagctttcattctctagggataaaaaagttcctcatcttccaaacagagtattaatgcttctactgtatactcgtagcttcttaaatttcagttaggtaggcagcctccaagatgtctccctgaggatcagtgatgagtcatcatgctctgtaacagtccccttgcaca

SEQ ID NO: 40935 - DNA, 1278 bp, Bovine  19866880851158
cctgtgaaggcccgtaaccccttgaatatgaatgctctgaatacatccagttttttgtcagcataattgtccgagtaaacaaacaaacaaacaaaaaatgacccagctatatgttttctgcaagaaacctgctttaaatacaaagaaacagaaaggttaaaagcaagggaatggagaaagatacgccacactaatgctaacaaagagtagctatattaatctcagacaaagcagaccttaggacaaggaaaattatcaggagtaaaaaggggcactttacctaatgataaggggttaattctcctttacagtccttaacgtgtatgcgcctaacaatggagcaccaaaatacatgagacaaaacctgacagaaaggcagggaaaaatacaaatgccttgtaagtagcacatgagagcaacagtgcaaaaattaagttcgtgaaagttgccgtttctttcagggcagcatgattgtcacagaagaactaagagaatataacaatagggcaaaaggatttccaagacaccaaatatttctagattcctgttggagaagctgctggggctctcttttacaggattatagaacctgtcctcaatcctttgacaactgacactctcaccagtaaaccttttaatcctccaactagtgaaatacatttaagggataggaaatccacaaaattcacaaagaggccacccttcctcttctcagcagggcaaatgcccaaatctcattgtcacaccgtttacgggatttttgccttctgtgggcctcagtggattacaggagttttttgaatggtatttatatttcctctagccaaagacacattaactgtagtatttctttggcagattactactaaagaaagaaatgttgcttgctccacggaaataaattgataggttcaggaactgtcactttgcttatataagtgaatgcctcaaaagataaatgtttcaagcctgagcaaatggttttaaatacagaaaaaatatcctgaatccatatacttaaacattacaagacataattggtaagtttgaatctttttaacatctggtaagtgctttcccattcattcaatcagttagtcagcacagccaatatgccagccactgtactgagtcctgctgactgaaagtttaaaaagatctcatttctgtcttctgggggctcacagtccacggggaaagacagacatgtcaataaatacaatacaattaacaagcgctattattagctatccctacacaaggctacagaaagaagca

SEQ ID NO: 40936 - DNA, 1004 bp, Bovine  19866880859736
ataagaatactggagtgggttgccatttccttctccaggggatcttccctaacccagggattgaacccagggtctcccgcattgcaggcagactctttaccctttgagctaccagggaatctgggaggaatagttaagtatttaagtgaagcaggcatggtagatacaacatgtaacagttatgtgtctttgtttttagcatcaagcattgcacaattctctcgaataatgtagatcatcttttactgaatttaacgctgtctgatatcatggtctccctggcaaatgcctcaactttgcagaaggattccagttggatagaaaggataaggaaatttgtaacagaaacccttgaagatggctctaggctaaatagtaagcagctgaacagattgcttggagtctcctggaggttaatgcagatacagccaaacagaggtaggtgttaatgctttgtccagaggaactcttaatgcatgctgttaatatttagagtctaactttgagttcataactgtcaaacatttcacatagtcatttacgttcaagccataaaaggtagctagcataatcatgaaggaatatctccttgaaccctgatggctgagaagacccctttttaagtgggtaggtccactcttaagctgatggataggttttctactggattacatacttggagtgaaaggaggcaagttttattaagaggaagtgacattgagcctaaggatgaagaaatactcttttctgatctaatttgactagaaattgatacttatctctttacctttcttgtaacttgaagttatgttgcattaagtcaatttttagtgtgacttactaattcttttcattcataacagaactttcctggttggttcctggcttatctacctttctagtattctgttttttgttgtcctttcctaggtttgttgtctcttaggaaaatttgtactgcaattgcggtggttgactttgtattaggccattatgtaggattt

SEQ ID NO: 40937 - DNA, 1252 bp, Bovine  19866880872235
ttgtttggaggtgactcttctagtctttctacctgtctggttacttagactgtttcttcaaggatgtctgcacaggaagtggccttggaatctagagacagtatctcccttcaggcaggaggatgaatctgcttgctgcccaaggacaacaaagataacgtcttgtttgagggaaaagtttgggcaggtatgctcacattcctgaggtaagatttctaagctcaagttttctcaaatgtgacacagtcccactccctgtgcagcatctgcctggacttgcttctgcatcagcgtagtacttggggacaagaagaatcaatgacgcctgctgtatcataaataacaaactatctaaataaatgtgatcttatgggctcttcatctgctgaatctatgtggcaagacaacctaatagctgcaatagcttgactgcttgactgtattgtcttttgagggtgtgctcatcaattatttgacaaatgagttaatgaatgaacgaaactggctgcagcatggagaatggttcgagaaggaagaattgaatccagagtgctgacaggctactttagttctttagacattaaattacgatggataggattagaatgatggaataacaggaatggaaaaaagagccaaagtggggagacctcagatatgcacacagattcatctaaaatccttggctggcccctgaactgcaaatgcatggagaaactccaagaagtctgcagaaactaataaactgaaggttgaaaaagttgatcagagatttcagctactacccagcacagaggagacagaatgtggagttttgagtctcacctagttagagggcttgatatacttcttggggtttccactgaaatctccaaagagccatgccttaaaagcataggttatgtaccagggctatggatcaggtctgaaagattcaacaaaagactatgggaaaaaagtaaaacatttaagttcagtgtgattaaccagttttaactacctgataaaacaaacaaaaaaatcaacactctctagaggaagacaacagaatgaggagtccctataacataccacctaaaattgtgaggacatgataaaaaattactacacatgcaaagaaacaaaaaaatttgggacaaaatagaaaaaaacaattaatacagacctcaagatgactctttggccacctgatatgaaaaactaactcattggaaatgaccctgatgctgggaatgactgaaggcaggaggag

SEQ ID NO: 40938 - DNA, 1017 bp, Bovine  19866880901769
gtgatgcctccgcctctatcctctgtcgtcctttctcctcctgccccccatcactcccagcatcagagtcttttccaatgagtcagctcttcgcatgaggtggccaaagtattggagtttcagctttagcatcagtccttccaaagaacacccaggactgatctcctttagaatggactggttggatctccttgcagtccaagggactcacaagagtcctctccaacaccacagttccaagaccctgttaatggatctatttgctttggttgtgtcacttttgtaaatgtaactttatattggaattgaagttttattttatcttcccctttcaccttttggtattataactgatcttgttttaaacatgaatctgtgtataagtgcttattgagcaacaaactggacagtccagaaaggagcccttaatatctctcttttcttgcccttaagtcaggattctttactaagccatatcctaatttcttcaagaaatcatcatgcaatccttaccccttgcctccctggccctctagaaccctatctttagcaaactgtgggaacccagaaacctgtgaccctagcttgtccagttcctccatcctaccaatttattcatttaacagaaatctactgaaatgcttattagaatatgtagtctcagaataagacacggtccctgatgtctgcagaccctacccacctatcccagatgggagagatttaagaatgctagaagaggaaagagccacttgaaagcgagagactgaagatacagattgtgtctccttggtattttctaggacatctccttaggaagtcaggtgagtgggctagaagagttacatacaaagagaaatagggaggaagtataaagtttgtatcctgtcatagactttatatttttcttaaattataattaatatgtatgacctaattgcacttcgctggctcagacagtaaagaatctgcttgcaatgcaggagatgtaggttcgatccctgggttgagaagatc

SEQ ID NO: 40939 - DNA, 3793 bp, Bovine  19866880903158
gaaacagtccataaagaaatctgctggcttttctggctttaggaagtagagatctgctaaccagttcatcagcaaagcatggtgccatccctgctgccctttccataactgcactctggatgccagttccactactgtggtactatgagaaaaaaagtgaagttctcaaaagttcctgagcatccattgaaacattgcttatctttaccttatacagcatttctaaactctgtagcaggtatcctttggattaaaagcactacatcttccttggtttatgtaattactggatattttttttgatactgcaaacctcaaatgagcaaaagtcagtctaagtggtctcagaggagaataaattttggtcaaatactatggctagaatttaatcacttagcagccaggaaagagttagaagatggcaaccgttctttgagcagagtcccctttgtggaacataatccttttaagtttaccaagaataagtcaaagcaaatctcacctacttttctgatacagaagaggaccgtagatataaaatatttctatctcaatcaacattatatcataccaagtgcttcataattacttatatatcagaagaagaaatatagattgaaagataacaatcatatggttgcccaatgagttgtatttactgtaccaaggtcaaccaggagagaacactccattggtgtaaaaggttgcttaactagcttcatctcctaatagctttctcagaccctaaaaatgcagtaccaacctagacaggtagtcttccaaagttactatattagttacacattttctgtgcattcctatgaaaatatttgagtacttgacctgtcattttcccctgagaacttctgtactgtctcccactggtttcttctaggtcccacctaccagaatctaagttgctcttacatttagcattttaatttttctctacaatattcaatcaaatccctcatggtaggtaaaactctcacacaaaaaaacccactgttttttccacatcttaataagagatactttgtaatattagtttgaaccacttttgaaaatcaaaagaaatggtagtggcggattcattttgatatttggcaaaactaatccaatttgtaaagtttaaaaataaaataaaatttaaaaaaatatatcagcaatttcatatcgttctacatagaaaaccaaatccaaatgtcttctgctaaaaattccattggaaatcatcacaatgggggtgggagactgtaatttatagaagtctgtgaagatgataaaggcaagcatttgaagaagcagatattaccgctaatatcagctcagaaaaacacattaattggataaagttcaatgagcttcaagcacgtttttctccttctctttacaactctgttcctgaagatgaaccctttctctttctgcttgatcccatgaaggtcactacttccagcaaacttgagaatttaccatgctgtattctaatgttgataattttctctgtgcttgatttttgagtcttcctataaacaagggaaaacaaagaaatactctcttccttcaacagctggaattcaacagctggaaattccatttcattctgttttaaattcttaataaaaaacattttacacaaaatttatcaagtaaaattacaaataaaattatgcataaaatgttttgtatttttaaacaaaagtaatctagaaagagtatttatctagtacattttgtaaaatataactgcttttctcaaagtgaagtgtttttgtaattaaagatgtatatttatcttatgtttagattcaaggtggtttccctgatggctcagcagtaaagaatccattgtcaatgtcggagacacaggagacttgggttcaatccctgggtggggaagatccccctggaggaggaaatggcaacccactgcagtattcttgtctggaaaaccccatggacagatgagcctagtgggctacagtccatggggtcacaaagagttggacacaatggagcaactgagcatacacgcacactagattcaaggtattacaaaaatttcacctcaccagtctgaattatagttcataataatccttcaatgaggtccccaaaagacagagctgaaatattatagaatgtgccttgccattaactatttcaaatataattttccttcaattttttattaaagaaaatttatggccagatggaataaaacgcaagtatctaaaatgctaacctatttataatatatgaccaattaaaaaaatgggaaaggggaactgagaatatgttgcccaaaagaaaaatgactaaaagggagatttttataatttttactgtttcttaatttgatcatttttgttgtttcttaacatcaaaaatatgaaagcataatttaatgaatctgtagaatatttaggagtgaagagatgggaggaaggtaaatggatatctactttattcttaaagtgtcctattttcatggtttttaagatagcaaaatattttatgactagattattaacgccaagaaattaaaaaaatttgaaatccaggtaacaaagaggatttctccaagcctgaattattttctactgtcttttctcatctttagatctacgaatccatgacctgagcagggcagcttattgtgaaacaaaaaatgaatgtgaaaatagttgaaattatgggtgttaacctacaatgatttatattttaggcagatattatttcatcctgcctagttctgtaaaattctttcataaaagtccccgactctcacaaaaacagtcagaacatgatggaagaactccttttttgagtttgtgactcatatagttaaaacttcacttgaagtatcagagtttcagtttaagttccttttatttttccctctgaggatgtagaaagtcataagctatccagatatttcaggtagaagaaacagacatggaataaaataatcagcatatgctatgggtagagatagaaattaccatgcaaattatttatctgcctggttgaatctgtctgcacttagcaagccaattttaggcaagacacaatgctagataattctgagactttaaaaagggggcatttttcctatttgtctgttgtattttttcctcaatataaatagataaagatgcttccaataaaactgaaaaatatgaattgaaaataaacaaaaggacaaagtaaaatataaataacagctatagaccaggggaaaacaagctcagataggcaatctcaaagccttcccatattatggactataaactttactctaaccttctggaatgcctcgtcaaagggaagtattattcttataattcaagatgctaaaatgtagctctgtatataagttaaataagctgggtgacaatatacagccttgacgtccttccttttcctatttggaaccagtctgttgtttcatgtccagttctaactgttgcttcctgacctgcatacagatttctcaagaggctggtcaggtagtctggtattcccatctctttcagaattttccagtttattgtgatccacacagtcaaaggcttcagcatagtcaataaagcagaaatagatgtttttctggaactctcttgctttttcaatgatacagcagatgttggcaatttgatgtctggttcctctgctttttctaaacccagcttgaacatccggaagttcacagttcacgtactgctgaagccggcttagagaattttgagcattactttactagcctggagataagtgcaattgtggg

SEQ ID NO: 40940 - DNA, 594 bp, Bovine  19866880909830
gtttagttggtgcctccctcctatatcttaactttgtgaaaagttaccatatctatctttttttcacatgaatcaccaagcactttgcatgacagttggcagataagtacatagtaaatatttactggatcaacaatatatagtatctgtatttaaagaactttagtagaatgttgaagatacacagagaaaataccatttataaaatgtacaacagaagatagcagtttccgaagtaaattaggattgtccagatgtaacattcagagaagaggatggcaccccattccagtactcttacctggaaaatcccataggtggaggaccctggtaggctgcagtccatggggtcaataagagtcggacacgactgagcgacttcactttcacttttcactttcatgcattggagaaggaaatggcaacccactccagtattcttgcctggagaatcccagggacggcggagcccggtgggctgccatctatggggttgcacagagttggacacaactgaagcgacttagcagcggcagcagcagcagatgtaacattaaccacagaatgtggtagaaaattattgaattcagtcca

SEQ ID NO: 40941 - DNA, 763 bp, Bovine  19866880938859
aggacatatagcccagcaaaaaatatgtactaaaagcataaaatgtactgtgctaggtgtaaataatttccccagttagtccaagtggtgaataaccccagcttttgttctatttggagcacctgtgtgtaatccacgtcataaatattttcaggactattgcttagtagtcaatgagtttctttgttggcacagaatttaagatatttccctaataaggacacccagtgttaaagcaatgaatttctatagctatgcagttcagagagttacctaggagatgaaaagctaatctgtctggaatttctgcccttgagaccaaagatactataaatttgctcgggaggaaaataatcatggtaagcatcttaatttcttccatctcgtttccaagcagatgtcgctgtgttttagcctggaattcatcatctctctgatacatcaacattgacatattacatcttcatctcttattatagaaaatggaaatgaaactagaatgtgaatatgttgaatgaatcggactccccagagatttgggggagaagaaaacctcccactcgcctttgacttttggatttcttatttccctcatgtttggattgcactttaagaagtccatctggaagttcactcttttatattttacaaatgcaagtagagcttattatcaaaatacaaacccctaaaagaagaaaaacctgtgagcagggattgggtaggggggcacaggtcagagaatcacctcagaaatccagtgatg

SEQ ID NO: 40942 - DNA, 1892 bp, Bovine  19866880945559
ttctgaatgttgagctttaagccactttttactctcactttcactttatcaggaggcttttgagttcctcttcactttctgccataagggtggtgtcatctgcatatctgaggttattgatatttctcccggaaatcttgattccagcttgtgcttcttccagcccagcgtttctcatgatgtactctgcatagaagttaaataaacagggtgacaatatacagccttgacgaactccttttcctatttggaaccaggctgttgatccctgtctcctgtaccatgttgaagcattatgggaaatccaaacaagttccaaggactggctctgcttcatgcccttttagccaaggctgctcactcacacctgcatggcgactgggtacgggtcctcactggtccagctcaggttcagatcccatactttgacttcttatctctgatgctttccagatttccatcatcctctaatctccattattctgaaaccaataataaaaggagagaaagggtcagccttctattgtggggattccttaattcccgagctccagccctagaagcacctccatatttcctgttcctcctttgtcccattagaagcaaaattactagactttactcaaaaagtggaaaatagaaatcatagaggacaacagtatgaaagttaatatcttgttatgctctcatctgggaactgattgagtttctaaaagcccttgaggtgctcctgctgacagctgggactgagggttcaaagcagagaaacagagcatgtggggaaatgcttttactttgtgattttcttctcaaacctggccatgggatgtaatatgcaaggggggagtggaataggaatataaatattgcaataatgatgataatgctttcatacctggcatggggatgagatttcattaggatgaggcagggagaataatgaaaaggattctgagatgctgatgaaacccagagtggtgtggttctgcgtgaagagtgtgttaagaaacctgagaaatttctgcctgttttagtctaccatcaaggaaactatcttatccttttcccccacattttctgttatgtgtggcatgactggagattaggatagaaaagatgttcctggagctttctctgaaaacagtggccccaccccactgacatggaaaggattgatgctcagaattaccaacttgtaaatgaaaattaatactgtaattagccaaggaaaatccatctctttgttaatagagatacttatagattgtgatattccccttgggatcaccaggttatttaaaagggataaatcaggaaccacattcaagcccatgaagaatgccagaaatattcagagcagacatacgcctaaaacagataatattttcactaaagttgtaaaatagtagataaagtggttttttaaaagatacacatttgtggtttttaacacttcttagatggaaaatgttttcagattgacttttgaatatcaacattgtcacctggacaactttttttctagcaaacaaactgaagacactggataaaaagattagtctcacagaaaaaaaaaaaaaaaaaacgatgagatgaatacagcatttcacatgaaagcaagggtcaccaaggatgaaatataaacatttgatagacctgtagctctgataaaaatctatatgatggtacatttctatagtggtcaaaatatggagcctgctttcatatccattaactcatttgattctcaggagtatgtaggaagaggtaaacgagagagatggtaaaaaaaaaaaaatcctcattttatagataaggaactggagccagaaagattcaaacccacattgcctcccaggtattaacagactgtgtgtatttaatgtttgatg

SEQ ID NO: 40943 - DNA, 1485 bp, Bovine  19866881045227
ttaactaacttaattcagattgctttaccctctcgcagacagttaagaagtaaagaagcaaactggggggaaaaaggaaaaagaaaaacaaagctgtctaaactgccagacctaatagggcccaaatgcaagtgactcatttagccctaccttagtatatattattgctcctgggcctttgttcactatattcttcctttgtagaatatcctttccccattttcatacttccaaactctatgcatttcttccagaccaagctcaaacaacacctccatcagctcttcaaagttttttaaagttttgggatgctcagagttgggaagatatccagttcccctgtgaggcatgagcaaaacggtgcccttgggaaggaaagtaatatttactgagcagctactgcaaatcagtctggcatttcatgtaattctcacaaagctgaacaacctgctcaaattcaaatagctggagagcaaacagagacagaatttgaactcagactttgctgaattcagacccaggtcagggctaattgccaccaagacttgggcattcatgtcaccagaatatcacttatatccccagtctgctgaggcctgagaacactggtgctctaagacgtcctcaaggacataaaaacctcacgcttcaaagaatgctacacaacttgggtgatcactggcaatataaaataagttgaaaatgtccaatttttaaagtaaggaaaaggtcatctttacaatgtaaaaaagtcaatggatggattcattgtcagtgtagttgaccatgaaacaacgctggctttcagccattcgctgcgcccccctcagtcaaggcacttgaacaggcaaaatgaaggacccaggaaacagacattcctatctgcattgccaagaggaggtccagctcctcatggtaacttcccctctgcgctggaagagttgaggctgggccagaatagcttccccatgacagcaaagagcaagcaaaagcggctgggatgcgggaggggcaagggctcagctcctgatgacgctggctgcccttcctcctgcgctgggactcagggcagagaccaagcacacaggctgggagagacgctctatgctcctaggaaccatcgacacgtgtgtgtgtgtgtgtgtgtgtgtgtgtgtgtgtgtgcgcgcgcgcgtagcaagtgggggctggggagcgggttcgtcgtcagaaccgccagctaggaaaacccttagggattatctagtccaaccccctcatttcccagggcaagttactgggggcccagagagggaaaggaatttgttcactgtcacggggaattcagtgacgcaggctccccgtgctgggttcagtgtaggacagtgaaccctgacaagggaccctgggtttccattgtatgcatcagaaaaatcaaaataatcacagagctcagtattttccagccactggaaaagtctaacttagttaaatccttgaagcaca

SEQ ID NO: 40944 - DNA, 3165 bp, Bovine  19866881256195
aggacatctttgaggccgttgacgacagagcctgagtgtaagttttaaatcagtggaaattgggaagttggctgggggcaggaaagagctgtgaagcgttcaatgattgaagtccactctgaggacagagaacatttgtatttagagggggaaagcacaggaaaggaactccaacagtggagcagagcttccgtattacaaggctctgcagtctaaggctaatgagggacagagttcctggagacaaaatggtggataccttgagtcaaggaggctgaagaattagtaggacaggtgataagtttgacagaaagagaaaatgaggttgtgacagagtataggctagtagctctgtgcttgggtagagtttcttaccacttgctgatgagcaaggaactcagggtaaatgatctctgtgctcagagagggggcaggcatctaaagactaagtttcaggaaggctgccagaggttttgtagccatatagacatgcattcaaatctcacgggatgtcaggcaaggtactcaacctctcctagctcccttcaccattttcagacaggggataatgacacctcagaagcagtgagcattaagtgatgtcatggatgagtatttctatcaggatagctggcacacataacagatgcctaataagcgttgagtctcctcttctcctcaaatcaaatacccttagaaccccagcctggaggatgaccagcatcacggcaggtgatcaggttaaggggctagtgatccctgggctgactgttagagccatgaaataggctgagatttaaaaaaaaataaaacaaaaatgccagtgtgcttgcaaaactaactgaatagaacacacaaaagtattgtttatagtaacgtcacaatgcagttcaggatgacactgaagaataattttctgaagtatcttttgaaggattttgttcatggtgaggggtgtcagatagtagatggtacaagaaccaccctctttgaagcctgatgagattttcaacctactgggcaaagtacagactttttcaaatatttggacaagatgatagactatttaatactctcagatttttgtattctctgttttttgactttgttcttttccatttttctcctagtcttagaacaaaagtttataagtagcttggtcacgaagctacctgatagaaaaaaaatgggggagagtgtgaaatcagtgcctaaggcaaaaaaatcacatataatcaagattatctttgaaaataatttgcattatgctttttataagctcaaaagtcaatgtttagtcaaaagaattgaaagcaaagtgttgaaaagatatatttgtacatgcatgttcacatcagtataaaaggaggaaacaaatcaaatgtccattgacacgtgacaaagtgtgatatattatttgttatggaatattatttagccttaagaaggaaggaaactctgacatgtgctatagcatgctgaatcttgagaacattatgctaggtaaaataagccagacacaagaggactaactccactcatatgaggtacctaggtagtcagattcatagaaacaggaagaagaatattggttaccagggctgtgggagggaggaatagagagttattgtttaatgggaacagagcttcagttctgtaagaagagttccagagattgtttaaacaataatatgtggtcttaacatcactgtacatttaaaaatggttaaaatggtatgttttctgtgtgttttaccatattttttaaaaagtcaatcaaaattgtgcacaaaaataattcttgtgttatctttgtccatttaacctatggaaattcatccataggcatatgccccttatctaaaactaatctttcttgccgccttccccactcaaaccagacttttgtccctagagtccccagagaaagagcttctccactccccttctcttttatccctttggtccagacattgacatttgaatttgtatgcaagatggtgcttactatatctctcattctattcttacaatattttatagttgaggaatgaaggtactgtcaagaagcagagagaagtgtttggctcctagaccacacacagcacctagatgtcacagaaaatactttatgtatgaaccaataaagaaaatcatgagaactcccacatttctgtttttgagctatccgtgcattaaaaaaacccatatttggaactgtgagattaggtttgacataaatacacttccatgtgtaaaatagatagctaatgggaacctcctgtaaagggagcacagggagctcagcttgatgctctgtgatgacctagaggggtgggatgggggtggggagggaaagccaagagggaagggatatacgtatacatatagctgattcatttctttgtatagcagaaacacaacattgtaaagcaattatatgccaattaaaaaatatttgtactcacttggaatatatatttgggatatgctaagtcatttcagtcatgtccgactctttgcaaccctgtagactgccaggctcctctgtccatcagattctccaggcaaggatatggagtgggttgccatgccctcctccaggggatcttccccactcagggatcaaatccgtgtctcttaagtctcctgcattggcagtcaggttcttaaccactagcgccacctgggaagcctgtatgtttcggccagtgttgaataaaagttgtatttgcattgcccaccggggcgtttctaagcaaaaggccgagtaccaatcaatctttgagaactctaacccggattcttataaattctggttcacaaataactgatatcccattaatttgaaacagaaagaaatcctttacatgcctaaatgatacttttaggcaacaaattgttaactccactatatacagttgaaagcaaaagcttcatacactgcatgtttgtatctcctcaaagcgcccaattgtgctttgcttgcaggaagtaatcaatagatagttattgaatttagaatgtccctcttcccaatcagtgaagtttaatatatttctgattcagaatgcctattaatttttcagcactagtaagcctttaaaaaatccatttgagatatgtttaagagttcacatgggggttgcaaagagtcggacatga

SEQ ID NO: 40945 - DNA, 1182 bp, Bovine  19866881277376
ataaaatgtttctttgtctcttaaccaaattcagtctccttctgttggcttgagcaacaccaggcaggaagacttttattggagctcagctggaaagggctggtaacaatagtggattctgtagccaaatagaatgaaacaaaataaattgcagttttccctacagtgaaagtgtaatgtctattacactgaaaaccatccaggagtatgtcaagccccttatcagtgtcatggggcatgaaaaatggaagagtgagtagtttcccctggggaagtccacagagggcagtccaggtctcagcagatgagggaggtggatggtgagcggtccatcgtgaagttgggacccagggcacagaggagagaagtgggactcaatagcgaaagatgggatcattcaagaaataagcaggatacctacaggagaaaaggagggtcagggatagcctttcattctgtgatagagaactgtagagatgagaagcttgttagaagatattcccccaccctacatccgatcaaatattctaactgtggcccagactgggccagcgtctcaggtaatatccacttggtctcaaagagaccatgagggctactgaaggtttacaaacagatttccagagccttcctcttgtctcctaatacaaaaaaataaagtattcttatcccacattaattttttatccagaataaattttgcaattaaaaaaatcaactctcaatctttttaaatatgttaagttaaaatgtgcaaaacaactattttctccttcctttaaagagaaacagagaaacctttaaatttgctttttcatatttcataggagaaaaaaaatggagcaaatgatgtgattgaagccaaggttgtctataaagtgtgaaagcacgtcctttccttcttagaagccagggctaactctaggagggagaggaaattagcatgaaagttttacttaagttacaagatgggtgagggccttgcctgaagatggtatctccctgtctcctgtgacagacaatgaatggctttcaaaaccaaggtcattctctttattatgtaaatagtttctgagaaactcacagtctgttctattggagtaagtgtgatggtgctgaaagcaggctgacccctgggagtttagagggtccgctgggtctgtcctcaatctgctacctatg

SEQ ID NO: 40946 - DNA, 933 bp, Bovine  19866881374342
caattaataaggaaaagaaccaaggcaatgtaagatttttcagattatgttttcagtgtctgtctacacaatgatttcctgagctgctcttgatcatgaaggaagaggagtggccaggaagggatgttagcagagaggggaaagaatggcagtgaagctatgcttaaacactcaaaactcaagttcactcatgtgcttgtccctcagagataccctctggcttctaatatgaggaaaagaccagtccctaaatctctgagtaccaacacaagtggacgtttgcacaagtagaaacaaaggcctggagtcctactttaaatgcattttacatttaatgtagttaacacacaatacattaaaagtttcacattaaacttcttccagtgagcctagtttcaagtgtgaggtggcaaaaaataacagctcctgaaaccattttctctttttttcaaggtgtcctttagggaagttggagttacaacaaaggaagtaaaacagaacctttgctttggtcttctttccagctttcctgtcagcctcaggctcactctcagtgccagctatagccccacctcctttcctctgacaagtcttggctgcagcctcaccctggctgtctccagagtcaagggacctcttcaaccttccccctgaaagcactaggaacctctcctcctcagcatatcacatgcttgtccttcttccattaaatttgggtaattattggttacgtgtctgtcttcctgaagactctgagcttcctgaagacagtggctgtgcctgcttgttcactcctaagcccatggagccaagggcagtgcccggcacaaggcggtaggtgttggccgagccacaccctcattagtttccccttcctccccagggtctgagtcacttaccaccaagagctatttgcagagcacacacgacgtg

SEQ ID NO: 40947 - DNA, 1509 bp, Bovine  19866881428208
atcacggtgacacgaaaggaaaagtctgaatatttttttggtgaacaagtgggcatgaactgccctgccctccaagttttggacaataatggttcctccccttcttccttgtctccccaagaaacagccagagaacattctaaaggccgatctgcctgtgtccacttcagtcctagcgaaggcagtgatgggaacaggcgtccaggagtctgccctgctgagaagcccagaggtgagacagctggtgagcagcactgtgacaaggggaaaggctcctccaagcagccctcccatgtcaagggggctgggcccgatgcggaaggcgaggagcccagctgggcagccacaagccttccacagcaagacagccattggaaagccagccggcggcaggacgcagcacccaaggccatgcgtgcctcccagaagaggcgcagccaggagctcagaggagggaggcgctccccggccgggtccagccggcctggcagtgccaagggggaagtggtccaccctgggcagagtcctctccaccaccggacaccaaggaacacagtgacacaggacaagctcgcaggagggacctcctcagatttgccaccaagcacagaggtgttgagatcaggagtcaggaagctggggacatcggcccggtctgaagacactcggctacccaaggagactgatccggctcctggtcccctccctgggcagactgtgaacattgaccttctccccgtagagctgcggctgcagatcatccagagagaaagaagcaggaaggagctgttccgcaggaagaacaaggctgcggcgatcatccagcgggcctggaggaggtatgaaggcagggcgccaccacagctctggctctgtggctgtcctccacctgacgcgacactccctctgctctgggacactttctttatatgcagttttatttatttatggcttctttgggtcttcatggctgcatgggcttttttctggttgaggtgagcggaggctactctttagttgtggtgggcaggctcctcactgcagtggcttctcttgttgcagagcatgtgctctagagcacagactgagtggtggtggcacacaggcttagttgctctgaggcatatgggatcttcccagaccagggattgaacctgtgtctcctgcattggcaggtggatttttttttttaccatggagccaccaggaaagccctctgtgatactttctagtggattgcatgtgctggcctgacaaggccaactttactgagcctacctatgagattcccacatgtttagatcttaataatttatattaagctatttggaaggtgtttttacccagaatgataggaaaggacccaagatagtggggtgtaaatgaaaaaccaggaagcctgagtttcaggtgaagctctaacacattatccgatgttgagcaatggcctccctgacccttcggtttcctcctctgtaaaagggtgtttaacaattgctgcaacctgtc

SEQ ID NO: 40948 - DNA, 742 bp, Bovine  19866881428810
tagtgagctgaaggcagttgctgtgggccaggctcctccccatctcacttaggttcttcagactggagtcaacaaagccaggcttgcaccagctggcagggagaaatcccaacccagcagatcttcagtgctcacttttcttagttctgcgtagagttattataaagtcttcttttccagtcctactgaagtggaggcagatgggcagttctgcacaggtatggactaccctggtcctttcagtgcagctgaagaatttacaaaacagtgctatgtgagagcagaaggaaaacatttcttttcagttgttaccacatttttaggctaataaggctttgggatattaaagttgcgtaaagtgtaaaagctaatcagagaacttgaagtctgcactagctatccgagccccccgggcacagtcttcctccttaggcagtcgaagctttagtttgtttcttgatgggttagctgattgcaggttgtaagaaaaattctgtgatttcccactgttcttaaggaggtgaatacactgcaagttgctcactgttaaataacagatactcaaattattaatgctgaagggcagggtggggaggaaaaggggtttaggtttggactacccatgggacccaataaggtgatggctggtttatggtagagacaggatgacatcagcccctccttttccatcctctcaaagatacttgacatctttttaaggaagaacctgactgtgaggggg

SEQ ID NO: 40949 - DNA, 984 bp, Bovine  19866881578376
gaataagacagatcaaatccctcacttgtttctttacctgaatttgatcaaatagattttctagttctgacattttatattcaatttcaatatgatttccgttttcttctggtgcaaatggaaacataataggaaatcaagagtcaagacaaaccacagtagtagagaaccttggctcaagatatatgaggagtaagaaagagctctcgaaatagtctgcatgacttcaactctctagataaattctattccataatgcacaagaaaaacagacactgtttatcatcctctgagccattttgagacatcatagaaatgagaagaggtgcttaaacactaaaaataagcgtatgttctgactttttgaaaaaggaaattatttgatcctgcaaaggcaggaaaagtaagtttaatgcaaacctctggaaaaattcaggcagattattgagtgtagaaaagaatgcagggatgaccaggaagcaacatgagtttactacaaatgcatcagccattcaacaatttcatcatttacattgtaggctgcattattagcagacacatttatttattggtttatcagatttaagataaacctaaatttaaataataaaatcaactggatggtatttaactttctttctatgtcccaagtcagtttatgtaccagcaattatttgttcctcagaagtctgggtaaaactcagcagtgagtccatcctgaccaagtgcccactctagctcctgcagttaccctgaaggcaatgttttcattctaataatattgccttcatatggaacatctctaattccactttcagaattttcttctgaagtttactttctgtctctacaagtagaaagttattgccctaaggagaattgatttttaactttttcataaatagtcaagtctgtgctgtgctgtgctgtgctaattccttgggttgtctctgactctttgcgaccctatggactgtagcccta

SEQ ID NO: 40950 - DNA, 1210 bp, Bovine  19866881656524
cttgaggatgagactaggagttgaactccctgtggtaattcctcagttaggttcccttttcagtgagctttactgtggtatttatagatgatgatactactgcaagggactcttgagatcttgtttgggtgtgataaaaaccatcaggaagcagttttggtaccactcacattattcttattttctttgcagacactgaagagcggaggtgtgcaggagcagtggctcacagacttacattattgcttcaacgtgtacatcactgggcatccccagggccccaacgcattgagtacagtgtattgaaaaggcactgcagcacgtctgttggaaactgtttattcacatctaattttgaagagagactgatgtcataaatgtttgtcattaaagctgaacttttaaagaagctgtttatgaaccttcctttgcactgaaacaggaaaatgcttgggagttgccactgatacacaggctggcttcttggactagcatgtgatgtgtggttaagtatatacatcccatagctaagtatgtataaaatacagagcaataatatggtacctcctgttatattctaagaaaccagctgaatcttttcagccccatctaggcaaacctcattctgtgtgttctcagtcccagttcattcagacagcaacagactagtttttggtttcgtttgggagtggttgcttttcgccttggagttgtgttgtttacagaggatttctagcaggatttcaagaccgtactcccattgttgtgaattttcctatacctaagtggtagttggtctgagctgcaaaactcttaaaaaatcatttttctactagtgattattatttttgttataatcattttcacaataatgatgtaattagccaactgtaaaaaaaaaaatccaagtatttaacactttattgtttccagtctcttacagtcaggacaggggtggcagtaattttaaaacagaagcagtcctagaaatacctgtgagcctaatatgtctacattcttagtagctttgcccttaaaagatatgaagaaccctgtaatcactgattttatttaaaccaaatgttcttcaagagctggaatgcatagttcgcacagtgccagaggaaaggcaatttgacaagacggctcacctctgcaggtcaggcagaaaataaaagtaggttaaggcctgagctggcgccatgcgtga

SEQ ID NO: 40951 - DNA, 2644 bp, Bovine  19866881690164
ggaacctggggattgcagaccttaagcctccctcagtatcggccacagatgaagagttaaagaaagacagaatagaacaacacagataaggtggatgtgacactaggtctcagcatggctttccctggggagcctagccaagctgagttctttgataaggagaacgaaggaacagactgtttaacaaggttgtacaaggatcagatttgctcatgttttcagccagttttgggtggggagtagaatgcagacactctaggaagaagagacagaagaatttgcatgggataccacttggattcaaacatctttttagcagcaaacaaatgtgattaacctggccagcacagcagtaagctggaaagtcccaaggagacacttccaggcaagttttctatagtgtgtgtttctgttggtgaatcctacattcctactgattgcattttaaaaaaaaatcagatatggattattttgaaataggaacaaatagtccaatgaaatatatctgttgatcatattatacccacatattatgagctagagttattatacctaaatgcctgttggcttaccagaatcaaaaacacctacatccaaaaaaaaacaaaaaacacctacatccaacgctgtgacactaaattatagaccctgccaaatccactcccctggctatgcttcctgtttctgaaataaagagcaccaccattctcccagtcacaccggtgtgaaacataggagccatccttaactttctctagccagttctatcccaattaacatccctccttctccatccccattaccactgccctggataggacttcatcaggtctcattagattaaatggtctcacgagattaaactgatagcttccaactggttcttctgcttcctgatatttcccattaatctccctttatatacttcttccagatccatcttcaaaaagcacatctgtcattgtgtcacaacacatgcctcaaaaccttcaaaatctcttcattgtcttaacaaaatttaagctttgtaacctggaattcaagaatggcataatttgggcccaatatatcttttaaatattttgttattcccctgtattttcattttccttaaaatatatttaactttaattaaaataatatctactatttattgactaaagccctggtttcccccacccgcttcaatcactctatgagatgagatgccttatgatgatccccacgggacacacgaggaaaatgaaactggaacagataaaataacctgctaaatgctgtctgagtggtaggtggcagagccaggtcactacctccaaagcccatgtttgaggctctgcctgtccctcatagaaatttcccttttctgggagcacctgcactgccccctcttcctcatgaaggtgaaacgtttatattcctcttgcttgaagctgttaattcctgaaagttttttgttgcacaacctggaactaggagtttttttaactccaattttctataaaagatttgacttgtgagaacagagcactcctagtgattgttttgtcatttatttctaattttgttttatctgtattgggagttgttcttgcagggtggaactgttttcccttctcttttgctaagcaataaaggaagaattggataaataacatgtattcacttaaggtaaagcaggttggtatatgaaatctcatctgaatcaccccttctccaaggcctggtttttgcacagaattgagaagcatgtgaagagctggaagagttgggtagaaagcacagtctgaaggcacagaggtaagaagatgtaatgctgtaagttctgaagattctcagaagattcatgacctgctaatggtaaagctaaattagtgctcttgacaaaactattaagtaatatattagctgattattttcataagtccaattctagcacctccaggcacactggccatatttttaaaacaaatagataattctctaacttttctttgcagactaccacactgacataaaaatgcttatgtagatttttgaatgaatacgagtctcattaaaatttgcacaggatccacaatgttgtattagattctttttttctgtatgtatttcttcaaattttataaagtaaaacattttcatagtactttgcagtttacaaagaacattgacattatcttatttgatctttggtttttctttgaaaggtaaatagaataattgtaggtaaggaagtgtaactcagacaggggaggtgacttattatgtaacagggataatgcatggaaaagaaaggattttaaccttggtacttaattccaaattccaagctctttccaagcaccttctaggcatctggcacttgacgggtcaagaggaacaaaatgttgaatgagagcatgagaaacttagagtatagtggaaggatggacagcgaagccagtataaagcaatctgaggagatacacatatggtgtatggaagctctgaggaaaggttcatgtatcggtcaaggggtttgtgaaggactggtgagctgagtcttaaagaatgagtgggattcagccaaataaaggaccagcaaaaaatgatgagaaattccatgtaagggaagaacacgagcaaaggcactaggcctgta

SEQ ID NO: 40952 - DNA, 1007 bp, Bovine  19866881916416
tagtctggaaaattaagtatcagaaccaataaagataaagtcccccaaatagtgcataacgcaccagtaggcatgcaataaataccagatattattacaaatgctatggaaagaccttcagagatcattcaattcaacccttctcattttaaagatgaaaaccctggggaccagttaagagaaagaattcttagtattcattttattatataatagcctttcactgtttaaatttctattctctgaaattgcctatactaagacttccaaaaatcaatgctgctgttcaagccatcacttatgacaagaactgggatatgttcagataagcctggaggtgccttgctcatcaatgttagatggcagactatatctctttatgacaatctgtagaacatcaaatctaagacttgagactccacaggtctgagtcactatgtatcgaaggcaatttatctaggtttcctggggagtaaatcactccttactggttttcaagagttttctctaaaatgaggcttcaaagcttccaccctagcaagacctcagtgacctaccagtcacctatggtgcctcgtggctctcagttattcactgaccgccccctacagagtgtgaccagagggaagtacacagaccatttctggggcccattaaaaatgaacattccaagacttgaaggtacaatcttgtagcctccatttcccagactcccaggtgactcttaagcatcataaagttgagaatcattgtcattccaaaaaacatctggcagttcgttcattccaatgatcaatatcttactgagcaggtactccatgcaggccctgattttggcactaagtcagagaagacattgttcttatcctcaaggaactcagaatctgctagaggatagacaaactgcaggtgacacaggacagtgtgatcatttactcatttcatcgttcactaaataattaccaagagcccactgtattctaggcatagattcacatgtagaaagg

SEQ ID NO: 40953 - DNA, 809 bp, Bovine  19866882036446
ttacataagccttacaaaaaattatgcctcatttttagtaaatcagagttttgaaacagtatggaacagatatttgaaaaagaagactgaaaacattcacttggtttgaggtcatctgaagaagtgcatatgattagggccctaagtttaagcaaggggtggtgtcccagtttgtaagaaagcctagtctctgcttccaagactttccatttgagtgcaaaaatgttgccacttatcagcgaccactggaacctctccaacagtcagttcggcttcctacccagaggagcactgagacagctgattggttcagagcaatcagacaacaggcctcagcctcaaagcggtcaaggaacaaagattggtgaccagatattcaggggaaaaaagcatggaaaaggcaggagagggggaaggggacgaggagagaacataattaaccaacgtaagcgtccagaaagtcacatccactcaacatgtcaaagagaaaaatgcgttacctggagacattctgctaggggtggattttttttttttttaatttaagataaataagaatatcgaaactgtcacggaggaaatccaagtcatatgaacaaacttaactaacaagttttacatattaacatttacaaaacgtagtttactcaacaaattcactgaaagatgtcctatttcctaaaaactgtacctaacagttgtccttttgagtgattccagtcctgcacgcgatttcaaattgaagggggaataggtggggtgcagaatacagaaatttttacagcaggaaataaaaagtatttttaaac

SEQ ID NO: 40954 - DNA, 674 bp, Bovine  19866882102928
ttttctactcatatgagttgtttgtcctctgctgagatcctggtagagatctggcctctactgagatcaattaaaattcattatatgttaaaatagaaacctgtttctccccccctccccccaatccattgcatgaattaaaatgcaggtctacaaacattttatttccgtcagtagaactgattttttaaatgactgttttggtagcatacctggcttgtgttaatattaccagtttttctttttatcctctccggaggtcctgcaagtgctgtttcttctcttcagtaactcccactgagattgacagccagtaacttcactgtacacccattctggctcccactagctccaatgcaagaggccagcaggtgccagacgcacagtttacaaatacaaatggctgtcaggtggctgtattgacagaatgcctctgaaagggcctctggtacagaagaaattgcacatgtaccagacaaacactgagaggatatcaatttaatctgacatcatctattgtcacccacagcaaagtgctcaaatatattcaaagaactgcaaatctataatgtttaagataaagcccttgctagtttgttatttaaaaatgctcaaagacggtcacaccaatccaatgtgaattgcttctgcagtcaagaaatattacaattaat

SEQ ID NO: 40955 - DNA, 739 bp, Bovine  19866882159918
tgtgtgctactgtttaagctgaagataaatttaaaaaatgttattattgctgtaaaatgtttcatgctagctaaaaaggcaaactaaaaagtgaatattttgctgatgttttaaatagttttagacgattgctctctgtctctagtctataacaatgtcaaatgttggtcccttgaaattggttagagtgctctgggttttgaaaaaacagttcaagtctgtttaaagccatctgaaaggggaattttctgaagctttttctattcccatgatcctcacagaattctccaattctttctagtatataaaataatggatcttcccttaaagaagtgctaatcccagagtgatcatgtatgacagattttcccacctctgatcaggtttttttttttttttttttgctatatatatatatatatatatgtatggggttttatcctcaaggtgtttattttttcatgaaaatagtgtactgtatataagaaacactcttggaatttttgtttttcaggactctattttggtatgacatttttttgatcattaccatacttagctaagtcagatttcactatcatcaaagaatatatctgagaattaaaatctcaaattgcacttgaccttcctggtttgcagtcagtttaaattagatagtatctcccgtcatcttaaaacaggtgacgtcttagaacgctaccatttgggagaaagcaactataacaataggaaaaagatg

SEQ ID NO: 40956 - DNA, 923 bp, Bovine  19866880344571
agagttggcctcctgtcgctatataatctgagccatcagtgtcccatatcccccttctctccccccacctcacccccaagcctttatctcctccttgggtccttgctccatcactgtaagtaaccaatgggatccttgacctccagctcctccctctgagtggcccctgctgggagctgatgtgaagaaggcttactttcctacaccccctctaatgaaagactcctgatttttttaaatgaaagacataactagagggaattacaaacagaagtggaatgatgtgaaatggaggctgaatgtgactgttctagtacacagaagcttggattggaaaccccatctttggcaaactggagaaggtgcctccattattatggccaccatgcaccatattagtgattcctactcctggcttggaaaagattttagaggtgccctaacggaaccttcttactctgcactgaggcatgagatccagatgggtactctggcttatctagggtgccttcctcatcctttgctattaagttcaagactctggttctctcccagaaactactgagttttgtaaaaatctcatggtagagaaatcttacagtctgtctgggtttaggctccaattttctgaagaactgaaggaaacaaagtgacctttttggtttctgaacatgaggataaggaaagactacagagaaggcccagacttttatcagagcttctctgcattttcaggaacctcccagtgagctccaaaaaatctttctatggttgccacacaaccaacatagcaaccaggaaaggaaaaaaggaagctaagggtgaggtctgaacaaaggttttcctttccttctcgagttcctcttttagtatgtgatgctatagagataaggtccagtggcatcagcatctttggtgaaaag

SEQ ID NO: 40957 - DNA, 971 bp, Bovine  19866880535003
tttaaaaaaattatttgtcatatcttattatgttgtatatttcttccttgatcacctttcacagcattaaaataattttatgctgaactaaaggtgatttttattgcattaagaaaaacccatgctttctaatgttggaacagctgtaataattcaaagtaaaaaaaaaaaaactcagagtacattttacaaacctcattctatacattgcctaatacactgctaattttggctagattttaaataaaacaggcttcaatgaaatgatatgaaaagcaatggatttgacacagtttcaaggattaacacttttagtactgtttcttacaaaatcatgcaggattattacagaaattggtatcatgattattttaactctggccttatcagctgtaagaaatgcttacaccgctgtcactgctggctctcaaaacacactgccacaagtgtcattatttccattgcccatggaaggcaaattaagactggagatttaaagtgcccgtctgaacacacacaatatatccctgaggtccagatggctcttcattctcaccctcatcacagcctcactgcttctcttcttcccgttccggactaactgttcaggtaagctttgattatttgcatctgtcttttcagaattaatgacagaatactgacagaaagggaggtgctggagtcaatggcaaacgtttcttattgttcttactcatgaaagcttggaagacccatcatccccaaggtctgtggctggcttgccactgccagagcctattatttaaaactgtctgtgttgtcctctcagacaacaaagcctgcttcccttctgtgtttgctcacctcgtcaccatttttccctgggagatggaagggtgtatcaaagcaagagaaagcgtcagtggctatttcttccccttctctctctaggttgagtagtgtttcggcaccttgtttatacctatgtaaat

SEQ ID NO: 40958 - DNA, 1347 bp, Bovine  19866880576763
gagaggcacagtgaggacttccttagcactgagtcaggagggaaaagctccagcctggagatgggaatgcaggcttccacttctggctaaaccccagtttctctgcttacaaaatagattgaaattaaatattccaactctaggatttgtcattttactcaggttcttacaagtgtttaagtcaaaccctacctatcactatgattttcttcctgcaggttaaatggcaatgtgtatgtgctgtgtatgtaatgtgtatgtgctgtgtatgtaatgtgtatgtgctgtgtatgtaatgtgtatgtgctgtgtatgtagtataggtgtagtgtatatgtacatcatgtatgtgttgtgtgtatgcagcacatgtgtgcagtgtgtatgtgttgtgtgtgtagtctgtgtgtttggcacgtcatgcactatttactcctgctttccagagcgaccacccacatggccccatcagtgctgaatttccggatccttcagaaaccctgtctcccacacccagccaaataagcaagaacacatgtgaaaagccttattccagtgcctcttgggatgcagccaaacagctggaattatatgctttgtagagaaccggggacgtggcacggcagtaaaaaaaaagttgtttgtatttggaaatcaaattcctttccccaaacctgagagggcaagggagggctgggctgcgctctctaagggtgtgtatgtgtgtgtgtgtgtgtgtgtgtgtgtgtgtagggggcatctttcattaaaatctctgtcttttctagtgttcccccatttacacgtgcatttgcatttcaggctccaatttaaaagtcagcctcttcttccctttgcatctctttctccagttctattgttcttcattcatttctctagtcccagcccccagcgccccctcaaccccctgcttcctgttttgcctgggaacagcgtgtcaagctccctgtaacagcagctcagtattcttaatctgctgtgtggagggggccccacattcaagcaggaaagattagaatgctgtatgattgctaggctgctggatgtcagaatttttagcacttataccttcctggccacaggagagtttcctcttgattccagggttgttcagagctgccagggcccatcttgccattccacatctgttccagtcctgtattgttccttaacaagtcaccccaaactcagtggcttcaaacgagcatcagttttgttcctcaatctgtgatttcagcatggcacttgctagggtggctcaaaggtgaggggtgactccacggctggggggtggagtcatccgaaactcattcactcacaagtctg

SEQ ID NO: 40959 - DNA, 717 bp, Bovine  19866880683559
gttagaagaagccctggtgccttctatttaatggctctcagaccaggaaaaaggcacgttcagtacacccttgctcccttacagctggaaagagttaacatgcaaacagcactttacaaatactaagcagagactgaaataccaggaaaggaaagtgctctgcatgctgctgtgtcctttagcgcggtgatgaggccatggctggtgtgggtatcccactggccccgggccacgggtttcagagggggctcctgccactccttctcctgttgtgccctcccacctccaccgacccgggtgcccagctcacctggccagctccagccccttggcaaacacagcacaccccacagagctggaccttggcccactgcttctcagttgccaaccagccaggagaacacctgcttttcattctcttcgggggagtgtgaggtttccccttggggggaaaaaaactgtgcttgggctctaacacttcccctggttttctttatcaacgtcttctagcctcacttcagaaggtgttccagtgagtcctgacctctgctcttcccagcccaggatcactgctgagtctctacagtcagtgacagaagttccgtggtccatgacttgcctctacgggtttttgttttcctttgtctacatttggttggcataaacacttctgaaaaatgggctgcagctgatgccttttcgtttggttccctttat

SEQ ID NO: 40960 - DNA, 1105 bp, Bovine  19866880722813
tctggtactttcaaaaattctttgctaagtttctcatatttttgcttggaaattgctgccatctattataaagttttacaaattattcttcttgatgccaatagctagagtcaaagaaaatgtgatgtagataacagattggaaacctatcatattggaaaactgcctgttaaaggtccttgagcaataatgctaatgtagccttgttctccaaccaaccaatggacacaaaagggccaggctgcataagcaacatgagaaccatgaagaagtgggatctggggcccattggaggattattttttctgaacttccgtaaccacaggtgctacatacgtaagttggaggaccaggatccacacaaaatctagcttcaaatccaagtcacagaaggatgtaggaaccaacagacttacacatgggacatttataatcttttccatcatgtttttctgtttctcccattatggtaacaacacacatggctacagtttagaaatacccatggctgttttcattgatgtctttcctcttcatactaggaaatgctagtgttttgaatccgatagggttctgaggtaacactgaattgattttctgtcttaaaactgaatttttcactacaggaggcagaataggccttctggagtatgccacaacgatgttatactgcagagttgaattaacaagacagcttatagcttactgatttcaatttccaccatttttcctctctgctgagctaatttggtattatacaaagctgagtgcatttcaacactttgataattccctccatatttcagtgctagaatcttctgtgaacccattatgtggatgcataacaaaacagccattagtggtcaagccattcatctgcccatctgacaccttcaaaatgccactcttcttccccagaaagatgttttttgatgagtcaaatcctgaaacatatatctgtgatgtaaagggaaattatattcacatataattctaaaagcaaatcttgatatagtgctttgtactgactgtgtgtcggaattatcaatacttttactcctggaactatatcagttattacaaaattaatgagactttcagtcaa

SEQ ID NO: 40961 - DNA, 2195 bp, Bovine  19866880765084
gcactgaaaatatgatgagcaccttcattgggcttatattgtctcatggaatagatgaaaaccaatcaaacaatcacacagctggtgggaattaggagaatgcgatggttgtaagattatcccatgtggctgatttctgtgaggaaatccaggcttttcaacctctttaaagtcttctgatttctctcaagggagtgacctctgacctgggatctgaaaactgcttggccctttgaaagggatagattttatcagttgacactacagagatcaagcaggggttggtagaaacaaatttagataattatcagactgaccattcatgtaaacaaaatcactgttgctctttagaaagaagaagaatatcaggagcctggtggcttagaattattaaaactgtcaaaaccaaaagtagaacagttgatcttggggtatccagggagtttccaagtcattctgtcttatagtatataaaggcacagaccctcttaagtgcttcattctcttttattgaaataagttgtagaatacacacacacaagcacacctgggtataattaaagaagtaagatgttagataaattacttttccttaaagaaatattttgatgttcttggaaacctatacctctactggaatactagctaagtttctgatatagacaaactatgtctcacgaaacagcactgatctcttccatataaatgtttcctagtgccctagaatggtcatctgtgaaggttcaggaaataaaatgatccaaaggagcacaaacagtcatcagaatctagtttgcatgttagaattccaatctccttggaagttctagctggtaatctaaattaaccatgaaatgatatatgataatttgaaaataattatgtactcttaaatgagacgccactaaagaacagcagcacaacattaaagtagcatgtgacactctctaattttacctgctgtcattttaatttggggttcagagtcagggtggcaatgcctcttcaaaacattctgaccttggtaaaaaaaaaaaaatccaggcagaatatctaagagaaaaatagtctatcatcctccaaagagggcatcaaacactttcccctgtgcggtgtttcacgaatctggttttgtggaatgctgccagatgactgaactctattcccacagcacctccctccagcccccttcccccacttttcctggtatccctgacagcatctgaattaggctagcaccatgcttagagcaaaattacactgtgcttagctaacggaaatcacttcagaacacacctatggaccattctggggtgtgtgctggttagaaccactaggaactctagggtccatgtagcaccaaatgcttttctctcacctacaaatgttgacctgtaagccaacaggtaagatctccatgagtgatgggaaaatgctccaaaattcatgtccacggataccctgaagcctctgaacttgactgtgcagagttcaattttctatcaaacccacactgattgttttcatcaagatacacactcacgccctctccagaggtaggcgttgctactaggggatccctacgttgttattaccctacatccagtctttctagtctgcagtttcacgtgaaacaattcttgtggagggggcttctgtgtgtggaggggcttctgtctatggaggggaggcaggaaagagtggtggtttggggaggagaattctattcatttcactgtgtgtgtgtgtgtgtgtgtgtgtgtgttccatcgctcagttatgtctgactctttgcaggcccatggactgtaggctcctctgcccatggaattttccaggcaagaatattggagtggggtgccatttcctaatccaaaggattttcccaacccagggattgaacccatatctcttatgtctccttctctttttttgagaagagttgattctttatcaccgtgccaccttccctagtggtcactattgcctctctgtccaatcactctttcaggcctaaaccattatataatacatttttgtagccttttgcatgtaggttacaacataagcaaatgatctcctggaatactttaactttctataatagaaaacttcaaactttttataatagaagattttaaatgtatccaacagtgaggcacacttgtacaataaagctccatatactcccatca

SEQ ID NO: 40962 - DNA, 1029 bp, Bovine  19866880770515
tcctgaatcagacagctactattcacttatgcaaaacattaagacaaagtcattaaagcccccattcctggtaattgtctcagaaattgcgttccctggccgagcaattagttttatacaaagcaagaagatattcgggttagtaatcttgagtttttatgactcaatcaatattttgcttgctgcaggctgctttgctagtacaaattttgagtacagggcatgtggggtatataaatatttagccagccattgaagcagcagttaatgaaattacttcttctattctttactttggaagataccgttggtaggatactagtatgagtgtttatttcagctcctatcatggacgggaaactgaaccgctattgtgctgtatggtttatcattccgtccctttccatatccatactgcaaacctctcttttagatgcatctccttcaaacagatcttgaataacctagtcacttgcctcagatggttttgacctgattttaactcggcagccatgcttctctgttttaagatttgcagtgttttgtgtgtgtgttgtcactccagtactcctgtctggaaaatcccatgggcggaggagcctggtaggctgcagtccatggggttgcgaagagtcgggcacgactgagcaacttcactttcacttttcagtttcatgcattggagaaggaaatggcaacccactccagtgttcttgcctggaaaatcccaggggcgggggagcctggtgggctgccgtctgtggggtcacacagagtcggacacgactgaagcgacttagcagcagcagcagcttgtgtgttgtatgtgtgtgtgttaatatcacctatgtaactaggagtcacaaccaggactaattactaaaccctcccttttagaatagaatgattttattaaaaaaaaattttttttatattggagtatagtcaattaacaatcttgtgatagtttcaggtggaggcaaagggactcaaccataaatatacatgtatctattctcccccaaactc

SEQ ID NO: 40963 - DNA, 833 bp, Bovine  19866880774853
tggatgatgccaaactaaattagtcctttattccacatttcactgctatccagtggtgaatgcccctccccctcaccgggagctacattttgttttctgggttctaatgccctttctgttcccaagtccttggtgatcacagtcttttcaaattctctgtcagattctttctgtaagaattcaagcctggttcttgggtcattagtggagaatagacatacatgaccctcaactatggcccaggctcaaacttaatttctggacttgatgataatatagagtgataagaattacactagatgcacatacagagacctagcaaaagagatgagaaaatgaagacagcaggaaactagagggagggggatagctgatgtccccttccctctgatggtggtggattaaacttctgcctcatagttttgccttttacttgccctgaagattgtgtcttcataacctgattgtaactttcttctccttgttttagaattttctctttccaagtatgcaataggtgcttattaaatatttgctgactgggtgacaaagagaattaagaccttagtatagtcccattgcttgtcccctaatacttgcttttctatattgattgctctgcggtcacactagtctatgagaccctggataatgagaactcaataaaccttcatttgttcaaatcaaaatctgcttagggactacacacaatgtgtcaagcattgtggtagaatggaaatccacaaagattaataagatgtgtctctaaagaagcacacagtgtagcagcaggaataatgcatgtcaggtaactataacgtaaggtagaaaga

SEQ ID NO: 40964 - DNA, 1415 bp, Bovine  19866880807837
catggcccaggttcaatccctggtctgggaactaagatcccacaggctgtgcaatgaggccaaaaaacttaacaagatttaaaaaaattaaaattctaaaatatttaatagctccataaaacatgatttgagggtactaggtgatgcgaaaagatgctggaactagtgggatattttggacaatttttttgtttcttgttgttttttttgttttcactccaggggcccatctataaaaatttaggccaatgatactaagtgcacacaacccctccttgttccaccttacctaactctatagcagtaatttatatgctataaacatataacacccaaagtttcctatttttagcaaagcatcaagcttaccgtccggaaagctgcaaccacaagatttgaaggaaacaggtttctgttggaaaagaaagcactttgtcagtatccttaaaatttgtcattcaacatgttcactttaagatgcccacacctgacagcctaccacacagggttccctctctccccacatcctgcagttattgccatcttctccttgatccaagtactcaactgtgccttggctgaagggtcacaacagagactctgaagcactgatctctatcctcatctccctcgtggtacccttgatatttagctgtgtcccagcgaaccagaataactgcatcactttcctttcccctggtggctaggccctagggcagtggttttcagtgggaactggcgctgccaacttgtgaaatccaagggaatgctgtgttgttacaataactggggggcattcctggaactgggggagtatgtttgggcagaagtgccagatcccagctatttgttctgctaagagtggcaaagtcctgtgtaataaatagtttcaaggccctcatacttcccaatgtcctgtatgacacaaaactgtagaggaaaatcttattcataacttatttgagcttagagactaactttaaagcaaggtatttttgtgcagtttgaatatacactgaattttctaggactgaaactcctgtgtaaaatgtgggatgatttgttttgctttgttcagaatattttcaagtatcattcactttctgggaaatcacatcactaatgaaaaattgtaggatctgggcccttaatcacacatgctagtaactgagtatcagtctgaatttaaagctctctcattaatggtgactctcaactcagaagcaagcacttaatcattttgttttagagcattcacatcttgaaatacattatttttactatgaattattctccttcagtattgaacttttaaaaactttacagtatacttttttatttctattttttaaaatatgtaataatctcttctacctatttatcccaccctccaccatcatctcggcaaccaccaa

SEQ ID NO: 40965 - DNA, 1005 bp, Bovine  19866880840639
gagggagcctgacatgctggaagaatagtgggtagaccagtgcagctgcagcccatgagggaagcagacagtgcagatggggtcagagggaaacaagagggagctaagttgtgtgcagtcttgtaagccatggtgaggtcttgggttttcattgtaagagaagatgggaaatccttggagggtcctgagccaaggacttaggttttggaacggttactctggctgctgtgtggagaatagactgtaggcgggcaggagtgtgaagcaagggcacaggttaggaggctgttgcctttaaggcaagacgatggtggtttggaccaagctctagctgtggagatggttggattctggacgtatcttgaaagcagaacagtctgctgatggattggactgagcatgagagacaaaaaatagttaaggagctctcaagggttttggtctgaacaattggaagaattgtgttgccattaatggagatggaaaagctgggggaggaacagatttggagtcggagggagatgcggaatttagtgataataatcttatctgccctgcctccctcatgggattaaatgtgatgtttcgtgtgtaatttaccctcccaatattccttacagttcctagtattcaaagactctatcccttcccattcagatgccgtctgtccggtggagagttgcctctcgtttgctctcagctggttgcaggtggtagtgggtgaagggttcctagcacgtggactcttggatctgacaggtattatctgagctatatttaggtggatattttaggatgggttttcacaatcatgactcaagtatgacttaacagttgataccttcatttctccccagcagaatgttgtttctaatttttcttttatatagcaactgatgttgccatgcagatcttttggttgctatgagatggtaacattactctgccccacgattggccgggtcctcctaagcaatgtagttctcacttgggtgactggcactg

SEQ ID NO: 40966 - DNA, 1010 bp, Bovine  19866880851403
taattaaattatatcgaggtatgactaggcaaaagtgacaggtgacagctaactaataaaataagcaatagcttatggggttgtaatacatagaaatggctggatggaggagaagaggagaaggcaaggaaaaataccaacaagtggctcaaattaagaactgctccatttccagaaaacataccaggcagttagtcaaattactttcctaacacctagcactggaaaagaatgccgactgaggcagaagtgagaacgtgctgtaattctgcaatctgcacagacatggcaggcctgtgagaatagctgatagccagagggcaatatatagccaatgaaaggaagagcgctaaggacagattcagcctactgagacatcttgcccaaggctccttgcctgttgcccaatcagtaaggccaggcattttatgcattaggtctccatgcccatgaattcagtgacagtaataaactggtttcagagggacgttgaagctaagctcaagtataaaccacagtggtacacagcagtaatattacatgtttcttgaaacacacctgaaaaggcaggaccctgctttacaaaatcatttgccaaagtatgttcttcaaaacactagttctacaggtgttataagctcttcttccttgatccctacagaaaagggttctatggccaagtaaatttgagaaatgaaataaaattaaatagcgttattcactgcaggatttttcagagtccttaatatacgtgttaggaacctccaagtcttgtttagggtttgatatgaaatatttcctgatctcacttcactatggaacccttctttagtgaatcaattctggggattagtgttcagtggaacacatcttgggaaagggtgtccaaacatgcatttttgtgttagacataattagtgatgatatttaaggttaagaaatgacaaacacagcaagaatatattttagaaatggcaatattcattaagtaatattaatattttaaaaaa

SEQ ID NO: 40967 - DNA, 1098 bp, Bovine  19866880881504
aatatctataaaactactgaaaggaacacagcggaaaattccctcaaaggcacaaaccaataaggtgaaatcatcaagcctctgaaatttctaaagcccaaacttattatacttaactctgggggtatctatacccttgaaaaccaatctctcagatttcctctgatgtagtaatcacttagagcatagaattaagtaggaacttgctacccagaatataggaaaccctcagagaatgaagagtttaggatggctgaaatttctaagtgggtgcagattttaattttaaccccttgggacagaaatatgtctaccacatattactctagtttccttaacagaacataatgaacataaaaataaatattctatgatgactccaggacattacacttatgaatactgtttatattaagctgaagtgcagtgacgtctttgggtgctataaaggtgtagaagaacactgatccctatgttaaaaccttacaaagccgtgctttgaggtcttatgtctacttcacagattttctcctgtcttttctgtcaggctgtcaactttcattgcttgctgatgggtatacttgtttctgcagcatactcctccttgaaccagctactctgaattctgctttgggttgagaaatcagataattgaacttcaaagaacagtatttcaaaaggttcttggtgatggcctaagggattctctagggagttagagaaaaggaatttcagtacatggactctgtggcatttattttatatgcctaaatgtcttttctgttttcttcctggttcttggccatagtttaaagacaagtttccttgaacagagttctgctggatgaggtgtcagtgaagtaaaaacatcttcaaatgtactagctagtaaattaattaatttcattttgaaagatgaaagttgaaaaaatgaaattggtggaaaagacgtcaaaggtgacaattatcacagggtattaaacatttagaaatcagttcattaatgtatttgttataaagtagtatcataggacttccctggtgggtcagtggttaagaagccgcctaccaatgcaggggacaggtctgacccttggt

SEQ ID NO: 40968 - DNA, 1399 bp, Bovine  19866880888033
ttgatagcaacaaatggatggaagcatcctctgagacattcttaactttttaattttccctacccatatcatttcaattcaagacatcattgatgtcttacagtttcctcagttttgttcactgacaatttctggaatatccattctcactgctactgttactagtcagttcaagtattcttctctctcggttcaccgtcacagtgccctgcttcacttccttcggcttcttcctcatctaatacattcacctgttgccagaatgatatctttacaaagcaaatctgattatatcactctcggaataaaaattttcaatacctttccattgccttcagcaaggagtccaaactccttagcacaacacgtcatgttctacgtttaaacctcagcatttatgactttccttagacttttgtagaaatgaatcttcatttctacaggcatgacaaacccccctgaatgcactcttcccaggctgctatgtctttgtacctgcccttcccctggacaacaactgctgtccttcaagactcagctccagggtcacctccagaaaaccttccctggaggttgttgtagggatgaaatagtgtgccacttggattcctccgcctcctcaggacaaaagcactcacccttctaactgctgagagtgttagtagcagttcagatccctgctatatttcattctggagattaccttgagttgaagagctacttactaaaggtcatgccttccttccttggggcagcccatttgcaatgactagtcacagaagtagacagaggcataaaggcctggtcccactgcccccattgggacagtgctatgggccatttcagccccatagtcctctcttggaaagactgaggactttgtcacaaatgtatcacagctcaatttattctttcccccagttcaccttctttcacttcttcctacaggtgtccatcatgacagcaagtcttctgcatataaatctccatcgttgactctgcttcacaggaaactgcatggtagcactgggttacagctctcaacaccacttgcttattcctagtgtgactcttatcccatcattgtttacttgtggggctatgcctaaatatagtcagcagcttgagaacaggattttcaatcttgtcttttcatcctcacttcctttttctcctcactcattaaatctttttgaataagtgaatgcataaatgaacacatgaggtcatcatcttgaaaagccttgggggctttcctaaaatcaattcaatccttcccgtgtcttattttcttctaggaatagccccagaaaatctggaacatttctcctagaatgtattttaagtttgctgctgcttctgtttcatgaaattgtgaaagcatagatttggaaatctg

SEQ ID NO: 40969 - DNA, 1307 bp, Bovine  19866880924701
ccggttttttgtgtagttatcttggttttgaaaaatagagccatagtactttttttttggtgataatggttttggagggctgagggaggttgatttgggttttgttttgttgttttttttcaatctcccactttccctgtttgacagctaaagtggccagtattttacaaacccaactaaattttcactagcactttcctgttgccagtcagattgcagttgtttattctgcattatgcattcaccatctacctgaattttgtggttacttggaatagaacctttcacagtagaggaaggaggtgctttgggttcatctggtcctgctttacaagcatctgtaaatttttgcattttagctgcatatttatgcttattatagaaatacaaagaaaggggcttttaaagtatattttgaaactgtaccttaatgaactattaagaacgtgggagagtcaacattttctatagccttcctcccttgttggacatggtgactgtgaaagccgcttttgctggtgtaattgctgtaaacatctgagatctgtgtttatatctgctagtcagctacaaagctggttcatagaaagcagttcctgattttcttcttaaccttgaaataccctaaaaggagaaaacttgtgagcatcaatatatgactctattatatataattttatctgctgatcttctttttaaagaaataataagtagagattgatgaaactataagacatttgtacttaaaatctgcttttctattcaaaactactgaatttgctgaaatcaaagaaagagtataattaaaaaatttttgtctgattgtctttattttcgtaagcttagcatgagttgaaaatacttgttacttgtttttttgtagtcatcatattttatataaattaatattcaaggaagttttaaaatatgtatgtgtattttaaggaagtcagacgggaaggattttactagacttttacaataaacctaatcctaatgaactcagcttcattttgaatttttccaagaagatatttgaactgttagccactagattcagctgtgaaactttaggagtataattaacccttgagatgattttcattttgttcaaaagtagctgttttattcactttttctgaaaacattttacctcccctcttcttacctaaagaagaacattgtgatatataacttttctttagtaataatttaattctttggataatatttcatgtcctcagatagtcagaatgtatttaaattaaccaaatcatttagtgtatgtgagactttacattaacttc

SEQ ID NO: 40970 - DNA, 2322 bp, Bovine  19866881018250
atttccagggttagatcccaggaatcttttagaaaaaactctttctgaagaaaaaaaaaagaaaattctttctggatgactctgatggaagtcaagcttgggaatcactgagttctatttggaaggttaattatcttttcagctgtccgtggctgttttcccaaacagacttcagtgaaatcttgttccaggagtaataaactgttgggagaactatacctcattattattgatatccatctcttctctttcctaaccattgcccctctcctcaaatcccacctgtttctcacctcttaacattatactcacaacttgagtggcaggttttgaaagcctagccctagactttaccttagacttctctttaattccaaattctgttaattcattgcccttataagtactttttaatcaaataatctagcatgggaacagaggggtgtggaaggggaggattggcttgttgcaaggcagattcctaggtcctcccctggacacaggagtatgcattttaatcagctccctagatagtccatactctcttttttgcgcttcactgtatgggccgtttagagtgatttactcttggtaagcaactttgtaaacctctgcttgtgtcgctgaattaaacctccattctcagaactcttgtccacaaaacacagacaccaaatgaatttaccttcccatcttttaactcatctctttcaatgctcctattttaccagttctctcagaagaaattgtccattcacagagtcttagcttttctctaaaaccatagaaacaggcatcttatttctgctctccctgccttttactcccactctgaccaaattcccttttagtgttgactcaaattgtttatctgcgtctgtgcctgaccttttggttctagggacatatttatggcccccttcccctcacccccccttttttttcctttttggtgagtagagatgatgtagaagggagcccagaggaatgattacaggttgagaagtgacccacactttgattccagtatgccactttgaactaagttgttcatcacgggagaaaaagaacttatttattattttgttttttcaacttgcttgctctgtttgcagggtaatctgatctattcgaaaagcaaatattctatttttgaaaatcacattagattttccgcaaagctgtattttgctaccatagaaagaactgcacagaaatttaaccttttcaatatggttgttaaaatacctggtgtcccttagtaaatgaaaaggagccctctagaacccaaagttgcctgtgatgaaggatacaactttcctttatcattccattcagtagaaaataattcctgccggatgatgtgattctagtgatgccactagcaattttagtgaaacaatgtggaaaatacgatgctgttatcagatacaacattaatatttctatttatcaatttctatcaatttataataagtgttaatttattttaaaaaatatttattattagttattcttatttggctgtgtcaggtcttagctgaccaatctttatcatgcaatatggggtctttagttgcggcatgtgaactcttagttgcagcatatggaatctagttccctgaccagggattgaacccaggccctctgcattgggagctcagagtcttagtcactggaccaccagtgtgcgtgtatgctgtcacttcagtcgtgtccgactctttgtgaccccatggactgtagcctgccaaggctcctctgtccatggggattctccaggcaagaatactggagtgggttgctgtgcacttctctaggggatcttcctgaaacagggatcgaatccacctctcttatgtctcctgcattggcaggtgggttctttaccactaggacttcctggaagtccctgggccaccaggaaagcccctaaattaacaattaactgaagtttcagagcctgcagggacaaccacacctggccagtaagccctgacctcctgctccctctacagctgcccctgcccccccaggcttcaggaaccccctagcttcttgactgttcctgcctcctgtctccccgccaatccccaggggagaggaaccttcatgaggctcccaaaggcaccgctgctcttgcagctcagaggccccctcccgtcttctccctaggactccagggagcccgtcgctctgggcaaccatgagctcctccttaccgtctctggccacgtcagtgccatgtagcctccccgcctcagggggactcccttctctgcgcagaagccccctatctcctttccgagattccaggagtct

SEQ ID NO: 40971 - DNA, 873 bp, Bovine  19866881037843
aagggagccgaggacttccaaacccggaccccaggccatttcattccaggccccaccccctgtctggcggggaccagccatccgtagtgcccctgaggagttgggttgtgcatttattttctgtcgagggatctgagctgaggttgccattaagtacccgcttaatttcattgcactgagagtacactctcacgtgggtcggtggcatactgggatcccgagggctgtgatcacaaagttcttacggacaagagcagggagtggcagttataaagtcatttccagttttctaagagtttatgagcactctacccacagaggcaggtgaatttcattttctgattgcagataaagtgactgacccgccagggtctcactggagctgctggcactgatgtctctttgaaacagtgatgagccttgctgtttactattattttcagttatgttcccttttgtgtaggaggccaaacagaacacttgcctaaggacagcttttggctactgagtttctgtttggctcatgctatctaggcaaagggtcgtcccagctggttcagttcagttcagtcgctcggtcgtgatccagctggtgttagtggttaaaaagaacctcctgcctaccaatgcaggagacataagagagaagggttttatccctgggtcaggaagatcccctggaggagggcatggcaacccacttcaatattcttgcctggagaatcccaatggacagaggaacctggcaggctacagtccataggcttgcaaagagtgagacatgactgaagtgacttagcacacacggatctaggcaaaggagagctgaatgtggagagccaacgaagtggggtaaacctagcagaccctcga

SEQ ID NO: 40972 - DNA, 816 bp, Bovine  19866881088362
gtattattgacatatgccaactaaaaacattgctaaaaagaacttctcagttttgttttcggcgttttctatgcatatgagttgatgataatatcagaggggggaaaacctgcacagaggaagtggaaacagcttgtgtaaaagaaacacagaaagacacagaagaatgattatatgcagcaaagaggctaaatgaaaaaaaaactttcataattagaactttggtattatgaaattttacttggtttcaattggtagctaacctgtaatataaagtcttcatagatttaagataattaagactgtgaaattttcaaatatacaaaaagaatatacaaacacctgggtactaagtacccaacttttatcgttcttactaataccatttctgcttctgatattttaaaagaaattaaactgcagatataatgaaggctgcttatatgtccttccctactcctgtctctgtagaggaactgaacctcaagagtacagtttaggtcactcccatgcactttaacaggctttacgacacactgatgcattcataaacatgacaaaaatggctttaaagatttaaaaacctataattactttatctcaacaataagcagctgacttttcaatgaaataattttttagtactttggccattaattcttaatggctaaagggatttaaaaacacaggttttgtgtactttgagattataagctgtttttttttttaactatgagatctactctgattgagaatacagagctgtgtcaagttaaattctcacggatggaagtcagggtttaagcactcatccca

SEQ ID NO: 40973 - DNA, 1210 bp, Bovine  19866881088617
accataagtatcacttcacagtttcattactttatctctacaactaaataccaacattgcatagtacacctgactccagggcttcttgccacagttcagttctttgaataaaatcaatcaaaaatataattaccacctgcattcattcagtgtgaataatatagaaattacactaacaaacttgttagaattaacacactcaagtgaacattgtttctttagaaaagtcatcatgagaacctatacttataccaaaattgggagcacgtgtttggaatgtgagcccccagtattcttgcctggagaatccccatggacagaggagcctggctggctacagtccatagggtcacaaagaatcggacatgactgaagcaacttagcacgcacacacagtggggaggagagagggagagagagagaaattgattgcgaggtagggggaatacaagcaactgcctgtctttggatgttgattcttgcctataatttccatacctggacattggataattactatggttccctggtgggggccacaagttctctaacttcccattccaaatcctaatatgaattcaactttggaaggaattgctttgggaaactaacatgttaccaagatctacagcagacaattcctcccatgacccagagcccatccctgccttaggagttcctaccagctaaataggtctctgatggcctttctgtggaaatgtcttctcatacatctagcccactttaactcctttttctccacctgaagatctgccctcatgaaacaagattcagacaactttatgaacacttgagatttggggttcaggttgatattgttattcagttacacagtagactaagaaaaattctgaattgacaataaagtgacatcacaatcactacttcaaataacttattttccaaaggtcagctgaccaaggagcccactgcaaatgaaggatatctgaatgtgttgcattcctgcagagatgcagtattcaaaacaactatgctaacctcagaacacacagaaaagtgaagtaagtgccttatcactgagtgagcactcttgttggtcgaatgattcatgtagagactaaagggctggaagtgaaactactaaacaattgctttgattttcttttcttttctgtcatttccaaactaggtagcctttttttttttttttcccaatttatttatttta

SEQ ID NO: 40974 - DNA, 877 bp, Bovine  19866881170424
tgtgtgttctaaatatttttcctaatctacttttcctagtctttttagtgaataaaagttcatcaacggttgtcaaatttatcagtcttttccttgatggtcagcattttttgtatcttgtttatgaaaccgctctgtacgtctaattttatattctccaatatattcttctaaatgttgtatgggtgcgcacctcacagtgagattcatagcaccacatgctaatcagctgttacataggatctccatgggcttctgcaggaaggaactctacaccactcttctcggcattttcaaatgtctcgttaaggagtgacttcttctctactgctgttaagtttccatctgaatttctcaattcagcttaaaagatcaaaggctagggaatcaaatgtttcagtagaaaataagaaaaataagaggccttagtttctgaactgacttctggataagtaagatttcatccattcttttacagtattaccatgatcaataaagatgcctctcagactgtcacaacaaagtttttaagaaagcagtgttgatgttttaagaaagaactgaaagtacttcgggaaattttctaggtccataggatttcagtatctctcagcaaaaggtaagtccaaaacagcggagtgcaactgacagcacatggcactcaccttgcttattttacaaaggcctaggaagtggctccagaattctcctcagtaggaaaactaccatcatatcatccaccacgaatctggataaggcatttacatcacatatctgtcaccctatgagacccagcatctttacagaatgtaagttatttcttcaacaagactgaacaaatatccttgcccaaggaccgctatttttaaacatctag

SEQ ID NO: 40975 - DNA, 1177 bp, Bovine  19866881178479
ataatgctaatgaaaaacctgtgtgattggcaggagaattgtagttatttcgattttagaaataagctaactcaggtccagagaattcaaaagttagtcaggggtagaatgactgaaatgtaggccttctaaacactgttttgtctctctttttactatattaaatcacttctttaataattgttaattgttctgttctgttacttcctctcccatccaaaatgtgtgggaagataatttatgagttttttttttttttttccccagtcaagacatctgtgcattaaaatcagatacagtcttgttgcatttgggaactcccagacattacattaacccactcccttgcctcagacagagcctttcgaaaaatctagcataagtctacactcaccagcctaattgggaagatttattaacaaggtgatcctgttcttcatttggcctctgaaagctacataaaatcataattcttctgtgttgttaacaggaagagacaaagctgacatgaagtggctgttctattagttagaaatcaggattttattgggaaggaggagagagttgagctgctggttaaaatataatgtgcttgttatataaaatagttggtctttctcatgtgcccacttctagtttattttcagacagttacaaaaagtgaaaaagaacaatgacccttcctgatttatagttgcatatgtggtttgggaacacttgaggctgtagataactcttggttttctctttttgactccgagtaggtttttcaatgtgacattgaagagtaggcagaagggtgtttagatgtgagtggactatccacggtaaattagtgggaccttaacttctctactgaatgccccaacttgagccagctcccctcattttgacgtgtgtgtttagggaatgaaaattaatgttgattttagcttacccctgacagaaaatgcatttaaatcctatgtattaaaaaagaaaatataattaaaaaaaaaactgctttctaaaactgcattttggtacatagtgggcactcaaaaaggaattttaaatgaaactgtgataatcagaaattaactgtattagcaacctcaataagtctagcatctatatatagtagttgactaaactatatccaagaaacaaagtgcatttggggtgaaagaaatatatt

SEQ ID NO: 40976 - DNA, 1316 bp, Bovine  19866881207786
ctacagccaagctttacacagagaaggaatataaaggtctagattagatggactaaactgattgcctatttcacgcactgtcttttcagtttccactaagtcttgctctttaaaaaaaacaaacaaaaaagccctgggtataaatacaactgtggcttttatgtataatgtgagatagaagacaagagaaaaatgaaaagtgtcgtggctttcagtgcctgccacggaaggtgtggggtggcttttgtaccccctgccacccttaatcacaggacagctgaccatctctgcctgtctgaaagcttgataagtcaaagctgagagagaccagaactctttaaaggcaggttcaaagcagaggcctctgggcctaatgagcccctttttaacagttcaaaagccttgtgtccttagaagggtgaggaagggtgtcatataacagagtccactaaacgttagtgcacacagctgcagggagacacctgtgtgtgtcaggcagaagtgtgtgaagtcaaccacagaaccagagttggaaagatagttcccctctgatgagtgggtgtcccagaagactcagccaaaaaacaccatcttgcccccatcctttgttttgaggagtggagggctgaaggcatattagatgctgaaaagcagtcaagctcaagtaagttttggaacagagtggagcataaataaatgaatgaaaataaaagggcacatcaaaaaaatgaactttagtattatggaatgaataccaagtttctccaaataatatgaattctcagccgtttacgatatcagcttgaaattgtacagaccttctccaagccagggtctggggaccgaggaaattctctccattcccttgggttcctaaataatcagcggtctcctagagtgcatgttgccctgatcttaagtgactttggtacagtcctcagaggcccttgtccggccaagcaagtgaggaatgccagcagacctggagagaagagcaacgaagtagcaagaggcccagcagtcctctggattcctcttgggaaaggtcttcagctgtgaactgacggggttttctttctctcactcacagtatgcaactgactacagagaagtgacctacaacacgagcgctggaaaggtgaccattgaaaaagtaaggatttttgtgagatcacttacgacaaatcctatgacacaaataatgcttctgaactcaaggagcatgcatgatgcttatttttttctcagcaggactgaagactggggtttgaatcacacagtttaggtttgttctttgggccgtttaccatctttag

SEQ ID NO: 40977 - DNA, 2402 bp, Bovine  19866881217038
cctgagaaacaatcgatgtcattgctggagacggtgtgcttgcagaggaagaggcattttctgccctcacattttatctgtctctaacacaaaagatcaggtgcctctgaagagaagcattctggggagagtttcatcttcaccactgtcctaattagggagcccttcagcctaggaattgcaaaagccaaggaagtactgctcactagaggtggggactttgctgcaggtttcattgtaaacacacggctgaagtgtgtcacacatgggcaggcatgctggtgtgtccaaaatcagccactagccagaggacatggcctttcagcaagaccaaatgaaacagcagctgatttttttcaaataggcttcattagacccacagaggactaacccctcaccctgactttggattccacctttcttgccaggaattatagtaaatgattctatctggaactgaaggccttgatagactttgatgtggctttggagtcttttgagagtcagctgtcaggactcagccattcagaccactcacaggtccccagggcacctatgacataggcaagcccatgacatctggcaagactattaactttaggcaggaaggtaggtgtcagcttgtcagagaagatctgagcaagcattccaagcaaacccttccacatagggagctcagtccctaagaaagagtcaagataagggcgaccatctagcctctaagagagcagagcagggcaaaggccacacccaccgtgtgctgagctcagggaagaagaggctcaactgggtcctgctcagtcccttgagggactttcaatgagaaacaggtaagaacaccatccctgccctgcgctctgggatggtggctgtgagccctcaagattctacagagctgaaaggtagcctacatattgcttgttgttcagttgcgatttcgtgtctgactctctgcgaccccacagactgcagcacaggcttccttgtcctacacccagagtttgctcaaactcatgtccatccaaccatctcattctctatgttgcttggctggatgataatggattcaggcccaggtttaattgcatcactcacacagaaggctctgatcaaagagttattttcagatgacatagatccccatgaggcacttgcctcctgcctgtgacactttcaagagtgactcttgccacatgactgtagtgacaaatagagcttttctccagtgatgtcactgagaattccaaacttctccgaaaggaagaggggtgactacaaatacagacttcccagtgtatctcacttcttaaactcctgtatttgtaggcataaaaagaaagcttagaatgatgagtacagggaacttgaaaacaaagatgcttttcaagttatgaaatctggttgttgttgttactagttcagaatatatcgtgtagcttgagtttctaaaacaggaggcgaccagattcaaaattcaaagtatttaagtggtggtttgggagcaggtattttaaggaagtttagaggaaagaattggcaccataggttgttggtcactttaatgaaacctgtttgaagtgcactcagcagtgctgagcattcagctgtgctcagcagtgctctgaggtcctgggtttcatataagataatcacaatttctccttttaaggaaaattgagtcttatttcttaatcctatccatccttcaagacccagctcaaatgccacctccctccataagccttccatgattgagcccaggtgaaatttccttttctcgccactctcacagtactttatcctcacctctctgataactactttccattttctataaagcaagttacatacttgtttatattcacacatttcaaaagaatgaaatcttacagactatgttctttgaccacaatggaatgaaattaaactgaataaaatacctagataattataaatatttgaatattaaataatatttaatacttctaaataaatatggattaaataagctactttaagagaaattagaaaatatttaagcagaatgataaaaagtcaatattacatttccatttataaaatttatagggtacagcacttagagagaaatcaatagcaccaacctgatcatattagaaaagaagaaaggtttaaaattaattatccaaatttccactttaaaaagaaaaataaggaaattaaacccaaggaaagaaaaaacaataaacataaaatagaaatcagtatatcagaaaacaaactgtagggatttttaacaaacttgaaaactggttgtttgaagtttcataaaatttataaacccatagtaagactgatcagttaaaaaaagagaaaattcaagttaccaatatatgggaggaagaaggaccactcctacaggc

SEQ ID NO: 40978 - DNA, 822 bp, Bovine  19866881237527
ttaaagaagttgttaataaaaagcacgatgatttgactgaataggacaccagacaacagcaaaaggtgcatccaggctttccttcagcactgttattcaattggatgctttccagataccctaggatcccctactctaaggcagagctgataagagaaacaggtgtttcagaccatggctcaaacaacttatgaagtataaggactaagaataattgtactttagagtccgattaaaacttgtgatatcaacacacaggaaacctaggattttgtgttattaaaagaccccaccttattagaataagttaatccttcctcaggattttcttttaaagctataggaaaaaccaattatttctggaactacctactagtattttgagctaagttttagaaaaggagcatgaaaatcattcatttttcatttgcatacaagtgctctataaaatattattaagtctgaaaactactttgagtcaataaatatggatctatttgcacattgtttttggttaaataattgtgctttgtgctttaaagcagcctctagacacaagacttggcatccaagaaaattccataaactaaaactacagaaaaaaatttcaaataaattggtctacctaaaatgttatttaaactacctagatatttgtgagaaataaagaagcttttctttgacttaagataaaaagaaattaaaattttatctggttactactacttatatatggacattaataatgttaataatagtaacggctggtttcttgagcaatcactattcagaaagaaagcctgaatttccaaagcataagaa

SEQ ID NO: 40979 - DNA, 888 bp, Bovine  19866881240422
cccagccatcccattgtgtgtggtgatcagtagctgctggatgagtccgtttctgtgtccaaatgaatctaagcagagctgctcttctctgggtttataagggagggacagtgtatctggggatagcagctaggctggctcaggctggctgacctggctcctgcatccccactcactggttgggaagttattcagaaaagctggatatgctttagggtgtctctgaccttcaaggaatggaagggggcttctctgacatagggctaccctgcagatgaactctctacactttctatttctgtcattaaacagctacttgagtagacatcactgcatttttttctttcttcattagatatttttaaatgtctaattgtgagaactcattctaagaagcttgaattttcatgctgaggcatgaaattagtgtccagtaactcaaagcctgtctgcttcactacttaatttagagatatgctggttggcacaaggcttctggtgccaaaaaaaatatttcatttctgaagcctcctagccaagttcaatgaaaaatataaccataaatactcattccaatgactccctaggccatagtcacaaagcttttacattgcatttactcagggctccccagccaaaatcatctcactcattcttctccagggtccttggaaatgtctgtatcctcccaccacctgccttactgtgtatatcctttctggcagctcatgtatctagatgccaggctgaagctgtgggccctgatttcctgcagtcataacgccctggctccctggcttaccatgaggtgatactctggccagaggccctgggggctgaagctttggatttttggctttgactgtagaagtcccttatccctggggt

SEQ ID NO: 40980 - DNA, 1124 bp, Bovine  19866881279207
gcaaaaggagaaagggatggcagaggatgagatagttacataacatcattgagcaaactcaggggatagtagaggacagaggagcccggtgtgctacagtctatggagtcgcaaagaatcagacataacttagcaactgaacaacaaagcaagtggaaaaagcttgaggtcattttgggaaccaatctattgtcttccccgtagttataatgccaggggggaaaaggatgagtaattgctatccaagcctaaagctggttttcatggtaagaaatcctctctcttcaagaatgatcaaatgtgaagtttggaaaatagccttgataattacagactatactattaaatgcatggtaaattaatcatttgacttcatggcatgggggtatcccataatgacaggttaatggatgccatgcttaataaaaatgataccattagacctctagtgaagtcaatactgtagctctttgctggccacatccttgttaaaccagcctcaaaagcaaatgtacagagaaactttgaggttctgaactggtttaacgggtttcacagaagggtttcaaaggtagatagatgccttgtcaatttagaattaggcaatggaggcttcagtagagctcatatgttgaccccagattgctctggaaatgaggcagctagaaacttgactccctgttccctgcatctctcggctgattctacttcctgtctccaaccgtgctcatcagtgtttaaatctgtccaagtcggttctgaagaggaaattccagtctcttcttctcccacatgtttgtgtgtagaacctgacaggagttcagggggcagtgagcaggcaggataacagggcaggatggggcagaagtcatgctcctgggcaggcactgagaataaagtcacccacaaccaggggaagaaaaactgcaggccggctctgcagctgggattattcaaaggtgtcctattgtggaaagtaagacggaggtgtccattcaccagtgccaggtagagcagcattgttctggaatatctgattcaaaataggtggaaagatgggtcaggattcaagacctaaacaatgagggtgaaggaccgtaggctccacagaactccccagagca

SEQ ID NO: 40981 - DNA, 2478 bp, Bovine  19866881316452
agaactgctcctggggaagatgtggacatagaacatgggaccgtgaccaagactgacctgatcctacacctgaaaacaactgaagctgcttgtccctgtgctgctccttcccgcccagggagccgggccccagactcctgccagccactcaccaggggctgggagcccaggcctgtaccccacggcttcactcttccacatgctaacacctgtaccacctgctccacagtacaaacaaagtccacatgacaccacagggcaggctaaagccctccttgagagctagaaaacttccgcggcgtcgctcctggggacacagccctcggctggctgccctgctgcctgtggacacatctgggcgctcaggcgggaggcaggccctgggctctcccagggtgtggacagctgcgcgcctgaacatcctcatgtgagggactgtgcaaggtccgggacatgaattatttcatttaacccacacaacgaccaaggaggcaaagctccacattcctaccaacaagcaaactaaagagatggagccagaacacacaactacctggcgcggacaaccctgttccatgcagtagcagctccacctcctttctcacacggtccacacgagtccagcaagtctaggcaacagtgtgcctgacaccctccaatctgcagctacagcactttatcaaattaaaagctctgggcagtctttttggccaagaaaacacttttattgagcctgtacttcctgaaggcatctgagcacaggtccctcttgtgcagagggcctcttgatcctcaaggtcaagcagcctggggagtggttagcagcacaggctctactctcactgacagtgaaggcgcaggttacctaacatctcgctgccttttcctccagcgttgacaagagaatgccagtcctcatcaggactggacagaaggtgcagtacggcgcctggcacctaagtgctcaacgtcaccaagcttcctacaaggtcagtggacgggggaagaaggcaacagtgccgagacgctgagtttacctgcacgcactgcacgagtgactctttcccctgctcgccgcccttcctgggaggctgcccttcagcatctggatccaacactgccgaccaggaggcgcgcgttctcactggtccggaggagactcccagggcctggctgctcaccagactgccctctctggcagagcgccttgcatggacgaaggagtgtcgcaaacagtgcttctggtcctcagcactccaggaccctctgagggtagccccggagggaagctggctttggctggagtctgacgggagggaagctggcccatcactgtctgacacgtccagggagctctgcccttcggcagcatccgtggacaggggcaccaaggtgggaatggagcccaaatacgaaatcacgctagaaacctgtgtcagccgagtgggtagggccagatactcgtcgtcactttccacctcctcttggggtttccatccagactcctcgcaggtgaggcgcctgaggccctggctggcccccttctccctctccagcccaggtgaggaccaccctttgtcccttgtcctcaggcgtggagaacccagctcaaggtgccggcccacaggtggccagtccctcaggttcctccgggctggctctctgctcacccaaggagtggccctaccgcttggggctctgggagtagaggcaaagaggctgcaagatgctaaccccaaaccaccctgcttctggggtactccagagggcccccgcttaaggcttggctctctgggcccagagaatgacagggcagcggcctcggctggtgggcaactatgggagacgttagtgggtgacttaagggtgctcgccggggagacagagaagctatccaggtctatgcccgagtcctgcaggacgggctcagccagcacgtggctatcgagctgcttcgggagccggggcccgggcctgaggggataggtgtagtccagcagatcttcgtactctttgttcgggttccagagtggggagcggcggtctggggagggaggcagggaatcgggcagcacacaggcccagtactcggcctggaaggagagacgtctcctgcccagcccggaggcatcacccgctgaggacacaggctggggcaaccactggagccgaggcccagggctgaccactgagggcgctgacggcgggacagccagctccaaggaggaggagaccttggcgaggcagccactccgaggctccgccttttcctggtgaccctggagactgctgcctggggaagatgcggacatgctgcaactggaagatggtggcgcgggcgtccctgggctcacggccgacctccacctcgatgggcacgggaagcccgagatgggatactgtgggcagaggtctggcacctgcggcgattccacaggatacgggtcatctttcggtgtcagcatcgtgtcccaagca

SEQ ID NO: 40982 - DNA, 983 bp, Bovine  19866881564843
acttgaaactgtaaagaaagtgcttatcacagcatctaatacactgtaagaaccccaccaaatgttaattgtcatttcttctttgttttcaatcctttttctcttatgtttcatgcttctacctaagcactatgaccaaatttctttgtcattaacattccaccatcagtgtttaggataatcagtaaatgatgtggcaagtgtaacaacaaaatagatactatttattgagtacttactacgtgacctttttatgcatcaacaggcatgatgctaataacaaccctacaatccagctgccatcatcatttgatgaggaaatgatgaggacattgaagtagagagattattacttgccccaaatagcacatgatttagacacagtaccagttgagagccgagtcatggaagcccattttaaatactctgttttcgttaagggtgagagtaccatcttcaggaagaggtactttctaaaggtgtttagaaatacagcaacttcaaaactaacaattggcctcagaactcctttcttgttgttattgtttcacacaaaatttggacagattttaaatctgctctccatggtttggactataaagctagtggtcagaaagaacttggtatttggccatgttaggcaaagcagcctgaatcaagccaacaagtgttgaggtgtttggggaggaaactggaggaaagctggagaaaggttaaagttagtttataattagatataattttgcaacctaaaactcgaaaaacttgctccaaaaggactgccttgccttcttaaagcatggccttgtgacttttactggaatgcaaagtttgtcaagttattccagccagtaactctctccccaacctgccccaaacccaatctgccccctaaagcagaaactctaaatttgcaaccccatggattatactcagtgggcttctggagttgattaaaatttttttttcaaaaattcaaatat

SEQ ID NO: 40983 - DNA, 1808 bp, Bovine  19866881852073
tattggctggactcaaagacctagagtcctgggagttaacttttcagataaactaagtggatcatttcctaggttggatcctatcttatcatactatctcagcagagcccacgcagtaggaagcatcttctactctgaagctccaaagtcattgcttagggatgggtgagggtcacataataaaagtcatacaaagagctaacagcttaagttgatataaattctttccaagtaagttctttgggcccatttgcttctgctttccattgcattcccaaatcattttcatactatacctttaaaaatgtatattaacagtccattttaaaaactgtcaatgcaattacctgttactgtgttttcaattagattaataacaactccatgagctattatgtagatctagggaaaagtatttagtcttaaggaagccatactgtgctaattcacagtaaagataaaaagcaatagaattttacataatcatcaaaaactttgaaaagcagtcttactgaactgttgcaaagttttcccaaaagcacttaacagcaatttatatcaagagatcctaagtttaggggtaagaggataagactcgactctttaaggtagaaaatcacctttcttatgacggtaataggtaatttccctacccagacctaagataagtgtacattcaaaagttcataactaactgtttctgagacattaatcattctctaacacatacacttagtagaaataactacaagaaagcttaaaaaaatctgagttaacattatgctgtgcaaaaaggaaaaaaaaaaaaaaaaccttgaacaacctacattctatgctaaataccccgactaaaatgttggttgtgctacacaattccacttgagtgcagaaatgcggtgattcctatgtgccatctttgttaagtctttggtacttttgttctaaatatcaccttgctttgaaaagatgaataacttgttaccaaatcacaaatccatttcagttaagtctgaataaaatccagcataaatgtattactttgttctgggaatgatggctccgtgtcttagttctgacagcttcctaagggcaaaccaccactgaagtcatttgggtttaaactgcacagatagaagaaacagtgaagtctgcctttttgttttctttttaagtcttcagaccttgctaggacacttctttcagaccaacagtcagacagttgtggcacctgatgctctgaaacagatgtggtttaaacaacatcagccaagcttagtgatctggaggtctccattgatctttatggtgtccattgcagataacgtttgaatgcggtggtaaaaatcaaaaagtgtttgtccatccacaaacactctgaaacccggatgctaacaaaggatttccatcctgaatggctggtctgggatgaatgggaagtaagggatcgctgactgttcttcacctctttccccaaatatacaagaatttctgagtcgctgccgatctgtgaacaccgctttgagttcaattgccacctctgcgggaggatcttccaaatcaccacaggtcaatctgatggcaaagctctctgggttgaggtttacaatgcccatcactaacactttcttgcctggtctcatgccacctctaatgtgcccacaaaatagcactctcagtcatggcaagtatatgtcggcttgaactggagagcccaaggagttgtttaaatgcgcatcatctagttcaccactgcatcgctgtcggccacagaccccaccgtcttcttgcacagcacgatggggtggcaa

SEQ ID NO: 40984 - DNA, 776 bp, Bovine  19866881905271
ttaccctctatggtgtccaaatattttgaaacaaaaatcaaagtgaatggcttagcatagtttcaaaagggaatgttaacactgtcttggagctgtcttggaaattttacagaaagtaattgtagctacacatcttccttccaccatgtgaaagctcaggaagaaaatgtttttctttctcttgtactttaaactaaatccatttctttgatctttttggaaaatcccccacaattagcaagagggcttgaacaaaacataacccttatttgtgattatgtttttgaagtgcacttttgagcacacaaatatataggtcgaaattaagtaattatctcccacacattgttttcttgcaacacagttaaatgttaaagctactcagtaacaagtagtatttttgtttgtttgagtgttgtctatgatcattagccaattgaaaaattcttcatagctatttttaaattattaaatttttttcataaaaaaatacatcaaacacctaagcaggacataggactttaaaagagcattcagagggaggagggaggagggttcaggatggggaacacatgtatacctgtggtggattcattttgatatttgtcaaaactaatacaattatgtaaagtttaaaaataaaataaaattaaaaaaaaaaaaaaataaaagagcattcaggtcaatacaactaatatgccatggaaaaattataattttttatatttctagaactactttctataattttttttcaaatgctcccttgaataggc

SEQ ID NO: 40985 - DNA, 2225 bp, Bovine  19866880137321
tgctgctgctgctgctgctaagtcgcttcagtcgtgtccgactctgtgtgaccccatagatggcggcccaccaggctcccctgtccctgggattctccaagcaagaatactggagtgggttgccatttccttctccaatgcatgaaagtgaaaagtgaaagtgaagtcactcagttgtgtccaaccctcagcgaccccatggactacagccttccaggctcctccgtccatgggattttccaggcaagagtaccggagtggggtgccactgccttcttcactgtccatgtctaaatagtccaaaagcacagaatgaaaaaaactcaggaattatccaaaatgagtcaaatactcttcctggatcttttgggttctctccccaaagaatttctctgtcaggaaacttccaatactgtttttatttaatagacaacacttctaacaactgcaaattgaccagcaagcagagaacacatggtaggcctgagttgttttaaggatatcaaatcaatttgattttttggttactgcagaactatttattcaaggatattgtttgtgaatgaaagcctaagctttgtgtacaggtaaattatcaagttcccaggtgccagtattaactgagcatgcaaatgtaattgcatagtagaaacttcagactaggaactccatggggtgaaaaaacatttaatttgtagcaaaaggtaaaaataatgacatttgtaccttgtttctgctatatctaatggctggcaatatttaactgcaaaaataagttttcaaatgtttaccttgggcctttagatatgtaaagtcttgaatacacaggacatcatgttataatcagggactcagaggatttgaggctttgcattcatatgtttttcagtaagtcaaagtataataacatttaaaacccaaacaaaaaactccccatagctatgagattaaactgaatcagaaccctaggtactgcaagggaaatttagactttatatttaatgatttgttaaatttaaaatttttatttctgggagacaaaattcagacaatagttaataggtatgcattacaatatgataattccctataattatcatatgataattcattcaatatgattatgaccattcaaagtatatcttctaaattgataacaaggtcatgttttattttttaaaagatagaataaattaagagagatggaatgactgctttaaatttactccctaatctaacattgttattatttttttaaacttctttaaagttgcttagtcgtgtccaactctttgtagccccatggagtgtagcccaccaggtttctctgtccatggaattctccaggcaagaatactggagtgggttcccatttccttctcccaagggatcttcccaacccaggaactgaacctgggactcctgcactgcaggcaaattctttactgtctgagccaccagggaagccctcggttagaatgaagtgacgtaaaagtcgatcagtcgtgtctgactctttgcaaccccatggactatacagtccatggaattctccaggccagaatactggagtgggtagcctttcccttctccaggagatcttcccaacccagggattgaacccagatctcccgcattgtaggcggattctttaccagctgagccacaaggaaagccaaagaatactggagtgggtagcctatcccttctccagtggatcttcccaacccaggaattgagctggggtctcctgcattgcaggcagattcttaccaatggagctatcagggaagcccttggttagaatggccatgataaaaaaaatatctacaaacaataaatgctggagaggatgtggagaaaagggaaccctcttgcactgttggtgggaatgtaaattcatacagctactatgaagaaaagtatgaagattccttaaaaaactaggaataaattgacaacatgacccagcaatccctggacatataccctgagaaaacaacaattcaaaaatatgcatgtacctcaatgttcactgcagcattatttacaataatgctggacacagaagcaacctagatgtccgtcagtagctgaatgggtaaagaagatgtgttacatatatacaatggaatattactcagtcatgaaaaggaatgaatttgagtcagttacagtgaggtggatgaacacagagtttgttatacagagtgaagtaagtcaaa

SEQ ID NO: 40986 - DNA, 1619 bp, Bovine  19866880368991
gagaagagggcggaaaaggatgaaatggttagacagcgtcaccagcgcaatggacatgaagttgagcaaagtccaggagatagtgaaggacagggaagcctgctgtgctgaagtccatggtgtcacaaagaactggacatgacttagcaactatagagaagtccctagaaaaacaaagattcacttaagatcattcagtgtggtatgaaattttatgcctaaaggtataaaaagtccttaataaaaaagttcattccatgaatgccattagataaatgtcttttttaggaataaaaaataccaagatatcttcagggaattattaacaaatattgtttacatatttccctttatactcatgtgacccaattcagtaaataggggtgtgagtttgctttattcttcctgaatgataaacacttatcttagtagtttccaaaagagtgataatatcctatcctgtacaatattccatcccttactattcaagacttgactcttgtaatccaattttagtatgctgctgctgctgctaagtcgcttcagtcgtgtccgactttgtgtgaccccatggacggcagcccaccaggctcccccgtccctgggattctccaggcaagaacactggagtgggttgccatttccttctccaatgcatgaaagtgaaaagtgaaagggaagtctcagtcgtgcccaactcttcgcaaccccatggactgcagcccaccaggctcctccatccatgggaccttctaggcaagagtactggagtgggttgccattgccttctccaaattttactataaggacaatgtaaatacataaacaagtatataccaacacatatacatacatacataaggagataaatatttgacagctagcttcttgccatgcactagtaattcaagcactatttaaaactcttaaaaactttctaaatcccagtggtttgcacagtctaatattgctaaaatagtgcattgactctttaagtatctgtaggctaccaaagtaaaactaattcgcagtgttaaatatttgaaataactttaagttgcctttgatttctttattcagattatatttcctatctttaatttgtttttcagaaaggtacttttctatagtttagaaaataattcttttttcctgaagacaatctcctaagctcacgtactctcagagtgtgaagttattaaataattatctttactccaagatttcaacttagctatctaattaaatctatatttattctgtatatgcaaaaatgaatgactgattatcaagaagcttaaaataatcatactttggtcatcatctctagtcttggcagggcagttggtatagaacacaaacagaccttgttcaaacttttatttgttcttgaaagaaaaagaatgtcttaatttctatacaattcacaaatccttacagtgtccttgactgtaaaatgcaatgtaatatcacacaaggtaacttttatttctctgtgggtattgcctgtaaagcaaggcagaattctttgagaagcaaaggaaagctttgaatggcgtttttaaagttaaaagaactccatcactaatacttcccatcgaacatatctccaaagagag

SEQ ID NO: 40987 - DNA, 2038 bp, Bovine  19866880433798
aatgtttgctgctgttaaaatttgctttttacaagaatgtaataaaatatgattcctctctacaaggactctaaagtatgaaaacacagtaaaaactttcatggattaagaatattaaaagaattttggctttcttaaatcgtctcatttctagatgaacactattcattagagatataatgtgagacacaagtacatataatttaaatttttaaatataaaaaaatttaaaagcagatgaatatttatgtaccctgaaatatctaaaatagcactttcaacatgtaatcagtataaataattattaaatatgatattgatatcatacttttttcataatagtcttaaaaatctggtgtactatatattttacacttatatcacatctcaattcagagtagccacatttcaagtgcttaacagaatcacctgactggtgattgccattttggacaatgaagttctatgtcatttttgagagaaaacattgataaaattagggcagagaggaaatgtttactgagaaccttattgtcaggcagactgtacaaggtaattttacattgatttaaaatgtaatccccacaaaaatatgtgaagtagctcttaaaatcctcatacttcagatgaaaaagaccgctactcaaaggtttaacaagcttctcaagaagtcatctagctaataaacctatctcggccaagatatcctctttccacgcctcttttcttgttcaaagcaagtgtctttactgaattttcattattaataaatgcttaagcttgcgagtctcttggacagaagggagatccaaccagtccatcctaaaggaaatcagtcctgaatattcattggaaggactaatgctgaagctcctatattttggccatctaatgcgaagaactgactcattgaaaagaccctgatgctgggaaagattgaaggtgggagaaggggacaacagaggatgagatggttggatggcatcacagactcaatggacatgagtttgagtaaactccgggagttggtgatggacagtgaggcctggcgtgctgccgtccgtggggtcacaaagagtcagacatgactgagcaattgaactgacctgaatatttattaatagaagaaacatgttttagaattactgagaatgccaaaaacacaaatagtatttaatcagaaaatgttttagaaaacatagttccaaagtgattatgtagatagagcatatatatttattttattaaattagtttatataacttttatctgaatataaaactgcactttctatatgcttacctttccaaagtctccttttttcccaaagtaaaatctaaagaaaaataaaatattaagatatagtgaataatacagggtgctttaattctgtttctctttttctatgataataaataagaaagaaaatttaatagaaaatctaaaatctatcatttataaattaagaacaagaattgctgaaaattgtcttatttcataagcattagggaaagactagtcataataatatatattctttaggaccaaaaaaaaaaaaaaaaaaagaaagatcagttaattttaaagattcactcaacaattaggagaaaaatctggattgcggtccaagcttttcccgtatgtatgtgaccttgggctgtttccacttttagatcacctcttaaatcatttttaattgcaaatgttactattctccaagggctcaatataaaaattctaacaattctatgttcacatccattcattctgagtagcttattcactattctctaatcatgtaattgactttcatatgctcttaaatagacatgaaataatggtttactacagcgattggtcacacacatttgctctgtctggagtcgtaatctgcagaaactcctttttccccttgtctatttgttaaagtgccagcttgcttttaaaggtgaagaaatagtaaaatattctattggaaaaataaacacatgacatcagacatcaaaatttctctctaagcagaaattattttaaataa

SEQ ID NO: 40988 - DNA, 1270 bp, Bovine  19866880458412
cacagaaagggcagtagggaaaagtgaaataaagctaaaatgaagcaaatattttgttcaaaacaaaataaaaaacacttcagtaggtatttatttaaccaaattaattatgttaaaggagagttatcatcaaatatttttgttattttgcttatgagtaacagtcctctaataactttagaatatttattaatatattaatgagaatacttagtctttctgtaagataatatatgtagagttataagaaagccttatagtttttattctagcgggataggaaattttaagagcaaaataaacttagagcaggttacaatacacagcctagttagtactttagataaatcaaacatttcccttgaaaatgtgaagtgttacagaagtactgtacacttaatacagcagctggaaccagataattgagttacgtgccaggtgggtgataaatctaagttagattcacccaagatttatgcacagaataaggcagaaagacaaccataaagcaaaaactaaacaaagaataacaacaacaatattatgtgaaggaaaataaatgagtgggggaaactgtagcttttttccaagagtcctaactttctggggaagtatgtgtgcttggttatttattttcagttcagtagcattgtggcacccacttctgggatttaacttgcactgtagaaaagtcaaatctcccaagatccccttcctcctgttcacaacaggtcagaatctgccaacaatgggcaattacaataaagatttgggcaaaagaggaaaggaggttattattttccagatggagtcataagtgtgaatgagcaaaggtcaggtccaaaatagccgctgagagattttcttgagcatcaatgatgttaatgatggagattgaaatagaagtagagcttctcggagtttggtgagattgacaggggcttcagggtaagatgatcccggattttcagcaattgctggcttagattttcagaactccctgctttggagcagcaggctgatgtcattggtgacagtttctctgatctctgtccttccaactttaccaatagtcacatcagcctctcattctttctgttaaaacttttcacttaccaatcatgtattctgtccaatatgttgtactccttacattctcattactcaagatagaagatgcaagtcctgctgcagtttagattcgttggagacacagccaaaaaaaaaaaaaaaaagaagaagcttacttaaggaaggagaacgtttggca

SEQ ID NO: 40989 - DNA, 789 bp, Bovine  19866880499312
agtaggatacagcttaccaactgagcaagtaggcaatcccatcattaggaccccaccctcatgacattatgtgtgcatgctaagttgcttcagatgtgcctgactctttgtgaccctatgaactgtagcctgccaagctcttctgcccttgggattctccaggcaagaatactggagtgagttgccaagccctcctctagaggatcttcctgacccagggatcgaaccccttgtctctaatgtctcctgaactgataagcaggttctttaccactagagccatctgtgatgccccctcatgacctcatctaagcctgattacctcccaaaggccccatctccagacaacatcaccttgagttaaggtttcaacataggaattaggggtcaggaagccatgaacacagttcataacaatgttgctttctttctatcattactcccctgacctgtgagtttagaattacaatgactatacttacacttttctcttggcttttaggaagagattttttttttttttagttatttttggttttttttagaagtccttttctacatacctgtaactgtagaatgtaaaagaaagatagttgaaaaaattacatagaagcatatgctctcttaaaaagtgttaatgagaaattaagtggaaattgttttacctgggaaatagtactatcctctttggtctacttatcttctttagtgtttttaaagcagaaacagagaaattatcttaattgggaaatatttaattaaggagaaatagatcattgggggaaatca

SEQ ID NO: 40990 - DNA, 733 bp, Bovine  19866880521040
tgtaggcataacacctgtaggcataatacattaaaaactcagttcagtgtttcatgctgaaagtgggactctattagagggaagcttttaatgtttgtatagggtctgacatactggattttatttaacagctgagtttcctagacaagtactaggcatttcttcaaagaacccagccaaatgctataatccatttccctcggaaatggcagttgttaaattagaccccaaacatttatgaatgtcgctttgcctttccagcaattaaaagagttccaaaaaaaaaaaagaaagaaaggtccctttgtgtttcatggctttgaaattattatgttaatcctgagctggtcctcccatgagctctgtcaaatgctttggaggttacattcaagagggtggcatcattctgaactggtgtgggaaagggtttcttgatgtataaaaagtgtttgatattaaaggcgttttagcaatttgagcgcatctactgctgtgagttcccgcgtaagtaggcagcccattcatttccctttaaaggacaaacacctgaaatcaacaccagagacctactttccccaggatggagggggtaaccggtgagttgactgaaactgtccctttgctatttccttgtcatagtgctgatcctcctgatcgtcaccatgagaagacggaaaaaagagcccctgattttcgacgaagagagagatatcagagaaaacatcgtccgata

SEQ ID NO: 40991 - DNA, 1795 bp, Bovine  19866880579874
tgaaggttactgctaagaatatactgataaaaggaaagtcaaaatggaggcagtgttgttaagagaactcttttaaactggagccaggactctctgaggaagtgtgacttaagaatggctcagcctggtggtatgtgaagcctagtgactgattgtctcagcacaggcatccagaacaccttccccaatgctccagaaactcaagatacttacgggacacttattccaaaatcaggcttctctagtggcttagacggaaaagaatccacctacaatgcaagagactctctcttgcattcagtctgtctcttgacaaccttccctttagggacaaatatttgctttcctgtgtcagagttaatcataattcctggcagacaattttaacaaaccttacagtttttttgtttgtttgtttgtttgttttttataagcccctgattctttatctccctcagaacacttttggattttaccagaatttgggtctccccagctgcaatacctaagatacccaaacaaagctctttgttcttggcagtctccaagttgattattaactagaaaattctgccaagaagctactatgttctttagttttagtagaagacactgatgttaaaagtttttatattcaaatagttattttgtactttctccaatttggaattatcattttaaagattacctctttgaaggtcaaaagttgaaaccagagtggatattgtgaaggagcctcaggcagagagcagcagttttcctcaagtctaaatgaaaaggctccaggtaacttaaaataattccatcaatagtatctggatagagtgaatatggaccagaatgaaggctcaaaagagcaacagagtgtggtttttaaatagtatggctcctttatatatttccttcaggttaggaacagtctcagggtaacaggataagatttaaagatttggaggtccttatcctgcaaagaacattctcatttagagccttctatattcagagtgtggaattagacactgttaccttgacagacttcacatgatgacctttataaccttcaaggccatagacacattcataacagtatttttagcagacatataaaaatactttgaaaaaataaaatacatttttttcagcttagaatggtagcaaaattcatattgtaaaagtcactgtgtatgttttgctttcattattcatgcatttgtttgggattgtgtttctgtaaggactacatatttataattaacatttcaaataccccaccaatgtttttccctcatcatttacaactgctgcagaaactactgaaaatgttgcatttctaaggagaaaggaaggcacttcaaggtccttgctattatgttaggaaacaacagaaaaggatgcaaaaggaaaggcttgttggtgatgaatgacattaggagagaaattgtaggagtggtctcaggtttgcagtgcagctctgtagtgtctctattgctattgaattgtcattgctaacatacagaaggaaatggtgaaggcactttattgctttttgaaacttagaagggaaaaaaaatcagtatcttaaataaagatttcaattcctgacctcactagcttactttgcaattgaaccaaagtctttaattttagcctcaagtaaatgagaattcaggatttttctctctgcatgcaaaagctcaataaaatgggctgtactggtagagtagacccactgcatatgcaaattcagacacattaggaatggatttcatttcacaatgtcatagtaagtcactct

SEQ ID NO: 40992 - DNA, 1322 bp, Bovine  19866880652367
gagctactactaccactgcgaagttacttcagtcatgtccgactctgtgcgaccccatagacggcagaccaccaggcacccccgtctacactccactaaattcatggaacttcaaagtatgtaagccccgctgtgtaacgtgggaaatggcccaatcgagcttcacatgctatatttctctttaaaaaagcctaagcccttaacatctaccatggcttttacaatgcttacctttcttctggaggaattttttcatcatcccaattaaaccagaatttgaaagttcctttaatattagtttatgctatacatcaaagtgttagttttgctgaaacatgctgatgatatttcatcttaaaactggcaggatttcaaaagcaagtaccactgggtatttttaaagaaatcacgaacaaggaggctggtattctgaagcctcttacctggcctggctgggcgttttcacaaacagtggtctcatagtccatggcaaactcaggggcattgtcattgatgtcaaggatagtgattgctacgtagcctcttcccacttgagatggattctctagtaaagaggaaaagattttctcatttacaggcacacctagttctattgtactttgctttgaatgtgctttgtagagattgtgtgttctacaagttgaaggtgtatgccaactctttttttttttttgcactcagacaattcattcagtggatttacatttatatatatcaaaaaatagttttgcatagcttcagagttccaatacatttttttgtcaacaactctgttcagaacacagtttattaaaaaaatattttttgaaccaaggcttattttgtcatctccagatctccagaggagaatgaatctgataagaggattgggttatatcctctgggtatatgagtgaagcacaagactgagtcacaatcatgtcttaccaagtgattgggtacacctattaacaacttttaggctagagaaatctattcgaaattcgtgccatcattttcccatttctagtatgttattaatgcttcttttttcttacttcattattttatttttttaattttatactttttttattttataaggtgtatgccaactcttcatcaaacatgtgcatcaggcccatttctgcaataatactggctcacccacctcatgtctctgtcgcattttggtaattctcaaaatatttcaaaacttatatttattatgtgttatggtacagatgataccacccttatggcagaaagtgaagaagaactaaagagcctcttgatgaaagtgaaagaggagagtgaaaaag

SEQ ID NO: 40993 - DNA, 1128 bp, Bovine  19866880710239
ccaatatgtgtagccattagtcctgtatgatactgtcattcggagaagctgggtcctactttgcagcctatgtgtaaggctgaaatgacttcaagatggtttcaaatttttacctagttgatctctgttttacagatgagaagactgaaatgtatgcattttagagcattgcttaaaataatgaggaaattgacagtataacccagggtttctgcttactgatctttccactatataaagcttcccccagtacagttttagaagattctgtcctaccttctaaggggataattccttttttctctcctctaatttgaagactgaatcatgaaatcagagtgtttccaggtatccttgtacaagcctttgttcacggatccatgaatttgtgcctctggttacccacctccacagctacagatcagctgtggaactgactcctttccatcgcctgttacctgcttggtttatcaaccaggcaatgttaggatggagaggctttattttttttaactcttttatctaagacggtacctaacctagagcaggtacttaataagtatttgaagaagagaaggaaggggaagaaagaaaacacgtgacagactgcctagcatgccaaagatgttaagcatagttctacaaactattgtttctctccagtgatcacgatcactatgacagataatcaatataaatcagatgaaacgattaggatgaaattcctcccacgctagcactcatccatatacgcttaaaccagcaaagcctcagtgcctggcctgtgcttgtctaattctgtcatttatcttggtgagtcacagagactgactgtgtatcagtgagcatggcatacacagttggtcagttacacttttctatagaaaagcccgatagcatccttttagcaggaactttgtctttgcatttagaaattcaacataaacataaaaacccaactattatacactgaattaagcttttcaaaatttttgctcctctcaccaaatgggtgacaactgtgcacaaacacacacattaaagaagacgggattttaaatgatccttggatcaacataaacaatcaacataaaaaaagaaaattgagagccaatctagactatctag

SEQ ID NO: 40994 - DNA, 930 bp, Bovine  19866880786424
tccatggaattctccaggcaggaatactagaataggtagccattccctttccagggctttttcctgatccagtaatcaaacctaggtctcatgcattgcaggcagagtctttgctgtctgagccaccagggaagcccttatacatatgaaaggcagacacatacacacaccccacacagtttaaggactagacatgatcgttcatttgtgtagtagaatgtagaataccaagttatatttccatttatagtaaaattttttctctaatagatcttatctgctagacattttttttaaaccttcctgagtgtgtatgttgtaattctgctcctatggggcaatttaaaaaatgatagtttatggcatttttccctctaacttctgttgctttgtgattgttgtagttacattcatcaaacaccacattcatatgcagcaatataattgggcccgttcaatatctatcatcacttaaagagaatgaaggggaattagcccttagctagagtgtttaaagagggaaagagtgagccttagtgtttcaaaacagatgagtcatttgctaccttaagatttcttgcaggatttgcgcctagtctgatttttctttagactggagaaaatgcttgtaaccatgaagaatttaaatgagtacattagacaaatgctatattcaggtggaatatagtatcacatagtagtccatttaaaggattcaatacctgaaaatccagtacaatgaagtttcatcccttcagattttctagaggtctagacgatgtggaaaaattactttaaaaagagtctcacatataaaagaaggccctctttttcctgtatgtttataacaagtttggaagtaacaactgaaaatgataatacaacaaacatgcagtatcaaatctgaaattagattatttaatgatattt

SEQ ID NO: 40995 - DNA, 939 bp, Bovine  19866880806824
tattaaagatggtggtgatggtggtttagctgctaagtcatgtccaactcttgtgaacccatggactgtagcccaccaggctcctctgtccatggaatttcccaagcaagaatactggaatgggttcttgctgtctgtggataccgataatgtgtttcatcaaattagggtgcctatatgatactaattgttctatttaactccatcatttctttctaatgtaacaggatttcacaattagaaaaaaaaaatccattttacttccatatctgacaggtttttgccccacaaaaatttcaatttatttgagcactaacattgtagctaacaattttgggaagtttagtgctaatgtgaaaaaagaaaatacccttgcaaaatttaccacaattgtttactttctgaaaatgagcactaaaacatttgcataacatctgcactgcttggaggggtgaaacactaaggcaattagctctgtattctataatgcatattgcaactcaggcaacgctgaagttgagctaacttaatatttagttagaaaagaaaaggcactttatttgcccttcactattagtgcttctgtaaactgcccaatcatggttaatgtgtttagaatcttgttttcaagactgttccaggaaacatcattttaagaaaaaaagtctctaagagaccttcatttagtctttataatatgtgtgcatttacatctattttgtgtacttgagtactacagattttacaagcagttatactatagcctcaaaagctccaggtcttctataataaattataaggaataatttataacagcaatatgccaaaatagctaaattatttgagattatggagaatgaaatggcaacctactccagtattcttgcctggaaaatcccatggacagcggacccctgggtggtctacagtccctggggt

SEQ ID NO: 40996 - DNA, 843 bp, Bovine  19866880844664
taaggttatttaaaaacctatcagaatcacaatttgtttcagctaaatctatggtaattatatataaagtctagaaaaatatcttaggtgaacatataacttattctacaaattacacactgaaatttcagagtagatatacttttgatgtaagtaaattttcctcctttttattaaattggaaattttaattaataaaatataagaaatttatcaattacaatcattttaagaatacagcatcaaaaattaatataattcatattgttttaatataatttatattgttaaagtagtattataatttatggtgttataatgagtatcacctacccaaagataataagccatcccagtactacttaataggctgtattgtctattccagtaataaaatttgtatagcttcctttaacctgagttaggattttaattttcctttcatgttatttatctttgcagccaacatatgttttccacaacaatgagaattatgtgcctggagaatccaggctctagctttaaagtgaaatagttgctataaaatgctgtatcttgagttttgatcataaaatttccaaatgtaggtatctcgatcaagtactaaaacaagacaactctttcctttatcatgctgaaatagctggttattgcttctctggggaattggtgtattaccttcaaagacagaactttagtgtcatctgttgctgcaatgaatggttcagtactgtccccagagttgagtgaaatgttgagtgaaccttgagtttcctttcccaattctgtagttgaaaataattgctttgcttttcccaagtgatagttgtagcaaaatagttt

SEQ ID NO: 40997 - DNA, 1078 bp, Bovine  19866880853564
atcccaaagaataggacacaattgaagtgacttagcacgcacgaagatggaagacgccttttatttccttctagcccttcatgtaatgaattgggtttaaagcctgtgcaccctacaggacactgaactctgtccttttgaatgctggagcagtatgaccttgagacttcacttgcttctttctgtatgtatgttttggatatgaaaaaaaagataaagtttacatctaagttttctcctggaacttttcctcctaggtttaacacaatatctatcaatcatatgccaaaagtactttataaggagactaaagaaaagagactagtttctgaattacttagtccttgtcactctgtacctgacactattgtcatttcccccacattgtataatttgtgtatatagaagttactttgtcctcagatgttagaagacgatagaccacaaagaataaatgcttcccacgcaacttgttaggaatttgagcaaaagaacagaagagattgctctctttctcattcctacgggattacttggaagttgtttcactctgtctttgtcaagttgctcaatcttaccttaaaacttagatgcttgctctaagagtgaacatttgacaaagactagctaccagactgttagggctttcccagtggctcagcagaatctgcctgcaacgcaggagacacaggagaggcggctgccatccttgggttgggagatcctctggaagagtaaatggtgactcactccagtattcttgcctgaaaaattccacacacagaggagcctggagagttacggttcatggggtcacaaagagtcagacatgactgtgcaccacactgccaggcttctgtcccttgtgatcagttgctactaagttttgcaccaagatcatcacgtgccacactcctctggggccgccagagtggctgcttggagtgcagcagcctgaccttcagggcacctgccacagccaagcccccatcatactgtcctgggctcccttggtggtttgctgctggtactgctaagtcgcttcagtcgtgtccaactctgtgcaaccccatagatg

SEQ ID NO: 40998 - DNA, 1011 bp, Bovine  19866880892984
ctagctagtgtagtttttcagctggacacatgcctgcctctgacataaccaggtttctatgaataagaattaagggcaggtgaacattaggcatgcaagtgaaagtgtgttacatgaccttacatagctgtttgaggattaggaaacaatgtatatattttaaattcttagtctatttagggggagggactattgggggaaaagttaatgaatctgcttttgggtatactgacctttaacagaagatgttgccggtatttggggtagtttatgaaatctcaggaaaaggattgaaactggatattgagatttttgaggcgtctgcataataaatacagagagcacaaccttaactgctcgtgctgcaaaaatatggaagcgatctctttaattggtcgctccaacctccagtgaaggaggtcaagtattttcggctgtaatttatagaaactagaaggatcattgtgaacgtgcagtcagcactaactgcagcagaagttgcattaaagataactttgggtcatgattagagaaacaccagtcctttcctttcccgttcagcctctaattggcaattgtatttctctgtccccaaaccagtagatccggagctacaaagagcgtgcggctctgaacttcttcagagtgtttttttctctcttggcctcactcagccctcccagacttattcagagacaatttgtaccactcactctaaaaagtgctatattgtatttctcttggttaaggaatttttttttccccttaggtaactttatccccaactaatgtctcatacagaaactcctgctttttgcatatccagaggggctggtagaaactaggggcccctttaatgctggggatcccaagtccttgtggttaagaagtagaataactattctttgtctcttcctggtccctgccagagtcctccatctcttctcaagttaattcctctttctgttccccactcttgccctcgttcccttcatcttactgagcacagca

SEQ ID NO: 40999 - DNA, 1586 bp, Bovine  19866880959404
ctgctcctactctctgcatacttaagcagaatatattcaaactgcaaagaaaatcaaagacaaagagaaaaactagaaggcacagagaaaagacacacagaggaagaaatataagaattttaattgatatccaccacaaactatgccaacaaatagaagctagatcctctttaaagtgaaaaaaatgttaacactgagttttattcaaagcataagtgtagctcacaaagtgtaaagaaataaataccaaaaggtatgagtaagaattcaagatctcttccatccccctgtccaagaaacaaaggtttctatgacccgttttaggaaggaaagggagcaactctcttgtatctcttagatttaaaaaattgagacacaatttacatattacattgtgaatgttttaggtatagattgtattggcttgacacttatatgttacaatataattagcacttggagtgcaggctacctcctctctcacatcacataatcttttcatttttgtggtgggaacaattaaattctagtttcttagctctgatgtttataacacaatactatgtccataatcattatgctgtgcattggatctctaggacttatttatctcctgactgaatgcatgagagattcacactccctttcctccctgtcatcccaagggcagcagtaagagagtgcgaggaaccatacagctgttacctgctttctaagtgaataataataacctgtctgatccagagcaccctggggttttcattcataataaaaccactaaagataaatattaaaaccacaaccaactcctcatcatacttgaggctatccctctctgggtcctcagtaactggctcacttcaaaaagaaaagagctttaaagcatgattgacaacagagcagctgaaatctatgaaagctcccaagaccaagtgttgggtagaaagtgaaaatgagaaggttactgtaggcgttgatgaaacaatgagtgaagcagtagccactcccaaaacggaagtgtgcactgcttgcccatgaggctctctaatcagtgtataaggtatgtacacacacacacataatatttacaacagattggatgatggatcatttttagtggaatacatatgttttctctctcttagcatgatataagcttggagcttaaaatgcatttattatgtccttctctttccccttttcaggtttaatctgggcagaatttaatcagctgaatttagtgtttgtagcctataggttaatccctataataaagggtcattgtggttcaaccagacaagatagagaaacctcttgagtaaaaaaaattgaggtcggagacctcaatttttgcatttagacctttttaacatactgttcagtgtaatattttaacctctcattttaaaattggaagattgaaattataattctgaccctactgagttaagataaagactcatgattctggctgagtgctaccttctaaaatgagtaaattgacaaaatgctaaagttattaaattatttagatgagggttagtttaaataatctaatgaaagattgcctgtttaatggtgaataa

SEQ ID NO: 41000 - DNA, 1381 bp, Bovine  19866881092360
gagttgggttgcttttctgggtgcctgatgtcctctgccggcattcagaagttgttttgtggaatttactcgacgtttaaatgctcttttgatgaatttgtgggggagaaagtgttttccccgtcctactcctccgccatcttggcgccttcccctcaatctgaaatttcttagcatccccttactccgtgacactgagttccatctcaagaaccagtcggtactttaacctgattaacagatcttacctctgctgggtctctccacatagcagagttgaaggaaacctttgatccatcctgcatactgctactacctgactgattgtgtacatgtgacaatgctttattttaagcttgctgcaggaagtgagacttctaataaatttaattcaaacatttccttcagctggaaagtttttatatacaaaaacgtgacctgataataattttttgatggtgtataagaaaggaaatgtctggttaaaggttactaggctcctcacaagtctgcaagttaactttctgggggaatccaacccaacataagggaatttgatctcatagagtcttttagaaattgctcaaacccattccttaaaaggttgttaatttcatcaaataactaagttctgttccagactgcctcttcaggcaaattttttgtttcattttgaaatctttttttttttttaagttttcgcatgttagagtacataaactctttccccattcaaaaaaaactttgtactatggacataagagaaatctttaatttgacaaccaaggttaagtatttctcttcagtggccttcaccctcctcttcacttaggtggtaaatttcagcttcttggtctaatgcttgctgctgctaagtcgcttcagtcgtgtccgactctgtgcaaccccatagacggcagcccaccaggccctgtgtccctggcattctccaggcaagaacactggaataggttgccatttcctcctccactgcatgaaagtgaaaagtgaaagtgaagtcgctcagtcgtgtctgactcttagcgactccatggactgcaacctaccaagctcctccgtccatgggattttccaggcaagagtactggagtgtgttgccattgccttctccaggtctaatgcttacttagtggcaaaaaaaagctgtaatagcaggtatatgtaggggtggaggaggtcatggccccaagaaaccactcctctggccaggggagtcacagagtctggcagggctacctaccctagagtctggaagggctgtgatgtgccttgactccaggtctataggcggggccataggctggactcccagtcatccctccaggtcgggccaacactgtacttcccagctggctgtgcc

SEQ ID NO: 41001 - DNA, 1053 bp, Bovine  19866881228919
cattgctatctctgttatggataatggtatatttctgccaacatatatatgaagatgatcgtcatatttggcacttatttttgagggggtatgtgctttttgtagtaaagcattgggcatggtccaggactaagttttagacttgtctgtacgttgtaaggtctcatgggggctgccgtgtcctgacttcagcttatgttaaggttaaaaggttcatgtcatgcagcttgaaccataagaaatgtttgctaacaggtgagtgcgttgtcggggtaggagccatactcgtgatgctggccattagcctacagggttattggcccacaggcaacagagcacaaacaaaggcttcaggcccaaaggagaaaactggccaaaatcaaaccagtttctaaaaatagagacaagaagaaaatcttcttaaaaaaacccaaaaaaactagaatgaaaaacctaaaaagaaagtacataaaaagggccgtattcctgtggaacaaaaatgaaacaaatgagcaactgttcacatgtcctggttaaacctaacagacagtaaccacattttcctgaatgaagttattgatagtactgaaagctttacgtcaagacaaatcttgtaagtgagagaagactgaatctacagaactggaacgtactgggtttattgaaaatacctaagcgggtattgtcagaaataatcttagttaagaaggctattcaaagagtatattttatgtctagcctggggaaatccaagttgttcctagaatttggttgagggtattttgagccttattggaatacatggaaaacaaaatgtataaatgatccagctctcggggagcttatagtcttatgtaggagacagccattaataaaaacagtacgaaaactatgaatgcattacataagacttacaatctgagattagcactctgaaggaatgcaacagtcttgaaagagtgtataacaaagacataggacctctactgggactttggggctcttgccagagaaaacagcttttaaggtaatgttgaagttatgggcaaccag

SEQ ID NO: 41002 - DNA, 2052 bp, Bovine  19866881297929
agccctacaaggattccagcaacggccccggccctcatggcccccctgccccagcagactaggattccagcaacggccccgaccctcatgacccccctgccccagcagacgccactcagcagtcaccatcccttcctttccttttacttattatgggatgcctttgagtgttgtctgagcccatgtcgtggaccgcagggcctgggtttcagagcgtaaaaaggaagggccaaacacaacaatcaaaaccaccaccccctcagaatcttcaaacagaaaccgagagagggaaactcctttttttatgagagactggaaatatgtgagcccaatgcaggttaaagatgctcaaattaattaactagatgcctctagagaatatagaagaaaaacttggagaatacagaatatgatattttttcatgaattttttgtaattttttttaattgtgaactaaaactagttccaaatataagaaactgcttctcaatatttgaaagtaggaagatggataattctataagcattcttgtgtcagtgcaacaattacataaggctttcaaagaagcagcaatgaggtatgttaaattctcttaatcttcacatgccatttttaaactacttttaactactttggtattcctccttaagagagactgctaaagtgatcacaggggacaatatacctatttattttcatttctaagcactggaaaattatacagcctacttggagggctctcttacattcgtgacggaagtgaagattgacattgatgtgtcgcagaagtacagatagaaacctcaaaattaagctgggattttgcgagtagaaaactggatgtcatcacactattatatcaaaatagcagtgtataaaattcacctttctgagggctaattcacatcagtatcctaatttcactctggcttcccaggtggctcagtggtaaagaacccacctgccagtgcaggagacatgggttcgatccctgagttgggaagatctcctgaagaaggaaatagcaacccactccagtattcttgcctgggaaatcccagggacagtggagcctggtgggttataacccattgggttgcaaaagagtcggacatgacttaatgactaaacaacaatttcattctatttcatcccaggcaggcaggaaaatacagttttgaagagatttaaaaagatattttctcacatgctgctacgttcctaatagataaaaggaaatggatgcattataatcttttctgaaagtaatagtaattttaaccttcaaaattttggtgatccttcctctgtcttaagattctgcttttataaactcactcttttacagtacacaaaattttgaaactaaagaatgcaggtgcttatggtccagaaagaataatgtgaattcagtgaagatgaaaacaaagaaatgtctgaggaagtgctttaagtctagcacttctaattatcttctgttaagtatgatcatattaaatttcctttgagtaaagtcattttctaaaagactctgcttatgcagcaagcaaacacatgcaaacaaaacagaacaccatcactactatggtaactaattctaaaactttgtatcatagttctgaattggaaattgagccaaaaatgaaggaatagcataatgagaaaaaaaaaaaaaaagctgctatgttactccagagaggttaggaaataattagaaaaagatatgaagaacagggtttgatgaatgagagaaagcacgtaaggttggcaataataccaaagagacctgaatgctaagacaaaatatattcaatgacattcagttcaaatgtgaaccttaagggcaacctgtataaatgtgtattgaaaatcagatgggaataagatataatttttaatatattacactgtgggagtttttaatcctgcaggagataaatcttttttgtcagtgtcacaggagcatggattttttttccaagtgcacataaaactgaaatgtagatacttgctccttggaagaaaagctatgaccaacccaagcagcata

SEQ ID NO: 41003 - DNA, 2511 bp, Bovine  19866881331143
ttcttgacctttttattattatgctgccttgtactggcttggatcttaaaagaacaggtgtgtgtgtatgattgagtgacattggaaagtatgtctgaaacgaccttaaaaaataacctaatattatcttgttaattccagtgtattattgtcatttggcaaatgcctattaagcaataagacaaagtctgataaattcaagggagcaatattttgtttgcttaagaatctaaattgggaaaggattgtggtgttaaggggacagcatttagctgaactatctggataactgtcttccttgttttctttttattgagtagatgccatctcattgtcaacacagaatgtggaatgtgaattatttattgtgacttgtcaccaggctttggcttgttgagcatcactggtgtaagaggaagcaccccttgtccgtggttatcaaatctgggtagaagtcatttccagcacattttggctgtgccctggataccactctaattctctgaacctttatatctttgtgattaaaactgagttaattaccatcctgtctgttttagaagcttgtgagatgattaagtgaaaatgctgtgtaaactgtaaagcactgtaaaaatgtaaggctttattatggaaaattatggaaattatgtaataagattgattatatttcctcttagtggtaaacatggataatttctggcttgggaaatatgcaataagggaaaaaacatgcaattaatatcctaagttgggaaaagacacaattgatattattaattgaagcaactactttagaacaggtattttataaagtctttcatgagtttgggtaaactccaggagttggtgatggacagggaggcctggcgtgctgtggttcatggggtcgcaaagagtcagacacgactgaatgattgaactgaactgaacttataaggtctttgcaggttgagatccaaaccaaactaatttaactgctaataagagttaagcaaatcagcatgggcatgctgatagagaattcaataattctgtcagtcatgactggtgcttgtgtaattaatcatttatatacttcaaagaattagagtagaataatactgacttaatatgaaaaccattctgtactcttgatgacttgaaagcatttttaatatcttccaatagccttttataaatgaagaagccatcagaaattaaaaaataatatgcataggtactactgatatgttagtctactcataaaatgagcattaagaaatcttctttgtgtatgtgtgtgtgtgtgtgtaataaagttttattgaagtataaaggagatagagaaagcttcttacataggcatcagaagggggcagaaagagtacccgccaaaatcttctactcaggaattagttatctggttattcaaagctcccatgaacaagcattataaataaatacattagtagctatataactactaagaatgttgctacaatatacactcaaattaactcttacatttttgttgcattaactgatgaaattatgctgctaatgactgatatttttaaaagcaggaaaaattatatgattcactatcttattgctacatgctatattttttatgaatataaatactatgtttatgtatctcaagatatggaatgtatagttcgttgaatatgaccagttcttcaaaagaaatcaactttttaaacaacagatcagataactacatagcaattgcattttgtctgtaataatttaaaacatgttgggggagtgtgtaatttccttggttctgtctccccgcagcaagtgggccttaggaagcatcagtacaaacaagctagtcaaggtgatggaatcccagttgagatatttcaaatcctaaaggatgatgctgtgaaagtgctgcactcaatatgccagtaaacttggaaaactcatcagtggccacaggactggaaaaggtcagttttcattccaatcacaaagaaaggcaatgccaaagaatgttcaaactaccacacaattgcactcgtctcacacactagcaaagtaatgctcaaaattctccaagccaggcttcaacagtacatgaacagtgaacttccagatattcaagctggatttagaaaaggcagaggagccagagatcaaataaccaatatccactgtttcatcgaaaagcaagagagttccagaaaaacatctacttctgctttattgactacagcaaactctttgtgtggatcacaacaaattgtggaaaattcttaaagacatgggagtagcagaccacctgacctgcctcctgagaaatctgtatgcaagtcaagaagcaacagttagaactggacatggaacaacagactggttccaaatcaggaaaggagtatgtcaaggctacatattgtcaccctgcttatttaacttctatgaagagttcatcatgtgaaatgctgggctggatgaagcacaagcggaatcaagattgcgggagaaatgtcaataacctca

SEQ ID NO: 41004 - DNA, 1573 bp, Bovine  19866881371451
aaaatggagagggttagagaaatgggatatgcactctggcagcagtaaggattcaatacctttgaccttatggatcatgaccaggaagcaaacaaagctgttcttgtttacccaaaccccagcaaactcaatataatttttaaacaaagatgaatatcaaccttgtaattcctgatttactaaggttatcaagttgttaacacacacacacacacacacacaacttgggatggatttttcagagtcaggagagacagggtggcaccacttggcacagccactaggggaccaattacctgagtgattctgggcaagagatctgcctctctggctcaaggttttcatgtatgtagtgaccataacaatacaatcaacttttatagatgctaaaaaaaaaagttaaatatgacaatgcttataaagcatttagaacatcagctaatgattcacttgttaaatagatagaaatcttaccaaactgaaatcattattttcctgagttgcctggaaaaagtcaaatgggtgaaccaataaaaggaacatctcttcatggcctatttagcaacaggattacttctggtggtcatctgggacggtctttgtggactaggtcactgttagcaatttgagtgacttacatcatttcactgtgaagccatttatgaatgaaagaactctttccattggcccaaatattcttgcatcgttttttttttttttcatcgtttttttttttttaacatatctagaaaagtattgatagaaacatgtttgaaaagttgaaaaaaatttcagctccagacaataataaagtagttattaatatgttagatatttggtgaattataaagattaaaaatagcttattgtctccttatcagagagagatcaaaattctgagatggtattgtccaaaaactagcaacacccactaccaaaattaagccccaaggagaatttattattttgcatatatctactgacatgtctttaaaaattattttgagttatcaaaagacagccccaatgtgaaagcccagattactactcatcactgtctgactattccaggtttaatattgcattttaaattgttgagatactttttttaaagccttttgggcttaagtatttgtttttgtatggctaaaggttttaacaatctgtgttcatggattctgtgaaatcttgaaagaccagatctatagaatgaaatttctttcttctcaaatctataaaaattcaaataaccagacttctaaaagaaatgatttctcttagggattttattgactctggcactccaaatatatacatcttcttgaaagaagtaaaccattgtgtgataattttattaagaaggtatttggagatggcagtaattaaagtggtctaagttcatctatttcagaagcaaagcaggaagaccaagaaaagagcctgagaactgccaggaaacttcacaggaagaactgaaatccacccaggagaaataagtttctattaaaatatgacagggcatttaactgcactgatcttcctctctctttggagatatgttcgatgggaagta

SEQ ID NO: 41005 - DNA, 1200 bp, Bovine  19866881652464
actggtgttgaagctgaaactccatactttggcacctgatgagaataactgactcatttgaagaccctgatgctgggaaagattgagggcaggaggagacagggacgacagaggatgagatggttggatggcatcactgactctatggacatgggtttgagtggactccgggagttggtgatggacagggaggcctagcgtgctgcgattcatggggtggcaaagagtcggacaggactaagtgactgaactgaactgatattgtagaattgcatgtcaagaagcccctcttcctctaccacatatcctttggatgatttatttcagtatcctgctttttatttttttaaaagaaggaaaataacctttggtcctctttttccctcggactttaattatactataagaacacctgcctacccgaactgattcctctccagtggcaattcctagaagactaacaatacttctcaacatgtaacctctgtgtccctccatctgtgtgtaagaccatcagaaatgcaagatagtttctccttatttatctttccaatgacacacacatactgaaaataccagtttctccaaatattagattatatcaagacgtttaatcccctctcctccctcaaaatatcagaatttcactactccaaaaatgttaggcaaacagtattaattctcaacacataagctagaggtgcttaaatgctacttgtatttggaacaaaatcaaattaatcaaactgcatttctgaattcagaacttaatggagtgtagtttgggtaaaccttagtgggaggcttgagccaaacttcagactaaaggcataatcttgaaaaaaaagaaaggaaagaaagaaaattaactgagagattaacaagctttatctagttccattaagcatcacttttctttagtaaaatcctaatagcactggaatctcttgcctcctgggaaattctcaaagatgtcattagctttctagttttggaaagtatttgagaataaaacaatcctgtgtgcatgcgtgcgttcatgcatgcgtgtgtcctgccctttggaaagtatttgagaataaaacaatcgtgtgtgtgtcctgccatttcttcaaatctgtggtttgaaaagctgtcctatgaaatttaaatctgatttgattcgaatatgtaaaatttaaacagcagccaaatcctaga

SEQ ID NO: 41006 - DNA, 822 bp, Bovine  19866881875398
caatgtctttctaggctgcagagtagacactacaagggaacgggtgggtgtctgaattgaggttctcagatctactcattaaatcagagcacaactttacattcacaggattcagatcataaagcagatactttcatttacttccccttcaatacttgctcaatcagaactatttctcctctgtcagactcttcaggcagcttccaaacttcatcacaacactggtataaaacacgcaatgcagcctctgtgaacattctaatgaatgatgagctggccttgaattcgtctgtttttgcacattacagctgtcattctcaaaagacatttaaaataggtaccccgccacacagtgatttgagaatgaatgaatactgccatttttataatatggaaaacggggtggtgaatggcattaaaatattcatttaggatcataagtatcatcagtgattcaagatcataaacttggctatttgaagaggcattcttctccatgataaagataaaattactaaaatacagagaaattttggattttttcagtggtgaagaaaagcaatggctcacacccacccacactgccctataccaacagccagagaagcataatagataaaatattattttataaccaagaaaacagtgctccaaattatagccttactgaatgtaaaccatttcatcttcaaagtgaaacagaacatctagccaaacaaccacattttctatccaggcagttttgcaacccatatttttttttcttctaaaatgaaaaaaagtcatttaatttagtttttgatttagcagatcatcatccta

SEQ ID NO: 41007 - DNA, 682 bp, Bovine  19866881907755
ggattctctattttttattttaaatattaaattgaaaagggatgataagacctaggtaatttcttgaagacactgagcagtataaaagaagaatttccatacaaataaaataatgtgtcaaaaagcagaatttagacactggctactaacacagctcaaacattccctcactcaaaatagtaatttctatacaaatattaatgtgattctttttccggtacttatgatgatttaattttaaacacaaacctccccaaatcagatagtgtcagaccaacttgtgcttactcacccacaggtgacatttcgggaacccctgccgtgtacgggccatccaagaatttgggttcgttgtcgttgatgtcctgaatcttgatgacgaactcagactcgggttccacgggcttgttggtgagccggtccaacgcctgggctcgaagcgtgtagtaggcttgctcctcgcgatccagcctcttggtagcatgaatatccccagtgttctcatcaataatgaaaatggaacttgccccttcgcctgacaagatgtatttgatggaaccatctcctttatcaacatcagagtgaagctggtgaaaaattcatgtgagatgagattaacttacaagagagtcagcgatatggagatatgtaaaaataattctaatgtcaggcagcagcacat

SEQ ID NO: 41008 - DNA, 1170 bp, Bovine  19866880385959
tggagttatttggctgtccgtgaggcaggccggggatgtgggagtgtccggggaaagttttcttgttggccctttaccttcctttgatgagtaagtggacggcttcatttgtaacttgaggtctgagatgtgtaatgcattacttgaattttaatttgcttatgatcccagtagggctggtgtcggaacgtctgtggactggagctgctctgctttggaagagagcgtaccggccacttcccagcctggccaccctgtgtcttgtgctcccggacggtggctgtagggcttccggtttcggtgtctgtggcctgtgggcagcttttgtgccggcagctcctgagactcctcccttatgacgccttcccccagggaggtgtggagcccagccgagctgagctggacccaaggctcctcctcacctggccagcccgcgttggggcccgggctgggaggaggggttctgctttgggcagggtctctgagcccagcgagcccagcgtgatctgggctgtggattctgtgtctcaagtgaaacttgaaaccatgagctccggcttgttttgtctttggctgggagactgattcaggtttgtgaacttgggccaagattcgagggttcccacagctttcctctcctcttcccctctgcctgcccaacagtgtctgccgatgtttcagggtcctcgctggtctctcatcaggctcattatggttttctgggggcaagtgacgtggtgcttacctccttttattgaatttgtacgtgtgtatgtgtttgttcattcattaaacaaattttttttcggctgtgccacgtggcttgtgggattttagttccccaagcagagaccgaacacatgccccctgcagtggaagcacagagtcctaaccactgacccgccaggaaattccctgaatttgtgttttaaaaaggctttttacctgatgtctctggatatgttcacaaccacatgtagaagctgctcatttaaagtaaacaaggccacggaaaagaattagcaccccgatttgtttttgcctcgtgctacaatataacgtcagtgaaaacatagcaataaaggagctgtgtacagactagagacagtggggaacaggcccctgtagtcgctccctgttcggtcgagccgggctgccagccctcgtgtg

SEQ ID NO: 41009 - DNA, 2823 bp, Bovine  19866880533044
atgccctgaatgattactttaacacggttgcatgtgtgcatgctaagtcacttcagttgtgtccaactctttgtgaccctgtagcctgtagcccaccaggctccttttgtccatggggcttctccaggcaagaatactggagtgggttgccatgccctcctccaggggatcttcccaaccctgggattgaacccaggtctcccgcatttcaggcggattctttaccgtctgaatcaccagggaggaaaatgtgttccttgcacatttctccttcctggtttttctcttggagatagcaaagtggggacttccctggcgctccagtggttaagactccaaacttccagttcagagggtgagggttcaatccttggtcagggaactaagatcctacacatagtgtggacaaaaagacaaaaaaaaaaaaaaatagcaaagtagtttgacctgagtgtctccagcctcctcatggcctggctaccccagctcatccacacagctcccagctcttagctgccccagctaagagctgcccatttgggggctccccattagggggctaaactctcccatgccttccctggcaggaacaggaccactgtcatgcccaccttttcccctaacaatctatgtgctaagctactgcattcaggccttgtgaaatcccgcagcaaggacaagctccacagaccagatactgatgggacccagtacatcacctaccacgaatgaaattaggggtcatccagagtttcccctatcactcaatacggcccaatgactaccccttctttccagagccctgacacatcagagggtcccaggcccttcaaactgcaaggctgcccctgccacatcttgaggtcaccccttaatgtgggcactgcttagacctggactcaggccaccagccgggctcagttgtcgtgttactgagtctaagctccctctgctcgccacacaacccgtcagtgaatccaagagacaaggtgttgaggcacggaatacgatgaaagccagctgactgagaaggtggcaaaaataagtggagagaaataacgtgttcatggaccggattgatagacccagtatagttaagttggcagctctccccaaatggattcatagattcaatcaaaaatcctggttggatgttttgggggggtagattgacaaagctaaattttatatggaaaacgaaaggaattagtatagctcttatgaggcaaggaagacccagtgcagccaaaattaaactttaaaaaaaaaaaaaaacccacccaaagagacaagtcatctgtattagcaaactgatgaaatgctggtagcatcttaagccagcgtgctgcagtcagacgcgctttaggagcccctggagcccctgcaaatgggtgggtggaccggcaccctgctcctagagaggaggaggggggagggtgacccaggttgactggggaatttggttgaggcctgcaaggaggcaagctcacttctgaagaaggtaaaccctgaagatgtcacagaaactgctgtcttacatcatagcccctttaaattgtcttctttgtggatctgacaaaatctacataactgatatttttaggtccaagccccccgggcgttgcagctcttctgtttttatttatatacaattcactttttgcccccagttaagctaaagaagcctggaaagtgtgaaacagaagttcaaagcaatctcttaaggtgaagtgagcccaccacagcctgcaagtactcagtaacatgccagccatttccatacaacttgctacttctcttcacccctaacagtcgccacgtggaccctgagctcctgggccagccatgagtaagcaggtgtggctggcaggacctgggcaggacctggaggctgtgattacctggctgctctcacctggcagccaccaggcgtcccatgacagtggcaaaggacacagggaggggtggctgggcctcccactctggtagctgagtctcctacaacctggactggctagttctgagcccttccctgcccattacctaaagtcaggttcaccctggactgggggcttgcaggggttagaggtcagactaaaggggctgtctccactgcagggagaagatcccacaaagacacaggagaggtaggacttactcaaggacttttaacgagagaatctcatacaaatacaattttattgttttcaaatacgtggaagtatttatgacataattttaaaaacccaatgcattaagtttactgagtgctcacaagtggtactgagggagatgaaggagtttgaccatgaagaaggaggataaaacacgactcaattctcagttcaaactggaaagtgatgactttataaatcgtgttttgaatcctaaagtggttgcccagggagacgggcagagtccctgtaagctgtctgcagcatctagaaggtagcaggagagagtgggcatctcctggcagaaagactgtcaaaggcaaagagaaaggacaaataacctatttcatgccatggttcttctacactctcaataagtgggaagtgttatttttagctcttggcaaagatgaaatggagaaagaaagatgggagcttcctgctgggaaaaggaagctggagaaagagtcaaaagaaagtagtcggagaaacagtgagcctcctgttgggaaggaaaaaaactggaaggcaagagattgtagcttttgatgtcagtttgatccactcccatcactcaggaaatgaacaaaatgtagaaactcagcaatcagggaaggaaagggtataaccggcaacaggaacaccccag

SEQ ID NO: 41010 - DNA, 1648 bp, Bovine  19866880588010
gtcctctatccctgtcaatccccattgccctgcactccctgggcagctgcacatgtcgggaactgaggtgtgaggggaggtgctgctacaccttcggcagcctggctctgggccttctttcccgggactcttcctgttctgtctcatgcggggtcgggactcttcacctgcagtcttgtcttcattccacacaatgtggtgtcagtgggtgaaacccacatcaggttcctctttctggttcccctgtcagcgctggaacctcaacaaagacatgtgaccagtgaatactgtgactgatgtagaacattttggtaaacagacttcctggttgcttccacaacttctgagcctggcggttttcttaccccctgctccctgctcttagccatccctggcaacaggaaggggctgcttacttgggtctgcaggtcctgggaggaggtggtctctgggctagtggtggcccaatgggaaggtacctgttttctccccacaggaatcttgtctatcggcctggctgctgcctactacagtggaggtgaggaacgtcatctgccccgccccacccctaggagcttccttagctgattggaaaatagagaaaaaaaggaaaccctgtcatttgtaatctgacaggcatgattttggggattgcccccacctctaaatggggcttccctggtggctcagatggtaaagaatctgcctgcagtgtgggagacctggtttctatccctgggttgggaagagcccctggagaagggaatggctacccacttttgcctagaaaatcacttttgcctaggaaatcccatggacagaggagcctggcaggctacagtccatggggacataaggagttggacaaaactgagcaactaacactttcactttctgcctctaaatggtttgcaggcgtggtctcaccttcgtgtgctggtgtgtcccccacagcttacattcatttacatcagcattttcatgtcaaaatgttcagaaaggcattctcatgtctgcctcaggtcttgtggcaggtatagtctatgctttcagcagctccctggaagtagtcccccatctctgctctcacacctggtgccatgatagtaacctcaaggagtcacccaggtggagagctgagggcagagctggtggaccacgtcctgtcctgtgtgacagggcccacagtgccaggtggccttggcaggggtggggtgtccttggaggcatgggcagtcagctgggcccccaggggccactcctgccgagtgtctgggaagcagctgttctgggaggaggcaccctgtgcaggcatgttgacttttgcccccctgctacctgcccatggctgtctcctgtgtttgctccccagatagtctgggctggaagctcttctacgtcacgggctgtctgtttgtggccgtgcagaacttggaggactgggaggtgaggctgatgcaggaagggtgcccaggctttggggctcctgagtttccctgcagggctcgtcaaaggaagaaagattccaggggcctaattccctcaaccccatcctgaaatgtgagcccagtggtctctggccagcttgacttggcccctggacattgcctattttgtgaccatttgtgggccacacaatcttctgaag

SEQ ID NO: 41011 - DNA, 1065 bp, Bovine  19866880671150
gaagccatagttttcctgccttctcccggagtgtttcttgaactcatgtccaccagttccccatcgtcagcgtcccacgtcagtcgggggtccaggcgggcagcccctctccccgatcctgctgggtgatgatatcttcctggtgccttaagttcctgtagtttttacaaaataccccctctccccgatcctgctgggtgatgatatcttcctggtgccttaagttcctgtagtttttacaaaataagagttgaacagtgtttggagtttgttacatgtgattctgtgatataattcataccagggattagagtctccagtgaaaactgaaaaatcatctcataagcggtcacagcacatattttcatttcttttcataaaaagtagttcacgtggccaacaacaaatgcagctctttaatgtcgtcttaatattttttggagcctgaagttacatctgttactcggtgaaaatatttacgttttgtataacaagagttttaactttgttttcattaattttcaggggtctgggaggagagctcatgagacaagcaggtaggtctgagcaacagaggctgcaggttgtggggcaaggtcctttcttcccaccactgaaggaagacaaaagtcccaaggctatttatttacttgttttccaccttgtaaagttccctgatgggctcctttgcagggaccagtggccgggccgttttctggtcagagttaccgtggcggtgcacctggcctgcacatcctaactccagggctgcctgctcagcccgctgcttctcctgtgtgtgtgcaccccaggctcttaattttcagcttctgtgggtccagatacattttagtagctacggggctggcagccgctggggtgggatgaatgagtagagtaagtgtcccatgaaggggtgatacagttaggactgcgaatgttgccctctttccctcttcaatatgatagattgataaaacagaagggagaatcagaagtttcaaacgtacatgggatttcacgtgtgacaaagaaggtacgtgtttccaaccggctaagagggca

SEQ ID NO: 41012 - DNA, 1183 bp, Bovine  19866880753351
tgatcgatgcgtgtgggagggacacatgggcttttttgagtgtggctcccggtgcctggttggtacacagacacacccacctcctgtcctgacccacaccaaggtggctgcgttggccacagcacctgcaggacatgatgggcacaggttggggtcgggggggagggcgcggggagatggacactcacctgcagagcagcccagagctcacgggcctccctgtcaccagacctctgctctaccaggtccatctggggctgaatgcgctgccgggcatagaaagtgacccagtcctgctgccagtcgttcacctgtgtgggtgacagcagagctcaggggaaggtgccagagccagggttgggagggctgacccccagaggcgccactacagggacaggtgtgaagcaggggagctgacccggcagcctggggtctagaggacatgcagggacagcaggcacctggacaacctcccacaacacctcaagatctgaaccaagtggacagtgccctgtaggttactcagtgtggccctcccagggagctgcttgcttctcctcggggggcatggccaccatcctacccacttgccccaagtgtggctccctgggctgaaacccccagggcagccaacctcaaaatcataaaacgcaaacttatagttcctttccattgcactacctttaggagtctccaatttaaaatcaaacactgtttaactttctattttcagcccccttggtatccagcatcctgttagtccttcctggctcctttgagctgacctagcatgtgaggtggagaaggtaatggcaccccactccagtactcttgcctggcaaatcccatggacggaggggcctggtgggctgcagtccatggggtctaaaagagtcggacatgactgagcgacttcactttcacttttcactttcacgcattgaagaaggaaatggcaacccactccagtactcttgcccggagaatcccagggacaggggagcctggtgggctgctgtctatggggtcgcacagagtcagacatgactgaagcgacttagcagcagcagcagcagcagcagcaacatgtgaggtggacactctccatgtcgacctctttcattagcagagaaaaaaaaaaggagcaaagaccgttcaccaaatttcaccaaaaattaggctg

SEQ ID NO: 41013 - DNA, 1243 bp, Bovine  19866880853655
gtaattctgttatgttcctacttggttggcaaaatgtgcattttgatattttggagttcctggccatgctggcaacaacccctgccagcccccatctgtagttcctgctgctggagcccaaatgcccaaacccgaaagagcagaggccggcagagctgctggcggacagctctctccatgcttcctgcttctccacgcctgtcataagatggagacttcgataccagggagcacggccccctccttcagccctcgttgggcagctccttcccgtatcctgtgtttgatgttttctttttcatgaggagagaactgcgggaagaagtgttgtaagaaatctgaacagggacatccctggcggtcccggggttaagactccacacttccactgcagggagcatgggtttgatcactggttggggaactaagatccctcgtgccataaggtgtggccaaaaaaaagaaaatctgaacaaagcagagattgcatttttagcagttagatatacattaactatccccattaaatatgtcatttctttcattgtgaacgactgcattattaccagatgaaaggggccacctcctgttttcttaaatcagcctgtaggttgcgactaaggggtcagttagttggttcgggatacctgagcctcacctctgctcccgtcctcggcaggttcacctctgtctagtcagcctgtcttaatcgctgtgcagcgaccactgccaccgacgatcaagcctgtcacctacactgtcgccgcccctgtgacgacctcgacttcccagcagcccgtggtgcagacggttcacgtcgtccaccagatcccagcggtgtccgtcaccagcgtggctggactggccccagcaaacacatacaccgtcgcagggcaggctgtggtcactcaggcagctgtgctggcccccccgaaggcggagccacaagagaatggagaccacagagaagtaaaaggtgagcagcagcagcagtcactttgggcagtttttcaagtttttaaaaacctgccagccttgttcacctgagccttgctaacatgttacgtaatgttgtgctagaagcagggatgtttgccacctggtttgctttactttaaattagtgagagttctgtaagctacccagtaatattagttgatttcaatttttttctcttttctttgaatttagtgaaagtagaacctattcctgcgattagccatgccacaataaggtgctgctg

SEQ ID NO: 41014 - DNA, 1186 bp, Bovine  19866880917182
atttttggctgccccctaattggagaggtgggttcctcaggccgtctttggggtgttcattggtagggtaccaggtgggcagcggccagcccggcggcacctggtgcctgactctcgcccgtgttcctcctctccccctgggaacaattgcgggaactacacgcagtatgaaagcccagcttggttaaacatgtggtcacagctttgcgtcttcctaatttccccttttattaagggaaaatgcgaaatagtttacgagttcagtccataccttgtggggcaggtgtgccctgggctataaaagcattatttcctgcctcccgtcaggaagctattccagccagcttggggccagcctgataagtcagggcaacctgtgctggcacgtcccattatgctccctgattctgaaggcgtgagaacctctgcaagtcaggttcccatgattgtataggatatgttatggcagagatctgaaaactgatgatttcatcactagctggaagcacggtgatcaaaatgatgacagttgcaaaacgtttcatcaagtgtgagcccgagagtcctggtggtaccaggagtgaacacagacacacacctgctgcaccagcccggacccgcgagcccaaaccagctgaaaacccctcgggtttaagatgacgatggtgttagctttaaaagcactattgtttgatgttgctcatactttgaggccaaaatataaaataagctcactttggttaagttttctcaaaggtttataggagatctgttgtatgtaagttttcacagcgttactcaaaataatagtttgggaattaattgctcctatgttaacatgtacttttttcagtcagatgatcttgtgcccgcagttttggtctgaaccttttgttctttggtcggctatcttacaaggacagtgaacaggttttcaggggatggtttccttcgtgccaatgttctgggagatgagagtattccagggcgcaactgttggaaggcgagcctggatggagtcacaggggcagcagttttagtaactttgagtaaactgacctctccaggggttgcacaattcactaattaaaacaagggagtgcagctgcttcagacgctgatggagacgagctagttcactaggttataaaaatgcaatcatgtcagagaaataaacggggtaaga

SEQ ID NO: 41015 - DNA, 3558 bp, Bovine  19866880952572
tgccttgtagcacaggcatgcccacctggcacccgtgttccctgtgtacacgcactgtgcccacacagggtttgggtaaaatcccgttcccccatcttggccttctgtgtcgtccactgtatttggatgacacatggctgatggacaggtgtaacacatgggtgatggacaggtgtgacacatggctgatggacaagtccacagtggggcatgtaggtggtgtggccggttcagacagtatgtgtaagcagttggtgttttagaggcattaagtataaaggtgcgtttttttgagtaagtaatacatgtgcatggtataaaattcagaaggtgcaggagttgtttagggaaaaccagggcatctcccctctcctctgaggcacctggttctaccctgggggtccttgttgacccccagttcctgtgtcttgtagagagctttggctcatgtctgtgggcgtattgacttccttttgtccatgctgagcagtggcacacggtgcccaaggtgggagccactcaagtgctcacccatggaggattggccagatacaggcacgccgcggggatactgtgggctccgggcagaccgctgaagaaagcaagcattgcgttaaagtgagtcacatgaattttttggtttcccactgcatatgagaggtatcttaacacaaatctgtaatctgttagggggtaatagttaggtgtctataaaaacaatgtacatgctttaatttaaaaatgctttattgccaaacactgctaaccatcatctgagctttcagcaagtcataataacatgagccatcactgttcacagatcaccataacacatataataatattgaaaaaaaagtttgaaatgttgcaaagattaccaaaatgtcacacacaaagtgagcaaatgctgctggaaaatggtgctgatttgttcaatgcagggctgccatgtatcttcaatttgtaaaatatgcagtgtctgtggagtacaataagacgaggtcagcctgtagtaatcaagttggctgtcagtagtaaggagcagctctgcgcgtgtgccgtcacagcagagcctggacgccgtttgctgcctgtgacgtcctgcgtcttggagagccttccatatctttatgtggagtgtgacctgtaggtctccccctcctggccattggcttctgtcttctgctgttatgaacgatgtggagtgaatattcttgtgtatattctcacctgtgtagttatatctgagtgaattagtagaagtggaactgctgaaccaacggatattcgttttcagtttcctgggcagtgccacttgctgtctccagaggctgtgccaagatgctgtccccagcagtttctgggtgcttctagatccttccagtggtagctataaaaccctgattttggcagtttgccaaaaactttggacaaatttttctttctgtttcccattgaatgacactgaatgtttgagctgtatcttttctataaacttgagtgatttttctcctaggtgatgatattattgatttggaaatactccatgttacagaagtctcttgtttgtgatagcagttgcagatatttttttgttttatggtgtgtttttcccggcagcatttttctcctttggttgagtattttgaaggtaccaatttcttctttttttggctcctgggttttgagtcataattagaaaggcgtgtcccacttggaaactatttttagaagttctcctatggtattttcagatggaactttcatttttaaggcataattacacttcatcagctgtcctcacatgaagcgtacagttcagggagctctggcagcctgcacacttggtggccagcactgtcactgacatgtgaggagctcagctctttggccccaggtgctgctctgcccatcaccgtagctcactgatgccttttgtagaatgtcgcacaagtggaatcagaaagaacagattcttggacctggcttctctcagcacagtggtttcagagagtcacacttcctgtgcgcgtgtgtgtagctcgttcctctttattgctgagctgtcttgagtctgccactgttgccgtctgtgtgttagtcctgttatagacagacatttagggcgttttctctttggggctctgatgaatgaagctgcttgaagtctttatgtatttagaagtctttttgtggatttatatcttcatttcttttagataaatacttaaaaggggatttataggaaagttaaaagatttataggaaactgccaaacagtttttgaaagtggttatatctatcgcctcatgttcgcagaagcagtgtgtgagtgcctcttcctgcacattctcaccatctctgcacattgttttttccagcatgtttattgccggctttcctgagtacacgcaacccatgatagagcacctggtcaccatgaaggtcggccactgggacgggtaggttttgtgtttttgtgtttgccgaagtaatttatctgtcaaataagaattcatattatttcccaagggagagattaaattgagctcgtaagcctttgatatgttttttgattatagatttcgtatttttgaagttaacacttgagaagtaatgtaagctccactcttcacacctgatgtgttggttaatggtctacctccagctttacttctggagacttcagtgacatgtgctgggtgtgtaaacattcccatgtcatgagggcagggaacttgggctgtgagatccactcacccctctatggccacggcctcccacctcacatctgctccatttggccgcttagccgtctcctccatccttcctggagccaggcaggcctttgctttttcctgattacggggcagtttcaaggtgtcttcgcatttcccagcagttaaacgtgtccgtccaatggggagggccattgtatgacccagagcgggttatcagcgctgctgtcagcacctctgggaaaacagcttattttctcttggaaagctctgtgtagctgccggcactcaggccgaggtctgagggacacagacgcctgtgtgtgtaaggagcttctccaggttctacatttggaatcccagcttatagtggctgttgcttgtggtcagtaggacatataaaaccaaaattgcaactatgtcacccatggtgttaaactaaactttttagccattgaaatctccagctgttgttgaaatgtttatttcttttttcaattctgtcttttttccttcgtgtattttgggtgagactctctggttaggtgcatatacatttctaacttttttggtatcttccaaatgtattgtctctttttgtttcatgttagatttcttatcttaaagtgtaatttgatatgattatagcttaagggttgccaagctttttcttgtaagggccagagagtaatattttgggtcattgtcccatgtattttattgttttttggtctttataaaatcctttaaagatatgaaaaccattctaagcttgggccttacaaaaagaggcctgtcacagcccccgtcacctcgcacc

SEQ ID NO: 41016 - DNA, 2487 bp, Bovine  19866881028964
actcttcagtagctggacagtctcagtgctaacagtgacttgcggactggagtacccgtgtgcctctaaatttagacacaatttccatctcacgggagaatgtatctcaggctcaggagcaaatcagaagaaatgggagctacaccataacctcaaagttagttttaaaactctgacaggatggataaaagccagcaggactttgttagcactgcctgtgacccaactccctttgcccatgcagacactcggtgccccctctctcccggtggaggcaaggcgcctgctctgctgctgtcagcagtgtcttggcacaggcgctccagtgctacctaggcctttggcgtgctccgaaaagagtatataaaaaagcagtgcctgcttaagcttatcaaaaggacaatgatactctgtattcaattaaaattaataaaaatattttattgaatttcaggaacttggtacttttaaaatttcaaacctttgcacacaaatcaccactatcctttctagaatagtggaggttaggacttgaagattgtcacttgtctccttgtagtcacatagcacagaaatcccaagtcctgacacgccccgcccccttccgaccgtggcctcgcctactcttgttctaggagaggacgatgtgacgggtgatgcatttaaggagctcaactgtctgattggagactctactgatgcaagaagatcagtcccaaagccatgcacagacaccttgatacgtgtcacatcacttagatcacattgtgagtttctcttttgtaattttgtctggttcagggcgaagctgaagtgaagtttctagccccggaggaagctcagaagtttggcaaagatcgaagcagagactttttgaaatgaggcatttaggaaccaccagtggacagctgggcaggagttaagtgcaatgtgactgctgatgtagcacctggcatcgagtggggcctcaaggacacaagattagtgactcccaggtgttgaagggctcctggcaattcagagctaaattcaaacattttaaaaagcgcccaggacatggtagtctgttaatctatgtttgtttgtttgttttttcctctgctttcttcttgatattcttaaatttctgcttgccaacaaatgagccaactaagacagcaggaaaaaggaaagaggatgccctgcctttgaaaaaggcatgctctagctcccagcagcaaaagctatccttccgccttctttagatttgagaacagggtgcttttcttacccatagacccagctgaaatccctccagactcataaagtctaccttttaggctcaaaaataatcaactgatagactgggctcacacagggaaaagctaccggggtctttctacctggtggtggggatgcatctcccgggacaacaccccgaggcattgcttagtgccgcctgagctgtctccccaccgggtggttttatccactcacctcccccagagctcacggttggggaattccccaactcacggctggggggctgcagtggccatgactgaaaggtctggagactcagtggagtgacccaacccccacatacggggtggtagggggacaggacacagcaaatccaaattattttttaaatagcaaaccttctgtgcaaaaaggcaaataaaaatataccttccaaggtatctgtaaagtgtctgggaaatgcagattgctgccctggggtgctctgatccatccatgcttcagtccgcaagttagattttgctactgtcctgcatgtggtctcattcacatgatgattttatttttattttttaaatggttgagtttaaatccagctagtgtgcagtaatttcataatctcaatatgcattatctgcaataccattgtgacatctccgtaccatgaactgacacacaatacttagaacagatttatcatatttggacttcaggtaaataataaatgttttaaaattgcctaaatataccattctcagccatttcattccacgaggaaaatacagggttttttcctgtctttaaaaaattaaatatcaaaataactacatttaaataaataatgttatgatgatgacatttaaacattcacaataaggccttattgaggaagttgggctgaggccaagtgggcctcctgcttttcattctcccaccttgttccctttcctctcacttgatgttccatcaggatgatctctaattgaggatttcttcttattctcactggagatctgttatgatctgaatattcatgtctatcatcagatagactattattgtctctgtcacactgtctctactctctcttctggaaatctaactagaagtatgaaagaccttttcattttatccttcatgtctcttaatttctatctatttctcctctggtctacttctagatttcagagtgtcataggacctaatcattctatcttctctttgtagggaattcatctaaaattc

SEQ ID NO: 41017 - DNA, 1073 bp, Bovine  19866881207791
tctagcttgtcttcccactcctaacagtctctctgttaaggagaaacattttatactttgataaacttgtttgtatccttgttcttttatgaattgtgttttttgtgtcattatctaagaaatttctgcctgactgaaggctccacgactgtctcttaacgttttctcctagaagtttcgtagtttgagtgttccgctcagacctcaggtctgagtggggttggtttctgtgtgatgcgactacaggtccaggcctgtgtcccggttttgcttgttgacgccccggtgctccacgtgtgcaaaagactggacttcccactgcgttgcttttgcgtcattctcagaaatggtgggtgtgtggtccagcctggggctcttctgttcctggatgtatttgcttgtcttcacaccaggatcccacggttttgatacttgggctctgcggtgctagctctccaggcccacgctttcttcccgtcgctgcgtgggcttgtcttcatccttggtgtctgcacatgagcctcaggactggcttgtcgtttcctgcacgtcctgccaggagtttggttggggctgagctgttggccgtccagggaggcccgcgaggcagtggcactgagtttcccgcgtcgcgggtctgcccttctgctgttctgacacctggcatctcacacttgccttccccccagggtgtccgtgccgctgctcaagacgctggaccagatgctggccaacgggtgcttcgacatcttcaccgcccaggagaagtgagtgctccctgtgctctgtgttcagtgctgcctcagtggttcagcctcgggctcacctttcagagaaccgttaatcagatccagagatcaggcttctgggagatagtttcctggtatgttcagggtcagcttttatacacactctaagagccaccaagaacatcggctgctcccgtgggggttgggggctcctgctgtctgtttgggacacggagcaggtggggcgttgcccctgacgggggcctgcagtcagcaccactgtggacggtggattggatggtgaacgggatcacagagggcctg

SEQ ID NO: 41018 - DNA, 712 bp, Bovine  19866881240469
gtggaaactgatctgtgattcaagaaaacactgtattttacgatgactattaaaacttaccttataaccaggaaacagttagatctgttaccaacagcaaagtagtcagctgtggtcaaaatatcgatcccatgagggaaagtaccctaacaaaaaaatgggggaaaaaaaagaaacgaaaattatttcaatgaataaaaaaggcattttcaaagtttgataaccatatgcacatgagttaggcttataaacaaactgagaagtgccggggaacgcagacttggttactaaactgacagctaaaactacacgcctttaccaagctcacccaaggactttcaagtcaaggactactgactgcctctccgagcgaggctggacactgtgctaaaattatttgaagcacttaaataaaattttttcctaacaatactaacatttcaactttgaaatactctaagagccgtttctctaaaccacacaccacagaaagacatcagatttcagcagaactcaagttcagatttcattccaccagttcccctccagccagaaggaccccagaacccctgaggggggctggcacctgcctgggttgtgaatcctggacaggagcccacccccacagctggtgggagaatgagcaagacaaaaactgggaggtcacctgtgggggcccgatagctgacacccaggaccagactctgaaaca

SEQ ID NO: 41019 - DNA, 1568 bp, Bovine  19866881393255
cagttaaagatccccgacctgttcctgatctggacatcatcccagccctgctccacggagacctctggggaggaaacgtagcggaggattcctctgggcccatcatctttgaccctgcttccttctatggccactcggagtatgagctggcaatagctggcatgtttgggggcttcagtagcgccttctactccgcctaccacagcaaaatccccaaggctccaggctttgagaagcgcctgaagctgtatcagctcttccactacttaaaccactggaatcactttggatccgggtacagggggtcctccctcagcatcatgaggaatctcgtcacctgagctcgggagggaggccggagtcctggtccctagatcataaccggacccctgtggccaggctctcctaccctggaatagcttcagaccaattttcccagcctcgtatataaagtatgtgacatctcaggagaaagcttttctcaccctaaagttagacttcatagctggatgcagctgcactagaaattggtgtgaaccaaagggaccagtggagggtgggctgcatttaacctgcagctgccccaaaggtagagaagggaggtggccagagtgccaggcgctgccaccaagggcatcttccctccagctccccatctctgcaggagtgactggtatccaaggtaatgcttcttggtgggtcagacttgattgtggacatgaaggcattgtcctgggagcacctcctgatgaccagttccaaaccaaatacaccccctttcctctgtgccgccgctggactgctcatttctacagcttgtgagctgtcgttcatcggcactgtagaaaccggtactacagcggtggtttccctccttcagtcttgaagtggtgagaaatgttcacgaatgccactgatgctaacaaatccttttgcgtaaaaacttgaataaacttcaaatggcttcagtgatgtgtgagactgtattttcctcatttacgttctctcctgtgtattggtgctgtttgccaggaaactctcgtaatgtgacaataagtacaactgttgtttcttaaaaaaacacttttttttcttggctttgctcagtaagagaatagctcagagcttccagataagagcaggtgtagcctgaggacttgctgctaccagtttaactgctgttgttgtcaccttatgagatttgcttaatggtaaagggaggttgcggagaaggcgatggcaccccactccagtactcttgcctggcaaatcccattgacggaggagcctggtgggctgcagtccatggggtctaaaagagtcggacacgactgagcgacttcactttcacttttcactttcctgcattggagaaggaaatggcaacccactccagtattctttcctggagaatcccagggacggcggagcctggtgggctgctgtctctgtggtcgcacagagtcagacacgactgaagcgacatagcagcagcaaagggaggttgaaagtaactctcaaatttcatttcaaggaagaagccgatgggtggcccctactagttctgg

SEQ ID NO: 41020 - DNA, 820 bp, Bovine  19866881495404
acggacagtaggcaggaattagggggcagacacctttccgaagtgatgaaacccacaaacccactgaatcggggccaagggagggatgagaggcgggggcagagtcacacaggggcgacaacagagtagaacagacaacgaaccaccaacagaacacacaagcagtggacagggacctggagagaccggctggggaagcacggggccctcactgtgcgggggcatgaatccagacccgaacaaaagccagggagctggccgctgagctcctgcctcatgtgccgtcaggtcaggggaacaccacccgcccacccccagagggtcccgaaggaaggaaggaggcagcgctccctcacagggacgcccacccaggcgcctgctcaccgtggactcggtcaggccacccacggacacggccagccccagcagcacgtggtagcggtaggcaggcagccccaggaggcgggccatgcgcgggaaggcctgggagggcgcgccccagttcacggaggccacggcggccctgcaagacaggagcaagagctggaggcgctgccccatggggacaaggggctgtccccccgccctggagcagggcccagtacctgggggaagagcctctccagctccggccgggcgggcacgtggggggatggaagggctgtcggcgtgcagcagcgccaggaacacgcgagccgcgtgtgcacggaaccggtcgatcttctcactcgcctgctgggctaagcagcacatgagctgttggcagctgcagaccagagtgcagggttagcgcgtctggaaccggagagtgggcacctgg

SEQ ID NO: 41021 - DNA, 849 bp, Bovine  19866881558813
cagacttgaaaagcagagggtaaaatttccaggttgaggacttcaggggtttgatgttttgacggcctgctggccccacgtgtgtgcggtgcaggaggggccctttctcctttgttgactcggattgcggatgagtttgtgggagccttacctttgtgtgggataattcaacctgtggttcttatcctttggtaccttcagttacacgccggtcctggaaacctggtgccgttctttcctctccgtacaggccggcgcgcttactccaacacgggcgtgcgtcagtgagcctgcctcaggctgtgtccctggtttatgctgcccactcggaagattttcagtctcgtaatttctttcctgtatagcaaatcttgttacttcatggcgagtgttcaggataaaaattttgaaagattgcaaagagttgttttgataatttatgttttaaatttgtaaaggtttttgtaatattttaatagtttttttttgtttgtttttttttaggcacaaatatttaaacatggaaaacgtgaagactgtttaccctacggtaagatttatttgtaagtgaggatgtgtttgtgacatgagtttgcccaaattctgatcaaatgtgtctcactaagattattcataggcacaaaaatttgtgacttgctgtatttttttgttgtcacaaattttttttgtcttctgtgtgtgtatgtgtgtgtgtgtaagagagagtgtgtatgtgtgaataatctaactctttggcctcaggccttgtacgggaggaggtctgggctcctgactgacaggtctcgatcctggggacttggaatgtagacctagcccctgaggtcttca

SEQ ID NO: 41022 - DNA, 942 bp, Bovine  19866881562802
ccagggtcagcagggactacacacccggggcatccaccctcccgccaaggagagagcaccacccaggaggtagcatgcgccatcacgcggtcagaagaccagaccctgagcagccgcctataccaggcgagatggagaccatggctctgcattcgaggcaggcccgctgcctgctgcagagccgtcagcgccctctggaaggacgaagcagaaccagagcgtccttggtgtccaggatccgctcgagagccacacggcacaaaaagaaccaggaagacgggccccatgtcccgggcagacgtgagccccagctgcaggcagagcaccatcgcccacactgccctggggatcaagagcccagccagggtcagagcagcgacatggaccacctctggccttggtgggacactcatgagaagagcaggggacgaggacagcacgagcgcctcaccaggcgcccacgttccccgcggctgtcggtggtgtaatccttcagacagtccagcagcgtgcagtaaatctgggagacgttctctctgcacacagcttcgtccggaggcccttctgcccgcacaccgacagtctggcaaatcctaaaattaaaaacgtgtgaaacccagctaacgtctgagaatcccatgcaagctctcctgccgttcttgtcgttttggctggatgtgtctttcctgccaggatgccctcagaacagacccataacctcagaagcagactcataatgctcctgcactaatgcaatgctgaatgacacgtcgccaagccacatttctagcgtctacagtttcagggtgcactgggggctggctgtggctggcccctcctaccccgccatcctacagaaggcactccacagggcttgtcagagaaagggcaacccctcccgacgtgcatgtgtgtactaacgtcagcattccctccacacag

SEQ ID NO: 41023 - DNA, 1178 bp, Bovine  19866881819742
ggtggaccgcggccctcgcgcagggcgtcaaagggtatgacccagagcagtgtctggctattatcacgtgaggtagcaccttaatttccagtgttaatcctaaagcttggccaacccaaaccagttagtgggactgtcacagatttcaaagaaccacaggtataacaagcaagcaaaggaaaagcacagaaggggaggcaggggcctgcctcctgacccctggggacggattagtagctagagctgaatctccatcgtcactgcaaagcaaggcaggcccagagagagagcacatggaatcaaaacgaaaaaaaacgggaagagacttttcataatcacttggaaatcagcaagaaagtggttttattggcattgggttttagaaggggaaaaactgaccccaagaatctgggtaatgaaggaaaacacatctaccaaggaagctgcaagtttctcacgatgagtctcgtgtttggcaaagataaggaatttgctttaatattattgccttgaaaagtcaaatgtttgtgccagggcctgatgtttggggaggcctgtccctttgtgaggggagtcggttgtcatggtcacagcaggaaaaactcccgcctcggtgagatattaacattccttactcttggagagaagagggtgggattgtgttttacttcaattttagcaagtgatcacattattaagaaatgttttgctctattatgatatgaaataatagtaaatgaatcttaacccaatttaaatacccaacacttctcaaaatagatactttggatctacagtatccaatagtcaatataacattgcctatttaagaaaatattattataggaaaatgtgtcctttcagacataatcaaattaactccattttattaatgtgtaacacaggattcccatgaatttgccttatccaaccttaaagagacagcagaatcatttcttcacaatattacaatttacttttttgttattgatagaatatatacaaaggtgatgtggctcaagttatatctactctataaaaagcatattatgaaagataaaacttgctttttaaaaaaaaacaaaacttgcttttaaagtagagattatacaaccaatcacaggggtcatcaaaatgcccttaatttactctcattccactaggaagatgcaaaacat

SEQ ID NO: 41024 - DNA, 1196 bp, Bovine  19866881820034
tttctctgttgtgcattttctgcttttatgtaaccccatttatcaaaaataaatcccctcaacaggtgccacagcagttacactgaaacaacttgccaacgttagagactgattgcaacatattagaacaatgattttaaagaactacactaaagtgtaatatctcttaattactgaaccaacatatagtcagacattttaaataaaacagttacttaccgcatccaagaagcaaaggtaagaccctgagctctgtgctactgcttgatttttagaatatccgactgtttaaaagagaaaaggaaaagctcttttagaactcagttttagtggattctcttgcataaaacttactgcgatgtacacagtaggaaagctaggaacactcctcactgccaagtaaaaactcagaccaatttaggtgaaactgacgcagtaaatataatgacgacagacaacagtccacccagtactggtgttaaggcagaacgtgctcacagaaggaaaataaagccggcaaacatctatccagcacagcactaaggtaaccctggggagtatttttaaaacacaaaattacaatgtccctgaatggaaggacttgaatagaactggcagaaacactttctctaaagcctctgctgataaaagtcacgatacagttacctgacagatggggccacaaacacaagagagatcggctggtagaagcagctcattggactagacgcttcatgggcacagattgcactgaacacctgttccggggatgagttacaggccctgtcagtgtccactcttcctacacgtcctgggaccccccagctcccccaggaggtgcagacccaacttcaccaagacgtgactggcacaagaacccctcacggaatagaaactagaccacgtgtatgaacatcctggccgcacacagagccggcgccacttgcactgctgagcaccaggacagcacgtggagcacaaaggctgcagattcacctgtgcctggaaatcaaggaagcggtgcccggggatgggggtgcttccagggccggtgaggtcagctctgcctcagggagctggctgcagggtgtgttcagtttgtagaaaaataactgagctgtactttgatgataggtgtactttcctacatggatattacatttaataaaggtttaaatcctcatcttcaaagagat

SEQ ID NO: 41025 - DNA, 1603 bp, Bovine  19866882022303
ttctgccaggagccccacacctcccttcactttaacccaacttgtgcgcatcacaacagtgccccttggtggaaggactcagcaatctttttcttggttcaagttcaaagcgctgctctgaatagaaaaaataagtctgtctctaagacctggtcactctggctaggcttttaaaactgctgccctccacagagcaggcaggtgccaggatgggacaaacgccatggtgggatggaccctggtatcacgtttcctgttgcaacattttctgatttaacaatcccctaagacagaaaatgcctcttctcagttcaacttgttcattgatatcttcccaattctgttacatctttccaggcaaaccacctcgtccaccagatggaatccacactgaggtgggggggcacctcagtaaaatactggccatagcctgggcagtgaagcctgggcctgcccctgcactggtggggcctgaaacactcacactccccagaacaggtgtgagctaaccaacgtagtgggggggcagtggggaaggaatgccgcctgtacccccaaccccacatgactttcgacctgattcccaccaattcatcaaagtaaaaacagatgcattttgaacacaccaaattctatgttaacatgctgctctttcctgaatcaccttggcactgcgtaccttcaaaccttcggtgactgtcatagtcctcagagcagggcacctcgatgaacctgcctggcaggatctcgctgcggtgagccaggacctcagtgatgccgtcatcaccccccaggctgccccagaacaggcaggcggcgagagcagtgcaggaccccaggacaacgactcttaaccacctcttgcgcacatcccgaggcgcccggacactcttggtgctgagaacagaaaacagctgtggtcacccgaaggcaactgcgtgtgctgaaaactcagatcacaatgaccagagaccacacccacacttagttacagccttaaaggggtcccacactggtcatcatcagagctactctccatcaatccagaggcacttgtcagcatacgaggacatggtggggaatgtgtccctcgccccatacgaccagacagggctcactatgcccccgaggacaagacgaactgctagtcgcggtccctcccagcctggccatgtccatggagaaccatctgggagatcctgacagagcctgtgacatcgatcacattgcctgcatccgaagatgactgacacaaccccatgcactggccctagggtgcacactcacacacaacgtgaactaaggcagtgaaagtcgctcagtcgtgtccatctcttccaaccccgtggactatacagtccatggaattctccaggccaaaacactagagtgagtagccttttccttctccaggggattttcccaacccagggatcgaatgcgagtctcccacattgcaggcggattctttaccagctgagctaccagggtgaactaaggtaaacacgaatcaaactcatttcactgaaaccaccaggcagccgggaaaagaatgcaagaaccacagaaatgattccacactaagacactttctgtaccacct

SEQ ID NO: 41026 - DNA, 967 bp, Bovine  19866880404659
gataagacagggagatgagcatgcctccccaaagctgactggactggaacacctgctgattcacccaagggataacaccaacacatttgggtccacatttctacaagtccccagaatgccctctccctttgctgcgcttcacacccctctcccatgcacagtcctctccttttgtagtaacaactcccatcccgtggttgccatgacaaacagatgaggcattgttaagaaagatgagagctgagaccttcacttctatttcaatcttgcagtttatttttactcttgagttcttagtattttacaacctgcttcatttgcccatgaactccaaatgatttccagaaggatctggactttatccgatatgtaagtaacaaaggtcctcctttgtcttccctcttacttggcagtggtgatcaaagtaccagcatcacgggatctgtgagccaattatgacagagtgatccaaaagtagtcgaagacaaaggagccacatatttaccaccactggcttcatgtgaagtgaagtcactcagtcgtgtccgactctttgcaaccccgtggactataaagtccatggaattctccagaccagaatactagagcgggtggcctttcccttctccaggggatcttcccaacctagggatcggatccaggtctcctacattacaggcggattctttaccagctgagtcacaaggaaagctcaagaatactggagtgggtagcctatcccttctctagcagatcttcccaacccaggaattgaaccagggtctcctgtattgcaagcagattctttaccaaatgtcatcaggaaaactggccttatgaagggttgtaaaaatgtttaataatggagaaacaattaagatcaccaatgtgagtcaatgaagactcagttccaaccaaaagcactttgcatgtttgaacatgtccactccattaataggataaaata

SEQ ID NO: 41027 - DNA, 1557 bp, Bovine  19866880449417
ttgcatatttgtagttttagagttacaacatcccccgtggcactctcatttaaatcctctttaataggacatccataattcatacatacatatagtatgtggacacacatacatatagtttcctcattttaaaaaacttacatacacgcaagtaaatcacatatccccacaataaggctagagttagatgctttatttatgggtggagatttcaaagtgaaaggtaaatttttttgccttacatcctgtgtcacagtataactgatggaattcattgcaagtgtgcaggctgacctttctgattctggtatttggaagcggcattagacttactccattgccttgtggatttgttctatgtggttacctttggtggaacataatttgccctttagttcataagctagcctgtgttttattattctgtgtttatttgtttaacactctgaatcactgcaattgttttcaccctaaagtattttaaatgctttcttgttacagaagtatcattcacccatcctttcaacaaatatttgtcaaacacacaccaggggtgaggcagactgctagctgcagtttatactaatcaaacatacagcaggtaagttctgtcctcagaaaactgaacagtgtcagggagtaatcattcatataaacagagcactatgattgcaggtaaaaggtgcagtaggcatggcataataaggtcctgtgtacctggagagaagaaacttctgctaacagatgaacccacagtaggcttccaatggaagggtgttggggctactactgggagggctggggatcgcagagagggaagaagacttaggtgaacctcgtgaactctgcttgtcattagggcatgccctgtttctcgaaccagacccctcacctttgagaggctccatggcttaatggttaagctcaccaaggctagatacacagccttggtttgaatcctgctcctcccacttccaggatgggtgatcttgagtgaagtctttgacctctctgtatctcagcttccctgtctacaagttgtggatgctagaaataccacctactacatctgatgacagtgagttcaaggtgttcagcctcataaagcaattggagcactgcctggtccaaggtatgctgttgaaattatcaaatctttttgcaagatattagcagatttttgaacatccagttaataagctttctacttttctttccttcatcctgaagacaatctctagcaactgcccaagtaccaaatattgctctagaacctggagatgcatgggtgaccttgggccctgaaccttcagttccttgcagtctcataagacatagtgcttcctggtcagtccatattcaggatagaaaatgaatacatcatgagaatagaactctgagaaagaacaactaggggagaagcttcgtagttcagttcagtcatgtccaactctttgcgaccacatggactgcagcacaccaggcctccctgtccatcaccaactcccagagcctactcaactcaacgtccatcgagtcaggatgccatccaatcat

SEQ ID NO: 41028 - DNA, 1008 bp, Bovine  19866880460822
agggtgtccagaaaatctgactgggggcccccaaagcctcatgattctgatatagacctctaatccatattttgaaaaaatactgatccctagaattgttttcagccataatgctttgcaactctgtgaacgcttggcttgctttacattctatttctcaaatcattctgtatgcttctatttccctctctttcaaagctggagaatattcaagtcatgtgagattcagtattgaaaagatttataccagttgaaatttgtgttattatatttgtttcatgcattgaattcctgttgagactttaagtactggcagctggacccctattccaggtgctatgcctcacaaattgttgacatcttttctctctgttagataccagagcccagctgtaccagaagtaacaaacctaccacctacgttaccctctcgtttgcctgggtgaccaccaccgaagatatgaaagcacaaatttggaggtggggggtggttgctatcctaggctgcatgcaagccatctttgtagcttggctaactgaagtatacgaatagtggtttcttctagattaaacagatttaggttttgagaattatttcctggcagagaaaggaggcaacacaaaagcttaatgattcataaaaaagttctgccgggaaagcattggggttttatataagcatggatacccaacacccatgtagttttgctaacagggtatttaaagcccacctcaatgactacttatcccagaaaatgttctataatatctgtcctacctacttaattgtcaaaaattaaaattacattgctttagtacctctaacattaatgtaaccaatattgattaactgtactttagtatcagagtcaacagagagagctttcagaaattaagatataatccttgctttccaggagcttatgggtacaaataagcacttaaagagtgaagagctgattatactatgttcagaggataggaacatatatttcagtcttcctacag

SEQ ID NO: 41029 - DNA, 827 bp, Bovine  19866880489042
ataaactggatttgagtgaacagatgtttgctcattataggaagacaatgctgtgaaattctggcaggtcgctgcatttattcccaagcatgagagttttagggatcctgagcatttataacttgtcagtgattcaggctggacaagacggaatctttgtcaattatatcctcttcacacatgacctgcccacagcagtggtcactgaaggaaaggtaaatgcaagagactctttgaagggtacctgccacactcaaaaaacatggccatttttaatgaggcatgatcttttcatttgaagttgtgatctaccagcagggcaacttttttcagcttgttatgttctgagttctgcaggttagctagctaagctcaaatgtgattggcatgcaaagccccttaaaactgtcaggccaccttgcaattaggcataatgccaccagaacagatggcatgaatgatggcatgccagacagccaatacacgtatcagcattgagcattcagagagaatttcctctctcagaatgccaaaatatgaatctatggcttagctatcaataaagtaatttacattgcacacacattttagaaagaatactgctagtttttcacaggttgatatgggacaagataattatagactcatagattctcagggttaagagacactttaaagtcaatgaatttgggtgatgcatatgatgcttccattcattcattcatccctccaacagacactgaacccccatgatgagttagtcaccacctggctctctgcccagctctttggcctttcatcatttaccttggacttgaccacattca

SEQ ID NO: 41030 - DNA, 1058 bp, Bovine  19866880637672
aatagcagagactgttaaaatcttcagaaattaaaggcaacagtaataaaaagttgattttttttttacctaaacattctcataagagatcactgactacagaggtaatggtgtctaatgattaaattcatttctgtataatttttaatttttttttggttcttctataatggatggttgaagtattggggtattttaagtacttggagtggggaaaaaccagtatcagtataaaataaatccaataaatcttggatttatcagaagtttgtgatagagaaccaatacatttaccatggagattgtactaacatagcattaaaaggttgcttgaaagaaagtccaaggaggcttgatgatctcgttacaatatggttactattttgagtttcagacactgattttcgatcaatatttttgtcatatggagtccttttctcatttgattgtttggtggacatgtacaaggccaatgtcaatttaacgagagggctctgaggcttccaccagcaagacctgctctcaggatccccaaaggctccatatttgaactatttttgtctactcaactgcatttacaagtaataacacttttattatctcatgttttattcatcaaaccctatatagctgccaatcaaggcttgtaatcaacatgagattcccgtgctattgacatgaggttgacagcaataaggcaaggagtggcttgttttgtggtttaggggctggggtttggatctcagtcactagctttgtggtgttggcaagctgtttaaccaatctgtctctccctttctgtccatctctctctctttctctctcactctggctccctgcaggcttataaaatgttaaatgctgatatattgcaagattgttaggagggatgctgagacctcaggatgggaaccactgtaccatggagactcttctaaatgggataactgatgatggaaagagacaaggacccctagaattgaccttgggagcaagtagagcaggttatctatacaacactcgcctagctgtcatgaaattgatgatctaaatgatag

SEQ ID NO: 41031 - DNA, 1690 bp, Bovine  19866880672208
ttaccctctgctgtaattgggggtttcattctatctgcattagcagaactgttaataaatcacacaagcaagaaatgaggaattgaaaatctccaggtgtttgatgatgccccaaatatcctccccacatgttccataggagccatgtgagttcataaaatgacttgatgatcactcactcaggatacagtcttgtttacttgcacaggatcaattaaaacataggttacgatcattataaccattcctctagcctaaccctcaggagtttcttaaatcctttgcatatgttagatatctggtcattacttctctgacccttctgttttattataaaacttacatacacacacatacacacccataattttgccacagagatggagatttgagctgttagtagaatggttaaggacctagttaagagagatgtgcttgtgtgggctccacatttcctggagaagctattatttaaaaggctttgctttagtgtcattactgagaaaggatgaggtgaagacatgattagaatatagactcaagccttggcacctggcagtagctgagtaattgggcatcagaagtgaaatggcttgtcagagccaatcttatatagcaagtatagtcttctatgagataatctgctagacagagggcctggggacacttaagacctaggtcttgagctcttgggggactttgccctgatgtctgatgtgtctcagtatcagaggaacagaacattgaaagaacagaggtgaagtcagtcctcatacacaggaggcctgaccgtgggggaggatgccctttgttcttatccaacatcatgttgatggtaaaccttccttttcttattccaatctacttctaaatagaggcaatgtaactctgtattataattgtattttccaatgggttttattgactactctgcaaatgaccaggaaatgaaaaaactcttgatacgtctcaaaaaatgtgaagatacataagccagtcttcttgacaagatgatctgtacacaatgctttctacccaagaaggaacatcatgtgggcattagcataggactctttctgcctttgaacagagaaggcaactgccaaatgctttgctctgagaaaagatcagtcccacctgtatatagatattcccaccaagatgtcgatttcagtgtagatttttttccttttaaaataatcctaagtgttacaatagatgcaggaaggaaggaggttgtcccccaaggaccctctacattaaccagagataagagggggagtcctcgcatcattgcagggcatagtttgggggcagagcacatatacacacctctgtacacatttccaaacgtacctgactcagcgagccccttctcctggtgttgtgacgtttatgcaacaacagatgaaaggcacacatattttaaccctaaaaacatctttccaggtagttttgtaaagaagtaaagaagagtataaagaagtcttctgggatccaggattcaggggcaaactgctagttttatcttcttaaacctcagtactctcagcttctcattttataatgaggacaataatcagcctgtgttatgaaatgattgtgatgattagataatgtatttaaagttgctaagtaagtatcctcccctgcaaaaaaaaaaaaagaaaagaaaaaaatctagctgtta

SEQ ID NO: 41032 - DNA, 1704 bp, Bovine  19866880822571
tctttatataaatctgtatgtgttgttgttgttcagctgctcagtcttgtctggatctttgggagccaatggactgcagcccaccaggcctctctgtccttcactgtctcctagagtttgcccgaactcacgtccattgaatcaatgatgccatccaaccatctcatcctctgtcgcccccttctcctcctgccctcaagatttgttgtaaatgaatactaaatgacaggctagtttaaagagcgcctatgccaatccactctgtgctccctccactcaaggctttctctggatgtgcaatgttaacagagatccccatggccgttaagaaggaaagggcctcctcctttctccctgacagaagccccactgcaatcctgctgcccttagcgcagggcactgctagcgtggattctacttttcagggaggtggaggggcttccctttttaacatcaccaggttttgttctctcctctgtttggtggcataggcacccagtgactcaaccacagctatatctgtacttgaacagccagggcatctctgtgctgcagaatggaccagctgcctcctcctgctgccctcccggggtgctcagagagggctctggtcttcagcagtagtggaaaagcaagcagctgctcaactgtttggagcaggctgtgtaattcgaatcccactgctgcttctattcctggaatgcaaatctaaacacatcaccttcttactgggatgggaagagcctcctgacacccccctgaaagacccctggactcagcagtgggttacagagacattcaggagagatccaggtctgtgccaccagcctgtgccaaccctcactgcggtcacccaagccctggccatggcccagcagcccttctgccagaggctgtgggtctccactgctctgcatcatctttcctttggctaatgttttcttctgacagggaagcattggaaaccctacctttcccccaagcagctgtctaggtccattcccttctcatctgtgttcagttggaacccagctaccccaacccctgcagtagcctacagatgggaattggccagcgttgaccagaagccccctctggactgccggtaggtttgtgagaagccttgtgattttcatgtgcttcttacaaatcacgggtattcatcagtactagcttcccgtgatgcctctgcacagagtagctagaagctttctaagggatctcttgcagccccagcctggcatcaacacagtaccctccagccggagcccacaagcccactgaggctgccttcacagcccagcctgacacccgatctgggcccagtgactcagcctttctgatgtcatgtctgcccactgggggcgcctgctggcctgactgccccaccagggagaaaagaagccaggaggaggccatgacctgaggccgaccccccccaagaggccagccggggagctgccatccttggaggctccaggggggatccacgctcgctgggattagtcaattaggtaaatattactcctgggtcatctggaaagaaaataacaaacaacgtgttctgcaaatggaaaagctggtcctgccagtgactgaggagccaggtgggtctctgccgggcaggctctcaatcagagggggttattaatatgctaaagatgccgcagccaatcggctcccatggcgaccgtgcgcagcctt

SEQ ID NO: 41033 - DNA, 1841 bp, Bovine  19866880845541
ctactatgtttgattcctccctggcttattagcttcttaaggggaaaaaaaaaaatcatgtctgggttacttctatcacttttccattccctgatataagctcttcacaggtaaatctgaacaagagccttagcctgtttctttgaagaatgctcaggttctgctgcttaaataaataaacactcaaaaacaagcactttagcaaactgctgtaacaaatggattgatttgctccctcccatcttctttattattattaaattttgatttctgcaatctgcatcatttttctctggggtattttaattagatagtagaatttaaaaataggatctcccatatattaagaaagtttcagtggtgtttatgtgggacagctggtagatctctgatttgagagtttttttcttattctgtcatctgaactttgctttggtaatgctgcaaattagcagctattcattctttaatgaacaagggttcatgtaaattccaactatgaataggcaatcaggatttctttgggtataatgggttatttaccaggcttccatttcaattttgaactctttgcttctttaaacaccatcctatataatttagcagccttctaattatgtatgtgtatatttactatatagatactgcctttgtgcctctatgtgctccaaattgctttattgaaataatggcaaaatctcactccacctgaagtgggatgtacaatactgaattcaatgaacattagttgtgcaaagctttgacggaattgtggagacgttgggagcagacatttggaatggttttcccaggagcctcggtaccatagctataatgaaaaatggcgaagctcagatgcttaaccattttagacttttcataatttatttccccgaaagttttacttcaaaaataatcttcagctgtgggaaagatgatctatttctggatgttttcttttccattttctagtatgttttagacccatcaaattctgaaggttaccaagacccaagactactctcctgagtttggtttcagaatctgcatggtagatagaagacctagaataattcaggattaagaacaaatggaatgattttctcacttcttcccccttcctttccatcccatctctcctcagtctaaccctaaataatctatctatagcgtaataaccctgtttatgcatttcaacatgggttttccagtagtcatgtacagatgtgaatgttggaccataaaaaaagttgagtgccttaagaattgatgtgtctgaattgtggtgctggagaagactcttgagaatcctgtggactgcaaagatatcaaactagtcaatcctaaaggaaatcaaccctgaatattcattgaaaaaactgatgctgaagctaaagctccaatactttggccacctgatatactgattctgggaaggattgagagcagagggcaggagaaggaggccacaaaggatgagatggttaaatagcctcaccaactcaacagacacgaatttgagcaaactctgggagatggtagagaacagaggagcctggagtgctgcagtccatgggaatgcagagtcagacacaaatgagcaactgagaatgatgcatattatgtacagttggagagacatggtttggaaaccagttatcattctgaaagctgaaatttgcatctggtgtcataattgtgactcagaatatttacctgtgaaattgcacagagtccatgagagcccagctgagtgcagctcctcctgcaaggtccgcagctgctgtccctaggacactcaaaccaccagaaagtgcagcacgaacactctcatacagaag

SEQ ID NO: 41034 - DNA, 3522 bp, Bovine  19866880853980
taagtcatgtccaactctttgagaccctgtggattgcagcatgccaggcttccctatccttcactgtctcccagagtttgctcaaactcacatccattgagttggtgaagccatccaaccatctcatcctctgttttccccttctcctcttgctctcagtctttcccaatgtcaaggtcctttccaatgagtcatctgttcacatcaggtggccaaagtatagcttcagcatcagtccttccaatgatattcagggttgatttcctgaggattgactggtatttgatctcctgctgtccaaggaactctcaagagttgtgaataagtgctgaataagcaccacagttcaaaagcatcaactctttggagctcactcttctttatggtccaactctcacatccatactggaaaaaccatagctttgactttacagacctttgtaggcaaagtgatttctctgcttttgaatatgctctctaggtttgtcatagcttttcttccaaggatcaagtgtcttttaatttcctggctttagtcaccatctgaagtgattttggagctcaagaaaatcaaatctgtaactgtttctacttcttccccttctatttgcaatgaagtgacgtcatgatcttagttttttagatatttaacttgcaaatattttcttccatgtttgggttgtcttttgttctttatagcatcctttgatgcaatttttaaaaaactttagtgaatttcaatttgcttcttttgtttctgttgctgcctgtgtttttcatattatacataagaaattacttcctaatccaagattatgaagatttatcctacattttcttctaagagtatcatagtattagtacctacacttatatctttgatccattctgagttaatttttgtatatggtgagaattatgggcacaatgttctacttttgcatatgacaatccagctgtcacaggacaataagttgaaaagaatactgctttgcattttaattttctgagaaaaaaattagtcagaaatcagaaaaaaaaaaactgtcaaaaatcaattgattaatcaagagagtgcagtactagaaaagaaatagagaaatgaaacataatggagagcccagaaatagccctccataaataaagttgactggtcttggccagagaagcaaaggccatccaatagggcaaagataggtctctcaacaaatggtgctggaacaactgaacatctacgtgcaaaaacattaatctagacacagaccttacaccctttcaaaaaatgaactcaaaatggatcacagatctaagtgtaaaatgtaaaactgtaaaacttctaaaagataatataagaaaaaacataaatgaccctgggtatggtgatggctttttagataaaataccaaagacttgacccatgaaagaaataactgacaaattggacttcattaaaagttcagttctgtgaaagataatatcaagagaatgaaaacacaagccatagacttggagaaagatttgcaaaagatccatctgataaaggactgttatccaagatatacaaagaacatttaaatctcagtgataataaaacaaacaaccctaaagcagccatactacccaaaacaatctacatagttaatgtaatccctatcaaattacccatgacttttttcacagaactagcacaaatcatccaaaaatttatatggaaccacaaaagaaagagaattgctaaagtaattctgaggaaaaagactaaagatgaaagtgttatcctcccagacttcagacaatactacaaagttcgagtaatcaaaacagcatggtattggcacaagcacagacatgtagatcagtggagcagaatagagagcccaggagtaaactcaaacacttacggtcttccctggtgactcagagggtaaagcgtctgcccgcaatacaggagacctgggttcgatccctgggtcaggaaaatcccctggagaaggaaatggcaacccacttcagtactcttgcctggaaaatcccatggaaagagaagcctggtaggctacagtccatggggtcgcaaagagtcggacacgactgagcgatttcactttcactttcaccatataatttggtaatacactaaaataaatacattaaaaatacggaaagtgatgacaagtgtaaaagcgactagtcaaaatgaagaaggtagttgctgtatgtggacattttaagaggataatataatttagacacatccaacttggaaattgatatgaatgtttccattttacagaacacgtaattgaggctcttaagagattcagtgagttgccttaagtcatgtatttactatatgacagtgaatattgacacccagatctgtctggttcctaaattcttttctgagtagtatgtcacttgttttcaaaacatggttctggaagtcaaatcacttcacagtcaggcctgggtacaggtgtttcaaaaggagaaaagaaggagctcaatttggcaggtatatgtcaaattaaggtcattggcacaggtaatactgaggaattaatcttgcttcatcaagagaaacagcatatgactgagggggacagaggtacattgcatttctatcagagcatggcttacaatactgtagcattagtcacatttacactgtgtctgaatttttttttttttttcccaaaatgcctcatttaaatgctgacagattggttggcatcgtgaatgtctttgctatgtaatcatgaagtggtgtgacttgtgaaaatgtggtctataaagctgctgttactcagactgatttcatggtagcatttgatggacaataaggacttgtgtaaaaagaaaaatgatgtctgttgcgaattggtgggtggggggggtgttcaatgtggtatgttgttatttagatgatctttaaaatcctttttgctcattacactataaaaaccgagaaagcagcccttgaaaagggaaaaacaacctgtatcctggccaaatcctccctttcaaagtagcttggcttgatttttttttctcttgatctccaaataaatttccattttttaagcaaaaaaaaattctacaatgctgaattttgtacatctgggaaagaaaaggttatggatataaagtccctcccactcccaaataacacatttcttttattttgatatgaaaatgctgaaatgaatgtggtgacttgtcacaggctatccatggggtttgggggagttgcagaacttccttgaattttcttattgtctttcatgattcctaagagcttgaaatcagttagagaggaattcctgagacagagacaacaagtggtgacagttttagcagagatctccttcatggtggatgaatgttggcatggttctgtgtcctggcagattcttcttgaggatgggctagtttgtaatatatttggtgatcctggctcaaaaggacagcgagctgggtcttggctcaagtcacacacatgcaggggtgggtcacttacaa

SEQ ID NO: 41035 - DNA, 1242 bp, Bovine  19866881040455
cccaggacagttgcccctgactgcagttggcatggcctgaagccggccagctgggccgggcaggtgggcgctccacatgtcctcagctcctgccagccctgggagcacctcatggggacacagatgccacaagccgccctctgctcctctcacagggatgggctggcagtggcatgcatccatccccctgctccctgggggccgagactgaccctggttacttccactctctttgttgccaccctccctgccctctctttggccctgcctggtgcgggggttcctgggaaaccacacaggcagtgtagcaggctctgtgcctgccacgccagcctgcatcagagcacgaacactggaacagagtggggctgtgggaggcgggagggaaaaaataagatctcaggttgtcagcgccagagccttcccagggcagcctcgcttcccatggttggaacgttgctcgccttggaaacttaagatgtaaaaagggtgaagcagagaggcacagggctgagcggagcagaggattcatccattctagctctgagaccccagagaaactctgcagagcacagtttgaaatggcaggtgtaaccaagcttctctgttttacttataaaaaaattttgtgcctgtggagacggaagactagcccaggagacacactgactttggccccaaccttgactcttctgttggcctctgattcccaacgcctgttctcctagccgtccttcctcatccaaaaaagacttcgtggaaggcgggggtccacaggccacctactgcccactcagtcacatccttcaccccacctgcctctcaccacgccgtttctagcatgagtaaatgtgcatttaggtggagaccatggtccatttgctaaggtacatttctgtaagtgacaaattccagaatggtggtgtattatgttacaaccaattagcaggaaattaccactgtaaagtgcattccctgcactgggacagaagccaacgcgtagcatttaccaagtcttacctcatcgggctcagtcgacagtgaagaggtctaaatccaattcaataaaatatttgatgctgagacggaagctttagaactataaattccagttagtggaccagaaagaggttcctccatccttccaagcatcattcgcctcccctctccactgttaccgacaggactgggagctggaagctcttggcatttgaagatatgctacttgtgttcaggtcacag

SEQ ID NO: 41036 - DNA, 1764 bp, Bovine  19866881141918
cctattgttaaagtgtctggatttatcgcactgatatcttttttgtgatacagtcccctttatcttgtggagaaatactaggcttttcctaatgaagtgtggctccacgaggtgtaatatttcctgagatgtccccaaacgagcagcactggctcctgcatggaggcagacacttattcttgacaccctaattccttatccgttccctgctgaccagaatctgaaaaagaatagatacatgtgactgaatcaccttgctgtacttctgaaactaacatagcatagttaactaactctactccaatataaaataaaaaaaaaaaaaagactcgtgatgaatatccaatgagttgatgtaggcggacacgcattgcaaacaacaaattgctcttaaaatataaagcattattatataaacatgtataagacgtcagcaaattgcatttgatttgaactaatgtggtttccctgatggcgggaatggagaaaactaaataataaagagtctgaaatcgatggccagaggctgattatttaaaatgagctgcagtgttgtcagtgagaggcctctgtctttgcaaaacagggcccccattcttccctgatttttcttctttgtgtctgtgaattgtgggcaattttggtctttaaagagataatactagatcaccttgtcagatgagaagaaaagagcagttatttgttgtctgagtgggttttgttcatgtttaaagattttaactaaatccattttagacaataccatcatctagctgaaaaaataagggagacagagtaatttttgatggtgactgtggttaaggttggcaacttaatcacccttattacctttaaaaatctattcttgctgatggttttgctagaataaagaaggctttttacatttagatggtatcagcctctatattcatagctgagtatttaatttggtgaacagggagaatgtgcaaaatgcagtgcaaattgtagttctgttgccaagaaggagaaaacctggacctgcgtggatttattcagctggggagacaagatgtatctgatagaaaaagtgagaatacaagtttgtacgtgattaggagtctggtaagtgatacacagggcttcactggtgtctcaaaggtaaagaatcctcctgccaatggaggagacataagatacatgagtcctatccctgggtcgagatcccctggaggaggaaatggcaactcactccagtattcttgcctgggaaatcagtggggttgcaaagagtcagacgtgacttggcaactaaacaacaacaacaaaaaatgatacacgtgaatggccccaggcagaattcaagcatgcagcagctacagtggccaagctttttggaggtggaaagggactctgaaggatgaatgacattagaattaatcaactcccaaattaatttttttacatttattcttttcagtactcttggtattgtcataatttgaaattatgcagcttttgtttaaactggtgcccagtaagaattaaatattttcttataatgacagtgtgatatattttttataagcacttgactatttttgtaagaactatggggaaaaaaacaaagctttcattttcattttccagacaaggaatttaagactcatctacatccacaaaccaagtaggtggcggagagtaaaacaacacacagctttgatagctctgtggactattttgtagataaaagacaagcacgtcctttgcattgtgaaatgtagt

SEQ ID NO: 41037 - DNA, 1062 bp, Bovine  19866881240387
aattgcagctgtactttatgaggctatgatgaaaaagacataaaatgtagctgtgaaaaattgtgttcacaaacctgagaaaatttggctatgactatctactctgtgaattacagcgacagattatgacataaactacatcacgggaattggaaacatccttggatattaaaaaggaagtacacacacaaatacacacacaaacatacacatgtaccacttgatgtgaaatattccagagaatgaagaatctttagaccatcattcgtttgattctatttgcttttcactgtcaattgaaacacttgcttgtttgcagtaatcttttctatctcatttttaagagtgagatttaatttttggccacctcaaaattcatctccactcaggacttcagaatgtaatgttatttggaaataaagtgttcttgtggatatgattcattaggggtggaccttaaagtccggtagatcagaaggtcaagaagagcacagacttacagaggggaggagccatgagatgacagtcagaaagtggagtgatgtgtctacaaaccgaggagcatgagggttgcccacaaccacgggaagctgggaagacccaaggctggatttcttcctagggtctttgggtgagttcaggcctccctgacaccatgatcttcagaatgccagcttccagaactatgggggaatacatttctgttctaagccacctagtttatgatgatgtgttatggcagccttagtagctacaatatacataacttaatgaatgagtattcattacaaaaaatattactctctagcacagggtaagtatgattgattttcatgcatcttatttttgactccaagaagccaagcctcatcaaaattttcacatggaaatgtctcagttcacagatctgactgcgtttaacacaggagaagcctcagcttgtccatttaaactctccttcacaaggaaagcactgcttatcttctcaaatataagtcatagttgtttcccttttcaggttatagccatttgcaggactcacaggaggtcaagattttggca

SEQ ID NO: 41038 - DNA, 531 bp, Bovine  19866881380744
gcactgttggaagcgcggcttccacatatcaagaaaatcagggctgggtctcctgttggggtgctcagaaaagaactgagcccttgcaccaaagtgtctgttgagtgaaagatcccccaacattgtcaggaatcctaatacagcaatgacagaaagagctcctccccaccccacccccaagctattccctccatgccaggggttagaattactaaacactattccaggtgcagtactgacattcatctgtctatcccctgccccgtgataccatgaaagagaccatttctactcaaatacttaaggcccgtgttctctgtcacattggatgataggatttcccttgcctttattaggtttacattattcagatgctgtataaaagggccattgttttactaagttagaaaaataaattaagtctttgagtggtggatgactttgataagaaactctatttgcggaaacatgggggagtcgctatttctgatgtctgcttgacttgagttattcatctgggactgctccagt

SEQ ID NO: 41039 - DNA, 1399 bp, Bovine  19866881585775
aattatttgtgaggccttttcagctacatcgcagtattggaagtatctgagggatggataacagacagcttcgtccccacttcatcctgaaagcttattgccctgctcaacaccacaggttgccgaggacccaaaagtaagctcacttgattaattagaacttttctctagagaaagtttaaaaatttcaaggagaagaaggtgaatggtaaggcactcacctttttccagaaaagccatctggagaaaacttctgtccttgctaagcactgaagctgaaaacgatccacagttctaaacctgggtgctgaccctaggcccccaccccacactgagcacaaagaaaccctcttctgtgattggtgctggggcgggggcgctgcattctgactgcctggctctcccagcctcagtccctgtaaccagagccgcctccattatgccccatcacaaagaagggacagccggaaggtcaggttcacggagggggctataattttagaagcacttcctgttatgagtctgacttttgatctgtgatcactcagaccagggaattgaagcgaatggtatgcatgagtcactttctggtgggatcactcctggagtgtggtcagacgtctggagggctgttttcccctgctggctctaggaattacttagccagcccacttggccctcaagcatgtagcctgagcagactttgtcaggaacacatatgctgtggagctgaaatgtatgacataaccacactgtcctgtagcatctttctgcttaaccagaacagaactgctcttaggagctaccttcagacttttcctttggaacatgaaagagaatgtcttctggatctcattactaattaaagacaggattgagaatagaacccagtctgtatggctttcaaagtaagcactctgactgtgtgtttggtagatcagacttccccacagcaatcaggcattgcttgttctgatgagatgtgtatcacaagaaagcagaagccggggtagactttgtgaggttatctgtaagttgaagttccttagatgagaggagccagtgagtcagtttcacagctagaattcattttctttttatgtaaaataaaagctaatgatttaaatggtggcttccaggcaatgttatcttgttctgaattgccagagaatgttttcaaacttcagatttctgcatgttatcctcaatcttccaaatagcagtttctggaaagatactaggaatttctgtttttcagatcccacacttactcaaacaagccctgagaccgccccccacctcccccagaagtctgattcagctttcatattccatgattactgaatcagcatttctcaaagtctgcttttactaggaagcttttataatcaaggtgaga

SEQ ID NO: 41040 - DNA, 1249 bp, Bovine  19866881653568
tgattttatcgcttctgattggtttgaagatactttgcccctgaattctatttaagtctctcaccttatggtgtttttttctatccttccttaatgcttctagggggaaaagaaaagccttaaagcatctttaattttgtatttaagataaggcacagtgtgatgtcatgctaccttcccagaaccatggatttccttaattcttagcctcattacctaacatgttctgtctcctcttttaccggttctattcatcagccatattggattcctcatcttttttgaaggacagtgcatttttcacactgttgtagctttgcagattctgctcccttcaccgaaatggtcttgaagtagttctcatagtcaggagacctgagagacaccgaccttgaaggctttgaggtttgggggctagttctgctagatgatggtaactccatggctccatcagagaccaaggccagaagtacatcctcccagaatatgtacagtaattatggtaaagataaacactgttaaagcagttcaagatggggtctaattgaattatacaacttattaagtgctacaaatacctactcaatactcttgcctctatgcagatgagataaaagaataaagcagagattgttgggaagcgaggaaattaagctttcaccacaaaccctggagaagtttttcaggcagagatgcataaacgcatgagatgaactcccaacaaagcattgttgttgttcggtcactaagccacgtccagctctttgtgaccccatgggctgcagcacgcccagctcctctgtccttcagtacctctcagagtctgctcaaactcatgtccactgaatcagtgatgccatccaaccatcccatcctctgtcgcccccttctccttttgccctcagtctttcctagcctcagggtcttttccagcaagtgggctcttcacatcaggtagccaaagtactggagtttcagcatcaacatcaatgcttccaatgaatattcagggttgatttcatttaggattgactggcttgatctccttgcaatccaaaggattcttaagagtcttctcccacactgcaatctgaaagcatattctttggctctcagccttcatatccaatgaaagtcacatatgttgatgctgggccaggacagagagaagtgtgtcagggctgggggaacagagccctggtgcttctttcctgtcccagcctccactaacacatcagggcggagggag

SEQ ID NO: 41041 - DNA, 2685 bp, Bovine  19866881696962
ttgacttcttgcttttgcattccagtcccctataatgaaaaggacatctttttttagtgtttgttctagaaggtcttataggtcttcaaagaaccgttcaacttcagcttcttcagcattactggtcgggacataggcttggattaccgtgatattgaatggtttgccttggaaacgaacagagatcattctgtcgtttttgagactgcatccaagtactgcattttggactcttctgttacctatggtatattcacaaggaatttatatacatcaatatggaaagtgatgattttctggtagctaagtgaaaatagaaatatgtaaataggtaattaacgaaaggagaaatgcaaataaccaataaacacacacactgtacaaaaatatataaacacaatagcattcatttcattgctctttatattggcaaacaagtcacaagtcatgtaaacatcacaaaaatgatgtaatggttaatgcttcataattcacagatgaatgtaacagtatttgcctatgaaaaatatggccattaagacaaagcaataataaaaagatttgattagtttataatttttagcaaagaagctgaaaaataatacgtattatgtaagacgttaaatctttgaagacatcacagaataaatgctctaaaggaaaattctccaagtattttatgtctcttgacagtgttcttataagaggttcttatctgtgtttttctgtacttgctgtaatagcacataatcaattcagtcagaaaaacaaagtttgacctcaccagtgcttcccagggcagagcaaaggcaatgtcaccctgacgcgcggcgctttcacagcgtgcctccgagtgctgctcccagacccgtggcaacctcctccagaactcttcctccccggcgatgacacggtctttgaaccccactcagtctgatctgtccctgtgctctctaccacctcgtctgtctcccctcctcggctgagcaaaccccttgcagtctacaggctgccaggaaggaagaggtgccctgaactacaggaggccgtgctggccttcacccgcgaccctcatggccagggcggggaccgcatctgcagacgcagtttccttactgtagcaagcaaggaaacagaatcgataggttcatttgtctcttaaatctaatgataacaatggggaagatgatgatagtgcttgtgctttttcactgtttaatcttaattttcaatttattttatttaaattttattttacaaacagtatctgtccacacatactggaaatgaaaggggaaaaaaaaaataacaaagactaaagcaaatccagctctggttcctcaccacaggaacttggagaagcgaagtgttgaggacccagtctccaaagcacaggaggggtgaggccttcagatcagacagcctgaagtccagaggaagctgtggaaagacaggggctgagaaggactggagggcactctggacgaaggaggccttctcaggatcgcctggtggggaaggaagctgaggatggcagttgctcttcagaaaagtccatccaggataagaatctaccagcagccaagggaatcttcctttccctggctcttccaaccacatcttttgaaaagcgttctttgccctattgtgggcctgaagtgagtgcccagatgtgtgtggagatcaggttaccctcccagccaccagcccacacccgccccccaccggaaaagtgacactggaggcagtttggaaaaaaaaatgcatgaatgatttcgtgatttcacatttgtgtctctagggcgctgcctactcatttgttaaaaagaatcttacgtttttataaaaacagaagcccacctccaaaaaaaagaaaaaccccaaaatcccttcaatgtagccttcttgttttcaaacagaggtaggattatgctgccaaattaaactaggaaacttctgtaaaatttgatcttgatgaataatagcgagcaaacaagagagacagagagagatattcatttcaatagaagtcaccatggcccctgagatgggagtaatcccactattttgttatgggattagatgtggaatcacggttgtgcttcactgagtgttttcgagtatcatggttctcatttttactacctgctcttatcaattaagaagtcttataatgctttctacatttttctatcatgctgtcactttatttcagtgaattttgcatatccctggaactgtctagccaagggaatatacttcagattacacacacaagtagggccccagtgtctctgacccccagaaatacagacagaagtgtgctaacaaagagtgccttatactggcttgtccctctcaccagaggatggagttaatgaatccaaggtcagggagatcaatcaccatatgagccacttaagccgaggctggagcagagctgtgtccccagccaaagctgcaccctgtcacaatcttcttgtaaatgtcagccaccagccacaagtgcaactagaaatgaaaacagggctcgttccaaatagcttctaaccaacaactaactgcaaaatagttctgaaataaaaccattgtcatcgaactcccagtgataagaagtggtcccgtctttaaagtatctgtgtagacatttcttcactctcttttaaatattatttatcacaactg

SEQ ID NO: 41042 - DNA, 4093 bp, Bovine  19866880244172
aaaatgaggtccagaggtcagttattatacttatctactaatcacaaagcaggcaggcactttatctacttcaaaaataagtgtatgaaagttgaaattcccaaaatacacgcatatatacattttaaaaaacgaatacaaatagctacgtgccagttcagttcagttcagttcagtccagttgctcagtcgtgtctgactctttgcgaccccatgaatcgcagcacgccaggcctccttgtccatcaccaactcccggagttcactaagactcacgtccatcgagtccgtgatgccatccagccatctcatcctctgtcgtccccttctcctcttgcccccaatccctcccagcatcagagtcttttccaatgagtcaactcttcacatgaggtggccaaagtactggagtttcagctttagcatcgttccttccaaagaaatcccagggctgatctccttcagaatggactggttggatctccttgcagtccaagggactctcaagagtcttctccaacaccacagttcaaaagcatcaattcttcagcgctcagccttcttcacagtccaactctcacatccatacatgaccacaggaaaaaccatagccttgactagccagacctttgttggcaaagtaatgccaacttcaaaggcaaatatccaccagaatcaatcaactaaagttgtgctctcctaatttgaatacttcctaaagcagtatggaaaatcttaggataaaacaaatgcagaacacatgggtaagttcacttgatgaaaaagactggactttgcagtcagttacatggatgtgggcttaggaaagtcaataaaactctctaagcctcagtttcttcagttgtacaacatccatgacaccatggatattacaggatcattttaagaattctaaaaaaaaaaaaagaattgtaaataacagacatgaaacacctattagaaagatggcacactgttgacaaaacttttgtacattacacaaataagtaataaaaggcaaaagaaatcaagaaaaattttgttaacctgggagcactggataatggggtaagcagaagtaagagtgaggaatgatcaggctggaagcagaccatgaagggctgtgccagaataaagaatttcaatctttctttttaacctctgagcaaaaatttctgagtgacctcacaataatttcaaaaataatttactttagctactaatttaaaaacaaacaaaaaaactatggacagctattacatcaccagaatcacaagaaggtctaaatgatgaaattctgaagtttaaaaattttttctcaaagtggcagtgtttttagagattgtttctctcaatttaaaatgagaaatggagactaacatttacataaaccttgagagaatattttcacaaaattttgatactgcttgctctttattttaataaagggaattctgagataggctctgctgaggtttaaaattataatgaaaacatttatcatttatctttcttcatttaaataaaatgaatcccagcagataagctcccaaaccttgccatgagaggttaaagaactatattacaaacagaaatgtttacctttccattaatcccagtaaaagactccagaactgttttttttttaaataactatatagaaattatggcatccaaagcaactataagactgtgaaaaaaccaattatacaatcttgtataactttcagctcactcagttcaaagttagcattaaaagatctaacagtgatcataatcaaacgggaaaatactgaaggtgatccactgtatgtagaatgaagccccaaaacacattctgtttactcaaacaatggttccctggagaatttcctaactagtttgaaaaaacttaagaaacataagcaagtcattactgctgactttgaactgtgtcaaacaaaacctcacagaaaaggttttaataacctgaatgggaacaaacaataggagaccatcctacacacaagtataaagaactttgctgtaaataatttgtatttttgactaatctgtatttatatagaattacacctcatgggggaggtaatgacaatccttaaaacctgtcagaactgagtgcttagaaacgttaataggtaaatttgcaactgtattcttaacttttaagaaatattttagcagttaacagaaaactaaacctaaggtttacaactgcattttattgacaaaaattcttagaattcaatcttttagttgaagtccccataccactatcttcatcaccacccaatgtggttaaccagctcagtgttgactaaacatgaaactaaaaagttcacggcattcatcctcaagccaaaaaccccttctcatcgaagaatctggcaatttatctgcaagtaaaagtttcaacaacttacctaatgactgaaaataaaagttacaaatctcaaataaaagccttatcttatcacttcacacccactaggatggctatagggtaatttagaagacagataacatgttttgaggatgtgaagaacctgtggtaatgtaaaatggtgcagttcctcaaaaaggtttaaacagttaccatttgaccctggcaatttcactcccaagtatatgcccaagagaaatgaaaccacatgaaatatccaaagcaacataattcatgatagtgaaaaagctgaaacaacccaaatcgaatggataaattaaactggtattatccataaacccctgcatggatcatagccttattgtggtgaagcggcttgtgtaactcaatgaagctatgagccatgccttgcagagccactcaagacagatgggttacagagaagagttctgacaaaacatggtccactggagaaggaaatggcaaaccactccagtactcttgccccaagaaccccataaacaatataaaaaggcaaaaagatatgacaccagaagaggagctcccccaggttggaaggtgtccaatatgctacttgggaagagcagagagcaactactatgaactccagaaagaaagaggctgggccaaagaagaaacgacgcacagttgtggatgtgtctggtggtgaaagtaaagttcaatgctgtaagtaacaatactgcataggaacctggaatgttaggtccatgaatcaaggttaattggatgtgaccaagcaggagatggcaaaagtaaacactgacatcttaggaatcagtgaactaaaatgaacgggagtgggaaaatttaattcagacgaccattatgtctactactgtggcaagaatttcttagaagaaatggagtagatttgatagtcaacaaaagagtcagaattggcagtacttgggtgcaatctcaaaacaacagaatgatctgtttgtttccaagacagatcattcaacatcccagtaacccaagtccatgtcctaaacactgatgctgaagaagctgaagttgacaacttctacaaagacctacaagaccttctagaaataacaccaaaaaaaaaaaaaaaaaggtgtccttttcatcataggggattggaacgcaaaagcaggaagtcaagagatacctggagtaacaggtaaatttggccttggagtacaaaatgaaacaggacaaaggctaacagagttttgccaaaagaatgcactgatcatagcaaacactctcttccaacaacacaagatacaactctacacatggacatcaccagatggtcaatacaaaatcagattgattatattatttgcagctgaagatgcagaaactatactgtcagcaaaaacaagaccaggagctgactggctcagatcatgaactccttattgcaaaattcaaatttaaattgaagaaagtagggaaaaccactagaccattcactaattattatagaaatgcaaatcaaacctgcaatcagatatcacttcacacaagccagaatggctatcattatagaattcacaatcaataaatgctggagagggtgtggagagaagaaaacccttctacactgttagtgggaaggtaaattggtatagcctctatggtgaacagtatagaggctctttaaaaagttaaaaa

SEQ ID NO: 41043 - DNA, 4462 bp, Bovine  19866880341800
aaaccccaaaaagattccccacacatagtttgaatatcactgacctaaacctaacactcagcacaagactgagcttaaatagttaatgaccaatcaattttaatgataattaaattatttaaactacaatgtacagctaagactaacaaaatgcaattaaatttcattgtcatgtttaattcatactctgtgttcttacaagatagtttttgacaacctatgtgactattttgaatttaacactctctgcatactaaattttgacaacctaagcttgacgtgcaacacagcatagtggttaagagctctaactctagacttagacacccacagttcaattcctggctcagcagcaaactagctctgagatcttatccaagctatttagtctttctgcagctactttcctcacctataaatgctgataatttataagctgttgtgaggactgaggactaagatctttggaaacaaattaacaaataataactatgcagtaagttacttattatcattgtaaatcaaatatccatttaaaactaccagactattgtgtgtctgcctcttgagaaatctgtatgcaggtcaagaagtaacagttagaactggttatggaacactagactggttcaaaattaggaaaggcgtatgtcaaggctgtagtattgtcaccctgcttatttacttcatatggagagtacatcgagcaaagtgccaggctgtttgaagcacaagctggaatcaagattgccgggagaaatatcaataaattcagatatgcagacgataccacccttatggcagaaagctaagaggagctaaagagcctcttgatgaaagtcaaagaggagagtgaaaaagctggcttaaaattcaacatccaaaaaacaaagatcgtggcacctggtcccatcacttcatggcaaataggtggggaaacagtggaaacagtgacagactttgttttggggagctccaaatcactgcagatggagactgcagccatgaaagtaaaagacgcttgctccttgaaagaaaagctatgaccaacctagacagcatattaaaaagcagagacattattttgccgacaaagatccatatagttaagttaaagctgtttttccagtagtcatgtatggatgtgagagctggactataaagaaagttgagtgccgaagaagtgatgcttttgaactgtggtgttggagaagactcttgtacagcaaggagatcaaaccagtcaatcctaaaggaaatcagtcctgaatgctcactggaaggactgatgctgaaactccaatactttggccaccagatggaaagaactggctcatcagaaaagaccttgatgccgggaaagagtgaagacaggagaaggggacgacagaggatgagatggttgaatggcatcaccaactcgatggacatgagtttgagcaagctccaggagctgtgatcggcaggaaagcctggcatgctgcagtccatggggtcggcaaagaatcggacatgactgagcgactgaactgattatatgattgaattccctgaagcaagagactatcttcaataagtttatacctctaaaatgtagcaatgtctagcataaagtacaaacccaaatgtttgatgattaaatgatgaatcaatgagcaacctgaggcagttcctcctataaaactgggaaaacacttgatacatctgagaagcaacatggcctatgttataataaaactacgcagagctgctttcaatctttctaactctatgatcttaagcaaattagccaacatctgagtcagagattcctcatttataaaacaggtttcatagggggcgttacactgaacaaataaaaaaaatacatggacatgtctagcacaatgcctgaaataaaacaggtataaacttagtttagtgtaaaaaaattctaatttacttagttcagcaaaagcaatcttaattcctcgaatattaagacgaggaaaaagtctacatatcctgctttactacagtatcccttccccttgcctgttagtctttctagaattgttcttttttagaacatatttctatctgcagtaacaacttaattcaaccatttgcagtttacattaggaaataatacatctcactgaatttgttttatcaaaatggcctttttttaaaaaaaaaaaaaggataaaatttattgacatcagcattcataggtaagtcttatttatagcttttctgacaccagaaacttgctgcagaaataaaattcataacctttcctacccaaagatcctgatttgacattatataaagaatacaacataattaatcctgtttattatgcatgtcaaggttaactttgaggtcaaaaagttctccaattactcttactaaaatgactctgagtactcaaaactaaaaaaaattatctttaaacagctttttattaatcagacatttataattacatatataaaattttatttaaaaaggtctaaaattataatgtagacactgttctgttccagttacattgattaaaattaaatgtaatgttagaagtgatttataatactgaactaaacttttgtgcatgataacatcttgttagtttatctgctacaacctagggaaatgaacacattttaatttcttttttgtatttagattttgctagacttaaaacattaaatgttaataacttttcacttccttttctgtattatttcaaggaagctttattttttcattaaatgtgatctttttaaagcctaaaacaacttaaaattcttatctgccccaaagtatacagtttttaagatgcactctaaaatttgtttataaaaggatcatagtacactagatactagtaaattcattgtcttaagcagttttctaaatgaatcaatatttcataattttacaagttgtgactaatcaatactaggatgcagtgtagtgcaacaatttccaagcagacatatatacaaggggttctgagcctaaagaaaattttcagcgtacgttttactcacacacagaacatgctgactgatagtaaccaaaaaaaaaaataaaaaaaaaactatcccacaattcaccaccctgatatatcattctctctaaattattatatccaggtgagattacccaattttaataactaacagttctcatcactttaaaacagaaacagggtatgttctgtttcacccagagttacacatttcggaactacaagactttggtgggggggggggggggcgccgatcttcggaaacaaaaggtaacctgatccattccagctaattactaaatgcataccaacaatacaaaattcgaattgcatttctggacactaagatcacaaagggagcagaacgtcaaatgtgtaaggaattacttttgtattaaaaataatcaaaacgaagaaacacggtacgccgaaactaagatcccgcgcaaggtacaacattcatttgattaaaaagttgatcatctaaaaagaatttaatcaatgttgttaaaataacagtaattcatcgcatccacatacgacttgaaatcccgatgaggtctttctttcaggtctaaatatctcattcttttgcaacccggataccaaaaggacctgaaacctctcgcggaggcgtacaacacactcggcgagtgctgtctgtttacaaatacgaatctcacagtttcccacgtcaaaagcgttcattaccaccattcgactggggggcgggggagagagaaggcgggcgagcaagaaacgaaatcctcacagacacctctgccttctctcctcccgacaagggcgatcccggaataaatatttattatgtattatatgcgtgtgtgtctataagttatatacgtagtctgtatcaaagccagggtgaaagaaaaggcacacaggacagggaatcctactggaccccagagaatattcactcctatcccgttaactcagaatcctccgcctgggtctacaggtttcggctcggggccgagagctccaacctcaccgtggagttcggtcccaaagcgccccggtgccctgctcaggaagcccaggccgccgcccctacctccctcatctccgccttcccctgggacacccgatgcccaatccagcaaagaaagaagtgtcaggccccaagagggcggctgatacgcgctcgggccgggaccgcgacacctgcgaggcgcggcacctgagggcgaagagggggccgcccggcctgcctcgagcacaccccctcgggcgccgggtgctatgccgcggccggaacctccgtacctgcgaagcccgcgagctacaggcgcgcgcggcgcctcctcatctcagtggctcccgctccccctccgcctcccgctgcccgccgtcaccgccgccgccgctggaggccaggacacgacgagctcagggctccaccgccatgtccgccgcgccgcg

SEQ ID NO: 41044 - DNA, 1888 bp, Bovine  19866880507027
cagactcctctgtccatgggatttccaggcaagaatactgaagtggggtgccatttcctcctccagggatctccctgacccagggatcgaacccatgcctcttatgtctcttgcgttggcaggcgggttcacctgggaagccctatgtgtgtgtgtatgtgtgtatatgtgtgtatcttctttacccattcatctgttagtggatgcttaggttgcttctgtgtcatgtcttggctgctgtaaatagtgcttaaagcttctgtttcttgcttaagttgtgaagaatagagagagtagagcatcattttaatagctctctgagcatattctattaaattgttaattaagtagatttaaacccactcaagatgtattctgcaatattatactttattaagtttagttaatgtgatcttcatgttgatgcaaagaaaaagaacttgaaatttaatttcattacaaagtaaatgaaaactgtaggttatcaaagttaattttttaaattatagtataatatatataacctaaaatttgcctttttaatcattttaaattacatttacattgttgtataaccatcaccccaattctcaaatgttactttgaaaaacgcctctcactaagacttttaagtagatccaaatgtgtaaatgttcagaaagtatgagataatattgaaattttgtttctgttgccactgctggtttaaaaaatatttttcttttatggtaaaagaaaccttggtaaaggaacctttctttcattactatgatttgatgatgccaaaaggagaaactatacaactgtaaacatttgcacattttcattcatagtttaagcccaacccttgagactcacaggttaatgagtatcttatgctatgtttcaaaaagtatgaatttgaagttttcacttaaattcccatttgtagtcttgactatatcctgccaaattcttgaactctctgtaacactgtctatgccaatttacttttcctagacgaatatttctctattctctggaagtataactcaggtcggaagtcctgttggcagtgcaatgaaccttattcctgaagatggccttcctcccattctcatctccactggggtaaaaggaggtagtgtagacttagagtgtttaaacagggagtagttatacatgcaaaagtgttgccttccaattaagggaatgagagtgaattcaagtaataacctcctttctcttttctagcaacaaaaaagtgattattcagtgccatgaaaagcactgttgctgttagtgattgttttagagaatatatttatgtttttatattataattgcatttgttgaaaggctgtattatttttaattgtaatataaatgtagcttattggcagttctttctttatattccaaagcatataatactctgtgaagagttgctcatagttctaggattgacccatgttatacagtcagtatattcatttaactttttgttttgagtagaatacacattcagaaatgtatatataataagtggagagcacagaacataagtaccagttttctgttaaaaaatatttttagtgagccctggtaagaagctaagttactactcagtcaaaagaatgcttatctctatgtgaaattttcttgttgatagatccagatcagcacccagtcagtacattttcaggagctggttttttccaataatctttcctcacttttgtcctaggcttttaccttgtctccttgccttcagtttttctcacctttatttaatcttgcacattggtgccagttatcttttattttttttaagtacagttatttacagtgtgttaatttactggtgtacagcaaagtaattcagttatacatgtgtttgtgtgtatat

SEQ ID NO: 41045 - DNA, 3597 bp, Bovine  19866880712095
taagtgatgacaaaaataaggatcatgtcatctgcagaaaaatgacaagctcgccccctagtgtcaagtaaggaagataacagaaaaagcaaatattcttaaaaggcacaaccaccacaaagaaaatcatttctaccctaccaagaatctggagagaataggacaaactactaatcaatcagggcttaccacgtggagctagtggtaaagagcccaactgccagtgcaggagacataagagactcaggttcaatccctgggtcaggaggatgccccagtagggcatggcaacccactccagtattcttgcccagagaatcgctatggacagagaagcctagggggctacagctcctagggtaataaagagttgttcacgactgaagcgacttagcaggcacacactaaccaatcaagatagtttattcacaagaacagtgaaaaagggttcagttctgagagacaaaacgtatcataaatcccttgcttacagatttctagggtaagtaagttactttattaacagtaccaaatgagtggcctgaggatgttatttttaacatgtgaatgtctccactaacggaagttttctgttataccctcttgagcaactcagaagcataatgacctttatctttacatcacacataactcccaatctctgaatttattgaaaaatctgactctaaaaacaaaaaaagcagcccacaccaatgactgcataagtcagcaggtggcagtcctgactatttaactgttcttagctccttaaacccgctattacgtaaatcaagatactttgatttttttaagctctcccaactaaaaataatggtgatgatggtgattccttcaggcctgtggctactaatttttccagtttcctgctctctctttcccacccccacaatctttatggctcactagtctgctgtttttcacagaaaaggaaaagagtttgagaaccaagatcttataaatgtggatcacaccagataaacaaatattgaccaaaataaacattttagactacatctgagcaggtgacactggggagcaatgggtctatgtaatcagagttactaatattaaacaccaagtctttcttctctagcaagtcgaccttcaagggctccatcagaaataggaggtgccagcatcaagctgtctgtagcatgggagggtgggccaccctagccaaacgttaaaggctggacacttttctgctgttctttgtgcagctgccgggcccgattttttagttcctcagcctttgcttcgtccttatcgacaccatccccaagcttgtacatgcggctggcattagcacaggcccagacatggcccaagtcacaggctttcattgcgtatttgcatgccaggcccatgtccttgggaaagctgggggcaccctgcaggaacatggcactgaggttgaaacagctagcagcatagttgccatcacaggcccttgtgtagtagtctctggccctctccagattgggctggccatcctcattgacctgtccatcatgtgccaggagaccaacattgtggcatgcttcggtggacttctttcccggcttctcacatgccatcagaaagcagttggaagcagctttcagatcctgggatagtccacctgggaagaaagaaaaaaagtcaatccaagccaggacagaacctgaatgtctcaggtcaaagtcaggaagcaattcccaaataaagttcataaactttgagctaaagcagcatgaaaagaagatggcctgtcatagtacacagaacttacagctttttcagccacggaatcttctgctcaaatggtatcttataaggaagcccaaacaggtaaaaagggtgaaatgactagcttctcagccttagcttcgtccttattggtaaatgatatttacctctgggataacagcaagatcacggcatcttataagcacttcgccaaatgtttgttaatttaaatatatactgaatatatattaattgccaattactatgctaggttctaaggaataaaaagataatgaccctgcccttgtggattttgtggtctaataaaacagacattaaataccacacaagtaaatgtatgattctaagtgtgacaagcatatggagaaagagtacaggatgctatgagaatgatcaaggctctgaactaagaggtgacgtaaaggaaaatttctccaaagaagtgacatttgagctgtgaaataatggaaaaaagaatgaaaagaaaaatatggagtggggaaaaaaaaaaggcaaagaaaactgttcccagcagcaggaacagaatacagagagaaaaggagcccatgtgctataactcagaaatcactaaggaagggcggtgaggcaggcaggggctagctcacgcagggtctgatgggtcttcttaaggaccctgtactttaacctcggagcaatggaaaactgctaatggatcattttaagcagaggtggtgacagggcctgcttttttctttagtttttgtttgtttgtttgttttaacagaacatttcaaatcccctattctcaaaatccctcattcctaaaaaaaagagaaacatatctcaacattagtttttaaagaagtcatcccaaatacaccacctaggaaaaaaacatcattaagagaacaccattccagtcatctttgtagtatgtgtttgaattaaatgttggctggctgaatggatagctagatagaagtacagttgactcttgaaagctgtgagggacacccactctccatgcagccaaaaatctgaaaatctgagactagcttaagagtcaaccttccctaaatgtgctcctgtgcacccagactgaaccaacaggggatggaaatcacggagcattactattgtatttattgttgaaaaaatccccatggaagtgaacctgcatcattcaaacctgtgttgtttgaaggtcaactgcactttggaaaaccagattacacatgctacttgtaaataaaaaatttaactttgattttacttgcatttattaagacaaactgctaacttcaaatgagtatttcttcaacagagatatttcctaaatgaggccctggagttataaattattaaaaacatttaaacgttcaagttaccgggtttttggccggaggcaaggggctggggccggggggtgtttcatggtggtgcagcagaagcacagagtcctaaccactggactgccaggggattccacttttattttgttttaaccaaatttcagacagtattgactcacaactataaaaggggaattctcctacttctccccacctctcttctcctgccttctactttttgttagatacattatttcaactcagagagatacaggaaacaaggttaatgaagcctgagctctgcaggcagaaaactgaggctccagtcctggctccatcatttggaaaatttatactatcatttcttcaaaaattttttttctgtcccaatctattttctttctgggctccaacacacgctgtgttagattaagggacactgaaccctatgggttgagactctgacggttgggggaagttttctgcttttttt

SEQ ID NO: 41046 - DNA, 1844 bp, Bovine  19866880805503
catgcgaagagttgactcattggaaaagactctgatggtgggagggattgggggcaggaggagaaggggatgacagaggatgagatggttggatgacatcactgactggatggacatgagtctgagtgaactccgggagttggtgatggacagggaggcctggcatgctgccattcatggcgtctcgaagagtcggacacgactgagtgactgaactgaactgaagtgaggtcagatcctgtccatgtttttggcaacgtttctctcctggcttcttgagcataaagaatatgcttaatatgctgtatctgtgaaaaaaacttgacttcccaggtggcgcagtggtaaagaaaccgactaccaatggaggagacacaaagagatgcaggttcagttcctgggttgggaagatcccctggagtaggaaatggcaacctgctccagtattcttgcctgaaaaattccttggacagagaagcctggtgggttccagtcccatgggattgcaaagagtcggacatgatctcgcatgctgcacgcgcgcgcgcacacacacacacacacacacacacacgatcttcagttatgttaaaaaaaaaatgaacagaatagtatgggagctagtggatgattttcttcttttcctgtaatttatgtagcttttgcagttacctgtattttttgaaatcagtattaattaatttaaaaaagttactgtgcatatataatatagtccctctttagctccttgttttaaattggctttcaaacttatcagaataaagattttttttaaacattttgcctagttttgtataaaataacagggaaatcattttttaatgggaggtagtataatatatgatgatagtgtttagaatgttttcctgcagtgatttaatctgattactgtacatgccagtcacagtcaagaccttctgctacacctaagtcagtctcttttggctacaacagaatgatcagctaaatgttgtacttatggaatcttggcttgtagcatttcataatttatgcagacagtaaagtaaaacaagttttattttttaaatgtttaataacagcttctcccatagcatctctcattctttcagtcctgtttcacaaaggcagggatctgtttcttttgttcagtttcatttcctaggtgtcttaaatctggcaatagaagatgaatatatgttgagtatgtcctgctctcctaaatatgaggacattaaaatagaagtctctttttgtattgttgttattaaacgttacactaacaggaaaaacaggaagaaagtgagcttcgttctctgccgcctccttcccttgcccacctggctgctttaagtggttgcagttattgaattagcaaaagaacaaggaataacagatgatgacctcaaagtccgtcaggaaattgtggaggaaatgtcaaaggttgtaacaacatttttaccaggtacaacttcattttatacttagttttaaaagtgatacaactcttcctcttacttcctcttaaacttaatgtttttctttcaatttttttctcttctttttttctacttaaaagtagatgaatttcattattttataagtgaactttttggtgggagatagttcagaaaaagaaaaggaaaaattatagtatggtataatttttgtaataagaaaaaaagatttttaaagtgtcagatacactttcaaataattgcttagtgcttgaatatggtattttatattaaattttcattgtcattgacttctgaatggacattttaatcatatttatttcagttgtttgtattcatgctactcactaaataaaatttcttttg

SEQ ID NO: 41047 - DNA, 761 bp, Bovine  19866880854376
ttctcacctccacttcagagcactggtgcttatttggactgatgtattttctgagacttacctaaaaccacagaacccaaacagcaggaggttggggttgtcctgcaatggagactcttctgttgacatgcaggatacttgagctcctctctcaccttgtgagcccagggagctgcctgcccccaccccacctctcagttaccatctccctctccgcggtcctcacaggtgctggatggaaggaagcccactgggggcaagctggaggtgaaggtgaggctgcgggagcctttgagtggccaagatgtgcagatggtcaccgagaactggctggtcctggagcccaggggcctgtgaggtgggcagctctctgggcccttagaacttctgcctgagccccatgggaacccttccggtactcgtatctaaggagaaaacccaggaatttctcatctgtgaggaagaccaagaggcaaaactgttgggttgggctcaggctggttcatgatcttcagtagaactggggaaggaagttaacccccccaggtctgttgtcaggaatcccttccgaaaatctacttgtacactcactgcagtttagacttcctgtgctttgtgcaacagagggtcaacggtggagtggagtcaggccagcgactcttctccagctttttcccctgggctttgctggctaccgaagtctgtgtacataaaggagacgctgctacacaagcaccaaagacctgttaagcgcgtgcagt

SEQ ID NO: 41048 - DNA, 1721 bp, Bovine  19866880874538
tccttcgggtttttcctaagttggtatgggatattttagtttggaagtttggaagtccaaaaggggcttcactgggttaaaatcaaagtgttagcagagtctgttccttctagaggttctagaggacagttggtttccatgccttttagagccacgcagtctgtggctcatgaccccttcctccatctttaaagtcagcatctcatgatctttaaatctctctctgactcttctgccaccctcttctgtcttttaaggacccttgtgattacaatggatccacccaggtaacccagaacaatctccctgttttaagatccttcctttaatcacatctgcaaagacccttttgacatataaaacaacatattcgcaggttctgagtattgggatgtggacaagccaccattccgtcatttcttgaacacttgcttgctttctggtataagaagatgtcctgggttcaggcttccaggattccctgagaattggggtagaatgctctaccccgattcctatagagaagcttctgctccctaaattctgaagccccatgccctccagccagcccctctggagtcctccaacctgaaagatacacttccccatctgcttcctgccctaccctggctcctcctttacacctcagctccttcatttgtaatatgggactgataatatctcactgggcagttgtgaaaataaaatagatgacctaggaaaaaggcctgacccagtgccaggcagaaggtaaataccagcaaagacgtcttatcagtcctctcctaactgtgccccatcccttcttcttaggtcctcagatgcatgttctctgtgttatttcaatattttattccttgcctcctcttccccatttctgtttctcttgtcatccactccccatagtcacacctgctgatatacgtaatatctgaccttccaacccatcttgcaggcagttaatacattatgttttttaacttttaacaaatgtattttaaatacaaaatgcttttcaggagtccacaagttttacatctttaaaaaagcgacgtaatttttaggattcaaaaatcctgttcttcaaaagaaatgactaagtgttttcttctgtggtttcaaactttctacacgcaactatttgactgttctatgctaccccagacaggcctggcataactgaactgcttatgtgttactgactttcccaaaagaaagttaaaaaaggagtttgcagtaaatgcaaatctctcatacaatgtttaatgcaatatctaacacaaaagaagatttaaaaagattatttctttcctcatttgatttgccaggagttaatgttctgtaaaagcaaaaaaaaaaaaaaaaaaaatcatttacaaactgtaacactgagggttcctttttcactcaagatgtttactactcaaaatgacaacaattacatctgtaagaatataataaaagggatggaaaacagcaatgcaatcaacaaagtgtagatgttaaatacgattttttaagggttctttttacggagtaggaaggattagaagcttgggaaaatccaaaatttgaaaaaaaaaataaataaaaggaaagagaaaaagatgtcctcaactgcgacccctctgtttatcaatagcgtcttgggctgtaggacggagcgcttgaccatgatctgtatcgactacagtaaaggagaagggatcttctgtaccggt

SEQ ID NO: 41049 - DNA, 1543 bp, Bovine  19866880886926
aggccagtttctgggcagctgctaaagtagctgccatcatatcctcctcagtagccacggtgggctccaggccaggtataggggggaatcctgcaggagagagacactgggagagggttcagggagccttgaggatgcatcaggctgctgtgggtcctactggggtcttcctgggcatggctgggatgggtagttcccccagggtagaggctgatgtgtgagaaatcatttctccctcccctccatcctgctcagagacctcatgagcccccaggccaaaccccacttacctggaggaacaggtaactcggcaaagtcaactttccgtcccgcccggtgggctcgaatggcatcttgatattgctgcaagagaagggagggagggacctatggtgggcagcggtcacaggctccactcaggcaagaggcaggaagaggaagatgaagacagcagccccaggaggaaggagagccctgagacagcaagagctccagagacacacagacaagatgaagactcaaagaccagggagcagacggacagcagctggtcaaggaggcaggctgtagcccaccttggcaatgcgctcgtgcatccgggccttgcgctcatccccactgccccgcgcttgggtgcctgcctcgcggtacttgttcagcctctgctgcagggcatccagcactgtctgtggctcagcaggggccacttgaaaggagaaaggagacagtattagctctgcctgcctccccccaggtccccactccacagtgtctccaggcctacccggggctgctgggatgtcagaggccatcactgggtgcattcgctccactgccgggggtgcatcggagggcgctgtcggggcttgggaagcctgtggaaggggcttcaggtctggggaatccagagcacaggtgtaggtatgggtaggcgtgcttggccagccccagccctagcctgagcaggctgcccccaccaccctgatactgaccctctggtgatgggggcatggcactcaggtccacaggctgccccttctccagggcctccaggacagcagcaaatctctgtggtaggaacaaggcgggaacataagccagggaaccccaaggatctgggctgaaaagcccccgcagaccagtctcactgaagcttggccgggtcaccgctcacagctgtgaaatgaggggctggacacagggcttccgaaccagatgccataccttcccaaccctcatgagctctcgggcacggtctaggtctccagcccgcttggcattcagagcagccactttgtactctctctgccgggccaacagcagggcccgtgggtccgggtctgagtcgggtggggcagaaataccagggctgcccaagaggcttgtctcaggctgggaggggttatctatggagaaacaaaagaaaatatcaaggtcaaagaaggtttccagtgcctccaggtctggccagcccgagaatgtcttacggaagttgtgactgaggccacagacaacggcaggatggggaggcaggccacgggcc

SEQ ID NO: 41050 - DNA, 1423 bp, Bovine  19866880897768
ttagaactggacatagaacaacagactggttccaaatcaggaaagcagtatgtcaaggctgtatattgtcaccctgcttatttaactgatatgcagagtacatctggagaaggcaatggcaccccactccagtactcttgcttggaaaatcccacagatggagaagcttggtaggctgcagtccatggggtcgtgaagagtcagacacaactgaacaacttcaccttcatttttccctttcatgcattggagaaggaaatggcaacccactccagtgttcttgcctggaggtttccagggacgggggatcctggtgggctgccgtctatggggttgcatagagtcagacacgactgaagcaacttagcagcagcagcagagtacctcatgagaaacgctgggctgaaagaagcacaagttggaatcaagattgccgggagaaatatcaataacctctgatatgcagatgacaccacccttatggcagaaagtgaagaagaactaaagagcaagaggagagtgaaaatgttggcttaaagctcaaaattcaggaaactaagatcatggcatctggtcctgtcacttcatgtcaaatataaagcacagtgagagactttatttcagggggctccaaaatcactgcagatggtgattgcagccatgaaattaaaagacgcttactccttggaagttatggaaacttaacttggaagttaaggaaagtcatgaccaacctagacagcatattaaaaagcagagacattactttgccaacaaaggtctgtctagtcaaggctatggtttttccagtagtcatgtatggatgtgagagttggactattaagaaagctgagcactgaagaattgatgcttttgaattgtggtattgggagaagactcttggaggagtcccttggactgcaaggagatccaaccagttcatcctaaaggaaaccagttctaaatattcatggaaggaatgatgctgaagctgcaactccaatactttggccacctaatgcaaagagttgactcattggaaaagaccctgatgctggggaagattgaaggcggaaggaaaaggggatgacggaggatgagatggttgaatggcaccaccaactcgacggacatgagtttaagtaagctccaggagttggtgatagacagggaagcctggcgtgctgcgattcatggggttgcaaagagtcggacacgactgagcgactgaactgaactgattctaaaaggccaggaattcaaggttccagagaacaattttaaaaagtggaaagaaaatcactgatgaaagattttcctgtcttgagaacttggaaaaatatatacatgctatatactctaaatgagaagagctactgatgctaagaaacaacttccatctatcaaataagggataaaatca

SEQ ID NO: 41051 - DNA, 2139 bp, Bovine  19866880939233
ttcgtgttctatatattacactcagactaaaaagaagtgttctcttttttgtccctctggaagatagagttttgactacacgtcaacttaggtctaaccttccagattgctatttataggacatacacagagggattctttaactggagattttacaaaggtcacaaaagggttcactgagaaagaccaagtccatgctctaaaatggaaatgtacagtttaccgcccattgacttacagataaatctatttaatgatcttcaaaggtggtttagtaggttctggtttaaacttcagttccttctttctaagaaaattaggggaaactattaagcaaagtgaattcctcagaatcactttagactttcctttcggcactatccaaattttataaattctcttctgcctggagccctaaatctaaatctccataactgtattggctcaagtttcactttaagtacaatcttaatggatcatattcctgaggaagcttgcttcctccaataagcctgcaaaattctctcttattattcttgattgtcccctgaaatgttactcttcgtgaattaatatggctctgcctagctctagataaaatcctaattttctgtcacgtgtcttgtctgtgttgcattttctgtgcacttttgtccacccctccagtgaaagggggtattttaaacatttttgtttccagagagagcaacttgctggttggaggatccaagtttaaaatggacccccagagaaacatgtatggcttgaggcatcctgtgtaattcaatgaatatccaccctacccctaacccatatttgctggctaaagcaaatgtgaaagtcagagaggggaaggagttatattcaagcaattttatgtacagtcttgtgcagactgcacatactagagagttcacacacttttctcccagaagtgaccttcaactctaactttacaagcacttccaactaggttggatatctaatttccataactatcacagatcaaaatcatcaactagtgggtgggagttgggggtgcagaatagtttagtggtgaagagcacagattctggtgtcaaactacaggcttgaattttggctctgccacttcctagctatatgactttgattgaggtacttcacctttttctgcctcagtttcctcatctgtaaaacagggataataatatacctatttcatacaattttcataaggtttgtatacataaagtgcagcagtaggttctatatgagtatcaagtagagtgggtacactggtaatagttcttatgaaaagtaaaagaagtaactttaaaaaagtgtcaggcatagaccttggaacataaaagatttttagggccccttttcctttgttaaacatgccttaggcttgcatcctcctaagcctttgcaatacggtacttccttggcatgataaactgtattgcctttctttgctggcaaactgttccttcttcacccacttaaatgcatcctcccctctgtagtttctcttgtcttttttttcttttttggcttctttggagagaatgagtctctccctcttcttcagcacttactgctatcacgctgcttgatcatattgtattgtaattacttatttatgaatcttctccctcaccagactttatggtcctcctccatggctggagccacatcttattttcacagcctctatcgcagttctgtccttcattaaatgttttgatgaatggaggaataatatcagccaacacacagtgcttagttctaggctctgttccaatgctttacaaatattaactttaatcttgacaacaatcatatgaagtattattatcatctctaacttacagataagaataaatgactcaaaagagtttacgtaatttgtctaggtcacctctgctactaattgtcaaagccaggatactaatataagtagttggtatcagaaaccaggcttttaactcacccagtacaatgtctcctagagaacaagagaacaaataattgctcgcaaacttggctttcccaaaggtctcactttctcaggcaaatgagacgttcatctagcaaatatttacatagtgctttctatgtgtacaccatcatgttgagcactgatctctaatt

SEQ ID NO: 41052 - DNA, 1295 bp, Bovine  19866881026742
cttaaatgtactttttctgctgaatgtaactgacactgaggtacggatacccttgagacagcaggattggctggttgctgtgcatctgtagaccagctgaaagaaaatggacttgcattactccgacacgtttcctcttggtgggtggggacaacgctctctacaccgacgggtggcacatctgtctgttggacacaacacagacaggaaactgaaaggcttgtgcctatttacctgataaccacttagaattaactttttccccctagacattccctatttgaattgagatactgtggaggcaaataagactagataatgtgctattcattacttagatcaaagccattactggtacataagtaccaacaatataatcaattcaaatgtcattcaaatctcagttttactaaacaattacactactcaactcaaaaattctactagattccattgcttactaaactaaatccaaactcctttataatatgacctcagctgaccttctctagcctcattacctacacatttttccatttacctcatctactattattttttcttttttcctattctttttactgaggcaaaactcagtgattttgcgtatatttttgcctcagctaagaacactcttctctaatctctacacaatctctagggaaaaaaattccatatatttcaagacttaattcaaatgtcaaaatcttaggcagtttgatccctggtgtccatattctgttctctctgctagggcaaagttaatggattcctctaagctcctatccttgtctgttttacatgtctagctttcctaataaaatatgtattaagtgtaggtgttattatttaattctgcttgagcagtaagcatctagcacaatctgacatacagtatgctctctcaatgaatatttactgaattcctgaagtttcactcccagatcctggccttttcaaaggctccattgtcccagaacaaaacccactcagccttgtaacaaatatgtaagcaacggtaccttgagtatagaaaggtttgttgggctggaatctggcatttccctgatgcatgaagttctgatgcaaaccataaggccacgaagctgggacaagagggaaatggggtcgtggtgcatgttcccagggaattggaggattcagtcctggaaatcctggctctgcatttcaagaacaaaggagagatatatgttaaaacatcaccttgttcattcaaacatcccttcattccacaaagatttatgggtcatcaagaccaagaaatatgctaaatg

SEQ ID NO: 41053 - DNA, 647 bp, Bovine  19866881113545
gacacctacctcttgggtgtatgagtattgaattgtttattaaaaagcattacttcactgcttatttttgcctcatatatttacatagttgttgtattaacatatgtagtaaaaaattttactgtttctgttttctgaaaaaatgtgtttttaactttttttttagcgctcaccagaatataccaattgccgatatctatgcaaactttgcttaattcacattgaaaacatccagggagctcataaacatataaaagagaaacgacataagaaaaacattttggtaagtctttttagaaaatatttatttattgaatgataaacctgtatgaaatatttttattaatgaaactaaaaaccaagtgtttgtctattcttatagtaataactgatatgatagtgttgaaagctgtgatttccctccttctgttagatggtcaggaggggaacctgctcagtgaccagtttgctcatcctaaagtatgttgtgattcctaagcttaaaagtcaggtataggtcagtccaacctggtttttatttgagttcttatgtgttagctctatgggagtggtgaataagatagtcatggttcttgccctcagagtttctaaagtattggtgaaagcatacaatgaataaggattta

SEQ ID NO: 41054 - DNA, 1150 bp, Bovine  19866881318452
cctggttgctcacagattggcttggattggggttgaaatggggcaagagtggaggcagagagaccaaggagaaagctgctccaggagtcccagtgagaagagctgaggcccacatgagggtagaggccagggagaggaggacaggttttagaaatcaatgacaaagactatgaactttacacatactgctagaaataaggtccacgaagaaagcagaacctattttattttttgaccgcaaaagcagagagttgagttaaacatactactcggtgtctttggtctttgtcttatctacttatttattcccttttaccctctttcttctcccaaaccctataggtaaactctttcatgtatttattgtgtaactttatattgcaaatatgtgttttcatattgtgttgaacgtattttacatccaggcaaatggtgctgagttatgtatcctattctgtaacttactttttaaaaaaatatttatttatttatttggctgtgttgggtcttcactgtggcacacaggatcctcaccgtgtcgtgtaggatatttcgttgaggcacatggattgtctagtcgtggcacttgggcttagctgcttacaggcctgtgggatctcatttccctgacgagggatgggacccacatctcccatacttcaaggtgagttctcaacccctggaccagcagggaagtccctgtaacttatttcagtacaccacattatatttttcaagatctattcctgctacatgtttatttttagtctgttgtcttcctagaattaaagaattagattgacaatacaatgccatagaaagggctttatcactgagtggagagacttcagctatagcccctgcccctctactaacatgtggtgtgaacctgggcaggtcccttttcctagttgaatcttagcttcctcacttataaaatcagagttgccttctacatctaactttccatgcaaccttccttaccttatacaggaaactccagtccagagtgggagtgactcaatcaaggtcacacaatagttatcaatagttcaattcaatttatcccatatttagtgagtgccagacatgatgctaagtgctttggatatttaaataaataagccctgctgagttcctcctctcaggg

SEQ ID NO: 41055 - DNA, 1273 bp, Bovine  19866881409697
tatgatgtttatgtgaaattaacaaaattccagacatactaggtaaaggtaaatttcaacggattagcaaataaacaagaaatgttaagaggatttaagaaataggattacagatttcacagatggcagtgatgtttttctgcctgccaaggagcagtcttacctaagctgctgcctaatccgattcaaagtcaagacagaactcttcctgcggatacgggaagtagagggagcttcatcctgaacttctggctctttaccctccctgcaagatatcacagcatgattacggaaagcggttttgggtgccagctatcagcagcaggacttggaagtgagtcaggtagcctaacaggctcctattctttcggcagctactttggaacgagctaagcaaaatttgcccaaaagtttataatggaagtttgactcaatcccagagattaaaatttgccaaaagtttatcatttaaagtagactcatcacctccacaactagaaatcagaatatattaatactaattctacacagagtttcttattctttttaaatttttgatgtatctataatttactatccactcaaggttagtagctatgcaggtatactctcaatgcaaagcatttatcaagaaatctaggtaaaggactttactggaagtccagtggttaagactttgcctttcaattgcagggggtgcaggattgatcaaacaaggtctgatccctggttggtgaactaagattccatataccttggggctaaaaatccaaaacttaaacagaagcaatattgtaataaattcaacaaagacattaaaaatgatacacatttttaaaaaaatctaaaaaaaaaaaaaaaaaggaaaccaaataaaatcagaaaagccaggtgctagagtttctgagcagcaaacacagaaatttcaggattgtcatatttgtacagcccattatgtacagacaaggcccagtgtcaaacttcagagttgttctaaatgcattatcttattgtattttatgtatttgaaaatggtttccagtttaaaaaagaagaaagaaactgattaagaaaattactgttaaaatgtggtaaagagccaagcaagtaatgaaatgcaagactgtgaagcaattcaggtctgggaattatcttctggagcagcaatccccaaaggacagctgggtatgtcagaattatcataagagtgtctcaaaaatacagattcctgggcccaacacttggagactgattcactacatctgggggagag

SEQ ID NO: 41056 - DNA, 2230 bp, Bovine  19866881421797
atgtttctgggaggaagctgtgacagacaaagctgttgaagcttttattcagcaacggcccagcatgcagtttgtaggtttgctggccactgatgctggctattctgaattcctcacaggcgaaggacatttgaaggtcagattttaaaaatatattcctttgtcaggctgaccattgtttagtttacataagactccattaaggtgaatgtctaataatatatagatcatattcatgaaacatgacatagagtgaaaaggccttgcttttgagtctgaattaatattccagattatttgctttatggcccagagcaaactatgatgtaacttttcaatttacatttatttataaaatagatatgactcttacctgcaaaattattctgaagattaataattatatatgtaaagtgcaagtcatgttgtaggccctggataaatgatagttctcatgaagagaatgtttagatattttgaaccacttaaacatatagtatctaaaggatcacgtcaaagaaactagagatgctcctttgtagaaaagagtaatgggaggtaagttgtccaagaagatctctattgtaaaaatggtaaaatccttctcttcttaggtttctcatgcgtaatggcttaaattccatttgggaaacatctactgaacttggctcaacttgagattgaaagataaaaaagatacaggatttgcttccaaggagcttgatagtagtagtaatgttatgatcacaaacaaatctaaagccaaggatcagtatagttgctgtaggagagtaggagaaactttttctcactggagaattttcgtcttgatggaagatggtatctgaatcagaccttgagggatagaactgtaacaggtttaaggacaactagtatttttcttggagaaggaaatggcagcccactccagtgttcttgcctggagaatcccagggacgggggagcctgttgggctgccgtcgcaggggtcgcaccgagttggacacgactgaagcgacttagcagcagcagtatttttctaacatacattgtatcctataagtgctttatattgtatatggtaatatctgtaggttgatgttaactccactttatagatgaaaaacatagaaattatgatttactgttagttagaaccagcgtttggatctacatctatcaaatttcagagccccatttttttttccctctacgacttacatcaaaccacttaagttgaagcatcatttgattctacctggtgcaaatggcaatactgcattcttttttatggctgagtagtgttcatgtgtgtgtgtgtataccacgccacttctttatccattgtctatcaatggacacttagattgtatccatgtcttggctattgtaaatagcgctgctgtaaatttggggatgcatgtatctgtttgaattataattttctccagatgtatgtccaggaatgggattctgaatcatatggtaactctatttttagttttgtaaggaacctccatactattttccatagtgactgtaccaatttactttcctgccagcagtgcaggaggattcttttttagcaatcaatatcgatctcaaaaaaggagaaggaaaggttagctatagaacattttaaaacatgtcagttcttatattatttgtaaatttagactttaaaaagtagaatgtaggcaattattttgagtcacttttttattcattcattcagtaaatattttattaagtacctctgcatattatgtactgtgctagacatggagatttgatggtagagtgaaatggcgtgatcttgccctcatggagcttataatttagtgagggattcagacagtgaagtatcatacatatgttatgggtgtatgatttcaatatatgtatttatatatcatatacataatgtgcacatatatatatgctttaaactgcatagtgtgaagaatctaaaagctacataatactgtatttgagtatgttgaacagagaggcttgacttagtttaaggcttctctgaggacttgatgaatgagtgaagaccttatggatgagtaacttggtagagaagattccaggcagcaagaataatacagcaaaagatgtgtggtaggaagggaacatggtacatccaaggaacttcaagaaagccactgtggctagagttctagagtaggaagttgcagagcgatgagatgaggctggaaaaagt

SEQ ID NO: 41057 - DNA, 788 bp, Bovine  19866881599482
ttcctaggatatgaagtttctgatttttagctaaggataagagaaaacatttaagacgggggcctgaattatatatcacgaaatggtaatatctcagaacatttcaaacaacggaagaattctacctcaatctagttaacataattaaagtgattggcaggctgtcctttgagctgagcaggggagtgcagtaatcgggtaggccttggataggctaagcacagtatggggtagtggctaatctaaagtgaaaaacaaatcgaacagtgataaggatatagtaatagagtggaaaagaaacaaaggaattttctgtggagacagaaagttctataatctacattatgactaagatgtgggttatatggatatatctcttggccaaaagtgtacatttaagatctatacaattaatgtataaattttacctttaaaaatctgttaaaaaaaaaaaaaaacaatgaagcagggagaaaggaataaatgaagatatataaatgaaaaatggcagtacgtcaatcactactgaagttgtataatgagtacacaggaatttattatactattctattattctatttacttttgtatatatttgaaatttgtctataacaagtttaaaagtttcctacagtatgtgaaattctgcttataaccatgtgacaatacattatttcttaggttcataattatactgaggaaatttggcagaaattctgcatttgccatataaaatcaacgtttttatactctatcaataatcaaaatttcatttaaagttatttttt

SEQ ID NO: 41058 - DNA, 4940 bp, Bovine  19866880573420
aggtatttaattaagttgttaaactagaaaagttgttgagtgatttttgaatcattgacctgaaaccggggtggggtggcttttatatttttccaagagacaaagggcttccctaatagatcagtccgtaaagaatccacctgcaatgcaggagacctggttcaattcctgagtcaggaagatccactggagaagggataggctacccactccagtgttcttgggcttcccttgtgacttaactggtaaagaatctgcccgcaatgagggagacctgggttcgatccctgagttgggaagatcccctggagaagggaaaggctacctactccagtattctggcctggaaaattccatgaactatatagtacatggggttgcaaagagttggacatgactgagcaactttcacttttcactttcaagaaacaaaggactgtttagagtgtggtggggaatagaatttaacactgtgagattaatatgctgggtggaattcacaacaactaagtctccatcagttattcatctttgtgtatgctactgctgcagctaagtcacttcagtcgtgtccaactctgtgcgacaccatagacggcagcccaccaagctccaccgttcctgggattctccaggcaagaacactggagtgggttgccatttccttctccaaagcatgatagtgaaacgtgaaagtgatgtcgctcagtgttcgactcttagagaccccgtggactgcagcctaccaggctcctccatccatgggattttccaggcaagagtattggagtgggttgcaattgccttctctgatctttgtgtatagattgtctcttgagattttccaagcaatttattagtgtatgtttgtatttcactgggtaagttttcaatactaatacagaaaaccaagggactgtatgtagtacatggttatagtcctgagatttgcaaaagagaaccttctctttctcttggatggttgtggcataaattattgtgatagtctctcccaagagcccagggattttaaggagagggatatttttggccttttcctatgttctgcctagcatctataatcctgactagccaggacagtgagtcacctagcagccgatgcaaaggatacaggtctggcatcttccaaggagatggagttagtaatgcttctctagggaaacctcatccagagacaacagtctgcactgggtatgtggcagacaacctacatggcactctgtgtgctgggccacttacttttattgggtttgcaagacctgggggaatccaaaataaagccatctatctcaggatgagttctctttatgtgttggataaatccgtgtccatttctgcctctaagaaaatttagctcctgtatctaagaagccatattctcttgtggtgggatctgaagagcaatggataagggtgtcagattctgggttcatgtgaatcccagctttcctccatcctaactttgtgactttggataaatttcttcattttgctaaacctgatgttattaatctgcgaacaggggttataatagtacccatcccacaggcagagatcaaattgtagctgttcttaccatgactcagagtcaaacagaatgtaatttcctgaatcgcaggagaagaggtttaatgttgatataaaaaggagcttctgagaagaaagagttacaaatcttacagtgaaaatttatgaaaactccttccatgaagacctttgaaaataatcccgactataaaattatgtgacagatgtttctggccattcaagaatttatatagtcaagtgactgtcatcagctcacagttaccaccttgggaatttatacactgatcccaatgatattgcttttgggaaaactctctttggtacctcatcactaaaacagccttcagagaatgtaatgtactgccttgacatcttttatcagggacagttgtcatcttcagaggctgatgtggcttagaaacaaccaaaagtcattcagagccagtgaagagaggtggctgtacaatgaaagagaatcttacagggctcaaaggctgacatttgcatatgtgggttttatatcatgtgaacagattggaaatgaagataacttcttgtggcctaatatgtgattgcaggtgaactgttacagatgtttgagttacagacacactggaacttacctttaattctcagatggctgaaacacaattgtttaccatggtctttgtcctttgtggtgaatctgaaataattcataataaaaagtatttttaaaaagacaaatttcagggcttccctggttgtccagtggttaagaatccaccttgcaatgcaagggacaggggtttgatctctggtctgggaagactacatgctgtggagcaactaagcccgtgtaccacaactactgagccctagctctagagcctacatttcacaagggaagtcaccacgatgagaagcctgtgcactgcaacagagaatatcccccacttgctgcaactagagaaagcccgtgtgcagtagcatagacccacaatagccaaaaattttttaaataaataataagtaaaaattaaaaaaaataaaaagactaatttcagaattaaaaaaatagaggaatctagcttccaccaaaatcaccgcttctcaattcttcttggaacatcagaatatatttttctaactccctcatcatttcatgatttagtcacaggcagtgactaaagacatccctttaagtcttctagtttctagttccccatgtaaatgaaatggagaaggactctgtggggcctttccaggacagaccccacccacatgtcctccaccttcctcttgtctgtataaacactttaaatatataaagaataaatgtatcaaaaaataaatgtaattagagaaatggaaaaaatgaagaagcaaagaaaacagtcaaatagaacaaaataataagaatttagtgattaagtaaagtcagggacctttagttcctcctcaagggctatagataatattctgagtcatatcctttgggctgcttcatagagactgaaacttctaccaggtggaagaagttaattacatgatgaccagactgtagccatgacaagctgctatatcttgcacaattccaagaactggcctcaagaaaatgggaaccaaccaatcctggaactgaagactcactacttaaaacaatcaacacaactctgatcagaccaccacatgactaatttcaagatgattggtagagttgactgtactgttcttcatgtagttccctccatctgcctacacctctgaaatttccctttaaaagctcttgcccttgatcaacagttgggagttggtttttggaggtgagtctactttctctcccagttgccagcctcctgataaaaacaatctttcttttcaaccaatacttgcctctcgagtattggctttcaagcagagagcaactggatctgagtgtgataccataaggaccttggaagcagcctttgtgtcctaacaatgagtgacaaggtgaacagacttcttcaacttttcttggatccataagagggaggaggacacagggcaaactcccgccctgagattggagggacagacaggtgaacataaagagccgaggcttaccagagcagagactcaggagtgcaaagcaccatgggaaccagtgccagggaaggaaaacttagaccacaattaaagaagagctggaggctcagtgcaaaaaactctgattaaaaactccaaggggaccaaatcataaggagatcctcataatattgtgagatctaactccagaaactcaatcagattctcataccaaataaatccccatggacttctggcaggggaaggtgatggagaaccatttagaaacagccccaagcactctattcttcttcacaagacctgccctcagaggaagtcagttaactagaacctacctactggaccattatcagaacttaagtggtgtgaggaagggaattcctaacttctgctggctctagtcatcctgtcccagctaaagggggaggaaaaaaacctgaaaaacacttgtgaagttcagagtccaggcatagacatagggtcaataaagggtggagacccaattatgtgtgtgtgcatgttcagtcactcagtcgtatctaactcttctacaacctcatggacgttagcccatcaggctctgctgggcatgggatttcccaggcaagaatattggagtgggtttccatttcctcttccaagggatctttctgatccagggattgaaacttcatctcctgcattgcaggcagattctttaccactgagccacctgggaagcccgagacccaattatagaccgcagctattccttttatccaaaacaacatatccaagtatcagaaaataaaaaaaaaattctgtaaggaaaaagttataagaaatatcaaaaagccaaaaaacagacaaaaaagtccaccacattttgaagacacagagaaagcatcagaactagacatggcaaggatgttgggattatcagactgagaatttgaatcaaccatgattaagatgctaaaggactctagtgtgtgaagtagacaacatgcaagaccagatggacaatgtaaacagaaagatggaagccctaggaaagaactgaaaagaaatgccagaggtaaaaaatacaggaatagagaatatctttgataggctttttagtagactggacatggctgaggaaaaactctgagctagaagatgtatcagtagaatccttaagaaactaaaagcaaagagaacagactggaaaaaacaagacagaattgccagggaccatgagaccactataaaaggtacaaggtatgcatgacagaaataccagaaggagaaagacggagaggaacagagtccatttcact

SEQ ID NO: 41059 - DNA, 798 bp, Bovine  19866880854670
aataatgaatatagttaacaatcatttgaagatatatataataaattgggaaatagaccctagagagaccaagtaggaagccagaactgttgttctgacacatgcagtgacaaagattactctttcagtaatatttagtgtctgatattaactgaacttatttactttgccaaattataaatagctttataatttcttcaaaatatacttttagtaatcgcacagttaatgacatgctgatatatgttttattcaagtctttgaattcaactatttcctgaatttttatactctgtttggcagggacaatcatcatcttaactttgtaaaataatgctcaaaagaaaaacttcaaaacctagttacatttgtctttgtagtttgtctacactgttccgtggtcattctatgcaaggagataaactcagtttataagaattcataagaaagaagggaactgagccatttaatcttcttatattcttgataattgcaaactatgacagttctttacactctgtgcagctcatactttcacagggcttggcttagacatccttgagtatttcagtaaaaatgaatgtacactgtcatgagtgcctgttttgtgacaaaaattgtactttcatgttgcttttcagtgcatattacatatcatccatatttaggttatcagatggttattttagcataatacatacttgtaatattcatatatccattttttttcatattttgtacctatattgcattcagagcccaatattttaatagcaaaagctaaaaagactttccatt

SEQ ID NO: 41060 - DNA, 726 bp, Bovine  19866881023073
aaattcaccaagctggatagttgcaatttgtatggttctctgtatgtaatattttaataaaaatttatggcagattacaggttaacaaaaaatgcccctgatacatatcattaaactaccttctgaaaagaaaaaaaaaatgagttgcaactagcaatatataatcttatttcagtgtacagggtattattatttttaaaagttactaattataaatggaataataatattttaaattgcatttgtgattattaaaaaggttaaaaaggattttgtatattgttttttactaaggattatatgcaacattatattccctggtaaatgtgatggtttcctacataaattcttattttttggtagctttaaaatatcattatttcatatgaactagccaaattcattacccatgatgttcacgtacatatatttgtttctgatggaaataattagtcttcaattgctgtacttaagtgcctgcagattgtttctttggctcagactgacacaatttgtttgcaattacttccagcattttgcacacgaccacaagaaaacgattaaggtatctttcaaaagttgtttgcctatatttttctgacaccttaaatgtgattagataagagagttaggttttgagtgtaatagcctaaaatgcatgagatatcttgctgctatgagggtctttattaaacaaatgttcaccatcctttcatttgcacagtg

SEQ ID NO: 41061 - DNA, 1888 bp, Bovine  19866881086153
tattatgaattaagatgtcacaaatattttgtacaatcctctttgaagatacagatttttatcacatttgaagaattacatgattccagagacatctagggggagaaggacatggcaacccactccactattcttgcctggagaattctgtggataaaggaacctggtgggctgctgtccatggggtcacagagtcagacacgactgaagcgacttagcatgcatgcatgcattggagaaggaaatgcaacccactgcagtattctttactagagaatcccagggacagaggaacctagtgggctgccatctatggggtagcacagaatcggacacaactgaagtgactttagcagcagcagcagagacatctagggagcaatagtgaaaagcacaagaagttttcggtctaatatatgttaaaaaaaaaaaagatttttgggtataaccacaggttattccaaaaaggtaataaaatatctcatcatccaagatatttatgcatcattgaaaagattcaaatagaagctgaataaatatctgaaatgttggaagataattccacatttgtggaagtagtctagttaccttttctttattcctccaattctaatattctaaagtggtagggctatgctatggtacatttagtagatttagtacatttacttggaattttgaaacaggtaattgctctaatgcaaatcatatgttctgttggcaagtaaagggagacatgaaaatagttaaagaatacaactgaatgttaaacataccaagaggaaatttactctacatcactgaacataatgatcgccacatacaaattaatatgcataaaattttacacagagaataactctttacaatgttcaggtatctttttcctataaggaaatggcatggttggcaaatgatagttgatgctctatttcagtgaatatggtagtctaagttttagagattgacaaaattttaaccttgaagactatgtttcgcaagtttcacagaacatctgcatatatacaattcctcacagaattttagcatacaactgatgaaatgcatataaagagatcatttatcagttttctatgttaaggaaagaaaaaaacaatgttcctaaatgatcttataaattacataaataaaagctgaaatcctttgagagtattgaatcatgattaacaaaatccagggtttttaattttttctcacagcaccaatttgtaaagggtgttatttaacaaagtgactttggactatgtgaatgtcctttcaaaatgttctgataaagtggcttagcagcaggacttctgccattgactcaaactaaagcaaagaactctgaaaagtgcaattgttctgtgagagtcctccataggaagtagaaatgaacaatgtgttgaaatgtaaatttccttcagattcttccaaatcctgctctacagggatttcatttttcaaagcaatcttctatatttactactccacttgttaaattttaactccctgggccaagatttgtaaatgatcagagaactgtcaccacagggctaattcaggcatcttcccgcccttgttacattctacctctttcaacctaatactaagagactgtatttgcaaagtggtgtggaagagactgtaaaatgcagctattaaaatatttccaatgatttgctaatataaaaagttaagaactagagccattttttagaaagatagaagccaaggatgcattctattgtaggtcattatcttcagcctccacagcccagtgtatttataaagataaaataaacttgtgaagcgattttgtatttgagaataatttaaaaagcaaattcataaggattctggcttattctccactgcagtgatgctg

SEQ ID NO: 41062 - DNA, 1494 bp, Bovine  19866881400845
atacattagtaattagacaaaaggttcccaatgatatgtaattatatgaagcttaacatcccaatataattaatatatcaaaaagataaaaattaaaatgttatatggggtttttatcatgtttaactctttcttttctctgcctattttaattactgcatttctcttagtattatttgttaaaatttttatttgtaccacatttcatgttttatattttagagaaaaaaatgaataatgggataaaagtattttcaatgaatgattcttacattaataacccaaagttttcagctttcaatatttcacacatatatactacttaaaccaaattatatgcttatgttagtctcttattttctttgaagaaaagaatatatcccagggctatgaaccacatttccataattatactaatgaacctgagttttgtaatgcattcaatcatgaaatcagttcctgactactagctgcctttaaatgagaaaccgggttttatagctacagggaaattcagacaaaaataacccatattgtaagagctggccaaaatttaaattgaatgtgaaacttcttaattttatatatttcccactgctctctgggatatccctgttcacatgcgatattgaaaaagcataaaagaaaaagtcggacagtctatccactagaacaaattagaaaaagaagttgctttttttttttttcttttcccatgtagtttgattgttaatttgttattttcagcattgttcttcaccatgctgtatttttcaactatgccagttaaattcaggtcataatgccatagtcagaaccacaatatgaggagcatgtttcaagaggagcaggtgccaggtgtccagctcaatagccagggcctcaaagctaacatgactacttaggcagatgtgttcacaggacagttcatcaatgacaactaggagctggacttctttcaatattcattggacaccttacttaagccacacactgagctaggtcaaggggctataaatcaattaacctattatctttccctcagggcatttataatctagcaagtacttgcaagttctccaggtctaggtaagcaagaaggctcaaaaattttgaaaataagagatttagcaaaacagcactagtaagaaaaagttgcgatcttttatcccaagacaaaagtatttttatcttaggacatgttttgctgggttcccctgtggctcagctgtaaagaatctacctgcaatgcaggacacacagacctgggttcaatcccctggtctggaagatcccctagaggacagcatgcaactcactctagtattcttgcagaatcccatggacagagaagcctggtgggctacagtctatagggtcacaaagaatcagacacaaatgaagcaaattagcacacacacatacatgttttcctatctgctgaggtatccttgctaggatggtctctgaaacaaaaaaaggcagaagcatgtc

SEQ ID NO: 41063 - DNA, 1481 bp, Bovine  19866881534498
tgtaagttaaatatctttaaatgtgtctgccctattattaccagtcttagtaataatatttctcttgttcttggcagatgagttttttttttttttttctctctctcttttacattaaaggacaataacatttacctgtgattgcaactgaatgcttaaggttgattttttttttctttaactgaaaacaatgaattttttctacagtgcatcaatatctactactctgaaactatcttcactgaatgcacaagaaagtcacggtgagctctgaatgatggccacctgcaaagaaatgataagactgagcctttctctcttttcttggcaggacccctttgctgtgttctgacttatgccaggtaattggagtcagtcaactagacaaccagctaatttccattttctctctcttctgtatatatcaataatagcctcacattcttcacaaggaaatgtaacaatgtgtctgtcatttaaataattcaccaactgatgtacaaaaacattacaagagaaagctggaattaatttcagagtgatacaggttcatatatccatcctaatttatattttcctaagataattttggagttagttaattattttgaatggagaggtggcaaacaatttgttgccatcatggagcttaatttgagtgggtgttagtcactcagtcatgtctgactctttgcaatcccatggactgtagcccggcaggctcctctgtccatggaatctccaggcaagaatactagagtaggttgccattcccttctccaggagattttcccaacccagggactgaacccaggtctgctgcactgcaagcagattctttaccatctgagctaccaggggtcttcaaatttgagtgggtagagatgaacaaaaaataagctgtcaaaaagtaaataagatcatttctagttgggtcacaatctgtaaaataaattattgtgacatgataattttaactaaggaatggggagttgctacctaaaatgaaggattaaacttagtcagcatttggcacaatagaacagaagggaagctaggagagctgatgtagactgcaaggaagggagaattaaagggaatcgtgatgaagagctgggcaagagctagaccgaattgaaacttgccggtggatgttacacttcaaaagcatacaagtgcggtaaggctatgatccaaactacgatttgtgattgctgtgtgtggagataattttaggtgaacaagaccaaaagtaggagacaagaggctactgtgttaaaacagccccgagattgacagggacgaaagttagagaaataggagtcgaaatggagaagaacgttgagaagcattgcaaggtggtagcaacagggtaaactgggtgatgagggcagcaggaaccaaagtgtttagtattgaactattgggtatgtagcagtgctatttattgagaagaaaataattgtggaaggataaattta

SEQ ID NO: 41064 - DNA, 1069 bp, Bovine  19866880366284
attatgctgctgctgctgctaagtcacttcagtcatgtccaactctgtgtgaccccatagacggcagcccaccaggctctgccatccctgggattctccaggcaagaacactggagtgggttgccatttcctcctccaatgcatgaaaaggaaaagtgaaagtgaagtcgctcagtcgtgtccgactcttagcgaccccatggactgtagcctaccaggctcctctgtccatgggattttccaggcaagagtactggagtggggtgccattgccttctctgatgattatgctgacaaaggtgcatatagtcaaagctatgatttttcagtagtcttggttggatgtgagagttagaccataaagaaggctgagcattgaacaactgatgcttttgaattgtggtgctggagaagacccttgagaactcttgggcagcaaggagatcaagtcagtcaattctaaagaaaaccatccctaattattcattggaaggactgttgctgaggttgaagttccaatactttggccacctgatattgagctgactcactgaaaatgaacttaatgttgggaaaggttgaaggcaaaaggagaagggggcagcagaggatgagacagttagatagcataactgactctgtggacatgaatttgagcagactccaggagatagtgaaagacaggggagcctgggtggtgtgtatggcctaatcaccaagcatcaaaaaaatgaggacacctcagaagatgccactttggtagacaatgacaacccagacaagattcctcctgtcccgaggggccttgagtgatttaagttgtttttctataacaggctgagatggaaacccaactcagaaattatgcttagtgaaagaaagtatagaaaattgcattccttgcgcatttgagtctgtgacttgaaatttattttgattataggagcacatttttggattaggattccttggaatatactttagaaagcagtaatcaagctaattaattcctggcagtacatatatttcatactcactgagctgagcaagtttatcttcaaacaaatta

SEQ ID NO: 41065 - DNA, 2819 bp, Bovine  19866880415233
ttcctactgcaaacttggtaactgagttggagtgagcacacagacagtggctctgagctgaggataatcctgggttcagacaccactgtgtgatactggtcacaatgggagatattggaagtcaaggggaaaatggattttaggtcaagcccacctctcaacgggcccagtgggaacacacagtatggttattttttcagtgggagtggcgaagttgaattgtcctgcaagctgattaggattagggggcctttacttgcctggaacttctttcagagccttacagcttaagcagagaattggagcatcatgttcaaatatggtatagattgtctacaaaatccaaagaaattctttgtattcttttgggaggaccaggcagcagcttgttgcagatcagttctatcagatctcttcccttctggaagagacactcttgatatagctttgctttccttaaatgctgtgattctgccactactaccttccacagacttacattgccatattcactgtcacaacaggccacccaactctgaacaagaaacttttccaaaaaataaaagcactgcagtggtgaatgcccatgggattctctgatttttttgttttaccatgtaaataattaccctgaaggagctggccttaaagaagagtggattgcctttttgaaaactcagttacagcaacagttggaagataacattctgagactaggttactatcccatatgatgctctgatctagtgaataacatatggtacagtttctccataaacagaattcccagggtagaatggcagctctcattattacacctaaatttcacttgtaaatattttatttctcaatcccatggatttggctttcctggtttaaagatctcatgatgcaaaggaaaactatctccactaggggacagaacaatggaatgttgagactgccacctggttactgagctctgtgaaccattgggccaacagggaaaaaaaagtcacttttaggattcatcctgtttatcaaggggaaataaggttggtgctttataataggagttgagaggagtccggggaccttcgtgaatgacacctagtactcccatgtaaggtggtaaaagttaaggcaagagtggagcaattctatggcagattgagatatagtcacatttcccttttcctcgttggcacacagatcgactataattcccggcctactttgcagctagatgtgagtatgacactgtggtctgtcaataggctgtgagggaagcattatatgctacctgcaggcctagcatacaggatagaaggagctagtgtatcagaaggtcaccatcatcagactgaagacaacctctttgggttttattgaaggaggaataaacatctcctggattagaccagtgaaaattccaagttcatctcttagagcaattagcattaccaaactacttacaaaccgcttaaaagcttaattttcccttgagtcaacggcacacttcagaagacagcctgcccatgggcctttatgtctgtattctacccaagaggggtgctttctggatgaggggaatcaaacagcaagagaccacaaggagatccaagcacaaaagctggaagaggttgggctgaagtggatctctcaccttaggaaattgtgcagttggggggcccttgatggatgtcagaaaaactcatctttggttcatatatgagaactttattttgagtgcctgccatacaatgttgatgttcaagggacaccatgaccagtaaggcaagagccacttgatttgtccagatttctcttatctgcaccctgtggtgagtatcagtgactaaaaggttggtgggaaggagccggaggcaaacaacctgtctccagaggagtttatggagctgcaggctgactgaggtcgaggaagtgatacaggtttagcctcagatctgacactggaacttccaactggacaggactacagtggactatgggcttcctaggtggagctagaggtagagaacccatctgtcaatgcaggtagatgtaagagactggggtttgatccctgggttgggaagatcccctggatgagggcatggcaacccagtccagtattcttgcctggagactcccatggactgaaccgtccacagggtcccaaagagtcggacacaactgaagtgacttagcacgcatgcccactcatgcaaccttttgcaaccttgagaggaaggagaactaaaatcctctgaccagtcacatcccttctcagtctgcacgtgtctttgttgtcccactttttttttcaaccagctcagtcttcgaagattgcatccagtcttcagtctttccaggtttctcattgctcctcttgcatattaatgggaggacaaaactgataccctccacggacacatgcatgtcattaggctgttgctgtgggggtgagtctcctctgaattgtcatgagaaagattataaacaagtcaaggacaaataaagctgattggataccaaggaagataacatgagctctggctgaaggacaaggaggaagcacctcaggcctaacagctcagacaggagcaacggcaatacgcctgcgtctgcctccatctgaggaccgggcttttgtgtgccacacttaccaaatagctgtgtatttgtccaccttgtggatcatcatataattaacacttccgagaaaatgacgttttgtcatgtaaatgtatgtatttcactgctgaaaagtggaagtgttagtcactcagtcatgtctgactctttacaaccccaggacgtagccaccaagctcctct

SEQ ID NO: 41066 - DNA, 914 bp, Bovine  19866880470901
tttttttctgttagtgataaaaagacctttgttacttttgaccttttcataatcagggcatgctgatagaactttgccactaaaagtggagggaaatccacaccgcaccaatgagacttcttataaaattagctgggtgacattagaggcttaaaattaattggcatattggggactgtttctctttgcatctgcatactcagttttgtataagtattgaggaactttaaggcactcaacttgcattctgagagttcttatgttatgagaattactcattattcctgagttactgcttgatcatcagtgtagaaatggacagctgtccaaggaagatttatgcatgatcatttaaattggtgttgatcttgtcattttagaaaagtagagattatgttttttctgtcttcctatgctatttctaaaagtatccagtggtttacagtagtggcaaaccaaatactaaccaagaccattatcccaaacaccctgatattatagggctgaggttagtcaaatatagacatatctcaatttttaggacctccaacagactttagcacacagcaggctgatagtttaatgataaaacattagaaataagttcagattaatatacagacattaacacttttggaggaccttgaatgcaacatattgcaacagttttatattgagagtcataaaatttctttagaagacaggcatttattataaatggattaatttgaagcacataattaaattccttgccaagtggcaaatagccaatcagaggcagagcatgctttctaaccttcttttctttttagtcacccatgagagtgactttcaaacttgtgagtaccacagtttcacattttattagtattatgtgtgagaatacaaattcggtattacagactccagttttc

SEQ ID NO: 41067 - DNA, 879 bp, Bovine  19866880500854
agtcccttagactgcaggagatccaccgtccttctgaaggagatcagccctgggatttctttggaaggaatgatgctgaagctgaaactccagtactttggccacctcacgcgaagagttgactcattggataagactctgatgctgggagggattgggggcaggaggagaaggggacgacagaggatgagatggctggatgtcatcacggagtcaatggacgtgagtctgagtgaactctgggagttggtgatggacagggaggcctggagggctgcaattcatggggtcgcaaagagctggacacgactgagcaactgaactgaactgaactaaactgaatgcatcaataaaagctactaattactgagaggtaattatataacagatattaaggtaaatgctttacatacattgaaaaaaactttaaagagtataaaattatgcctataaggaaggtcttggtaactccattttgcagattaaggaaattagattttaaagatttaataaatggtccacaataaaacactgttgaagaatgactaattcagggaaaagtcaatataaccactgagtggaaccactgcactccacagcctttctgattctccttattaggaagcaaaaattctctgtgtaaccggttggcagcatttctttgcctgctcctgtgtagtgtggactcagtcttctaaagaaactgtgagtacagccatacgagaggcaggctgctttagaaatactcagccacctggaaaaccataacaaatatgacttggtaatcagctctttcccagagctgtgatgtctcacatgtcaaaagtggtaagcacttcccagagctctgacaaaattacacccaaatgaaatttcttc

SEQ ID NO: 41068 - DNA, 668 bp, Bovine  19866880508041
gcggctttgcttccagagatgaaatcccaaccattttttccccctattttccacatcatctcaatgaaaagcaaagaagcaaatattattttcgtgctgtaaaaactgattgacaaagtagtaatctacttgctatttcatgtatcattggctaagctaaagtttccttcgattgtttgaaactattgttccagtagtttgaaagctactcattttaatgctaaaagggaaaaaaggattatatatagcttccaaatctttagtctagagaccagatgcaaaacctgacagatgggagttctacctgccattgagaaatgaagattgttttctcttcacaagtctacggggcatattttttctagagctagaagtgaaaaatccataaagaatagattggtcaaaagttaattttgatcccttggggaattgtttaattaacagaacaattcagcattgaacccacaagtacgtgcagagtgtgtgcactgagccagcactgttagatgcaggggagtcggtgaagactcagggctgcctggcaccgaggtggtgaagtttactaacgcagttagccaggcaggtgatggatacgtggtgcatattccacaggaagaaatagcagttttcaaaagttataagcctgggaacctaaatagatgataatg

SEQ ID NO: 41069 - DNA, 1887 bp, Bovine  19866880676416
ttttagccatatcttattaaattcatatgtcaatgctgtctgtgaatacataaaacttatgcttatcagatttgtaaacaactcaaggctgagatggctagctaatatactagatgacagaatcaaaacctgaaaatattttgacaggcttcttctaacaggatgaaatttgttgttcagttgctaagttgtgtacaactttttggggctccatggactgcagcatgccaggcttccctggccttcactatctcccagagtttgctcaaattcatgtccaatgagtcagtgatgccatccaaccatcacatcttctgttgcccccttctccccatgccctcaatctttcccagtatcagggtcttttccaatgagtcggctttaatggagttaaaggtaaaaactttttatctccaacagcaacaacaaaacctatacctgttgagcatctgcatgtagaagattcttagaaaggatcatcagtgattaggagtcatacaagccaatggagtcatagacttatttggagaaaagaaggatggaggtgaaggttgccacactggcaatggtcagaccccatccaaagtcttgtgtgcacttctggattctttattttcagagagatacaaactgaaatgtattagagaatgtcaaagggtcttaaatccttttcttttctttttggtaatgagtctgaagagtagttttctacctaatctggaaaaatgtaattattttgtcaagttaaagaacataagcaagaggagttgtgatcctagttgggataaagatttcttttattctagaattaaaaaatttggaggacaaactatatggcaaacacatgcgtgtgtctctgagtagaatatttattcatgagtgtggcaattttttctcttaagaatgacatggaaacagcatggttaggagtgctgtgaaatgaccaagctgtgcatgtgtgggagtgcatatcttctgcttcttgtggtcctgagtgagatgtgagaggattgagtatgttctgtcctgcaggctttgcaaatacccagaaagctagaacacctaagaggaaagaaagaagtgaggaaacagagagcgtgcagtgtatgatagaacaggataggacagaagagagaggagagagaaaaggacatactgagcgccttataatatgttctggggaagcaaatttataccataaacttactaagaaatgaatgaattactagtgaatgggtcacatatgatgaccagtgcaaagctgcagatgtcttaagtaaggatgcttttaagaaatcagaagtatcatcttctctcctcttcaggtatctgccttttctgcccctgtttctttcctgtgaaaagtcagatactcatcagacttgtgatgtactgtcacctgttcttaaaggtctacctgtgtgtttgaatagtgaccttcaaaatgctttcccactatagttgagatctgctgaaacactgctgtacatgatacaccatacggctttgtgtcactttcagagttcatgattgcaactcatgtcaaacaattttccttagtgtcatacatctgcaaatttaaattcaagaaaactcattcaaaacagtgaaattaagcaataattgaagtggatactagctacttcagcacaaaaggatttattttggtgtatttttaggacttggtacaacatactgatacaaaaatattaaatcagtagaaaaaattgatagtgttttaaaggatgtgaggaaggagaaaagaaaaaaggagttttctccaatcaaatgcaaatgaaaatgacccacaagattctgaaaacagtctctctccgacaagaacattttcatgcagtgaaatccatttttagactcattagcaagcgc

SEQ ID NO: 41070 - DNA, 1422 bp, Bovine  19866880771129
ttctttttgtccaaaagggttaccaccataaggcaggttaaaaaaccccaatattatgtactaagggaaccttggaaaggaaaagttacccttttagatttttattttaattgaattgggtctttgatggagctaacattgcaaaatgatacacaatccatagagaaatagcattgcagatctttgctgtccagtatggtagccatgtggctattgagccctggaaatgtactagtccaaattgagatatactgtaattataaaatagacacgtgatttcaaaaagttactatgaaataaatgatgcaaaataccatagtaataaggtttatattgattatatgttgaattgatattttaatacatgttaagtaaaatatgttattaatattaatgtcacctttaagcttttttaaatatagcttccccccaaatttaaaatatggcacacgttaatatgtttaatggacaacactgccctagttgtaggtttaaataggagctttttatttgttcataaagtgttttttttcagagttgtcttttagggcatgaaagatgttataattttgttttgatggtttattctcactaagacccaaccgagccaaaaaatcactgaatttagaaaagaaaaaagtaagagatggtttcaaatatctcccagataccagataatgaagcaagactgatttctccaagaacaaagattagactgccaagctattttgcataccaaagagatttcccctcctggatgatatttgtgcctctaacctctgaaggtgcaaaaggagagttctctatttctgcatacctttgtaaagcttttgcaatctaaaatgaaaaatcaaagcagaaatcttgcttgccactgcagaaagatttgttttaacatcccaacaagttcatcattttcaagaatgatgaaactggcagatagttcactcacagaccacatcagcttttaaataagcccttagggggtaaggagtcattttttttttgggggggggagttctcaatttacctaattttattacagttatatttgatgagggttcatactcaaaatattaatttgctctaaccagcattattttacagggaggagttgaattggccccaagctatttggttttacattttctattgcctaaatattgatggttcccccaaacctatcactttctctgcattcttttttttttaattttaatttttaattggaggataattgcttaagaaagatgtgttggtttctgccatacaacaatgtaaatcaggcataagtacacacatatatatgtatgtatctcccttttctcatgagcctccctcccagcctccccccaggactctttttgatttatcctttttatagccttttattgactagcacagtccttttgtacttagcaa

SEQ ID NO: 41071 - DNA, 1039 bp, Bovine  19866880782848
cccagaataggaaaatattgcattagaatataattccaacaaaagaaaactataattaaaacataatcatatgattagaagtaaattcaaaagagcacataaggtttccagcatattttttatatacttagatcttaacttttagagagtttgttttaatccagctttaagcattttgcacaaagattcatgtcaatcttttcatttacacttcatgaaatctcctaccattgtttctttatacaatattcacatacaatatttttacttgggttgtagacagtattgctaagctaccattgtatgcatctcaaatttcccttaagccttatcttgattttgacgaaattgaatggatttgttgtgctacttgagaacagaatcaggattatcctgcaggtggtttttttaaatcatttttgttttgttttggtcatttctatttttcatgtagcatttgtttctttttgctttggccctaagtttcttctttcatttttcattagtacatcacctcatggtctgaaataccttctgttgctttcttaaatgttaaacaagatgatatgcctgttgaagaagcctgctgctaagtcgcttcagtcatgtccgactctgggcgaccccatagatggtagcccaccaggctcccctgtccctgggattctctaggcaagaacactggagtgggttgccatttccttctccaatgcgtgaaagtgaaaagtgaaagtgaagtcgttcagtcgtgtctgactcctagcgagcccatggactggagcctaccaggctcccccccatccatgggattttcaggcaagagtactggagtggggtgccattgccttctccggttgaagaagcctaatgtgtctgtattctctcttaaaaaataaattggaagcatattttaagggtgcttaaaaatcactgcagatggtgattgtagccatgaaattaaaagacacttactccttggaaggaaagttatgaccaacctagatagcatattaaaaagcagagacatcatttgtcaaca

SEQ ID NO: 41072 - DNA, 1496 bp, Bovine  19866880855019
ctcccaaggagaagggttaattcccatctcgtgttttcccaggaagtcttctcctttccttctcctactcttagcctattggcctcttagttgttcctttcaccttgttggaaattctgtgaggttagactatctatattttttcctaccttgttcctgttacagagcacttaattattatttagaagataaagtaatgcacaagagtttcttcctgaatagttttgatggtttcctgttttccacttgggaatacctctcagagagaaactatttctttaagaaggtaaaatgctgtaaatttttttctatcaatgttttgagcttttgaaaattactaccggagtgtgtatttttatctttctcacacctctgttagtatttcagactacacaattgtatgatcactatctttcaaattgtctttcttgtgaaaaataagtgactgtttgacttttatgtgcactgacagggacctcacattgttattttattatgcatagctcatagtgctgtagatgtaattaattggcaaggtctgtatgtgtggtttctaattttgctaatataatgctgttgggccaaagggaggtatagaaaacattcaaaattacttgccatttctattaattaataattggttcaaatattcttagtaaaaatgtagtatcctttttggagaaggcaatggcaccccactccagtactcttgcctggaaaatcccatggacagaggagcctggtaggctgcagtccatgggggtcgctaagagtcagacacgactgagcgacttcactttcacttttcactttcatgcattagagaaggaaatggcaatccactccagtgttcttgcctggagaatcccagggacgggggagcctggtgggctgccgtctctggggtcgcacagagtcggacacgactgaagcgacttagcagcagcagtatccttttaattgtactaagatccctctattgtagagtgaatataaggtaaaaagccatgtgacattctgttttaaagatacaaccttgttcagaagggcttatggaattggtaactggtactttgccagtacgtaaaataattattacctctctaatctaatggataatatttcatatgatgggaaagtgagatgaaataattgccttctcacattcaagtttctgttaaagctaccagtataagggagaagcagagaaggcaatggcaccccactccagtactcttgcctggagaatcccagggatgggggagcctagttggcttccatctatgggatcgcacagagtcggacacgactgaagcaaattagcagcagcagcagcatacggtagaagagaaataggtttaaactaacacagaattaaaggcaataatttagggtaagatgttttttcagagctgtattttattagtaagtttcaaaatccataagaacatgaaataggatacttaccttttataaactcactggctagactaaag

SEQ ID NO: 41073 - DNA, 1064 bp, Bovine  19866880881148
tgcatgcatgatttggttagctgactcacagagctatcctccctaacctactgaggttagctttcaagacactttttttttttttctttttaatgtgtatgttcttgaggcaatgactttttaaaatttattttctaacctttcttccaagtctttatcttctcatatcaaagaaaaggaatgagactgtcttcttttttcactgcaggctttttcaagatacccagaaatgaaggattctttaatcgattaatcaggctcaaatacatagtgccaaaagcaaataaaacaatggcacctaaatttatatagtgtttgagaagcatcttcacaaacttcattttatttgatcatcacaaaaaaactttgaggtgggccggtccgctatgatcaccattttatgagtagagtaaaatcactatgtgagcacagcacattcaacagcagaattgaaactagaagccagttctcaaatccctgtctccagtgctctccttccctaacacacaaacgcctatgatatgtagagaactgtgtaaatatctctcatctcacttttatatgtttatatattctagtaccaagatagaagtcttctcagtgttactcaaataaattggtaaagattttatgtcttctgaagctaagtgatatataaggaatgaaaactaatttatctttccccaatataattaatgtttcaaaaagcaaaactagtaagaatatttattttcacactataaatatttagtataaggccttgttctcaaaattccagttttgcatttactttcaatacaataagtcaatgttataaaagcttcacatcattgaggaaatagattcagtgaataatttcactggaagacaatttccacacaactttttagtttttgatactttaaataaacactatacataagtatattatatatgttatatatgttactcatctctgatgtcatgaaagttgggtattaataatataggaaaaatgatacttgaataaatactgttggcagattgaagacgagtacaaaggacaatcaccacggaacactgta

SEQ ID NO: 41074 - DNA, 1585 bp, Bovine  19866880885527
tcaagggaaagaagaaacaacgatttagtttgctcatatttctaaccatagcaacaagaaagattaaatagtaaaaaacaagattaggtagaattgataatccattaatgtggagttccttcatctcattaacactagtcaataaaaaagtggctttgctataaaacagtggcacttgagttccatggaagtcactgtgtatcctagcaatgtccttttttaaaaaaaaagaagtctgaggatcttatctactgtggctaacgtctggaatttctggccttatctcctggctactcacttaggatagtctaggattttatttccccatgggtttaccatcaacatttttccctttaaaatatcagccctgaccttaagtggcacagggctctctctgtgggctctggaaatatttatagcactcaggtataattcttctgattaaaatatgttttgcttctattcttcagtgaaacaataaaggtagattgcagagcaagcccttttattcctcctgaaaggacctgctgtgaactacaaaaacgaaatacaaagtaaattgcttcaaactaacgtgaatgctgctagctcatgctgggtcatactaaaagagacttccgtctgtcccagcaacaacaaaggggggggggggtctaattcttaaccaaacttgacatgtgtctaggacaagatgttagtcatgcctggcttcatcttctcaggaatttcttgtttaatttaactcaatgactttgaactgtgaaggaagagttgatccaaaacatgagttagacaaaggaatctaaataggaacctgaaaccatttctacctctctgggtctgatcttaccataatgaagaaaaacaaataaagttgggagaatgtgatctctttctttgatggaatcacagatttaaagatcaaaaaatggaatggattgtcataagctatttggaatttatgaaatatgtttttgataactatcatatgtactatttttaataaattcaaaacagatttggtttgaaaatgtgcaagatagaaaattgatatatatggtactaacagatagggatggtgggcaaaactactgggttataatgctgggccagctaaaatgatgcagataatatttaatcttcactacctactcatatttttttatttttccatgggtcaattaacaaaatgctttatgtgactactatgttctcagcattacaagacatagaattacatgactacttcaaggagtttaacttctggttgggaaactcaaaacactactaaacaagttatgaattatcaatgggcaaaacaaatgaggctatgtttgaaagaattacgaattacaaagtctaacacattctgttctgtatttcagctgttttttatttcaaggagttcagtgacaatttgaccttgtccttatttggggactagtcctagtacttactcttgggaaaattccctctgtaaattattcttcattttatgtcagatgaacccaatccaactcaatccaatattctttgatgggatgtcacagattttttatcccattcacagctgctgctgctgctg

SEQ ID NO: 41075 - DNA, 1646 bp, Bovine  19866880920711
acagtttaagagctcagtgccctctttcctcaaaacttcatacataactcatctcctaattaaattcaaagcttttatggtcatggctccttaattctacccctaacttgcttggcaaaaaaggacatttttgtcatagttaaagatttgcagaggtgagtgaactcacacggtggcaaagtcagttctaagggaacacaagaggaaaaaattgtatgatttagactttagattttattacagtatgtttcaggaacatcctgttgtgtggcatacatcacatccacataaatgcatttgttaaaaaagcaaccttagaacctcacttttgccttaaattagccagatagcagagcagcactctgttgagttttcattttatattttgcaattatttctcaaaccgttttgacttggatttagataaacatctgcatttcagcttagttgcctttcaaataaaacctaagaggaaaaaaaaaaaaaaaacaacattcttaaagatttgggatatttttagcaaggcagagaaaagaaaattgttttgtgaggctatttttaaacaatactttttaagatttcttaaagctccagtggttaggacagtgctaaaggcaaaaatgttgcttaagaaaacacttcagaaaaagctagaaaagttaaagcccaggccaagcccctagagagcaaggagagtgctcacatggcttaatgtcctttgaatctcttaaggttattttctaaatgagactatgagaacaaaatgaaattatacttcccttccagctagttaagcctcaactccctagatgaaaaaaatgttttctttttggacagtgatgtatttctagtcagtatattcccaaaacaaatacaccaaaacccacttcatgcacagagtaaaataaaatataggaacagaggtcattaaaatggtttagtatcactctaattgccattttgctgataaccctcatttgatggaacaggtgggttttggtcttattatctactacctgtaaagctatggtttatgaaactgaattcctttgaatccctcacccacttaacacttaagattttttacttagagtaatactgattctcaggctaacttgtagcagacagggtttgttaactagccaatgttcatttcccaacttttttcttcctgatagaatcccagttttgtctagatatatttcctccctctgaccccatgcatggaattaaaatcaagggaagctgatcccaagaatagacctttagtctaaaaagccaattagcacatggaatttcctagcagttaataatatactaagtggtcatatgtcctatactggctcagccaaactgaaggacactacccttaattcttgatagtgagagaggtttttctctctcttttgctagacaagaataaggaaggatgtagctccagtagccactggcaatcatcttaaagtttgaggggaatcattgaatgctgctgcagctgctgctactgctaagtcacgtcagtcatgtctgattctgtgtgacccgatagacggcagcccaccaggctctcccatccctgggattctccaggcaagatcactggagtgggttgccatttccttctccaatgtatgaaagtgaaaagt

SEQ ID NO: 41076 - DNA, 625 bp, Bovine  19866880928524
aattctcatgaagcagatggctactaaccacaatattaatattattttgctttgtacatttagggaaaaaatcatttcacagttgcaaaggaaaacctcgtttggattttataaagaatgatctgcaacagaaataacatgctgtcaggacctgttttatatgctttcattatcagtgacaaattgtgatattaattctatagcaaatttgtgcttgggattttagcatttctctcagccatttcctttctctgcatagctagctgtagaataaaatgctctgaattttaccttggagggatcgacagctggatttaaatgttacctctgtaatttgcttagagataccattgtttataaatttgaagagtggatgttctttgacaggattcggaatgaagtggaggtttgaggtaattgcttagataatccaggtagcagagacacttctgcctggattcccccaataacatagctgaaacaaaagaaatttatttctgtttgaattagtcaggtaattactcctgcactctgctttgttttgctgatgacattctggtttgaatgtattgggagagatgatggtgacagttaagttcatatgatggaatggtggtcctgtgat

SEQ ID NO: 41077 - DNA, 777 bp, Bovine  19866880954938
tttatctctctttttttatccttatgtggtacaatcactaagttagctctggttagatattcagaacctgttgttccaagttattgatacatttggaaaaaggaagtatcatttgatgtcctggagctacagttatgctttctattgatattagcggttttcaagtatctcagaacaatattttcaagagagatttttgctttaaaatgaagagtgcctcagtaagtttttacttgcaaagctgatggaagtggtgggtggaagaggtaatatacacattttctgatagtaggcaacttagtagaaaatgagtgtgtttctatatattatctttgcagagttagcattaagaaatagaattgcaataaattgatgtaaaagccagatagtaaagggactaaaagtccctgcagagacaccagtctgtcacttacaaaggtagcaaaagataattgcagacaagtacagtagaactaaaccattgctgttttcctttagagatacactgctgcttctcatgtttttctgaaaaaattggttacttcctctgcttctgaagtatgccatgaaccatcaaaacaggtagaaaaagatctgccttttatttctccccaatacctttttaattagaacacaccatagagcaaaacgggcgagatacaatcctgcgtgattgcattttccagtaaattggtggatttcttttttagtttctgagctctgcattgaaaatctggcctctggcataaactttgccctcctcctatgacataatga

SEQ ID NO: 41078 - DNA, 1476 bp, Bovine  19866881060438
tctatgaaactgtcgagctgacaaaggagcttgtaagaatggtaaaacctcaagccttttccagtctctgacaggtattatacaccattgagttgaaaatgtgttcatattctctaggagattataatctaaaaatgtcaaacctaaagttttgaatgaaatataattggagaagcttaaacagtagtcaatcattttaaaaattaaggataaagaaagagcagagttacagtagtcaaaaagtctattcggggcttcccaggtgctcagtggcaaaaagaatccacctgctaatacaggagatgtaggagacgtgtgtttaatgcctgggtcaggaagataacttagagagagaaatggcaacccactctactattctggcctggaaaatcccatggacagaggagcccgataggctacagtccatggggttgcaaagattaggacatgaccgagtgactgagcatggcacgcatatagtagtcaaaaaatctattcagcaaaaagtaaaacagaatcatggatatatatatataataaggagagatgaagtgtctcttctgtgactgtgaaaggggcatttttattacaattatttaagacaaacttgaagggctttagaaacagcaatgatatttttatccccataagctgtaactaaaaagctcctcaacatcttgccttttatatttgtccataggattctcatgaatcatatcatttttgcttatagggcttccttcagaagccatttcctagaatggatgtggtaaggtggaaatatggcaatagctgattccaatgacttggaagacttaaacggcaatcacgctttgccactgccgagtcatttcccttcttcagccagcacttggggagctcaaatttcttaaattaattgagcacttaatatacagctataaattaatcatattgaaaaggtgctaattatttcattaactccaaaccaatccaatctaaattgtcacttctttagagcacaactgctgaatttcctctgtatttaatctattgatttaaactatgctatgaattatatacacagataaataagatttagtttctgtctacctttttggaaattaagctgaaggaagtgtgtgagtgtttctgatcatttttttccctatagcatatacagcagtaactgtaatttgtatccatgtgaataaaagtgaggtaggaaaaacattttcatcccactagtcccagggcaaagaaaagctctttgctctccattttctccccctttcccatgaacatcttgactggcaggctggtagataatcctgtccagagttaatggtgtagtaacaggattgaggggaacctgacttagaggctttcatctgggctgggacatatcgatgccatatttaaaggtgtttgctctgttcacctccatgaagataaatgtctgaacatccagctttaaaagcaaaaagaaaagaggca

SEQ ID NO: 41079 - DNA, 1995 bp, Bovine  19866881092053
acttgaacacaagtagcctagttgctcagtgtatactctaaccactataatgtgtaagctcaataaggcacataggaacaaaattaactttaaataatgagaatgttcacattaatcagaaatgaactgaaacttaatagaaatacctcatttgtaaatgaaaatatgaatatataaaaatcaatttaactgaaagtacaagatttatacatggacaaaaatgcaaattttgctctagttcacaagaaatacttcaatgatcaacagtaatgctgtttttgaatgaaaaaaaacatttaaaagtggcaattatattaattaaatataatacatttaaaaatctgtttaatgaaattatatatgttggctctaaatccatgggaaaaaaatgatgagaaagccaaaacaaacgaacaaaaccacaataagaaagaataaagagtagaactgagctcataggttatctgtagtggaaaactcagaaaatccagagtgaaatccaagttcaagaatggactttcagaaaaaaaacccagacatagattcttgcataaacaatgagttttatataaaaagcatggcctttcaaattagtgaaaaaaggctacactattcaaaaaatgatatgaattcaattgtacatgtttagggaaaaaaagtatcttgtcatatgtatacattaattagatatttcctattcatctcaacgaaagggcaatggcaccccactccagtactcctgcctggaaaatcccatggacggggtagcctggtgggctgcagtccatggggtcacgaagagtcaaacatgactgagcgacttcactttcacttttgactctcatgcactgtagaaggaaatggcaacccactccagtgttcttgcctggagaatcccagggatgggggagactggtgggctgccgtctatggggtcgcacagagtcggacacgactgaagtgacttagcagcagcagcagcattcatctcaacaggaaacaaaacaatagagcaaaaattatatgattctttcattttactgttttctacatttttacattttatattggagagaacaaatgtttgactagtgactagtagtacaactagtcactcttcagaattctctagctgcaatatataacagttcatttttatttcatctaatgaagacaagaaaaggatgtaggagtatataaaaaagtctttgactttctacctctgtataagaaaaagatgcttcatagtatttattcatttgcatgggtgtctctgagtgaatttcaatgcaaaattaatgagtgttgaattatctgtcaggtacagaggatcatactgattattttatataaccaaaaactatcagactaaagctgaaaatactataattatatatacctctctactgaagactattcaaaacttattttgcattttaatcaattacacagttgaaggaagtctttcattgttctttcacaacatttttttaacttaaagacatttttattatttgaataaatgtgaagactgactcatatgaatgggtctctggattatagtctgtcatttcctagcctaataaggatctcaatacatttgctacttaaatttttctaaaataatttttctaattatatactgtggccagtccaattattgaatcactctttttttataataaaaaagggtaattgttccattgaatcattttgaatataaatcaaataaataaatatcaaataaataaaaataccctctctctgctaagccacttcagttgtgtctgactctgtgcgaccccatagacagcagcccaccaggctcccccatccctgggattctccaggcaagaacactggagtgggttgccctttctttctccaatggatgaaggtgaaaagtgaaagtgaagccgctcagtcatgtccaactcttagcgacccggtggactgcagcctgtcaggctcctcccatgggattttccaggcaag

SEQ ID NO: 41080 - DNA, 944 bp, Bovine  19866881223674
attaccagatttgcttctgtaaaaactaccactctagatgcaagacagaaaatatgtggactgaaaggtaaccaaatgtaagtgattaggatgctttcacaagcaagagataatggcagctcagactagagtagcggcaatggggataaaaagaaatgaagaaatccgcggactaagaggtaaaactgacttgtagtatgttgcagacactattttgacattatgaacaacacaacagagtaacttcccttaaggattctagtttggagaaaatgtgatacactgatacacatataaaatataacaccctaatagatatttataagcagagaaaagacaaataacaaaaggtaaagaacaccaggagttagtgagccactcctttagataggatgctcaagtaagagcttctttgaggagatactgttaaaatgagaagtaaataaaggataagatagagtcactggaagtttgagaggcaggacattccaggaagaaggaaaagcaaatgcagaggtcctctgatagaacttgtcttggtttattcaaagaatagcaggcaggccagtgtagctggagcatagcacagaagaaggttgaatgaaatgtagtagaattcactgtgataggaaacacaggaggataatgagtttggaacagaaggcaatggatgcaattttagacatgttgagtttaaggcacctttgaaacatctaaaaagagattttaagtaggcacaatatgtatatgcaaaactggagctaagagaagtctgagatcaaaataccaatttcatagtccttgtcatacagatggtacattaaactgtggatgtgaattatatagcctagagagaatacacagaaaacagaaaggagcaaaggatagagtcatgaggcattttagtatttaattgccagatagaggaaaatagccgtaaagaa

SEQ ID NO: 41081 - DNA, 1161 bp, Bovine  19866881237263
cactgaaggtctgactgagtaacagagaaggccgtgtgaagggagacaaaacagaagcataagcacagtgaggacaggaaaacagtactctaagctgagtacttgtggcttccaagtacctgtttccaagtctttccagaagccctgcagaatttccactcttgagtttcaaaagaagactctacatgatgataacaaagaccctcttatctgtttaactctctctaattagcttctgttacttgccaacatgtttttgtgtgccagagaatgaactagaaacagtactaatatgacactggataattgtataaccttagtaactctcagttttttatctctgaaatgaaaatgaaataattctggatgtttacataccagataatcatttgaccttaataactctcatttttttatcttcgaaatgagaatgaaataattatggatatttaattgagaacaatgactgcagtaaataatgctagaaatcctcaaatatcacacaaaaatcttttttagtattaaaagtgctgtcctttatgtaatgttgccacttgaaactatcccaaagcaaattgattgcttatccattcttaataacaagtagttgcttcagtcacctttgatgtgtagtttagtggggttagaagagtagtatatttcaaacaattaaagatttcctttgtgagatataaacttgttcaacagggagaacattaatttcactattatcccacttttactataaaaatcagttattctgcacatctttctgcaaaaggcagtcttaaaatgtggtttatttttaatggtatatatatacatatatgtatgtatatacacagacacacacacacacacacacacagccacagttttaccagtaatatttctgactcttctgctttccagttttcattgccttggacatgttatttaacccatgcaatgccatcatcaatctgcttcctttgtcctaacggggaaaaaatcagactacttgttgaaagaagaattcaataaaatgatctgtgaaagtactctgtaagtgataaaggaccgtaaaaacataaggagctagtatttccaattaaatgtatagaattcataatctgaggaatggaagcagctttcttctcgcctaccctttctctacaagat

SEQ ID NO: 41082 - DNA, 652 bp, Bovine  19866881251606
tttaagtttgaattctgaaaataaaatacataaattgaaagtgtaaactcagaggtgcatcctgtttccaaacacaagaattaaaaaatcaaaatgacagacttctgttaatctgcttaggaaggcataaattgttaatcaggctccaggcaacattgtttaataccaagtttaataaaaatctgcctggaggaagaagaggtctggtggccaattttgaaagctgggcagctctgtttacatgcttagtctctctagctctgaggacaccattgatagggtttcctttgaaattggcttcttttaacagagtcaaaattattaaacactatagcatgggatagaaaacttgaattttttcattggtgtgaatacacttgaaaaggaaataaattggaggagtatttatttaagagaatcttttgcagtttgtatgagaagaatttcacagtaagcatttattgagccttcactatatgcttacatttgctagtgatgccttcatcttaaaactgtgatcttgagatgaaagaagtgatattttaaaatcattttctcctttctctccagcctgtatttgttcattccacaaggcatcttgtaattgtatcatgtgggctttctctgtgcaggggactcaagaaaattttcc

SEQ ID NO: 41083 - DNA, 782 bp, Bovine  19866881276743
caccatatgcataactttgaaaaaaagaaacacatgtgtaaactccttgaacatactttaagtgaatggtactacttactgatggccttctgcttccaatttgagaggtaatttcatgggaaagaatgttgtcctgtaactctcctttcagacaggacatctgacagtgtcatccagcttccttcatgtctttcatgtattaagcctgtatctaatatgtgatgatttaacaagagctgaaggcaatggcaccccactccagcactcttgcctgggaaatcccatggatggagaagcctggtaggctgcagtccatggggtcactaagagtcggacacgattgagcgacttcactttcacttttcactttcatgcattggagaaggcaatggcaccccactccagtattcttgcctggagaatcccaggggcgggtgagcctggtgggctgccgtctatgggattgcagagttggacatgactgaactgacttagcagcaactatgatttaattgtcatgagcacagcacatctgaatctcaaaacattaaatcgtagtgtttgtttcaacattccatgtcctgctatattaaggaaatgtttctggtgaaataaattaattaacagtcagtcacgagggccctgtcattcggagtcttgtgccaacatgcaccatacaaacatgattaataaaataacaccctggagtaaaaagaggtcaatcactgcatcatggcattaaaaatgagactatggcatgtcaacaactttaattgagttaa

SEQ ID NO: 41084 - DNA, 1510 bp, Bovine  19866881388080
caataactcagtcttacatcccatgattcctttcagtaatttaatattattagtttaatatttacatgaatctaacagaagcccaaagtttttctagtaatcgctctctcctttttattgatagagtagaatataagtacattagtataatcccaaagaaaccaaagattgaattcatgtttttaataagaattaattttgaaaatgttaagctaaagtatcaaagaagttttcaagaatggatttgtattagtaatttttccatatttacgatttataaacatggaaacataataaaaaggaatgacaagaaataagcattaaataagaaaatacacataaaacccagaattagaattttttcagaagttcagccaaaaatagcctagagatgatcaacagaaccaatttttctcaaatacttgagtcaacattccctattttaaattcatgtgcaggtatggtatgctgaaagaagggacaagtgaatgcaattctggcatttacaattggaaaacaggagacctgagacagaaagggagtgcaaatgacaaaaattaaaatgaaataaaagtaattttcaggaaaaaagtcaagaaaccatgtaagaaggaacattaagggaaagcataagtggaagaaaggggaaatttccattagaggtgactatcaactgggaaatctcataaagaaagcagagaataacaacaacaaaatttaagctaatttgaactgctggttttactgccatcagctgaagaagttaaaagttttcattctcattataacaacatgaaaaaatgaacaaataaaacaccatgtatacctgtggcagattcattttgatatttggcaaaactaatacaattatgtaaagtttaaaaataaaataaaattttaaaaaaagaaaaaataaatgaatcagaatgtggcctgaatttagaacaagaaattccatctttaagtactaagacaatgtgtatttaagtgtacacatcccatattgggatttttttaaaaccatttcacattgcttcaaatgttttcactgagtaagtaaatccctgacttagtctaaggtagaattattttattttacacttcagaagtacttatattttagtttacctagagacacacaagtgctgaaatgactcagaatttgtaacagaactaggtgagcctttgcttctaagacagtaatcttcaaacttgaatccagtccagtgtagctgtggggcgtattatccttcagagtctctgcatcatggtgcaggactagagatggtgcatttataactagtttccaggtgctgatgatgctgctggttcatggaccacagtgagaaccatacttcttaagttgtctcgctcatcatctcatcctattccaatcctccatcacttctcagttgggcaactgcagtgacctcctaagttgttttattgcttctagttgtttaattaatttttattggcatacagttgccttacagtgttgtgttagttt

SEQ ID NO: 41085 - DNA, 1703 bp, Bovine  19866881457780
tgcttctcttaggtccataccatttctctccttttctgtatacaaatctttcagtgtcttgccatcaaatatcacccggacctaggagatccaaaaaactctttgagagtcaaataactgtctagtgaagcgaagagagcagatggtttaccactcttatttactctaagcaacttctttactttaaatatggctgtattctggaactaatgatactttagatggagttaccaagtaaaatgttaaatgattacatcatactacataaagaaaggatgagtattggggaaaaaaaataaagtaaaacatacacttattttttctttttaattaatgtaaaagataattttatgaagtaagaatagtaacaaaatcattgtttatagtatatataaaagctaaacaatgtcatacaaggaaggaactatgagtattctttcataaggaacctatactacatgtgtgattcacttttaaagcttttgtaaacacaggttaagatatttgttgttgttatttagttgctaagtcatgtctgactattttgcaaccccaaggactagcccaccaggctcctctgtctgtaggatttctcagacgagaatactggagctggttatcatttccttctccagggatcttcccaacccagggatcaaacccacatcttctgcattagcaggaggattccttgccactgaaccatcagggaagcccaaaatactatataatccataccaagtatagattgatatataaaaattacaaacccacaaattgcatcttcttaattaaaagatgaatacaagagctcctgtcttcagtgttcacatgaatccaaattatttgtctttaaaatcatcattttacagatgcatttgtgtgactaaaatcttactatattatatcccacatgaatattatgattatttcttacactgaatttataaaagtttatctttctacttttcataaaattttattaacatacagccattagctatggcaatgtatagagaataagcagtccaaaagtagtacctgcctgagaggaaattttcatcaaactgcagccttttaacctagagatatgtatttgagaacattttgtaatatattaccagtaaaagtcatgcatctatagtgttaataagtgctacattttataataaattgtgcagaaagcatgagtaaagagatgaaaaactaaatggcaatgtgttcttagaaaaatttatgatatatgtatatatgtatatattaatcacagaaaaataaacatcaaagataaagtgccatcaccattttaattaccatacatatgtttgtaatcactggaatttctgaagtgaatgaggaatggattatttttaaaagacacttcaaagaacacatgagattttataaattcattaaaattatttaaaattcagtgaaagttttaatccctttccagataaaagttgtattatactgcaaaatgtagcagtataatagagcagtatgtaaaaataatataattcacaaacttaaaatgaaaatttcatcattgattctctaaacatattcaaagttttttaataatttgactgaatctgaggtattgaataagaaaaatcaattactgttcataggcacatcttataaatgcatagcattcacatagcagagagtccacacaaccttatttaagttatgttgca

SEQ ID NO: 41086 - DNA, 719 bp, Bovine  19866881501211
attctccttacgcttgattcctcttctctgatgaactgtcctagggacccttctctccttccctctgagatttccagagtttaaactctgcctttgagtacttgcttgttgtcatggtagcctcactaattttacttatatttttccccatattttcccacaacctttgaatatatgtgccaaaggctatttctgacttaatgttgtaggcatgaaaatatttcttttcttggtctcttgaaaaatgttaaatggttttctcagcgtcattgattgagactgtttgtttatttccagggctgaaagttaaggccattctattttcatagaactatttatttaaaacaagcctgaaatcaaagacacctcatagagtatgcacggaatgctgtttaacccaagtgatcccaaagtaaataatttattggattactcaatagattgagaaatgaagtgaggatctgggtatacatcatctgccttttattttttaattactcactaaataaatgcatgtgctatgtgagtttagaagaaaacagggtattattgaaaagaagatatcatccttgtagtgatcttaggtggtcctaagaaagaacaggtcctgtccataccgttgtagcagagcaggcctgctatccatggttgtatggaggcagtcacatttgcatgtaacacctagattttcaaaacaacaacaacaacaacaacaaaaa

SEQ ID NO: 41087 - DNA, 987 bp, Bovine  19866881521956
ctcattctctcaggaccttaggggatcttttgctacactgctcaaatcccctctcggctcccctacatttgttaaactgaggcccagcgattacagttaagcctagcactgcatgctgctctaatgctgatcattaactgcctgtccagatggccccggctctcactgacagacagtaagtctaaattgttcatctccagtgtttcttgtagactgcccaatatgtttactgtggtccgttttcaggagggtgacattaagcagatctgatgctagcattctggcactagtcctgaggagcaaagtggcagatctaggcaggactgtggaagactcagtaaatgagaaagttgcatccgaaagcaccggtgttcccgtgtagccgactattttagtcatctgtcaaacaggtaggaattcaagcttagtgctccattcatgctggcctggagaagattagcagtgcagcaactgacacttcaaactactttcctttaagtcatggaagcaacgagcaagcaacaacaaaaaacatcagtctcacacctaccttaaggtcattctcataaatgtcagtcatgctgagaccggtggcgtttctggagacatgtgtcacgagggactagcagctcactcacatgctgcttaacaattgcattccccttttagaagttttgtgttaatgtctacgtgttctcacacttcttttagttccacctttctgctggctcagctatcaacttattcagtgtttatctttattttctgttcctaagggccataaatgctaataccaaaggtaactttctcatttttctttcttttgaagtatcagacagtaagcacctgaagacgctggatagctagttaagaaggcacagtcatgttctgtgtggcgacatcaaatcgcttagatatcagagtgccagttatgtgcaaggcacttggctccatgatatcatggaggctatcggctatcatggatat

SEQ ID NO: 41088 - DNA, 675 bp, Bovine  19866881597123
tttaattgaaaacttgcattaactataaatgatgtctgataagctcttacattttcacataaataatgaatttatgtggatttattatgtatgatatacatatattatataaattattatataatttatgtataaattccttctgtatttgtaaatttgtcttctaagttttcatttctgaccaagtttcaccttggtcaatcactcattgattcactgatttttttttttaatttgcatcctctgaacagaccatatgtcttttttagttgatgttttcatttatggtaaaacaattttttggtaaataatcttttctagtctgtcatatgcctttgaaagcttcattaactcttttaggccactagcaaattactacttcagtgcaccaaatgttccccttgtcacctaaaatagtttatgcagcttctaaaacagtctaacttggtcttaaaaaattggttaccaccaagaggcttactgtgaggaagaacagcacaatttaaggcacattattacttgcagtcattcagttgggagctgagagaatttgtgtttggatgcatgaaattatccatatcaatagtcaatatacgtgttctatcaaagaacacaatgccatttacctccaagaaaacagggtatgccaggtgtacatagagaactaaggactga

SEQ ID NO: 41089 - DNA, 716 bp, Bovine  19866881655409
tagacctgctttaaatgctctttttaatagtgggaaaatgatttttaaaaagtacattttactcactgtagcaagtaaatttctatagacattaagagaacttactactaaacttcaactgctatttttaaattttggaaaggaccaaggaattattttgaatatcaaataaatgaaattcagaaatacccaagaattcagaaaactaaaactaacattttcgttgaagaaatacttcttcacactgctaaagaagtctctgtcataggttttgcaaaactggtatagcacttttaccagtactctgtcaacatagagccagaaagtctagactttggtaaattacagtgtaattaaagtgttatgctttctatggtggtgccttacttgatgcaaagtctccacaggcaagaggcatttaactccatctctcagcctgtttttggcagctaccatgaccatctttaagagtctctcagctgctctggttctcctctttctggtctgatggtagaattgcactgccctggtgaaattgcacatgaccatgtgttttactttgaggaaggaaatgtgactggaggggatgtgtcatttctggtggaagctttagaaggcagagtgccattagctatattctctttccttctgccacagtaatagccacctctctgaatggaagagtctttatcagcttggttcccagaaagagggca

SEQ ID NO: 41090 - DNA, 693 bp, Bovine  19866881712311
tataatctaattggagggcaggtcaccacaatatttttcttttctctgagttctaatgagaaacatgcttttcatttctaggtaggacccagcttttcctcttttgtgccaacttcagctggtgaagtgctgtcttagctgtaatagcagactcttctccaacaggcacagacttatgttagaaggcgtagcatcctgtcgcttttcacttagcatttgcttcaaatagatggaaaaaaaaaaaaaaagaacgttctagcaattggatgttttgcagtagcaacaaaacctgtgtgagagctggtccttcactgtttggcttctctcttaaagatccagtggtatttcagattccctgtccctcataaccaacatcacaactttgtcttctctttctttaatttatgcataaatagttttgaggaataaaataaaataaatagttttgccacgaggaagaaaatgtcctaccatttggccctatcctgaaatttaaaaaattttaaattgaaacatgtataatatcatatatgaaacgagtagccagtccaggttccatgcacgatactggatgcttggggccggtgcactggaatgacccagagggatggtacagggagggaggagggaaggaagggttcaagatggggaacacgtgtatacctgtggtggattcatgttgatatatggcaa

SEQ ID NO: 41091 - DNA, 819 bp, Bovine  19866881734844
atgattttttgcaggcagtctgaaaaatatgcttcatgcaattatgatatgtgcagatatttcaaagattccaatttacagtcttcaaacttaactttagaaagtttttttaatttattatcagtttaaactaaattaatttggactactagtcttaaaaatagatattttcttgtcctttatatacatctagcctattctaccctcagtgaccttagataaaagattctttccattaaatggaacttggttttaaaaaaaagtattttaaaaactaagttagatgaataatagtaaacttcatcctatcatttttactattgaaacttacagctacagagggttgctccagactattctgcttttagagcgtttcatcaagtttggagggctgtgtagaagttgacatcatagagtggtgtaacgaatccccttcctgatgggtggttgtacaggaagcatctttggaaaagtaaattttgttttattcataagtgaagagtgtgtgatttgcttagtagaaaccataaatcttgaactcactagtaaaagatgcaggtttttatttatgtgatgaatgctgtactgttgtagtctatgcattagtaaacattttttaattgacagtcatctggaggggggaagggaagggtgggacaaattgagagagtagcattgccatatatacactaccatgtgtaaaatagatggttagtgaggagctgctgtacagcacagggagcccaactccgtgctgtgacgacctatagggtgggaggaggaggcgggagggaggctaagaggaagggtttatatgtg

SEQ ID NO: 41092 - DNA, 770 bp, Bovine  19866881761632
gttatcgacatcactgtgaaaaaatactttagatatttctcactgcatttggtcttgggaaaaaaggcaacttttatattttatgttttcattttaaaaaaatctctcttgctattcccagtaagcgtaatccttaagttgtcacatcactttgcctataggaaagttatgttggttatatttatggtgattaaaagcacttggtaatgtctccaagagtgtgtcattaatttgctaatgatgattctaagtctgtctttatccaaaattggtaaagacaacctattctgtatatgtgcacctacacgtgaatgtcagtgggtgtatatttctaacgttgattacagtccagctagtttaacacttgtttgccatcaccaaacataacacaaaataagaggcatttcctaaaacacacatagtacactcaggtaactacaagaaaaaatacacataaataagacaccgtgtgcttccttgagaagagtattgctatgggaaaacatggtttgtactcttgaaagaacactgacaaaataaacttttgaaatacaaatccttccgaggatggggactgcctgaaggtaagattcttatagcatggtgagagtagaagattattcttaaaccccagagctagttattggttctatttggtgtctaggtcacctgccctgtagttcgctgctctttctagtaaattttgctgcttttgttcctggcttctcacctaccaaatcatatttgacaagtaccacttaaggttacca

SEQ ID NO: 41093 - DNA, 1311 bp, Bovine  19866881842970
ttcccaaaatgccattttcattatagcacttctctgacttaaaactatactggtcacctattggatcaagtttaagattccatatcacctaatggatcaagtttaagattctaagtctccattaactagcctcagattgctcatcccttttttaacttccactaggtctcagacttatgccatctgctttattctttcaacaactcttgccaatttcaactctcttgctttatttatgctgcttttccaagtgagaaagacctgcctacttcttcctgaaaaatccagctctatccagtcattgagctcctgctaaggaagttctcatgaggttgattcttccagtccataaaatattctctgtctcaagttctgcagcaattttatttaggaagcagtgaggaaatatatatatatatatatatatatatatatatatatatatatatatatatatttagttagatgagtgaacattaaacttttggttcatctgtgctttttggcattcttcttatctcaataaatagacaaccaacttcagtacccttcagaattaagcctgagctacatggaatcaataaaggcaaatctttaaacaagactctgtttatttcatgtataagctattctctttatattttttttacactttttaaatttcaatgcctaagtactttcatcacaacaactaatgtataacatacacacaattgcaagatttcatataaaatacattacatctaaaataaacctagtgctcgtgctgtcgcttctgtcatgtccaactgtttgccaccctgtgggctgtaccccgccaggcattgctctccatgaggatttcctggcaagaatactggagtgggcgccattccctcctccaggggatcttccccatccaggaatagaacatgcatctcttgggtctcctgtattgccaggcaggttctttaccacaggcgccacccgggaagcccaaaataaacccagagaaggtctatatcacttagtagaaagcctttacaaacacatgccagcagaaattatgtaaattgtaaagctatagaaagttcatgaaaaaacatactttgtatctagctgctctaattctttaatcacatgtaacatattaaaggaatattttgctcctgactcatgattcaacttcacacttgcagtgtaacactgatatgagggaaacagagggaacaaggataaaagaatgttagtagactacaaaagtgtgttaattaaagaatgtatttatttaaaaataccaagaataatcttcccatataaaaaggacatatg

SEQ ID NO: 41094 - DNA, 880 bp, Bovine  19866881883117
ttctaattgtttcctccaattacagtacaaaggaatacttttgcatcttcctaactgaatcaggaattttaacttatttactttcacagactatgacctaggagtacaaatgctcacctaactaaaagcctagtggaccacttagcagaaagcttttccctctcctagcgcttacttatagaaatccaatagggctttgctcccctagctatcacgagctgctctgagctttcaaaggttgtcttcgtctgtctgataacatctgctccacactctggtcatatggtagcccttaggaaacagttctctaaggcagaagcatatttcataagattcatatgatttacaaacaagaattttaagttctaattagtactttcagggtgattcatgcaaaagaaagatttctgtttgcatgtcaatggaaacctgctgccttagaaacccttgctaaactatatgattaatctttgtacatgaggaaggatttattttttcttattcccagtcctcaggaacagattcaacaactttagtgtcttagacatttaaatatccatgagtcttgcactatgttttaggtttggtatgtggtatgaggagacaaaaactcctagtaagagttccttttctttaactataatatcccaactgtttctctccttgtgtgttcctttcctactttcctctctcttgtctttacctcctgtccctttctccttcctctgcctttccttctgcagtattatatttcttttagaaatatttatggccagtacttgttgtatggtaactttgattttgttagctcttaagctagggtgacttattttcacactgtgtaattattaattaaaaagatttattttaaagttcttta

SEQ ID NO: 41095 - DNA, 1620 bp, Bovine  19866880473676
ttggctttccacttccatttggttatagaatctattttagtgtttcactatatagaattcatctctctctctgtctctctctgcctctgtctctctcacacacacacaatacatgtatagataaacttttcactttttcctgaatatgttctctttatttccattttattgtattttcctgttttgtttcattcgttcaaaatacctctttattttaccctgccaactccttttttagaatctgtttcatccttacttataatccaaacaagtttttttcatgaacatttctcacttgtttccagctggatgttaatgtgagatgaatcagcgtagtgtagttgtcaagaaagcttattggatccattctgcttaagttcatctctcactttggcatttcttacctgtaagaggtagcacaagttgcttaacctcttttccagtttccttatcagtaaaatcaggacagtaaatagtatattctataagaataaaattaaaagaacatgtaaatttcctaacatggtgactggtaggtaacaaatgccccaaagctatatttattaacttctgcaacacaaaactctctctatccaaaacactatttgtggagaaaatatttgaagcctgagactacaaaaagaaaaaataatcacttttatgataatctccaccaaatagaattaataaagagatacaacattccattcagtagcttccagtctcaacataaatattcaccctcttgttcctgacacagagtcacaaagtggtaatttggtatactctgggtgacttagattgggtaaaagtggttttttgtttcattgtttggttggttggtttttgtgtttgtttgttttagctgttttgtcactctgctaaccctgttattagctaatatctcattgcacaaagctttccttcatatttcctgggtataacttctaagcaaatacttaatatatacactcctgacattattcacatggtaagatgtacaataatagaaattaatcagatgtagacaacattattagtacaattagcaacaatcattagtgttatacaaatcccttccagaactaacaccccaaaaggatgtccttttcattatagaggactggaatacgaaagaaggaaatcaagaaacacctggagtaacaggcaaatttggccttggaatacagaatgaggcagggcaaaggcaaacaaagttttgccaagagaatgcactggtcatagcaaacaccctcttccaacaacacaagagaagactttgcacatggacatgaccagatggtcaataccaaaatcagattgattatcttctttgcagccaaagatggagaagctctataccatcagcaaaaacaagactgggagctgactgtggctcagatcatgaacttcttgtcaccaaattcagacttaaattgaataaagtagagaaaaccactagaccattcaggtatgaactaaatcaaatctcttacgactatacagcggaagtgacaaatagattcaagggataagatctgatagcatgcctaaagaacaatgggcagaggtctgtgacattgtacaggaggcaatatcaagatatccccaaaaaaagga

SEQ ID NO: 41096 - DNA, 3315 bp, Bovine  19866880800883
cgtccggatgtttcttcctcttctttgggggtcatgaatgaatcctgtggccccacggtgaaactcctgtgcttctaacccttcaggtgtgcaccttataaccatgtccagctgatctgggataaaagccttaatctcaccatctctaagtgaagaggattttgaagttgatttgaatctagcttttcattagaatgttaactgattatatactcaaaaagaataatgatactaaagcagaaattcccacatctctatagggtttttgttggtagtggcattaatgccaccctaatgagcagccataaaattaaaaggcgcctactccttggaaggaaagttatgaccaacctagacagcatattaaaaagcagagacatcactttgtcaacaaaggtccatctagtcaaggctatggtttttccagtggtcatgtatggatgtgagagttggactataaagagggctgagcgctgaagaattgatgcttttgaactgtggtgttggagaagactcttgagagtcccttggactacaaggagatccaaccagtccatcctaaaggggatcagtcctgggtgttcattggaagggatgatgttgaagctacaactccaatactttggccacctgatgtgaagagctgactcactggaaaagaccctgagtctgggaaagattgagggcagaaggagaaggggacgacagaggatgagatggttggatggcatcaccgactcaatggacatgggtttgggtggactccgggagttggtgatggacagggaggcctggcatgctgtgtggttcatggggtcacaaagagttggacatgactgagcgactgaactgaaatgaactgaatgaatggttgccctttgaggctgttttcatccattattgaaatcttgaaatgctgacttgcttcataggattctaatgatcaccaagcaaattatgtaattaacagggaaaaaattctccagttgtatggaccattcatattttaccaccatgatcctttttttttaaatttatttattttttaatttgaaggttcaagagagaggggacatacatacacctatggctgattcacgttgatgtttgaccactgtgattctcaatgggaacttttcataataggctggtgttcaacccggagacatggattttggtttatattttttcaattctgggccacttaatctttaagaaacaaggtgggtgggtgatggggaaaaatgaaattccccttcaatatttggttatggggagtggcaataaaaaagctaacatgagctctggaatggcactggggcctgcccttcaatatcccatggccttggattcctgggaaggtgggcaatggctttgtgagactgagcaaacagctgccagcctcagatagccgcaaatttatagcttttgaatgcaataacattaacacactactgccgaaatatttatgttggctttttaaatatcccagaggaaatccatccagaagcctatgaaccatgtatattctccttccttagaaatttccatgaaaaaaaaatgataaattacatttacactgaggacccctccctgctcctgagtaaattccacacatataaatcaggcatcattttcctaacttctcttcctcaaaggcacttgaaatttacagggtagaaaaataaaggcttcctttcatcctcagagcagagacagaccagagctccctgaagtctctctgccaggacaaccactctcagtccctgccgctctccccctcatcgcttctctgtgtgataagagcatttatgaggggggaaggcagccaaaaaggtcacagctggtgtgataatgtcaccttccttatcagtagcttctccagaatgacagaaccttgacttgcacagtcaggttaagggaagcaggagtgaaaatctcagggttgatccatgctaaaggtgaagcagaaggtagcttatctctttggtaatgccctttggtttctgcacttttggtaatgccctttggtttctgcactttaaggacacatagggagacgcctgccccaggtgagccccaaggcttcctccgtggtaaaaatggtttatagtttggaggtacaaggatcagcagcaccaaataattcatggggcaaataatctactcctagattggcgagaaaatgtcctgtctaaatatctaagacataggttggctctcaaagtactttgcatttaattacatctattacagaaatttcccgagctctcggaataaagtaatcgatattaagtgtgataactctaacatctaacaaatattaggcatacagcttttctcatagctaagcagttagtgggtttcccttgtggctcagctggtaaagaatctacctgcaatgtgggagacctgggtttgaccccagggttgggaagattcccctggagaagggaaaggctacccactccagtattctggcctggagaattccatggactgtatcgtccatggggttgccaagagtcacacacaactgagcgactttcacttcacttcacttcaagcagttagtatttccttaaaaacatagattgcaggacctcgtgctggctggggaattggcacttttaacaagcgcttcagataatttttatgattagtcaagtttgggaaaaactgaacttctttatgtctaggttaaagtggtattcaactgcatgcatccttaggccctaaaagaatcagtgctcctcaaacagcaaatacccaaataaacaaatcaagatggataattcgatccactttgatagacagtgtgattaattgtgatccaggaaggctaaagaatcttgctgagacatggctagggagacagccccaatatcatgattttcaatctaagtgctctttttgttgaaaattaatgatttaatgggttaaaaaaaaaaaaaaaacaaacctgcacagttcttaaagaacttgtacacattagcatctcccaagattcaaaggcctcagtacttcgcagtatagccagctcccccttccctggtgggtactcacgctggtggaggcaactgcttcctgcacactctccataatgaattccttggtgatccggcgagagggcagctcgttgaagagggagttgattagggccactttagctgcatcccgtctggcctcagctctacttaagcagcacttaagaagggaaggagaaaaggagtcgttaaagaatctggcatctcatcattttgccccaactcaatgggtctctggacatttatttctatttatacatttactgtc

SEQ ID NO: 41097 - DNA, 961 bp, Bovine  19866880810059
ttttcagtaaagatacatttggcagagtttaaatactaatagtgtcagaggaaaatttttcaaaatggaaaaaaaggaagaggctttttgatcacttaatggcaacatctgtcttaatacatttatttcttaatatataaataagatttaacaaatcaaaaagaatattgattgacaccaaatcctgtgatcaagtctgttgcttctccatggtctgcagtctcatctcaccataggcttttttttttaacagttaagatttgttagcctgagctcaactttaacaacctctgaaactcatgtgttaagttacagcccataataggatacagctgcacaagggtgagtttctaagttacgatttttctgtttaaatgatacggttttactgattatgtgctacagattgatttaagaaatgtaagacaactttagaagcctttcataaaagaatcttctttattgaatacatttcatattgacattttaaccccaaaggctcttattccctttcttccatgttcaaatgctcacatcagtttaatctgtcaaggtagtttttaaaactcctattttaaaagaaaaaggggggaaaaagaatcctactgaaagtttaataatgataaaacaggcaattattacagtccctgtcgttttctacattctctttctggtgtccttggaatcctgtttgcactatggtttcgctttgtttttcccttcctctgcgatgataatcagttgatccctattttgatccatcccattacacagctgtgggaacccatcatttagtcaccactcctttggcacttacgggctgcatagtgtagtttccgtttttctcacagggctctgccccatgagttatggttttgctggcatgttttttccacatctcagttgcgactcccaggagggcaaagccatacgttgcacttctgtgtagccaccagaggcg

SEQ ID NO: 41098 - DNA, 645 bp, Bovine  19866880855997
tctttggttccgggctctatgctttccctgaaacagttgacagttttgcttttggtattaaataacataggattagtctgcctaagggaccatctgttgttccatgcctgccatgacaattctgggtcctttagaattgcagcttgtggtttcttattaaggggagcagaagagcattctctatcaagagtctaagcctcagaaatgttgtccattctgaatgaatcaacatataactatgacatgtgtcaagtaagacaggatgtttttctttcattttatgtaaataaacttgaggttttaacagatgggaatgtaagtttgtttgtttgttgttctttcattaggctgtgctttataatgtggatatattattaaatgcttcaaggcagtttctcagttttgttttataagttactgctgatatttctgataaagctacaagtaaaaatgaagtcctacttgttatatgctaactagtttcaagcaaatcagcaatacttatatccttttaaagctataaaagaaaaaggctgtcttcaacttcaaaaatcctttaacagagttttaaaaagctcgaaagtataataagtgcatacaataaggacgttacaaataagcaaaacaaattcatactgattcagt

SEQ ID NO: 41099 - DNA, 1666 bp, Bovine  19866880881123
ggcagaatcgatttatatactgtggtaatcttatttctcacattacttgaccatctaaacaagcccaattgtgaaatatgacagaacattttcctttatgtgtttgtattccatgatgcaattgagcataatcaaattaaggttgagtattttttctcctgttctgtcaattccatgtcatcctgtctctcaattctccctttctggacaccttctagagaatttaatctgttcctgctattttatggttacctaaaaagcaccctgatactcagaggtccttctactcccagagtaacgtgtcttcgaattattatttataagccatagcattattaatctcttgtagatgtttactgcatattagctaatgggtaataaagataatataaccataacattcattagtccccaaactttttcttctgagtcactagtctgtttttgtcttcaactttcccagttgactagaggttctagtgaacatagctgatgggaactataactagacagactgaaaagtagaaattggtccccaaactgcaggcctgtatcttttccttgtttcgtatgtgtatctgtcacagtatgggggaaccttgggtttattctaaccgtaggaactgggtgcccttgacagcttatagtccttgttagttcctctgcttttagttttagtttttcagatactgacaactgatttatttttcttttgagtaacatccttttctctttcatgtaaggataagagtgttataacaaatagcagagatgttgtcattggctaataaggaaaaagatgagcaacaaagtctgtataaaaaaaatgattcttgcttttgcaggtattttgacagagatgtgaaatgcattagagatttcttcatgaaacgtttcaactatgaaagtgagcttttcccaacctttagtgatataaggtttgtacactgtattggataaaatgatagaattctgttaaaatacctgatttatttacttagaagttaatgctttaatctaaaagtttttcaaatagtgacctgtggtacattataatcattgttcagtatcactgctggtaatatacaaatgaaacttaaaaactatgcttccctgtggtccattaaccttactgaatttggaagaggaacatagtttcttataaattcaagaactcttattcaatagtggatgctctgtgaagaacgcgtttttaaggaatatagtcaagtgtttatcagaaatgtgtttttcctttattcactatagaaactatctttaattgattcatggaacataattctcacagccaaattttctcattttatatgctcaattaagatgctgttttctgatttgggatgattgacctaacttaaaattgttagccccctctgaaagttaatttattaagtcagtatgcactgaaatttctctaatttttctaatatctgttgctcttcgcagtccttttattcttaaatgacaagtaacatatgtcttttatatttgtgtacttaagtgatttaagtattaccttttagccagagaaaaacctttaaaatctataaactgttaaactcatttgagagtcatgattcatccgaatactaaatacacttgcccatgtcaggggatttttttctctctcctaaatgcgtaacat

SEQ ID NO: 41100 - DNA, 1952 bp, Bovine  19866880928161
ccatgcaacatgaaaatggcacaaattctgctagtggcataaacttataggttcttaaaaaatatttttaaaaagtaaccagggaatgacgaaatattcatagggatttttgttacagtgttatatgtaaaagtgaacatttggaagcaatatgaaagtccagtgctggaggactagttaaatcaattatagaatacccaattaaggaaatactgcatatttgttcaaaataatgtgtttatacatatgtgtatgtatatatacacatgaaaagatattcataatgtactgctaagtaataaaagcatattgcaaaataaataattgtaatgtgaccacatacttggtatacatgaacagatcacagaattaatgttaatgtatacacatgtacacacaaccaatagcattagtagcttatattgccattctctaaatttttctataagtgtatattttgctgataaaaaaaacatcaaaaaagctgtatagatgtttttggaagatctgtattgacaagaaaatgtttatgatataatgcataaaaaagaatacaaagttatacacacacaatgatagcaagttgatagaaaaaaatattttgacatagagaaaggctgttaggaaatatactaaaatattcacaatggcgatctctaggtaattttttccttaagatttataagaatcctatgtcaagcatatattatctttagcatacaaaagctattttaaggctttttatctgtattgttctacctatccccctagctgaattggttcataaactcaaagctggtaagacaattgattttttgttttttgtttcccctttccacatcctccactgctatcattgtgaaaaagcttgcagctaattgatttcccacttcgtctttgcgtgtctccaaagcccacagtcttatcttcaccccagcccttgttaccacttgtttctctgtctcctctgtttcaccctgggatggttgttataaaatatgatttattatcctgaaatatgagcactaatcacaacagagaaaacacgatgcaggcagaagtagaaaagtctggactttaataatgcaaagtcgaacactgatataccaaagggatttctatgtagaaaggatattatccaagaaaaaaggcaaagatgccgtctttgactttctgatgggagggggtggggaacaggagccataattattaagacctggcaggagggagatacagttctgagtcacaaaactagattaggtcctcaaggaaatctgtaaaattaagtctataaaagctggcccagctggttaattagcacactgtacagcagattatgttttatagtttgatttttatattctaagctacaacctaataagtcaagccaattaccttacctgtgacttgacttctttctcttatgagctcactaccaatcgctaaacttgcatttatttacaattagggccacctttgttatacgcgtagctcctcaaacctctgtgcgaaaaagcatcagcagacaaggaaatgcttctagaatggctaacccacaaatgctacgctcagaactccactagtgccagccaaaggaaatgattcatttattaaggttgtaattacagctatgaaacagcttgtcatgggttctttctgctggcctgagctactttctaacatctgctagtatgagcgagaaaggcactgacttattcgtttcactatccttcgactggaaaaatgttatatttcagagggtttaggatatttgttcagaataaacaagagatcaaatgttggggggagggcaagatttgaccagtatgagaacttgaacaggactatactttaagatcttgtgacatattttgattaagaccaaaaaatgcatgccattctagaacaggctccattgcccacgagtttcaagctgatgatgatggtggtgg

SEQ ID NO: 41101 - DNA, 850 bp, Bovine  19866881048393
cagctaaaatagtttatagagagaaataactttaaaacttgtattcaaataaaaacatttaaaaacagtggtctaaatttttacttttaaaagctagagaaataaaaagaaattaaaccctaaggatgtaaaagaaaataagaaagacaagagcatgaataagtgaaacagaaagcaaacagaattaacaaagtccatctaaaaatttcattgcatgttctgcacattcagactatcagaatgaattgctcctcatgtggtatattgtgaggttacatatacccagaattacaggaatgatttattcatactacttttgaaagataacattgtattaaaaaatgataatgatttcagttatagtttactgaatccctacaatgggcagatatatttgaacacatttattgttaatagaaatactgtaaagcatatatattttcattttccaaatgaggaagccacattttggagacctgaagtagttttctcaaagttacccaataagtgatagaaataagattcaaaatagacacctttggtccccaaaccagcaccactttttctataaagctaagttatattatctattgatctggtttgtctgtctctttttatcacaattctttttatagttcttttctcatatgatatcttagactctcttggacattttatttccagtctatagttcagttctttttttcagtttattattttttggtgatatcactgaagttaaatatacttaatatgaactactttggaaatatctacagaatttcattattggacagttaatggttactttcatatctccataccttcaaaatgtcaaaacctaccttga

SEQ ID NO: 41102 - DNA, 807 bp, Bovine  19866881131281
atgattttttttaaatgcagtgggttagtctgccaaatataaggaaggcaaaaaatttttttttaatttttaaattctgtccaagtactatgaaaggctgtactcaaccaccttttagtaatacttttttttttttaattgccttacgatgggctgcatgtcttctgtgtggtctgcgtagtaaggtatttaagaatgtgaaataataatttgactcatattgtggaaatgcttcataaattcttgtaaaggaggctgggtgccggatgagagacagaggtagaggaagacatgacagcaggaaaaatccgaactccctcctcccagtagggatgctggcaacccacagggagggccatgaagtacatccctcttccttcctccagccccagcttgcctgctggtttcctacacattcctccgtggcctgggttaaatgcttcaacttgtttctgctcataatgggaattgaccacaggcctgggctgtctgcagtcaacacagcaattcagtccccctggtgggtaatagatgtgtgtttgtatctagctacggatgactatacagtctaaaaacaagcctggtgtctcctgactgccctcaggctttccaggggggcctttaaggaggcagagctcggaagaaacctgatcggcttctgcttaccttcacttcagggcgggaggctggggtgcctgcttaaggtagccttgcctctctccgtagagaaactgcctcatgtttgcaggggtggggatggtggcagctctagccactgggtcttgtcaaggtcagattcaaggcaga

SEQ ID NO: 41103 - DNA, 1178 bp, Bovine  19866881194176
aaatatacttcaaggatcatgacacatttccttccagtattgcacactatttcatcatgcttcctaatttcacatctattgcatcttgatacataattaaaactttcattttaattcccttcagtttaaatatctcatcacacacacatacaaacacacaaaggataactgtgaatagagagaagattacaattcactaggttgaaggaacactattggagaatgctgaatttaggtacaattttaatattgataggaagttttttgaagagtgtataattctaggatgaactgaaaaaatcccagctatatttaataatattaatgttcctatataatctattatgcctatttaagaacatttaatgaataacatttatactggctgagtaacataagcatattaggttttacagtgaacataacagaaggctaagctctattcttgggtctatttaataaatattgacttcttgcttaggcatttgacaagatttattgacatggcaatttcatattttctgagaaggattaaaattttattaggtcccaaaactagaaggcaatgtcaatactggtcttggttacatgcatttatcatgaaattcattcaaacagcagattccataaaacttttagccctgtttcttttcatagaaagaagagagacagccccattcaagcatctcttttcaaaccagaaataagcaaaggatgtccaagtctggatgcaataccgaatctaataacagggccctgaaggaaccagacctctcgaaacagcaagggcaagaaaggggaaggacaacagcagtgcagtcactgctctgccaagtgagaacaggggcccatcactctggcccactgtcacgggtgttgcagaggaaaacactaaactgatttatacccatgaacatcctctctgagctcacatgcagttgtcatctaagggggataaggaacatattagaatattttgtttgtctttaatctcctacttcacatagaaaaagaaggaaaaaaatctaaggagtacttgaaatgttatatcaaacaataatcaacaagtagattaccagcagaaaataaaagcccacaggtgagagtacctgaaaagaacggagccacctggggctttgatttatttgcctatttgcctgggatgatatacacaaaga

SEQ ID NO: 41104 - DNA, 926 bp, Bovine  19866881343169
attaagagctctgttagcaataggttgtttctcaaactgggccacatgggatacaaggacgatgccaggagggttactgaagtcacagaataaactcaatacctctttctgggttgtcgacattatgtgaagattgcaggatgaggaaaggagtggagtggcattcgttgtcttctttaaggaaacagacatatacaataaaatgcaaaatttaagaggagtcttacaataaaacatttgtcaatattgtccctcctgtaacaccacggagactgcttcatatcagaacctaaacagcgttcctatccatttctttttatgtctgcaaagcattcggtgagtaggcctgagggtatagcaaggagggcaacacaagtttgccttcctcagccactggggttatcttggtaaaaggcacagtggtgggagccagatagattatggatttggttgggaacaaaagattctcactttcccaaagcagcacagtgctgtgacagagtggaaatctggaagggggcagagagaagtggagaggagccataagaggggtgagttcccctggcctggacccaggaccctgggcatgcagacatggggtcagtatgtggctcagctggtgtccatgtcagattctaattaatggaaacacatggttctgcccttaccaaggtctctgtctgttcttgggcttccctgatggctcagacagtatctgcctgcagtgtgggagacccgagtttgatccctgggtcaggaacatcccctggagaagggaatggcaaccctctcctgtgttcttgcccggagaattccatggacagaggaatggtgggctacggtccatagggtcacaaagagtcagatacaactgagcgactaacaaagtgtgttcttgtggtgcttactgtgtagtaatacataca

SEQ ID NO: 41105 - DNA, 981 bp, Bovine  19866881343457
aggatccttaaagtttaaacttcattatttaaaccataaattcacccctattttggacataagttgtcaaatggctttgaaatatatatacattttattgaaatataataatgactacacatagcttcttactatgattgtggtttttaactaagatattcccttcaagtccttcaaacaaacttcttcttgccttaagaattcaattccagattcaagtttttcacactaaatcatttccatttccattccatgggaacctttaaagcgtaatatattccgatcactgacgtcataccatgctaaggtttccaattctcatcctgaaaggaaaagcaaatgtggagctttttacttctccttttcttaaaagtatgatagatctttcaaacaaaaaagcctctgaatcacaaatctttataattactgcagaaaaggcactttttatatattgtgttatattccaataatggtaccaatggaaataggtaaggaaatgtgtctaagtttaatttttctctaaacatcaatttcctgaaatatcttagttatgcaatgagcttaaaggtaagttcatcaactgtagttcttacacagaataaaatattacacacaaatttcttcagaggtcttgaatacattgttatcatcagtataattttagatttattttatgtttatattattaaattttatataattttatttttattcagtaacaatagctaccaacattcccttcaaataactcacctctttgtttttaattttaagagaaaattatacatatatttaattaaggcaaaaaatatgaaatttaattatcactgaaaatgtcatttaaaattctaatttttcagttttaatggaagactaaaatacccatccatgcccagatgtctatcaaaggtacatttctcattccttctaataggtagtcaccaaaaatacgtaaaaaacatttttagaaagggaaaacag

SEQ ID NO: 41106 - DNA, 1755 bp, Bovine  19866881537455
cagattctcataggttacctttttagaaaaatctttggaggttgaagacaggttttaataaaggcttacccttccttctagttagcattaatggtgcctttgatttcaccctatgaatatgcgtccctttttattgatgaagggatacgaagttgactatggaaacaaaagtgatctgtttgaaaacaatctagcttttaggaaataaatctatgactttccagaagtttagaaaatgtgtgttaatatttgtgctcatttgcagtgtagccatagagtcacagatgttggatctaaaagagagcgtctggcacacacccctaattttttagatgaggattccaagtcccaagaagatgagtgactttctcaaagttacacaggtcacaaaaatcaaatcccagatcatagtaataccaaatgcagtgttccttccaccactgtacacatctagagtactactggaatttaatcccattgaaaagtccattattgattgaaatcccagcgttaatcatttctaatttttctacttttagattatcagtcttctccgagaattctgtactttttgttgttcttgttcttgttcttccaatgggaatgtttccaattcagttatcacactgaaaatattatgcattcatttatacttcatgtccaatcaatatattaatagtttttcatctacaagccatctagtttctcttaaattataaactagatggcagagacatggaagattttgtattacagcacatgtaaagtacacctgtgtcttaacgtgaagtgtgatttctttcaattgattttctttataatatctttgcactctgaggcagcccttgtggaatatacatattcctgtggggatttactaagtgacagtccttataataggaattactattctagtctcattccttctgtttccttttattaagcccacgtcttctaccaactagctgaagaaactgatcacatggaaaacattgtatatagtctttaaaggactgcattcagttaatcgtatggtacaacatgatgatggaatctggaaattggaaagcaacctcttgtgcctaccctggaaaaatactttaaataaaagtaaagaagtcctaaataatccttcaactaacgtaggttacagccactgaaatcagttcttttatatctggtgtaaaaccttattactgcagtggaattctatgacatgtctcctgtgaaaagactatttaatattgttgtgagcagtgtaggacctcaatagaaaagcatctttgttttcttcacatgttttcataaccacctatattctttgaaacatatacttttacttctccggaaatttttagtataaaaagttatcatgaagagaagtgaatgatatcagaattcattaaaatcaatcttgagaatgatttgcctcgaaggataaagagggaaacaaatgttcccaggcaaagccaaaagacagactatgaaattttacttgccactgcccatcaaaagtgactataatttgggtggatgaaaaaattaaacactttgctcccaaagagatgctcctgaattcaaactgaaagcatgatctagagcctggctacatccacaatctttatagtgctttttctttaccaaagaagagtttagattatatggattctaagctggaaattcctttgctactaaggaaactttcttgagaaatcatctcccgattctatttacccgaagacagcacatcagaag

SEQ ID NO: 41107 - DNA, 1023 bp, Bovine  19866881803347
tgtttcttttatctattggacatgtgtagcaaattatttctctggtgtctgtccatataatagttatattttaatacacgggcttctgttttatttacattatagatcttcattcatcaattctttattcatttttaatcattccttcatttattcaatagtaattatgaataatgaagtggatctctacctttaagaggttcagtgttagtagaaaagatacatatgtaaatttagagttacattgcatttggataagtgctatgatagatttatgcccagagagctttggaatcttaaatgtgagacacctaacaaagccaggtttcagaggattgtcagtaaagactctccagggaaagcttcactggagggtgtcttgaaaaaataagttaggtacatgataaggagaagggggttatgacaaggagaaggggggtattttaatatgcataaaggcaggaagcaacatgtcatgttcaggaaactgcttgcagcatgccaatggggttatggtgggaaatatgatcacaggtcagattatatagaccctggtacatgtgaactcttgtctttgatgcgctggtcagccattgaaggactttaagctggcagatcatgatgagaattgtaatcttaaaaggtcattctagagtcagtcagttagattggaggagagatttaaagtaggaaattattatagtaatcaaaattggatatcataattccccaaatcagatcaacagcaggaaggaaaatgaggaggggacagatttgaaacttatttggaagcagaactaacaagacataatgacaaattggatttatgagataaagggtcttagaatgacgtagaactgtttagcaaggtggacagtaatttcaagatgagatatacagaaggaggaatatacaatagctttttttggtaaagcagttgggttgtaccataaaataacagtgaaatcatcaacaaataagagggaaagaatgttgcattttaaaagaacggaaaattttcct

SEQ ID NO: 41108 - DNA, 1997 bp, Bovine  19866880449930
tgaaaagtgcctagcatagcactttgtaccaagcagactttcaaaaatacttgtttccttcgtatgtgatgtgggtaaagtgccatacaggcccattaatgctgggtgagacctaaataaggtttctcagttggcacagcaaaacggcttctcctctctgattccctcgcaggccatcaccctattccaagacgactttagctctgcctcttctgtgttatcctagcatttatgtgacctagcctctgctagaacacttaccatactcactgtactcagctctatataactgtgaccttcttgagggcagggccttgttcttcacacctctccaggctccacacttcagtaattatctgaatgaatgaatggtctcaggcctcttctctgttccccagcttttcatgttgagaaatatgcttacttattttgagcatgggttttgaaatctgaccatccagaacttgaacccagggtcaactaattactatttaggtgactttaggcaatttcttatctgctccacacctccactcccttgtatgtaatgtgaggttaataatatctaaatttcagagaggtttgtggaattcagttagataatgtatgacatgtggttaaaaaatattggtcatttattaagtgcttcatcagttggaacttacttttagttggcatactaatgtatacttagctgtgaatggtaaatgagttctcaatttgctcttagtcctagggtatctataaagctcaccttgggtctcataaattaaacacatttgccttagtctttacaaataaatcagaaatactgaaattataggtacttagagtattttggaactcagtgaccttggagaaacatcaccccatgaatgtcatcaacgtttcttgaggctgccaatagcattaatatacccaccaacaaatatttccagagtccctaccacaccagtgtaggtggagctgagaggaggggacagatggacaccaagctgagggcagcatgatttgcaccttcaagaaggcttaagggaaaataaaagaccaacgcagatagtcatttcacaattcagaaatactctgcactccctgctctgagctcccatagtgccaggacatacatttctcacgatgtactctgcatataagttaaataagcagggtgacaatatacagccttgacgtactccttttcctatttggaaccagtctgttgtcccatgtccagttctaactgttgcttcctgacctgcatacagatttctcaagaggtgggtcaggtgatctggtattcccatctctttcagaattttccacagtttattgtgatcctttagatattatggttgtaaaattctggaggagttattcaagctgaacctttagcagtgttttttctgagaccctacttggctggtgacctaaatacatgtttggtgcctcccagcccaaagcacagggtccaggcctgatgcttctactttagtgtccaggagagggcatgttccctctccatggaggtttgttgaatgaatgcttaactgtgtgtttcccagtctcattgggttgctagataaaatgcaagatgcctaataaaacttgaatttcagataaatgatgactttttagtacaagtatgtcccatgtaatatttaaatgacatcctgtgtttttgttagctaaatctggcaactctgccctataggttaggaattcacagaaaggaaactgagtgtggcttgtagccaaagaagggactaacctggaagagatagaagttgagcagactcaggagggaagcataaatattcatggcaccccctggagttctacaaccccacgaccctgagagatggagagcattcccaggtggtactagtggtaaaaattcctcttgccaactcaagattcacaagagacacgggttcaatccctgggtcgggaagatcccctggagaaaggaaaggtaacccactccagtattcttgcctgga

SEQ ID NO: 41109 - DNA, 1810 bp, Bovine  19866880495466
tgtattggttatttaagattttctccttatattggtttgaagcaatttaattttgatgggccttgatgtagtactttgtgttcattgagcttcttagatctgtgagtttatagttttcatcaaatttggaaaatttgggggtattattcaaatatcctccccatgtcttcaagtcaattaatcttttcttctgcagtatctgatttgcttgttaattactctccagtgatttctttttcatcttgtacatatttttcatttctaaaagttttatatgggtcttttttttttcttccatgtccctatttaacacgcccaagctttcctctggccccttgaacagacagtactgttttaatgtgcttatctactaattccgtcacctgtgtcattttgacattttcattgatttctctcattttgttatattttcctgcttctttgcatgcttggtaagttcttttaatgtttatttttatttatttggctgtgctgggtcttcagtgcggcacgagagatcttctagtttgaagcatgcaggatctttggttgtgtcttgcaaacgcttggttgcagcacgtgcgatctagtttgaacccagcccccctgcactgagggcgcagattcctatccattgaaccaccagggacacttgcttgataagttttgattggatatcagggactgtgagtcttgcctggttaactgctggatatttttctatttgtgtgaatattcttgagctttgctctaggatgcccgttgttgcatgggaaatagattgagtctttcgagtctcgcttcaagctttgttgagggggaccaggacagcatctggtctagggctctctctacctaacaggctttcccaggactgaggcaagcctctcttgagtattcctctcagtaccccagaagtaagaggttttccagtcatgttggtgggaacaggaactattctcaattctattatgagctctgaggattgttccttttgatcatttcaagtggttctctcctggccttgagtaatttcttcacaagcatatgccagtcattactcaagggagctctcacggggagctcggcaagtctccagctcactttctctgtgcagccctcttttctggtaccctgccctatgaagtctaaccaccttggcctccctggacttgcagctccatctcctcaattcagagagaacgctgggggccgcctgggtccccctccctggacgatccccacacgggagacaatcttacagatcaccacctgtttcctctctttcaagcattatggtctttctttccttgggcttttggttgtttttttttttacctttctaatcactgacctatttatttattttttgaactctttattgttggagtatagccaattaacaatgttgtgaaagtatcaggtggacggcaaagggactcaaccatacatatacatgtagccattctcccccagactcccctcccatccaggctggcacataacattgagcagagttccctactacagtaggaggtccttgttggttatccattttaaatagagcagtgtgtattagtcgaaggcatcattgtctttcattatctcatgcccaatgtcttggcaatctagtttttaaaccgtttcctgtgagagggagaccaggccctgggtctcagtcttgaccagaactgggaggtactgctgccctgattcgtcggcactttttcccatcacacgtaacagcagctgaacacgaaatacttaaccccgggtaaagacaataaaccttgtaggaataattctgcct

SEQ ID NO: 41110 - DNA, 694 bp, Bovine  19866880561652
tgctctggtgagaagaggttgatggtcatgacctttcggaaacacgaagtcatttatctgagagaaaaaaaagcaaatgactttgttcccaggttgtcgtggaatatttgttgcccaggatgcacagagatataaggagaggattatcctctcatgtgaggatagattttccccatctgtaagatttcttccttctctaccatcatttacatccccaccttccctcttcaaactagttgccaatctctctagaaagaagaaatttggccttcttgctgaatgtctttggtcagttcaggatctagaagaccctgttgttccatttgctctccatcttgggtgtggcaaacagtgatgactgcaagccaatgtgcgactgaggatgcaggaatgctcttggcctcgtgggcaggcgagatgcttattagtgccacgtttccaatgcgctgcacagtgaaagcaggggcaatctcctgctagagctgaggttgcgatattgaaaatgatggtgagccctgctgacagtattcccacaggagagtctgagctggatgagggtgaagggggacgttgtctaccacagtctccctggaaacacaaagtcagtcaccactttgtctcagtctaaagccccatggttcacattcccttctccctgcagccctttccttgagggtaacctcagtttggtccc

SEQ ID NO: 41111 - DNA, 2090 bp, Bovine  19866880609822
taccttctgggtgatttgaaggattttccgtagacattttgattacgtgtagtttcattttgggcttccctggtgtctcagtcggtaaagaatctgcctgcaattcaggagactggggtttgatccctgggttgggaaaatcgcctggaggagggcatggcaacccactccagtgttcttgcctggagaatcccatggacggcggagcctggtgggctacagtccacagggttgcaaagagtcggacacaactgagcgactaggtagcaacagcagtttcattttatgtggctggtttcagtcactgctctgtacggaagatatcgcactgtgtgtgaaagtctcatgcgttctgacttcctctgtcaccagagctgagaagccactaaccgcgtctggtcttatgctgcagagtccatgcgggcggagaagcaacaaggctgcagcctccggaggaagcaagagcctcacagttagtgactgattctgacgatgcagatcccctgcttcaacatccctttgctcacataatggactcgtgggctcagaacccctgcagcgcagggtctgtcagccggcttgccttgtcgggtcccacaccaggccttctacagtcagcctgacgccctggtgacccctcctctccactcagcacaggacggacccaggctctccctcttacaatgtgatgggcagccagacaactgtgggctctggtgcaaggaagacccatagactctgggctggtgaggggggcaacaggcagagggtggcagagagaactagggtgaggagatctggggtgagccactaaggcagtcggcagctgcccctgccttccttgcctgtgccttgcaccgcccagcctctctcactgagctggcccactccatcctatctcctgcatgcaagcaaggctttaggggccctggcttcacactgactcctggggggctccaaggcctgcagagaagagacagtctaactgttgaatgattcacttcagagttttcatcacttgtgacctctggtcacccaaaaggcaaacttctaagcattcagacggtctcagcaagtttatgtgtccctttcgtacaggtcagctctttttactgggttctgtgtaaagtgcccactctgagccaaaaccttccttttctgatggtttcttagtgttacaggcaccacttttcagcagtgggcacgagtttttcctactatgtatcacttgagccatgaaaataatcacaatggttttcaaattttcagcacatactttttttttagtgtgacttgagacccccatgccgaagaggtgtaagcctagttagctctgggcttcttctctctgtgccccacgccccactctcggccacaggcgctcctaaaacccaagggccctgggaacaaacatagggtgcacagttcaaggcggcagcttgtttcatccttatctcaggcaaacatcaaggagcacctgttaacattacagatgtactctagcctgccctgagctctgggaatgctctggaaacatagcaaagtgagagacgcgtccctgacacaaaggaaaggcaggaagataagatgccagaagccatcaaccctgcccagtccaagggggtcacaagtacacttaaggctaggggctcagagatgggtggagaggccaggtgagacttgggcagggcttctgtagatttacataagaagagacagtaaaacctgaaaggtgagtgtggtgggtacagcctgacaagagaagcgtgggcaaggttggaaaagtctgtgcggcgtccaggggaagagttagctgatgaatttgttttgagaacagggtgttcagaatgggaaaatgggaaggagccagaattcgaatggaaggctaggaaaattcaactcatttcagaggccatgaaaagacttgaatgattcaatttaggggaaaaaaaattaggacaaaggaaaacaagataagaacaagaatcagacactgcacgctgctgagatgcgctgtctgacaccgtctgcaggaaaagagaggggtgagcaaaggggagacgttgatgacacatttccccactgctgac

SEQ ID NO: 41112 - DNA, 2459 bp, Bovine  19866880623078
attattattatataagttctacctaagatatccggcattagatcctggaagttggggacacttggcattttgaatttcaaatccacttggtcattgctaatatataggaaatctattgacttctgcatgttaaccatatattttgcaatctgactattgttgcttattagtttcaggaagggcttttttattgagtcttttgggttttctacatagataatcatgctatctggaaataaaacctgttttatttcttcttcctctatttgtatacctgtttaccttttcttgtcttattggtgagctagaacttccagtgtgatgttgaaaaggagtcataagtggcgctatccttgaccctttccttgtcttagtaggaaagctttgcatttcttaccattaagtatgatgttagtgtaggttttttgtaggtttaattaaatattataggttttaattaggcttaattaattttgtaggttttattaggtttaattaggtcctatttctttatttatgtttttattttcatcactatgggagatagattgaaaaagatattgctgctattgtcagagagtgttctgcctatgtctttctctgagagttttatagtatctgatctttaatctattttgtgtttatttttgtgtgtgctgttaaagagttttctaattccatttttttaacatatagttgttcagttttcctggcaccacttattgaagagaatgtctttcctccattgtatagccttgcctcctttgtcatagattcatttaaccataggtgcatggcttcaaatctgtgccttctatccagttccattgatcagtatctctgattttgtgccagtaccatactgttttgatgactagttttgtagtatggtctgaagtcagggagctggattcctcttcttctagctctatttttttttctttttcaaggttgctttggctatttagggtctttgtgtctccacagattttttaagatttttttttgttctagttctgtgaaaaatgtcattggtaatttgatagggatttcattgaacctgcaggttgcttctggtagtatagtcatttttcacaatattgatccatccaatccaagaacatggtccatatttccatttgtttgtgttgtctttgatttctttcattagcatcttatcggagaagacaatggcaccccactccagtactcttggctggaaaatccatggatggaggagcctggtaggctgcagtctatggggtcgcaaagagtcagacacgactgagcaacttcactttcacttttctctttcatgcattggagaaggaaatgacaacccactccagtgttcttgcctggagaatcccagggacgggagagcctggtgggctgccgtctatggggtcgcacagagtcggacacgactgaagtgacttagcagcagcagcagcagcagtgttaatatctgtatgcagtcatgggtatgcacacacacacacacacacactcattctcacaggttgtatcttcctcagcactattttgtagcccactttttcacttaataatgtattgtgataatctttccctaccaatatgtgttcatcaacaacatagtttctgatagctgcatattcttccactatggataggccatgatgtatgtaaccagtcccatattcttagatacttaagacgaaacagctaaaaggttttagtgcccagatctgagggacatgcatatggtagagccccaccacacatggagcctgcaagtgtgttcctcacaaaagccatctcttcctctgcggccctgctcatactactgtgcagccagtacactgtcagcataggttggtgagttaactgtgggttggcacgagaaagaactggtgcccccgagaggttccagcttcctgtcttcagtctgagacctcagaggacctttgtgtggtcactggtctttctggaggaatcaggatgaccatattttgtttcttgatccaccagcatcttaggacctcagctttgatggaaagaaggtccatcaaaccccattggtttccccatgttttgaaaactattattattggggagaatgatggtaaatgaccaagtggggcaagatgaaggctctggaggactagccttgcacaaggagttttgtcaaaagcttttgctaattagttccacatgtgcaagctctgcattagtttaaagcaggagtcctgggatttcccttgcggtccatggctaagaccctgtgctcccaatgcagggggcccgggttcagtccctgaaccgggaactctatcccacatgccacaactgaagatcttgtatgctgcatctaagacctggagcagccaaatgaataaatattttaaaaacaaataaaaatagaggagtccttctcctaccagaaccagagcccccttttattaacaagtattttt

SEQ ID NO: 41113 - DNA, 1951 bp, Bovine  19866880653282
atcatcagtgcaagttcaatgcatgaagcagggcactcaaagctggtgccctgggacaacccagagggatggggtggggagggaggtgggaggggggttcaggatggggggacacggtggcccccatggctgattcatgcctatgtatggccaaaaccacaatattgtaaagtaagtagcccccaattaaaataaatacatttttaaaaagtcacccccccaaaaaacaaaagaacacaggacattgacctgtcaagtttcccagtctggatttcattaactgtgcactcacattctggagaaggcaatggcaccccactccagtactcttgcctggaaaatcccacggatggaggagccttgtgggctgcagtccatggggttgctgagggtcagacacgactgagcgacttcactttcacttttcactttcatgtattggagaaggagatggcaacccactccagtgttcttgcctggagaatcacagggatgggggagcctggtgggctgccgtctgtggggtcatacacagtcagacacaactgaagtgacttagcagcagcagcatcagcactcacattcagctctgtcccagtatttcctgtaaacaggcaactggatccagatttgtattgttcattttctgccccaagcctggaattagctatttcttcaagaaaagctaggtttctttcatcacaaatgatatgctaagaccataatctggataatgagagcagagacctatcaaagttgttttcaccagacagtgcctggcatgaagaagctgctaagacagcatgtgttaaatgcttatgtatttagaagtaggagagtgcttattctacatcatcatcatttatcttccatttatctatctatctcccttcccaggttactcagtggtaaaagacctgcctgcctgtgcagaagatgtgggtttgatccctggattgggaagaccctccagagaaggacatgcaacccactccagtattcttgcctgggaaatcctatggacagaggagtccggtgggctacagtccatggggtcaaaaaagaatcagacatagcttaacatgcttgcatctatctacctaattatttatccatgtgtatatatattatggcagtgctggccctgtacaacacttacatggatctgatctgaatgttctgctgccactccttcattgattttcctttacagtcattatatcatttaatcttcacaaacaacctcaaggtgtttacaactaaccttatttcacagatgaggaaactaaggctcagagtggtgaagtgcctcattcagatctcacagctaataagagcagagctcaaccacaaactcaaatctgatagactccaaagcctgcctgctttccacggttccttcatgagcatttgcccctgaaatattttgtatgttcatttgaaaatttaatctcaatttaaatttgttataaatgagtgattgaataagcctaaattcatggggccgagtacaggcagtcaagctttgcactcggcccatgaaagaatctttccttccttattttatttttagttcccattgtgacatattttggccagatatggcagagggatatttttagtattctggaataaacctgaaggtatattttcactcttggcttgtaaggctcatttttattcatatgtttacagatataaaaataagtgaatgatatctttaagtcattcatgtctcaattctcatgtatgcactatttatgagttctctttttatttgagtctaaataatagttataagaggttctttttgctttgtgaccccatagccaaagcctcactgtccccttatatttgtgatggtaatggaaccttttgagaaggttgtttgatggaaagggtgtgtgacccttctaatagaagcagaccacattacaaagctgatacaaag

SEQ ID NO: 41114 - DNA, 897 bp, Bovine  19866880693282
ggtaaggaagaggtttatttaatcacataaagaaaatatgaaaacttcacagctttttatgaacacagaaaaaaaatatttatactggcatttgaaaaacaaaattgaaccagaaaacaaacttcctccgtaggccaaatatagtgactgtagacacaaacgctagtctcgaaccctgaactagaacagctgcagaagcaagaaaaccattaaaggaaaagatgcaaaacgaatcacaagatcaaaagagctattttctggtcaatgagatgtttgggccatggcagtgtcatgctgggctcacctaacaaagataagggctttggcaactggtctatgatttacctgcttcccacagaagcagaacagggcttcaaggagaccccccatgacctgtcagggaaggtaaaaaaagcagaaacatcttgcctgaatcacaaattcaatttttttgcattcaagggcttctcaacttaacatctgctcatgaatgcgaaagagtggcagcccttatggaggtcacctggcaaggcaggcagaccagcttggagcagggcatccagacatacggtggcttattaggagccaagacatttcaggaaggtgaccgaggataagacacagagtcccggggaagaaccatccttgccatcggttgcaatgcccccaaagtgaaggctgacctccaggaaacagtataaaaggccactaagagaatagcatgccattcattcatttctttctgaaacagagagggcgtacaagtgtacctgtccatacaatgccctagctttgtacacaaacctggacatgagcttcctagggagttttatgtcacatttccattctgtttggggggcagtggtctctgtcacataggagatgctcaacaaatat

SEQ ID NO: 41115 - DNA, 1469 bp, Bovine  19866880743374
acccacagaaatccaacttactgtggatccaggaccatgttaccaaccaagatttggtcatccccacggccgagtaaaatctggaaaggattatagcccatcaatttactgcagagtcaccctttcctggagaggaccttacctctagaataggccacagaaggttaacctgtattcaaattgctgtcaaacgcctaaaaccctgtaaagccaatgaagttgccatttcacagacagaggtgggccacatgctcaccctgccctggcatcctctgcactgcagcatcattgggtttgtgcattcctggggcatcagtggtctctcatactcatatctatatccttagagcttagaaaagtatatgatgtggaataggtgtcccataaatagttgttgaacagttgagtggacttaaaatccaaatgccatgtcaaggctgcaggatgaacttggttttccttgacttgtaacagcagaccctttctggaaaggaactgggaggtggggtaggcaagacagggagtccagttgaacccaagagagtcaaagcccccagcagaggaaaaggacatgtcaaagagaagccacagtgaaggggaactttgctaatttgccactattgtctagggctgggttttggtgaatgagacaaagcaatatttagaagtagtcatcagaagttttttttcttctcccacccctgcaaaagcttaggctttcacatagggaaaatccaccactttgtgacatcacctcttctcaagtccaacttgctaacaggtaaagttgagtgaaaactaatatcaagggtggccttgaacttccacctttagacccaaggctataagaattattagatagaagtattccagggaaggctggctgtcatacccaagggaaatattagacaaagaggaagagaagggtgtgtggagaggggccagagtcactttataaacctatactagcatctttcagcccagcaacaagtggttttcctcccttttcacctacttccttggagcccaagttagtttgccactggctttgatatctggggaactgaaaaatttaactgaagtaactaacttgattgttttgcagtccgctatgaaattgataatgacctcatggaattcaatattttaaaaaacagctttaaagctgacaaggaggtaaagcgaaaagagatcagaaatggatttctcaagctgcgcagcattctccaggagaaagagaaaaccatcatggagcagatagagaatctggaggtatccaggcagaaggaaattgaaaagtatgtgtacgtcactaccatgaaggtgaacgaaatggatggcctgattgcctactccaaggaggcgctgaaggagacaggccaagtggcattcctgcagtcagccaagatcctggggaccagatcgaggatggcatccagagcacttacaggcccgacccacagctccgg

SEQ ID NO: 41116 - DNA, 1159 bp, Bovine  19866880804077
gaagaaaggaagtattagccaaagtggcttgctacagttgagggcgcttagaggacagtctactaatgcattcccctcctggagttcccctcctggagtgatacagtcaatctgaatttgcagtcagcagaagaaagggttttaggcaaaggttcaggaaagatattacaagtaatgaccaacataaatcacttaaagagggaggtataaattacttccccgtttcgatgcagtgattgtgagtatttcttttacagtaactactaccagataattcctctgtgatgttattgctggaagtcagtgagtacatcagctcaagaatgaatgtgagctatttctgcaaaatacaaaagagtggcaattctattatgaatgacaatcattcgtgggctcatgatgcactatttccattacatttatcctatgaatgtattgagtaaaactaggccactgctttcaagtccaagatagtagaattcacaaccatttatgatatttaagtattttaaaattttactggtaagtaataataatttccatagattctgagaggcccttaaaagaaataattacagaatataatatattggtacctacaaccttaattaaagaatttccaaaggcttcagaggagcctggaaaatcccatggatggaggagcctggtgggctgcgatctatggggtcgcacagagtcggacacaactgaagtgacttagcagcagcagcatggaggagcctggtaggctgcagtccatggggttgctaggagtcagacacgactgagcaacttcactttcacttttcactttcatgcattggagaaggaaatggcagcccactccagtgttcttgcctggagaatcccagggacgggggagcctggtgggctgccgtctatggggttgcacagagttggacacgactgaagcgacttagcagcagcagcagcagcttttgttaagggcttccctggtggctcagtggtaagcaatccgcccgccagtgcaggagatgtgagttcaatccctgggccaggaagatgccctggagcagaaaatggcaacccactccagtatacttgcctgggaaatcccacgtataggggagcctgacgggctatagtccatgagttgcaaagagtcggatacaactta

SEQ ID NO: 41117 - DNA, 1920 bp, Bovine  19866880856187
ttttattgttttggtattggctgattcttaccaaaattgttgatccctttctagttttatatgtatgtatgtagcattaaaagcacttaagaagaaatggagactatataatcattaaaaaattattaaaggagttattaaaccaaacttttgcttcatttatcttagttgataatagattcaatttgagcatctctttgtgaaacatctgggctatttctgcagtattaatatagtggtttaaaggagtacaatttgagttagctaatgatctgacattatagaaggggaaagaacctgtgagactaaattccaattagtaaacaatgtagtaccacagcatttttgttcctgaaagtactttactaatattagtgtgctgattatatttcaaagcctttctaaaaataatgtacttgacctgctagtatttgatagaaagtattaacagttaagatccttagacatttttgcatgtaagttttcactgaatttaaaggccaattgaataaatgtaggttgatgaaaggtaattctatgaaatttgtgtagcagctaatcttaaatatttcagaagcattatattatgaaaaccctgttttgtatagatgaggcaatcttcataaatttccatcatcaagattgcatttcatgtgctatttttccgtagctctaggaagatagcaagtaaaagatacgcactagcctagaaacatagaagagatcttaatttactacctgaaatgagccaccttaggggaccacccttccacactgatagttaatacatagtactttagttttaaagtataataaagctaccttctaccttcagtttctctcttcagtgtctcaaagtgaaagggaagttctgatttgtaactttttgtatgtttaagtttttgtatgtttttaagtggatgaaaaaatagatctgccctttttaattctttaacagaaaccatatctgtgtgataccattatgttaacagtattaataagtgtatggttacataaagtattcataaggccaaacaataattctttcgtcatatagtcaacttaagatcaaatattggtaaatgctgacgtttatgtagactccattttgaacatagtgatttgtgatgttagttggaccccaagtagctgttgtagagtttgcatgctaaaaagccctagaatacacaaaatttctatgtgtctgcaaaaatgggtttctaaatttagagagtagagggtgcccagagggtattctgaatgtattggaagatgaattacatataatcagattttgttcttaaaaatttttttagttatgagtcagaatttgagactaaattgaaaataaagtataaatgttcatggttgtgaatggatttgtaaaacaaaagtgtaaagcatacatcagtttataggtaaatatttatatgcattttttaaaatatagacttacataaagttttaaaaaaccttgaggttaatagtgtgttcttcatttttaccagagttcattttaaacatgtttgtttaggttttaccgcaatcacagcgaccaaccccatttggcttataaagactcgattacagctcgatgcaaggtatgttaattcattaaagttggcttcaacaaaattttttctataaatttatatcagtgagatttcagtgccaggtatccaaccatgtttttgccctcatttgctgctgaatttgttttatttggttttgaaacttaggtgtaccatcagatgcaaaagtgatgttaattgcaggtatgagaatttctaggaaagaaagtatattatgcattgtgtttttcagtaaaagaagaaaaaggacctcttgatctagcttgagcagtgatactttcattcaccccatgttgattataatcaacccttctaaatacctaaatta

SEQ ID NO: 41118 - DNA, 1069 bp, Bovine  19866880924833
cctcacaactagaaaaaaatttttaatgcatgaaaatttatagctcaagttgagagtttacaaattcttacattatttccttgaaacactaaaacaaatgaaaataagacagcctttaaataaactgtcctttaaattaaataggcttagtattcaatttctatgaatagaatgcaaaaggcaacttaacgcaagaggttacttggaataaaaattatgtacatgattacgtaaacccttaaggcatatgctatgtgatgtggcaaaatcttgcaggcattatcaacagtggtacatttttgatactaaagtgacaaggttagcatttttttgaatagtaagaaaacaaattttcaaatggctgcctctaagcactttgcaccccaagttcatattttgaagacctctaaaaatgatcctgaagaaaaaccagtctagattattacaagagtgaagggggccaaaggctaccttaacaagtctgcacgggaccattcagtttcaccaaccatgtagctacctataaaaactgcaaagctaaatattattgctcatgaacaggtgcaaagaagctctgaaggtgtaattctcagaaaaaatctaactgcaaacaaatggaagaagtattttcaaattacacaagtgtatagtacaatattctctgaacaatgtaagtctttcaatttaccaaaattcaagaaattcaagttgggaaatagtatcaatgcatagatagaacaagttaatatttgtacacatttgagaaaaaaagtacaaaatggcaattccactgaaaatctttgcaatatgatacaaatacagtaataaattttgatgagatagtctaatgaaagatgttccagtgggaattggttttctgaaaccctaaatttgcaatactcaatatattaacaactatcctcaacttaaaataattgcttacctactttcttggcatcaagtctttcaaaaaagaaagattaacatttctttacaattttctggggttaaaaaaacaaaaacatgaacactgataatccagaaatatattcttaaagaccctaacata

SEQ ID NO: 41119 - DNA, 972 bp, Bovine  19866881029912
ctacctccttcagctcctttgtagattcaattgactactaagttgagaagttctaaccccaaaatgttgaaaatattataaatttttgtagatttagatggaaaatgattactaataggcacaaagaaagcagtgagagttaaacacacacatacactgtcagccactccaaagaaatcttcagctaaaattaactaacaattgttatataatcttcaaaaatacttcataataaacagccttgtgtatgaaagagagagagagagagaatggttagttaatattgaaatattctgaacaggaatccacactccagggagggttgcttaaattctttagatatcattattaaaatctatacagcaggtttgtttaccagctaaagagagataagaaatatttttaagaacccaagaggaaatggacaaagaatgtgaacagacaattcaaaaaggaggaaactcggggggctaaatggcatacaacaatattctcaaacccattaaaaatgatagaaatgcaaattcaaaccaaattcaaacatcacaggcccattggaatggcagaaattagagagctatataactttgagttgatgaagccccaaaacccttgtgcaccactggtggggatataggcccccagcaccatcacccgggactccattcgacaatccccgggaaacatcttggatccacctgataagtagggaggtttgttgcaacatcatttctggtaccagggagctgaggccatctgaagccatgcaagtaaccatggtgggatgtgaagcacggcttagaaagaacagcctggacttagcgtgtggcagatagcagagtgtgttctgtggcctctgtcagaacagaagcattcagaactgaacaggtcctccagcccctagaactgttggccactgatactcttaccctcaaacctctctaacaattctgtcagccagtgcaagcccct

SEQ ID NO: 41120 - DNA, 1217 bp, Bovine  19866881121872
gtcctttttgctaaggaagaaaataagctggaacgaacactgtcatatcttcttcttgaagaaagctttcaatacagtatgtatctggctcgggatgcattttatagactgttgatttcatagaattgctagcaaacaacaacaacaaaaacaaaccttttaaagctattgtaaagtaaagagtcgtagcatttctagactatttttcagaatcctaactggtgccggcaggcttgtagaagaatgcatgatcagctgtctgtatccgtgctataacctctaaccacaagtcgtgtaaatgtattcagctaaatgtatctgcagtacagaacagcagatagctcctcatcagaatggtatgaaaatgtgaatgaatttgcttaaacttagaagcagaataaaagcagttacagaaagataaattaatgctgagttcctttggatgtctagctgaccatcatgaacaataaaagctgtccttaggacactgacctaaataatgttaagtcttgcaacagcatactgtacttgctcagaatctaggaaatgtaaaatgatttttctcctttttcccccctccaaaagctaaattgtcgagtaacaagccattcacaggaatgccaagaggctttgtgtgtatgtatcatgcaaactgtaagggaagaaatggtgttgagctgacattcgatgtttctttgttttactttgaggcttatcttagctatgctcccacgatgacattgacatcatggaggtcagagctgacactggggtgctatccgttttatgagtgaaatgttttccgaaaattaaatctcatctactcaaacaccgaatttcatgtcttcttcaatatcccctccctaaccccgctgctcaagattgatgggctttactttggctgtatgtaataaatcggaatcaccttccgtagaggctctgatacataatcgtaggaattaaatttttaaagaaaaaaaccttcaagaatccttaggcattccctttcagtctttcatatcaacacacacacacaattgaagctcaaattgcagtgaaatgtttaacatgtggaacaaaaaatgtggaaagagctgcttattcaggattttgaagaaatgcctaataagcaaagactgttttgctacaaaaccagtgtcaccatgttcccaaagaggagaaaacagcatagcctgctagaaaaatttcctccagat

SEQ ID NO: 41121 - DNA, 2433 bp, Bovine  19866881172859
actgtcctcaggcaggatacattattgttatataatcctaaggaatgtagagaaggaaaaaatgtttgtccttctttctccttgagaattccagacccctctctccttggggacccctagactccttatcaacctgcctaggaaatgattctctcaaaagaatcttcctgacccaaggatagaaactgcgtctcctacattggtaggcagattctttactgctgagccaccaggggagcccatggtctccttacataggtcaaaagtgtatgcatatgactgatgaggctgtagccttgaccatttagtagttttctgagttacttttatagcttgactctgaacttggttggctttgatgacttcagaaagtcctctaagagatccagccctgaggacttcccttggcagtccagtggttaagactctgtgcttctgctgcaggggacatgagttctatgatcctgcaagccatgtcgcacagccaaaaaaattagtaattaaaaaagaagatatccagccctaatccctgaaatctgtgaatgtcaccctaaatggcaaaagggttctgcagttatgattccttttaggatcttaggatgggggagatgatcctggattattcatgtggcccctatatgtagtcacaagtttccgtagaaggtgaagggagggggagacatggctatagacaaagaggagaaggccacgtggcagaagccgaggaggcaggtcagagagtcagagagaaggtactggccttgaagatggaggaggggccacgagccaaggaatgcagtcatagaggctggaaaagacaagagcagagcctctctagagtctcatggcccagccaacacctggagtttggctagtggaatcgttttggacttctcacctctggagctataagcaaatacatatatgtggctttaggccaccacgtttgtggcattttgttacagtgtcacaggaaactaatacatgggctgaggtgggaatttcatccttgggatcctggcccttaaggggcttccactttaggaggtgagatgaaacccgcggggatctttggatactaaatgtgcgccatcgtgtttcccaccacccttagcagtggagtggagcagggctgaggctcaagggcaaaggctttaggttcagagaggccagttcaaggctggtgctgccatctgtcatctgattgactttaagagtgtcatgtgaacccttgaaacccggctgcagaaaatgcagctaagagtgcaggctgctgtcaacatgaaatgaactaagggctgcgatggagtcatggtgagctcagtgcctgatccatttattgtaaatccctcatccctctccccacagacacacaaagtattgatgatctgagtaactggggaggtgattgtgaattagtcaaaaaaatctgaattctaggcttttggttaaaaaaaaaaagaaacccattattttacagatagggaaacaggctcagagaaatttctgactgtatcttcagccctaccagtcaagtgatagtaagatctgtaaataaggtatgatcaaatgctccttcctaccttgtgaatcaccaaatccatgactatactttgattttagttctcctcctgagaagaggagttctcttttcctgagaaggaaaaaagggttgttcttaaatgaacattgcatgggttctgctgacatttgaagtggactcggatttttagtgatgtaatctactgtcgcataagaaataatggcatctaaaatcaggccctgatgaggctgaaaaggacaaatgcttcatttttttttttttgactatagttgagttcctctgtgcagataaaaatccctgaaggatctaaaagtgtgtgcagtgtacatgtgcacacatgaccaagggaggtgcaagtgagaatgggtgtgctgcatctgagtgagctggtgcgagtaccatatcctctgttagcttggactggaagcctcagaaagcaaggtaaggtttgcgtgcaggtagcttattttggcaggtgattccagggagcaggagtggggaactcagagaagtgaaacaaagaaggtgggaaggccagtccaagggtgtgtcatcgagctggtcactactgtgggcagtggcctcaagggcccctgggtggatgtgcctggggctggtccctgtgggcggtgggagagaggattgttggtaaccatgtcaatagccttcacccatctcatctggttcatgctaccaagggcctgactgcttcttcacaggcaggttcacaggcagggacagagcatctgggggcagggaagggagtcacatagctggggaggcaggtgtttacagctggtggctgcagtaacaggggcagaaaaggcaggcaaagggtatgtgagacagggctcaaggcgtgtgcacca

SEQ ID NO: 41122 - DNA, 1024 bp, Bovine  19866881199835
cccctgaaaatttgtgacattcacattttaggaaaatctgggctatgcctgagggcctggtaaatttccaaccattaaacatggagggaaatgaagaatgattttatagtcttctgtgatgctagggaacaaattaaatgtgatttgaataaatatattcaccattaggtatttgtcctctaagaaaaatacaatttgggactggttatatatgtccaaatatgggctacatattaataattttatgatttaacagtataatttagccagaatacaattattaagttgaaaacagcagctgggtgctcctcgaatctctacccataggggaatagtctgcaaaatattgacattgtatctttaaaacaatttgattctaattgcagagttgataaatgccatctttttatctcaatctagcccctctccttttggggcgtgggatttcatgctgacttgagggggcattaaatacattgcaatgtcacacaggaaatcaaggatttaaagtaatattgtgtttattggtgtaatttcctctttgttcccaaagggtttcccctttaaagcaggtgggacaaggagaagagccagtgactgacgtcggcctgtcctggctgctccctcagcccccatcatcgagaacgtgttctcagtctatggaagcacagaacacacactcatcagttttctcgtttatttgtttattcatattcagcaatgtttactgagttacaaagaaatcctggcagagcttgctagaatttagaacttcctcccacagttcatcactgctgatgaaagaccagtataattgtacttggtgatatttgtgggagagacagagctagaagagagctgctttctgaaggacatggtaggtagaatctgcgtttacaattgtgcctctggagtttccgacttggagatggagacagagtccaagagcagaaagtccagccttgttgtgctgcacacaaaattgtgcctaatgggcagtgaacaccctgccccgggtgaggag

SEQ ID NO: 41123 - DNA, 2561 bp, Bovine  19866881217077
tgagctcacagccgcttcaggtcctagtgctgactcaccctcgcgcccacagtgtctcacccgaggccccgctgcttgcgtctaccacacacaggagtgggtggaagagtaagtggaagaatggtcgatgtactgacctgtctgcgtgagctctcccatctcacacagctggtgactggagtaaagaggcagcgagtgcaaggggctttcgaaagcggctccaggtccttttgacatgtgattcacaaaagcctccagtttagagtgatacggcttcctaaagaaacaacagagagttggcggtcaacgtgctctgaaaaagtccacaacgatttcacctgcaacaagcagtatcccaagtgagccatgccctttctcacccgcaataatagtacattcccagctcacgattactcgcctgctgacacctacatataaacccccgactcagtaaggccagcctgagcccctgccatctccgagtgcccatcttctcaagccctgtgggggttagtgctgacctcacgcactctgttccccagcccgcaccacttcctgtctccctctccaggaggccactgaccttaccgggcagccaagcctaggttgggggtcgtcctcgatttctccttcccctgcccttgcccatgtgccgtcctgggctgctctgctcctctctcctatccctgcatccctgagtaggttttggctccgttccaaggagcctcatgcgcccattagcctactctggccctgcctgactctgaggcccagggctccccagtgctgttctctggccacacatagcatctgccttctgtaccccacacttgttcttgcacccttccaagactttccacatgctgcctcttcctcctagaaaaggccacccaactttcactggggtaacctttaatccttaacttacatgacctctggaaaatctcttgtgaagaaaattaactgatcaggataacccatatctctacagctcactatgcattttgcacatatggtatctcactgcatgtggggtgataatgaagagtgggaaaaaaacaggttatgtatgagatcttatgaaatttatattatttatatttctgccatgaagtcacacgtggtaaatcaagatttatcagtctaatcacaaatacacaatttccctgaataatgaaattacctatgaatatatacatacattttctctgaataatgagatgatctatgaatatacacacctttcccttgaataatgaaatggcctatgactgtttatacattgtccagctaaacagaggtggacagatagagtagttcccaactaaactaaagcagcatgaaaagaagcaaagataaattgtttaatggcagacccctgctgtctgaaaacctaattaactttggcaatgcttttacaatggctgcaaaaatgggtttattatctttcgaaaacataaagctaaaaaaaaaaaaccattacaaaaatatgttttagagaatgctaattctgacatatagtatatagtctaataaatcaccctgtattgctacaagacattatggctttccataaaaacagaggatgttattttccctgaggctgaaacacatatatatttgcaaactgggaaataaaatgtccagactgataatgaggctgccgaaacgaatccacataaacaaaggctatctatcaacaggagtcagatattctgctccaggccattatttcaggttggtgatgtctgaggatccaagaaagctttgctaccaattttagaaatgaaatttccccactcaaagtgtttgctgggaggtcccaggttttcagggaatctgattgcttaatgatgctttaatatctaactgtattcatggaaacctgtttctgatatggaaaaatgacaattcatggaagaaaaactttacttatggataatataacaaaagactgagtcttttaatcaggaagaggaccaggtaacctgagtccttgggcctgtcctggatctgaatgatcaggtcctgaggcaggagatatatgggccccagactgagtggctgtaatctgtctcctgaagacagatatttcaagataaagataaagcaggagcaagaggaagcggagtcctgcttggataaacgataaagagaccacatatttctctttcttgaggtcagagacccccaaactatgcatgcaaagaacggatccttaggagagggggtgctagaccataatatgttctgtcaacttccctgagacctctgcactggaatctatcctggctaaaagatgcacgtgcacacacgggagggcctttagccagaccaattatggacttaaagccagacaaagcaagatgaccggccagaggaaacccggaagaactgcctccaaaagcacaggactctctctctgagccagcccatgcttcctctgcacatatatgctctcttaataaacattttagttatctcactacttttcatctctttgctgaattctttcttcaaagcagacaagaactagggagcacagcagcctaggttcaaac

SEQ ID NO: 41124 - DNA, 935 bp, Bovine  19866881238578
aggccaagggactgcctgcttccactgggatctgctatgatagagcacaggctgtgatgatgtttacccctctatttgctcaggaccctgaggcctgaggctggcatgtgctccctgatccaggtgaggccagagctatccctgcccattggggctgaggggcttgatgaggacagtcagccatatcctgccccctcaggaggaccttttctcaaaatgtagctgggattccctgggatcactttagttatatcgtgtatggatgacaaaaatcgtaaatctgctagtattctctctgatgggagacattgcctggagcccaatctgggcttcaacttaataatggaggacccaatgacctcagcatctgctttctaatcccaccccacaccaggatgactttctgtgctaattcatattgtccatggtccaaacttttaattctacttttttttttttttgtatttctgaaaggtatgattgcatgatccctcagttcctttgggcaaataaacaacaaagcagcccaccactcaggtaaacagtgaaatatgataattcccttcaggtagacattgaacatgtgcctgcttttatgcatcaaactgattatcctcaggcttcatcaaggaatttcaggagatggcacaaagtctgttgtgtagtcatggtcatgattctccccactgtggccacacgttcaccaggcaccgtctctgtgtcacgtggcaaggaaccactcggcttccaggagtgcactggtgctgggtgcctcccctcacaaagcaccatctgaccgggggctaggctggctcctttcttacctttattccttggcccaggctttccagggaattgatatccagcccttccttgcaggcctgcaggcaggaaatcaccttctgactgtccattttgccagggcgaatggtgag

SEQ ID NO: 41125 - DNA, 449 bp, Bovine  19866881299160
acctgagaacctggggtgggtcgcctgccccttggcttcggagccaccctccctgctgctgccctgtctccttcacggcctctcctcctccatctacccacatttcacctttgccttgtccttcccctctgcaggtacatggagtacaaactccggagctgacagggctcagcacagtgctctcgccacccctactcagattgcagccggctgcagctgaggtccctgcaaaggactgtgggccacagcttgtggacagtctggttcttaaaagaggggctagaagtttatgtgaaattgcctagtttaaaaacattggtaaataaattttccaaagtgaaaacgttccttgggccaaaaaatacaagccagcaggctgtgggactggagtagcctccatgggctccagggagatcagggaatgctggacacaagtctgcaaacagggg

SEQ ID NO: 41126 - DNA, 1542 bp, Bovine  19866881310080
ttttttgttgttgtggtttttagatttaccaaataagctgattgttaaaaaacagaaaattttgtgatttcagctctgagcatggtaaataataatggtaggaaaatgggatatgacagtctgctctgaatattttcttagatttccactttgacaaggttagcattttttcattaaggcagaattgatcttcttttgggtaagtatttagactctcaaaactgctacagatggcagaattttcagtactcggtactttaaaaacaaaaaaattatggcccattctgatattcctttttcttttttaacttaaaattttcaaaagttagatctcacagtaaatatttctcaaatccttccaatgggattcattttgtacacgtgtttctgatgaggtcactgcttgttgttatgatacagaaaagcctgtgtctattttaggcatttactgtacatttctcccgagaaaagagtgagatcgtgtcatctcatgctccccatccgcaggtcacttcctgtagaaatatggactaacttaaacctcgtgagtactgatctgagcatctcttgcagcctctagttataagaaacacaccctgggaatttataatagctgttgaatagaaggcgggaaatgaatttttatttcctgaatttgtgtgtgcattatctgagtatttcataaaactttaattctgattccttgataatactccttctagaaggaagaatggagtaacttttcagttattgttaataaaagcctggggtctttagcttggccataatagccttgacctccaaagaattccttaatagtatttaagatttacatagctgtaaatggtatcataccatctgacaacttttagaaaatagtagttctctttgtttagtataacatgttttaaaagcctaatacagtgctttccattcttatctgttgatacttggctttctactttcttgcaaaaacattgatcttaatacctaccattactttccaaatatgggataagaatatatgggatcttattttagttttaattagttttttgtgttttttttgttttgttttgtttttaatatatttctcttcaaaggttaggtgggctttgttcttacagaagttaataaaaagtactgcaaatgcaatactacaggtatcactcacttaatgaaatagacattttcagcaagtttattatgtggatttctgttgttctggtttttaattggtttacattatcaaatagaatcttaaatgaaacaaaactttaaaaattacatttaaaaggtttcttaaactttctaataaaatattaaccatattactaatagtatggccagtatattgccattttgcttttattgactggagcaatattgattctttttaacctacaaatagataagtcagttttaatatttaacagggtactcagaatattaatatgaaatagcatattatcaaaatgtcacaaaattttaatgccaaaataaaagtaataggaaatgtctaaatttcaggggaaccattcc

SEQ ID NO: 41127 - DNA, 1187 bp, Bovine  19866881326678
cgctcacagctgctccttcttcctgggtgtggtgaggggccactcaagggacacaacatgcaccttaggtggctcgctgggggccctggggagcccaggtgaggtgttgtggggtggaggtaaccagtgcagcagagatgggcaggatgaaaggctgccaggaaaggagcttcgaggtggagagaacatggctcaggcagtgggtgatggatttctaggatgttggtaccatctctaaagaaaacggaatgactgggataaccatgccagcactttccagagagcaggaaatgcgatcactgcacagtcctgacccaagaggaccaaggctgtctgaggactgttctctgccaacaccatgaaatcacagatgccccctctcccgaaatgtttctagaagttcttggagatgagaagaggcagggagagggacactgaaaaaaagtgagggcttataaagggaccttatgtactacagaaaaataaagaagtaagactcactgtgtttgtgactctccccaactccttatccattctgaacaaccctgcaagttggcatcttaagggaagtcatttgggattctgcctaaaggagagacaaaagaggttctggacattcttcctccccatccgattaggacacatgttcctaaagggaagcaggtctcaccaaaggccagtgtgctaggtggggtgttgagtgggctatgtcactgcattaaaggaagcatggccaatgcacccaagaaatcagtctttaactgtggaattagagcactgacaatgcccaattattttgctcattaagacgactggtctggactggattgaccattctccaattaactccttggcacttggctataataatgattgaactaactcatttgactcctagggtggctgaaaaagcagatgcgagtaaactcattttacatcattcaaacacactttcctcaccaagaataaaagatttctcctctcccaggagctttggatttctaagcaagtagaatagacttaatgggcaaaggcgatggtctgacaaatgtgagtatttgactcaaatcctggctctgtcatttttttccagagtaacttgggcctgtgcttcttctctcctttatgtgggaagaaagaagaccccctgggtctgagggaccctgccccactcacagctgcccctt

SEQ ID NO: 41128 - DNA, 4969 bp, Bovine  19866881388251
taaggtaatatatgtgaaatggtttggacaacttaggaaaatatgtggcaagttagggtgttgatgaaaacaattaccgtctttgtgatcagtattggtgttaggattttgatattgctaataatacctgcaagcatatttatttattgatctttctaaattgacttgaacctgaaatccttagcaccatttcctaactagccaaagcatgtggtgtaaaaatttcaaggacatttggaaaggttaggccccctaggccaggggcctaaccaagaatcttctactcttactcaggtttgactcatggatcactgagatccatgagagaaagtaaagttgagccatctgtctgccaaaaaaggatgcttcctggcactcaatggggctcccagtgcattggccagaagaggctttgaaagcctccatggaagaaggctggaagctccatggaagctctggccctgggtggagtctcccaagctggaatgaagcctatcatctgtccaggagcccctaagcagagtgtagtcagtctgcatggtgctctagggtgaggccacggggattatacacagaggcaacaagcatgagatcaactcaagagcagtaaagatgttgttcacactgaattccctcccatgtccctgttcctatagtctgttatcttcgagtgtagcaagaaattagtatctagtgaaaaggattttctcgttgacccaaattcctgggcattgactataccaaggtactttgcaaaagagaatgtagcttaaaattcaccccagcaccagactcagtctgtcttccaagtcctcttacagcagcaaggccatggctggaccaggctcctaagaggtctctcttccctctcttttcattcctcatgagtcaaattctttttctttacttaaaaaaaaaaattttagcattgtttttcaaataaaaagagccataactagtcactatgcaaaatctggaaaataaagaaaagaagaaaccaacaatctgcagtaatctaacagccaaccaacaattcaatattaacatgttgatgtatttcttgtcagttttttcatatatattcttttcttcttttgaacattattgaaatgctattttatatgcctctttttaaattttatatatgttataaacatttttccaagtcactaaatgatttcaccccacttaacattatgttgtaaacatttttccaagtcactagatgatcttttgaaatttttatttttaatggctgtgtttccattgcatggatatgtcttaatttatccattcttttttatgtacatttttattgcctctagtgttctgctattataaacgtaaaaacattcttataaataaatcttggtggacatctaagggaaaattcctagaattgaatcagtaggtcaaatggcctatttttaaagttcctaatgcgtaagtcagcccctgaaaagtcaccaatgtctatttcaaaatctaagtccccttcagtttctcatgttaaaatgcatgttcctaggccccagtggcatggaaagctctgaggacagggtctaggaatatgtattttaatataccctctcagtccctatgcacattaaggcctgaggattattgataatattgtgttcaatttaataaacactcatttttcagcaatacttactagacagaaaaaagtcaaggaactgtaagctagtacatccaaactagaatttaacttaaaggtgttttttggcttctgaattttagatttctccttaatcgtgatatgatacagttgaaagtttatcagctagggagtttggaaactttactgtaagtataagataactgagccacagaatagttgattcactcacttgtggttgttacgaagagatctagtggcagaggaagaactagaacttgagtgacaaagggcctggatccacccaacctctgagtagcatcactaagtcctagcttgtactgcttactgcgcaacaggacaataaattgagagacaagttgttgggtcaaaaaataccaactttatgcagaaagccagcaaccatcttacccaagttagagttcaggcttcttttatactaaaacaggaacagatttgactggttgttgcaaacatctagatgttggaatcctttgttcttacagccttctacatagatctggtcacaatgttccgataaacctccagcaagacaaatgttatgctctgttatgcaactttttatctctatatgaatggagaagtgttatacttttaaaggtcacagtcttgagaatgggatatcatgaacattttggactactggcagcattctttttcacaaagtgttgagccagcatgcctaagcacaggcaacagagtgcaagggttagagctggaggaatagctccaatatggagtcagatttgttcttctctggtacattagtagagacaaggcactgtgagaagactgactcctaaagtgagcccctggttctaccagagaatgtgtatctgccttctgataggcagggcatatctcaggatacgtgtgggcagcccagaccctgtgagggacaccgtaagagactaccctgtgctctgagcactgagataataacacttagtccgaggaagacatagggcagccatgtggatccaggccgtaagagccaagtaggaggtggggtccagagtcagaagccaagagaacagagcagggacagagcaagatttacactgtgggcaaatgttaggtcacgggagtcatgagtggaaaagccaaagccagagctgaggggcgctgccgtggttcagccttaaggatggagtctcattacccaaattcatggtcaggcgaggtactgcccccgtctccacctacctcattgtatctgaaaggtgctatgtgcttggctgccttctgatgggaggtaagtaagagcacatggccaaatggagcagtgagttagagaaaaggtccccaagaatggaaacctggaaaataagagaacatagtgaataaacaacaaccaaattctaaaattctcaccaccttctaagaggaagtgtgactatccatcccatctgcataactcttctcaaagtcatcagaccaccatctcatcatttggctttcaggttcagcctcaagttcagcttccagagactgttcagcccccaacagtccccagttcatgatcaggttctgtaagacaccatctagattcctccatgcccaagttcacatgcatctcctgtgaatgcatcaggtgaagcacaagagccagaaccaagaggaacccagaggagaaccttcacagcatccatcttccatacagaagcatgagggaatctacctaagatcaccgagcttccctgcttctgtgcagggtctccattatctcttggctgtcctgatgcaggatcactaccctcctgattcttgacctcctggccaaacctgtggaagcagggtcttgatgggtatgggttctgggaaggttcacagcctcccttgaatcaggggtacaacagatggaggatgactttccagacatggctggggctgtttgagtcatccccatggggttggcccttttcaaagcccgattccctggtcatctgaacaccttccttggctgaggcaccttctgctactcagatggaattctacttgctggcaggacctggatccctaggttgcgaagctccctgtggtggtgacacattgcctcacatctaactcccaggaggtagaaatcagaggtccatgccatccagacaaggtgtccacatgctgcaggagagtcttgagcagtcaacagagtagaggggccaagggcaagaagtgttcagtggggcctctgacatctgacaggtgccactggtgatcccgtccttacctgtctgtgctgacttcatgtcccacccaccatcccaccaccccgtgctaataaggtactaactttaggaataaaaagcacttacacagtctctggctaaagcttcaggaagaccccagtccaggcaaagtctgtccccacctcatggctgttatatcatggccttcatattactccacgggagtgaatgtcaccggtatcaagtctgcctgctgggccaagaaatactgccttaaagaaacccaacattcccagatggtgaagtcctactactgatgtcaggagcaactggacaaacctgaggcctcaccctatatcaagagcctcattttccatcatcaaaatgccaaacagcacattgctatgtagacagtatttggaaagctggaacagtgagagaaacctgaagccacaccagtcaagctttggaggccccacaagtgactgccatcttgactggggaccatcaaaatgagccccaatgagtctatcaggatggctaaaattaaaaaaaaaaaaaaaaaaactgatgttaccaaatgctggtgaggatatagagaaaatggatcactcatacattgctggtgggagtataaatggtacaacactctgaaagagtttgatagtttttaataaaggttagcatatatataccatatattcccactcttggatatttacagaagagaaatgataacttaggtttacacaaatgaacctaagtaccttcacaaatggggcttccaggtggcaataatggtcaagaacctgcctgccaattcaggagacatgagacttgggtttgatccctgagtcaggaaggtcccctggaggaggaggcatggcaacccactctagtatttttgtctggagaattccattgacagaggagccatggggtcacaaagaattggacttcactgaatcgacttagcagtcacatgaatattcatagcctttttatttgttctagcttaaaactggatacccgccaaatgcccttcagtgggtgaaggataacaaactgatacattcatatcaggaatactattcagcaataa

SEQ ID NO: 41129 - DNA, 953 bp, Bovine  19866881471232
accggagaagctctgacttactaattttatatgatatcagagctagagttgttttaatgaaatggctaaacgtgtttgaagaagcatagctgtaaacacacatttaagaaggtaccaccatgccccctgcctgagccttatctgctcttggcagagctcatcactgtcgtccctgcttgtggctctgtccccagcgaccacctcatctctgcctctgctggggactctcctccactgctctggaccttggccttcctagagcgtccagctttgcctcttcctaacgatagcaccccctggtgttggatgaggagggccttctaccctagctcctggtctggctgagtcctacccgctacttaacaaacaaagcagcaggagatagagaaggggctagttctaaaaattagactctgttaaggaaaagacacagaaccccacttacttgtggcttttgggaggggctgaggcaaagaatacgaatggccaaaaaaagtaataaaaaggcagaaatgatgctgaaagttgcagtaatcaatagcatctgttcctcagacagaggggaattggagccacatgtggtcctgagatctggtgtacattttcaggtcattatttttgccagacactaaaattagtacatacctggagcgcatgtcatcacttaataaacttggtctaatttaatacaaattctcttaataaagtctgtgttgaaattattctgcatccctggaggtctctgctgctgagagagaggcacgtgctagcatagtctgccttacattcaagtggaatttccccagggcttcatgaagcttgggtcccccaggttccacaaggaggccaaggtctagtttgggaaaacatataagccatccccacggcccacactgaagagtcacaatgcacctttgtttattcaaagctctcagaaactcaccaagaaacta

SEQ ID NO: 41130 - DNA, 705 bp, Bovine  19866881854252
atcagaaagacctgtcactaaaggacactgatggtggtcccccttcataagttctctctgagttggtaacacagcaagtagagtgaatagattctgaactttcttttgatcctgaatgccctgtgcctgtggaccagctctactgctgtgccaagccaatatgagatggttgggggatgggtgtggggagagttcggcgatagatcatacatactaaggacaaaaagcccaagacatttgaaacatagacattcgcagagcctcgtggaagtcctgtaacagctctagttcttgcctgctatcttcttggccacaaaagatcacagaccagttactatagcaacaactctcctccaaaagtgtccacgttaagatggagatggaaaagattttcttatttaaaaaaagcagaaagaaagaaactaggtttttggatatatctgccatccacctaaagcactgctccctttctgagaagaaaaaagaagctgttattacggcaaacatgcttctaattcctagcagtttaatctccaaactcttgttttagactcaaagcagtccatgcttgttccaatacatccaagaggaatgtatcttctcaagaggcagaactgtgaactaggggatgagggaccctaagactagacggtgagagccttgtccacttccgggccaccttctggcctgggagggcccagccac

SEQ ID NO: 41131 - DNA, 1138 bp, Bovine  19866880086884
ccattttagttactgattcctagaatgtaacgttcacacttgccatctcctgtttgaccacttccaatttgccttgattcatggacctgacattccaggttcctatgctttattgctctttatagcatcagaccttgcttctatcaccagtcacatccacaactgggtattgtttttgctttggctccatcccttcattctttctggagttatttctccagtgatctccagtagcatattgggcacctactgacctggggagttcctctttcagtatcctatcattttgccttttcatactgttcatggggttcttaaggcaagaatactgaagtagtttgccattcccttcttcagtggaccacattctgtcagacctctccaccatgacccacctgtcttgggttgccccacgggcatggcttagtttcattgagttagacaagactgtggtccgtgtggtcagattggctagttttctgtgattatggtttcagtgtgtctgccctctgatgccctctcgcaaaacctaccatcttacttgggtttctcttaccttggacgtggggtatctcttcacggctgctccagcaaagcgcagctgttgctccttaccttggacaaggcgtatctcctcatggctgcccctcctggcctcaaacgtggagtagctcctcttggccctcctgtgccctccaggagacttaggaatcatatagtccaaccctttatttcacacagtagggcccatggcttagaggatcccacaaactgcagcatcctttcaagttctcttagcctttcacctacacctccaccccatcctgccaactctgccacccacctgagaggaagggaggcctcgcgtaggatgcagctgggtgggacgcctcctcttcccctggaggcgggtgacgtccgtcactcctaggagatgattaaaatgctgctattgttaaattttggcgagtagattctgatattctcccacagggctggtcatgagtcactacagcacatcctcaggaagaaactggctggactcccaatacggccagatcctgctgtgaacttgggacccagtgaactcgggtgtgaacttcaggctctcatggctgctcctatcaccagctggggg

SEQ ID NO: 41132 - DNA, 1199 bp, Bovine  19866880340260
aattaagctgtacaagaatttaaaggaataaaaaacacccagtgtatgtataaaccagaggcttctgctctaggctttatcccctgaagctgctccaggcctctctactgcacctctccacacagccacctagtctccgaggcaggtgactccagtgagataagcacttgggagccagctacgcttcttacccaaatgctgagaggaggtcctattcaaggataacaggtcatcttcagcaatggttctcttgatctttaggcaaagacggcaatccactaccctcatgtgaccatcaatactggacggtccagtcaccattctcatcatgtcatcctcaaccaccagtcagaacacacacccctctaaccccatgcttgatcattttttaacattaatttctccttccaatggtgacctcctacccaatgttcccacttaatatgggaacttactcaccatgatgttaactggtctcttccctgatgagagactgagtttctcgaatttgacatgacagataaccacagatactttttagagcttaattttaaaaccgtggcacattttgaacttccctgttgaattcaactgacccttccacactgctcctgggatatctgcctttgggttaaaaacagctccctatgactttaggaagattggcaaaacacccccaagtagacttacttgtatctagtcagcaaagacagaaacgtgttggaggcactcagcaacaacttaccagctacaaactctgttcctgcaagttctgcagtggcaaggaagtcatccagggaactctgttcagtcacggactgaagattaagtcgaccccaatcatagccatcgttgagctcacttgtgtgtagctatgagtaaaacatacagctgctttcttctgctcttcacatccaaataaacgctatgttctcaaaaaaccattctatggccttgagggtggtgttagctcttttagtcaacactagtaacagttaacatttaaatgggtactttcttacctcgtaatagttattttccttttactttcttgtttaattttcaaaatcttttgaaataaacttcatatctccatcaggattaaactggagagaataaattgcctatagtcataagctaataagtggcagagctaatatgtgggttataaatccataaaccatatacttctggttctg

SEQ ID NO: 41133 - DNA, 750 bp, Bovine  19866880399449
ttctactttttctttactgggacccaagtacatggggaaaaacccaaatttttgtttgataggagacgctgaaaacaatgaaataagctcttttcaaaagagtgaactttaggcacctggatgctaagtaatatgttttttcctatctgtacagatattaaactcattcttcctgaacctattttcatgattgaaacagaaactataaatcaaaatttctacagaatttttaaaaaacatttttctgccaaagaatgtggcttgtatactggcagtatttggagttggtatgttttcagctacaagaagcagaagactccaactcaaattggcttaaggaataaggatagttatcatttcttctaactggaagttcagaggaaggggaagcccaagcttggatcaaccagcagctcaataaagcaaattgttttcttcttctattctgcagttctcaattttggttggatcaaagactgccttgcttggaggctgaggcagccccaggtatagcatccagaaacagatactgagagaactgacagaagctatctcttccttgtatttttcttttcagaagcaagaaaagttcttccagcagactcctggcagacttccagccaatgctttgctgtacttgcgtatatgtgtgcgtgctagatcacttcagttgtgcctgactatttgtgaccccatgggactgtagcctgccaggctcctctgtccatgggatttctccaggcaagaata

SEQ ID NO: 41134 - DNA, 1972 bp, Bovine  19866880529492
aatgtagagtcttattcccctacccttaagtgtaggttgtactacctgacttgctgctgatgaatagaatgtgccagaagtggtggtatttgacttccaagactgggtcacagtgtagcttcaactgctctgtcctgggttgtttgctctgtggaacccagctgtgaaggggccctgctgggagggggtcctcccatcctggaagggggtccttccatcctggaggggggtcctcccagcctgcaaggggatcgtcctgtcctggaagggggtcctcctggcctggaagggggatcctaccatcctggaggggggtcctcccagcctgcaagggggtcctcccagcctggaggggggtcctcccagcctggaaggaggtcctcctgtcctgtacactctgcagaggaccacagcctgcctggtgtcctgactgtagtcttgtgggaggctgagccagaaccatagctcagtagctcctggaccttcctttttgaaatcatattccattgcatgcatataaagacttctctggtggcccagacggtaaagcgtctgtctgcaatgcgggagacctgggtttgatccctgggttgggaagatcggctggagaaggaaaaggcaatccactccagtactatattgcctgggaagtcccatggacagaggagcctggtaagctacactccatggggtcgcaaagagtcaaacacgactgagcgacttcacttacttactatatactacattgtgcttatctgttcactcactgatggacacctgagtttgtgctgctatgaacatgggtgtaaaaatatcttttggggaccctgctttcagttcttctggatatatacccacaagtggaattgctgtgtcatgtagtacactatttttaattttttgaggaactgccacttgaaccacctgggaagcctatgttgatgcagaagataagataaatggttttcaggtcaaacctcattacacatttttgcccttctacttaaaagattttacactttggttagtctctcttatcttccatattgctgtctatgaaatggggttaaaatgtattttagttgctctggatcccagctctcagagcttcaggagactctgccctttgagggtattcccctcatagggtcaccatggccaacaggaaagggtgctggaagtgggccattgttggcggcatcagtacagttctagtgtttgccattgcaatgatcatgggcttctcactgcagaagcgcaccgtcctgccaggccatgcacaggatgggacctgctgctctgacgcagacatgctgggctgcctgctaagtttgggtcagattatccaaaggacggcctgctggtcacctggtaccatgctgccaacagcaaagagcagatgaaggctgccctcagcaacagcatcacagtcctggaatcagacgtcacaatagaagggcttgacacagtcaacgagacaggggtccccatcacggtgcaccccccagccatctacagtgacaacacctgagagcagtggctggaggctgtgctgacctcttccgagaagggcatcaaactggacttcaagaccatctaggctgtgggccccaccctggacctcctgaggcagctgacagaggaggggaaagttcaaaggcctgtgtggatcaatgccaacatcctgaggggtcccaacatggtcaaaccaatagagatcaatgcccccacagttcctggccttggtccaggagaagtatcttgagataaccctgtctccaggctggactaccgtctacctgcccttgttcccaaatgggacatacacccagaccatggtggagaagatgcaggagctggtggggagcagtgccacagaaggtgaccttctccatgtgggttgtcatggccagggccgcccggccccacttcagccggctgctgggccaatctgacaggtacagcctgacaa

SEQ ID NO: 41135 - DNA, 1994 bp, Bovine  19866880588230
atctctaccccatttcagcctctgaaatgtctgtccctcctggggccgtgaaggacctggttcagaggagaaccgaagagggtgtgtcctctgcagcccacatctcctcagatcatactttgcttctcagtcgcctcttatttatacgtttttttttttttttttgcagggaagttgagagagagactagaactgcaattagctgcctgcatttactgtctgggcccacacccagctcatcagaactgtgctcacagcattcccatgccaaatgtgtcaccagagcctaattgtagcctccgagacagagagtgggagaggaaaactgggtcataagaaagtcaggggaaaaaagcagtttttgaaaaagaagtggctacttaaaaattaggattctcaagctggaaagaagcctggaaatagaatcaaagagttggcaggcacctcaggagttgtctgctcaggaatccctgctatagcagcctgtggacttcacccaccctatgactcccccttcttcctggctgatagcaccccaattttgtccagatactgagtgcccgtgtagttcatggacactccccaggcacactgatcaatttaagctaattaagctaattctttttgccaaggactggaggaggcacacgatgtgaccccacctcaccaatgaggtataaagggaagcctatgagggcttctgggaatattttctccattccaaaaagaaactcagtactgactccttcctatatttgggtgtatttgtatgagaaagtgtgacaccccaactgtgctgccatcttagaccttgaggggaaacccaaagagaagcccagagatgctgccccagatgcctgactccctagatatgctgtatcatctaccctattatgttagatagcagaacctctttaccaggctagatagcaaattctttattgtccaaatgacctttaatctgtgattcttttagttgcaggcttaagcctcctaactgacaggctagcccacgctcccttcacaggcctctactagaacacctccaggaacggagccctcactacattcctacctcaggcagagactattattaggatgtcttctctgataccaaactgaaattggatcctggcaactaaccccatgatggagactgatttctgccttctagaatcagaagcaataagtcatcagcctctttcctaagacttctctgtagcccttagagggcagcttccatgtctatctgcatctcggtttttgcagtcttttcaggtcaccaagagcctctacatccaaggctggttcaaactactaagtccatcaccctatagatgagaaaaccaagactgagagaggggacaggccctgctcaaagccacccagcaatccagaggcagagcctcttaataatggtaggcagatgatgataatgccatggaaatagtacaggcaatgaattattgatcttttttaactagggagagatcaagcagcttcatgaagggagagaacatttgagcctgattttgaactataagtagtacttttttaaaaaaagaaaagagagaggagaagccataagtaaatctaagaacggcctctgcagcagtgtcagcattccctatctgagtgatcttctggcctagaactgggcaccctgtgagatagcacatccctcctaattcttagaaagttgtttattaagctgtactgaggcctgcttctgtatatctcatccttttctcctaattctgccttccaggcccctagagaacaggaccactgcctcatccccacgttaaacctttgttgtggggcaggtcctaaactccatttctccaggctgagtaccccagttcttctggtcattttccaaaggacattgcttcactgtccggtcattgactttgggacaggccccaacttgttaatgtcccttcaagttggttgccgagaacgagcaagaccaggaggtcttcctagtagaa

SEQ ID NO: 41136 - DNA, 1369 bp, Bovine  19866880678557
tgtaacacattgaacttgaagcccaactctgtcacttaactaattcatgagcacattagcgttagagcaatgtggctttagagcatttagcacagtgcctggctggtggcagaagttgaagaaatgctattcccttcctcatttacttcttcaaatagtctttcccaggtttgagattctttggcaggaatgtttctcctgtgcctctccatttctctcctgtctgtaaagcatctgattaatcacactctttgatctttcccttctctggtcctatcagaactgcaccatcaagtcagtcttcctagtactgtcttaaatgatggttcctggtctcccttgtaaaatttaatagcaaaatgcttttgatatgcaagcttctttgaagtcaacccaatctatattccaaagttaaaaagctgttctgcaccatggatccttcttatgtgaacccggagtgtcagttgaaaagacagctgcactctctgctctactagttccattttccctggttccatttggagtttcctggagaaacatgggaaattgtcaggagatgaggaccccgcatcctgtggttaggactcatgtcaagggcactttttattcaccaccaactttatggagttcatgacactccacaggactttctaatttttcctcaccattcaacccccaccatcaccacccaaagcctaggttagaggtagggatgtctgtctgttccacaaacaaggaaacaaatgcagagaggctgggacaatttccagagagcacacagtctcgatcctacgtcttcttaaccagatgcagtgtcccaagaaaactagaggaaatcctgcctccagtagctgctaaccattaaatctggagttaattaaccagccagcatcccttccccaaagagtcaggcactttagaaatcaccatctgtagttggttaaagcaaactatcaggcgccccccacccccaccccaggaaaagctattactctccccccatttctctctctctccctctgctctcctcctcgcactacctcagggacatgccctttctcaacccatgcacctgagagcttggctcatagagggggaaccagagcctagggatgctgaaaaggtttacgcacatgtatgctcatctcaggcctgctctctgttgacctctgtctctgtctttctcttgtatacacacagaggaataccctagaacttctctccgtggctcttgggtgggactagagggcttccctattggcagaagtgaaattacaagaagccattgcactgctgtattggagccatgttcttaagacttgcagggtcatacacatctccgggagggtctcgttaaataaatgtcaga

SEQ ID NO: 41137 - DNA, 1243 bp, Bovine  19866880715686
ctttagaatttccacttcacttttttttctgggtctctaagacaaagcacacaacatattagcaccacctccgggggtccttgccagggtgttaagtctggcgtcactgcagagtgcttccattgcaataaattcttccttcaccaactttacgttctgtccctgttgatctggaatccagtcccagggcaggttctctaggcttctattgggacatgctggggaggctgtgtgcttcctttgttatatagtcctattctccccttaataggccccacgcttcccccacccagggtttgtgtgttttggggatgtgaattaaccctcattattggtctggtgacctggacgggaagtgggactagatcctggggtagaagaaaagaaccagggacttgttctcttgcaaagcagaggttcctatatttttaagcaaaggagggtagtagccttcaggtagggaggagtggttgcttcagcaggtgcaggaagttcatgattctcaggtatgttggcccagatgtccctgtcctgtgtcaaggtctcattccttcccaaccatgacaactatgacattgtagtattgttgaggtcaagaattccaccatctctgaagctcagctgcctttaagattaagctctgagcctgctcctaagcaatttctgccctgcagatgcaggagatgaaaattctttacatgctgccgagaagccctctcgctctcatactttgccttaaattggtaattagtcattctcagtctttccttatatttctccaatgcaggcatggctctttgggacagccctttgatcccagtcctcataattaaggggctgacttccttagccccttaaacaccagggagaccatacctgctgggacatcccttccaccagtcctctatcccgtttcaccaccagtaacagtcttagcaactgaactgtcccagcatgccaggggctccccaaatccacacgtcagccagcaggtaggggatctggccccacattctcattttagagtcaacttcctcaggcaacttgtggtaccaactgttttaggttgggttccccaggaaatacactctgacatgaagagctgtgagtaggttaatggagagttcttgcagccagaacaccatgagggatgaaggaagctgattaggcagaaggagacactgaagggcaatgagtcacaacaaggcctcagccaatcccacggtgagctctggggctagag

SEQ ID NO: 41138 - DNA, 2128 bp, Bovine  19866880745567
gggaaaagattatgcagaagcctgtgtcaccatatgtgccaggcgctctcctaactgcttttaatacacatttaaattcatttatttttcatgacagtgctatgaggtaaggacttgctatggtgtgacagtttgagttctccaccccacacctagaattcatatgctgaaatcctaacctccaaggtaatggtattaggagctggggcatttgggaggtgattaggccaggagggtggagccctcatgattgggattagtgcctttataagacagagagctctctggcccctctaccatctgaagacacagcaagaagacagctatctatgtatcaggaagtgggttttcaccagacactgactctgccagcactgtgatcttggatttcccagcctctagaaactgtgagaaataaacttctgctgtttacaagctaccaagtttatggaatttggttataatggcccaagctaagacggtacagttatcaccccattatgaggaagagaaaaggaggcatagacaagtaagcaggcaggattccaacccaggcagtctggcttctgagctcaggtcatacatacgggctctccatgtgacacagcagcacagtgctgcctggagaagtaaggcttctggcctagaagccgccagaagacctcttcacaagtgcttgagaaccacacttgaatgccagcaccttccgtgtttctccttacagtggaaaacatgcaggatagtgcatgtggtgctgctggaacagctgtggggcatcacattgtgagatggtgtgagcctacagacaagcagttgtagggtcttgcacccagtcacactggaaatgtcacacccatcgcaccgaaactgtcaaagtgagctgatccagcatgaagcagtgtccactccccatccgctacaaggcctgctttcagccacaggaattcctagaactttagttacagcaacgcctctctggagggtccctactaccctgatggataaaagaatggtcctgtttgacatgtcattggcccccagtcctagggcatctcccagtgtatcaatatgctttgctgtgtttgtgaggaaaccatgccagactggccaaggaagctgagaaaagtatggtgtgtgtgttgctaagatacaatgcatctcttttgggattgaccagactgcacttccatgaggaccacaatctgaggaacactgctcaggggaaggagcacaggctcttggatagagcccaggactgtgaccttggagccttgagttcaatcttgctctctacttactaatgtaatctagacaagtcaggcatctactctgggactcatctataaaatggagggaaaactccagcgctcacctgtgtcacagggttgtcatgggaatcagttgaaataatgtacaacaaagagtgtatttgtctacagaagaaggtggatgtctgtgagaggtcacagcccagccacacgggatctttaccaaacccaggtcatttgctggttctagaataataactgaaaattcttggacccctcccagctgctaaagctacccacaaggtcacctgaataatagactatgacttacagtctttctgccagcctcactcaaaacattatcaatagaccaaagatccattgagtaactggcttccttttgggggaggctgtcccactaagggacactaagagatgtggaaagggatatggagccacttttattagattgcctaatggactcacatgtaggaatagctctgctggaaccctgagtaatctttcctctacttccaactcaacttatctagttgacttctaacttcacttctacccctaaaagtctctgaatctatgaagctgattcactccactactgttgccaattcaatttacctctgtaaatgccgtttcccgtctgcaaaaaccaaattgcttttccttcctgccagctgcagggtgctgctgtgcagtttaattagacagtcactctaaacccaatgatctccttggaggacgcctgcctcactcagtcactcagttgtaatgagatcattgttggaactagcagtttacacagccttggaattcaagcaaagcacaccagacttgacaccaaa

SEQ ID NO: 41139 - DNA, 2619 bp, Bovine  19866880858122
atgagtgcattgtgcggtagtttgagcttctttggcattgcctttctttgggattggaatgaaaactgaccttttccagtcctgtggccactgctgagtttttcaaatttgctgacatattgagtgcagcactttcacagcatcatctttcaggatttgaaagagctcaactggaattccatcacctccactagctttgttcgtagtgatgctttctaatagggcccacttgacttttagatacgtttgtgttttagatagttcactctggaggctgagtggaggatgaatttgtctgaagagattgttaggaggctactgtaatagttcaggttggaaaggatgactggaatgtttgccagtggaaatggaggtagagatttgaggcttattaaggaggtgaaatagaaatgactagatgattggataagacaaggggctgaatcaataatgactcacacttggacttttctaatggttcagtgggtaagactttgccttccactgcagggggaagaagcaggatgggtgggcaggttccatccctggtcaggccacatgccctgctgcaaggccaaaataaaataaaaacactcacattcattctcaactttctaattctgatggctgtggatgctggtgccaacagctgagggaagggctgctttgaaggcagagggcaagtttagttttggacaagctgagtttgaggcacccctatgatatctagagcttcctggcaggcagttggatatttgggtctaactcttgtggaagaggtctgggctgcaactgctgattgggtaattgcaacgtgaggttggaggtgatctcctaaaagtagaatgagaagaactgtgggtttggagtcttgcatataaggtggagactcacaattagtggcacttaaggatgccacccaaggaggcagaggccttatttactgagatgtgagaactggaagagtatactcttccgcaaaccaagagaatgttgagattccagaaggtgggggtcatctgaattgtcaaatgtaacagagagacccagaaagagaatgcctgcagaatgcctactaagatttgggagaatgaaactcaggggttatcttacccaagcaggatgaggaagggtgtgtgttggggagaagaggggaagctggaatgcccagtgaggagaaatgaggaagtggagacagcagagagaccactgtttaagaggtcatgagagggagtggagcccttggaagctaactggagagggtacttggagcggaggttgggcgccatagttttgtttttaggagctaagcttgtttaatggccgagggaaaacagcgaggatccaagtagcagtgagaggtgaggaaggaagctttatgggctcaaccccaccaagacagcttcttatagtttgcccaacaacgaccacgctccttatctcatttactcatttgagggaggaaacagacagtgagactgatcccatgggctagagagagggctacagatccatctgggtacagtgtgcgccacacgacgcggtacgaggaagtgcgcgtaaactgtcccgctccaggtgacatagaggcccaggagcgtgttcctggctcctggtgaggcgacatcgatgtcatgggtgtgtgctgtctcagatgaggtgtcaccacgtgtcgtggatcaagggtagcaacccccaacttgtaggatcatgtgccaggaaccagagcctgacagctcccaagggcggtgcaccagaggtccggagcctcttccgtacttccgcccctgcagatgggagttctgttggccgcgaggtgaatgacactaacagtgatggcggggcctaaagggcacgggcgagagtcttatggcgaaaagatggccggagcccgaggcagcaggtggctgagtgcgctccttgtgcgggtcgcccaagggacgccgcgaaaatcgagcccgaggcaacaggtggctgagtgcgctccttgtgcgggtcgcccaagggacgccgcgaaaatcgaatttgcgatttgctcacgcggccggaagatttgttcatctctgtaccccgagataaatcttctgctaggggaagtatttaatttgcatccagcgctgtcggaagaaaatccctatcactggaggaggtgtagtgggcgcgtgggagctttctcttgggtacgccttccagtcctcctcgcaaggctgggcaccgctgagtcggttgttaaatgcgatctatagtttttggtttctgcaagggggagtgtaatgttaaggaaccgcgagccgagccaggatctgacctcctctccatcattcttgtacaagctacctctgtgaccttgactctgggcaagtcaggctaggcccctcactacaactcggtttccctgttcataaaatgaggatttggactgtaaactggtctttgcacggcggccaagatggcaaatatcacctcctcccgccaaaaaaaaaaaaaatgccgtcctgcgttagtaacctacccaacacacagctcctcagcagcgttcttactccctctttctcttctgctctggcctggggaaaggggactgaaggggaagatgtgggcggggcctggccatcgccc

SEQ ID NO: 41140 - DNA, 1189 bp, Bovine  19866880965377
tagagacttactttcccttttcactttctgcattggagaaggaaatggcaacccactccagtgttcttgcctggagaatcccagggacgggggagcctggtgggctgccgtctatggagtcgcacagagttggacacgactgaagcgacttagcagcagcagcagagctaggtaggaacgactccaaccctaggactagcagaattggttttatcaggtggagtgaggagtgggtgttttgtaaggtgatcaatgaataaataaacaaaccagtgtctaacagattgcctttataggaaggcatcactgtggttctctagcatcaagaaaaagtcaaggactccaggtggataggtcatttccctgaatcttgcaaagtgctgcctgagaaggcagcatagttcttatgtctacaagaggaccttgagacgaggaatctggatgtgagcagctgtcgcagaggcaaattctctgaaagataaaagaggaatttgtatttgacacactattttgagatcacaaaaggtcaatcagagaacacagcatttcacagtgtgttaatgttataggcctagagagtccctaagtcaaggactcccagagacagaactgttctccctggcaaacaccattgtgagatttgggcaagtgatttaatctctctgggcctggtcccccttttataagtgataatactattagtactgactgcacagcattgttaagaagaaaaaagcagtttttatattacaagcaatcaaagcagggcctggcatattgtaaacactcaagaagttatagttactattacgatgaaggggactgtcttaactaaacagtggatacaggtaaagactttgagttttctagatgttgccttaaaccatttccttttcagttttgtccctgttagatccaagtgtgcctactcctaggacacattcttcaagacataccccagaaactgggaagaagagagatcaatagttgggggactgaaaggaagaaaagggtactatctattgaaatacccttgctaaaagaaagaaagaaagaaagaatggaatcaggcagccctctagatgaaactaccaatttactgaaaatctaggggacagaggagccatagccataaacaaaccataggggtacattcagcaaaccacactgggcgaactccacagggcaa

SEQ ID NO: 41141 - DNA, 1576 bp, Bovine  19866880989791
agctgggtgaggcggcagtgctcctcccagcccagccccttcctctctctgcccagtgccagggtaagacatttccctccatccacctgtggacccggctcctgtcagccctggctggtctcctctacgcctcagccatcgtggcccatgaccggcggcctgagtacctgctgcgggccacgccctggttgctgacctcgctcggccgtgcagcgctggacctgtctgtatccaccccgggtcccggggctggactgcctgtgtctcctctcccctctgccccaccacgccctcctacccgcttggtagaaagaattctttctcagtggccagggtggtggtttgaagcctagggcaggcagacacaattgcagcgtgcaattatgtgtttttttcttttttcttttttttaaataagaagaaggatctcttgactggagctctgtgaaattgcagagagggaatgtgaacttcttggccctgagctcagagaagagccagctcctgtctccatgctgctcccctctgctctggccccaacaaccctctgtgaatctgttttctcacctttgccttgtctttctcgtgggctggaatgggctttgagagctgacttggcctgcacagctgatcctgcacgtcctgtcctatttggtgctggagcctggggtggggaagcagggagaaaagctgtccccctttcttgtccccagggggatgttgcccaatgtgctgacaccccggtgaccttgctgtgagggcctcaagggcacactaagctcagacagtggcgggtggagatgctgacagtggataagcctcggctggcgagggagtgtgtgaaaaaaccctgtggatttagcataaaagttacgaaaaagattttctcacctacattgccacaaactcgatggcttaagccaaaggaatttattctctcaggtttggagaccagaagccccaagtccagacagggccacactccctccaaaggttccgagagagagtctcgccctgccttttccggcttcaggtgggctcctggggtgccttggttcctggcagcataattcccatttctgcctctaccgtcacatggcccttttccttttgtgcatctctgcctgtcttctcttcctctgaagttcctgttgtgggacttaccttatccgccctaggccactgccaacctcatcttaactaactcttgatatcagcaaagaccctgtttccaaataaagtcacattctgaggttctgggtggatatgaatctggagaggacgctgttcaacccactacgtgtaccgtccctcctaagccgaggaagatggttttcacaatcctttggtttaacaagtattcaccaggtgcttgttggagcacctggctgggtggtgggccctggggggacagagagaattggacctggctctgtccttagatggtcttgtgtctgctctgaggcctaccctggaaggatgattctggggagagagggcgtcactccagggtggagccctcggggtgccaaggtaaaggcagcatcaggcaactaaattctctgcttccttaacc

SEQ ID NO: 41142 - DNA, 1320 bp, Bovine  19866881000026
atctctccttttcctgatcccttagactgttaattagaccttcttagaagggacacttttaaagatgttacatttaaattaaattaattttattaattgaccaagggagagacgttaaacagtaacatagtattgttgggttatgagtggatttaattttcaagggtgtcctccaatgccatgagcacagctttaaaatacattagatttctctcaagcttgttgcctgattttttttccacagctttgctgctaagacgcttcagtcgtgtccgactctgtgcgaccccatagacagcagcccaccaggctcccctgtccctgggatcctccaggcaagaacactggagtgggttgccatttccttctccaatgcatgaaagtgaaaaatgaaagtgaagtcgctcattcgtgtccaactcttactgaccccatggactgcagcctaccaggctcatccgtccatgggattttccaggcaagagtactggagtggggtgccattgccttctctttattgagatacaattcacaggctatacaagtcatcgatttcaattgcatattttttgtatattcacagagttgtgcaaccatcaccaaagtcaatttcagaacactttcatcatctttaaaagaaatcctatacctctcggccattactccccatttcctgctagccctaggcaatcagtagttcactttatgtcatgatagatctgcctatcggaacatttcatataaagaagcataccatctatagtctttggtgactaggatttttcacttaacagttttcaaggttcacctatattgtagatgtgtgtgcccgcttgccacatctcttcagttgtgtctgactccttgagacccttatggactagcccaccaggctcctctgtccattgaattctccaggcaagaatactggagtgtgttgccatgtcctcctccaggggatcttcctgacccagggatggaaccctcatctcttacatctcttgcattggcaggcaggttctttacctctaagccaccagggaagccccatattgtagatgtatcggtactttattcctttttgtggctgaataatattccatggcatggatatatcatgttttctttatccattcacaaatttgtaaagtgttaatacaaagccagcaaaaagggggaaaacagtaagtaaatctcaaggaagtaacagctcctacagggttcagagtcatagagaatcagaatggaaaagaaaagactgagtgatttccatgtgggaaaacctgaaacccaaggtaggaaagccatttgcccagggtc

SEQ ID NO: 41143 - DNA, 866 bp, Bovine  19866881233502
cctttgtatagatggcaatgtgaatgattcccaccctgcctgagttatacattgcacaaccaggcccagcagttgacacagcccctttgatcccaggtatccttccaacaaattcccttttctgttttacttacattagccagagtctttttattgttgttgctttcaacctaaggaaatttaaatattaagtcttctcctgtcccagtggcctacttcaagtgtctactctatatgagacctggttctggagtttgactttccccatggtatgattcatccattttgccgccttgttagttctcatagaaagaaagcagcttagcacatactgcttgggaggacgccaaacattctactccaccaaacctggcagtctgtggctgggcacgctagcacttaaagattctctttccttccacttctgagcccaagtggaacaaactctcacaattaccgtgggtgaaggcaggccagctgagcattctgaacactttttcagtggacttgtaacatgggtgtctttctagaacagttttgcaatatataaagctttaaaaatgccctttgcctttctgagaattgcacttctaagatcctctcttaaggatctgaaaggtcattaaagacttatgcccaaaatggccactgtgttttgattgtaaacacagagcttaagaataaccagaatatccaatatatagttgacccttgaacaaaacaggtttgaacacagggcccacatataccagattttttttcccaataaatatataaggaatatggatattccttatttgtgggctttaacatctgcaggtatggagggccatatgcactcattgccatccgctgtttcatataag

SEQ ID NO: 41144 - DNA, 1524 bp, Bovine  19866881263036
tacaggattcgtgacttacaagatataccagaatgcaaacttttaaggttgtcttctgccctctgatccagtgttctttcctttaggtagggtaggctttgggcatcctgtgaagattgccaacttttactgtagacattccatctgactcccttctaggtgggctatccaaacgttggtaagagttcaacaatcaacaccatcctaggcaacaagaaggtatctgtgtctgctacgcctggccacaccaagcattttcaggtatttccacagcatcagcctctgcatttactcctcagacagttcctccctctgagtattttctggagttctttgccgctcgtgtgctgctcttcttccccttcctgtgccgtgtgcccagcctaacccccttacttgtccttcagactctctatgtagaacctggcctctgcctgtgtgactgcccaggcctggtgatgccctcctttgtctctaccaaagccgagatgatttgcagtggaatcctcccgattgaccagatgagagaccatgtcccacctgtatcactaatatccttggtgctgtgccaaaattgtggttgttctgtgtatattggagcttcagaaaaatctgggtaattaaacaggggaggtaaaaatcatccctccttacataattgtaaggattagaaacaaagattgtgtgacttatctctgaattaggattatctcacaaatctgtagtgtatttaggtaaaaatttgtcatcttgaagtctgtttcagagataatatttttaaaggatacatttgtaggtgcatacatttggtgcataaggctttttttaaaagagggactgaaagtcttttaaaattaagaataatcatacttcttaggagaggtggaaagttttttgtcaccatggtgctgaaatacagtgttcttagaagatgccatggggaggaggaggagggtcagttcagagaagtagattccttgacaagcttatgtttgccagaatattccaagacatgttttagaagctacatatggcattgacatcataaagcctagagaggatgaagatccccggcgacctccaacatcagaggaactgctgacggcttatggatgtgagtggtgatttattttaaaatgtgaacaaaaaataacaatataattactgatagaagtaccctgcaaagatacaaattcagaattttcccttagcattttgtcatctttcagggttgatatttctgtggtcctgttggtctttcctgcggagtagcctccaggtagctgacttggtagtggttttggggtctggcagtaaaggagggggagccggctgctgcctgagtggtattttatttcatgttaggtgctttttagagttagagaaggaggtgtgctatattccttgcctcttccccaggttttaattgcagaaatcagtgcctgggagacgtgtcttcccaggctttggtggtttcaggccctttccagtaggaggccttggacccaagtgtagacgtagggg

SEQ ID NO: 41145 - DNA, 874 bp, Bovine  19866881307079
tgggaaaagtatgatgacaaaaatccggaaaatatctccttgtgtcttcccagatgctgggtctggaagacatccatgagaacctgagatgacctgaggttgtcagagagatataaaatgcaagaaaaacataaacaactaacaggccgaatgcagcagatcctagaaccgaagtgagcagtccgggcttatatcacaggcctggagggcgtgtggtccctgatggcctgagaatagaaccggctgccaccgggatgggagtggcccggacttcctgccttttggttagacagactgccttcctgaattactaggtctaggaagtggtggtgacagggtgggggtggggtggagaagtcacacgtgtcacggacaacccccattgcagccctcttcctcgctgccacctcacttcccctcttatagaccagttacctaatctgcagcacgcccagatggtatctgggagctctaacggctctgaaatcacacagttctagaattcagacacaagagcagcagctaagagacaggcaaaagcccagccccaaaaaccagtgctggatgtcacaggtgagacaccgagtgtggggtcgaggactcgaacaatagccaggccacgtgcccttacgtgcgcagtcactgttcttgcccatgtgggcattgctggcaccggtgggaagacacaggttacacaggttggtctaccgggcatctaatccataaccctggtctctctccatcacacaacactagacactggcttacatgggacttataagcctgggcgcacctaaccttcatccctccacccctcctgattctggtagcactgggagaaacacacccctgcctcccttctctcctgaggagg

SEQ ID NO: 41146 - DNA, 1303 bp, Bovine  19866881671362
tgaatttttgtcccttaagactgattggaaagagtaatgggcgtcagtttttcatgatgatttaagatagtgattcttaatcatgggcaattttgccctccaggggacatttggcaatgtctgaatacatttttggttgtctaactgaagacttgttactggcatctcgtgggtggaggccaagatgctgttgaatatattacaatgcacaggacagcctcccctcaccaaagaattatcttgctcagaatagcaatagtatcaatacagagaaatcctgatttaatgtaaggtacaattaaatattgaaacttagtccagagtcctgcacctgcacttcaaatattgggatctgaagtaacttaaattccatgccataacatagcaaattatgaatagaaaaagaaaaacaaagaaaaaaatagagatacaaatatgttaattattttaatcaacataattgctacagttcaactgagctttctccaaggctaaaaagaaattacaatcagttgtataattttggtaattaaaaagaataattcctaaaggacattgcttttccaaatataaattgtaaaatgttattttcataaagtattttataatatggtagcaataaatgacctgataatgcgaagggcaatgttttcagtgttcatgcaaaaaatgcaaaagttagttccatatggctatttataacaggaacttagataaaagctatgcagaaaatattcagatgaaatgccttcagggtaattctgagaggcactggattaatatcactccatttggagccttctgttggtctaatttgattactgaattagattatgatacctggagagatataccgtctaaggaaaggcacaactgaaccatggcctggagcccttattatctttttaaaaactttctgtaaatatactatttaaaaaaatatctttattgagatatttttcacataccataaaaatcactgttttaaagcatgcaagtcagtggcttgtggcatattcatagaactctccaactgtcatcatcatctaacttcagaatatcttcattactccaaaaggaaaccctgtactcattagcagttacttcttcatacccctgaatctccgtcacccctgaaaaacattagtctacattcctgtctctgtggatttgcttattcaatctttctattgccaaacaatattccatcatatggaatgctcattcatcaattgatgggcatttggattgtttccactttatgattgttatgaatgatgctatgaactttggcaaattttta

SEQ ID NO: 41147 - DNA, 2446 bp, Bovine  19866880360706
ctaggtgtggtgagagttgggcctaaaggaggctgagcaccgcagaattgatgcttttgaactgtggtgttggaaaagactcttgagagtcccttggactgcaaaagagacccaaccagtcatcctaaaggaaatcagtcctgaatattcactggaaggactgatgctgaagctgaagctccaatactttggctacctgatacagggagctgactcattagaaaagactctgatgctgggaaagattgaaggcaggaggagaaggggatgacggaggacaagatggttggatggcatcaccaactgaatggacatgagtttgagcaaactccaggagatagtgaaggacagggaggcctggcgtgcctgcagttcatggggttgcaaagagtcagacacgactgagcaactgaacaacaacaagaggtgcaggcccacgtttaaccactgctgggaggagcgtcataaaccaccgtgaaagagaggcagctgcttctgcccggccggagctctgccactggccagcacctctggccggtgaatacaaaatcgtctctgttcttgagttacctttgggagggtctcgccaaacttcaccaccaactccccttcgcttccttcttcattttctccttcctgactcttgacaaaacctgtcggggggacaagaaggcaggttttcagaagaacagcacaagaacgagacagagaagactgctggggtcgctccagcaggaccagggaggacacccatcctcctctttatctgttggggccacagcatcgttgaggagcagagcttgctggagattctgttttggttcaggggatggtcatttgccaacatggtctaattatttttaagacactcagagattcccctccctctcggctcctctttgccacaaaccaggcaatggaggactcatcacatcataggcaaggaggagattaggaaacaggacggctctggctcgtcccacgccactcaagataacagccttttgaaatgctaatttaagcttcctaacattctgtttccatagaaatgtatgcaaatgtctcgatagtttattaaaaacacccgcacaaaaatcctagtcatttttggaagtgctatgcccttgctcggtgaactgggacccggggagacttcagggagaaggcggatctgtcaccaggaggggagcccaggcggagtctgcggaggaagggaggtgggacggcactgcagcaggtggcccatgtcttgttcccagtttctggaagcatctgtcaccccgtgacacagggcctgctgttgtggggctgactccccacttcccactccgggccatctctgcaagaagagctagaaaccgcacagactgcctcaccgtggcacggctttagacagtatgcctagaaacgccccctagaaagactatctcctaaacccagctgtgtgcgaaccgctcctggctgacgggaggctgtccatctctagctcgctttcagatgctcagaccagctgagaaagattgtctgtgatgcaagaaagaggaggcgaccctggggaagaacaggtgatgaccagcagctgctccatcctggcgctggcctccatgagctctggacctttgcccaggactctctggtcattccagagccccggcctgggggacccaggagtgggccaaactccgcccagaggggcaggcagaggatccagttgccccgctgcccacctggtacgtctgtgccccagggaccaccccgaccctggagcagcagcatcgcaggtcactgggggccccgcagtaaccgggtctcctcttacactgtccacccgcagccccactctctgaccctgtccccaccaaggcccatcaggaaagccttcccagagacagaagagaagcgtcaccagggaccaggcattggtgaaggggccctgcctgtgccccccccaaaaggcagttagttgagcgagcacgtacttctccaagcagctggagtggaactccaggtagaatttggtctgggacttggtcttcagtgtggcgtagcacccgagaaactcgatctgcccttggctgtcagtggtcccggggcctggaatagaggagagcagaggttcggttccacagtgtgtctggagacagagcgcttcgatccagcccccctcctcccctgtaacaccgagctccctccttgcgtccaaggtctaagtggagggagtgtgtcccctgaaatcccaccacccacgccggtaacagcctctctgatgagtccaagctggtgcagggcagagggaagagttctacgctcagctttgccaccaaagctgtgtgggccccaggtgacgcccttaacgccgtggcctctccaggggttccggcaaagagggctggtggatgcccaaacctatcttgttcctaagttcacatggggaggcaggcctgct

SEQ ID NO: 41148 - DNA, 2005 bp, Bovine  19866880361123
ccccgccagcccccttcctcagccccacgccccgggtccgctccttcacctgctccacctccgagggccgcccgccgggcggggacaagagccaagggaagcccaagaccccggccggctcgcaggtcccggtccccgtgccggtcccggtgccggtcaagaggcccatcaagccttccagatcgggaactcagccagcagccccttgcccgcccaggggcagcggccgcccctcccggtcaagagcccggccgtcctgcacctgcagcactccaagagccgcgactaccgcgacaacgccgagctgcctcaccacgccaagcaccggccggaggacgcgccgctcagccggaccgccatgcaaggtgcgctctgggagcgggcaggcgggtgtgcgtgcgtgggtgtgccctacaggtgcacgtgggtgcatgggagtgctacccagccatgtcgggagtatgctcggtgcacctgtgtgggcggtgcctgcgtggtcggagggtgcctgtgtgtgcatgcgtctgctagaacccaccaggctaggaaccgtgctctggtgcatgtgggccctcatccatggccatgtatgcgatagaccaaccctacccaggagtgggttccgagaaaccctgccctgggaactgcaaaggagaaaggaggtgaagacaggattcgaacccagcctataccccaaaatccctgctcctacagttgaaaggttaaaggaggggctgtgggtaaactgagtcctctatgtcaggcccagaagaatcaattcagtcactcagtcctgtctgactctttgccaccccttggactgcagcatgccaggcttccctgtgcatcaccaattcctggagcttgctcaaattcatgtccattgagttggtgatgccatccaaccatctcatcctctgtcatccccttctcctcctgccctcaatctttcccagcatcaaggccttttctagtaagtcagttctttgcatcaggtggccaaagtattggagtttcagcttcagcatcagtccttccaatgaatattcgggactgatttccattaggatggactggttggatctccttgcagtccaagggactctaaagagtcttctccaacaccacagaagaataaggcttcataaatataaaagagcccagatcatttctatttcatcatcatcattagtgttagttctttaaaatttcctagcgctctagagacttcatactcaatgtcctcttccttcctagaaacagatttctttttcagcaaaacaaataatggttaagagcagattctggtgctgtcctgggcttgaatcccagctctctcccctaccccagtctctgatgctgggccttgggcctcagtttgtgcatcagtcagtggatgagcaatcagtggaacctgcctcataggtttatagggaggactaaatttggttatatatcattgttgtatgttacaatttacatgtaaagtatgtattatctattacatattatttcatatatattacatattactgtgtatgcatataacatatatacatatgtaatagattatgtgtaagttctgagaacagtgtgctggccctcttcaacactatgtcaggggaagcctgctctagcttggggcatgaaaagacatggggaccttgagttagttgtggcctggcaatgacgcagtgctgaatcttctgttcttgtcctgcagtgaagcccctggtgagccgccaatgagataggagcccagaggagcaacacgaagccactaggaccctctcccaggacccctgttcactcctcctacccagcttcctgcacagggcttcgtgtttttctggagagggccttgcttctgtgtggtcagcaaggcgcactggctgtgaaacctgatcgtcagtgctgaagctggaagaagcagcacaccggatgggcacccaacaacccgcacacctgggcccccagcttgatcttggtacttgggacccaagag

SEQ ID NO: 41149 - DNA, 1645 bp, Bovine  19866880500277
gctgttcgttgtggtgttccggcttttcattgtgttgtcttctctcgttgggggagcgtgggctctaggtgctccagtttcagtagttgtggctcctgggccccagatcaggggctcagaaattctggcacacaggcttagttgctctgtagcatgtggaatcttccagactggaggtcagcccctgtcccctgcattggcaggtgaattcttacccactatgccaccagggaagtctgctaacttaatttttaaggtagaagagtcctttctcgtattgttcattttctttataatatagatattgaggtaaagcatgttcagggctttgtgaggcttaaaaagtgtaaaacttttcgcaggctctggggagccctctctggaaaagattggcttgtggtgagattatcagataacatggtcatgtttatggcattgtaatttttcttgactagtttattagttgctaattttattctcctttcaccaaaagggggaaaaaagaaacatttatatattattcagaagtacaaggtggggaaaatgacagtaacagtaatagctttttgtgtggtgatactgtgcctagagtgttctttgagaacaaggctctttttgttctagttgttctgaacctcgaggaagtcttgggagctctagcctcttcagtattggtcctttggttgcagagactgacagaattgtcagaggtattgttttggtacctaataattggtaaatcttggttcaatccttaaagagatggttacatccaggggatttcatggttagccccttaggaattgagatggtttttgcccaaaccatggctaattgagtgactggatgaagccatcttgcgagatcggtaggtcagagagccttaattcatgttctagaatctgacactttttaatctattagttctgctgttgttaatgaaatttctgatagtgtactatgagaatatgtattcttccccagccacagggcttggggcttccccagtagctcagtggtaaaacatccacctgccagtgtaggagatgcaggaaaaatggattcaacccctgagttgggaagatcacctggagaagaaaatggcaacccactccaatattctttcctgggaaatcccatggacagaggagcttggcaggctacaggatatgaggtctcaaagagtccgacaccactgcgcatgtacgcattcaagcagagggcagaggggctcactgtattgcttgagtgacaagaaggaaggatagtggaggatagtgatagtgggacagagtgggagattggggaaaggagaaaaagttacttccacaactctgaaaattgcaaggaaatgggaggaagaaagtaactataagcagtattgaacactgtcagtatgcagagaaaaagcttgtggccattaaacagaaatgtgggtttaattttctgtcgcttactacttgtagctatagataaagaagctaacttcttggaaccttgttttccttactggaaaatatatcccgtagtgatttgggaattaaaagtctaaaatgcgcaatacagtgcctggcatgtggtgttgataaataggctttcagtgattggtagtgggtataattgttattactatgcagatatataa

SEQ ID NO: 41150 - DNA, 1902 bp, Bovine  19866880544426
aatcatcagcccccaccactgatcatggtggcatggggggtgttgactgtcagacacaactgagcacttagcagcagcagcagggggcactgaccgtaggctccatgaaagctggaccatgccaagtttcgttccccatgagcacttagcacatggatgaccaccagaagcactcaatatttgcagaggcagggaggctccccgggcagaggttgcagtctgggaacttgacaaagccttaaaggcacgcttgtgcagtactgctgcagcaggggcccaggactgctccaaccaaggttctcacaaagtcaggtcatgatgtcaccgggataggtaaatacaaccccggtgggaagacagcagctctaatgtggaagggtttgcctccccagatgccttttagagataacccacttttccagctcccccagaagaacaggagacccagtaccctcagtaataagagtgcaaacagagcatcgcaggtaactgcccctccagcacccctccacctgggcactgccaaagccctggtagtaccatgaatgtgaacatcagctgtgcaacagaaacacaggagagggacacactctaaaggatctcaggccacttggacacggtgactggagaggtttagatgctctatctccgaaatcgtttctattcttacactatctcagaacaaatataactgtgacttatgtttcacagtttatgcagctaatttcatatacttctgacagctctatcttattttcagccttttgcaccattttttctctctgggaggttgaaggagcttatttctcacctccctaccaggccttgacatgggctgtggggccagtggctcttttaaggtgaccttggggcggggtgtgacccctagctctccccactcctgctcaacctgctgctgctaagtcgcttcagtcgtgtccaactctgtgcgaccccacagacggaagcccaccaggctccctcgtccctgggattctccaggcaagagtactggagtgggttgccatttccttctccaatgcatgaaagtgaaaattgaaactgaagtcgctcagtcatgtccgactcttaacgatcccatggactgcagcccaccaggctcctccgtccatgggattttccaggcaagagtactggagtggggtgccattgcctgctcagcctagaggagactagatacaggcttgagaacttgcaagaactcagatcttaaggggttaaaaggacagtctcttagacttgttaactcctttaacatttgaattaatagtaataataataatatgcattggactgagcttgatgcatgggttttacctacgtaattatatcttcggtgtttttaactgttgttattcagttgccaagttgtgtcctcctctttgcaaccccatggacttgcaaccccacaccaggattccctgtcccttaccatctcccagagtttgcccaagttcatgtccattgaatgagtgatgccatccaaccatctcatcctctgttgtccccttctcctcctgctctcaatctttcccagcatcagggccttttccaatgagccagctcttcgcatcaggtggccaaaatataggagcttcagcttcagcatcagtccttccgatcagtattcaggactgatttccttcaggatggactgctttgatctccttgcagtccaagggactctcaagagtcttctccagcaccacagtttgaaagtaaccattaaactgttgacatcttcccatttgttaaattgtcctcttagggttatttggccttaatttagttattgctggcttatttccccatcattcttctgatgtttgggcttccttactttgccctcctgccttgggtgcatgtgtggtctcttcagtc

SEQ ID NO: 41151 - DNA, 2934 bp, Bovine  19866880546420
tttgtttctgagctattctctcaagagctatggtaaaggaaacagaacatttctgtacccaatcttaatgttatttctattagagccttcatatttgctagtgaccatcatacaggctaaagagctgaaaaataaatatctaattcagatacacagcaactctgacaagtagccactaatccagaatgcacactggctattctgaatcaccgattgtctagatcacttttaaaatttacctcctctcgaagctgccgttctcgttcctcttctagtttttggatttcagccaatgatagcgttgcctgggactgacatgctgtcgtattggactgctggccccacgttgaagaagaaggaagctagcaaaaaaagaaggcagaagagttcatgcagacacatggctaggaaacggaggggcaacaatgcattgtgtacagccagaaccttcatgcttccctccgctccatttataacattcaatttaaactgccttcttcgatccttttacatgactactctaccaatcagttttgcttcttttacttaattttctcttgtcacaagattattttaaaacaacttaaaacacatcaatattattgttgttttagtcataagtggtgtcctactcttttgcaatcccatagactgtagcccgccaggcttctttgtccatgggattctccaggcaagaatatggaattgggttgccatgtcctcttccaggggtttttcctgacccggggattgaaaccgcatctcctgcattggcaggcaagttctttaccactgagccaccagggaagcccaaaatacatcaatacacttttatctgatttactctcatgaaattgcaaatttgttatacctgccactgatatatactccaatatacagccataaagagagagaatgaaacaaaagaatcactaagtttttaatccaaggaggtaataaggacacgataccctgttctgaagggaaagctgaggtgggcagctgatgccaggcacggttttcaatcagcctttcccagtagggagttaaccaggctgtggcttctagtcatgagcacaaaatcggttttaatcgataattctgtttttcctatcccttaaaattatcgactaaaatcaagtgtacacatgagtcctgtatactttagtgttctcaaaattttgattatttctaagggaattccttggtctttctgggccagaaaaagattcactcaattttcacacatcttatggctcttaaaaacaaaaacaacaaaaaccaaattgaaaccagataataaaaacagcacgtgtgtgtggatcaaaacaaaatgccaaaatagaaaggttcttcagtaggaatctctaaaattggaactgatgggataagggtaaaagcagcttaaactgtcaatgatgttactggacagctctccaaacgagagccctcaacactactgaacatcctcaacatactgagcacccctcaacatgttctgcccagtggtgggtagtaagggcacttctcttacacgcacctgtgttctgggaggagagaggtacagaagggagctaggagagaaagacggggtaccaagtaggaaaagtggggcacaaataaactcttcctctccataggaaatgacacatttggaaagtcctgtcaaaactgcagcaagcatcactcagaaggcctgtaaaaacggagacatcctggtccccatgttcaatgaatagtcaaagataaaggcagagaatttgcatatttttgtaattctgatgcaatcagtcagcaaccactgttgtctaaaatcccagtggctatatcaccccaccatacccaggaaccaatcgccagtcctctgcagcagaaactcagccagcaccaagaatagattcactgcctcctgaaatggcctgttccccttacaggcacctctgaaaccctcctttattttgtgccaaaatatacttcactgtactttctgctcatgattcacaagactcttctctggagtaatgcagaacaaatctaagtctccttcacatgacagatctctatcatttcccttaagtcttatttgtgcataagaaatgctatcccatcactccatcaacactgcctcagggcattttccagttcaaccaacatcctgtactgcccagagaactgaagggttgtcaatcacacttttcagaacaactctctcccaagtgacaagcaaacagtagggaatttgggacatttttggacccctgaatgcctaatatccttcactgatacttgaaaatttacatttgccccctgctctgatactgttaccttactttttcaacaccattttttaagtaacatttctttaagaagtattaagaacaatccttaagaaatgtaaaaacagagagtctgtaggacttgtgccctgacttaacggctctcccaacctccagctcagccagcacttcagatgaggggagccaagaacacaggcctccctctttcccctcggctgccaggcagagggctggtttcccggaaagagcacaatattagcaattctcatcctggctccagctgcctgttgcaaaggctaagttagagacaagcactgctgagatatgggagcttgcttatgtctagcctccacttatggaatggaaactgcatagagctactgagactgttgtttagttgccaagtcgtgtctgactcgtttgctaccccatggactgcatggtatttctcaggcaagaatattggagtgggctgccatttccttctccaggggatctttccgagccagggactgaacctgggtgtcctgagaccatgggggccctgactgccactgccctatagtttgaaaggcagaggttccacgccaccaggaaaggtaagccaaggagacctgaggctcaggtccctccccaa

SEQ ID NO: 41152 - DNA, 5921 bp, Bovine  19866880651847
ccgggcccagtgctccctttctgctggctgctcagatcctcagcgcccgtgtgttctgcagctcagtccttcctttccctgagagtgagggagatgccctggacagcttgaaggacagaactggccctgtcacttgtgcagagaacttgacaaagtgatgcttagagcctggcctctcgggtctgggtttggactcctggtcctctgctctggtgggtgtgcagagccgtgtgagctgagccgtttcctgtgggtgccacttaccggctgccaaatgcaaagcacagctgattagtcaggggtgtgcttttcttgaccacttttatttagttcattgcttttgactgagtgttaaaaatattctgcagcatatctatagtcctcacgagcaccaaatgtgagaagaaatgcagtttctgagaaagcttcaaagaaatactggtctttatcttttccccagcccttccgctgaaacccaccagagtctttttctgagcactcttgttctataaatagaacgacagctctccttgggtagcccgagatcgcagctctcatccgctctctgaaagatgtgcgtgtgtgtgtgtgtgtgtgtgtgtgtgtgtgttggagtgtatttgttttaattttgcttttcttttatgtgtggcatgtgtagcgggagatgcaagaagaatactccggcatttatcctttaaaaagaacttcttttaacttttctgggtctcggcctgtgattttgttgtcttttagaatttttttcctttttctttttgcatttgggaaagcgatggaggtgattgcttcccctgcagaggtaaggaaggaagatgtttgggggcaaggagaggtgcctgggtccgtgagcaggagctgtggggtcccaagcagaggctcgcctggtggggcgggtggtgcaggcatcgtgggtctgcactgcgcggcgtggaagcagcggcctgtctttgaagagcatgttgaagtagcatccacgcgtgcacttgggtctgaaaagaatcctcggacgcaacctggcagtcctcccgtagcgcaggccggtttctgcccgaagctcctcggtcaggaggctttctctacgccatgggccagcacgtgtctctcccgcattgtcgggtcatgctgtgttcgtctctcctcctcagtgacctggaagagcggtgggtgacctcctcagagacaacagtgagggatcccgccccaggataagtgcagcggttcctcactagctttcccccagagttgatcctctggggtgttggagaggttgctgtttgtactgctgggccagccctgagggacccagcatggggtcgcgagccagctgtgtagcccccctgccccgggactccgagaggacgtcctgcggtgggaatcgagaggagcagctggacacgggagcgcggggcgctcaggtggacctgtgcacggccaggcgctggtggggtgtgagggggtgtgtgtatgtgtgtgcgtgtgcccggggtgggggcgctgtctccagcattcgcctgtggggagcagcagtgcctcccaggttccattgcctcccccgttaggagctggctgacggagggacatacagacaaacagcagtgaccaggtctcgcctctgacgtgtttgggtgacgtagggtttctgtgtctcatttcgccttacatcgtcttcagtggccacaggagcccaggtgcttcgtatagccacttaaaagtgacctaaagtgcagagctgcatggggttaggtgatgcgacgagaagattctctggaccgatgtccttgtccttgagcagcgtttctgcgcgttctgcctctgttgcacagggagatgctgggcagagcactcgttgggagcctggcttcggtgtcagggtgccttgctgcttagttttgactgttggcagctccgagtggtccagcacgtctggtgaccaggcaggaccctgagcgcttggcttgtaagtggtgcggctctgggctcagcgtccaggatgcagctccggggaggccctgccctgttctgggtgtgtgcgccgagccgagcggactgcccttcaccccatgcttctctctgcactagtgctttggtggcaggctggtcagatttgggggtggaggagtctcagtgatattgctggtggcacctctctgtgttgcagcgtgggtagacacacacgcccggcccatgatcagggctgagggccgaggaggggcaggcctgggccgcgccgaaccccgtagcaacctacgtcgacagttttggcagccggctcctgagaaatggcaggaggccagagggcacggaggccaggccaagaacagccgagaactacccagtgctgaggctggagaacaggggcctggctcctgactgtcgtcctgcgtgccctcgcccccttccgccgacccccacccggggcacgtgctgggcacacctgggcctctggccccgcctccccgccgctcaggcaggccatcgccccctggaggatcgggtcatcctgtccccactgcccactcagcctgtccataggtcggggtttgcgcagaggatgagaaatagttcttctgttaggccgttggcccattagagacacacagatgctctgggctgtcagtggataagcgtgcggtgccgtgaaaatacacactcatgaatccctttctgtgcttccagaccgtcatcaaagaggggatgctgaccaaacagaacaattcattccaacgatcaaaacgaagatacttcaagcttcgagggcggacgctgtactatgcaaagactgccaaggtgagactcagtggaggacacttggcaagaggagacctctcgagaagctgcagggaaagctgggctccgggtcctccctggggaaagacctttgattctagatctgatattctgagcgcgttttgtaagcctctggggtgctgggtcttatgtcttgtgaacattgatttttctaattcattttctttttctttaatgtcatatgtcaccagtggggagatacggggagggaaaggtcacagaagcaaccatgttacaagtagccattgttcttttggaaagattgaggatcactggcttaaaaaccctcttattttggcctaaatatctatttttttcctctaagttttctatattttttatcattaaaaaattgattattattgttttttgtatttggccgcactgggtctttgttgctttgcgggccttttcctgatggcagtgagtgggggcttctcttcatcgcgcttctttggcttctcgttgtggggcttctctcgttgcagagcacaggctctaggccctcggcttcattagtcgtggcatatgggctcggtatttgtggtccgtgggcttagtcgctccgtggcatgtgcaatcttccagaccagggatggaacccatgtccccatattggcaggtaacttcttacccactgaaccaccagggaagaccttttttctcttttttcaaaacacttttataaacactgtatagaaacttaatgtgtgcaacttgatgactttggagacaagtatatatacttgtgaagctaactaaaaatatgcttaaagtgtgttgggctttttggtgtgtgaacagaagctgtctctgggctttctagccatggtccttcctcccatgtgtcatctttgtaagatttatagctggaatcaccaggcagacgccagtgacagaagaggagctgttgagagcccctgaatcactgcctggcttaggcgactgtggtgtggcacacttcagatactagtgtgtctacaaacctagtttttggtgttctgaacaccactctttgtgttcagatgctaatattttagtattattaataaaaaactggaatctgagtagttagtattttgagatgtatccctagtgagttagtaaattaaaatttgaaactgtaccgagtaacttgtttagaaaggattctgaccacatccttcattaaaaaaaaagactcgtatagttattttagtttaaggggcgggggggagttacttaaaaggctgagtcttttctgagttgctagtgtttcctccagaggggacagtaaggttaacgggagctggggggctgtgacagggggacttggcggggagaggtgagtggggagggggtgtcccaggcctgcttctagacccttctttctctccgggaccagattgtctctgccgtgcgcctttgttttctttcatggctgggtcccttctgtttgggtcagtctgtcctcccctagaatcgttcattttagccaatacctttctccccaagcgccaaggtggagaaagtaaagccgaagggacagaggacctccaccctggaccccggtgtggggtgaactcgtgggaggacgtgtttctgacttaactggcgcaggtcactagggagctccctggacttagaaaaggtcttgagcttccccgtgagccctgcacgctgtcagcagtgggtcgggtgaggtcactcggggtccatgtagttctcacacgcttggctggggtcgagggagagtggtgggcagtccggggccgggtgtgccttcgccccctctgactgtggcccctgtgtttttccagtcgatcatatttgatgaggtggacctgaccgacgccagcgtggctgaatccagcaccaagaacgtcaacaacagcttcacggtgagtctgtggacgacacccctctcgattcctctgccacgtgtggttttcctgtttaatttgaacgggtgtgtgtgagcagttcagacttttcatcctttgccctctgcttggagcagttcctgataaattttgagttcaaggttcaaaattgtacagaggctggagaaaaaccgagaatttggcacatgtaagcacaaaagaacgagagggtcccaacgaattgtttaaacacgttgcagtttgcgtttctgtaactgttttacacggagattcatttttcaggattgctgtagaaaatttgggaacacaggaaagaatgtggaagcaattagaaaataaccgtaatttagccacctcaaaatagaatgttgatatttctttaacagttgtacacagagaactgtttttcatgatcgttgtagaaaatttggaaatacagaaaagaatgtggaagcaattagaaaataactgtaatttagccacctcaaaacagaatgttaatattttagtatacctgttttctttttaaaacttaaccctaccacccccatgtatagaaattatgttgtactttgtgcaaaagttctaaatgcataaaatcatgtgacctcagcagcccagctgctcacgttagagtgattatctttacgtctaaatgtctgtctcttgagcagcatatagcatgagatgacagtgatccttttgatgaaacagctgtttgattttttttttctcttgacaatttatggtgatcacttcccgtgttgattgctttaaatgttcatcatattttttaatgtctatacagcatttcttgtatgactttacaattttggcttcaggggatgactttagaacctactgtgtaaggtatgactctaatattaataacaggaatagagtattttacaatatttttcttcatgttactaagtaattttatctagaaatacagtatgcttcccaattttttcttttttttttttcctttccaatttttaaaaattcttttgtaactcagtcaaggtggataattttcttcgtgtttagatccaacattttgagttaatgttagtttcagctactttcaggttttattttatttatttgtttatggattgattaagttgttgctccaaatgggatattccttcctccatttaaacttctacttattttattttggtgtaattaactgctctggttttc

SEQ ID NO: 41153 - DNA, 975 bp, Bovine  19866880655779
cagctacagtgatacaggtatcaataagcaaatgtctatgtcctgcagctggaaagcaggcactgctatggcagaatgagatgcagaccttcgcagctttggccttctccatctgctgaagctgttcaagggcaggtgctggagtcgcggggtcaaggggaagatcccatacgctaccgccttcccaaactggaagacaggaaggaatagaggtgatgggtatgagagctgacacacacggctaaatatccagaagcataaagaagctgctctcctgtcccagagcgagcttcatcgcaagggtctgctctgcttctaaacacactgaactaccagcaggctctagtttataacaatacccgtctgcatatccagaaggaaagaaagcactaggcaaaaagatgagaaaatgaggcaacaacagcagccttttctatttcctaaatttctgggtacctacagtggtaagttacacatcaatccttgactcaaaagaataggtcatcattacttatgtttttatttatgctttttctccaacgattaaagacaatttaaaagacttttctacaatgggttaggacaatgttttttaaaaaaaaaaaagaggaggctcaagttcaggaaatctatctactaaagaatttccagcaactccttaagagctattttcaatcctttgctgggacctattaaaaaaataaaaatttcctttaaaaaccacttttcattaatattcactacaaagcagtcccaaaattgatttaaaaaaaaataacaaaaaactcaattataaaagttattagaatctaaatccttggagctatactaaaggccaatctaagtttttacctgtaggctgtgagggtgctggctggagttcccagatagaaccagtatctggcactgacacagacctagttactgagggaatgatgttctgatcagatattctgcaaaagggaaattagaaaa

SEQ ID NO: 41154 - DNA, 1025 bp, Bovine  19866880661523
acacccccccccacacacacacctatttaaagcactgagattatagtcaacaaacacataacttgctttttcatttaatacactgtgaatatttttccaaagctttaaatgactgcatggtagcccatcctatatatagcttaattaatccatttctgttggacattcgggtgatgtccagtttagtcattactacaaagtaacaggggtaacgagtatctttgaactaaaactttatacacagctctgattatttcaaaacaaatccgtacaattattggcttaaggtttttaaatacatacaaccaaaccagttgtattactttatatacctaccaaatgtagagggagtgctaattgttgagaaccagattaatagaaatacttgatttgggaggaaaaatgtcactcactgctgttatgattcatgttttttggttatgggctagatagatctttttttggcagtttattggttgttcttatttcttcttttgtacattatttatatcctttttccaatttactactgagcacaatggaataaatataagagcactctacagacagggaaaataaatctgtcatatatggtttctgttttccatcagcttgtcatttgccttttggcattgtgtaatagggtttatgtgggcttccctggcagctcagatggtaaagagtttgcctgcaattcagaagaccaggttcaatccctaggttgggaagatcccctggagaagggaatggttacccactccagtattcttgcctggagaattccatggccagaggagtctggcaggctatagtccaagggatcacgaagtgtcacaaccgttagtcacaactaagtgactaacacacatacacagttaaggtttgcatcacttttccttcattttttttgttgctttcaagctaaggaaggtcttttctatcttaagatcagaaaaatacctacatttgaaggcttcttttttacataaacattaaaggaagtataatttcatgaaagggataaa

SEQ ID NO: 41155 - DNA, 1685 bp, Bovine  19866880693108
cgctggtgctaaaatagctgaagttaagctaacactgacacctacctaaaaaccttagctcttatgaacaggagcatccaaagtctttcatggaaatgtgatggcttcctatcacgaatatttcaaagctgactattggacaaagaacgtgaagtggaaacatcaatttccctaacgaggaaagggcaaggggaatcaagtctgatggtcagacaacacgaattctcctaatgcatcaccctgccatttcctacattttgtgactgatacgcacccacaggaagcctggaggctgtagtttctttcttaactgggtcttacccgtaaccggtagtcatccacggtccagatgcggcttgcaaaatcatttgaagctgctaagaggtaagatccctacaggaaagaaggggagaaggaaaaacagagaactttagttcacatgatacaaatttcctcataccaaactcaagactgtttagatgactaaaactacatacctgatctgaataccgtcataaccagaattctgttaactaatcaatcccgttaacttcaggcctctttcctgagcctgctcaacctcgcctgatggctgtagatattacacctccagctcaaaatggaactcatccccctgtgctcacttccaccccacttcggtaagatcaagtactaattctctacacccgcccaagtccacgagcccagaggcaccgactccccagcctcacctccccactgtcccccagctgtagaccctctcctttccacctgcaccgactcggcccaaaccagagccttatcgagtctggagagatgctgaccaaccggattaccaagacctgtctcccctacccatcttcaacctactcgtgatcagcactgaatttttaacctattggcatccttctctaacattaagatagaaaacagcagagaaaccaggtaggttatttttaaatttcaagaatcagatgtcaaaaatggtttctaaacacctctcaactcacccatttccatggatattaggtacttacagcactatcaaattcaatgcttgtaattcctgcattactgccagacagggagcccttgaactcacatttgtctgcataaaaacaaagatgccaacataccaattaaaacgaggcacttgaaacacaagggaagctaattacatggtcaaaagcaacttcccccgcatctttacagaatcaagtagcaggacaaacagcacaatgagacgggaatgttcggctgaccagtccccaaagcaacgaacgcacaagagggtgcggagcccagcattttccggttggctcttacacttgctctttttaagaaatttagtgtcatcaattcccttcataaaagtgcagggatttaaaaacatgtcaactgacctagagtttatttagctatttaatttacataaacacatctctgtcaatttaactatcactttaaatggaaactgaccattaaaatttcagaacccaaggtacgaaaaacagttttacttgtagttagtataaactggctagtcattagatttccagtaaaactagtttggagtttctggaatttatctgtccactctacctatgtgaagcaaggttccagcgaaccaatcgcctgccagtgctctcctgaagcccatctcacccccaggcccagccactcat

SEQ ID NO: 41156 - DNA, 2899 bp, Bovine  19866880739988
cacaagcttgacttgacccagctgagaactgggtggttggcttgccttccaggtgcctcaactgacttactgcaaaggccaaatgtcatctctgatcatttattatctacaaccatggaaggaaaagtagcatctccctctgagaggttccatctccctgcctccctgtcctccttcctgggacagaatccgtccttctctaaggcgttcaacgcccagctgggtttggacacactttctgggatcgaaaaatagaaggcttagccaggcaggtctggagcctgggcatgatgccccacttctgcggggctcagcgacatccatgctttaaagcacgggggttgaatgaagttacggcttacacgcttcccacccatctctgatgtttcgtaaatctggggacggtggagtgagagtagagtccccaagggtcaggctcgctcctccacctgagccatctggggaccatcactcaactgacttcacgaggttggcaagcaacagagacagagtggctcctttggttttgacaagaagcgggaagccccgggtgagaagagctaaggcgattagaataagatgaaagtctttgctgcttcacttggcaatgtttcaggccagatcttatttggggaggcttctattctgggggcacccaacagactcaggtgtaaggaatgagttatttagaaactgtggctaagctcagaaaagaatatgaggtttttgcctcaacatgaaaagaggaactggagttaaaataagccctgatcagtaagtactgaagctccgacaaccccaggactcggcctgacggcgcgcgtggtttaaccagctcctcgtgcacagctgctcggatcgtcttgaacgctgttctgtttttgcaggaaggcctatccttaggagtgcaaatggcccaggctgcctcggcacccccagctccccgtaccctggttactggtcaccaaggaggtcccaggcccagtgcccgggttggggaaagatgcgtccagagggcctggtttttctgagatctgcctggctgagtgtaggcctcaggtaatgatgcctcatcccccacaactctacccgttgtccgagccatgggtgagcccctgctccaagacagaggattgcagagaaagctgttgatggccgagccaaccaggttccctctcagaactggcaactcagtaatgagactgttggtgggagcagggcagactcaccaagaggggctaagaaaggggccccttgcagagaaagccgttgatggccaagccaatcagtttccctcttaggactggcaactcagtagtgagcctgttggtgggagcagggcagaccccccaagaggggctgagttgtggcaggtagcgcctggactgcagggccccaagcccttctggtccaggcccagccttctccctccttgcgctgtgcatctcccccagggctgcccacactccttgcacacgttagccaaactgattctctgttcttttcgacccccaaagcctggtgaggccccaggttcggaagctgctgcaggactggcagccgttccctggaaaacgtgatgtcacggcagcaaggagtgacggcgagagggtccagacctgggtgcagcttaagacggttacaagccgtgagtgcaaactctgtacaagaagccgcagtctggccttttccagcttacgacctagtcatacttaaagtcttcttccctttgaaggaataaaagaaaccacaaggggaaaaaagatcaaaagccccgactaacttttaacttgagagtttaaactcctttcagcaaaccaccaatcaaggacaccaacctctgtggggaaagttcacacagtcctagacttggggaaaattcaaggccattgagccccactggctccccaggcaggcctccccttgggcagtcttgtccctgacaggtgaggagcccacaagaagaccacccatcccagtggtgggtggctgccaagtcttgaaaagatcgtctagtattggggtaccaacatgtattcctagtggcaaggctgagacatgggggtgtcccagaccatccaaaaacattcaaatgggcgttctttagataccactgcagatgcacttgtgggaaaggaccaagaagccagaagctacactcagcctgacctgcgtgtgtgtccatgagagtgcactcagttgtgtccgattctttgcagccccatgtaccccagggacctgcctattgtccagttgtctgtcccactgcctcctgagtgtgtgttgagttgcttcagccgtgtccaactctgtgcaatcccatggactgtagcccaccaggctcttctgtccatggggattctccagacaagaatactggagcgggttgccatgcccttctccaggggatcttcccgacccagggattgaacccagatttcctgcattgcaggcagattctttaccgtctgagccaccagggaagcctgttgcatcctagttctgtacaaaatgcatcattccatttatctccggaatcaatgattgcacgccacctcaccccttccacttttactttcttttcaactaacccccctggtcctgtcatggctccttcatgatgtagtgtcccgaccctcgtgtatcctggccactctgctcggcatcggggtggggcaccccacctggtggtgcccctccccaggggctggagagctgagtgtctctcctctgcccccaccggcgagagcacggtcttctttattcagcccactgctgtctcggggcagccaggtaaaaagagctcccccggcctctgcatctctgttgtcatgcattgtgatgacgcaacacccgtggggcttggcacacaaaccacatggagggtggttttcctggg

SEQ ID NO: 41157 - DNA, 1128 bp, Bovine  19866880760414
cttcacatatgcgggccttcaaattgcacccttctataactgaggaaattctagattgcctgggctgtcattgtcttttttttaagtccttgaaaatagcctcctagcctttgaaggcacggtttcaacctacagtttaaatatttaaactgcatccgaccacctaattatacgtgcgtgtcacgccttcactctataaaaagaaagaagtgcccctcagttggccctgaggagtttctaagcaggcaagagttccccgtgagccaggagatcttagtgagatgagatcctggctgtagccttgagcacagcctgggggggtcacggaagagaaatccctggtggaaccgagggaccctggggccagagtgcctgcctctgatgactccatcctggactcgctgtggggtagccaccctcttcactagcatgtttatgggtcttaggattacatattcctccaaagttatacagttcactgacacaagctacgacaagaatgaaccttgaaaatgtgatgctaggtgaaagaaaccagtcgcctaaggacaaatgctgtgtgattccacttacatgagggatctggaggagttaaattcatggagaccgaaagtagaagggtggtctccagggcatgggagaggagggaattggggaattgatgtttaatgggtacagagcttctgcttgggatgacggaaaagttctggaaacggatggtggggaccattgcaggacaatgtgaatgtcattaatgctgctgaactgtatgcttaaaatagtcaggtttatgttttgtgtatatatatatattatatgtgtgtgtgtatacatatatacacattacatatataatacatacatatacatatgtatttatgggcttcctaggtggcactagtggtaaagaatctgcctgccaatgcaggagacacaagagactcaagttcaagccctgggtcaggaaggtcgcctggaggaggaaatggcaacctactccagtattcttgcctggagaatcccttgttcagaagagcccggtgggctgcagtccatggggtcacaaagagtcagacacgactgagcgtgcatgcatggtggaatacatgaggaataacattctctgaa

SEQ ID NO: 41158 - DNA, 2715 bp, Bovine  19866880760804
ctagggaaatagggacccattccaaatcaaattcataagataggagcacagaatagtatacatttcaatggacagccttttctttcaggacttctgaatgctaataaaaatgacataaatgtggatttggagctgtcaaatacatttacggccagcactattaagctggtgagtaaatccctgaattaatttgcaaaatacagcacatttaatgccttttcctggatcctagctttcattagattttcatgagtctaaaaaaggtcaacacctactaattaaagactttatttagattagatctttacagacaaaaatactactgcaaattctaaaaaatatctccgtggctcatgcctaaaacattgctctgtctggcaggtgacaaagtgccaaaacctcagaaatgatcactaagtgccagtctaccaagagacagagctcaaaagaccaaagatcgtcttatttcatgaaaggccttttggacttggtctcttccaagattcagtaaatattagcaaagagggagaaaattatacaccaagtaagccatctgtggaggaaaggtcctataattagttagaacatgactgatatttgttcctgaaaactataaaaaaaatgctgccagatgctctatgttatttctgtagatttagtagaaactctcattttactaacacagtttatgctccggcacaaattatgtcagtattaattctgattagtgttcacttcctcttcgacagcaaaaaggtaatacttctactaatggctggtatctctgattttcttataggtatttttactgaccaaggagtaaaataaaagtatttctagagctatttgtatttatttgcaaggtataattgaaacagactatctgtgtagatactttgttttaatcaccaaatctctgttcttatcattttattgttaagtttcagcaattcacccaagctcaggtcctagttcaccactctgtccacgtaaatcacccacacaaatcaagaagcgtctttgagtttccacctctcacacaggggtgacgcccagctgcctaacagcacagggctatggcgcggctcagaggaaacgaagcagacccaggcgggaccgtgctgcctccgctggaccgcgagcacacgtgcgccccactaaggaagcccggcaacatgctccctacagagccctgcagcctgttctctgaccgcgtcttgtcaaaagtacatgtatattgaactgagtatcaaaatgtggcgagtgggctatgcctcagttcagacatctgcgagagggttcactaactcctctctcctgtttcaatgccatcccattttgagtactataaggtcattcctaaaataaaacgtaatcaaagagactcagttttgatcttagaaggattagtctcccaggtaggaaggtgtccaatatgtactgcggaagagtagagggcaattaccatagctccagaaagaatgaagtggctgggccaaagtggaaatgatgctcagttctggatgggtctggtggtgaaagtaaagtccgacgttctaaagaacattattgcattggaacctggaatgtcacatcaatgaatcaaggtgaattggaagtggtcaagcaggagacggcagagtgaacatcaacattcttatgaatcagtgaactaaaatggatgggattgggtgaatttaattcagatgaccattatatctactactgtgggcaagaatctgttagaagaaatgcaatagcccgatagtcaacaggagtccgaaatgcagtacttgggtgcaatctcaaaaacgacagaatgaactcagttcatttccaaggcaaaccattcagtatcacagtaatccaagtctatctcccaactgtaatgccaaagaacctgaagttgaacggttcaacaaagacctccaagaccttctagaactaacaccaaaaagagatgttcttttcatcataggggactaggatgcaaaagaagtcaagaggatacctggagtaacaggcaagatgaccttggagtataaaatgaagcaggacaaaagctaacagacctttgccaagagaacgcactggtcatagcaaacaccctcttccaacaacacaagagaagactctacacgtggacatcaccagatggtcaataccaaaatcagaatgattatattctttgcagccaaagatagacaatctctatacagtcagcaaaaacaagaccgggagctgactgtggctcagatcatgaactcctcgttgcaaaactcaggcttaaactgaagaaagtagggaaaaccactaggtcgttcagatatgacctaaatcaaattccttatgaatttacagtggaggtgatgaacagattcaagggattagatctggtagacagagtgcctgaagaactatggacggaggtttgtaacactctgcaggaggcagtgaccaaaatcatctcaaaaagaaacgcaagaaggcacagtgattgtctgaggaggccttacaaatagctgagaaaagagaagcaaaaggcaagggagaaaaggaaagatatatccaaatgaatccaaagttccagagaatagcaaggagacctaaggccttcttaagtaaacattgcaaagaaataaaggaaaaccacagaatgagaaagagagatctcttcagaaaactggagacataaagagaacattttgtgcgagg

SEQ ID NO: 41159 - DNA, 1812 bp, Bovine  19866880765078
atgagttctcttagaagattcagcaaagagggcttcagagatacttcaactgcttaaagacttattaccttgaggtaaaggaaaaaagaaaataaaagggaacacatgaaaataagaccaaggccacttgcaacccaatgacaacacacgcccgaactgtagagacaagcctgaatggagaacaattgtgtctgccctgctcacacaacaagaaaacatgatgtgacccaaggaaatgccattgtgaaaatctaactatggcttcatattattacctggtgaaaaaaaacagaaacatatcatcttttaaaaatgacaaaatgtcgtctttcttgtatagttctagttaacttgaaaatattttaaaatattccaagagtaaaccttcttctaaaagggcaaaacttcaaatagcactcaatatttatcttctatagtcatcaacttaaatagggacatttatcttgccgtaccttcagggggtctctgtaactgggattttcgataaaacagcatgtaggcactttcttttccttgaaattgctgttcaatatccttttccttgattggttggactgtggaatcatttatatcaaaccagtggggacaggagggtctatcatttaatgttaaggattctgaagtaagtgtcttgaaaagtcgttgatcatttctttggatatcagactcagcctggagagaagaatccttcaatagacgaactgtactttcatctgaactgagcagaaatatctgagaatgaacctgcaaaaactgtacagaaacaaaaaacaaacattaggttaacaaaaaaaattttcattgacatgattaaaaaaattttcctttctgtgtatgtcaactttttggcctggccagtttaagagggaaaaaaatttcatttgggccataataaaacatttaataaaaatcagagtgctttctgttgaacagtctaatagctatatccagggagaaagctgccatgacacagtcttttttattgtttttttttttttttgcacattcctacccctaggccctagcctctcagcacatgccctgtgatgacacaatcttaaacatgttttaattatatctcaataactgttttaatgctgttttaaaaagtctttactgaaacagattacatagaataaacactttcaaaatgtttaaagcaatccaaagcacaaaacaaagaaaattacacaatgaagcatcatagaagataatcctgacaaaactatgggatatagtcataattacaggcttacatgaactaaattaagtattgtctttcctggaagctgacaggctagctcaagaaatcaaaacattgaaggttaagtcataatcccaaagatgctcaaattcctccagctaaaggattaggaagaaaaaaatttttcttccccagcctaccccacctttccacccctactccattcttctctcattccctaatttctacatggcctgtatctcttccttttctctcagcacaacacagaaaatcacctgggggcatatggaacattttcttaactcactgaacaacagagaaaggtgattttctcatttttctcttggaaaggaagaatttgtaacaatccatactctgatcaaacagatgacccagaggtaatactgttaacactatatataacagatagtaatatagtttcagtaatgaatactttccatatagcaatttttttctttgttccatagttgaagattaactattttaaacttcaaacttcagtgtagtctagttccagtaacggcagagaattttattttttagag

SEQ ID NO: 41160 - DNA, 935 bp, Bovine  19866880772894
acacacgtacccacgcttcggtgtggccgtgtttctgttttgtttttcctgggagtcaccccaggaagggacccgccgggccacgtggaaactctgggtttggaggccatgcctgcctctcctgacagcagccgcccagacacacgtgtgggcacctttccatcccctgccaccagccctggctgcccagaacctgctatcagctggctgaaagggaaacctagggccttcaaaaggccacgtgtcccacaatggcttctatacacacaaggacaagctgcacgaaagcccgagctgcctttagacgctgggcagaggacagggcacgcagcgggcagagtccaaacccaggaaagcatctcccggggagagcgaggaggggcgtccagcctgggacctgtgctcacgggggagcggcggacccacaaggaaggcaatgcgatgcggtcaggaggtggtgcccacgtggggccgcccaggaccccagagaggacaaccaagaacacggcacagcccgtcttggtctctgaacctgccgaagcctcagcacgccagcacgttcggaagccagagatgcgtgagcacggccaccgccgtcccagaagttccagccaccctcagccctgcagcctcaccctttctgagttttccttaatggccgacagcagctggaaaaggtcaaccagtcaactcttcatgaatttctcaagttatttcccagtcagacttctacgtaccagcactgagctaacaacaggcccgcttggtttaccccatactcacaggttttctggttcagagttaaagggatcggcattaattagcaatcggctgatgactgagcctccaggcagcgtaccagacatcccggcgcgaacatctgctggggagagaacgggagcagaccgcactggctgggggcccggattcaagag

SEQ ID NO: 41161 - DNA, 1764 bp, Bovine  19866880814120
ttggcaactttgcctgtcgggtgttctgacttttcccttctccccctccctttagggaacaagggagccgtgggggtgtcgttcatgttcaacggaacctccttgggatttgttaacagccacctgacttcaggaagtgaaaagaaactcaggtaatggcgctcactccccaagagcaacttttggggttatttgcccagacagacctcaacacctgaaccctgtaagcccttggccacgaccctgccctgttggcctctaaggacttttcctgtggtctcatcaaagctaactgtggcacaggggtgtgggtgaatcttgcctaggggacagaacagacacttccttgtgtcaccccagaggcacctaaacaccactccgcttctcaaggggaaagcctccttggggcaccgtcacaagtgagagccctatttgcctatggtggcgcagtcatgcagagtcatcgggaaggctgatgactgagtccctgcagagcagatgctcccagggccctgccctgcattcccagttcagcccagggaccacatcagatgggtggttgctgcagacttaagtctcacttccccacatgtccccctctgacttcctggcccatggagtagggaacccacggtcccgtgctaagctggccgctttttcgtttcattaggcgaaaccaaaactatatgaatattctccggtttctggccctgggagacaagaagctgagttcctttaacatcactcaccgcttcacccacctcttctggctcggggatctcaactaccgcgtggagctgcctacctgggtgaggggctctctgcccagggccggggattgcacaggacagaggctcctttgagctgactcagggtggaggtcgtggagacccacagaccgagctggtccagaggggccactcctctgggactcgatactgttgcaactatggagccactgcctttctttaccattcgcctctgctcaacctgggcttccctggtaactcagctggtaaagaaaccgtctgcaatgcaggagaccccagttcaattcctgggccgggaagatctgttgaagaagggataggctacccactccagtattcttgggcttccttggtggctcagctagtaatgaatctgcctgccatgtgggagacctgggcttgatccctgggttgggaaaatcccctggagaagggaacggctacccacaccagtattctggcctggagaattccgtggactgtatagtccatggggtcacaaagagtcggacacgactgagcagctttcactttcactttctgctcacacctacttcccacacacctgttctggccacccctccctaccacctctctgcccctccggtgccctagctgaccagcagcagcctctcaactcaccagtcccagatcccgaggaaaggctgaagtctgtggggaccagctcaattttctccccaaatcatgggtcaccaggtagcctaaggaagacactcctgaatttggacacccatccaatgagcagcagtcggagggggcccccggcacagatggccttgctcccttggggaaggtaaaggattccgtgggaagggggtgaactggcatggcccctagacgtggtaagaacgaaatgcggtcacatttgtgctcctaaaagagggggcaggggccaggcctgggagcagaaccacgcctgtctgctccctgtgtaacaggagtcctttgcactggtgtctgtgccgggggaggg

SEQ ID NO: 41162 - DNA, 2254 bp, Bovine  19866880842089
tgtgtgagggggagatctcccagggtacctgtgagccccaggggtgagaccctcagatggaattaagtggttttgtgaagtcgctttgggtccggcattggctgaggcttttcagatagtttccttgcaggtcctgacagctctctgcacccagcaccctgaggagctggctctgcctcagggttggagcaggttcaagggatcttgcctgaggttgtggtgatctcttagagatcagtattaccacaaatgtccaaagtgatgttccttttatgtagaaattaggaaataaatgaagcatgatgttatccggtaagcacgcctctgaccgaagccttgaaaactgactcaggtttgttttaaaacataattaaattttattatttacttttccttctgggaaggaagaggaggctgcgaaatgggcccgggaagaagaggaagcccagcgtcggttagaggagaaccggctacggatggaagaggaggcagccaggctgcggcacgaggaggaggagcggaagcggaaagagctggagctcccagcggcagaaggagttgctgcgccagaggcagcagcagcaggaggctctccggaggctgcagcagcagcagcagcagcagcagctggctcagatgaaggtaaagccaggcgccgaccaggccaccggtcagaggagctgcttgcctgcatttgtggttgggtggatgctggcagtgcgatagcataaactattctttatgttaaatattgagactttggttttttgatcagcaaaatataacgatgcatttagagaagggaagaataagtaaaagaggctactacatgagcagcaacataagcaaaaaccaagtggatctgtatggttcataaatttaaacattggcacctactgtatcaattcagcagtgctaaggcaagaataaatgagacaaggcaactgtccccaaagagcccatagactcatgagtgccagaaactcaaacatttgggtgtgtaagtaggaaccatcatacagggcttgaaacatagctgacatggttattgaacggtggattgaggtgatgtatgcaaaatgaggttttaggagaattcaaagccttatttgaaatagtagaaagtgagactgggaaaccagtaaagagagtgtgatggtggtggtgagaatgaatagggccaagatgagaactggctgacattaatgagcaagacctagtgatgctctgaatctgagggatgagggcaaaagttggaatggctcttagatagtaggccttccgtgactgggaaagtagtagaactgttgatgaaataggagtaagtggagagggaggagcagatatatggtagggtctacaaaacttctcgtggagtatatggctggtcatgaggcttagtatctcctatcttcaaggagctcgtaggataaagacataaacagaaaattggaatacagtggagtaagtgcagtgagtgagggagctcggagcagtagttctcagggtgtgatcacctgggaatttgttgatattgttcagttgctaagttgtgtctgactctgtgaccccatggactgcagcatgccaggcttccctgtccttcactatctcccaaagtttgatcaaactcatgtccattgagttgatgatgccattcaactgtctcatcctctgtcacctccacctcctcctgccctcagtctttcccagcatcaaagtcttttccagtgagtcacctcttcgcatcaggtggctgaagtatttgagcttcagcttcagcatcagtcctttgaatgaatattcttggttgatttcctttaggattgactagtttgatctcctttctgtccaagggactctcaggagtcctctccagcactgtggttcaaaagcatcaattctctggcgttcagccttttttatgatgcaactcttgagcatctatacacaactactgcaaaaaccacacgtttgacttatatggactttgtcggcaaagtgatgtctctgctttttaatatgcagtctaggtttggtttgtcatagcttttcttctaaggagcaagtatctgaatttcatggctgtagtcaccgtctgcagtgattttggagcccaagaaaaagtctgtcgctatttctactttttccccatctgtttgccatgaagtgataggactggatgctatgatcttagtattttgaatgttgagttttaagccagcttttttactctcctcttccgcactaatca

SEQ ID NO: 41163 - DNA, 1197 bp, Bovine  19866880859705
tgagcctgagaaccttccagactggaggtggagctgctggtgctgggggtgggcaggactctgagggccggcccctcaagccccgtttcccacactgatagtggatttctcgtaaggccctgactcccgccccgacatggaaagggaagtggccctcggaggaggagcgctgactccagagtgaggcctggggttcctgaggccttttgcaatgaccctcctcccggggacgtcaaggcagggcgagcagtcctgatgggtccgctggaacggccctgaggggaggccccagggctggcatgtaaacagcccactgccacagtccaagtgcttggggcctacagctccatcctgcgaccctcccaccctcgctgcttttctgacatccttcctacccagaagaataaaggagaaaataaaagcctccgctggtccaccgtcaaggtgacgtttgctgcaaacttcctgtcttttcttgtggttgagattctgccctggctggtgagtgtcgaagtcaagacaggaacatagactcagattttaaggcaactttgggtgaagagggaatttgaaaccatctgcctcatagtctccaggtcttctttccccatttagaagaaaaccccgggtggcttgagccgttcgggcgacagactcatgactcagttcctggtccctgacagtggccgtcacgttgctctggtcactgtggcttttgaagagagagaaaaaaacaaaacaactttctaaaagctgttccgtcacaagtgtccgggagggttgacggttgagccattgttgtttagctcaggaagagggtggcagctgttattgttctgagtggtcaccaagtgaagtaaaagattccgtctgagccgctgggcgaaggatgtggctcgaacacagacttcctgacgttgcacaagaggagcagaagatgcatgggcgacagaggccacgcctgcggggccgccttgcaggactcggcggccgtgtggtccacagcggggcccccggtaggctccacggcaaccaggcagtccctctaggctgtgacagccacattctagaagcctgcattttcatgtaattttatttcattttagtgtaatctgctgtagaacaaggacaggtctgtttcccaagcttctgggtatctcaaaacattttccagttgccatcagatccaaaaggaaa

SEQ ID NO: 41164 - DNA, 1230 bp, Bovine  19866880931372
cggggtccttttctaccctctgggatgcgaaaggcaagcacagtgcccccaggccgccggggatccctgcacccacacacccgcctgaggtgtaggcttggctctgggaagcgaacgcgaggcagtcccagctctccccacggccactgccacctgtgggagcggcgtctcctgtggtgggcgtgggaccgagaaaaggctcatgaacaggggtgcgcttatgagcaggttatccctcatctgggagaagcctgccagacgagataaatcagagcctccagacctgggaccttcgagctggaggggagcctgggtttcctctgggcctgttctccaagtctgctgctagggctctccggaggcttagagagaaaggtggggagcttgctcagcctcagtgagggcgagatcagtcggaatgcatggatccctggcctcctgctgagctcccatcaccactgttattcagcatcagaagctccctcttccttcccaccctgtttctctgaacggtgccttagcttgtcattcagagtctggtgaattttgcccgaggtgttgcctttgctaatggaattgtccctaaaccacaggggctgggctcggccaggtgaggtgcccgtgctggtggctgaggtcactgtagggcccaggctcacgcagctctatggtttcactcctctcatgctttcagaattgcagaatacctgcagactatctctgacctggagaccgagtgccaggagctacgcactaagcttcaggaccttgaaagagccaaccagaccctgaaggatgaatatgacgccctgcagatcactttcaccgccctcgaggagaagctgcggaaaacttccgaggagaaccaggagctggtcacccggtggatggccgagaaagcccaggaggccaaccgcctaaacgcggagaatgaaaaggactcaaggtgggagaatgaacccgcagtctgagtctcagcgttggtacagtagaacctagcaaagcaaggcacacctggcagctctaaccacagggagggggcgtcagggaacaccgacagaaggagaagggacagttgtgggtataaaagagacttgcgtttatgagaacacttttataactgagccaaggattacctccctgaagggctttggcacattactgtatttgccagtgaattctttccatgtttcaagaagaaaagctaattcttaacattataaattaaac

SEQ ID NO: 41165 - DNA, 1572 bp, Bovine  19866880952318
tttctcagtacacaggatctagtgcacaaaagttccatttctgaatattcatttaatgcttttcaatttttatggcagttcacgaggaaagatagaattattacgtgacttgtacctgctccaagtgtttgagaccctcttcgtcatctggctctgtgggaacactgcccattccaggagcaccgacgactggcgtctccactggccggagggcaggactagggctggggacaggaggcgggaggatgaggagcggagaggctgtatctgaagggatctgagataggggctgctggacagcaggaaccacttctagagaaaaaaaacgtagacagatgaaaatcctctaaaatagactcttagaaagaataactagcatcaagttgagcagcttgctaaatgggttcaacagatttgtgaaccatgtcatgaacactgctcctacttcttatggagaagtgtgtattcctccccagaatgacgaagtgctgcagtgccatactgtgtcactagagtatctacccaatagttataggtcgacctcttgaaaacaaacagaattagtccaatcccttctttacatcatgtctctgagttgtaaagacagtaaatagtactgcaaatctcctcaaagacactgtatctcagcacgtgaaagtgaaagttgctcagtcgtgtccaattcttaatgacgccatggactatacagtccacggaattctccaggccagaatactggagagtgggtagcctttcccttctccaggggatcttcccaacccagggatggaaactatgtctcccacattgcaggtgggttctttaccagctgagctacaagggaagtataaaaacctttattaaaaacatctgcaattactttgaataattacctattccgacttataattcataataattcgatttataattcgacacataattcaatacaatacattctgcagggtaacaaaaagttcactgggtctacctgtacagagcaggaggttcttcacaataagagtaaagactacaaaagaggttctgtcttggttcctatttctaacctctcagtattcaggctcttgaggcggaaagggggatggaagtaattagatacaatcgtagtttcccctttgaaatcttgtttgttcaattatagcaagcttctccaaatgccggttcctctccaccctttgccagacttcttaaaaggacagtgtgacgtctatacaactttccctacttcaccaccacccacaccagctataaggtaacttccacttccaacagccccaaagcgtctctcccaaaaataagcattcacccaaagtgctcaaacacaatggtttttcctagtccccatcactgaaccttaagtctgacattatcttcccaattctaaactggaacgttctccttccttccttttcctgcactcttcttcctgccttgccaaaatttttctctggctcctctatctaccctctaaaaatagggattacccaggttctattctcagtccacttcttctcactcctaacagtgcatgtaaccttttaaatgttcatt

SEQ ID NO: 41166 - DNA, 1627 bp, Bovine  19866880971920
tgcatcctatcttcacaatttttactgcctaccacgcacctgtcctaatattgacttaacatttcctttaaatagactcactttaaagccttaaataaatgtatttacatataagagtgcatcacaagactaaatggaaaaccagtgttgcttgccttacacagaaacatcacatttaaagcatattaaaataaatgcattactaataagtgttcatccatgtcccacccagaatcatctttgatgacacctatgctgcaccttgggaatcacttatttttcccaattttaaagactgtattaaaactgaggctttaagaagctggcacgcttgccaaagagagaaagaacatgctctggactgaaatcatggtgtggtttggacatgaagggagccgatgtgcggactgcgggcttacccggaaggatgaacatttatctaatgcagacaattgattgctgcaatcagaagacaagcgcccagtcctcctgtctgcacagagaagagacagacagacagcaccaccacccctaccactacttaccgttcttggagacaaactgggaggtgactcctgcctcaaatgtggcaaaaacagggctgtggtcactggtcatgatgtcactggtgctacctgcaggggagggaaggaatttctgagcaggggaagagggatccttctggttgagccaaggatggccaacgcatagcagaaatcaactgatgcgtatggaagccaccacaagtttgatagtttcatatggctgctccattaccttccacaaccatgcctgaaagtctccgtgaaagcctgtgaccctctcctccgtggctaaatatacccgtaatagttttttttttttttccctaaagacttgtgagttttaaaatatatagattgttgtgtgtgaactgtggggttttttctggtctaagccttttgctgccttgatgaggagctcacggcacagagtgggatgggaatctcatcactgtcccccaacccacaatgcctctggagagcacggaggtgatggaagtgtagaaacagtacagaggattcttttaaggagcctggcactcagatgagaagggaaggcagcggagtacgtttagaggggataacagaaagagcagagggtctagaagtctagagttccaagtgcatgtgatagagttacatggagatgtttggctgaatactcagggctggagattttatcttctgctctggagtcacgatgttaggtggtagcagaagccacaaggatgtctgagcttcagagggaagacatgaaggctgagaagagatgaggatgacaggccagtgatggggcaaggccagcattaccgggcaaaaggacacgcagcacgggagaaaacaatgagccgagatatacccttctcagtaaagcatttacaaatcagcagaaaaagaaaaagagattaatataccacccctccaacaatcaaagggaatgggcagaaaattcaagagaaatataatagattgtccaataaacaagggaaaaaaagctcactggcaaacaaccatcagaaagacaacttttgagaacttccctggaggtacggtggataggcatctacctgccaatgcagggtaca

SEQ ID NO: 41167 - DNA, 2364 bp, Bovine  19866881014939
actgaggtgactttgcatagtatgctcttattttctatactaaagctccaccatcttgacctggccttgcccgtcaaccagtaaggaaacggcctcccattattacgactcttcttgcacgtttgttcattgtgtcgtctttcccgtggcagttgtttgtaccgtactgggaactactgaatcaacccgcacaattcctttgaccttgttctgaaagggcactgctcaaagcttccccttttctgagacagggctttccatcctctgcccaacaccacacacctggtacgggggcgggtgttattgttagtcgctaagtcgtgtctgagtctttgcaaccccatggaactgcagcacaccaggtttctctgtctttcactatctcctggagcttgctcaaactcatgtccattgagtcggtgatgccatccaaccatctcatcctctgttgtccccttctcctgccctcagctttcccagcatcagggtcttttccagagaggtagctcttcccatcaggtggccaaagcattggagcttcagcttcagtatcagcccttccaatgaatattcaggactgatctttaggatggactggttggatctccttgcagtccaagggactctcaagagtcttctccaacaccacagttcgaaagcgtctgttcttcggcgcttagccttctttatggtccaactctcacatgaaaagatgaaaaggcaaaagataaacctaaatacataaacccagagacctgccaccctcccagcaacaaggccagttgcgtccctccagacagaactgctgcctgcgggtccctcccatcggtgcaggtgctcgtgtgtcctgcgcctgcactgcacacagtggtgtccaggtgacatgctctttatcctgaggccacaggccctggcttggtgcacgcagggcccaagatcccttgagggcaagtcggagcgcagtcctggagttacactttctcctctacagttacatggaagtcgtgattggacctgtgcttagattttagctcgagaaggatgggatgtgcttaagtggaggagggttagacatctattgactgatcattgcaaagaagagctccagccattctgttaggataagagatccatttaccatttgcaccttattctgtggaggtttgcagctaaaactcagcttttatcagcagacccaaccgcccctgttccgatgagaaatagcacttgggcagcagcagccccctgctccccatgtggctctccgtggaccttccggagtgggtccccctgcacatggacaccccaccttcctatttgcaggccccagatcctgtggcagtccccccaccagatgggctcagggaggcgagacctgactgaggccagtgccgtcttggagacccctcggcctctgccaccacacccccatgctgcgggaggggtgtctatctgtttacgtatttgtttctatgttattatggaatatcccaaacatgcagaagtagaaacagcagaacaagcccgcattgcagcatgtcgattcacccatggccccatccgccccccaaccccgccacccacgggagcattccaaacttaattcccatcgtcatctcacttcataaacacatcagtacgcacatacggaggaggtctctttagcaaatgttcctaatgttatcatctaccagaaaacctgaacaagtaattccttgatgtgatagaacacgccccctcactgggaccctgtcctgtcgtgtgggtttggcgaggacgtgtcctcagtctccccccggcttccctaacccagccgcctcccgccaggtttctgttggagctggagcgccggatggaggaaaacatcgtcatctcggacgtgtgtgacatcgtgtaccgctacgccgctgaccacttctccgtctacatcacctacgtcagcaaccagacctaccaggagcggacctataagcagctgctgtgagtgtggccaggggcgggatcatcgcagaggcacggcacgggcagccccctcctccgacgctggccctgagctgtggtccctggacctctgctttcccgggacggcatccaaggctggcacgtgctggggcttttggtgccaccagggaaatggtgaccccgggacagttggccatagcacccactggacctgtgtccagatggccacgcagggctctgcgaggtttagaaaagggagcttgaggccatgaggaccagtcgaggcccaggacagcaggagagtagtttgaatcagagacaaaggcaaggattgggggaggggagtcttttttggtgattctccagcatctggattgtgtgtgtgctctgtcatgtccgact

SEQ ID NO: 41168 - DNA, 1194 bp, Bovine  19866881059584
tgaaaaaaaatgcttaacattttaacaacttaatagtaaagaaactatccattgggatcacgttgctgtttagttgctaggtcatgtccgactctcttgtgacccccatggactgcagcccaccaggctcctgtgtccatgggattcttcaggccagaatactggagtgggttgccatttccttctccaggggatcttcctgacggagggatcaaacccatgtatcctgctctgtcaggaggattctttatcactgagcccccagggaagtcttgttgtgatcagacatgtatgtaattttgtatgtgtagtaggatgtcttaccccaagttttcttctttctgaaggggctctaagcagatctcagttctctttcccaatttatattccctgataacaaatgaaacaaaacaatactgaatgacatattaattttttaaaggttttttaaaaaaccaatttcaagtattcttaagtgaaatagtatactatataagaacactgaaaatttaagagactaccatgaaaaattatacaccaacaaattgtacaactgagaagaaatggcaaattcctagaaatatacaacctaccaagacggaatcatgaagaaacagaaaatctgaacagaccaattattagtaaggagattgaatcagcaattaaaaacctcctaacaaaaaagagttgaggactagatggttttactgatgataaaagatttaataccagtgctttccaaactctttcaaaaaaaaaaaaccaggagggaacacttccaatctcattctatgaggccagaattaccttgatatcaaaatcagacaataacattacaagaaaaggatattaaaggccaatgtccctgatgaacatagctgcaaaaattcacaaagaaatactagcaaaacaaattcaacaatacattaaaaggatcatacactatgatcatgtgggatttatgcaagggatgcaaagatggctcaacatttgcaaatcaattgatataatacaaccacgttaacagaatgaaggacatgaacatctcaacagatgcagagaaagcatttgacaaaattcaacattctttcacattaaaaattcataacaaactgggtattcaaaccataaaggtcttatttgacaagcccatagctagtatcatcggagaaggcaatggcaccccactccagt

SEQ ID NO: 41169 - DNA, 995 bp, Bovine  19866881089210
aaccggacattgaagcttcctttgctttcagtgacagcacagtgtgaatgaaattcctcagacccatcctggcgcggtcttatgcccacactgcgccccctggcggcccggctgccagaccccgcttcctccccatgaagtcctgaaaggctgactcgaagcctgcagattctgagttgcttggatagaattgtactaagcctgtgtgcagtatcccagcacagcctgtacttcagaaatatgagctaagttcatctaaagctcctgtcagaagtctcactctgtccttgcaggtgctcccagtgacgcacacgcggaagtttccctctggtacttgggagaccttgaaatctcagaagatgccaccttaggggagctgaagtctcaggtcagccttcctcctacagcgaaccctagtggtgatctggctgcttccagtgagatattaatatattcttctatttccttttccctcaattacagtctgttctgatatggcatgtgttatatgccatgttcagtggtgagtacctcacaggccacacacgcacactgctcagggggctcccgggctcgttccatcaccctgtggcttcctttcttcccactctgacaggcatgctgtgctttcatttgactgtcttctcagtgacttgcagcttatgttcattttgatttttttagggaaacatttgttggaacatttgtaaagcattcactttatttacattgtttttgcaccattgtgattcatgtgttaaatgtggttagcagaagctgtgttgtcagttgcccaggaggtcagaatctcagctttatgttagaatgttaaactagatattgtattgttttcttggacattaatattcacagacagagtgctctgtccaaatggaagggctcggttgaatacaactcaaaatgcctaagaagcatcttaactctcaggaactaaaatgaacatccttcttcctcataaaggaaaaaggtagggg

SEQ ID NO: 41170 - DNA, 883 bp, Bovine  19866881141722
ttgcctgggaactcccatggacaaaagagcctggttgagctacagttcatcgggtcaggaaagagtcagacatgacttagagaccaattaacacctgtgtggatatgccgttttataagaaaccacattaaaattaagttgtttggcttatttcccactgttctatattataaatattatcacatggacatctttgtatattatctgtgcaactgcctttgctcatcttgaaagacttcatacaaagtcacaagcaatatagagaagatgctttgattaacagcaacaaacaataaaatgaaaatgcttctcactgaatactaatcaaatagcacatttaattaactattaaatatccatgcagggacaaaaatattaatgtatttctctagaaaataaggatcatttaaacacgtctaacataactcttatttcattagtagcattttttggaaagtgaaactttgtaactgtacagagagccttctcctctgcagaaagcagagaaaaaatgcttttacaccaagaatctttatcccaagatgtgactcctccagttacctttcctcccagctctgtgacctgtgcatttccctgccgcctcctcggacaaacaccccctctacttcatcaaagcttctttggtagaaaccacattcacctctgcctctgcctgaaaacaacaatacagagaaaatgatggtcagatgtcaacatctggcacaaggtgaacaccaagcattcatctctgaagtgctgtctatatacaaagcaggatatctacatttaatatttagcaaggcccactgaatctttaccagtgagaccaataacagtaatgacagcggtgaagtagccagaccagaggaggatattaaaaaaa

SEQ ID NO: 41171 - DNA, 1744 bp, Bovine  19866881161717
ttccttcaataattttaattcctttatggctttaattcgaatatcaaaccacccccctaaaatagagaaataaactaatgactgtgtataagttaaaaacaatgggaggaagggaaaatgaagattatcagtgtgtgcatatgcagattatctgagttactaattacctgacatttgacaatttttgcacacttgaaaaaaagttactcccttccctgaaattctcccataaagtcaaagggaaaaacttagatcttggttaagtttttaccaaattgataataactggaacagaaaaagcctcctacagaaaactttagaaaactaaagacataatagtagcaaaaggcaaaaaaattgaaaaacaactcacctttctgatgatagcaaacaaaagacactgtagacaatcataattttttatgtcaagaatgatgaatttagggccaataagcattaactatataaaaatgtactaatccaagagtactatttaaaatttctatgtaaattatcttattttagactttttttctttttaaaaaaatttaggctaattgcctctagggcacaaaattgcggaaatttagggataaagataatcatagactctactttcccaccagtgcccctctcccagcttgtcccaccaccacttctgctgtgccaagacggagcagagcctgcagtaaccaaggactgcatcagcctcctgctcagggtcaaggaggtaggtctcttgagctatgtggtactgaccttatattatccccactactgtgcaaacaaatattaatgcaccttgagaaactataattttatataaaagaaaacattctaagttttcaaaatgaagttacagaaaaaaaatcttagagactacaccaaatgtaaaaagatgttttctgaaattctgtttaaggaaaccagtataacagtcttaaatgggaaaaaaatgaagaaaaatcctttttaagagcaactggctttatatagagcagagtatactgtagagcaattttaagataaactttgtaaaatccaaacaccaaagaacataaaaccaaaacaaatacttggcttaaaaagtacagaaaaaactcttaaaaataccatttcatagttatcaaagtcagaagattccatgaactaattaaaaaggtaattctcacattctaattctaggctttggcggggaaaaaaggcacaatttcttgacacgtgtcaaaggctaacaaaggtaaataagcaataatcaaatgttacaaataaaaaggtgacttctgaagatttataaatttacagagatgtttgttccaaaagattagggtactactttttaaacaaaattctattaactaaaaaattgtcagccacacttatagtctactcactgtgttaagagttgctgatattttaacttgttcctcttcagattctaattggcttaaatttctaacttggagccagttgatctcattcacagtatcgatccatttcccttgttttgtcaacaaactgtaggtaaaaagacattttaaaaatgtgtgttcacacagtccttttatggatcagagaggattggaaaattcatgcttttccttaggcaccacttccaaaatttaccacttaatgtggctaattaaggtgaccaagttctactgagttgggcttttgaatgttgactatctttttagggcagtgttagtactctacagagtctatattcatgattccaaatatt

SEQ ID NO: 41172 - DNA, 947 bp, Bovine  19866881185039
ccagaaggcatagtgatgtccttactgttaggactctgtatcagggtaagctgaactcatatatcaagatccccctggctcctggatccctgtaatggaactaatccacttcattagtttcccaaccacccccgaccctttaatttgttcttccccaaactctagcaaatagtagtacatgacaagctcagagaatgagaaacatgacaagtgaattgcattagaaaggaaaaataaggctgtaagaaactgaacagacgagatcaggtttacatttttttctttgggtttctgggagttgaagtatatggggcctctggacagaaaataagatcacaaattaaggactcggaaaaaacacagttaatgcttacagtgtacaataattgcaaatctccttgaggaatgactaagaaagagatggagattatagtggaataaatatccgtgagagatgtttattaggagtaaaaacattggtgataaagaatcttacttttctaggcagtcaagattattgtttaaattataactttactcaatataagacttgtttttacataatttgagatttttattaatgttttatgatcattggcctttctcttttggaaataaattatatatttatagaattttaaaattcaaattaaattgtgtttatacctttgtttcaatcttagctgttcctgttttttgctttggggagtgatgttcaccctgggacagagatggagatcatagtagaggaaacaatatctgtgagggatgtaagttattttactttgggagccagggtctgtggggtgtttggggtaggcagcagtggtaacctgtattagggttttgtgatcctaaggctagggtttacataataccctttaaagaattctatgtactcactaaaggagtgctttggttggcttgaaagttggtgagccggccgt

SEQ ID NO: 41173 - DNA, 1320 bp, Bovine  19866881273585
ttgggccaggcaggaagaagaaacagctggtggaagagagaagggcagacgggaaggctcacaagctcagcgtgtgcctcccactgcaggcagcctgggacagacccgtgatgctccaggttgcctgccgggctcctgctgagagcgcctgtctacctctccaccccagctacctttccagattctttagctgatgaaaccatcaacgcagctgaagatctttataacttgccattagaccaccatccagggcaaacagagcccagaaagtgcttcatcctaatgaattttcctgaaactgcagggttcacagttcatgatggttatcagtaaaatgttcagtcgatcgaggagtagggttctttccacgttttctccgcttgtccctttcatgccacctgggagttacctcgagggttgctgatattggcgggggcgggggggggggtcctcacctttcctgttgtttcattcccacagatagagctggcgatgctgtatgcaacctggatggctgcaaatgcccgtggaagtgcctgtcccccgctgcccccacccgcagggagagatgagaagggctatctttctttacctccccacgtttcttgtgcagttcagtcagctcttcttggtgtttaattctcagctgggccatttcttgcagctgactatcattccatgaaccatcatgtccgggactaaatgccccaaccaggcagatgaggagaacatgcaagaaagagggggaaaaaaaaaagaaaaaaataagaccttattccccttccgtcagacaatggaatagtaactttggaatttgaagcctgtacatgacaacacagccaataaagcagttcagttctccaggccagtggagtcctaagtcactaccaacctgaagtagaaagcgggacccgtgagacacaggtaaaaccaaccagtcacaacccaaaccaccagccgtgtcaggaataaaacatggcttctggaatgacgttcaggtgaacagggaggagacaacgcagttccctcagtcaacaagtgtctgagagccagctctgagccgggcctgttctgggagtgggcagaagggagggacacgaagctgtgcccgagtgacgctgcgatcggccaagaacacagaccacaagcgagagggtgcacaaaggctggtggtcagatgcgctgtgaagaaaaacgttagcagcgtaaataaagagggacaggacgacagggctcctgctccacgtggagtgaccaaggcagcccgagagatgacgccagactggagacgtgacagcagtgcagaactagccgtgcagg

SEQ ID NO: 41174 - DNA, 727 bp, Bovine  19866881328928
ccaaacagaaactctgcccactaggcagtgactcctgtcctcccaggccctggcgttcattttccttgttcctgaataaggtttccaactgtgccctcaacacttgcccctcatactcagcattcacactcagaggacacctgtactgaatggcaatgacaaggcatcagatttgtagagagttctgaaacctaacgtaggcacacattcccaccgcagcttcaccccagaggagcccgagccggggtcctcacggagggtgagaggggcctgcggagagcagatgggtccacaccacccgcgaggccccttcccccagacctgacccggctaccagtccttctgcatccatcgggaacatccccgagggatcctagcctggggatgaggcggggggtggggggtgacctggtgggccatcctgaggaggcccaggtgctgatcctgggaccgtccgtgacgtctcatccacgacgtctcatccgcaggagctccgtgcgtttgctgatccggaaggtacagcacgcgccacgcgatatgggtccccagccccgagccgaggcctcctggcagttcttcatgtcggacaagcccctgcgcctcgccgtctcgctcagcaaagaggtgactgtggagccggcctgcggggagcccgcccaggccctcatctgggggtgggctgtgggcagccttgggtgtagtggtaaataccgacctatgaggatga

SEQ ID NO: 41175 - DNA, 1355 bp, Bovine  19866881344284
aaataacagtttagttatagcttattacagaaaactccaaaacattcaaaagcagagaagccagtgtagcaggcatgcaccaccaagccccagcctcaccccgggtgagaaggagggactagaaggcgccccacgaggatcggggcactggctcaccgctcactgacggccatgacatccagcacgttggagaagaggatgtgggcctcagacgggtgcaggatcttcttcagccgctcgttctccatgaagtgggacaccagcaggttcaggcttttatagtaggaggcctcagaagtgatgagctcgaacatggcctgggacaccgggcaaagaagacgagaggagggccagcggtcgacacccagggctcacctttccccactctcagacagatgaaagtgcaagttgctccatcgtgtccaactctttgcgaccccatgggccatacaatccatggaattctccaggccagaatactggagtgggtagcctttcccttctccaggggatcttcccaacccagggattgaacccaggtctcccacattgcaggcagattctttatcagctgagccaccagggaagcccaagaatactggaatgggtagcctatcccttcttcagaggatctttccaacccaggaattgaaccaaagtctcctgcattgcaggtggattatttaccagctgagctatgagggaggcccctcagacagatgtaaaggttttattttatttttggccacaatgcacaacttgcaggatcttagttccccaagcagggatcgagtcctcaccctcagcagtgaaagctccaagtcctaaccactggaccaccaggaaattctccagatgcaaaggcggccagcaccctttcggagacctctcgcctgctcacaacagtgaagctggagacgccctcgtgtccaaggtcaaacacgagaggtcatccattcttcagagctccgacagctgccaagggtggtgactcaggactgcttcctggcgaagaatgggtgggagactcatccatagagggagccccacttctacacacccagaaaaacgcttagaaggaaccaggtcatgatgtcaaccacaggtgtcaacagggggtggaattagagggtgaatctcactctttttctttttttaaaaagtttctttatttttttatttttggctgtgctgggtcttcgctgctacatgggcttttctctagtggcgtcgggtgggggctactctctagctgtggtggccagccttctcaccgctgtggcttctcttgatgcagagcacaggctcgaggcaggcgggcttcagtagttgggctcccgggctctatgagcaca

SEQ ID NO: 41176 - DNA, 782 bp, Bovine  19866881408230
ttgcttttggcctggtaatgctcactaaaaataggaatagcagacgttcatgattcattcttaatctcagagtaaaagccttaaatattgtaaggggtagtttaggttttgctttgttttgcaactactatatcagactgaagcaattcccttctattctttaatatatataccttaatcttgaatggatatgaaattttggattctttttctttatttatggatgcaatatgattttcttcctttactctgttaatgtagtgaattacagtgaatgatttttcatattaaaatatctttgcaattctggaataaatccaatttggtaatggtatattatcttttaaaatatattgctagatttgatttgctaatactgtaagtattttgtatttatgttcatgaaagagattggcctgaatttttatatcttataatataatggtcttgtcaatttttttacctcccggctctgctagcattaaatcaatcatctatctatatctgtatgtagctagctagctaactagctatctattacatggcatctcacacagccttgactttgacttgcagatgaagtacaatttgccctcctggtgtgaccgagtcctctggaagtcttaccccctggtacacgtggtatgtcagtcctacggtgagtagcaagttaagaggtcacactttcctaagttaaagggctgcagtccatccatctgcctaaacttggcattcaaagcaagcctatcatggaggtctttaaaaagaaggagggagactgg

SEQ ID NO: 41177 - DNA, 769 bp, Bovine  19866881415540
atgaggaggaggacacaaaccttagagaagttttatgacagtattcgaaagagaaaaccatggacaggaatcaaaggagaaaattacaactgacagctaatgcaaatggatcaacctataaagagaaaagtaggaaatgaagcaaacaaaacgaagctcaaagttcactattatattctatgtaccctcagtaagtgacaacagtagttatcttcataaactactatcacaacatactctaaagcttttaaagataaacttaaaggaaaccacttttaaaggacagttctttgaagtatctacttttaataagctctagaactgaatgtctgactgaagtgttgatcagtcattcatgtggcccactcctagcctagacttaggcactggctatccttccatcctgagtccatgctctccctttggcaagtcttaaagcattttctttcttctgatgaaactatcattctttatggataagaccagccccctcgacaatataacaatatccacgacatgatgctattatgtcaattcttaataccaggctcatcatgtccacccactagtgtcaggatcccattggtaattctgattcctccccacttcccaaaacagtcatgaaattatagcactgacatgtcatatctggcccactatcccaattatagtagtttatgaaacaaaacctctgacagcagaagtaacctgcataacaaagcaacggaatccaatgctgcatcctctactgctctttccacagtaacag

SEQ ID NO: 41178 - DNA, 1136 bp, Bovine  19866880859903
tgtccacacccctgttcaattattattctgacattatatcaaatgtatccttttatatcaatttcctgttttatttcccttcggtcatttcccctttttattttaatttaaatttgtttggactgcactgagtggcttgcaagatcttagttccccgacagggaatggaacccaggcccagcagtaaaggaaagcagcgagtcctaaccactggacccaagggaattccctcttgccaaccattttctcccactaactgtccctctgtgaactcttactccttaaaaccattccttttatttttctacttttgatatattcgtaaaaatttcatggggatgttgataacggaaggaggttatgcacatatggaggcaggggttatacagaaaatccctgatcatccacttaattttactgtgaacctaaaactgttctaaaaagtaaactgtgttaaaaactagcataaattcttagccatagtgatatatatggcctcataattttcatatcatttagggataaacattataattttttatctttagaacagttaattactgaaaagtttatgagtgtgagtgtgtgtgtatgtgtaatttgttttcctttgggcccatcaaaatgaaattaccatctgtgtttgagactgatttaaatattttcttgactgaaggccagagcattagcaggaagaatccttgaagtgccttctaaccttgcattttcttccttttctagccatattggcaaagcatcaccttgtctgtacacaatgacagtgaatattggtatcacttatcatcgattagtacactgttccttgagatcttggtatcaattacattttactgatagtattagaaaaccaaggatgaaagaaagtcattcagatgtctagacagtgagttacagaggttagggtccctgggagaatgtgaattaaagattagcaaagagaataagtatagtatgcagagaaagtcatctcttttgcccttgaagacagatgaaacaaaaattagaaaacaaacaccgtaactgtcagaaattcagttttctcattttttctggggagatcaggtctatatactggtcacatgtttgtcctgctttgtaacaatttttcaaacaaa

SEQ ID NO: 41179 - DNA, 1188 bp, Bovine  19866880496044
aataagtcaattaaaagggtcaagtaaataattaaaatcatttctgactcaatcatacatgttaatgagatcttggggcaggatgaatcaacgaaattttcagttaatcccaaacaattaattgcaatttaaaaaaatgactgctcattcctcagaatggtggttctgaaagaacactgggaaggtctgattcagctcctgtgccctccctctgggtggaagtgctaacgagccacggaatggctacaaggaggccagggagatggaacagcaagtgtctcccagctgcgccacacaggagatcttaccactcctgctcatgctgtgtggcctctgccttccagcatgaaaaccgcctgttgagtagacccttcattctgtcttgtacctttcagattcaccctgcgcaactgtgaccgtgtcaaacccctgtttaaaaccctcaatggctccatgttgctgtcagaataaaactgaaatggaccaacatgaccccaaggtctgtgccacgtggaccccacttcttcctccagacatcactcctttcatgctatctttatacaccagtctactacactgagctccccgaagtccacagtctcccaggcccccaccttcagccttcatgctgctgctgctaagtcgcttcagtcgtgtccgactctgtgcgaccccatagacggcagcccaccaggctccgccgtccctgggattctccaggcaagaatattggagtgggttgccatttccttctccaatgcatgaaagtacaaagtgaaagtgaagtcactcagtccttagcgaccccatggactgcagcctaccaggctcctccgtccatgggatttgccaggcaagagtacttgtctagaattctctgcccctccacgacacatcagcagtgggacaggcgctaagaagtggccactggtccacgatgcttgcatctgagtaagtctgtccagcacaaaactaagataaaatgcccccttggagagaccagctaagatcttgttctctaagatcgctatcagtagcaaaagaactaacattttcagctccatctcccagagcatttgtcttccatccaaacttgagtgacaaataagggttatgttttactggattctgtcaaatattgatgcctgagctgcaattatctacttgtgtttctcccccatcagttcg

SEQ ID NO: 41180 - DNA, 744 bp, Bovine  19866880663326
cacacataatgattaaaaggaggtagttgttgattagacactcagataggaaggtaaattatttaaaaatagtccctaactctgaagcatcaatttagaacttcatcaatgtcactgacaaatggaaatgaataaataacaaattttaaaaataatgaaaaaagagataaggaaattatatcacttatatttcccagtgtaactttattttacaaattctgaaaattcagctttatccattaaattgaattttttaaacctgtagtagacagtttatcgattaacactgaatcaggtatatagcatgaattgatccttgagagtttatgaatgatactcatcctttgtaatataattaaactatttgaaaatgctttggattattacatgttggtttgcaaagagccttaagcaaatgattccatagatatattttaatgtggcaatactgacattttctttttagttttatctcagcctacactggacaaaatatgttttcactgtgcattattttaagctaccacagatgtctttaaaatctacagatcctctatatttaggctacatccaaagtgctaacttttagtttagaagtttgcaagaaataagaagcttaataagtggcacggaatgattgactgcataaatctactgaaaaccagttgccagcatgtttatttgacatttagacacacacctttatagatcacaaaccttgacaaaagctccgcagggtgtaca

SEQ ID NO: 41181 - DNA, 2992 bp, Bovine  19866880699114
tgtagatcctacgctagctgaaaattgaatgccatgttctggagattgggaagcaatactgagaataaaaatcatgttccaggaggtaataaagaatcttagaatgtgccatgtgaagaacagcccacggaaccagagaagaactggtgatggtgggagcaggaaaacatatagcaaatcttcaaatacctgatgagcttcaatatatataaggaaacaatacatttgtttcaagaaaaaattaggaccaataagaatagacattatagataggctgatattgtttcaatgtataaaaaatctaataacagtgcatccttttaaactttatggcagttatagaaaatgaaagaatttctacagctcattgtggaaaaaagtggttcaatgaatcctgcctgcctgaggtctgagatgtttaatatcttgacaacctgtaatccattcacagcacatttatgggaaaatttgttaataatatgatcagtgggctctgaaaagagtaaattcctcatcatagtaaaccttcaggcagagtttggaaacaatgtagatgggatgctgtaatggcaatttaaaaaatcctttaaaatgtataaactttttattgtattgtttcatgaattctgacaaatgcatagactcctacaactaccacaacaattaagatacagaatcattaccatcctccagaattattttgtacttccccattgtagtcaaatcaacacccatcccttagcactggcaaccaccgatctgttctatacgctgaaatttttactttcccagtgaaagtgaaaagaaagtgaaagtggaagccactcagtcgtgtccaactctttgagaccccacggacgatacagtccattgggaattctccaggccacaatactggagtgggtagcctttctcttctctaagggatcttcccaacccagggattgaactggggtctcctgtattacagttggattctttatcaactgagctatcagggaagcctgggactttcccagaatgccatgtaaatgaaatcatacaatatccagccttttggaacatgtttctttcactcatcatagtatatttgagattcatccatattgttgactcatccaagttttgatcctttttattgctgagtagtactccattgtatagatctaccacattgtccctccattcaccagttgaagaatatctaagtgacttctggtttccagtatggcatgtaaggagcttggaagtcatgtctccattctaacaacaatttaaaagctgaacaaactgaaaatcaacaacttttcttatattcatcagagaattgagatcccaggaaagactaccgcccctgaaattgaagagagagataggtggatacagagaatcacaatttattggaacagaaacatacaagtagtgaccttcatgagaatgattactgggtttcctttactcagtactcatatccagctttcaacaaaaattacaaggtatttcataggcaacaaacagagtttgaggagacagagccaaacttgatatggcaagaatgttagaactgtcagtccaggaatttaaaacaactgtggctcagtggctcagtgataaagaatctgcctgcaatacaggagatgcaggttcaacccctgggttgggaagatcccccctggaggagagcatgacaacccactccagtattactacctggagaattccatggacagaaaggcctggtggggttacagtccatagggttgcaaactttaggatgtgactaaagtgactgagcacacatgattaatatgctaaaagttttaatgataaaagtagacaatatgcaagaacagataggtggaaatccagagatggaaatcccaagaaagagtcgagaagaaatgctagaattcaaaactaccaatagaaatgaagactgtctttaatgggctcattagtagactggacacaactgaggaaagaatcagtgagcatgagaccatgctaacagaaatttccaaaactaaagcaaagagaaaaaagatggaaaaaagctggaacagaatatccaagaactgtgggctaactacaaaaggtataatgtaccagaagagagaaaggaacagaaaaaatatatctgaagcaataataactgagaatttcccaaaattaatgtcagacgccaaaccacagatctaggaatctcagagaataccaattaagataaatttcaagaatgtttgggttgcttccagtttagaaggaataaactactaatactacaaacattagcagcatataggtttttgtgtgaatagaacttttcacatttttggagtaaaccaaggagaatttctggtcataaagtaagtccatatttaattttataagaaactgcccaattgtttcccaaagtatctgtacaattttgcattcccatcagcaataagtgagaactccacattctacatccttaccagcatttggtatgatcaatttcttgattttaaaattttagtgattctaataatggtattttaatcagttatcctaatcagtggttttaatttgcatttcctctgtgaataatgatgttgaaaatctttttatgtgccatccatatattttctttggtaaactgttcaaatcttttgcctatttgaaaaattggattattttcttattgttgagttttgagagttctttatatattctggatacaagttctttatcagttatgtgattttcaacaatttttgcccagtctgtgatattcttttcattttaaaaacatttttaaagccttttatgaatgtgtgtgcgtgtgctcagttgctcaattgtgtccagctctttgtgatgccatagactgtagctcctctgtccatgggactgtccaggcaagaatactagagtgggttgccatttcctcctccaggggatcttcccaacccatggatcaaaccctcatctcctgcattgcaggtgaatt

SEQ ID NO: 41182 - DNA, 1967 bp, Bovine  19866880860000
aacatgctagacccctaatcatctgaataacttgaattcctaatgcatccaaccttggttcccatggtgacgcactccaccctgaagccttttctcctcttactctctgtcacctataaaacaccaaactcatctttcaaggctcagtgcaaagtttgcctgttctagaaaagctttccttaatcttaccttctaaccaacaccttcctgtattcttataatctagttgatgtcaaggattatgactaattctactttccagatcttctgagctcatagtgactgatacacagaagacatcaagaaaaatgctaatgaatgaaaacagaaattcattaatgtgacctgggtagatggattactagactccttgactcaatcaggagcactgcagaatcacctacaatgtaattggttgtgtatgtcaatagtatttccaagaaatcatttattgggccaacagagaagtaagttacaaacagatgtactttggataaatgtccgtagacatttttaacaggagtgtagttatgggatctgaccttttcacacatactaaaatggctaaggctgtgaaaacttcacctgcctgccacgtgttaaatggcaggtcccagagaatagttagaccagaaggaggtggagggaataaactgtactggagcaactgtctccttcttatagctcatattgcccattagttggggggaaattgtcttaaaatagtttcagaagaatgttttaaaaagaggaactcctttgcagataaccataatgttttacttaaagatgcaaaagaaaaaaaaaaaaacagaactgtgatttggtgatactcatcactttttacatatgtgtttattataagtagttgtgtcatgtagaactctgctgttggggagtcaagacataatgttcttctctctgttcattatttgagcagaggaaggaaactttttctagacatggattattaaagacaggatctaaagaacacagtactatatgtttgaaagctgttggcttaacataacgatcatcatcccacttcatagtccctggatttggtgctttaatatttagtttagtctaacactataaaaggcatgacaaatacactatgttctaggtttctttctttctatttaaaaaatatgtttaagtattgcagtctacatgacaagagatgatccagactattttaatgagttatgcatgcatgtgtgctaagttgcttcagtcatgtcagactctttgtaacccatggactgtagcccgccaggctcctctgtccatgggattctccaggcaagaatactggggtgcattgccattcccttctccagggaatcttcccaacccaaggatcgaaccctcatctctttgtctcctgcattggcagggaggtgcttttccactagtgcgcgtagcagtttgccgaatgacttgattggtatcgggcaaaagaataaggttggctttctgattttgtttcagttagtgtattgataatctacatatctctagatatctctagatattggtatattgtgtaatctagatatatatcaatagtttataggcctagtcttaaatcagtttgtaaagcttcagctcttctgatgtgtaatatttaaggtttcaaaagatatgcttatcatctagcgaatcttagaaactctaccttttcagaccaaatataatctggcataggtttaggaatataaacataaagtccttaagggaaaaaaatgagtgtgaaaagggttcatgctccaaatggaatcatgtttctgacatgtctgttctgagcatcggaagtttgattctaattatgataggtttcacatttcagaaacttatctgtaagaatataaatctttaattctgatctttcaagaggccacaccaggttggttgagaggattaggtcatagtatgtctgacatattcaggttaacacataggcg

SEQ ID NO: 41183 - DNA, 1459 bp, Bovine  19866880934760
catcccacgctggcccagagaagtgtcttctctgagggtcagctgctgaagagtgctcctctggcatgtcccaatctccagggagcacagaattagcaaaacagagttctccaaaaaggtcaggatggatccatcctattaaaattgagaaagttggttgccttctgaggtgggtggtgactgaaatacagccaagcagaggcgtggctcctttcccgccatgagagcagctttcctgactgtattcagcttaaaaactaacactatagatttgagttcatttaaaataaatgtctattaagaattagaccacacactccaaatgcatctgtttctgcttttctcccgttctagtgggacaaagccttgtcagttgcgccaagcgtgtctgtgaaatactggaagaagctgatgcagaggtgaggcggaccgtctgtgcccagatggacgtttgacgttttgttaaaatggaaacaacatgtacatatgctagtagcccttgggatttttgacttttctgttgttttaaacgataactgaattttgtatctcctgatacaataaacaagtcggttatcagtcattttggcatttttgtatttgacctgacatctgataagaacagtggtggaaggcaagtttccccatgttgatagaggaaaggatggatcagtcaacatgctcactccttaatgtattgcagttgaaatgtatggatgtcaagtagtgctgatggtaaagacgttttaccactgaacaaggttaccctggatgtccttgactggaatgcagaaaacgagattttttctgaggtgtattggtttactggagctgccataacaaaggaccacagagtgtttcaaatcacagaaatgtgttctgtcccgattctggaggttctgaaggctagagatctgctatcaagctgtgggcagggttgctttctcttggaggtttcaagaaggaatcaggtccactcttctcccctgacttctggtggttacagcccttggcactttggtggcccccttatcttcacatgcattatcccccatgtgtctctgagtccacatttcccccttttgaatgaggataccggtcatatcagatttagagtttaccctaatctggtataaccctatattaactatttcagcaaagacccaatttccaaataaagtcacgttcactttaaagaatcagcctgcaatgcagtagacacaggttctatccctgggtcgggaagatcccttggaggagagcatggcaacccactccagtattcttgcctgggaaatcccatggacagaggagcctggtgggctgcagtccatagggttgcaaagaatcggacacgactgaagaggctaagcatgcacatgggttaggacttccacggatcttttgatggcagtgagggggacgcattccaacccataacataagactattctctatc

SEQ ID NO: 41184 - DNA, 1124 bp, Bovine  19866881240140
cagcagcagcagcagcgcctttaaaataggaaaatctgcaatgttttatggaagaaacaagtgcctatactattgtttcagaaaacttttatcctccaataatggtgtgattataaagctaagtcttaaaaaaaaaaaaaagctaagtctttgtgaatactgatcaaattttagatattttcagcatttcagaaaatctgagtccagctgagaaccttgaaattagtatttcttaaaaaaacattgttgttactttattaggagagctgatcagttaatccaggaagataaggatgacgtcattccgtattgcatagccattggtgatgtgaaaaaattagtccatttttttatgtcaagaggtcagcttaaagaagctctgcttgttgcacaggtaaaaacatgtgatttacatgggctgcacagctttgtgggggcgtgtttgggagggggtggtcatgttcacgtgattgattaagtcataggtgccttgacttctgcccgtatcccggccttctttcctggacatttccatcaccctgcctttgctctgatcacactgagtttcttttagatctttaaacaggcaagcatctctgaattctgatctggtctattttgccgaacattgtatacacttgaacaactctttcaagtagacttggtgcttcatgttgatacagtgtaatttatgggtttgtttgttttccaaattctaagggtatctccaaattgtagtataaatttcaaacgtggtttgaatatactttgttcaaaataattttctgaagttgatctattatcaacagccaaagattaaccaaagattgcattaaattccaggctgcttgtgagggaaatatgcagaccttccatgtttcgacacccaaaggaccttctttttctgatgatatctacaaggaagactttaaagagtgagtgattcatcctttgcttggagtcaatatttttgtggctggtttccctttaggggcttttgagatcatccttccttgtacacagagtgcttggctgtcccgtgtcctcaactgcatttctcaccgcagtctcgtttcatgacatcacctgcccctggatgaggagggaaaagtcaggcacgtaga

SEQ ID NO: 41185 - DNA, 985 bp, Bovine  19866881477298
ttattaaaactttagtgtaagtctcattttactatttttaattggaaagagagctgacatttatggttacaaaaatataggtctttctccttagatgattgaaaaacaaagaaaaaatagggtaaaggagatgggtttaaagtcaaggacagaattagttccaacctagaaacttagaggccttaaaaaagaattagattctgatggttgcaacctgactgatttgaggtcattctattttcgactgtttgacaagaggtgagggaatgaggatagataatccgaagccacatactctgtgcccaggactcatgacatggcagacagacagaactacatctcaacaggagataaaggcctgacctatataactgataggactggaagagtgcctgaggagttcagaaggtaagatgacatggaattaaattcttctttactttgttaagacaacctaaagtcagaatagtcactcattactttctctacaatatttgagataacccaaactatataatggagaaggcaatggcaccccactgcagtactcttgcctggaaaatcccatggaaggaggaccctggtgggctgcagtccatggggtcgctaagagtcggacacgactgagcgacttcaatttcacttttcactttcatgcattggggaaggaaatggcaacccactccagtgttcttgcctggagaatcccagggacggcagagcctggtgggctgccgtctctggggtcgcgcagagtcagacacgactgaagcgacttagcagcagcagcagcagcaaactatgtaatgatagcaaaatcactatctctggctgtttctgtaagacatcttgttctagagcctctaaggctattgtctgaatagaataacttggagaatatgctaagtaccggtttgtgggtcccactgccaagatttgagatcagaaagtttgggcttgagaggtggacctgcagttctcacat

SEQ ID NO: 41186 - DNA, 1660 bp, Bovine  19866881603139
gttgcatttggaagacgacatgactaaacattgacatgaatgtaagtcctttaagaatgtaacaggaaagaacagattttaaatagttaagaaaggacagaaaggcctctttcaaatccaagagaattctctgatatctgaatcattatttaaaaaatccaattaatgggaaacaggataacagttacggtaaagtgttgccatagtttaaggggatggatcactaaatctgtctacctgaactcttgaaaaatctctaacgatttttatctgcttgtcaaggaactgcaacttagatctcatcacattgcctcctgctcccacacaagtagaaagaacatttatattcaactataacagtctaacaacaaacttatataggaaaggtgtcataagcataactgaaaggaaaggaagatcaggaatgaagaaaattaaacctctcttccttcagtaagaggaaaaaaaaaagcttaaccacagatatttacttctgtatctcagtatacttatagatcactatacgacatttaattttattgttttccactgctgttcctaaacaaaacatgcacatctatggtaaaaagaacccactgagacaggagcaggtgctctcacatcaccactaccccgacctcaatgaaggaatgattttcagtggtgttactggagaaaaaaacatcacaactaattacatcatttctcttggttcctacatccaccaaggcatgctcaaacatgctcagacatactcaacctgttaccacaatccatggtttctctcaagatttcacttagtgtaatgaatataatttctctatttaaaatgataaacttctatttccataaatggaatgactggccaagaagcaatcttctcatgtgctataacaaggtattaacataaggcattttattcctaaaataaggtaatcaattgagaagccttttaaggatgaaaattaccaggaaaattcaccatttcatatcactgatgaacacttattctattagttcacatagtaaaggtagttgaggatttttttttaatttaaaaacatatcatatgatacctatatagattattgtgtttctgttacagagtatcattatcaagtgtgctaatgtctaaaatttgggtactggtttattgcctttctctactgtgtctataaaaccttcatttatagaatgtctctggttatatatatgtgagtacgtgtatgtgtgtgtaaaaaaaaaaccattaaagctgaaaggttcaaaataatgaaaaaaaaatcactgtattcccactctattttatcatgtaaactaaaataatgcatttgtgtacaatcgaaatcaaatttgagagctgaatcttttccatactgctcttaaatatagcctttaagtagttttacctgtttgcatcctaagaacacaggagtatttgctataacattacataagccttgaagagacaggagagaaaacgctgccaatcctggggtaaaagccacagttccctccaaagctacccttgagacatacacaaattctagagtgttggaatcatttaaaattgctgatatttggccatttcaaccttaaaaaaaatgacaatttcacttaaacagccagatacacctaacaggcatagaaaatgcatctg

SEQ ID NO: 41187 - DNA, 796 bp, Bovine  19866881836942
gtgtgatggctttatgcttctttaagtgtgtattcagctttctgttgttcacaataatgtctctgtagcatcatctagagcaagttcctaatagaaaagtaatattagaagaagtaaataaataagagaaaaaaggggtgaattatttcttattgataggtattttgcattttttgaagcatggaaaaaatgggatattctgcattgcctggagtcataaagattccaaaagaatagcaacctgcagtggtgatggttactggtaagtactgtgtatgaaatcacactgtttataaagatgcatttgataatataagtgtctgctgttagcacctgtattaaaatatttgataagactctgtttgtacagctctgccagctgtcataaatattacttacggtggcttcacagctggcactagtggtaaagagcctgcctgccagtgcagcacatgagagccgggttcgatccctgacttaggaagcttccctggaggaggaaatggcagcccactccaatattcttgcctggaaaatcccatggacagaggagcctggcaggctacagtccatggggtctcaaagagtcagacacgactgaagcgacttagcagctccatctataggcacatgcactgctgtgatataccagtaataaataacaatgcaatgatgtttaaaaataaaccactaattgctttctaaatgtaaatactactcaaattataactaaaatactgtgacttgcctcaaagcaactttcacgtactttcagagtctaattctcatcacgttt

SEQ ID NO: 41188 - DNA, 1590 bp, Bovine  19866880497378
gtttgggttcagggaaaaagcagccttggccgagacagcttcactcctgagtagtcagagggaagcaggcttctccccccaagcctcacggtcctgccagcccacctacctggtagttgcgaacaccatcccagcacgtcgtctgcctgggctgtgcctggagatcctcgatgctgaactgggccagaaacaaggtcatttggtgaactctcctgggccagcaggtcaggacgtttggaagcagacatgttcttccccgtttagtgtgagcactgctggcagcagggcccaggagcctctgggaaagtaccccacagcccgtgcgtgccacgcacgcagacagcagccctgtccaccctgtcatctgggcccaggagcctctggggatagtaccccagagctgcgcatgccaggcacgcagacggcagccctgtgcccccctgtcattcctcacagtccagaggattaggggagtgggtaattaatctgctaatcccgttatctctatttctctattattaaaatatatatcccttctatagcatctccaactgtgttgtctctgggctgtgtgagaactgagtcacactcaccccctggttaccagctgttggcagggagatacctaagggcacagtgggtggccagagaaaggcagcctgaggccaagtgctgcctggcatggggctggtggaccagcctttgggctgcatctggcccacgcctgactcgcagacagtttcactggagcacagacaggtggcctatggccagttttttttgttgttatcttgcccgggcgtatagctgactgacaacgtggtgagtttcaggtggacagtgaagggactcagccataggaccacatgaacccgttctcccccaaactcccctcccacgcacgctgcgtggccccttctggtgatggcagcagcactgcgaccacgaccgcccggccctctagagaaaagctggagggtcacagcgcagatggcaataaaccctgctggtcctactccacaccaccgtctccctgctcctcagaggcaagaagtaggtgatgggccctgtggcgtcccctgtgcaccgtggaggtgggcgcagcacctcaccttcacgtccacacctttctccagtcgactttctggctctgacttcatcagccagtagctgctgagagcctccccactgtcttcagagactggagtcttctggaggctggagttctccacttgggctgatgccctccctaggttcttagttttggtgcgtttttcttctggccccttcatgtctgcaagagaaacaaaaagaaaactttcttacctgctgagaaagttctgatgcaggaaaaacagctgctctggagtcagagtttcccaggtggtgctagtgataaagaacccacctgccaacataggaaacttaaagctatggcgttcagtccccagggttgggaagatgccctggaggagggcatggcaacccactcgagtatccttgcctggaggaccccatggacagaggagcctggcgggctacagtccatggggtcacagagtgaagcaactgagcacaagcacaatacaa

SEQ ID NO: 41189 - DNA, 2164 bp, Bovine  19866880620437
gcagccagcagcagatgcagtgagagcacgctgcctcccgcgtcctcccgccggaggccagtctgtcagggccagggcccagggctcccgtcctgtcctgctcagccactgtggtggggggtgggcagttcttgactgcgctggggccacgtggagttggtcggtaataagtgtccccgttgcacagctggggacggggggcgctggggtccggggccttgtctccagcagccatctggagcacagttcaccacttcagcagcagtgtgacgtgggcacagacagccagcaggactgtgtgagaggagggtgggtgtgcaggaggtcttctcagagggtggtctcgggacaagcaggagtctgttaggatgtccatcctgagtcccacccaggccccagaattggagatattggggggggagtgccagccatctgtgcctcagcacagcctcggaggtcctggtgctgacacgagtctggggactgtggcctagactgggatagcctgacagcccctccgtcagcggggccgcgtggacccgtctccaagtcctcacctgcctcttgcctcgtgttcacccctgatctcccggggcccaggagcagacacggccgggcaggaaacctggggcgctgggcccggccccgccccgccccaccgcgcctaagtttccttgtctgttaaacgcgtgacgggcccacccagcctctcaggttgccgtgaggatggtgtgactgagtgacggagtcgagcacgcttcccacacttaggaatcgctataactgtgtaaagagatgcggtgtttcgatggcagtccccccgctgtgtcccctgggtgcttccctggacagggtctccacagagcgcagggtctttgggtgcagggctgccgtgcggggcgggaagagggggtcgctaaccgccgtgcggctccgcggctgggagggccacttccgcagcgggcccccgccgccctccgtgggccaggctccagtagggaggtctccgctctccccgcagagctctactacgaccgcggcaaccaccacgagttcgtgtccctggtgaaggacctggcccggcccggagaggtcacgcagtcacaggcctttgacttcgagttcacgcacgtggagaagccctacgagtcctacaccgggcagaacgtgaagcttcggtaagtgacgtgactcctcctcctcgggttccgcacacgccgggacgtggacctgcgtcctgttacgtgagaagggggtcacagatttggattcttttttaaatttgtgtttgactgcgccagggcttcactgttgccagcgggctttctctagctgcggggagcgggggcttctcattgcagtgacttctcttgttgtgacgcacgggattagttgccctgaggcgtgtggactcttcctggaccaggaatcgaacccatatcccctgcagtggcaggcagattgttaaccactggacccaccagggcagtcccagatttggattctgatcccagacccatcctctgcatcttttgggacaggagaggataaaatgtagcacagtgtgagaagctttagaacaggaatacacaccttttaagtacaggggattgtcttccttgtttcagtcttgaaaacccaaggggggcagtgatcccagggcctctgggctgtgtgatgtcacccggacttctggctccaagttgtggtcatcacctacctggggcctgcgtgggggaccacatgggctctggggaggtctcccctctcccgtcagaagacggactgcaggctcttttattccagcctttgcagggacgtccaagcgccgaaggtgccccattcagcagcgctctgtgactgctctcggaggaggcagcaccagcaagcactgtctagttaactgtcagttaagctgggccggggtcttattgtgatttaatgtgatgctctgcagtagattcctcatagatgttcctatgtcagaaagatgttgaaaatagtatggcagttcctcaaaatattaaaactaccaaatgatgcatcaattccacttctgtgtgtaaatccaaaagcagtgaaagcaggactcaaatgcaagtgctctcacgtttgcagcagcgttcccagtagccccagggtggacatgaccccagcgtccatg

SEQ ID NO: 41190 - DNA, 1608 bp, Bovine  19866880867406
catgcctgcatgtctgcatctgtgtgcatgtttgcatgcatgcatgtgcgcacatgtgtacacgtatgtgggttagagggaggcagatgtctcactcaagaggggcacagcagcccctccctctccccggtccccaacccctgcctttcctacacagtctcacttgtgttttgtgttaattgcacttaatatgcaagtttcatgataacttcaggaaataagctcaattaaatgtagatatattcagcttactgttgcattttacaaatataatttttccattgatgtttaattgccttaaaattctttcaaggttaaaagggaactatctcttgaacattagttattaaattatgtaatgccaattaacttgctgaattgatttgagctttatgacactttttattgattgtttgaaagcaagcttctaattatcaaaggattggatattttcaactcaaaagtcctctgagactaacagaaagctggcctgtcattttgaaggtcttggttccttatgaccagtgacctgaaccccagtgtgggctcaaccaaaggaagcattttcctgggtggagggttccgggaagccttgaatctgcagctggttttccacggtgttacccagctgctctccagatcaacagcggcacccagaagtagccatgtgatcttcataggcaaagagctgctatttcctccatttgtcctgcttggagataaagcaccccgcccccagggtctacccctgggtaaacaccaggggtctgcggtgggtccctataaccagggatgtgtccttgctgttgaatgtccagtgcactcaagagcagggattctacaaaaaggcatgaaataaacttaattatgtgttgaaagtgaaagtcattcagttgtatctgactttttgtgaccccatggactatacaacccctggaaatctccaggccaaaatactagagtggtagccttacctttctccaggggatcttcccaacccaggaatcgaactggggtctcctgcattgcaggtggattctttacaaactgagctaagagggaagccccaattatgtattagtcataatcttaattaaaagccaccaaggcttaagcaaaagctagcaaatagcatgttttgaaattgtgaaaattttatttttaatttgttaaattaaaatttatatttaaattatggaagtttatacttttatagcagcatcattaaaatcatagggaaaattcaatgaaatgtgtgtaaagtcatgctctaaaaactacaagcactgttgagtaattaagcaccgaatcgagctatgaagttaaaataatatcagtcagcttctcgtagtgatcgtgttttccacgttgaacagattcatgagataattattctgtaaagcctttggcttccagaacgtggtttaaaatcacagccgaattaattcagcctttggctcctcctccagccctcttttattgacttttctctcacttcccaaatatacagattgcatttctggttttattaaaactgccctgctgcagaatacttaatgggattcaaaaatgggtctcatttattattgcataattaacacacccaaa

SEQ ID NO: 41191 - DNA, 2350 bp, Bovine  19866880904636
acagagttgtaaacaggtaaaacaatgccactcttctcattaaaatttctttgctttggaaaatattttttttataaaaattgtgttatttatgttaacatgtgatgaatttattgacgttattttttaaatttatttatttgactgtgccaggtcttagctgaggcacacgggatctttggtcttcattgtagcatgtggggtcttcaggtgcaacatgcaagccctaaatcaaagcatgtgggatctagttccctaactagggatggcactcgggtcccctgcattaggactgtggagtcttagccactgaaccaccagggaagtccctcaatgctgtttttaattaacacttttttaaacttctcagtttgcatttctaatatatatgaacaaaaatattttgactgtctctgtcacccttatctccatagcagctgtaaataaataaagttattaatatattaatctcctatattaaaattctttcaattaattccactgcagttagaataaaatccaaagcctttctgcagctcacaatgcactaaaaaaggcacacgaccagcatttgccgtcatctggggccccgagtctgagttccagcacagcccccagctccctattccagaacacaccaagctattctcacttcaggtctttgcatttacttatccagacccttgcatggtggcctggttgaaggaggagtggatgaaattctggataaagaggacccgaagacagcggtgtctttcctggacaggtctgtagatcagattcaccttgaaagtcaccagctggtgactttcgctctagaagttcaaagtgaaaagaacaaggataaaaaaccatggtgggggaaggggggttaagaaaaagaagaagacgaagaagtacgcttttagcaaaattaaatggcaggggtgcagaaaggccctgggttctgatacaatgtgagtgtccctgacaatttccatttgaagcctgggtctcctgcattgcaggcagattctttaccatctgagccaccagggaagatagtttcttcacttaatattccttataaataagttcctgcatagctttttcattcttttttcacagtcacattgtattctattttagggaggtaccataatttatttaaacacttccctcttgatgagtttatttttaaccattcccctccatttttttgcagttaaaaaccagtggcagttaataaattttacacatcatcatgcaagtgtgcaatattctataaggtaaatccccaagagtgtcatcgttgggtcaaagattacctgtatttgtaattttgataaatatggtcaagttactctccgttttacctgtcagcattaatgtaagaaagttctaatttctcacagatacatcaacaaagcacattgtcgaatctggggttttttccaacctgataggtgaaaaatgaaattttggtgtagttttaatttgcataactcgagtgagattgtacatcatttttatatacttaggggccatatccattttccacccttgaactatgtgttcacatccttcacccaatttccttagggatttttggtctttggctaataggtagctatgggttcttcacccactaggaagactgcctttctttgtgatatgagttgcaaatatttttcctagtttatcatacttgcaagtgatgttttgccgcacagaactttttatattgttaaattcctcagtcttgtgcgatttccatcattacgcgatttccatcatttcgtgatttctggattttgaaccagagtgagaaacgtattactcacctcagtgttataaaggttttaacacagaaagtctcttaagttctcctttgtatttacatggatttttttaacatcccattttgattcatttggagcttttttttttttttccaacttatcacacagggaagaggattccttgcgtcctcgctctccatccagcccccctagactccccttctatcctaacctgaacttggccctgtcaccacctttagacataacagcagctgccagcaatgtggacttcaggagaaggcggcaggcctcgggcatctccaggagggatcagaatttctgcacgaatccgagctgtctgggatcaaacaaggtttgggggaattgaaggaggcaactgaaggaacccaatatcaaggaccccaaatttgattgcttgagccacttaaaattcttggaggcactgaacagcgtcccttggaaagggagagaaacagacttgaaaagcagttccagggtttcgacatgtgttcttcgctggtagaattcagggtgaggatttgaagggc

SEQ ID NO: 41192 - DNA, 1384 bp, Bovine  19866881229749
tgttcgtgcatatgctcatgcacacacatgcatagatacgtcttcctaccgtttggacttctccgttggggaccaggctggcacttagctgagctggaggccccagaactgtctccctcaagatccatcaaaaagcacaggggaggctgagaagcaagaggaaaacttgggaccactttctctcttctttgtagctgcagattttctgtttccaatagatattgtgaaggcagcctatgtacaaagagcaagaatgagggggtaggcagaaatacagaacaatggagaaagtcttgctggaacagggctggaggggaggggcaagggtgggagggcgaggttggggccggccccatgtggtcttatgtctctggacacacagatcctggtctggcacacgcggaccgagaaaccagtgctggtgaatgaggggaagaaaggcttcactgaccccacggtggagatctgagccccggacacaggtaaggggatgcgagccggtgacaccctgatcagccccccctccaagcttgggtgtagagtaaacctgccaaggcgtttcctcctggtctttaatcatgacagtcacagcaaaggccccatggagtggaggaggcagagatgaagtcagtaggtggcaacctccccgcacacctgggccccccagctgggtccccgcacacctgcacccccccaagctgggtccccgcacacctgggcctcccagctgggtctctgcacagctggatccccacacagctgggtccctgcacacctgggcccttccttgctgcttggaggccttcacctcacagcaccgcctcgtgacggctccctgtctccccatctcattctggccacaaacctgtcctcgtatgaggccctgctgggtggactcacccgggctctgtctgcatggtttcctcctcagttgaggtagaagcgtggactccagattctggcccagttcctaggctcccatttccctcattttcttcatctgctaaatgggttgttggggcaccagaaatagtctctggcactgcccaactgctgctgcttttatttggtccttaaaaatcctgtactgaagtagttcacaggctctatttacgctttagagatacaggaacgaaactcagaaaagctgagtggattgtgccagtaacccgcacagccaggcccttcctgagctggaggcttgctgtgagtggggttctcttggtcttcaggcctcggagtcaggctgcagcttttgtgcctcgctggcaacagcccaactgcaggagaccgcgggggtcatgaccctgagcatggcagatcacctgggccacgaccagaccgcagtgggtcagacagagcacgctcccagctcctcgggcgt

SEQ ID NO: 41193 - DNA, 1360 bp, Bovine  19866881578499
aaaaagaccataacctacaaagggaccccaacaagctaagagctgaacagaactatcccacgatccagctattccacttatggtatttttccaaaaaatatgaaaacactaattcaaaaagatacatgcgtccttaagttcactgcagcattatttgcaacagctaagacgtggaagcaacctaagtgtccaacaagagaaaggacaaagacgatggaatgtgtgtacacgagggactactacttagccatgaaaaggaaggaattcttcgatttgtgaaacatggatggacctagagtgttgcgttaaatgaagtcagacagaaaaagacaaataccacatgacttcactcacacgaagaatctaaaaaacacacagtaaatgaaaacacccaacaacctcacaggtacagagaacagactgggggtcacgagaggaagagggcaggacgaaatgtgcaaagggggtcagctgaacgtgatgcatgggatcagacttctggtggtgagctcgctatggtgggcaagaagcccagttataatgtatgcaggaaactttaatgatgttgaaaaccagtgttacctcaataaagaaaaaagaatgaaacacaaacaagcaatcactccaatcccactcccctgaaataactactttttgcattttcagaggtatctttgaaaacgttttattagtgtttacatgtatctatttcataaacaaaatagcacatgctcctaaaatatcatgtttcttttgccatgtaatccatcacgaatcttcctgcgactataaacaaaaactattataaacgggacagaaaaaaggcacaagttctggctgcagtgagggcagaaccaatagagacagcagggccccactgctccagaagacattttggagacaagagcaaaggaagggacacgcggggagttacctggctattggccagaggctctccaaactgcttccggaccttgaggtagtctcgagcgaggacgatcgaggcgtgagcggcgcccagggagcaggaggctgggagggaggggatcaaggcggccagggagtttggggggccgtcgcgcccgccccccgcccccaacccccgcggtcctcaccaacattgatcctcccgccattcaggcccttcatggcgatgaggaagccctggccctcgtccccgatcctgttggccaccgggacggcacagtcttcaaagatcactgcttgggtcggctgtgagttccaccccacctggcaaaaatcatgggctgtgtggcggcccggcagtcaccacacagcgcgatgtctgctgtccacccgggcccgatatgggtgctccaccgtcccgggactcaagctc

SEQ ID NO: 41194 - DNA, 844 bp, Bovine  19866880650941
taaggcccccttctgtgttttggtcctggctggattactacccaatcttagttggtcagaagctagtatgctggccagtgctggcgtagagaggggagacagcgagctttaatggtcttgaaaggatagcttttcttgtttgcaccctgatttttctatttgctagcttattacagatttgagatgaagtctaaaggttctgatgccagaaaaagccctgggtattccgcaagaggaggctctcagggcacgagggaggggctgtgtgagagcctgtccctgccatggcccctcctttcacatttccctggtgatgactgatgacttggggttttgctagaagtgtagcattgatgtgggagctaaactggcctgggtgctagttgtcaagagactttgagaggcctcctttgacatagaaaggggctggaaaaaacttggactaaatatcaagttccaaatcgccatggtggaaatgtttttcccagccttggggattgtggtgaattagttcaggctgggatagaacttgggggagggaaaaggctcttgacagcagctctggccagaggaacccccttgttaagagaccccatttagaagaccctaggccacagagaggagcctaattcctagacttttccatgtgaccctgctttagactggggaggtgtagggctgggtgggagagggatggaactgatgcagtagactccttgtgatttgaggatgtttcattgctcgtaaggagattcaacctttttttcttttttttcttaaagtaatactcattctctaaaaaaaaatgtttgggcaatttataatttagattaaagggaaaaag

SEQ ID NO: 41195 - DNA, 1510 bp, Bovine  19866880922149
taggcctactgaagtccagacctgtgctcctgtactgaactttggggtggtggtggctcatttgcagactgaaagggtcacagactccctttcttctcaaaacttccctcagaatgatgcccagataatgttctaaaacagatggatgagagatagctaagtgggaaagagtatttttgtttgaatcgtctgtgtccagagtatgcttaggcccctttggacagatttctggtttatggttgtggttattttgttttcacttgctgctcagcagaatcagcatcacacaaacactcattatcctcacccccttggcagtcaggacacttggtaaatcccttgtaaagtgctcacgtctgcagattattttctgatgcatctggcatgagttccagattgatggtccaatagcagctattaattgctccctttgggcttgcctaattactgctggcatcgtgggtgagtaagggattaagagtctcttctgcatttatggggcagcaggtcctggtgagctcccaaagcatttatctgtcatttccccagaatacccttgttaaaagttgggagtaaaacctcaggagttgaagggtcggcggctagacagtgtctggtggcattaggcttctcggttgattccctccgggaattgtaaagaaaccatctagtatttgttgcctatggatgactgtagggaaatgtcaggtggtgtcacagtgttataaaacactgcaggctgcttctgattgtctcagaggcaagagggcagagaggctactccggccttatcccaccacggctaggtatagagtcactcagtactctggagggcttctgaggctgcgcactgagaatggtgaaggtgtcatcttcctcgcctggagacgaagaagggagaggaatgctatgccagtgctcagagccttctgagtgcagcctggtgttcattcactcagcaagcacttactaagcacttaggattgtgttaagtgccagagaaataaagatgaccgagccagtgtctgcccccaggagttcagtctgaaggggaagacaaacacattaacatctaattgcagtcttcagcttgggaagtgtgatggtgtagaaagggaggagcacctgggcagcacagagcagggcttggggaatgctgcctgtaggaggaaatctctgctggctaaaaggataattaggagctggagagaagtgtggaggagaaagcattccaggtagaggggcagcgtccggacgagacagagcgtaatgtgctcagagaatccttccggagctgctcggggcttttggagtatagggtgtaaagcagacagtggtgaaagcactttgactgctctgtggatgggcttccctggtgtctcagacaataaaggatctgcctgcaatgcaggagacttgagttcagtccctgggttgggaagatcctctggaggaggacatggcaacccactccagtactcttgctggagaatcccagggcacagaggag

SEQ ID NO: 41196 - DNA, 2576 bp, Bovine  19866880977893
tgactggccccctcaacatcgtttaaggctgagtggagtgctagcctccccctccccatgctttcggaacttagcctcagaagagcttctcaatccccagtgtcttcatgaactgtcctatgaagaggagggcttggatcggtggattctgggaagtatgaccaaggcccaggctgaaaattacagggcaaggggtggaggagataacccctccagaactcaaactagaaatcagaagaggaatcaagggacctcagaggagaggtgattaaaaaaaagtctgtgcaaatatgtgttctggtgcctccctttgtggcactctggccacggtcttccattttgctcatagaaaaactgaatcatagttagcaagaatcatttgcttaataccatgagccccttggcaatgaggcaccagaatccttcttcccagcttgtgtctagaagttggaaactacagagtgcaaatctggtggtggtagcgggggaggggggagatggaaggccagggaggggttactcaggaccacaaactcccccgagctgtcagggcctgaccactcggtctcattccagccgccatccggtctgttagctgtaggatcttggatcaagcctctccatcacctcagctctcctctgtgccatgggcatgtgcagagtacttcctttgcaggatcgctgtaacgggttaatttagacagcacacagggagcaacccacccgtgctctcagttatctccgtttcacataccaacactaccaccatccattcttgattccctctctcctcacatccaagatggaaaaaagcttcacatgcttctgcaatatttcttacaagttggagataggaaggatggagagggaggcgttgggaatacatagataacatacctagttaccctccccaggggcaaagagagccactggcatgtgggaggagaggcaaccctggagggagcagtcaaggaagggtccaggtatccactctgaacctccatgactccacccagtaactttccactggctgagttagccactagccaaggcagcttgcacacttcccccaggtgtggcctcttggtccactctccagcagacctgcagggggctggtggctgacgcacacagtctgcctgagatctcagctgcctggaagctgataaggagacctgatcccatcacatgagaccagccagagggacttgccctggttgttagcatcagctggacggtttccaaattggagagatgaggagataggagtgaaatggcctggacctctgaactgagtggtcagagaagctaggagtagagacacgggcactgccagtggaggcctcaggaggcctggctggggataagccagcaactggcagtggatgagggaggttttggaagtaagatgggcagaaaggccttggggaagggctggaggcagggcccaatttcctcctgggtcagggggtcggggtgggtgctgctggctcagcagtcagaataagtctccttttcccagaacacccagtcttccagcgctcaagcccttactcagcctcaggcctgtgagagcaggctggggatttaagagaagacagtgagaggacgtcggtctcagtcctgccacatctcccaggaggacgcaagtctgggagagtcagcaatgctgcagagcccagttgcttggctgcttgctcctttggaatctcaggacaggtctccactcaggagcagggcccccctatacccacctcctgccctggtagtgctgtgttgtgacccagaagggtagaccaaggcaagcacagatggtactggtttcctgcccctctcttctgccccagggctcaagtgcctaaaacaagcccctggtcccagagctgagggaggctgggcagcctgggacagccatactgtttacccagtacccttgcctctccgcagagcacacacatcttgtctcccagttgtcctcaccaccacttccttacagaacgtcaaaacctaaactggaaggagggcgaggaggcaggggttgggcacaggacagtgtgccccagggtcccacactgtgggtggccctaggaggaatcacagtcaggttgcaggcttcagctgggcttcctggggcctttttcccacatctgaaatcctgctgggcttctcccacgcatcccttgggtcctcaaacccagaggggcctccagcctcgatggtcccagtctgggagaggtagctgggggaagggtggcacaggggacagtaggaccgggttccgcagggcccctggtggcatgggtacaagctgcagagggtggggttgaggacagtgagtgggtcggccgaaggctgggctggcagctagctttatatctcggcttgcaggagcacagggagggtcagaggaccagcaagggggcattctctgaaggaaggaaggaaggggtgggaagggctccttattcccggttggtgccaaaaagctgcaggaagaaggtgaagatatagatgatgtctaggtaaatgttgagggctccaaaaatatactcttcggggctcagcgagtggcgtcg

SEQ ID NO: 41197 - DNA, 2867 bp, Bovine  19866881046559
taatgtgtgcaaagaggaaatgaagggcggagggagaggaagtcaaattggggaaggctggatggctgcttcacttcttcttcttcttatcctagaaatggaggaaaacgacccaattaacttctggtgttgacagttaagctaaaactcttgagtgagccaacagctgactgcctttgattaggtactgtaagacggaaggagagaagctactttggtgtaggaggagctaaagcttaaccgtcttccactggcagtcccccaaattgccagacttgacaagaaaaaagtctacgctctcgctcccgcttctaaccggcgtgaagctaggtgcgttgcctgaccactcctggtactcacaaccgtgacagctcagatacccaccaccaaaagctgcagactggcagtctatcctaaaagaactaaatcagaggccaagaccaactttccattaggcctgagacggaaacataaatcctgggcgtaagccaacatgcaaaataatccagtccagccaaactcttcactgcacgggggtggaagcccagtgtataattacatgaaagaaaggcaagttgtttggaccgaaactgggaggctggcttcgtgctcagcccattcgtggcacagccgagacaggggccacaaatcctatccagtcgccagcacccaccactgctgcactgtcccttgttccattttaagttccgtgaagaaaggctatgctttcagctgttcccctactactggagtggacaatgcttgctcctcactaaccctacctagcatacctcacttgggaaaaaaaaaattagaccaacaaatggatacaactggcctatttctgaaataaagataaaaaagctggctgtcattttatccaaatcctctaggatctctttttgagtcaaagctatctttacagcctttaaattcttcatatatactaattgtttcttgctgccactgaagctcttttccttctgatactaatcttggggagacattttctaaaaaaaaaaacagaattgtctttacttgttcctttttatccaacagctaatgacttctagtttaacttatatgcagtggcctgccttacaagtaccctgggcccacacacagtgtgagcaagctctcaggtttgaaggacacacagatgctgagctcaggagcccgtctttcctcttcgggtggtgctaaccttctcattcatagccaggatcatcatgagctttctgaagagagttacgaaatccaagaagaggtcaacgcagtgcctgaaagagaaccaccaggttataaactgcactttccatgtgtctttatccacaagcccacagaggtacagggcataaaaacctcaccccaaccccaagagtcaacctcaccagcaccctaccaccaacaaagtaccctattgtctcagaccctctttgactccatgaatccatgaagcacagaaagaagaaaatttagactgttacattcctctccctctcgtctacctagaggtaaccactattcaaaggataagataattaaccatctatcaatagtccaacttttaaaaatctgatgtctttcaggaactgagaaagacaatgctttctaatggatagttccagaaccctggatattccatcatgtatacccctggtaggctggccacgtaagtcagccagtgccacctggtccactcttattcctaccaatgtgcaaagaaaggtgagtcagacaaaagatcatcccagagattcaggaaagagccactgaagagtagcctcctcctccatacttattaaagaccattttcacactcaccagatataatctttatctccattttcagccttttcaataatgagttgagtatcaaaaaggacaaagccacacatgaccaccagccccatatacaggtttgcctggcaaaagaagaatgagatgttaccatgtggtagaccttgtagagaagaacagtcatacctctctctggtccttggtcacttcaaagtacatcaaacactaaccctacagacataaacattcacgaaaattgaagcccacaatgaagaccatattaccttcccaagcacaattctgcacttatttttttttaggtcactgaaagagctttgatcattttaacaagaagccactgctggactggttttagaaaaatgacttctgagcaaaccatcatctccactgcaatgcccaacccctgttcagtctgtactttgacctggagcagaaggctccactctgaaagggtgagtggggaggcttcaagagcactgcccatgaagataagagttttggaggattcctagcctatcctggttttaggagattaaacaaggaaaagaaacacaaggtaaatggggactggaaagttatatgcaaatctcacctggaaaagccaaacagatccgaagaaaaggttccccagggaagacaagagcatgaggctcatggccgacatcaagatacctagaagggaagacaaaaaccaccttgagaaaagctaacacaaagttcagcaatctcattaaagccattctttactttttcccccaaaacagaggctttcattctcaacccaacagttacaagttggagggagggaaagggtcccagggagaattttggctaaagccgagatcctctccctgttttccagctcatacatacctcctagaaagaggtagctacggcgcctggcatagagtgcactcagggtgaagcaggtgaagatcattgctgtgcccatgaaggcagtgggaaggatgctgttaaaggaaaaggccgttatatcaagggctacaggcatataacctttgtttagaaggtatcttcattaaggt

SEQ ID NO: 41198 - DNA, 2059 bp, Bovine  19866881332601
tgcctccagcactgcactttgctcccaaggtcttcaacttcatttcctcaagagccagctcagggctagaaaaaccatttccagctttaagctaggccacgggcacctaggcccgccgtcactagaggcagagggaggagaggagaaagcaagtatcccttcttttttccccttactttttgaatcccagtggtcagctgtgatctaggagtgtccaagcttagcaagccctggaccctgccagcctcaggtctccttctaccaggagcaaggccctcctaagcctgggcctgcccagctgtgccctagtgacaaggaggagcgatcccacactccctgcccatggccctttgcagtcaaggctgactctgtccttgccaatgtgagcagaggggtcgtttcctcttccccaacctggagacagcaagacaaaggatgtgccaacagcatcctcatttttcccagctaggttttgctggcagggggcagggtcatggtggtctcagctgttttctccatcccctgccagtttcttctcagtccctgaagggaacacaggggcccactcctttttgtacatgtaccacttccttctctcttgtatataaacccccaaaccttccttctctcaacaaaggcttgaaataccaggcctgactctgtctcctttttctgagcataggggctacatcggccatttaggctgacctaagccacaggggggcttccctggtggctcagcagtaaagaatctgcctgcgatgcaggagacgtaggttcagtccctgggtggggaagatcccctggagaagggcatggcaacccactccagtattcttgcctagagaagcccatggacagaggagcctggcaggctgcagtccatagggtcacccagaattggacatgactgatgtgactaagcagcagcaagccacagggacagaaaggaggctgggtcaagctgccatgcttgggggaggtgactgcagaagcctgggcaaggagaatctgtttagatgggcgccaacctcacacagggaggcaggcctcccatgaggcaccagtgccccctgctggccatgcgtgtacctgtctggtccccagcctgcccccagtaccaagcccaaggacaagacaaaagagccactggccacgttataaatattgtcatttaaaaaacaaaaccaaaacaaaacacacatacgctgggccccaggggtggtggagccccagggcctgggcaggcgggagcaggccctgatgctagcggctaaggacctgcccctgccgcccaggctgtgtccaccagcctgccacttgttctgggggccccatctcacattttatctactggcaccacccacatggcattcaccaccaatcgctggtctgagactgagggcaaggactgcactagttgtccgggaagttgaggggacccttgaacaccacaagcaccttgggagatgccagaaatggtgggttggggttggggatacttgagaaaaagtggacacagacccaactaaagaagtctggggcagacagcgagggtgaactcagccacagcctcacgcagacccgaggcacggtggcgtgtcaggtcactggtggtcgtccagctgctgcaagagcgtccgccgccgtctttccagctcaccctcactcagctcgctttccgacgtgtcccagcccgtctggtggagcaaaggcacagctcacccacggcttccccgagggcctgggcagcgcgctgaccgggcgggggccgggggcctgcctctctcaccttctccttcttgactccaaaggctggggagcggttagggagctctacccgccggaggtccctgtccttgtcctgttccggttctttctcatcactctccttggcagctttctcctcagggtctgtctcgctctcaggactattctgtaagagcccagagcccacctcctcagttctgtggaggacggcccgggaggcgggtgaagacatgaagatatctcataaaatagcagagacttggacgcaagttccttctctacgcaccga

SEQ ID NO: 41199 - DNA, 1240 bp, Bovine  19866881656121
catgaaactgagcaaaaaagactgggacttctgggctggatttgctttccttacaggtatgtttgggatggctctgatttttgagggagcgacactgtattttagtatctctttaaaccaagggcccaagatatgtatatattctgatgcatcccaattggcacactgtattatcctgtcttgtatttgagtgtgccttgtattactttcttatttcatataagtacatcttgctcccccatccagagggtaagctgtttgtgactcgtgactatgacttctacttttgtacccaaaaataagcattcatgtgcttgaatgaatgaagtttaagagcttaggtagcatgacttgttaacagtggacatgggactaaacagcggcctgagaatctgatttaatgaattaaggactcaacgctggcaactttcgtaggagcatctgttctgaatcttgcagacagttcattaaagccatacatcgagattcatcctacagggcactttgctgattctcaagaaaagaagtacaagcacagctcttctagaataatcattaaggaaaacagttcaagcctacctaataaaaatactcacagagcaacatttgagttaatacaacttgttctgagtgcgtctaatctgtacagtgttgaagaaattgtaggaaggaagggatttagagattagatttttagatcaggaaaagctggtttttgaaagtgttaagaggtgggatgagcagaaggagagggcatggccagagtagaggaagtgtttggagctgggacaggtttccctcctgttggcaagtgtccacctgcagaaccggtctggccttttctgctacacagggagtcagtctgcatgactacaggttgttggccacttttcaccactttgctctttatccttttcttctattctgattcctgatctggcccacattacagtctcacatcactgctcttcagaatttttcagccttacagtttagcttgacaatgtttgaactccctgcttcatttctcctaatctctgttccttctgtgtcatccatgattttcaaccaaggacttggttttgcagctctgtccataaataatttagtcaagtatatgttctctggaaaacagttgaggatggaagggagggagactgaattatcttagtccacatgttttgttttctaggactgtaggcatgcccatgctattgattaatccttcaagaattggtgt

SEQ ID NO: 41200 - DNA, 1285 bp, Bovine  19866880222359
ctccaggcaagaacactggagtgggttgccatttccttctccaatgcataaaagtgaaaagtgaaagtgaagtcgctcagtcatgtccgactcttggcgaccccatggactgcagcccaccaggctcctccatccatgggattttccaggcaagagtactggagtggggtgccattgccttctctaaaatactactctaacacgatctaaagtcagtttcatatttatgaacacttaaggtgctctggatatgaatatgactttggcaaggaacataagaattagtcattgaatgtgtttcatatacagccatacatatgtgctagtaggtatttaatgaccttgctccaattacagaaaaatatttggaaaaaagttaagaacccaggttaggaaggcgtctgaaatggcaatgatattcaggaagcaaggtgaggaacgtagtcaaatagtttgggagtatttttaacttggcttttgctaacgccatacttttaggggaaagttaagttgttcaaatcacagtatgaatttgacatcattctttattgatttacttgatcttaaaggaaaaagtgcattactattttggattttaatatttaaactccagaaaacattggtagttaaaatataattgcaaagtaaatcattgttaaaaaatacttccacccttttactgggcatacttctatcatataaatgggcattaagccagaaatataaaaacttcctctggtttaaaaaatatcatattcttaaaaaaaggatttatgtcttggactgacttataaaattttccttgaaataccttcatgaaaggaaggataatcttgtatcaagcaaatatgttataccaatgtgtataattttactctgtagaattcttaatgatgaaaatttaatgaacagaatcaatttcctaaagtttttaaattattatttgttgttctttggttaaaaggaggaaaaatgaagtaaaagttgatagaaaatagaatacatgatatatcacgttattctgaaagtaccttgtattcttagtagtagaactgaaagattatttctttagaaatttgcaaggtactatttctgttattacaaacaatattgagtgattaaaagttctgtgaagttccttaagctatgataaagcctccttaacaacattaaaccctcactgtaattttttgagggtagaaatcagaatggccatcatcaagctggcctggcatttatatagcactgaaggaactgctgtgaatgatgtaatgatcttgctgag

SEQ ID NO: 41201 - DNA, 1675 bp, Bovine  19866880543811
cttgtcctttgggcatttctaaagtgtgggaagtagacctgtccctactgagccttctgatgtgagcagactttggctgggggaactttctgtgtgcctttataggctgctgaaactacacttaacatttccctcctgctgtttaagaacagctgggcacagatgtttttagtgggtggcatagtactgtaaattagatggaaaggtcgttttagaaaatcctcttttagtcttattgtctctaaattccctttttggagcagatggggagatgcacaagtttgcatcttaaagaaaaatagatcctatatccaagggctgtttctaggtgagtcagaatcatttcacaccagacagagcaggcttctgtgagactcattcgtgttccctcttcctcactacgtccttggtttaagttaaacacgtgggggcaagcctgtcagaggagactgctgactcacttccagaatggatgctatttaggtctctgaggcatagacatgcatattttgttttggggaggaaaaaacaaaacccaaattggcaccgtgaaggtctgtttgtacattagtatcaccagctttgaaaggtgaatgatatgggagaggaaagaacaaaagggatcctgagatcttacgtatttttacttttttcccaactcgccttcacagggaatgttagcccttgtgttaaactgcattgatcgcttaaatatctacaatagcatagcacactttgcagggatcgccagggaggagagtgggatggcctggaaagaaattctgaaccttctctacaaattgctcggtaagtacatgcccagagctctctccctgggcaggtggctgtggaggtctataggcatttttgttccaggaagggggagcccaaaaggggactcttatctaacattcagaaatgagtggtctagatatatgtgctaacaaaacaagagaatttgttgggaaggggcacctggacggagaggagagttagggaacccgggaggactgctctgtcatgtggctcacagtctagggtcctatggtaatgggattagtttccaggttgtctctggccaatcactcttactcgcgttctccctggtcgtgcatgcattgctcagccaagatggattccagcaaggaggattctgggaggtcagtaggatatgtgatgtctccttttgacctttccaaaattcttcctgttggtggtgctttgttagttctatgttccttaccaggatctcctattgtaaaataactcatgcaactgattactgtggtgcctggccagggtgggtggtttcagccaatgtttcccttaacattttcatggaacaaactgctattgtcatccagcctcattccttggaagattgtgttaaccacttgattctaacccagtggattatcaaatcaaccctgaatattcattggaaggacatgctgaagctgatgctccaatactttggccacctgatgcgaagagccaattcactggaaagaccctgatgctggaaaagattgagcacaagaagagaagggggagacaggatgagatggttggatggcatcactgactcaatggacatgagtttgagcaagctctgggagatagtgaaggacagagaagcctggtgtgctgcagttgatggggttacagagagtca

SEQ ID NO: 41202 - DNA, 1312 bp, Bovine  19866880550172
tgtaagtaatatccatttaaaagcagtaaatgtctcttcccaaacagaatggactggcatgcagaggaggtgtcaacccactcaaacatcccttggctccccagagaatcattatggtctgttgtgttaacttacttccttcttgatttttcttctttttttctttttctcccctgctgaacattatcatttcaaatcaaattaagtactaatagtaagtgcatacagcaatcacttcagaaacgcaaaacattcagactcaagaggttgtatgaaaaatattattcctcataataaagattgagagcccagatggaattgtgagagagttccaagagggttctagcaactgaagctgctgtttgggtaactagtggagccaccaacaaataataaaatctaaatcatttaaagacagcaccctctcctatctgtgccccagctctcttttcaagtctcttctttccagctctaagatctccagttattaattacaatagaagtaatatatcaggatgggaaatcactattagctcagtcttttctttggtaaaatagcacaaaatggcaatacagtacatgggaaatttgagagtctgactcgatatggtgattgttatccaatgactatttaaccataaaaatgtcatggattgtttattttagactggagttttcaaagagactggatcctccaataagacttaacctattggtctttaaatattgtaaattaaagatggtccttgaaatatataactacatggagtaaacttctgctagaacatggatggtaattataggtatgtattagacatacattccaaaactatgcattcaatcttattagactggcgttctattctatatggaaaatgaattagttattctttttcaaaagacaaaccaggataagactattatttaagttcctggcaacaaagaagagcatggattataaccagaactttttagttgactttgacacctgcaggattccctgaactacacaaattagatggtaaagaaaaagaagtccttagaaatgcaatttgtgaacaaagaagacaagagaatgcccatgaaataattatccagtgagcatagcttctatcttcccaatttctatcctggggccatatgttggcagggtctagctgatcttggttgacactgaaagtggtgatattccaaatcagccaggtcttcctcaccaaagatgtctataaatcatgagttaattatcttggaggaaaagtgagcaattaaaaactaatttatttcactgagttggaaatgtttgagggtgtgt

SEQ ID NO: 41203 - DNA, 1793 bp, Bovine  19866880576150
atggtagagtcattaaaaaaatagctaaaaagtgagtggcttcatataataaggcttgctttaacattattaattcatccttccctgaaaggaagtgagtgttataaactgactcggagacgtgacatctaaatagacagcattgctgcgccagagtaaatattaaatcacattaccggatgatccttggggaatggccttgcaatgtcaagaccatgggaaaatgatgcgaaatcaagttcacagaaatttgactttgatgttcaaattaatgaatctctctccttgaatgtttgcggagttgtgttgtgattgaaaatgattacacaatgactataaaattctgtgaagaggatggaggttaaaatggaaaggattttgctgtacgaccacacttacataaccttttggtgagtgatattcaaacttactacacgctccacactgcatggggtgcagaggtgcagaaaaggcgggcggagggatgtgtgctccttgtcatttaggggctcccagtcaagtgagtgatggctataatggagtcacgaaaagggccctacggggaaaggccctcttcccatgaggggcacttgacacttgtctgaagaatgaggaggagtttgctgattatggtacatggagggttaaaaggtattctagctacacgtttagctgtgagaaaagataccatgttcaaacacagtatgtacttagtatgttagagctcaaggcaaacatgagctggtggccagagatattacggaagggtaggcaggggttggctcttcaaagtcttcattgaatttgttacaatattctttctgttgaatgtttttgggtttttggcttggaggcatgtgagatcttagctccctgcctagagatcgagcccgtaccctccgcactggaaagtgaagtcttaaccacgggactgccagggaagtccccaggggtcggctctcagagcatctttcacgacagacttcagatgaggtgcagctagaataagaattgtgttcaaggtcccacagagggtagatgggagtcaaagccagatctaggtgacttggaagccatgctctatctgacaccctactccttctagactgaggggacaggtgtaaggctgtaattcagagccctcaacaactcccagacctccactttgatttggatctcctggtgaaggagaggaatgcaagctctgaccaagatccctttctgctcagtcacacagttttctcagagcccacagtttgattccatttgaaccaagcaacactgcagccgatgcttgacctcgacccctcccagtaaggctcagtcatatccctgtcctgttctgtgggtacaagattcacatggatacctgccatcctccttgtaagggcatcttgctgaggatgtgaacatgcacctgcagctgtccccaggcccctgatcatgtagtcatagctgtcatgggttaacacaacttgacaggaaacgtggggtaagaagcccatcactgccaatgactcacagcccagcttccccaatgtcctcctagaaatgtaggagcctaaacggcactccttccaggagtctcttctcttgtttttcagattctccagcatacagagaagatcagataatcagataatcccccactcaatctcgttcacagaggcacaaagaacacactatctcttcctctcagccttcccagtgagtttccccaacccctgtgccacctttcagaatctgggccactgtttcagacaactttctgctgtctgctccatcacctagca

SEQ ID NO: 41204 - DNA, 864 bp, Bovine  19866880642063
ggaacttggtccattgaaggaatacaagggatgaggaaaatactgcaaaaaacattgactgtccaatgtaacctggccctggtgtccttggccccgggataggtcatactccatcaggaaggccacatggatgatggattaaccctgcagagatgccagcgtgaggagtcccaggctgctcggatcatccggaacacgactgccttattcagccagtttgtaaggtacgtgagctccttccttttctctacttgttggtttctattttgcagccatccgatcccacagaccacccccttttaatactatggattttcaggaaataattatgtaccagcgaagagttctaccagaaagagcttgggattgaaacttatttcccactaggcgagctcctaccagcttcactcttggcccaacaaatgcccaagactcttcagttggtgtcattagttggcattcaggttggcgccataaacagccaaggtcttcttatgaaaattaaatggaaagagatggagtgctgtaagtcccctttgtattagcgcatgaacaggagaggagagagaaaaaaaaatggatctacaacctctgtgctatttagaaaggttttctacatctttcaaaattgttgctatgggtttggacacgagaagatttgcatggaatgcttgggtcacccacctacgactgggacttaaatggggaaagtaacttaactacctacttggatcgtaatccttccagcctcaacagtgctgctaaaatagaattctggattgtattcaccaattaccacacacacacacacacacacacacaaaaacagattctgttgtaaacagtgcagtgttgcaagccatc

SEQ ID NO: 41205 - DNA, 618 bp, Bovine  19866880768001
gggcggaaggggttgttgccacccttcttcagtggcctgtgaggatggactgggtggccctgccactgatcatacagaaccactgggcaaggaaagtgctgcgcagaggtcccacagcagggatggaggcagaggggtgggggtggggggcgctggtggtggcagccgtgacctccctctctcgcctgtaacaaaacccagtaccacccctccattgggggccggccctgcccaggcgcctctgtacctgttgttgtccacgtatcggatgagcatagggtagaaggcatagaggtctctgcagaggacagcaaactcgtccaggatgagcagctcagcctcctgcgtgtcgcccttgctgtcagctctcagctgctcctcctcctgcacagttttgatggccttcttcttcagcttctccagggtcgggatgaagtggcttctcagcaggtctggcctggctttgctgatgatcggttgggcgtacactgtgtttgcaaacaaagggcctccccctcattccacaagttatgacagtcgagaaaaggaaagaagggacactcaatggtgaggctatggaaagcccttgactcacactggcacccttccttcatcttc

SEQ ID NO: 41206 - DNA, 1409 bp, Bovine  19866880779283
cagaaattagtatgttcatatatcaggatgcgtcccttgtggttcagaatccccttgtgggattcccttgtgataaagaatctgcctgcaaagcgggagacctgggttcgatccctgggttggcaagatcccctggagaagggaaaggctacccacttcagtattcttgcctggaaaattccatggactgtatagtccatgggatcgcaaaagaatcagacacgactgagtgactttcactcattcactcatcaggatactgatttctctccagttccaactcaacacttgaagcattgtaagggttaaaaatacacacacaggctttgaagtcaaatcagggactgaatattggctgtcaatcatgaacagtgaaattttggctgggtacttcactttgctgagtctcaatttcttcatgtggaaaaaacaggaattagagtatttgtctcacagggttgttatgaggattaaatgagataatggaaataaggtttttatcacagctacaggcatgtggagagtactgaataaacagaagtactgttattatggtgaccaatcctagatgatttcagtgtgatcttgctgtgattaatgcagggtaagaaacagaatcaatttaacgagcttcctgtgaccatgtatttgtttcaggggagggtgaaacatacatgtgttttcattatacacactacaatcaaatgttttatctattttaaagtaattttatcttgtctcttccattttgcatttgtttatatcacttagaaataaactcccctatagtcacatgaggagatcattttacaaaagaaattaatagccgaaaatggccacctgtgtgataggccacacagcagacacaagctatggaaatccaagatcttaaagactaatttttatatcccaaacaaaattctcctcaaaaccagaatgttttttaaaaatttatgtatagttgacttataatatgtttcaagtgtacaacatagtgattcaatttttatagattcagaatgcttttctaaacaagaaataaattaatcttacagcaatgagcttacttcctaattccagacaaaaaagtgataacagaaatcagcaaacagtattaaacactgttctttcagtggagtactctgacccattacattaaaatgagtatgaacgattttcagataaacccagatttacccaactctggttttcaaaggcccctaatctttttcattcccactttatgatttttggatgggtaagagtggtcaaaaaaggccccagagctagcagaggttgatagtgctgacatcagaattactgagctccctgataccatctctgtgtgggaactggtcagaggagcaactgataggggggttgaccaacattcgtgcctgatctactag

SEQ ID NO: 41207 - DNA, 1726 bp, Bovine  19866880783898
aaccctaggcaaaggactaaatacaagtgaggacttgaggtagccatgctctgagaagcagagccaggatgctccaggctagtggtgctagcccattcctcaagtatactgttgaatgccatgcccaagaaaccacatctgagcgcaggctaagtacaggacacccctgaaagtgttgactcagggccccatgtgcacttctttgggtgcttagtatcttcctctgtcccttcacatgtacccaaggcctctggttacaggactaggaaaagaaaatgtgttggaaactgagatccgcaggatagtgtttcctggaaattccaggaccagcgttcagaggctttttgctcactgagaaggaactttttcaaaggaaccagaggaaggacttttgccagcttcctagaagtttatctctagcggatctttcagttcatttctggtggatctttcaggttctcctcccactggttgaccagtacttcatcaatcatcgcctgtacttcctgtcctcccctctgaagccccttagcagcagcgggtatgcctcccataaggagaaagaaatggtggccaggtgagtctacagaagagaaggtcatggtgctgatgtgatttccatgaaaccccagattcctggaacttaaatggtgaatcttttggagaaatgagctgtggcctgacaatcggcagctcagaggtttctgttatcatcttttttctgaaaatgactttattcatacttacctgtgtattattttggcaaccaagagaagtgtactgtttgtgggtatcactaggattagggggtagatttatatactcagatcaacttccatcctgaaatatatttagaaaaaggtgaaggtaattctgaagcttggggaaagcaaacacacaacattgagaagaaacagattaacactgctttcaaccccattcttatcaggtttttaaagattaaattgcttttaaagaatcagattttacaagtcttggtatggatgacctgagatttgaaatctaggctggcatagttcaatttaaatttctaacaggaaacaaattttaatcaaaagtgtcagcttgccttctcgttccactagatgagacatggggatgtctcagcagaactgagaacaaagcggggtgcttcatgatcaggctatgaggtggatcccaccatgcctcaggttctctctgtatttgacttatgagtgacaaaagcatgggttagatttctaaagagcagagagttaaggactgcaatcagagtagtctattcaccctttccctagcatccactggtggtgaagagtgtactttatattttataaggacctagccattgacagtcttgggaggattgtctcagcagtgagcttaatttttcatatgcacaaataattgcccacctgtggaagtatcattgtgaaacaccacagtgctttaatttctaagaaccacccggatattatgatctccgttttgcagatgaggaaactgaggtttgagcaggttccttccagtgtctaaagtgaccccagataatgagagcaagaatgaaagcccacccctctttatccagaccgaggggcattttctctatactgaaattacttcatttactgatatttgttaaacagggagaagcccatgctgtcaaaatgagatgcacttacaaccagttactgacctaacatttcctagatatttccacgatgca

SEQ ID NO: 41208 - DNA, 2524 bp, Bovine  19866880785946
gcttgggatataactccgccggggctcttttttcttttcttttttttttttttttttctggtcatcatttctggtaggtgatctggtagaattagaacccaaaacataagctatcccaacttcctcatgtaacctgagaaaaactgaggcccagagtcatatagcttcttagcatcagagccagggcctgaacttggccttcctgactcctgtccaatgtgctttccatgtctgcctagcaggaaaatgatggaacggttggtagatgttttggacttccctgatggctcagacagtaaagcgtctgcctacaatgtgggagacccggtttcaatccctgggtggggaagataccctggagaaggaaatagcaacccactccaatattcttgcctggaaaatcccatggatggaggagcctggtaggctacagcccacggggtcgcaaagagtcggacacgactgagagatttcactttcactttctttcactttgggggtcacagtgctgctccatgagtgagtgtagtctgcatgatccactcatgtcagttaagttcatgggagtatatttgggtcatttgagcttgctgagttaaaccacctcattaacatctggggggagagaaagagtccagtggaaaggatgcatgatgcccagggtgagcagagaaagtatttccatatcgtgtctcgagcatggtgccacctgcatgacttccttatagctccttgtgtcgcttctgtctcagcagcacagaggacgatgaagatgaagaagagatcgtgcacatgggcaatgcaatcatgtcattttattcggctcttatagacctgctgggccgctgtgctcctgagatgcacgtaagtgataagtgcccagagagcagctttgagggacttgaatcaggaacatggtagatgtcgtgaaggtcatttcttcttctgtccctggcatgtgtgaacgtgcctttctctctattccttctagccaaaatcaaaagtagtttctgcctctggtacctgattctacagctttctgaggaatgactcctgggaaaatctctgtgttgtatgatttctctgtgaccctagtagggcatatctgctacatattcttgtttcagaagcctccaaaaattacattttcttgcacctcagcctggtcacaatgtgaccaacttgatttcatggttgtctctgtcaggacactccacatggaaaatctttttttgatgaccatggtgttaggcatcaggaagatagtcacgattcatgtttggttatttcccagcggtaagctttgcagatatactggaaaagatgattctatttttatgagatgtcttctcaaacattcagtttcaaactgaatttgtgtattcaaagttgtgttttcaccttccctttttcatctctgctgagggtggagacacatactggccttatttctcataaagtctcacattattaagtgagagaggaaataattgctgcttgtaggaaaacagaaaagatagttctttctattttaaaagtacttggtaactgtgtaatagaactttgttcattcagggctcaggtgctctctccacagtgttcactgcatttggattatgccagtgtctcctaaaagtacttgcaatgcagactaggatgatataaatagtggtttctggtattgatgaggttatatatttggtcacagccaagataacagtgggtatgttgtatttagtgctaatgaaaagatagcattgatttaagtaatggctttcaaattcttttgaccaaaaaaattattttaaccatagtaagaaatttggggtgggctaacaagatcacttgggtttttctgtaacaatttgatccaaacaaacttgttgagaaaattaatatcatttacattgtaacctaatatacatatgtccagaaacaaaacttatccttgctatggatactgcattctaatagtttctactctattctaatatatttcatgctttttaatgctggtgacaatccactaactgattttataacccactagttggtcaagactacaatttgaaagatactgcattaaaacataaactcttatctttcttcctgtatgtcatgtattatctacttaacaatgtagcctgtttggaaatccatctacaagcgtttaggggaactcttccggtatggaagaatctagggtaaaagtactgtgtgcttttgtgaccccataaactgtagcccaccaggctcctctgtccataagattttctaggcaagaatactggagtgggttgccatttccttctccagaaaagtactgtagagaaaagaaaatctaaatcttcaaaggggaggctgatcagaattcttaacttgtaatagtttctagttcctactgtggaactagcaccttacccacatgggcaaatctttccatttctgtgctgttaaacaaataaaggaaaatgaaagggagctagggaaattctcaggcgtccttctgtcttagggtgggggg

SEQ ID NO: 41209 - DNA, 1567 bp, Bovine  19866880791427
gagaaatggaattgccctgctccctgcctctgggctggcctcaggaaaggtgtcctgggtccccaggataagggtactgccttgacttgcaggcaggagtgtttctttagaagcccccagtgtagaggccccgattctgctttctagcaaaggggggcgatcttcaggccacagatcacgaggatcctgcagagtcccagggctctgtgccatgtcctttctaggcctcgaggccgggctattggccgtctgaggttctgccaggccacaatagtttctctcttctagggcaactgtgccatccgtgtctccacagggaactgcactgcttcccacgtcccggggtgccagggcttctctagggcccagggaaattctgcttctagagcccaatgcctggccgcccccccaaggctcagttacacattccccctcatggaggttctctacgatctcctcgatctgtaagggcaactccaagtcggcagcatccacctcactgctgagccacagtctctggctgagagaagccctggcctcgtccctattcccagctggtctaggtgaagggttctgatcataactctgaactgtggggagaccactgtcctctccccacgtggcctctgaagagcctttctgggacaataccgatggctccatgctctgaggagccactccaagaccctctacctcttgtcctgggggcagccccagggtctgcttttctaacccctgtccttgcagaggagccagccctgcaagtccaacatccaaactgggaacgagctctagctgggggccttcctgccagcgaaggggcagagtctcagaagtcctgtcagtgcccagggagcacccaggggacccagcatctccctggaggccatcctgcggtggggatatctggtttgtaacttccccaggccctcttttctctatactcgggggcccttgagtaccctgtggagctgcaagttctagctgcaggccccagccgctgggggttggcagggtgttcccatccctgcccatcaccctcaggccacgtagggccggctcctgcccaccagatacttctcttgcccgctctccgagagaagcagcctttccaaggcggagggagcccccagccccccgaggcccaggtgagggccgaagccgcccacccccatcttcatcctcatcagaaatagaaggacttgaatctgactgggctccactgcaacttggaggtgcctcggcatcctcctcctcttccaaggccaggagtcgcttctggaccagctggaaggagaacggacaaatgctgttctatacgtggttgtgagaaggggtagcaggccgggtggggggagatggtatttaggcaggacaggggatacaagcaagtggcctaagtgagggtatcaaagccaggtaccaccgctctttttctccaccttattgggtcttattcctgcaatgctttgagccctaaactccccttttccatggtccctcgtctgtcgttctacacccaaagctggatgctaaagctgtccctctccagaagccgcatcatcca

SEQ ID NO: 41210 - DNA, 959 bp, Bovine  19866880791775
tgaaattatttgaaaataactgttgtttttttttaatgtgtcacacagggactaaatcattaagagtctcctgtgccatgtcagaggccctaaaggctttgtgaaccacggaggatcttaagcaggggagtgctgtgataagttttggatttagaaagattgactcgagtataaactgggatgggtttgagacatgcaagactggaggaagggagagcaggtaggaggcttttaaaataatccagaaatgatgaaggcctaagatgagaccctgaggatggagcaaagccacttttcccataatgcccatgttatcagattcccttggaggtaaagtgctgtttctgtggtaatacagtctgccatataccattattaaggaaggtaagcttggttttagagactgtctcttgtggttgtacccagaatggaaatactaggatttatgacaaagttgatactgccatacacaaaaagacccacaagagaataacatgggttattactgttaggggacagctccaggtgctgtcattatgagaggctgcccagaactgaattcaactggtctgatggataaaatgtgggaatttgtgctaatacatttctttattgctgttgctgccataaattctgtattttatccagttgtgtatttctattctgttgaacagtatttgctgtctgttgttgctatggagagcccatccctgctgcggtaggctattaagtgccttaaggattctttatatatccgctttagtggaaggtcttttctgtcatttttacttcaagtttttctgttaacaaaagagcttttggttctttgaatgttttaaaatttgtattgacttctgtctcacatgtgggtattgttctttgtgcttattataggggaactttgcccagagaaacatcagtccagagaaatcccactttcctcctacaatttaggagat

SEQ ID NO: 41211 - DNA, 1389 bp, Bovine  19866880797880
cttttctccaatacccagaagtggtatccagcagctgcgggagaggacaatgtgtttctcttggcctctcattgcataacaggaaggagaagattgggggaagcattctgaggcacgcacagagcagagaaaatgccaagctcaactaaaggctgatggaacagagacactgggtacccaacagcagtgctgtcccccttaggggcaatgatcaccacaattattaacagggagaaccttctgtgtacggagtcctgcttgactgcagcattagcttcacgaggctcttggactcagggtctgaagtgaacacaaagctcagggcaccaaaggccaagaacaacagcctggtttccaaatgttttgaatttttcttccaacacctccttcctactctcaaactgagtccaaattcctaatggaaacacagtttttattttttgtcccctctgcggaattttcattttggtaaatatccctaaaatgtcatttccggattcgaaaatatttttttcggtagggttatatgggtatgtgttcataaaagttgcaattttaaaaacctttgtggaaataaataatagttataaatgttaatagtttaaagttttataaaacttttctccaatacgtacaaatcctccagtattccatccccttcaactgcctcatagtatctgatctaaactactaccaggagatgttcatatttgcaaggattagcaccacaggccccatttgcaagggagaatatagtactcaacacagatattttaaaacatgtacactggagagagatttagcactgctcctcgggaagtagctgcatgagttaaaaatgctcacttaataataagcactctcacagtggagtggtctgtgtctatttcactagtgccttccttacccggaagcattccaagtatgaaggacaaacaaacatcaacaagatcattgaactatggagatctgttggatgccattctctccaaacctcctcttgctgaagtcaccgatacctttcactcagctcgtgtgccagatttgataatcacagggaaatcattaggagactcagtctcttctaacttgaacccaacccatcactcagcatctgatgaaggtgcctaggaaataaccatgtcgaatactgctcctgtccacccatccaagttcatatgacagagccttaacttgagtttccttccttagctctgctaggtagctaacccaggtgactgaggtttcccatcaacaatgaggagagagaagattatcagggagggaaggggaaaggaaaagccatcatcaggactcatacctccagtacacaatggttgtatcagctcggtaccatgagaatcaacacactgatagaaaccaacagac

SEQ ID NO: 41212 - DNA, 845 bp, Bovine  19866880800310
agttaataatactgtcttgataacatacctggcttgaggcattaccgtcccttctttttatttaaagacagtctgtacctttagaggtgggaatcttcacagagaatttattcagtgtaaagtggcaccatagctcggctgctcatttgtcattcacttgttcacagcaggcaaatggccccaggtgaattatgagtaggtattattcatacccgggctcctctgcagctcttagtgctttgctcttcagacctaatagctgctattttggtctcgattagcagtattttttcttcttccaccaactcctcaacttattaattagattacaaagacttgccttttttccccctgtgattagaagaacatctcttttccagttgttacttttacatggaattaaaatgatgcattgcatttatgttagaatttgtcaagaaccccaggcatgtgacacccaccatttttattcctcatgggtgttttaaaacctggggataaaacctaaatcatgctgatgaccttttatgtgagcttttgaaatgatgtgcatattcatagttcacagttgaaataattgtttacaaagaacattggatagtgattcaagagatctagttttgctctcattccaacatgctttaaaatgttacacaaaagaacctctcaaatctgatttgcctggccatcacaggagaagagtcttgtaaaggaaatgtttaaattgttttagaagttaagattttcagtttagttgacaactttatttctccttttcagtagttttcagtggtttcattggtttggaatagtgacctgaaacaactacatgaactgaaatattt

SEQ ID NO: 41213 - DNA, 1763 bp, Bovine  19866880803307
ttataagctgtttagcatatcttcacaagttcttactttcttatacttaaattttcacagaatgtggtggaagagatcagaatttagggtaaaacaaaaaagtgaaatctccattgtgatttatttctgtaggaattaagacaaatttgatgcctcttgaactctgagttcatttcagaagacttccagagggaactttagaaagtcaaacctcgggtcctagtggatgataggcatttttaaatattaagggaattggctccaggttacttgagtgaaaaagattagctaacctacttgaagtaaatgaggtttgaaaactcagagggcagaaatcacttaaagtaagtagcagggtatttggggattagcacagctcaagtttcccaagcattcagctagtatactcctatttttaaaaataaacccgttgacttaaatataagcagagaagctaaaagtatgatcctcattactttgtagtcacaccttataacctactatgacagcaaaagtgtgaagaatggttggaaaagcaccatgacactgtgagatgctgacacacagaatactgagacagtgggaaaagagattagaattatcaccaaagagtccacattaagtgatcatgaaaactctggataagcgtggcaactgccttttggctgattcaaatcttaagagttcaaaacaaatcctattatttatatattatttagcaattttagtttcttttcaaagatagccttatattttaataatttatacttgtaattataaaatattttaaaaaaccagaaacataactctttgaaaaagaaaataaatattacctataaaacccagagtcgacctctgtggtataatccaatatttataaatatcccttgtttggttttagagttctgcctctgtccctatcctttctcacccccttgtggccatgatttgaagaaaccaagaaccaggcagcaaaatgagagaaagcaaaaatcctgaaggataaactgatcacctctcacttttacatcattttccataataaagtaggtctgcttgaaattcacatgggtcaggatctttgagaaaacagatggaagatgtgaagtggtgattgtaaattatcactttgttaaactctcttggaagtatggacattgaagaaaactaaaaaggatgtgctactcatacttcctattggctgaatccaactagaagcactcagagggaaaaggaatcaagtttttgcaatccttccaggcacaaagtggagtgaagggtagaaagtggatctgactgggcaaacagagcaagtgagtacaaaatctttctaaaatatatcattataattatagtttattttctatgttatattatggaatggcttgtataatttggagttgaatatctatgcaattcctgtggtttacctgaaaaacatcagagataacagaatttcacaccatcagaaagcattacttaggcttttcttctccatctactgcctcttgtatgttcttcagtctcttaaggctgtccgactttctgcaatcctgtggacttcagcaggccatgcttccctatcctttcctatctcccagagtttgctcaaactcatttccactgaggcagtcatgtcattaaaccatctcatcttctgtcaccctctactcctgctctcaatctttcccagcatcagggtcttttccaatgagtaggctcttcgcatcagggcaagtattggagcttcagtattagtcctt

SEQ ID NO: 41214 - DNA, 830 bp, Bovine  19866880836270
ccagatctgtttgatcctgccatgatgcctttaaaaaaggaaaaaaagaacaagttaacttctttagttcctagacattgatatttgaactgctatcaaagactagaggaaaatctaggaatcccgagaatatagctttgtctcctaagaaaaaccccttccctggtctcatcacccataatacagacaacagcccatgtgcttacctgtgacagagggaaagaagatgcccaccagaagagtgaaagaggtggtgatgtccacaaggacatactcatggtttaagctgcctaagacttcggaagatttggctgagggcttctcaatgatctctccctttggtagataattactccaaagattctctgcagggggatcaaggggtatataagcagtagcagtacagaaaggacacaactggataattttctagccaacagtattctaaatcagatctgtcatttatatggtttttaagggtatgtttgcttctacagagcacagatatatgcacatacataaagtacacaaaaataaaaacctaatgccctttcccatctggttcagatgtagtttgacaaatactttggtatgtacaaatacagttgcgtttaccaatgcaaattagcaaaagttaagcagactaagctgaacgcccttacaaagtttttttttttttttaaattaggtatcaatgctaacaccttagtgtaaacttgcttacatgcaaagatatttgtggaccagacagttaagacagaaatcacttaaggaaagaatttcaaaaatttagagagtcaggaaaacacatgtgggtttgatgacattaa

SEQ ID NO: 41215 - DNA, 914 bp, Bovine  19866880867775
attcctatttgaagctaatcttctacacgagcaatgtcttcttcttccctaaaatgttttaaaatactttgaaatattttcttgatattccgtttttaatattttactttgaattacttcaaacaaatggccagcacccatgtgcttaccacccagctttaacaagtatgaatttttgacatctttgcatcatattttatgttcccttcataaataggtctgtgaacaaaaactccagctggcaatacaactgctttctctaagataagcatattaggagctagttataattctacatctttatttaggtttttaagtatcagatggatacttaactagttattacagaactatcctcattacaacattttgaataactgtaaacatcaagacaaagattttttcttcatttattgtacccttcctatctcagacgaccagctgaacttctgaaatgaatgtcctagacaacagaatcataggcagtttcttttacctcccggctgtgtcagcttcctgtggtgcagtaatatcctgggtagaagtaaaataatcaatattacagggtccctgggaaggaaaccgactctcaacagtgatttcttatgtagaaaagagatgacctcaacttgtggtcacaaaggcatgaactaggtatggtaaggttaatactgtgtttttttaaaaatgcatgtttgactcaagttggtaccaaagaggtaggaagactgaaaatatacatctcctcacttgaacaaaaatcaagatactcccctttttagaaagaaaataaaacaaaaaccacaataaccacatttaaagagaatataaaggctagacttcttacagggagacaaggaagcctgccttcaggataacaattgggagcgagctccaatactctcacctcttaa

SEQ ID NO: 41216 - DNA, 1356 bp, Bovine  19866880907539
taagaaaaggtattatcttgttaacatgttggtacaaatataaatgaaacatagtaagaaaaagtattcccctgttttgctgagtttgagtttcttaaaagatagtagataatacttcatttttacattcagagctatataaggcagcagtctttagcttataaatatcattcagtggcccacactcccaatttctgttcttggcctttgcagtttaccttagtacctacctctctcagttactgggttatgattagtgttaggtgattttaagactcttggataaaagataagtacatattgttgaacccttactttgctatcgagtccttctcatgctgtttaatcagaacagtgttgatctccagaaagagccaaagaaagtgtttacaaagtattttggctgttgtattgacctagattaaaacaattgctgtctgtcatcactctcttgttgctgtgctgctaagcaatataactgaaggactacccaaggtctctatgcctttctatctcttgtaccttactcagtttttttaagatggtagagggttataatcaagtaattggcttgattataaagcaaattatagagataaagtaaatgatgttataatgagtgttcagagaaaagaagttaggaagcaagcattatgcaatggttttaaaaacatcctttggcaataatttcgaaggtaattggcatacattatttacatgaatcttgaggtacaagaatttagaaataaatatctgtacccactttgaatcattaatatcagcactgaattttaagggcccctggaggaattaaatcctaatgcccctaaacatacttggtatgtgtcttgtcctaaccttaaaaatggttgtgtggcttcaaagctgtatatttggactttgaaataattttctcaaacttagaccatttctatatgtgacaagttgttgatataattaatatcaatggaatctaatttgagtaatgattattagctgttaaatgctgataatagaaattatatttaaatgtttatttagttaaggagtttgataaaacagaattttagttaacattttggtagtcattcccagttatttttttcttcctatttaagaacaaaatggtaacgtccgttggcttttttgatttaaagaaaaaaaatagaatcacaaacagttgacttaactggagtgatctatttggatgcactacttatctttcaacacagacttttattttctaaattatttcagatgaaaatagtattgctggacattttggtaggtattgacttctgtgttattctttaacccttaattcttaattcttctagctatggaaatgtcatagaa

SEQ ID NO: 41217 - DNA, 1819 bp, Bovine  19866880940057
ctgtgattttttcacattctgcagctttctttttaccccaggaatcaaatcagacactttcagaagaggaagtggaggttgctccttctttttaaaagtatgagaggtatgaggtgaaacagtgggattcaaaatactgaaggggacaggctggagttagacagtgactggagcccgttggtccaggcctcttagcctagatacagtttcctctggtggggatgccacagggaggcatgggggtggggtgtgatggggtttgaggcttgcgacttctggatttgccaacggacctgactggagaaggggaaacggaaggcagggaagataagactgatcatgaagcttaccgggagagtcaagataacaagctcacaaagtgatctaagctgtttgagcaacagctgtaaggagcctgtgcttcttctaccagagagaggttattgacacttgctttatcatgcatgtactgagaatattggggagctcaccaaccatacggaggcgggaaggcaattctattcacttacacttccctcttgtagccctgtgaggggaggtcgagggctgggttctcagagatcttaatggcgccttgcatggccgccaacagaccgtttcctccttcaccccgcagggcggggccgaagcactcagggcgtctgatgagcagcttgaccacgacactagcattttcttccacactttcacctaagggaaagaggcatttttaccatctcgctggaggggacaacctcagaactgatttcatttttttggccatgccatgcgacttacaggaccttagcttcccgaccaagaattgaacctgtgttccctgcagtgaaagcgtggagtcctaattactggactgctgacaaagttgcccagaattgatttctaactgataaggctggaagaacagttttggtttagcttgtcacatactcttaagattagtagctaatactgatgcagaggaagctttgataaattaggtcagaatctatttatctgaagtagtacaattaaccagtattagaacagagtcttgcttctcagttcaggattttatgccattcacattatttcagtatatttaggtcctcagagggcaagaaatagactactgcatctaccatggattactgattaattcacaagtgacttagagaaagaggacctttatgtctttattaactcccttggggtgcttattaggtatttccttgcttccttgaggtgaggtaatagggtaactcaagctggtgtgtttcggttagcatctggagaggtgacgtgcctcagctgttctctctggggtatgtctctcttggggatgacaatgttagtcgctcagttctgtctgactctttgcgaccccatggcctgtagctttccaggttcctctgtatcatgggattttccaggcaagaatactggagtgggtcgccatttccttctccaggggatctccccaacccagggatccaacccgagtctcccgcattgcagacagattcttaactgtctgggccaccagggaaactctcggggatggacctcagggcatttctgaaatcatttatctgggtaagaatctacttggtaaagttgtcttagttattcttagaattgctctgtggggagctaaagactggatgactgtgtttgctggtatttctgtttggaagaaaccgtagataaccaagacagggtatcacttcccaaagaagtgattaagcagtgaaccgccacatgtggacagggatcgccaatgcttctcagagtcagttttaaaatccaaagtagttttaca

SEQ ID NO: 41218 - DNA, 1171 bp, Bovine  19866881076192
atcggtgtttgagtgcttgctgagcctcaacaccttgtggtgttggtagtttagttgctaagtcgtgtccaactcttgcaactccatggactgtgtagcctgccaggttcctctgtccatgggattctccaggcaagaaaactggagtggattgccattcctttctccaggggatattccctacccaggaatcgaacccacgtctgcattgcacgcagattcgttaccactgagtcaccaaggagcctgtaaccatttggtaatctcgaaatcacaagaggacagcttgtgagtctccataatgtgagaaaagagatggagaaccagaataatattataaataataatacagcaacttggaaagtggactttgcagacaacaagggtgttgggttagactggtcatcagctcattttaacaagggtttgggattcttcttgaaggaaacaggtgtttgtgggccattcggaatgagtagcacaagtcagcctttgcttttcttttgtttattatttcttttaacctgattctttttttcctttaagatgcaaaagagaaacaggtctctttagacagagtaggcagttgttcagtctgtcactgtgaaacacacatatgagtacacctccctgccctgctggttgtgagctcagcacaggggaagcctggccctgtccttcccaggagactgaccagcatctcaatccccttttcgtaggtttccctaagcaccaccgaggctgcactggcactgaacaggtacatatgttctgctgtgctcccactcctcacaagatgcgcccctctctttgccgggacagagcactacacttctttgattgactctacactgcagacaatatacaggctttccaaggggcgatccctcaccaaagctcagagggacaccatagaggagtgtttgctggccatttgcaagtaagtgcacactcccatgtgtttcacttctgtgtatgtatctgtgtcagctgcatttaactgtgtaaacctagacctggcgaatctagtctgaggatacgctcagactctaagattgtgctgggtcccctacttgcaacaggctctttctttgtttttaatgttctgttgaaaaatagttgatttacattgttgtgttaagtttcagctgtagagaaaagtgattcagtt

SEQ ID NO: 41219 - DNA, 1391 bp, Bovine  19866881101474
tgcataggcttacatttatttgttagtctgatacacttgtgatcaggttgccttgtgtatatggcctctggctgcatcttctcttattccctgtcttgctgcttgtcccatggaaagctgagctttcactcactctccaaggccaatgtaaggttcacatgaatcaacatcacagctcagcaatatttttggagtggtcccaagtatgtaccactgaaggggaaaccagcccaggagaggggcagaccagcccaacgataagcctgtgtccccttacttcagtccacggggccagaattcccaggcagagttcttggctcatccaaaggcagcatgagagcccagcaagaagttaggtggcgttcagaaccatgattcagtgctaacccacctgctgcacctctcactctgaaataactgcctcatctcaggaaggctcaggatcagggaagttcacagatagctgtgtgcacacgtgctcattcattcctgagcctctcaacctgcacatgtctggaatcaagaagatgacaactaggaaaccgtggcagggaagggagtggcgaattcaaaacagcatgtcagattataacaacttatcactgccattgtcattgtcgtcttcttagtccccactaaggaccggaaaaggactcatccaaatacgtgctattattacagggcaacagcccccaccgtggctctgccatcttttcaaatgtttctctgtgagcagagatgcctctctgtgaaggatctgttgtgaggaggccatagcagtttaaatcacgcatgatctttcatcggggaatagttacgcaaacccccatctgcctcgccttgggaatggagaagtctaactaatttcatgacacttcattttattcaagggctggcattattaaaatgtgatttttactgctggctttgaatgttagtacaaattttccatttgtactcatttaatcctgaagtggcaaatatgttcactggtaaatattaaggcactgggagaagagctggcagactcacatgaggaaaccaggactgttgctggggatatgtgagtgggaggagctctttgtaaagatgaaatgcattttctcagattctcttttctctggcttcacgtaggatttaaagaacaaaagaaatccacgtttggtgccatattcattgctggatgagcgtaccaagaagtcaaacagggacagccttcgtgaagctgtccggacgtttgttggttatggctataacattgagccatcagaccaagagctaggtaatgagtgcaaattgttcattctggctccagtttgctaaacacatcttcttctggaggaatactgatgttcaataggtctaacttgcactgttagaaataccattgg

SEQ ID NO: 41220 - DNA, 3395 bp, Bovine  19866881139513
tcatgtccaactctgtgcgaccccatagacggcagcccaccaggctcccccgtccctgggattctccaagcaagaacactggagtgggttgccatccttctccaatgcatgaaagtgagaagtgaaagtgaagtcgctcagtcgtgtccgactcttagagaccccatggactgcagcccaccaggctcctccgtccatgggattttccaggcaagagtactggagtggggtgccatagccttctccatctgttctattcatatctaattctctttccccttacctcttcctttcctactcaaagggtttcttctattaagttagacgagaattcactttatgattcttagtttggtacaggcatttaaaaatacaggtaggtgagaaaaaaaagtgtacaacttaactgcaacataaaagctgggaagaagagggaattcaaaaccaactatctgaaaacactattgtcattttatttctctgcttctcacggcttcatcctttactttttttaatctggaaattttttgaggcaattataaattcacatagttataagaaataatacagcaagatctcctatacagttggccccaatggtaacatttttcaaaactatatagttgaatatgccactcaggaattgacatttgacatagaatccaatcttattcagacttcccctgtcttatttgtgctcacttgtatgtattatgagtgtgtgtgtaagtttgtgtgttcacccaccacaatcaagatattgatcaatatgagcactaactcctgaaaaccacaagtctatccgtcattcgtcacttcagttcttaggccatagcctggtagcaaatggccttctatacaaccagctttgctccatttcctgtcatcactctccagcttcacactgctgtgcatcactccagggagtcaatcttaaacagatggtcatagaagtaattagtttttcaccttactgataaagaagactattcaaaaacaaaaagtgtggtgttcgggtacacatggcttcagtgggcctacccgctagtatgtatattcctggctataaaagaaggaagaatgaacatatattctagaaacataataaaactttgtataaacttaagtacctattcctctgaaatcagcctatccagtttagcggggcacagtttagcatttcattcccataaagccttttacccatttcaaccagaacttaagtcatcctacaccagtatgtggaaacccaaggcttccaatgaaagaaatatccctttttccttgcaaaccattagatactgtcctttacctggatttaaaatccaaacaatgaatgctagttattaaaatgctatttaaaaaggaatataaatgtccatgcaactttcatagcactaagtagtatgaactgggattcatacctgcagagctgagaagaacactgaaatctgtccccctctgtgattctccactttcattatcaacttctttttcagtatcttgatatcgatcccagttagagactatcttccttttagaataatttccctgttcttcattctcttctccataggtttctgcatcactgtcatcttcaatctgcaatcattagagacaaatcgataagctggcagtagaaattttgaccttagtcgccttagcaataaagtgtttaaaaacaaaacaaaaacacagtacataggtatcacgataaagagtacattatataagccaagctctctgaaaacgttaaatagtatttcaagagaaccccattatatcatacattgtgctttctgggcaaacttttcattttgctgtcaaaaggaaatctgatgagttcctacctaaaatttgtgtgactgaatctctaaagtctacctgaatgtatcctatttcaagagttatttctcactgaaataatcaaggctgttaagagtcacaggcaaaagacttaaaggcaaaagtcacttcttccaacttacagattttacaaacacaccccataagtatatataagctttaaatgggagccctgctcagatgcatttcagacgatagtttccagtcttgggcattaaaatattgagagagcatgcagaaaaatgcagaatgtgacaaattacaaaagatacaggtctaatttcttcaacaaataaattacaaggggaaaacggtgggagaagggggaaaaaaacctatagattaaaagagcttaatggacacataaccactgtactgtgggaacttatttgtactctgatccaaataatataactagtgggaattctctggcagaccagtggttaagaattgatgctttcactgccatggcctgagttcaatccctggtcagggaaccaagatttcacaggctgcatgacatgaccaaatatacatatcaaacaatttaactaggaaaaaaaaatcatttctaataccattgaagaaatgtgaacaataacaaggtattttcttatattaaggaaatattttatctgcttattgtttggtatgatacaattatttgttaaatatttttatcttttagaaataaatattgaactatttattgatgtaaagatatgatgtaggatttgcttcaaaatcataggtggagaggactggtgggtagagatgaaataaactgagcataattgatgattcctgaagctggatgataagtatttggaaattcattatataatctctatctactttagtatatgtttgaaattttccataataagaattaaactaaaaaatcatgcatatagaatctaaagatacaattcaaatgagtaggccaaagattataaaatctttatgaaatactataaaacttgtaaaacacattaaaataatccatttgtacaagatgagttagactttacacttttattgacatgggaacaggacatgtatattgcagaaaattaggagggagagacaagccaaaaaataaaaaccccaggtttccatcacctaggcacaccactatgaacactttgctatacattctttcagatcttttacaatgtttatatttatatatacttttggtaaccagactttttcatcaatattctccacctctgctcttcagtaaatttcattttctacagcatccagactatttccaaatttccctaactgatccccaaaatttcctttagagttggtttttccaagacagtattcaagaccgtgcattatatctcactgcttgtccattaagtctctttgaatctaccacaacctctatttttatgacatttatttactgaagaaggcaaaaggacccacgttctgtcaggttatttccttgtggcattagtatattaatttataggaaatagtggataaaaaacattttaatctaattctcaaaa

SEQ ID NO: 41221 - DNA, 1256 bp, Bovine  19866881147036
agcttctccctctttggtcctctctacagtccagcctacagccagcatggttttcagggactctctggcaggccagcgataaatttccttctcctggaagaacattggagcagaagagctgtgtagggcaggctccagcactccggctggcctgtctcctggaaaagacgttggagcccacaacggagggggctaactggctcaagcttcctctcaccgggtcaaaataccctctgcagcatcccatctgaaacacgtcctcagcctttcggaggtttttaagtaaaagacgctacagtctccggcttttaaggggaatgtgccagacattacccacagtttgtggttaaagagaagcatcaagaggacaatgaactcctccccttcccctctccccacccgactccctccagcactgccacctcggcctcctccaggcagcgcttactgcgcaagcgtcacccgcctgggccccagcccctttctctcaagagtgatttctgttgtctggtaggtgttcaagatggcgcacgtcaaaatgcgtctgcacaaagctctcctctgagcttgggaaatagatttccttagatttgcaattctcttttgagtgatacacaattttatagccagtgaatatgcatataaagatatacatatcctcctttacctgtgatggtaaatctaaagcctacagagaactcttactgatggcaagataggaattcagagttaagctgaaccaaatctcataattaacaaagcaaaccaaactatgagacctgttcatatttccgtggggattctcttctctgttcctttcatccttcgtgattggaagtcctttccatctgaattcatgtctccccgccaaaaaaaatttaacaaaataatccccccaataattaacaaaagcctttcctatttcagttgccaagtgaaccacaaaatgtattttggtccagcttctgagtgctgaccagtgtttctttctccaatgggctctttgaagctggtcctggggccgtgggtcataggccagctcctgaggagcttctccagtcctgaaaagtctctaaggagctggaccgtgaatgtgccctcagctcctctgctgggatataatcccctgggaagggaaaccagcatggccactcagtggtccttaccttctcggttaatgtcttgaaaggccggatcaatggatgggtcttcacattttcatccagcgaaattccgtatttccatccattctgact

SEQ ID NO: 41222 - DNA, 2004 bp, Bovine  19866881153761
tcacaggtgcacaaattacaatcggagggccaaatctggaccattgctgacttttgtaaataaagttttattggaacacagtcactcatttatttgcttattgcttatgagtgattttgcactataatagtgaggtagtagttgtggcagagactgtgtaacccataaagcctagaatagtgtttatccctttgccaaaaaaagttttctaatcttcactccacatttatgatatcgcaggctcttaaaatttagtaatcacagaataaatcaattagtatgcctaagtgaagtaactgattactcctcattaatgcatctgcttgactattattgtaaggttacatataattaccatcaacattttggaagtgaatacatatttcagagagaacatgagatcccaagtattaatactcattcctttagttggtaaaacaatgtttgactaaatcttacattactaattcttttttctgcctaatgaagatatttcattgaaatggaacaaaagcatggtaattaccaagattatatacccgtcttttcagtgtatccctttttaatgtagtttgctttaatcttgtgaaagcttgctaattattatataaaacttgtatctgtaaaatatatgttcttaactcacaaagcataagatttcttttaaattaatatttattaaatgtacacatgatactaattacaatacttgtaaagcagatataaatttaatattcattcattcacttgtttattcctaacaaaactttgagctttgtacaaggaattgtgaatgtctttaggatatggtcacaggaccccccccccccaaaaaaaaaaaaaaaagagggtggggaggaacatttgtgtatcaaaagtaaagcataaaacagtatttcatgaaatatctgtttagaagagacggtctctaagataacactgaagatttgattgtcaaatcagactcacaagaatcagatcatacctcccattagtctttactaacaatgttttaaggacacagatggtcctgaggctccacaaagcattatgaggaccaggactgccctgtccactccccaggtcctctctggctgcaaaaggatcccctggttggccttacagttaccacatccctaagcaatgcctgtgatgtgttaggacagcatttccattgggaagcatttccattttgtgctctgatggtgacaaaacttatatgacatattttccaaggtattatccttcataaatccaaagattccagatttgttaatgataagtaatccatgctagacagattaggtgggggaaaaaaaaaagtgaaagttagttgctcagctgtgtctgactctttgtgaccctacggactgcacctgccaggctcctctgtccatgggattttccaggcaagaatattggagtgggtagccatttccttctccaggggatcttcctgatccagagattgaacccaggtctcctgcattgcagcagattctttaccttctgagccaccaaggaagcccagatgaatcaggtacatcttgccaaaaggattccataggtaaagactctccagctaataaacataagttgatttttttttttttttttttttgatcaagagctctaacactagttgttcacaagaagacttgaccaggttaattgacctctttctcttctagagcatttccataccccagtctatctaaccccaaaaagggagaaaacgaatcggaggcttgctgctaaccacttcctcgtctctctccctagtcatgttgccctccctccttgccacccctgctcacatacaaacatttgtgctgtggaagatggaggcaggacagtaaagccatgtcaattatagcatgtgccctgagtttttcttttgttcttttttcttaacatttatggaaatttgtggatatgcttaaattttgagtatgattcttatacatatattttcagaataggaagtcaagtatccagatgaat

SEQ ID NO: 41223 - DNA, 1107 bp, Bovine  19866881154121
cctccaagtgggaaaatccattctggaccacccccatggtgatcacagtgcagaaggtggccagagtctggcccctctaatactaggacagaaaagacacgtcatgcatttgacctgtacctttacttgcatggcctgtgtggaaagataagagaaaagaaacaaggagaagtcagtcagtgaaagcaggggtccaaagcataagcatgttagtcacagctcttccacccccattccttagccaacacgacagaaaaccaaccactctggaagccagttgaccatggcatgaagcgggggtgggaagttaggatggaggttaattggattgaaaggacttacacccagaccatgcagtacatcatctcagagaccagcattccagagtgtgtgacactctgcacacattccagagtgtgcagacccagatggtcttcagatctggccacccaagtgactttagatttcacaccttctctcctcccctctccatcctgtcacctgggtgggctgcaaacaatctgtcacataaccaaagaccctgattttctttctttcttccacccactacattatcaccaccagaagatctgtggttacaaaaagagtgaggagaactgagctaaggggctatgtatgtgcttcccctaaataaaggtttgctacaaaccatactctaggaatatccaaggtggttcaggatcatctcatgacccaaaagatggggcatctcccttcctgtgctgtgaccttcaaatataccttaggtcaaaggctcctcctacatgctataagttctaattttattcttttcctcacatattgctaagattagttaactcagtgcatttccctaatgcttgaatgctctctctctcgtgcatgctctctcaatatattttaatctatttttaaatgttagctgaaacttttcattttacaaacaaatctagaaattcctatacattaaaaatcacttcattttggcacacttaaccactaatagtttatgatcaaatagccaatttatgtgtgaaattaaggaaaaaccagagactcttaagggaaagggagttggaggagtggagggaggctgtaaaactaggg

SEQ ID NO: 41224 - DNA, 1717 bp, Bovine  19866881223287
ctctctgatgttaccttttagtgatttttctaagagaagaatacaatttggttgactgctcccttggaaagacagacttgtaatcaaatcagctccaggcgggggactagtgctggggagacagactcactgtggtgctgacggcctggtaatcagtacagagtatctcaaagcggtgaccattcgcaaaacaagtccagtcatgcagttgcttagagggttcttcacaaacgcatagtggagaggggttcaaaggcaaggtacaggcaaaaaggaaaggaaatggcaggacaaggagcatcagaagcaggataataactttgggaagggtacttgaaagagcaaacagcctcaagaggtccacaaacgtctgcagcctcaagagactggagctgcagaaagaccatgaaaactgaagtctgcttcctagagctggacacaaggccaaaccactttggcagtaacaaaattgagtctgaacagaaactggctatgcaatattaaatatgttctttggaacacctgttctgcaagatgtcgctagattgaaaataaagagagggaagaagaaaaaaaggtttccttggccacagaagtttggtaactgttggataaaacaaatatttctttactgtagtataccacttctcaaagtctttaaaatactaacattaactgtgactcttaaagaaagacagggaattctctggtggtccaatggttaggactctacactttcactgccaatggcccaggttcaactcctggtaggggaactaacatcctgcaagccttgaggagtgatagatagatagacagatagacagacagatagatagatacaggtgtgcaagcatgctcagtcacttcagtcatgtctgactctctgtgaccctgtggactgtagcccaccaggctcatctgtccatgggattctccaggcaataatcctggagtgggttgccatgccctcctccaggggatcttcctgtcccagggatcaaacccatgtctcccgtgtctcctgcattgcaggcagattctttacctactgagctacctgtgcagcccaaagttacctcaactctgaatccttcaaagaggagaacacaaatattctacagcgttattctcatctacaaagggtagcaggactagtcccagtcctgggaaatggagcgtggctccagttgcaggctgggtggacaggattgtggaaatggggcagggagaaagtgcagtgtggtagcgtcgcatgatctcagccaaggctggataaaagcaacagaacctgaacatctgtcagaggtatcagagaattaaacacaaaaacctgaaagatttagccatattttttcctttgcctgtcctttgccttttataaaaataaaaatatggcccttcatggaatagcatgttataaaatatatgttaaataagtcaaaatataaatttaaaaagtctgagagagtctaaatcaaactgtccatgaaaattgttatcacttttttgcatggtaggatttattaccttttttacttatttgtattttccattttgtacaataaatgtcttttttaaaaaaataattgtttaaaagtaactttactgggacttccctgatggtccagtggttaagaatctgtcttgcaacgtacggattgtaggttcgatcccgggtcagggcactgtgatcccacatgccacaaagcaacta

SEQ ID NO: 41225 - DNA, 1720 bp, Bovine  19866881228318
tactgaagaaaaagttgttttggtttttgacactttctgttaccccaacagctttcaagatgctagaaagttcaagccagaagtttcttcagggtttggtgtatctcattgggaaccttatgggtttggcattggctgtttataagtgccagtcaatgggactgttgcctacacatgcatcagactggttagccttcattgaaccccctgaggtaaggcaaaaggaaagttaaatttggagcagctctaatgtacagtaaatagctgacccatttgatggtgggggatcacagttggtattagagctcatttcttaaataagatccattaggaatttgagagttgttattcttaaaagataaagtaaaatagagcttgtgattaaagtagtaagtactcaatttaggaagttatttcaacactcaccattaacctatttactttttcgtttctcagaggatggagttcagtggaggaggactgcttttgtgaacttaagaaagaagcacctggtacctatatatctggattctttatgcccagtggctccttctcagcttattaacccttaacattatctcctgctgaaaagaaccaaaagctcttttttccatggtgaaagacaatgtatgtatcactacaaacacacaaaaactataccacaactcttgactgaaaataaggtagaaaactttatttatgtttccagtatagagcaaaacaacaaataaaaccatgactatgtaaacaaaagaatgggttgttgttaaatcaagaaccacagcagcatctccttttaataaattaaatggttgagaacaatactaaaaaaaaagttgcacaagtttttcttaaatctattcttcttaatatttcacttctatttaacacaagctgggacataaaaattccgttggagatacttgtggaagatgtgaattcagatcgtacatgatgaaaagaaaaataaaccagaccaaaaaagcgcataaaatgcttacagtgtaataactactttaatatccacaaaaatggatttttaacacgtttgggggagtaaggattggcaggattgctggggcaacaggaatcggaggcaacggaagatataaagtggtgatcttccccgccgagaggaattgggaacctgtcaaacagatgctgcgattcaaacttcagttttaagatagctatgcaacacagagggccagcaattagaaaatgaatattgtcataacctgccctggtaaagtcacagctaagacttaaaagctggatctcattcaaaaagcaggaagatgtctttcctttttctttctgcttaaaacacatagccccctcccctaagatgcattctcttgtcaagttttcagtattgctttatttgcagtgattaagagacaagacgctttgcagacaacataagtgacttgtagacatgaaatgctctagacagagatgagtttaaatctggcccaagaaccgcttccccatgtaacagtgattgttttaggggcgcagtaggggctatattagcagccactaattccattatccctttaaaggattcttacagagctccagccacaaaaggctcttataaaaactaaccttattttctgcccacgttttttctatatggaaaagaatacatatacatgtatcactttggccagagggtgtaaatataaaggaattccgggcaagcgactttagagca

SEQ ID NO: 41226 - DNA, 1214 bp, Bovine  19866881245369
tgttcctctgtgaaaggacccaaccctcctccaaaggtggctctggcgactaagtcccagcacgttattttctaggtcacacccattggttcaacagttgacccctgatcaagttctccagtcaaaagtgatcgcaggattcttgccttgaataccagagtagaagaaaccttctcaccattcccttgaacactgttgttcatggatgaggcccagaaatgcagctaccatgttggctgtggaggtgaggagagccaaggaattaattcaacaaagggactgcggccatcatctccagatacaccagtcataaaattcctttatcagctactccatctgaattgggtttttctgttctttttttactgaaagcaccggaaatgataaacatggaagtgaagttcttatgtatgaactataccttttaaattcacttcaggagctgaaagttacaccaacttctaagtaccagaacattaaactgagcactgctttactgagttcttatattcccttctcctaccctgtgagactggaactattattattctctttttacagagaagaaaactaaaacagaaaagtttcagaaattggcttaatatcataagcagtaagtgacagagctgggaatcaaaccttgcctgctggagtctaaacccatctatgttaccatcttagcgctgcttactctcaatagctttgtaaaattcagaaaaatagttatctttattaacgctttaaatttaaattatactgcttagaagcgctcttcataaactccaaaatggattcagaaataaatcctgaagattataaagctttagctctttttctaactgactctgagctgggaagattagtcactttcccaagaggctcagattcttcaccaataaaatgaagtgaacaatataaaattcatgttgaagaaaatgaatgagtgtgtcatctagggacaagagtgctgggtacttggttcctgctccgcctgtgtgaccttggtcaagatgctttacctctctgtggctctgttcacttgtatgaagtcaagtcacttgtggcttaatattctacaattctgtgtctatctgacccactgagttcttgaaagggttgtcctagtttattaaaatggtgaaatgaacacttatgtcttcactgggttaaactgataagcactaagaattttaccactgaattttaatgccaac

SEQ ID NO: 41227 - DNA, 741 bp, Bovine  19866881290071
tcggcggcacctctctgaggtctgcccatgccaatgcccgcacccgagtgggacagggccagagtgcttaccagcaacttggtctgatagatttccagccctttaaagaaattggccatgaaggcttcaggcttctcaaccttctggccacaccgtcgcttcttccttttggtcacgtctgcccacagggcctcggcctgctcttcttctttggctgtgtcctctttctccccatcttccatgctgcaggaatgacaaagcccctcagcacagagggcagagggaggcctgaccctgacagggagactaaagagaaatctgggctgagaggggagggagacatattattccctgagcccgggaatctcaggtcttgatttcctgctttgatgagtcatggtcacaggtgtacatatacaatttagtagctttctgaaatttgccttatcgaatttttccccttcagaaatgttgtcctttattttctaagctttcatgagaattgccaatagtacctatttcaagtctgtgttaggaattaaatgaagtatcgcataaaagaacttagcaaaaggcctggtgtgtagcagttattcagtaattactatcaatagatagcaccatcatcaacattatatgaagttgctaagtgtgagagtttgatcgtttgcttggtcagatggtgaaatcctgatctactatttggactgtgaagtgaacacaattattagaatgtgttta

SEQ ID NO: 41228 - DNA, 775 bp, Bovine  19866881334242
tgagaatatgaccctagccttgaaggaagttggaacttttaccgtgttatcccagctgctcaatatagttgattgaactagaatagtttattgtcctttctaaatcttggtcaacctccagcctgacagttttaggagacctaactcattcagccctgtgattcatctacatgtggtcttctcaccagcacaagccagaaagtccagtttgtagtactgtcagctgtttgaaggctggcccaaatcagatcagctctggagagggaggtatatgagccaaaggagtgagaggtgatttatttagccttggacccacaactaggcaccctaagaatcccactgcaaagagattgctgccctgacattggaaggcccatttgtgagatatgcatgggagaggatgctgtcattagaaagcctgctctgagtacagtgtcttcctgctcctaggtccctttggtcgtattcaaaagagaaaaagaaatcgccaggaagctggagtttgatggcctgtatatcactgaacagccttctgaagatgacatcaaggggcagtgggatcgcttggtaatcaacacgccgtaagttttgcccccaccccaaaaaggaaaaaggagtttctaccataaataaaagaataccttttcagcagccctggagactgattaatataagccttcctttgatttctgggacttgttttctcccctgccttttcacaaaggtagcgtcttgttcccccaacagttgtatgtatgctatgcatttaatggca

SEQ ID NO: 41229 - DNA, 1530 bp, Bovine  19866881415027
ctcactcaagttgatcctgacatcttggtcactgttcccttgagactttgggattttcttctcttcatactttagaatccagcttgaaactcatcttagcgtgaacaagaaaaaatctgccttttgtactcatccatccatccatccatcaaatgttactttgattcataggctctttgcccttgagatgttactgcatgactgatccccaaccgacatgagtaggcatcctcattctggttttatttccacagtatgttcctccagatctctgcgtctgcaactttgtgctggaacagtccctctctgtcagagccctgcaggaaatgcttgccaacacaggtgaaaatggcggtgaaggggtgagtacctgaattatgtcctgggaagggagggattgggacacaccatagcccaagagtacacacttcatttcattcctccagttttgaactagaaaaccttgattttccagtttccttgaatccatcctcatattcctcttattcagcagccctacttcctttgggttaaccagcttccaccagaaaatagactagaccaccttaatgctgcctgagcggggcataggtcattgaacccataatccaccaggatatatggagaggctgaaagagccttgggaaggggagagggagttatctgttaggctgattcttttttcttggaaaagtctcatcagagatttatgactatgccaatgaagcacagccaggttacagccatttggagaggatttcctatagaattcacagtcattgacatgtacccagatcttcatggtttcactaaagatgagcaaatacagagctgtattaagtttctattgccagtaaaattgtttccaagtctttaactaagggataatggcctcccaaaggtctcccaggcaagacattgactagagacttcagaataatttttgaccctttccctaatgactcacctagttatattcatttatcatttcaaatattctaactctatggactgaatatctcacaggcagacaccactctcctacgccccttatatactgtgttagaggactatcctttatcttctgggttattacatcagactcaccactctgattccttctgtgcttacctcatctactattttattttccctaagctgacataatgctcttcacaaaatatagacctaatcatcacactttaccatttaaaaattgtctttctgcccattaccatgaatgaaatcccatattccttaactgggcataaagaacttcaggatttgagtcctgctcaccttgcctgtcctgtttctcaccacatcttcccaaacacccaggtgatccaaccacatggaattattttcagttcctcaaacataacccattctctttgcctcagatcatatgtgtcagttcttccctccatttagaacagctttctcctcctctctctctccccttatatgatctttacttctctttcaaggaacaagtctaaatattaggtcaacggagaagcctataag

SEQ ID NO: 41230 - DNA, 831 bp, Bovine  19866881640000
tcttcaccaaaagaatgctcagaagggaaaagcagaaaacttcccacacaaattctttgctcaaaatgatttagttttgtcccatagttccagcatgttccagcatgtctataatccagtctgttctgttgcaactgaattttggaaagttcacaaatattaaggcctaattattatttccttaaggtttactaaattagtaacattgcaagctaatgactcaattttgttctaatatcattgttcatattcttaatacccatagattgtgtcctgttatataacggttaatgtaggaacactcacagggactaattgtggttctaattctctattattgttgtttagtactttacaatgggaaagtgggaggcttcatatgatttctgtaattaattttaaaacagcattttaaagaatttgtttatgttgggaaggggggaagaaacttaatatctgttacttggagagccttttcttttccagttttaccattagctgctcataatcacagttattcagccaacactgagactctgctgcaaggcttccccccactagaatattccagttaaaggaagtgagacctagtggagagtattgctgtgagagctttgctaggtcataacgttcccacatatccctccacacacaaaggccctaacaagccaaattccaaaacaaaattggactctaaccactgctttccagcttggtcttcatcatcttgttccaacccaccctcatctctcactgggactagattaatgtcaggtgcctcctaattggccccagacctgtctacagaaacgggaaaagaagcctgtgttt

SEQ ID NO: 41231 - DNA, 954 bp, Bovine  19866881665465
aatggcagcctgggccaacgcactggcaggaaagtgagggcaaggcagacgataggtctgagaggttgaacacatgtgaacaggtacagagtgaaggggatgttgaagaaggctcccacgtttctggcttggaaagtgagtataagctgatgctgttcatggagatacaggaaacccaagaacaagagccatttagagaagtgcaatgctgggttctctttctgacctgttgagaggtacctgtagacatccaagcagagctcaaataggtgtggaagttatggatctggactgcagatactgatttggtattcatttacttatggaccagggcctagattacatacccctgggaatagtgtgccctgagaagggacacaagcttgaaaaactccacattaacaagtgggaagaagcagagactgagaaagagcagccagaagtccctgggggatgaggttatgaaaaacagactctgacttatctctgtacccacagtgcctgggacagagtctacaacctactgtcgtagacactcaaccaatgtttgttgaatgatttttgaaattcgtcaacttctatgattctaggaaacatgttttgctatagttttgctctgggttttgcgggcaaagggagcaaaccaaatcagttccctccatgccatggccagtaggtccatttatcacaagcattcagccttgacacctgtccttgcctgtgattgtgacacattgacctgaaaagcattgttctcgggtcttttgaagcatcctttctgtctgtagagggcctgaaacacaagcaagtaagtggaggggacagccactaaaacaggaagaaataaaggagcagggttcacaactcagggggcagagagcctgacagccttaaaagatcaattagatatttttgggggggaaattttccaagctctgtcacatttccattatt

SEQ ID NO: 41232 - DNA, 627 bp, Bovine  19866881790642
tctagaggtcgtaagtttaaaatgaattagtagcattacagttctggggagaatccatttcttgcctttcccaactttgaaaggctgcctgtatttttaactagtggccccccagcagaggtgccagtccaccctctgcttctgtcatcacaggtccttctctgactctcaaccctcctgcctccctcttataaggacctttgtgattacattgagcccacccagataacccaggatagtcttcccatctcaagatccttaatgtaatcacatctacaaagcatctttgacatatcaggcaacatggtcacaggttctaagaattcagagctgaacatcttggcggtggggtggaggggccttattcggcctacctcagggaggaagaaagcagaggttgaaatacacttgttcttcctacttgaaattgatctaccacctgttatgcctccagagcatttacggcataccacaagctgacttttaatcacctagaatttaaaaataagtctacgtaattaagaggtacataattatttttcttttcccattgtaagtgtgagcgttataaattgctttctaagtttaagtacagtgcagttttgttcgctccttctccacaatgta

SEQ ID NO: 41233 - DNA, 1356 bp, Bovine  19866881913407
cgggatgctttgaagagtatatttttcctcctgggaataattggtctgtgtgtgtctgttcactgctgcacagcagttggactttttaaaaatgatatttgtttatttatatgatgagcatacagaagtctttctgcagggattggtggttctgcagcaattcctttcagtaacaaagaaaacagaggtgtccaccttggtttaacaacagagggtttattattgaaacatccttagctatagccagtagcaactgagagtcagctttatgttgaaaaggaaactgaatgatgacaaggccccaggggggcagaggatgtcagtgcccctcagagcccaccctcgctaagctcatccttgggtcactttacctctggttaaatcctatctgatgttattctgggaaatattaccaagagatggatgcttggcgctgtagccaattaaatagctggactttgatgtaaaatccctgcatacaaatataatatatttttacattaatggaacctacagtgtatgaggtccccagccaccttcagcaggacagggaactaaaaaggatgtcacatctccctctgagtcctcagtcttcatcatcctataacaatgactgaacacaaaactagcaacatgtgcagtgagagaagctccatttttggagtcaggttaatatgttttcagtccaggctatacaggagcaagtgacttctaggacaaattgcttcccctttccgtacctgactttccacaccttcaaaatgcaacctccctcctaggatcaggtgagaattacataagtgttgacaagtgcctatgggtgtggaaatgaatattggttcctcttttcatctctggtctgctttctcctgtcacagatccttcagacatactcaaatgcctcaaaggaaggagattcccatgctatatgaccataccgtataactacaaatgaattttgacatgaatgaatataatgcttctaaaaatgaaagaccttggttaacacagttaccagctgcactcctgataagggctcaggttttctctaaaagttgacttaatcactgtcagacttttactacttaaaaaagggagatgcaatatatgtaaaaagaatgaatgttacggttgtataagatcatgcttgacttcagattctaaaatctctagaatgcaaatacacaatcagccttttaaacttgattgggggatgtgacctggagagatactgtttctgtaagaacctctctcacagataaactcactgtgaaggggtcttttaattccccgtattacttatgagggaaatcaacactgaatattcattgggaaggactgaggctgaagctgaag

SEQ ID NO: 41234 - DNA, 1908 bp, Bovine  19866880718880
tgtgctccttaatgggtatattggtaccatctccagaaagctactacctcctccaggccagtggtggcctccggggggctccttgaccaccaggttccatagctggctggctttcaccccatagagtatacgatcaggtttgctttgttctaaattttgtttgtttcccaccacaaaaaggtaactgtttatagcacagtgattaaagatactacgacttctttacaaacagatgtaagaacaggaactttccactttaaaaaaactctataaatagttccactctccactattactattatcctctgaatttcctgtatcaaaggcaggtctttccccgcacactgcctttgactcttcaaacaaatttccatcatttcttcatcactcctggcccaggtgctcctgaaaagtctctaagtacaagccataagaggacagactttcagcctgtaattaaaaccagaactagagacacctctccatgaggcccgctcccccatccccaagatccctttcctatacagctgggccaccaccatcccacagcgcctcctactctggtgacccctgcagggctcccgagcctagaccctgttcctcgatgagaaggtacttgtccacaaaggagaaggcacggggcatccatgctgctcagcatcacatgatcagagggtcatgaagaaaccagtggagccttccacatcccacatcggcctctgcctgtgcgcgtccccctctgaatgttcagaggaaaccaaagacagccggtccatccctaagaggagattaggaagagatggaggtggagattgcctgcggttcagttgacaggacctgggtaaatagatagggcatttcagcccaaacattcatttggtctcactcagttaacaacagctctggtctttgcagtttatctagttattctgactgctgttgttgctgttcagttgctcagtcgtgtccgactctttgtgaccccatggactgcagcatgccaggcttccctgttcttcaccatctccctaagttggcacaaacccatgtccattgagtcgagtcaatgatgccatgcaaccattccattctctgtcaacccctcctccttctgcccacaatcagaatacctgaactgtattctgactatagcccagctcaaaatgccttttgcttttccatggacaattccagaaagctcgaagttacaggcagtgtggtttgaatgtgctcatcacacccggctgtctagctttgaaccaaacgggctcatcttggcttagtcaaaggagccataaacagagacagaaatgcagttgaaaattatatttagcattacatatgcttcagtcaaaagcagccttagaaaaagcagtgccaggagtcttgtttaatccccctaaatgtgattgaatctcaaattgttaaagctggaaggaactgctcatcttctagaggaaggaatggggcctgaacagatgacctgggcaggtgaaatgctcttgagctccctgtctgcagcagagccagaactaggacagaccagtctgaagctcagggccaccctcaccaggatcttgaggttcaggctcttcacaggctttatctcctttgatcatatgcacatgtattgtattgatgtctacacaacggtctcttatgtgaaaatggaagcttcctgaactgacttttgattcctcgatgaggaagtgcttgtccagagaagaggatgcatggagcatcacaggctcagcatcacaggaccagaggttcatgaagaaaccagtgcagtctcccaagtttgatgccattcagagaacgtggaaatgccaggactcccatctctgtgtacacagaagtgactgcttttttttttttttctccttggtgacacaggctctgggattt

SEQ ID NO: 41235 - DNA, 2416 bp, Bovine  19866880749860
ctgcccagccttggattcagtcactacttcaaggaacccttttaagggagaattgcacttagtaaacaagatctgggtgctaggtattttaaacagacacacaagcacacacacactgtgatgttaattctatgtgttaatgtgatggagtgcccaatcacttggtcacacattattctggacgtgtctgttagggtgttgggtgtttcgggtgagactgcccttcgaaatagtggcctgaggaaaggaggttgccctttccagtgtaggggcctcatccaatcagctgaagacctaaacagaacaaccctgactttcccacaaacaagggggaactcttcctgccggactgcctttgaaccaggacatccacgtttcttgcctctggactcaaacctaaacctcagctcttcccatatcttgagcctgtggcctccagatgggaaccacaccagcagcaatctggggtccagctgaccaagtgctggtcctcagacctgaagcctctgtgatcacttgagccaaattcaaataataaactgtaaagaggtacacatgagcacgcacacacacacacgcagacatcttattgctcctgtttcttggagaactctaatacacacacttatatctgcatctatttctatgttatccaaatacgttgaaaaacaggacttcataccaatatctcccatttcaacgccacaggattcattctagttttctctccctccatgtgtgttcccctttctctgaccttaagaaacctggtgcccatcaccttgacatattctcctcttggatgagactgtgtgatcagcaagcatcactgctgcccccttccccccatctccccgcatcggtggcttcctctccctgcccgggctcagacgtcacttgcagagctgtcatcactgccgtcctcactccagtcatccccctgcccactcaggcgctgcatctaactggacagtgaattatgtaggttccaccaccaccatgtggatgctgcctaccttgggtggcatgacctcctacacaatattttctacaatatagaaaatcccctagaaatagttttggcatatttagatgtaaaaaattctaattcatctgaaatagaacaatacctgtatgaatatggaatcacacaccctcctctttatactcctttcaaggcttcagaggtagttatcgctgttcagtcactcagtcatgtgcgggtctgcgatctcatggactgcagcatgccaggcttccctgtccttcattatctcccagactttactcaaactcatgttcattgagtcggtgatgccatccaaccatctcatcctctgttgctcccttctcatcttgtcctcaatctttcccagtatcagggtcttttcaaatgagtcagttcttcgcatcaggtggccaaagtattggagcttcagcttcagcatctgtcctttcaatgaatactcaggctttatttcctttagaattgacgtggtttgatttctttgcagtccaagggactctcaagattcttctccaacaccacagtttgtaaacatcaaattctttggtgctcaggcttctttatggtccaactctcacatctgtacatgactactggagaaaccatagctttgactatacagacttttgttgccaaagtgatgtctctgctttttaatattctgtctaggtttgtcatagcttatctttcaaggcacaagtgtcttttaattgcaaggctataatcaccatctgcagtgattttggagcacacaaaatattaagtctgtcactgtttccattttttcccccatctatttgccatgaagtgatgggactagatgtggctggtgatagcatcatccccatagcctcaaaacataccaagaggaccccatactatattttgaaaagtggtgttctaaacctcactcataaaagatgagtacttagatttaaaattcatgtcagctgtgctactatacttagcaaaatggtaggatagaagtttaattttaacaaatttctcaacacagcttaaatcttgctctgaaatacaaattatttaaaagcaagacctttatttatgtatgttgcttttcaaattctcagcttaaaatattcacaattttagtcctgaaggcatatatatatataatgataaataccctcatttctggtatagttcttgtgacacttttttttttttttaaagagaagaatgtttctatagagaaatactggcaaaatctttttaatcatcctgaatgtttgctctttcatgtagaaaacaatgaacactctcttttattgggcaccgaaatgctgacatatgaaatgtagttatctattgcttttcatgaggcaacatgaggtggctgatacatgcttctcaagattaaagaagaaa

SEQ ID NO: 41236 - DNA, 810 bp, Bovine  19866880792502
caccataatgcaggtggtgatcgtccaaaccctattcccaactcaaatccatcattttaactttcttccaaacagaacctcacacctgtatttatataagtgattcctaggtggtctttcagagtccagcccatgccaaatagcttaaatccactcacagctgctgaaaataaagtttttaaagcatcatcatggtggcgctagtgataaagaacccatcagcccatgcaggaggcgtaagagacctgggtttgatccctgggttgggaagatcccctgaaggaagaaatggcaacccactctctagtattcttgcctggggactctcatggacagaggaccctggggggctacagtccatagagtcacaaagagttggacacgactgcagtgacttagcacacacacaaacgtcattttaaaggatataagaaaactgaagtctagcttttttacttgtcagataatgcccagtgaggttaaatcagttgaacaaggtgacgtgcctagctcttatgtctcaggttgcattcaaagcttcctatcaagtaggctctgagcccatcttccctccatgtaaataaaccttttccttcttttcttcttcccttccttcttttctttccctctggaaggctttcctttcttacaggatcctgtcttagagagtgatgagcgcatttaaccctgaatttgactgtgacacgtgctaccacagggaaatacaggaccttgagagaacaagcaagcaaagggaaccctgaaggaagtagagtggaatcattggaaggaaatgccaggggacatctg

SEQ ID NO: 41237 - DNA, 1279 bp, Bovine  19866880814359
actctttgtcctatagacagccgaagccctcataggttttaagtgaattcgatgatattgggccttgttcctgccatttgttctgccaaatcagaattaatattctgattgcagctaatatccatctcacccagtttccagtgattgttacctgttgctgggtttgtatccaaaagctaataagtggaaaggacttgcccctgctttgtcatctcctaatcttccccgctttactgcctggtcagtaccatgaccagccttttccctgaaacactggttagcattttccttcttattagaatattaacttttagtcatattaattcccaagtttcatgaattattttgttagtgctttttaactatgagttgttatttccaaagaagtaggtataatattaaatcaggagttaaatagtaagtttcatgcctgatactggatagagtataggttacagatctttttcaaattaaggtttttgaactataatttagagtatcttaattatgcacacagacgactgtaattccatgcttaatagttctattcctaccttcaaataatcaaggtggtccttctgagaaaaacaaaagattcatctttttagctttctaggcctcttatttcgtattctaataaaactcacttcatatatatttttctgttttctgcgtgtctccattgccacgttccagacatcttgttaggcactataaaacattaccgcctaagatgcccttattagagacctgttctcactgggatatttacaggtaagagtcctaacagtgagtctcagttataaactaatccctaatccccagcctactaaaaatagcaaatgtacagtccaataaaacactagcatttcctcttaaaattaattatacacagagaaacactaatgatttctaaaaataactttaagggagggaagggggaggataacctgggagactgggactgacaaataaaacactatatatacacagtactgtatttaaaaatagacaactaataaggacctactgtgtagcacagagagctctactcaatactgtcaatactcaatacctatatgggaaaagaatctaataaagagtaaatacacatatatatatactgattcacttttgctgtacagcagagacaactcaacagtgtagaaaaactaataaaaatcaattgaaagtaaaaataagatcattttaattataaaatttatgctagactacttctctaaatgaaatctacatactcaaatgtcagatttctagt

SEQ ID NO: 41238 - DNA, 1279 bp, Bovine  19866880818714
acgttttattaaaaaaaaaaaaaaggatgataaaaaagaaaggaaaaaagaaaagaaacaaaaggttatttaataatgtatgttagttccacataggccagcttgtatgttgcatgtacttgtacagtttgcttgttaattactctactgaaataaccaagaaatctaagccatccatttttgttatagacattttgcaagttttagccagactccatctgtgagtctgaggtgaaatgtctgtagatggactttattttttaccctctggaaaatgtgatgtagtatggaccaaattccttctaataaatattttggtgtagattcctcctgtggggctgtaacacatgtagacactgtgtacacataggttttaatccatagacatactgcctgcaccaagtgaattatttattatttacacacgccagaatgacctgcccattgttcccagggcacagattgaccacgggtcaccatgctgagcaggaaggactgaagcattggtgtacttctgctagatactgttctgtcttagtggccaacgatcaactgattctaattgggtagtatctttctatttgaccacttgtcttaacacttccctgtgcttttaaatgaacttccaactcatgtatgtaaacatgtttaataaaatttacttttcatgtcagtctacagccatctgtgttctgtgttgtgccagacactcattgtgggttccactgggcaagaggggagctggattgcgggaagggaggtgggatttgtcatctgctgggggcacttgacttgtcactgcacggtgtgtgtcttcatctccagcccaaagggtactttgcatcacatacaattttttactctgtcagcctgtctaagtgagcacatgagtttacttctgaaaagtggcattactggaaacaataaatctcagtaagaatcaaatggaagattgtttttctgctgctctttaagtatgctgttgtccaactgcctaatcatttcaagcgtgtgatatgtcaaaatatcaattcctgcacctgttaccaaagcatctggttcctccttccattggttccttctggtcccctgactgattcatagaaacttgccttagggttgatcaacttaaaccaaacaatatgttatatcatctccaacagaatctttgagaataaatatatcttcaaagataatagctgagtctccaaaagtagtatgttaaataaaatttgttggctttattacttcaactttatgacattttcttttcttcccc

SEQ ID NO: 41239 - DNA, 2749 bp, Bovine  19866880819292
tcaatggaatttaaaacttccctccaagtcatcatcattaatataaggatcagttcctaggaaccaaatgctttgaaaatttttagtttgctggagaatatttaacatgacaagaaatgtaggtcacatataattacccctgaaaaaacaggtcacacattcacaagaaactcattgcaaaaatttatctgcagttacaactttgagcataagcaaaattaactttagcttttccaatcattgtctttttctcataaaaaagtgctttaattttttttcttattcatgtggatattttaaaagactagggtaaaaatagccttcaaggtagaatcctgaaaaaaaaaaaaaatccttattaattaaaaaaaaaaaaaaacccgcaaacttattcagtgttattgtacaggtatagacttaaaattagttcagacctgtgctatttagacacccgaggagagaatttccagagcgtttatagatctagagcttgtgaacatgcttttttgttttattcttctattattagttaagcagaataataacttttaacctcattaaacaagagatgccgggatgaaattccttaaccattacagtccatataggcctgaaaaatgaaattcaccttccccagaacatggcataaggaagtatcccatgctccaaaggatagtctgagtttcctctcaaaattatttctgaaccggtggacttcactgtttgaaagaagcccctctcctatacatacagactcttcctttttaagaacacagagaggggttgattccaactgcacagatccaataagcatcaaacctggtgtctgcggtatcagtgactggtagctgcttgttatttaggttcagaattcagcttattctcttgagaagtgctgactggtgacatccagtagctgtggaaactgcagaaactatatacatactatcatttccccaacttattcatcttggaaatgttggcctgccagcagacaccacatttcactctgacaatgattattaacaatcattttggctttgtttttgcctcatattcaaacaaaagatatattgatgaaataaaaataactaccaataccagctatgtaatgcaatccctggtggcgttagtggtaaagaacccacctgccagtgcaggagacataagggatgcagatttgatccctgggttaagaagataccttggagaagggcatgacaacccacttcaatatccttgcctggagaatctcatgcacagagaaacctggtgggtcacagtctatagggttgcaaagacttagacatgactaaggtgacttagcacaacataccagctatattatgcaatccatttatgtgaatgaatgtggctttgtagtttgtaccctgaatcattttagcaaacctggctgaggtcttgcctctctctttcaaggcaacctaagggcatgggagagtgggtcagaggaagcacccactttttcacagcaaagtacaggatttggggttctgaaccattttggggttatggacttcattgtcaatctacagatccctcctcacactgatactttcaagcatagatcataaaataggtataatgatcaaggaaatcaattatgttgaaaaagttatccaggtattaaaagaacacatttaaaatgtagtaatacatatgatcattctaacttcttggacacataaaaggagaacactttttaaaaatatacaataaaatataatatgctgatgcttattttatgcctcaaagccacccttagaaggcgacattcacagactcaaaagttaacagatgaggaggccaggagccaggggaaaagtgatttacagagggaaaggcagaacctccccagtccaccagcaggtagacctttggttctgcagggaaaccaggggaagctgtttcctttggaaagcaatttgacctggaccccagagttaactcaccttttgtgaaatctaatatggccttttcaacagtgagaagcaatctgatgctcaacattaaaaaatgttttttccatgtgaaaaaaaaatgaaataagtgtgctatttggttctagatatcaaaatccatcatttggtatgagaagtatttttatctctactgaatttttggcttgtcttctgaattcatctcaatggaaaattcaagttgcattcagtgtttttctctcaacgcatctcagttttaaccttcaaatacttgttcattgagataagcgtttagctctgacaagcatatgatttgcattttatttgtatgaagagccaatactgattccacccaacaagaaacgtgtagagtgacaagagctgagacacaaaggatgaaatttccagtttaaatcttgcaggtgctaaaaaacaaaaccaaaatcacaatggaatggatgacaaaaatacaaatgctgctcaaggaaggagcaaagattttaagagacactgctaagtcttttacagatggagctctaaatattcttctgaaagcccccagaagatgtttctcacattgattttgccctctcagtgtttgcaaaacaataaatagtgtctaatgttacttgaaggaccagggaaaaacaaaatcatgtttagatcacaccctggtcatgagggttcttcctgctttgtccacggacccatctccaagagccagtacaatgctggagttcaacatggatttgttcaatgcatgttggtgagttttttaagaggaggaa

SEQ ID NO: 41240 - DNA, 874 bp, Bovine  19866880845605
acaaaggagcctagtgtgctgctgtctgtggggtcgtacagagtcggacacgactgaagtgacttagcagcagcagcagcaatcacaagtagatacaactggacttaaaaaaaaaaatgtgaatttatcttcaaagcatctcgtaggcctaggttccaatcagatttccactccaaagctattatacttccagcaagttgctggctattgcaaatcactacaaataattatttaatcatgttataaaaacaatctgtataacaaaaccccaaccaagccccctgccctagatgctagagggaaacccatgcctagagggaaaatggcaaatggaaatgtacttgaattcatgcctggaaaccccctccctgcacgtccttgaactcccgcaatgagaactgttttaggttctctctggactctgtgcagaaattctggttgtgggagtaaaagcatgagcatccctgtgtgctaaattcacatagcgaaaattaaattccaagccttccctagaagaactttgcaacaacctgacccagcgttacccctggtatttgcttcagaaaatcgtttgaaatataactgttgtctttggtttcaagtttataatcagagcggtttgaaatctattggcactgaacataaaagccaaggatgaaaatgggaacatatgaacactgaatataggtagcgatgaatcacagtgtgtcagctttcaagtattacaattatccacctaaaaataccctaaggcaccctgtgcccttccctactgtttaccctgcttgctgcctgaaaaacctcgagagctgctacatgttggcttttaggtgataatggtagaactcttatatatatatatatatatatatat

SEQ ID NO: 41241 - DNA, 1655 bp, Bovine  19866880859434
ttgaaaaacagatttgcaacccctgcctctgtaaaacaggggagtgagttcatttgggaacctctacagagcctggagtaagtgtaatgggaatcttacctgacaccacaagagttggttttggtgtcagattgttctgtcagttcactgacttattaatcttctgatcaagtcaaaactgtcaggcaagtcctcaaaaggcaccagcttataattattgttcagtctgtcccttcagtaacaagtttataatataaaagaactgtaatgaatattctcattctttttgcacattccaccatgcacacactccatggtaccagaagttgggttatcttgccctcctagcttgcacaaaatttaatctgtatatctctgtggtcctgccccttgctcactagacaatagttgctaaagaaggttttgaattgataagtaaataagcttccctgtttgtttttaacatggtttatataaacaggtacccctcatggactaggaaaatatagtatgtattccatcacatcaaaaaatcatgatgaagtgtctcagggtacctgaatacttttaattattaagtctccttggtcttagttttattcacttcacctccttccctgtctggctcagttttacagaccagtttgctctcagctcttcgtgtgtgaaggagaggagctcaagtttactgcactctctgtttctgcaggtgattgtctggggggactacggcagaatggaccacaaatgcttcatgggggtggctcagatcttgttggaggaactcgatctttccagcatggtcatcggctggtacaagctgttcccaccatcatcactggtcgaccccacgctcacccctctgacccgccgggcttcccagtcatctctggaaagttccactgggcccccctgcatccggtcctaatgaactcacaccactaagactctaccttcaggataataatctgaaccagatatttcatgagcattgttggagacagacaatcaacctgtgttttgcctgtagtcgtttttcaataatatgtcccaatcgttgtttaaaacctggcttcacatgacagaacaaggcagtctatcaaatacaggaagaatcaacgtgctagagaatcactgatgcttctaacaaatgagagaaaggaaactgcaaattcacacacatgcgcgcacatgcacacaccaaactgaacaaactggaaactgtcactcttgtgaaaagctgtatttcatgtgttttttgcacaaaccacaaggagtgttatttccctggtgtttaagttttgtttgtgtgttgtttgttgatttcagttgatttcagatttgttttgatttaattcggttttcactgcatttgttgtttctactcgttttcagctgtgtcatgacagggctcgtgatgtttacagagacccttcctttctttttccaaaagcaccaaaaaaaaagggctgaagcagtctctgtagcatctctgcagagtgtgcaccatgagacaaagtgaggccaatgagggcctcactaacttttgcgttatgattcttcaagttctaatgagaaatccagaaaatgaaagtgatcttctgaaaacaaataatcacagaatcactgttttgaatggagctcatgtctgtttg

SEQ ID NO: 41242 - DNA, 815 bp, Bovine  19866880863892
gaagtgccgctgtcatcaaaacagatctctgcagtgtacagattctcattgattaccgcattaccgatccaaagtgctctgtgctatgctacagagaaccctgctgtagcaagcactgaggccctggcaagtctgattaaccgtttcctgaaccaatgcacagaagatgctaccctcctgtaggcagagacctgaaacgctgtggtcccttaaagccagcactggagagaagtcccaggcagaggcttgaaaagcccctcctctcatccctcttctgacatttcagagagacattcatggactcagatgacaaacgcaagcagacccctgccagtcagtagaccccagaacactcactttagatgatctgatcccattctcaatctcgggctgtggtcctgccaagctctgtaaaccccatcacttcctctgcagtctccctacctgggactttactcagcccagggacgactggcaggaggagacgtcagccaggagctcatgagtgaccagtaacaggacacagagcttcctccagctgtgctggacggacgcccagcctgccgctcacagggctcatctccagggggcaaaaggacaacccaaattggtgtatctgagagctcgggagatgggggtgggctctcagcttcgatatttttaaagatgcaggcctctgatgactgtgggatcacacttaatggcccactagactttcccccctgagactgaatcaccctcctcttaccagatttcctacacttcttgacccccctcccccacgaccacgggatgacagaacagcaatgatcaca

SEQ ID NO: 41243 - DNA, 1474 bp, Bovine  19866880885502
actacaatgttcagaaaagggctgcacaggggcatcttaaacaatgtaatttaaatattcaaactgtgaaacacttttcctttatctttgtcagtgcctcctacaagatggagagcaaagtagaacacaaactgctttttattttcatattcttttttgttatgattataggatattgaacatggttccctgtgctctgcattttggaatgaggggagaaggcctgagagggaggaaaaatgaataataatttcaaaacgtcaacatttctataatttttgctggggaaggtacaatgaaggctcagcttcaatcatttttttttttttctaaccaattccctaaaaagtgttggactgcacatgatctcttaaaaagtacttttgttctacaactgaagtgctgctgctgctgctgctgctgctgctgctgctaagtcgcttcagtcgtgtccgactctgtgcgaccccatagacggcagcccaccaggctccccatccctgggattctccaggcaagaacgctagtagaattaatttctgaaatggacatacttatattcacatttccttgaatgtttccgttataagagattaatatatatcgcccaaatatatgtcaggtattaatttttgaactgatatatatctattagcgtttatcctaacttattattacctatatcattttatctactaccactactactaagtcgcttcagtcgtgtccgactctgtgcgaccccatggactgcagcctaccaggcttctctgtccatgggattctccaggcaagaacactggagtgggttgccatttccttctccaatcattttatctagaacatgttaaagaggttagcataaaacttgttcttttagtgaattaattcattgatttttaaaatgatctgtttaactgatagagaatttaaaaatctgaaagccagttgtgaagaccctgaatatcttgtaacgcaaaggagccttatttagaaagcgactcgggtatacgggtttaatgcgcctttttaacatctcgctttttaattagacaaggaagaactatttccaaggatgctgcttctggggtctggtcctcgccttgagtttacacgcgattctccttctccacgtttctttgtgcatcccaggaagaagaccccagggctggctgagcagaatggcaaaggcgctccaaagggcgagcgcaaacgcgcgcccaggaccttcggcgcctcctgcagaggcgcccgcggaagaacgggagcggaaggaaaggcgggaaagccgaaggctggagaaaggccggtcccaggactactccgtcgtgccggagaaacgcgaggaaggcccggtggctgaagcggagaagcagcggaaagaggaggagtaccagacccggtaccgcagcgacccgaacctggcgcggtaccccgtccagccgccgcccgaggagcatcagatgcgcatgca

SEQ ID NO: 41244 - DNA, 694 bp, Bovine  19866880971435
tggagattgattttagaaaggttttattcatcctattactctctgctttcctcttataccaacagccgcctcctcccgctacacacacatttgcaaattataatttctccatgtatacctgtggcggattcattttgatatttggcaaaactaatacaattatgtaaagtttaaaaataaaataaaatttaaacaaaaatttaaaaaaaataaaataaaagatgccagaggaatagagaaagaaacagtaagcactttgcttaatactcagctatttaacacaaagacaaaatctggtttcagtttccttggactagaaagtaattcattgaacaacgtcaataggctacgatgggttttaatgaaattatgaccaactacttgaacataaatggtaggtttaagatatatacattctaatcaaagtgaagaaaataattgaaagctattgtattttataggtcttttaattttgtcattagcctgagaaccacaaaatccacctgaattcttgttacagagtcagtaatcataacaagcacatatagaacagtcaacccggccagttctacggagtggctaaagttttatcaccagttctgcatgacactagcattatttatgtacttaacttttattttttaaaggatttaaaaattatctacacttcaaattcaaagtgtccaaagtaata

SEQ ID NO: 41245 - DNA, 1340 bp, Bovine  19866880975773
acttggacacaactgagtgattgaactgaactaaactgtttcttgagagatcatggctgtcagttataagagtcacgtggcttgtatttgggcagtaagaagatcttattctgtccaaaatgtggtgcagaaaattctccaaaataaaggaatgaatgatgaggacatggaagttctcaaaagagctcaaaatgctcattttattttcttcatgtccctatgatataaacaagcagatgatttttaaaaataaaagttaaaactaaaggcacaacaggggagatttcattaaaatctgccagtgtgccaacaagagagcccaatagtaaatagaatgctatttttcgctcctcatggtccatcttgttgctacatatattttcacttataacttgtaaactttcctgcgaaaggcagtaggttaagaacacaacgagaaacatcttcattctcacggactttttaaaaagctgcctgaactccctactgagggaagctgctgctgcatctccaactggagaagaaatgatgttaacagcaaaaagatgctctaaaatatatagactatgaagggtgatataccacctctggcatcattacagtcaggcctggcactaatgctctcaatacctaggaagatagatttttaaaaaataggcagaaaatggcatcctaaagacaaaatgtattaaaatacctcagtgggactggtgagaacaaaggaccaaaagcatacggggtgggagtgcacagaaggagctagcagccacagaagcacagctttgcaggcagggaacctgcttggaggcctggagggggcaggggcagaaccagttttcactgagaaaagcaaaatgcttgtgtatccagaaacaagatcaccacggatgcccgtggaccccagtgtgaacaggtaacccagggcagatcagcggaatgcaacaaaaataggattgagcagggtaagagtggttagcagatgaagaagctgaaggtcaagaacacaggcaaaaatggaagtcacctagggtgctgtttacccttttatccctgaaagaaggtagctaaatccatgtcagaaatcccatcaaggaaaatgacccgtggagtaattgtcctcgctctcagcacagggaccgcaagcctcaggatgccggtctgtgcgcttccatcctcagggtcacaggtatgctttctagcccctaatgaggcatctgcttttatggtgtctccacagcagtcagcctgcggtgggcagagcatacgcgacttatcacgactcagtgacaagggcagagatgagggaggactcaaaaatagctgggacagtgctgacgggg

SEQ ID NO: 41246 - DNA, 1013 bp, Bovine  19866881005086
tagcttcatgtagtttattggaattttacattggttttgataaatgactttttccttagagcaataccaacattttgtctgaaatatttcccagtgactattcagcacagaaaatacaatagtgaagtaaatcaattacttttggaaggaggcagagttcactttcatataattttacaaaagagatgaaataaacttttttgtattaatgaagagttccattacctgtccctaaaatgattaaaccttgacatgacttttcaatattagcttcattttagaattaaaggaaatagaaaaagaataacatgcttataagccaggtgatacatacaggtaacaagaattctttgcagaaagattcaaacttcttggttataaaaagcaagccagctaaaattcaaagggattgcaaaagccataaaataaaatagccatttaaaatatttaatgaagtgtaagcaaagctcttgtgctttaaatgcctgcccctttcattaatttcttctctaaaacctgagcaattaggctggaatgttaaagtcattacaaaacttaaatagcacttctgggaataaggtgttttgaaggaagtgttattgcataagaactgcaaatatgaaaatatctcatcacaagaaatcaagctgtgttttatatgtgggatgggtgaaaagaaggaaattttatcgtaattatgagcagccacaccctcacagtatgcaggagagaaactagttaatacaggctactgttctaggaatttcagtgtctctttctaatactatatcaaagcagataagggatcaaaatgagtaaatcatttaaacattgctttaaagatcttcgttttgtagttagtactgtactactctacttcagaaaacaagtaaaatcactggctcttctcagaagcttctaatgatgaaatgattttaaaatgtttagggattgaaagaagacggcatttgttgttgttcagaattatgggggaaatagcacatccacagtag

SEQ ID NO: 41247 - DNA, 1337 bp, Bovine  19866881046892
ttggttttataagcctcttcatcgagtcccatatccatacattaaaagaagatttgtctcaatgccacttgtaggatgaacaaatcacttaattttttattgcatatgctttcccacacaacccacaggagctcttttattttcatcttatgctagagaatgagatttcttgagtcttccgtgtgctcttttatttttgaacgattgccatgatctatttgcaagactggaaatctatttaaatagcgtagagctatcaacctgataactaacgaaaaatgcatttagttctgctttttaacataaatctctctgatctagatttccactcctaagaaggtcatggggccacttacttagggttggggagggttgaagaataaattatggctgcctataaattgagcgagtgaggcagcaaatgacgaggcagggagatgtggagtcacatagaccttgaagaggccacttggggatgatcttgctgccaaatcatcagtatttatgacatcttctttgaggttgtaaaatgttggccctgggtattatacggcggtaatattgcatgggtcacctatcttgcttctgaatttttgctcaaaatattccctatacctagatgtgtctctccctgctccttcagtaagttttatttatgtataaacttgatttcaaactctaaccttggcttttcaagaatcctgcctgagttgacgtaaaaagtccatcattttaccatgttaagcgcatgtcttcatttttaaacataattatttctattaaatttaaaaatatatatattttaaatgtccactacaagacaagcagcacagtagtagacaagcacacaaatatcgtaaccacatttgcagacattgtaggaatataaaattctctgctttgcttgagctgggtaggaccttctgaccccaaataaccttcccataaatcagggcaggaaatccagtcttccttggtcctctctcttgttctaaattaaacaatctaccctgggtgaggtgacaatggaatttgtcatcagcatttagaggtgataggtttactcagcacttcaaaaggaaggcttttcaggaggggaaggaggacgggccacaatggtagggcagtggtgaccatctgcatggagctcaccacacctcaaggcacacgagccaagccaggagatggctagtgaccctctctgcaaggctcctcttcagacacccggctcccaaagagaggagagaagtgtgttgcacactcagaagtgtccttctggaaggaaaagcaaagagctcaaaatagtgaattccgaccctgaagcgatattgctgtgt

SEQ ID NO: 41248 - DNA, 1673 bp, Bovine  19866881067831
ctttccctggttccttatttcttccacattgtgtttgctataaagcaaacagaaagaacactctgatctctacaatattggaatagaatttaaatatcctaccttcttattgctattgtttattgtaatttctattacattataatacatgtatttttctgtaatgatggttagctttaatgactttcttccctatgctaacacatttatttaaaattttgtagcattgttcccaaggctggtttccataatcttctccaaacaatgacttcttgtaatgaaagggagcctctttaatggtaaaaatggtgctcagaggtcttggcaaatattagcccttagaaatgaacacaagcttaactattcaatttaattgaacaaatatttattaagtattatatgtcaggtgctgaatcatattgcccaacataaaaaatctattattaaaataagtggaattttaatgcagagaagcatttgctgccttctttgaagccagtggcatgggaaagaatgattggatgtttcagtattattttgcaaacaaaagataagtattttttattacaaaacccttggtaaaaacaaatgtgaaaaacagacttcatgcaagcttcttgaatttcatgtactatcttttgttctgaaaacaattgactgcaatcagatatagtttgaactttttaaaggaagtgcactcaaacattttttttttagccataagccaccttcaaagccaaagctttgaaattataagttgtgtagtttgcattaaaatacatacttatttaaaatatggagatatgttatatcatttaaatgattaggaatataattttgttttgcaaaatatctgtaaacagatccttatggtaaaacattcctgagaaatagttcggcttggctcaaccagcaataggacaaatggatgagttttcatgaatgctccttgcagggtgggggagactggaagggcaggatgggtggttgaccaccaaatattttttatttttttttaattatattttattttaaaactttacaatattgtattagttttgccatatattgaaatgaatccgccacaggtatacctgtgttccccatcctgaaccctcctccctcctccctccccataccccagagagtcccaaacaggataagcccaaggcgaaacaccccaagacacatattaatcaaattaacaaagatcaaacacaaagaacaaatattaaaagcagcaagggaaaaacaacaaataccacacaagggaattcccataaggataacagctgatctttcaatagaaactcttcaagccaggagggaatggcaagacatacttaaagtgatgaaagaaaataacctacagcccagattattgtacccagcaaggatctcattcaaatatgaaggagaaatcaaaagcttctcagacaagcaaaagctgagagaattcagcaccaccaaaccagctctccaacaaatactaaagaatattctctacacaggtaacacaaaaacggtgtatacattcgaatccaaaacaataaagtaaatggcaatgggatcatacttatcagtaattaccttaaacgtaaatgggttgaatgccccaaccaaaagacaaagactggctgaatggatacaaaaacaaggacccctacatatgt

SEQ ID NO: 41249 - DNA, 1970 bp, Bovine  19866881206078
gatggaagagaaagtagccctatgagatggaggggtcaaaaatacatatcttctgtataagaatgcttcccagaaattatacttcttcttcttctttttttttttttggtgaagacacagcctgagtgtgtgtgtgtgtgcatatacacaagtttttttctacattatatatatacacacgcatatgtgtgtatatatatgtgtgtgtgtgtgtgtgtgtgtgtgtatgcttagtcactcagtcatgtctgactctttgccaccccatggtctatagcctgccaagcccttctgtccactgagttctccaggcagaatactgaagtgggttaccattctcttctccgggagatcttcccaatccagggattgaactcgggtcaccatccgagctaccaaggaagacatataggtcttaaatgatcaaaaggttttggtttgtaatttttacctggagacattacattttccaatttatttttagcatatttgcaataagtgtgcagttcgagagaatccatctatgcaaatctatcccttcttcagtggatctttccaacccaggaatggaatcagggtctcctgcattgcagtcagatcctttaccaactgagttatgagggaagcccataatgtaggaagacacatcagaaataagggcctggaagttacgcacacctctgtgagcacaagactgagccctttgtgtctaaactgtagcattcatttttccaggttcctccagctctcgggctgcacatttgtcatcttaatttagttgtttacatgtttattttgggaaagcaacatttagaaaagtagaatctgcttcaagaaataagaagtgagaattccatcacaaagtaaatactgaaatcaagtggcatttatttttcacgcatcttttattgaattctgtatttttggatatcaccttttagagagcttgcaatgagcaggatataaaatacaaaccaactgtcaactgaaattcacgtgttaaattatggtaaaagtttgaaaattagaattgggtgtgagattgtttttttcctttcaacttcaagaagttgaagaactaattgttgagaaatggaataatgtttaagcaaaagcacaagctcaatagtctaaaatattgctactgaaatgcttcagtgtaatttttgattgtgtgatttattaataaatcagtgtgtgatttattcaacaaatgcatgttaaaaacctgatatgtataaaacatagtgttagaaataggacatgaaaagagacaattatagaaaggtgtaaggcatggtccttacctaagtttacaacagaaaacagtaattatctctgcaactccagtgttcctgataaaatatatgtgacatttttaaaaaacctcttctggaaaacccatgagtcattcacctgaaggctcctaatattgtaacatgaagcaggacttgtctagagaaaagtcctttaaatcctttatgaagagttcaccacaaaacaggatccccatcttgggaggaattcactgttcctgccctttattcaaacgaccctgacagatgagaaaataataagacactcttaggaaacctagggcggtggcgcattcacagccgccagcatgatataactggcgttccacattttctaaacgtgaattagtatgttgcaagtcacccgtgaggtggccagcaacatcatcaccttcaggtttatggatcatctgtgtccacaattcatgacgtgaaagttccccagaagcaaaagaagacatgtagactttgaaagaagggggagttttagaggtgacccctgattcctcctcaattccctttggggattaactctgtgggtggccaccaccaaaggtggaaattctgggccaagaattccataaatttaaacctgactccaactcggtttatttcaaaatttgtctcatttctctctgaactactcaccttaaa

SEQ ID NO: 41250 - DNA, 659 bp, Bovine  19866881214397
tgtgtgtctggttccttttagatgtcctttcccaatagaaaggaaaatgattgctcaggttttctcagacaggaaaagcaagatacaagtaatttatttatgattctattttgttcagctcttgtatttatgatcctattcttatgtgtattttttaaaacttttctccagaaaaataaaaatatgtttctctttcccaatcggatttgagaagggagtcctttctgaatgttaccaagtaattcgtcatattacttaagacaagccaccaagttttctctgacattctaccctagaaaaacagatagtaataatttgttcctcttataggcaaaaagagacaaaaagacaaagttaataataatagtagctgataattattgatcactactgcaacttctctggtgactcactgggtaagattcacactttcaaggagagtgtgaggcatgggtgcaaaccctggttggggaaccaagaatcccaacgccggggatcatggctaaaaagtactgatcactatctatgggggtttccctggtggctcatatggtaaagaatctgcctgcaatgcaagagccccaggtttgatccctgggttaggaagatcccctggagatgggacagggtacccactccgaaacttttgcctggagaat

SEQ ID NO: 41251 - DNA, 750 bp, Bovine  19866881283188
acaagtcagcaccacacatttttaaagagcaaaagtgactgcatgtccctcacttacatctgcacagatggaacaataattcatcaatttctgaatatgtcaccagcactccctaagcaatggctggtgggtgaccttcactggattgaattctaattaggctgagtgcttccctgaaattcctttgtgaacaattactttttgctcatgtagcatcttcccagcatgatgctaagccctttggaaggatgcagaggtctaaaactgttgagagtctagctatcacctaactgaagagacagtttacttcataaaacacatgacccctggaaaacccaggagggttactatgaagaatggaatgagtggagtttaaagtgagggtaagaagagacagagaagaaattgtccctgacaaggggttgctccacacctggtgtgcagtagccgctcatgaaatatttactgaaataaatgcacaagtaaaggcaaaacataccatcctgtgctggctggtatcctggcccagctagagatgcagtggtagaggtggatgtctactggggcatgacctacttgaggaggcccgggaagggagggaggcgttcttgtcttggtaggaaaatggaaatcaataaagatgcctgattctcagaagtggtcaccctaagagcagaacatgaagtggaacagaacagacagtgaagcggggtcaatttcaccctctcccacctgtcaggcacgtgtgtc

SEQ ID NO: 41252 - DNA, 2766 bp, Bovine  19866881285228
atgctaagtttgaaatgtgcattgggcatagttgactccagatttcaggtaacatgctttggctagagaggtgatttttggagtatttggccctggagatggtgtttaaagtggtaggactgggtgtaccgtttagaggatgtgcgtgataaaagaaggtaagaggtctcaaagatcttcatgtgatctaaagaagctctccaacagttgcaagctgggaagtcaaggaggatctagtagaggagaatgagaaggaatgaccagaatgtcagaggaaaagagtgtggtttaaggtgtgaatgatgaactgtgttggatactgagttattgcgtctggcagcatggaggtaaacaaagatattgacaagagaagattgcaaagagcagtggtgacaagtgagttgctagagagtggtcatggaaggacagaagtgcagagagaaggtaaagtcaactcagtttcaaagttttgctgcaaacgaaggaagaaagagcagagcagattttcaaaagaggatctaggtttaaatatcagttcaaaacatttttcaaagtttggataatatagatggtggggaatgatcatagaggaaacagcgatatgattttcagttattccagctgtttcatttgcatttctgaaagtaaatctgtgttttgatgcacatattatacttaaaattcattgtggaaaacttgcccaaagcacagtgctcttgtcttccttggtccagattcctcataatctttgtatctaaatattaaaataagcatgtacacatcccacttgctgaaggtagctgaattgccttcaaaataataactcagaacatttctaaatcatgagaattgtgttatacactgttagtttccttcccagaagtcatacctcttctttctttttaacagaatccccagttttgtgtagactggagatctgtttagctgttaggaaagaaaacctcattccttttagccagggcattttatgtgtgtggctgtggcagccaccttgtgatcatgaggaaaaaggaaataagccgaaaatggcagataagaaaattaagaagggccttggtttttgataacattttgagctcctgtaccacatcaatggggcttccctggaagctcagctggtaaagaatccatctgcaatgtgaccctggtttgatccctgggtcaggaagatcccctggagaagggataggctacctactctggtatttttgggctttcctagtggctcagatggtaaagaatccacctgcaatgcaagagacctgggttccatccctgggttgggaggatcccctggaggagagcatggtaacccactcgagtattattgcctggagaatccccatagacagaagagcctgatgagctacatacagtccatgaggtcacgcagagagatacgattgagccacataaagttgctaagcacagcacacacagcaccatatcagtaacactttacagctatatttattataggtaagaattaaatggttttattaattaaatcttgattactcaggtatggtgttaaacttgcagctgaaaacattcctgatataattttgattttaactgatgactaggaatcacaggtggaagcatcttagatttctcactgtgtgtgtgtatgtgtgtgtgtgctcagttgtgtccatctctttgtgaccccatgaaccaaaatgggaataactctgtcatctcttattcccactttggtgctttcatttaaaaaaccataaatctatttttaataataatagctaacacttaatagcacttactttgatccaaagactattctaaacaccttacttacagtattttatttaacccaataagatatgtattactatgttttgaatttttacatatgagaatctgagacacaaggagattaacaacctcgccaagataacacaaatgatgatcagcacagctgagattagaacttcaacgtctgcatctcagggtccagactcccagggctgagttaggaggagtgttcacctgctcctgtcctccttccccttcttcactcctgtgcctcactaccccctacagtcagatgtcccttcctagtttattccttccttttattaacatgtcttcatcatatcactctaattgtggggtcaagcacagcctttatctcccaagaggaaggagaccctcatgatatttttggctgctccacaacatgttatttggctctctttccatccagttattttgtgtgattattaggtctaatcgctcttgtctttctttggtgaaagtcccgtgtttcctggaactataccaattcgctttgcccacctgcactgctaacatagattgtgacaaacacttagaatgtagacacaacacacaaaaatagaatctctacaaacattcacagcaagcaatatcccatttcatgtacaattactaaatagggtatttcagtggacatctaaaaattctataaattatatgtttatttatatcaacagatttatacatacataaattatgtatgcatatgtacaaattgcatatctatacatattacacatactggacatattgtcatttaagttttacgaaaatcctaggacattgttgggcttctttaggtggcactagtggtaaagaacccatttgccaatgcaggagacagaggggacacaatttttggttcccatgtcaggaagattcccctggagaagggcatgggaacccacctccagtattcttgcctgg

SEQ ID NO: 41253 - DNA, 1441 bp, Bovine  19866881296381
cttttttacttgactttgtttaaaaagtggggatcagatgaaaagatcagcaggcaaaacaagtgaaattactttgtcatacataaatatctgtgcatatgatggattattacagtaagccattttaatttttttttaattagagggaatcgatgatataggcaatacaaaacatggaataatcaagatgttaatttttgattttgtaatgtagtttgaatggatatagacctaatatactggaaagttatttccccttgatagtctgactaaagaagctacttgaatctcccttccctttcttgttctccttggtttctgtgttcttggctctctggcagtgtgggttatagatctttgtaaggagatgagagtggtgggattttatcagtttaatctttgcagtctcacttgttgcagcttttcccatatagacatgtgaatttgcatgtactgctcagaacactggtcctgatgtgatgcccacactgtcatgtgaggttgctggaggtagttcagttagttctttcatgtactctttgtgctgagctgtgccaagtttactgtaaatttgagtttgacacaaacttttaaagagcttaggtttcagagaccaaaaattagggtttgaatcctgactccatcacttccatgacaagtctctccacctctcaagcctgtgttcttacatgaaaatgacaataattatatttaaatttaatgtttcagagtaagttttaaataacaatgtttcagagtaagttctgaatagaactattactcattagtataatatgccaatcagttaataattactatgtttcagagtaagttctgaatagaactattactcattagtataatatgccaatcagttaataattactactactagtatagagatattctgtgattctaggtgtaccttcagtgaactgcttctcctcatttctttggaggccctggaaatagtaaaatatcttcatggcaaagtccttctcaaatagtctgtgcaacagccagagcaaacttttaaaatcacagaaataagttttctttgcttcaaacctatcagtggtttctttagggaaaaccctacagtaagatatgaccaaggactgctatcccctttagtgggctagttctgtgtaccctcaaagaggacactggtgaagaaagttggagaaatgaggtagatggataaaattactggaagtaaaaccccagactccagaaggggttctgactcagtttaccatccctacataagaaatgagattctcagagatgcagacctcttaacttctcattgtacatgaaagatctctcactacagtttattcactggcctaatgtgaagtcaaattaagacaacaacaaaacaacaaaaagcccacctaaatgtcccagcagagttgccaaaaatagtaaagcaaaaggg

SEQ ID NO: 41254 - DNA, 813 bp, Bovine  19866881318903
atgatattgacatatgcccccttaatttgcataattcttcagacagggatgcaccctaatttgaaggcagtgattttggtaaatgtcaatagacagatgccacactagtgactgagtttacaatttaaagattttttacgacttcattaaaactgggagaatattatggagagttcctttaaattaggtttcatttgctccctgtaattcagagaaaatgtagtctttgattgctgtatgaagtgtcagatatccttaacaacaataaatctggctctgtatatctatatacttagattaccccttgatatcagaccatcagggagagttttaaataatagtggataattgtggattacagttcatgttttgctttctgagtttgttggtttctaaaaggatcagaataattagacacactcactctacatggaaacttccacacaaaattcaatagaatattttttatgaaattgaaagggggaaggtaaattataccccttggcatatttaatagaactcagatgattcctgataggaatggggtcttgttatcaaatctttctaacaaaaattttgccttccaattaccttaatgctgtgatttccaacttatctaaatagaatttgcttctgtgggtggttctcatatttgattcacctaaaacttcatacttttaggatgaggcaggatagcaaatgaagggctaatataataaatattacatgtatatttagttgatctctttctaggcttaatattacaatttctgaacaaggaaactctacatgaaattaaaaatacatgaattg

SEQ ID NO: 41255 - DNA, 1362 bp, Bovine  19866881486846
tattttccctctgacagatttctttctaaccgaggaccattgttacataagaaaattattagccactatagtatattcatatattgttaagtgaagtaaagaaatattgtcagtttaatgtaagatggcaccccactccagtactcctgcctggcaaatcccatggacagaggagcctggtaggctgcagtccatggggtcactaagagtcagacacgacagagcgacttcactttcacttttcactttcatgcattagagaaggaaatgacaacccactcttgtgttcttgcttggagaaccccagggacgggggagcctggagggctgccatctatggtgtcacacagagtcggacacgactgaagggacttagcagcagcaatgcagcttttataacgctatgattaccacaaaaaagatatgtgtttttattaaaattctcaaaaaatatgtagcaatccacaatggaaatacttacattaaaatgacactcagaccaaatgtccatgtttgaacctttcataaaatatctctaggaaagtggtgaaaggtgagctacaaaccacagttattttactttgctcattggcattttattaccatcaaaggactcctgtataaatttatgtggaattagataaagcttgactaaatctgtggcatcatttcaaggatctatacagtaatgcaagcatgaaagaacgcctcacacgccttcagaaccctgagccaactggcagttcatttgcttcaagactctttcactgcctctttcttttctgtgatggaggcagaaaatgtgctatttgttagataaaaataatactgatattgttctaaatttctagactattactgacagacatgcctacttatttacgttctctgatgttttagacattgaaatattttattttgaatgggataattgtttctttatgaatatctagcttcatttcctcaggcacatactacaaactgaaattctaaatatagaaatagatgatctataccccaacatatattacctgataacaggagaaaaattcctttcctcaatatgttcaaaggctggcttaaaaggcctctctgtagcggggtttctcatccttagctctgctggcattttgggaaaaggaacttttgtggggattgtcctgtgtgttgtcacaagtttatcagcatccttgacctccacccctggaacaccatggcaatgcctcccagcacctctctcaccagcactgcacctaccaacaatgtctttaggcattgtgagcaattctcatgagcaaagtcattctagtgtaaagaattcatagaggaatgcatgatgtaaaagtatattagttggccttg

SEQ ID NO: 41256 - DNA, 1283 bp, Bovine  19866881567792
taaaaaaaagactttgcaaattaacagttgttccaaagacatcctaacacttactgtagcatcacacacacatgctaagaaaatgccaagttttatttcggtcttctagcaaattaatgcaatgaagttttccagataaataataagaataatgtaatttttattaaaaatatacacacacattataagcagtgtcgcttttttctttcttttctttttattgaagtgtagttggtttacaatgctgtattaattcctgctgtatagcaaagtgactcaattatacatatattaatatatacattgtttatttttatattattttccattatggtatatcccagtatactgaacatagttccccgtgctgtacgtaggacttcgttgtttacccattctatatataaaagtttgcatctgctattcccaacctcccactccttccctcccccactttttttatttcttaatgcatttggggatgtgattaatacaagattttatgtataatgtacagcaatgtggctttaggagcacagccttggggtcaggctgatttgaatcctgatgcccccactaatgcccttgagaaagtatcttaatttctctagttctcaatttctccatccgtgaaatgaggatgaggacacagggttgagaaaattcagtatgatggtacttttatagcacttaacacggtgctcttttggggctgagttactggtgttatcatcatctttatatttttcttgccattgcttaatgcccttttatagggtcatttcttattccagtgacttttctgatagaatccgcagatttcagccagagaagcaatgacacagaccaattcaatcccatagggagacactttcttctgtttttctcaaaaattcaaattgtaattccaagaaaccactgatcctttttgctaataggcctcaaaccacaatttcatcaagtctttttttttccataaacaaagccaaacataatatctggttcatctgattacacacagaggagctgctatctgagtactgccctatcacagacgataatggcagtcattactaaccacccggaaaaacatcacctaaagaagacatgtggtctccatcaacataatgaaaaacgaaaaggacaaagcaaggctacccctcccacttcatgtgttcatgtctgaggaacagttcagtagcgttacagcaagtcaacaagtcgctccaaggcactcactgtgttttgcacatgatggatgtccaggataaatgtggtcttca

SEQ ID NO: 41257 - DNA, 834 bp, Bovine  19866881819828
tcgtcacttatatggatttaattgtagcagtctaccagcctttcttaaataattgacacacgttgttaagattcagaggctgtgagtacatacattccgtccagtactaccgaaaatggatacctgaacagcaagtcacagcttcatacacagtttatgaaaagaagtgtgttcagttctgcccggttcaggaattcatcctgcaacactgtctgtggccgaaagcttcctttctcttttagccccttttttggtcatagtcattttatgcacatcatgttagataatttgattttacttcgaaaggcccacgtaggggttttatgtctcttttcatagtagcaggaagaagtaagggatttttgtcgggccctccggggtttcatcttgtgacttgtccctctctgtctccctccgcaggacgcaccggcaggcgagccccacccggtccccgcccatggacgccgccttcagcagccgcaggggcaggcagctcccgcaggtgcccgtgcgaagcggcagcatagaacaaggtatccacagagggagcctggccaaaagcctgggttcgagaaacccctctttatatatgccttctgttaacagaatcatattctggttgcatgtagtcggatgaatcctaagaactcaagttacctagatctttattcccagcacctggttataacaattggtgcctcggtgctgtttttgctgagtgagtgaatgaataaattttagatggtcggttaaaagaaaaaaacgagcccttagagatacttcttccaacggtaccaagaaaaaaaaataaaactttaaagacctcagtacaat

SEQ ID NO: 41258 - DNA, 1575 bp, Bovine  19866881273864
ccctgtgctgtcgggcgtgacacctctgtgcctgtgtgaggatgcccagtggatgggctccaccagagggcggtgcacaggcccaccctctgattagacccgggcactgaagctcaggaaagtaagagggcccgtgaggctgctagatcccactggagtcgaggctgggatgaaatcaggacctttcctactgcgtcatctggtggacaccgtgtctccaccacctctaaggactatttgcttctggtcattgagaccagcaaggagaccaagccagtcaatcctaagggaaatcaaccctgaatattcgttggaaggactgatgctgaagctccaatacttgggccacttgatgtgaatagccaactcattggaaaagaccctgatgccgggaaaaattgaaggcaggaggagaaggggcgacagaggataagatggttggatggcatcactgactcggcggacatgagtttgagcaagctccgggagatggtgaaggacagggaagcctgatgtgctgtggtccatggggtcgtgaagagtcggacacgactgagcgactgaacaacgacaaccaagatcagccaacagtatccagtgtttcaagttagctgcacacttggtcctgtcttgccacggaacaccactggccctcgaggtcctggtacctgcttccaggaagatctaaacagttacagaccttcttgaggaccggactgctgttgccccttctctggctctgtccacgaggatagtggccagtacggggccctcagccgcggtccttgggggggtcaccttacaagggagcaatgcaagatggggaaacataaagaggaaataccagctcctttgggctcctgtgatcgtttgaccgttcctctgacacatctgaggtctgtgtgaaggaggggaaggttgcgaacatgtgaagaatatgagtccagaacactatgctcggcctccgtcgggagcagaggtccccgccttggcggcccccgcgtgggggccggccgtgggcgcagctcccaggacagcagctcacctgcaggccccagcacagtaaggacaaatgtagacacgcaggaacaagccagtgggggaggctcagaactggaatgttgtctgtgcaaaagggcagcagggactccatgcacatggctggaaggttctgtgagccgctggcctggccccctgttcaagccggccagggtcggatggcgttccctttctacctccttctggtttttccaggaaaacgggttaaggagccccaaggaagcatttgggagacagaaactcccctctgagatgaagactcgaaaaaaacctttatagagacccacctcaagcacccagtaagatgtacttcaattaaagtaaccctggttgtcctactccacatcacacaaagcgagaacctcataaagaaccttctgcaacttctaacccacgttcagtgccccccacccccttcctgggacatctgtttgttaaagcggattgcattcagctgatgtattcaccagatgagtaggacgtgcccctcggcttaaaactgttgagtgtgtgctg

SEQ ID NO: 41259 - DNA, 1915 bp, Bovine  19866881536787
acagcagcagaacacttggcctcaacagaggtggaagggagtcatgattagtttccaaaacttagaagaaaggcatgtcaagtgaacgcagggtggtggttgccaggggctgtgagaagcgggaggggagaagccgcttaatacagagcgggttttcctttagaaagatggaaatctttctgaactagagacgggggccgagtgcacaacactgaatcttccccatgccactaagctgctcacttgaaaatggttgcttttacattgtgtaaatttcacccaataaactgttttaaaagtcatttcacagttctctgccctctgacttgccaggctcatcaaccctgggtcagggtggtagaagcgtctggtgtgcgatgcagcaagcagagcttgaatctggcgccttccagactggggtccccttcccacctctgctctgaagtcgttggatgacccaggcgggtgtctaccaatgctgcttggtccaatgaggccacagaattattttttaatagttcataagtttttctggtttctaaagccatgtaacataaatatagtatgtataatacataataaagacacttaaaatcgtaatttcactatttaaagatggcattttatattttgatatatagccttctatgcctttcacatttatatgttaaggtgcttttggatctccatacttttttttaacaaatccctcctttttcgcctcttgtgggtgaagtcctgcagaagcttccagatgcccctttcccttgctcttaagatgtgcgcccccaggtgggtgtgaggaataggaaagatctctgcgttgcctgccattcagccttgctcttttaaatctctgcctttcccactccttcctttgtcttcacagttttgattgaaacaataccagtgttcaacctcctcagaggcatctgtttattttctctcctttgactttcagaaagcttagcgcatgactcatttgtatgtggtgtgtgtgcgtgcgtgtgtgactcatccgtatgtggtatgtgtgtgtgtgtgtgttaaacaaagcagagtaaaaaggaagtgaagcctggaataattatccgtacttgattctcccacaaatatttcagtaagaaataaatcttgtttcccttgacaggaatttgcatctttgctcacaaaagtgtgaatctgtccagaacaacttccaggacagctcgcagctccgggggggcggggggcatggagtgcagacctgccgggacccaggcctcctcccgcagtgcacgcagagtgggccagccctgccagcagatgctgcagagggacactctccagtcccatctctcgattcccctcttccagcccctccctgtggcttgccgctgcctcctggcccactttgacctgagtaaggccattcatgggccacagtaaccaaaaggccagctgatgggcacggtcccacccagtgagagactaaggtccacttctctctggggctggatatcagaatgcctgaaacaaaggggtggtgaacggtggagcctaggcttcgggggagaggtcctgcgctggccaccgggagcagcgctggggtgcgggctgcttgttctccgcacctgatgagggaggggctgccaggtagaggcggtaggaaaccctcgccaagaataaagccctcttcaaagagacctagaagctccacctgccaagctcacgtggactgtcccgtatctgccctggcggtcttcatctgccgttccccatcactttttgagttttactgaataggctcaacgagcaagtaagcatcctcattgtcttctgagcacccccccaaaccccagtgttgcttttccttctgcttggaataaaagccccactctctggtgttggagaaggctcttgagagttccctgga

SEQ ID NO: 41260 - DNA, 728 bp, Bovine  19866880724688
tgcatgcatttttacttactcaattctcacgttgtcccgagctagccaacaaacctttcttgtactacgaatacaacttttacatgacatgtattcctcttcttggtctacatattctccctgggcagtctctctcatctactctcatggtttcaactaccatctttatgttagtgattctcagatctttattttcagtccagatctctcttctaagaatccagatccatatacttagctgtcttctggccatcttaactcatgtgtcccttaagtacctcaagtacttcatgtgttcaaagctgagcactactcaaggaattttcagttactaggggaaacctcactttaaattttttttttattgaattatagttgatttacaatgttccaggttacagcaaagtgatttggctatacatattattatatttctgattattttccattataagttattacaagatattgaatatggttccctgtgctatacataggaccttgtcatttattttatgtatagtagtatctatctgttaacctcaaattcctaatttatccctctcccctttcctctttggtaaccataagattgtttcctgtgtctgtgggtctatttctgttttgtaaataagttcatttgtatcattgttaaaaattctacatataagtgatgccatggatatttgtctttctctgtcagacagtccaaccatgttactgcaaat

SEQ ID NO: 41261 - DNA, 2733 bp, Bovine  19866880745137
atgcctctgctttgtaacacactgtctaggtttgtcatagcttttcttccaggaacaagcatcttttaatttcatggctgcagtcaccatctgcagtgattttggagcccaaggaaataaaatctcccacggtttccacttttcccccttccatttgccatgaagtgatgggactgggtgccatgatctttgtttttttgaatgttgagtttcaagccagcgtttttgctctcctctttcactttcatcaagaggctctttagctcctcttcactttctgccgtaaggctggtgtcatctgcacatctgaggtgattgatatttctcccagcaatcatgattccagcttgtgctttacccagcctggtgtttcacatgatgtactctgcatagaagttaaataagcaggttgacgatatacagccttgatgttctcctttcccagttttgaaccagtccgttgttccatgtccagttctaactattgcttcttgacccacatacaggtttctcaggagacaggtaatgtggtctggtattcccatctctaagaattttccacagtttgttgtgatccacacagtcaaaggcttcagcatagtcaatgaagcagaagtagatatttttctggaattcccttgctttctctgtgattcaacgaatgttggcaatttgatctctggttcctctgccttttctaaacacccactgtataatgctttttattcctatcataccagtagtaatgttccatctttcattcctgattatagtaatatgagtcttctcagattttccttggtctacttatctaaaggtttgtcgattttattgatcttttcaaagaactagtgtctttggtttttccgctcccctcacttctctgagctctaaatctctaaacatgaagctaggtaagaaatggtgacagcctgcttcccctggggagaaatcttagcccgtggtcctgaactgcagcccagaggatttgagcttccaacatgccaaagtgggagttggataagggagctgttcttactgagatttagtagatttttttttaaaataaaggtttccctatttgctgaatactctctgaactttcagagacttgaaatggttgtgtccttcagaaacattcacctttatggttgtttcactgggaagaaggaacagagctcttcatgttgccattttatacatttctgctccagcctggcattctttttgatacccaaatgaatctcttccattttaaatgagcccccgttcttgtgctgggtcctccctgaacttgtccagctctctgtattctctttacctcagtgtgttgtggagtcatgagccagcagagttcctggtttgttcctgtcagtgtgaatttggtgacaatttggttctctttacttgggtctttactaagctctttcccttccattcttcttgctgctgcccatgtagcttctaaagtggaatcttccatgcttcaggaggcaggcccctgggcatgataagccagttggggagggagtgatgtaaggtccaacttcttgccaactaaggacatataaaagcagttcagttaacatctatgtagtcgccactgtctcagaaagcatagatatttcttctcaggaaagtaggaaaattcaaaatattacattaaaacattttgaaaacattttactaatgaaacacttcacattgtcctgtggttcatggatggtcacacagcaagcactggaccatgtgaggtcattctggaagtacttagctaaagaacacacctagctgaaccctcaacccccaccctccccccatcttgccgcaataactgcaccacaactctcctaacaccccctcccctgtgctctctggcacattcttataattggacatttattgatgatgagttggactgcctttcaagacagtgaccatgttaaaagcaaggatcccatcttcctcatctctgtgtgcccagccaggaacaggtgctgggactggcagaaagtagagtctccacaaatgtttgctgaatgagtggatggataagtgaaggataagtcaatgaattgttgcccgttgtcagaatcataaaatcaacttcttagttggtatcggggccatcctgatctggccgctgcaccatgtcctactgatcttatcactgtaaactctccttctcaacgtggactccattccagcccaaccagtctgttctctcatcttcagaaatgtcccacatgatttcatcttgcccacagctccgcttcttggatggtcttcctcctctacttatgaccactcttgagcctgccaagaccttttcacagaaatggatgtctcctcagaacagaccaggcctatttctataggtttggtatgtttggggtcgtgttcctgttttgccagagaattaacctggtgtgtcttgcactggaacttgttggctcttgagtggggcttggttgcagtgtaggtatggagacttttgggtgagctcttgtttattaatgttccctggagtcaggagttctctgatgttctaaagttctggagtagggcctcctgcctctgggttttggtcctcctcttacagtagcctccagacttctctatccatacagcacagaagataaaacccctaggttaatggtgaaacaactctccacagccaggaatacccagagagattcacagagttatatagagaagaaaagagggaggagg

SEQ ID NO: 41262 - DNA, 1013 bp, Bovine  19866880886358
agttggaacaggagctcagcctgactgatggcagagcccgtgctctttctctgtggtgctccacctctgggtggaggttggtttgtggattccagcacccagagaacattcttcctctaccagtgtttatagctgctggccatttggccttggcatagagctgaaatgtggatgatcaaaggtaggaggctggctaggtgatctctggcctttcctgggtctcagatctgggcctgaaaggtcagagcttgaagcatgttttggccttgtaaattgttcataagctctgacggtgagctccagatttgtcactccctaatctggccatggctatagctagctgtcatcaagctctggggagcaatgctgtaaatcattttcccctttgtgcaaggagaaaaaatagaaaattacattcttctcagcacttttgaatgtgctggtgcctctgtcaatagctccttcttgcgagcagaaaagcagcatgatccccaggaagaatgtgttcttatgggcatcagcccagtcatccacacacagagggagagcactgttcactcatcagagtgctttgccctgtcaggtcatggtgtgtacctcttaacagcaacctggggtacaggtcagatccccccttttgcatattggcgacctagacttaggaaggttgaaaattcactcaagctatcaggaggcagagctgcacctcaaatctgagctgaagttcagagttctgtactcttggccctgagtgtgattcaggactggggaactgcctaccgaagtgaggataaaatctgcctaagtaataaaatagcaaaataataatagtgacagttgtaaaatgctgctgctgctggtggtggtgatggtgctgatggtaaacaattcttcactgacttctctggaaatcagagaagggggttacacatgcaggggatgcccaggggggtactcacagtccataccctggtggctaagacgggaccccactggggggctccatcgtccag

SEQ ID NO: 41263 - DNA, 775 bp, Bovine  19866881624471
aatgagcctcagtcggacctcatgagtcatcgtttcagtgggaaacaaagcagctttgcttcaaaaagcaatttaattaattttgttatgtgctgtggaaataagcttttagagatgattcaaaacacttacatgaaattgtctaaaaataagtgaacaacacaattactgtctgcttttttttgatgtagaaatattaaaataataagaggagattttaaaatgtaaaataacataaagtttgcatgtaatattaaaagaggagaaaaccaaagtggattcttagctgggtgcatgtcaaaggtaaagaaaagcaaacatattgcccatgaaagacaaagctcagtttttttttttgttttctgttttttttaaagctcagttttaacagccctctgctgacctaggaagagaggacacaccttctgttccagcctttggacttacactctctgcatcccagtttccactcctggaatatgagaatggatcctgttggaccaacttccagaggtgatagtcagtcagcttgaaaagtggatgtgaaagcactttgtaaactgaaaaatggtgcacccatatatgacatggttccacttactcatgaatgactttgaacctgtgggtaactattagtcaaatcaatttcactggccttcactaaccaaggtcattttaattgtggctacaaaagacttgcaggtcctccaagtggcaggtagactaaataatatgtttgcctacattattttccaggaactggagtcagccatat

SEQ ID NO: 41264 - DNA, 690 bp, Bovine  19866880359184
ttcttgcctggagaatcccagggacagaggagcctggtgggctgccacctatggggtcgcacagagtccgacacgactgaagcgacttagcagcagcagcagcaccctttaaaagttatttcttaatcactctatgaaacatatgagctgagaaataccaaatactgatgatggctcagtggccaatctggctcaggattcaggcacaaatccaagtgaaaatcagttatttctttagaattttgatatttagtgctaatctcatctgtcttataggcattaattgcttatctctgtccagtacacatggtatattttatactcgctatttattaatttttaaaataaacttcatgtttcacatcaagtattcattgatagtagtagatcatttataattagccattgaattagcctcaaacttgaattattcagcctaggataatacagaaacgtctcatattttggacttcatagtttaagatatatcttgagattattttcatattaattgaatatttttttcagactattattagtttaatgggcttcccaggtgattcagtggtaaagaatccacctgtcaatacaggagacacagaagacctcagtttgatccctgggtcacggaagatccccaggaggaggaatggcaacccgctccagttttcttgcctggaaaatcccaag

SEQ ID NO: 41265 - DNA, 2140 bp, Bovine  19866880437637
tgatgtactctgtgtacaagttaaataagcagggtgacaatatacagccttgacgtactccttttcctatttggaaccagtctgttgttccatgtccagttctaactgttgcttcctgacctgcaaacaggtttctcaagaggcaggtcaggtggtctggtattcccaactctttcagaattttccaaagtttattgtgatccacacagtcaaaggctttggcatagtcaataaagcagaaatagatgtttttctggaattctcttgctttttcgatgatccagtggatgttggcaatttgatctctggttcctctgccttttctaaaaccagcttgaacatctggaagttcacagttcatgtattactcaagcctggcttattttgagcattactttactagcgtgtgaaatgagtgcaattatgtgatagtttgaacattctttggcattgcctttctttgggattggaatgaaaactgaccttttccagtcttgtagctactgctgagttttccaaatttgctggtgtattgagtgcaacactttcacagcatcatcttttagaatttgaaatagctcaactggaattttatcacctccactagctttgtttgtagtgatgcttcctaaggcccacttgacttcacatcccaggatgtcttggctgtagatgagtgtgagtgatcacactatagtgattatctgggttgtgaagatcttttttgtacagttctgtttattcttgccacctcttcttagtatcttctgcttctgttaggtgtataccatatttgtcctttatcgagcccatctttgcatgaaacgttcccttggtatgtctaattttcttgaagcgatctctagtctttcccattctattgttttcttctatttctttgcattgatcactgaggaaggctttattatctctccttcctactctttggaactcttcattgaaatggctatatctttccttttctcctttgctttttacttctcttctttcacagctatttgtaaggcctcctcagacagccatttttagattgactcctagggatttggtattttgggttcatgccctccagggttggctgtgtagctcccaagcagtttcaggtgaacagatgtggtcactgctgtgcagggcaccttggctccacatctaagagctggccagctggctccccacttcatcaaatcttgatttgtaggctccacttttcaacacctgctggtaaaagtcctactgtaattccaaacccatttgtcatttgctctataaaagaaaataatatatatggttttaagagcagaacagacatttggaaagtgttcataactaaggtgtaaaaacaacagtaattattttttccacggtttatacgaacattgtgaaaatgtgtcagtagatggcactgtttcttaatagatagagaaagctctaacccggtggagtaggtttgaggaaaatatttttttgttaaattggaattaagaataaaataaataaaactaaagaaagttctgcagagtcccttgtgatttacttctctggtgagcttaattaaagtcaatgaagaaacttaagctcttccaccccctcacttgtgatgggctgttgctctaattgtgtcttttccctggccaggctgaagtaagtgatggcgtatggtgcactcggcgtggccagaataaaatcaccgagagagaagccccgggtgccttcctgcttctgcacagaaggtgattctggttgttaccagaaccatctgtgtggaagacagcatgaaacatgaaaggaagaaaacccagagcttctcctcactgtattttctgttccgcagagtggaagatctggttgcaaatcccgcctctgtcacgttctggttatttgatcttagcaaaccgtttaacctctctgacctgtttccttacctagaaaacggagataatatccacatgagacaggaggctgtgagagtaaatgaggaaatgttaatgcagagcacttaacctggcaccaaggagtgaccatgtgaggttgggtttttagtccctgctctttggagctatgaaagtggcatagagggacttccctgatgggtccagtggaagtgatggaaacactctgt

SEQ ID NO: 41266 - DNA, 811 bp, Bovine  19866880536641
ttgtcttttctgattgtgtgaaggatgggtaggcgtctggcatcacatctccggcctcggagagcaatgttaaacatttatagtgaacttaatcatctgtcagaaatgtacaaagccatcatgtctcattaataattattaaatcattgagttgcacagaaggagatgtttccctcttcacttacataatgaccagtaaccactaaaatgtgggctatttgtgatgcatgaccagcacatctgatggtggaaatctgttgaagaaattaataaaaaaatcttattaagatataggcttttagaaaggaagaaaacatgcatatagatgctgtattattcagccaggccaaagagatgctccctccctgttcagagtcaggttaaaattcagtcaggtaattgctaagagtgaagagatgtgaaaggaaatgatcttatttgctttcagaggttagataactcatttcaaaatgcccagcttcgcacttttattcataagtatatgtatcattttatgaataaaagaggtacatattttgatttggaatgaggctgggatggaaggcacaatttttcaagacttgcattttatttctgatgatgtttttttatttcataagaatttttaatatcaggcaatgtcattttagcaacatataatacaagaattgaattacatccattgtagatcccacctcctgcttcccaatattcagtccagagaatgtaaagatttagcctttaacaattttgcaagctatatttgtctttacagcagctgatattaccagcaatttgtatttttcatttt

SEQ ID NO: 41267 - DNA, 832 bp, Bovine  19866880550514
acactgcttagatttaattaattcagtgtttcttatcaagttgaagtcgggaaggttttcaggtcaccctttctgggagggcatttttggtttgttgggtaatgagtttcataaataagaaatagacggaaatcccttttgctgtgaatcacagttaaggtccagactaaggaaaacactattgaattggattcctcagctgactgtatggctttgttttcagttttaggaaaaaaggtcagatgagactctcacagcttaatattgtgggttttttccaaaaaggaacttccaggctatgacctagaattagcacacattctccatttccttttcataaaatctttgatgttctgagtgataaattgagactgtgattctgacttattaaaggaagattgaattagtttccataggttgagttgggaccagacttagcggtcagtggactagtctttggcgattgactatgacatatggttctagttatagatcactttttaaatttctcaattgtttaatatcctgttaactgagcgccttttattcctcatccgagataaagcttagaatacaagtctgatgtgaaagaaaataaccctagacttgcacactctcctgtaaatgacctttatgggtcatttcctaattttgctgaggaggaagttaagtaacaggcactgacatctggaagtggacagggcaacacctagaggaagattggagaaggttgcagaggggtgacaggctcagccctagttttttaacctgctctctgctgctctttaaatatccagatgtctgttggctttcattcatcttccagaatcaa

SEQ ID NO: 41268 - DNA, 1863 bp, Bovine  19866880642604
gattcctgctcataggccctcatttgcagaaagggctatcagatcaggtggcctgggagttaccccccagccatagacatgaggcccctgggatagaaggcgctgccaggaagtataagactcagccagcacctccagcaaccagggcagaattcattgaccaggtcacaagttattacctccacagaataagtcagaagtgataacacttgggagttagattttctcttacatttcaacagttccctttataattatgctaacattgctattctgcttgtcctttttcctgctcagctggttgtttttctactcatagattgtgagagccttagaagcaaagcactgaatctgtattttctcactcttgcctcccaattccaagtctatttttctatttcccatattctctgtcactgtctttctctttgcttcttttctgattccatctctatctctataggaacatccaaaactgtcctttggtccctcctatagcatctttaccagcttacgcaggaggcatggaaatgaaaccacaactgaaaatgacttctttttcttctcatctttcccctgaggacaagcacatctgtgcagcctagcttaggctctgttttggcatttcaggtgcacaagtggatacacacacatgcacacagaaccacaaagtctgtgaccttctatttacttatttagctctttaaagagaatctcatgggtaagaactatgtgattctatttgtattcctagcacccagtgtagcacctgatacctaagaggtaattaacaagtatttgttaaatgagtgtttaataaacgcagaaaatctaaactaatgaagaatatgagtcaggcatccctgaaacaaatagaataattaaatattaaagtgtgaatatgattagagtaggtacagacagaccaatgcaccagaaattgcccatcataataaacatgtgtaaccagggaagctccaggtttgggtgggagaggatatcactcccatggaaaactgtgtcatctcattcaaaaaacatttagcaaacacagtatatgtgtgcaagtcagtcagtttgtgttcaactctttacaatcccatgaactatacagtccatggagttctccaggacagaatactgaagcgggtagcctttttcttctccagaggatcttcccaacccagggatcaaacccaggtctcccgcattgcaggcattttaaaattgataatatcagcatccattatcatttttccttgttagttaaagttcctgagttgggtagtaagggggttgctgtctttaagggcagtaatacaagaggccactgcatgtgtgggtccttctgcaagattcaagttacatatcaaatatcaatccccctgtcccatccaaaaaatattcaagcttttcccaaccattccagcctaggaaaaattcaacagacatagggtagagcctccctcagaattcatcccctgacggcacaagttctttgaacaatttgagaacatggcacaaactggggaggaggttgacagatggaaatgtaaatatgaaattttaatgagggctcttccgtctcacctaaaaggagatggtaaatatttcatgccctgctcagcggggtttcaagcattgggtaccattagtgagatagtcctcatcttctccaaacaactagccctggtttgtgatatttcataatacccaaacctagaccaactctcccgcccacacacaacaaaccctgaaacttctggggtgaaaagatcacttgatcatcttgaaaatgttgtattttttcttcctttggtccagtaatttcggcatgttaaaacaaagctccaatggattgaa

SEQ ID NO: 41269 - DNA, 771 bp, Bovine  19866880743099
agggcagaaaaggactttctaagaaagcagagggctgagaacacgtatggcatttggatgatattaataagtagtaacactctcaacttgagaaagaatctctcccccctcaccctctcatccccttatccttgaaaaagctattctgctgctgctgtgatacctagactccagtcagtcccaccagtgggaaacaatgcctggggaccctctccccaaggcctctgatcatcctatttgagacagcccccgttcccctaataaagacctctagaaacatgggaaagtctgggctgcacatgaatcatacacgtgtcagtaatgccaatgccatggccagcctgggcaagagcacagacagataacagagcaacctcatccccagggtcttgtggaaatgccagggctgttatttccatcccttcaacagggaaatcagcctgcacctggaggctccacagaggctatttaataagacatttgtttactgccttcctgctacctctgacaatataatcctttctgattctttccacgatttgactctaaatgaaaaagtatgatctcgcagttgggcggcgatgagactgcgacatcactggtaatccgccaaagctccagaatgtgatccacgggatggaataaagggaaaaacaacccatgtttctggcaaacataacccttcctcctgtctgggacagattgcagccttctggagacagtcagggaaacagaggaagcatggagtcactcttgctcatttttccctaa

SEQ ID NO: 41270 - DNA, 1349 bp, Bovine  19866880817704
tgcccacatacttatatctggatatctaaagagaaagtaaggagaaggcaatggcaccccactccagtactcttgcctggaaaatcctatggacagaggagcctggtaggctgcagtccatggggttgcgaagagtcagatacgactgacgacttgactttcatttttcactttaatgcattggagaaggaaatggcaacccactccagtgttcttgcctggagaaacccagggatgggggagcctggtgggctgctgtctacggggtcacacagagtcggacataactgaagtgacttagcagcagcaaagagaaagtaaagaggaatctctaaatttgtgatagtctgagttgaaatgtaggcttagttcctacccataatataagaggtaaattcagtgcaaggagattactttctattatgagggaatagcttccttggtagttcagaaggtaaagaatctgcctgcagtgcaggagaccctgggtttgatccctgggttgggaagatcccctggagaagggaacggtggctacccactccaggattctggcctggagaattccattggacagaggcgcctggcaggctacagttcatggggtcacaaaaagccagacacaactgagtgacttttacataataaaagaggaaaattcaatgcaaggagattactttctattatgagggaataaggctgtaaaactattgatgaatatttgagactgtactcaaaataatggctattcttgcttcattaagcaatgccagatgcttctatatccatttaagaatgatttatttactgtgagactgtttttcctttcctaactgaaacttacatctcatggaaagattcccaacttcagaagagacacaagtaaagaagcaaccttcagaagcagtttagcaactgaaagttttgtattctcaagttggtctggccacctttttcttttcatggttgaggagactgaggcctggaagaatgcagtgacttttgcagtcactcatgttttacgagctttctcgtccatcaaaatttggtgagaaatcatgataagattaattttactcttgttatataataataaaatttgagagagtcaagttcatactctagaggaagtaatattcagaaaggaatttatattaattaaaaagtggtgaataacacaaacaggaagacaaaaatttcaagtatgtcttcctcttttgattgaagttcattaaggccaattttttattattccagtcctttatatttttcatgcatagctgacaacatgagaatgatcctggtaattttctcttgcttcaattctagatgaatgggaggggaaagaa

SEQ ID NO: 41271 - DNA, 1536 bp, Bovine  19866880887009
ttctagtctggagcactgtccctactcagatcatacgtgcttccttttatgttttaccccccacccagatgttttagtcctcacatttaattcagatgatcagggtaggtgtcaacaatggcagtttctcagcagaaaattgtttcttccctaagttaaatctttccccttaagcacggggtttacaaaagtgagccgactatggctcctgctcatgaggagcctggaaagggaaggagccacacagacaggaagagctggcatggggctgcttcacccctgccccctttctcctgggaccctcacttggaggaattcagagaaatgccccatcctgcacgctggcagggagcttcctctagctcctgtcctggcagggctatcatggctgccacatgctgccagcctgcagcagccccgcacacacggcctctgtgcaccatggatggggtttccgcgcaaatgaaagtgagcgccagccgggcaggtcccagtcctgcagcatctcagcagggagagggcacttgggatcactgacacattttctcacccatgtgcttgctgatttctctgcatttacagtttcggcagtgcacaaagaaaccaagcagttcttcactttatataataccctggatgacaaaaaaggtttatttggaaaaagaggtaagagcctttatagaaagaagataacatagatgagtgtgtgtcacgtgcccagtgctgggtacaaggtcagaaagtgcatgattcctcggggctgtcaccgtgcagagtgggcagcggttgtatggtgccctgcgagaggcaccatcctgaaaagaaacatcctggaagcacaagaggtgcatatggagaagggcctggagttggtgaaagttgagtttgagctttaaatgaaggaaggaaccaactaaaggaaatggggaaggtgggccgtcagagctgacctggggaaatggctgtttagtcgtcagcgtcagacagaggcatgaactgaaagaactgctttcaattgtacagtcgagagcaggagtggcaggggtgaccatgagcagctgctccatattgctccgactctcactcaggtcagatctgctggtgactcggagctctctccgtggaaagcagcggctcggggcgggtgtgcagctgtattcagaaacaagcaatggcgtcttcacagctgcagcatgcagcacagtgtggtggcgggggtgggcgctctggagtcattgggtttgggttttagtctgacctcctcaccctcaccacatatcctacagtgatatagaatgaatgagacagtgtccctgaagttcctagcacacagtgatatgtattagttcctgcctacccctcaccttgagggtgacagaatctttttttatttcgttgtcatcctacaacctgcactaattaccactttaataagaatactattacagatgtatcttttacctgaacacaaatggaagcctctgtgcctattgttatcctgactacctattttttattttggggtttttttattta

SEQ ID NO: 41272 - DNA, 1654 bp, Bovine  19866880894563
tgagtggaattactctgtgaaacagaggcttgaagtcagaggcacccagcataaatgtaagccaccttcccccagaatccctcgagagactgggaatgactccaacttcctactgaatattgaacgagatcagagccaacttcatttgaatctcagtggtcaggagacctctagttaatacaaaactgtgctgagtaatttgtaggagtaaggagagcttggcttatgttaggaattacagatcgttgccagtgtaaccataagccctcctttctgctttgcacaagtgagctaagaaatgttggagctcctagctctgtgcgtactgagcatctttaagatgatgacccatgcccaagattttgggagtcatcatattttgagaatgaatatattttgcaccttcccagtatgacttgaaagctctggggaagagaagtacaagcttctaagtacaggaaaagaacattaattgactggtagtagttaaaaaataatgagtaatttgtgttggttttctgctctgatttacatgataaccttttttctcctccacaataaaattcacaaacaacagagacatctgtttattggtctcctgtctcccatcagcatccattaggcatctggatgggggtgacaggagcttctaactcttctatccctcccctagccgaacatctgattccactttccacattgcacccagaagggcccctcagcaagctgtaactaaagctaatttcttttggtgctttttaagtactaatggtgtaccccatttgcagatggaatcatcctggtggaggatgaaaaccaaagagttcctggaaacatcctccctgccccctactccctgccaagtatgcacacttaaaggtgtaaagagggagctttaggtaaagtttcacactggggatccaagggtctcaggtgcctaaggatgcaagagtgacagaaggaggaagctttacaacataccacaaagtatggtacaatcagtccagccaggtacacacttaaaaagaacattatcttcttttggatggttgctatcacttctctccactccagggaggctgtttcaacacagtgcccaatcatctcacctaatgtcaaattactgcagcaataggtccacaaaaagactgtgtggaatcgtgtgactgagctgaaaatttgataagaaatacactcaactgtgtcggagaaggcaatggcaccccactccagtactcttgcctggaaaatcccatggacagaggagcctggtgcactgcagtccatggggtctcgaagagtcggacaggactgagcgacttcactttcccttttcactttcctgcactgaagaaggaaatggcaacccattccagtgttcttgcctggaaaatcccagggacaggaggctggtgggctgccatctacggggtcatacagagtcggacacgactgaagtgacttagcagcagcagtagcacactcaactgtgtagtaacagagaaaatgttaggagtttggtattcttctttactgctatttttttcccttttgaaagtttaagaacaatttctttttttttaaactctgtctcaagatgtaagattttggttagtgttaggggttaggatcccagtagcaaatacagttagta

SEQ ID NO: 41273 - DNA, 2590 bp, Bovine  19866880924498
agggggtgccaccatgatccccaggataacccatttctcctcccacaacctggggacaacacacaaatagtctacctgctcacaagttgttaggcctgtgagcttctcagcaagatcaccaaagtgttttcctgaacctgagatagtttacagttttaccgtccccaccttcccttgcccctggagctctacctgcactctggcaaccactggcttcagcctcactgagtcctttcaaaatccacaggctaccagcacccacccaggcggagaagtacatgatcaggaacagtgccatcagcacgtgggggcacggggagcagcctcctcactgggcgggccttgctggaccagcacagaagccaagggtcattgatccagcatgagattctttaagtctgtacacaccagccctgcttactccacacattagggaactaaaaccgagcacaatgtccctgcagctgcacgcagcatgctcactgcacgtttaagcttttatgtttcatagcccaaacctgctgactggtacctgcaaggcttgtgtggaatgatgtgcaagccttgctcatgctgggttcactgaccctgagcgattcctgagggccggggcagaaggggctgtttggatggactccttccgggagaaaccgtaaagccctctgtctttccttcaaggctctgcaaagggtgagtctctgcccaccttcccggactagtctctaaagccccctgcagagactggccaccccacccctctcccaacaagcatgccttatactctccctgcactctttgagttttaatcacatctgtactttatccaaaatggcttttccactaatctctattcaactgtgattcctccttcggatccagcccaacccagctggctccgtgaaaactcctggatctctgcacacctggctgctcttcctgctcggacaccctcagcacctgctcaaggccggtccctccaggatttacacactggcctggacgggggtgactgtgggcgagcctgcctctgggtccagccctgacctatgcacagcagggagcatgtgatgtactcctagtgaggatgcacaagaccacccacagactggctgagactcacaggagagcagggagcggtgaggtgtcattcttacgtgccaagctgaggtcttttttttttttttttttggtgagatgaacttgggtgagtgtgatgaagccaagggcagacactgagttttcattctagttgctacaccattaaggttgctgagcagcccccgagggaccaggaacaaaaggcatcacggcaagtgagaggcccaagtgaccaatattcacatgggctggtcgttcagctaaaagccttgtttactaagaaaagaaaagtccccgtgatcaagctctggggccacgtgctggaagcctgggtgcagggtctgtgtcctcctgctcagtgcttcctcctcagcagctgctcaattaacattactgaacaaatgaattcctctttattcagagtccattcaaatacaggtaccttcatatgtgcaatgttactggagaaataaaagtagaatcgacacagagaacaaacactgcccacatttcttcactggaggatgggtgttatccaagccacaatgtctgcaccgtccgatcccatggacaacagccaccatggagatgaaatgtgagcaaacaggaggaaggaaatatcccgtgttgagatcatcacacctacatctctgctgcagtgtccagaaccatttcaccatctcggagctgatacatggcgtttagacgaagacatcaatgacgtgcgatgatgtctgggaatgttcaagaggccttggctttcactttggacagcaacatctcgttcttgcggccttcctgcaggggaaacagaaagacagagcagagaggtggggaccgtgttatcgcccacctctgcatccttccctgtccctggagaggcctgtggatcagtggacaggcctccttttccattgccaccagtgtaggggaggttcctggacacacgctgaccttcaaggccccaacagtcacaaagactgactgtcagactgaggacaggagaagattaggcactgtcatccccaaagacttcaatccccaaggggcagaagcagaaagcagacacttctctgatcttggatgcctccagtgaggaaggggaaagtcttggacaccacggcccaaggagtcctaagagacagcagatggagcatgaagaagagctcttactccacaagagcgaaggttaagaataccctcagctttaacagagaaacccacagcagacagagggagagaaacgtatcgagggacacctctcccataaagtgagctgtaggaaacccatcactgagggtgctgcaggatgtggacaaggtcactggcctcatcccctgtgtgcagagtctggcatccagggtacaaggccatggctgtgttgttttgaatccccttcttccacagcatctcactgtgcgtcctcctccccgtttgcagtggccttgatagctcaggatactttcgtctgctcgcacatcatgtccacttc

SEQ ID NO: 41274 - DNA, 1778 bp, Bovine  19866880930881
ctgactaatggggagctgtgttgagatgcccatttacagggcacggtctttacctggtgtcacctgcagaggtgagaccgggtctcaggcttgggatgtggttgcaggttagtatgtatctgtgatgggttggagctgttcctttcctcctggacactgtgcagtccactcaggcagttggctcacaggcatctttggcagctgcttctgactgggcagaggtgcatttaagatataaggggaatgttttcccctcagatgtactcctgaaatagagaaataaagctctgtgagcacgtcgtagagaaaagcttgagctactgtattttttctcatctttttcccatcttcgtgcttctgcctctgtgtgtgtatctgtctgtgtgcatgcctatctgctgtttttctcttttgtgtgtttgtttgttctgttcctttctattgcttctgatgtgtgtctctgctctgtacctgtttgcatctgtttctgtctttctctatctgtccatctgtctgtcagtcacttgattcctctgttgaaacaggggctgatttatccacctcaaggttactaagaatgttagtcagggttctgcagagaaacagaacaaataggagatcatgtttgattatgtaacatgcatacagttatataatcctatggattggcacacatgatcatgaaagtttgcaagtcccaaggtctgcagtcagcaagttggaaacccaggagagtagatggagtaagtttcactttcagtctaagtccaaaggcaggagaagactggcatagcagtttgaagatgggcagagagaaattcttggttattcaacctttctactctattcaagacttcaacagattagatgggatccacccacactaagagggcaatttgctttactcagtctactgatttaaatctactccagcaacaggtacacccagaataatgtttgaccaaatatctggacaccccatggcccagtcaagttgacataaaattaactatcacattatagaagtctgtatgttcaccatcctagaacttctggggtcacagaagtcttaaaacaggctgactgagggtcaaatccaactctcaggcatgtcctgttggtctcccacccttatgcttatgttacatccagtgatgctacatccaaggagcttcactctgtatattatctgccttagtgatgttttctaggtcatgaccaggtatgaggtcactgaatatgtgacccctttcctatctcttctaatagagtataacagcactcggatggtttatttacatcactgagaatatctaaacacatttccaaacttgtgctggcaatattatacagctgaaagaattcagcaatttgactacgcagctacctgatttcttccctgtcctgtcttgagaaccccttccctgattgacatctgtggaaagaagaggatttcagtcattggcactgtttgccagggtgaaccccagggcatttcagttgttgctgttgtccatcaggaaagagggttttcccaaacttactgtctctcatcctagctccttcttttaggtcatctcatgctccttgctcactggaattttgcctgacatcctcagacatctaaatcctttatcagccagggcatagactccagggctgctccagatataaactgtcttgtggaaataccttggagtttgaaaatacaagtttgttagtatatacattctaggatgaatcaatttgtagggcaggaacagaggcacagatgtaga

SEQ ID NO: 41275 - DNA, 874 bp, Bovine  19866880992326
gtacatgtgcctttctcttatgtgacttgagtgttgcaggtagatagtctaggctggtaaggtggctcatgtatcatcagtgttccagcctcctgctatctgccctatttctctgtgcacatggcttctactctccatgtttcctcaggggagaaaactggctgttgcagttctggtcatcataaccacttctaggcaggaaaaaaaggaaagaggaagtataaaaggatacactttcaagttgagtcaaccttctttgcagagttaccttaacacactgtacttttctacaaggaaatctgggaaatgcagtttttatttttaagtttggaacatttcagcttttcattaatatcaagtttcttttattaggaagaagggtaaagtgacattggaaaggcaactagaagtctctgcccattcatcattattatgacatgtcaaactcagtcttcaaactgcttcttttctctatttatcctagctccccaggtgttctcatacactagatttacagtcctctccgcccccttccaagttatctctctagtcctaatctttcctctaaatttcaaaattgaatatttggttatctgctttatgtctctaccaggaatccaataactatctcaagcgtgacacgtctaaacctgaacttgtgcttcttacctttaaactgtgttccctcaccgacttccccatctcagtacatggcgactctggattgctcaggccaagaaagaactctgtagttttctttctctcataatgcaatgtgcatgtgtgtgtgctaagtcacttcagtcgtgtccgactctttgtcaccctatgatcactctttgtgatcctttgtccacaggattctccgggcaaa

SEQ ID NO: 41276 - DNA, 798 bp, Bovine  19866881004269
gcctttatcttgtccctccaagccctgtaccaccatatggtctattctgtgaaaatgattaaacagactttctgccatgggtaaaagctgtatttcccactggatacagcaaaatccctgtaactttatcccagtagagtgagtctagaattctaagtgactcaatgggacaggtagaagagaaagccagtatgctgacaggcccataatttgtggtttctattggcataaagaaaaatacagtccgtgtgctatttcttctggacaaaatggaggtcagaaggctgcattcaaaaataatcttaaacatcaaaggctttgcacaggtgatctctccctagaatgccctttcccatctattcacccaggtttcttaaactcttgtttttttggccgcatcatgtagtatgtaggatcttacttccctgactagggatagaacccccacgctctgcagtagaagcacagttttatccactggatttccagggaatcctcatatcctcaatatttgctgcagtactgtcacatgttccacgtagtgaagttgtctgccttggccaagtctccctgtgatttccaaactctcggggcttttcactattataacatttatcacactgcataagaattttgcatttacttgtctactttacacacacacacacacatacacacacaccctgtttccctaagggttattttaatctctgaaatttcaatgcctgcgtgcatgtgtgctgagtcccttcaatcatgtctgactctttggaccctaggattgtagcctgccaggct

SEQ ID NO: 41277 - DNA, 1874 bp, Bovine  19866881008921
ttttcattgataaataatattacaaatactacaaaagaatttcttgaacagctggtccaacattgtatggtgaaaataaatataatttactatgcacacagatatctaaggaccacaaaagaggaacagctttctgatattcatctccatttcattcttaccaagaaactggtaattattctgggacacagtagtcactcagaaattaataactgtcaaatatctaacaatgtggctaaaggaataatttttggtctagactataattttcttccaggtccttgggatcctttctgctcccagtgtgatagtattaggatgtgggatctttgggaaataattaggattaggtaaagtcatgatggtgaagccctcataaacaggattagtgtccttagggtcacaagagagtttgcttcctctctgctctacataatgtgaggacacaacaataagactacctacaagccatgaaacaggttctcagcagatatctgccagcaccttgatcttggactctccagctccagagttgttgaagccacccaacacatggtaatttttgtagcatcctgagaagaccaagacacaaaacaatgtcgtcaggaaccaattctcaactcttccttctctttgatgacttcatcctcaagatcctcagggctgagcccagcatctcctattcccattggtataatatgaagtccagagaaagaaactctgtttcctataatactgtacccacaacccctgagcagagcctttttgactccaatcttgagccttaggtcttaagcttgttcctgagagagtcacaatgtctgggaagagagaatgcactgattgtcagatcaggaacaaaacagtggtgcccactcttaccacctctattcaacatagtactggaagtcctagtcagagcgattaggcaagataaagaaataaaggattcccaaatcagaaaggaataacactctgcttgtactgatgtgacattacatactgacctaccttattttatccacttcactttgttgagcttcacagatactgcattttttacaagttgaagatttgtggcaaccctgtgtcatttttccaacaatgtttgctcactttatgtctctgtgtcacattttggtaactctcagaacatttcaaccttttccattattatatttgttgtggtgttctaggatcagtgatctttaaaaatatttatttatttatttttgactgtgccgggtcttcattgctgcatgcagtctttttttatttgcagagagtgggatctactctctccttgtggtgccagggcttctcattgcagtgacttctcttgttgggtcacacatgctcttgggcatgcaggcatcagtagttgtggtttgtgggctccagggcacaagtttaacagttatgatgcatggctttaattgctctgcagcatgagggaacttcctggatcagagatcaaaacagtgtgccttgcgttgcaagtcagattcttggccactgaaccactagggaaggcctgtaattaatgaccttagatgttactgttgtaattgttctggggtgccatgaactatgcccataaaagatggtgaacttaaaaaaagaaaagaaagaattcactgatttgctggctcatatcatgtgatcctccatgaagcctgaagtagactcatttccttgaagtatatggactaagaaaggaggattggggcacacctgccaccaaagaaaaggggcatttacaccaggcacaaaagccacacactttccctctaatagtataataatctttcaggcctgtagaatgtttctttaaaactttgggaattgcctataatgtactctggatagtcatt

SEQ ID NO: 41278 - DNA, 711 bp, Bovine  19866881102085
tccttgagagcacaccctcccttgtgattgcagagtccggccgaccgcaagctccgtgggccagatcgtgggcctatgctctgccgagatcaagcagattgtgtctgagtatgcagaaaaggtaggtgggaacccagctgaagccatctcctcagtaatgcccaagaatttgtccttctgcttccctacccctcccagcactgatggaggcaggttgtaattcatctgccacatttgtcagaatatccaccgtgcagcgccatccacatttgcccattagctaaattcattttcttctacagtgactatttttctataaatataaagagaaaacctgtctcttggagcaattattgcatctgatagatggatgccttagggacagcacccacatttttccttctctatcaggcttcctataacttgggcacagtttggtggatgaggctgagggatgaagctttgccacttaggagataaaccccataactcagccaagcccaaggcaaaattttgtgtcctgctttattaaaagggtatagaatgaacaaaagcctgaaagtcatatttcagcattagattttttttccatcctaagaataggcagcaggaccttgaatatttcagggagacagtgattaatcattttgcacataactgatttctggtctggctgagatgtagtatcagtaaaatcagatttacaggggc

SEQ ID NO: 41279 - DNA, 2369 bp, Bovine  19866881105072
atattcactgtattgactgtggtgatggcttcaggtgtaaacaggacaaaatgtatcaaattatatacttaaaacataacaatctttacatgtaaaaacatgtacagattatgatgctaattatacctcgatgaagcagtaagaaacaaatcgtataaggcacggaaccacactgttatcgatataagcagtttataaatgtttcaagtactataacctaggtacatacaacttaaacataacacagagggcgccaagtcgatgactactggaggatgagagatggggtggcagggatggacaggaacgagacatacgttaaaactgtttaacttgcactgtaagctctcaaatggcaaaaccattatagtaagttaccagtaagatcgatgtatatattgcaaactacctctaaggctgaccggcacaacacctcacttggttaaattaaaatgctgacattaatagttttcatacaggaaaaattctcagctacttccaacagctgctctgcaaaccacatgaagatgcaacccacttacttggcagaagtttaatgatttgctttaattcctcttcaaacccaacatccaagatacgatcagcctcatcaataaccagacactgtaggtttttatacataaaccctggggtattctgacaagacaaaggacagaaaaagactgttagctgcgaagtgtacgtttcacacagacagaagatggggcttcacgacagtgtcctcttacctgcatgtggtccaggagacggcctggtgtggccacgacgatgttgatcccattggcaagcttctgagcttcagcagacctgttactgccacccattattaacccgtatgtgtgaacatggtgtgtcatcagctccttaaggacaccaaaagtctgcatggccagttccctagtaggtgagagaataaggactcctgttcctaaaaagtaaaacaggatatatggtcaaagtcaaactgtagttacaccaggagtgcgcccacagtcatgacagacttctagtaagattctcacagagacagcgggctcacaggcttaccattcctgggcatgaactttaacttaacaatgagttcaactgcagggatgagaaatgccagcgttttaccactgcctgtttttgcagctgctagaagatccctaaaaaataaaacagaaaaggagaaacatatttgctctactcatgcagcaagtatttactgaatacctaccatggactacgacacatgtttgaggcattgaggctggattataacaagaaaagagtccccaccttctctatcactgaaatcaatcatgtgggttaaacacttaactcagaaataacaattgtgctaaaaacagaagtgaacacttttctccaacatcaataaataacctaaagccttaaatgaaggttaggtatattatcaaacacaatgtgagatccatagaacatactggtattttttccccgaactattggcactaaaaacagagatattaagtgtgtgtatgtgtgcgtgctcaggcatgtccaactctttgcgaccccatggactgtagcccaccaggctcctctattcatgggatttcccaggcaagaatttccctctccaggggatcttcctgactcagggatcaaacccgcatctcttctatctcctgcactggcaggtaaattccttaccactagcgccacttgggaagcccaggaccaatgcccaaacctcaatgttaaccatacctgccttccagaagtggtctgatacttttatgttgaatttcagtcatgtttgtaaagcccatttcttttattgccttcagagtgttctcattgacaagattagtcagagaatcaaatgaagtatcctcaaaagctcctaaacagaagacagtttatcattaacaaatttaccttttctgaatagttaatattgcgtttcctaaatttgttttgctgattgaaaacattactgggttgatgtcaagcttctttagaagagcttcttccaataagaaaagactaaacaccaaccattcctatataacaagaaaaagatcttatacttgttgcaagtttctccactgctaacggctgtgtaatctaaagcctatactgtaatgaaataacaaagagttggagaggtggtacaatcaagggacttatgtgaaataaaaatgccaaggtgggggcacactggggcaggggtggtggtgtgaggctttcaggggaaaattcagagagaaatgaaatgtttaggaaatctgaaataaagaaagaaaacactcagtataaaaactgagtatgaaatcaatcaaaatagcaactctccaaaaaagacaactagaagagtcaga

SEQ ID NO: 41280 - DNA, 1365 bp, Bovine  19866881189804
ctgtccatcggtgattcaggctttgcaaatgacggctcttctcattttacaccccaggagcagcaggtgatggatcgaaagggtagtgggtgacaagttgttttaagactaacagttcaaagttggagcatttgagccaggctgctggtcataggggagttgaagaggcaggctgaatctcaatgtattcagcacttagtctgcaactggtatagagaccctcaactctgttgtagaaaagattataatatgagcaccaattattaatatactgaacatctattatgtgtcagatcactaaatctcatttagttgtagtcttaaatttttttattggataaggaaaggggttcagaggggtgaaacagcttactcaaagtcacctgaggagcaagagatgaaggtggtccttagacccaggcctgcctgcaagtgcctcactatatcagagccaatcattataatccttggcaaacacaaacttataagcattctgtggcccaggggtggcagtgttctctccagctcatcctcctagaaagttcacttttaggagatgcttttcaaaaggaaaaccaaaaatagataagtacgtgcatgcttggtcgcttagttgtgtgcaactctttgaaaccccatggactgtggccaaaaataaagtagatgatagcagtccagaaagctatactctcttttaggcctaattgcaattaccacataaactcagcctccaattatggtgtatttagcactggaaaatgaaattcattaattattgtgcagctaccactgaaatcttacagcaagtctattctctgaataaagtattttaaaattaatgacatacttatttctgcttattaacaatttaatagttatatgttaagcatttttaattaagcaaaaaacgaaaaaggttggatggagaattgggagataatcaaatcagcagcaccctcaactggaaagcaataaaatcaagacctctggagagacctgtcttcataagagttcaaacaaaagaaagatatttgagctcacccatagtctagtatatgaagtgcactatgtagtaagaatagaggatccttaggatgctctgaaagctcagaggaggatttggaggaatcacactgggagagacaagggagacttcttgggggaagttgaactggttatttaaagactataacagttgaccagtccatgaagtaggagaaagtaaaggagagtagatcattatagagaggcacccattatagagagcctgtgaaaatatatgggttaaaaataggaaactgtgtgatatgttgttcctacaaccagtttggtaaaccagctgtagaataattagactgggggaag

SEQ ID NO: 41281 - DNA, 827 bp, Bovine  19866881265006
gaccctgagacagagcctagatacattttctcacttgcctaatgagcaaagtgacagacagtgaaacagttcacacttgagtaattctctagtcatcagcaactgcagcgggcccctcctgccgggctttggagggggctggtcaggagatgtaataaagagaccccggctctgctgaccagaataagttatcacaaagagagaggtcttggggtacactccccgaggacattgaaccagaaaaaagagtccgtttaaggcatctccaggcattcattcaattagaattaaattaaaacaatggagaaaaagaatcaccttatttctcatcaggccagtggcctgaagggtggctaaaaatctggaaagtgatgccctctcctcaacagtgctcttttaaaccatctcccctcttgtgggccttggtctaatgcaggtttcatttccagggagagtgggcaaatgggagtaggggatggtgtgtgtgtgtgtgtgtgtgtgtgtgtgtgtgtataagacaaaaataatcttttcactgactattttcaggggcctatgagacagttcacgggtcgggggctgtcttgaaaatccactgcttcttctgacattggcagtgggctctgtgctacttcagtagttagtgttagttgctcggtcgtgtccgactgttggtgaccccatggactgtagtccaccaggcttctctgtccacggaattctccaggcaagaatattggagtgggtagccatgcccttctccaggagatcttcccaacccagggactgaacccatgtctgtcacattgcagggaattctttaccat

SEQ ID NO: 41282 - DNA, 2132 bp, Bovine  19866880112692
acccagcaatcctactgctgggcatacacactgaggaaaccagaattgaaagagacacgtgtaccccaatgttcatcgcagcactgtttataatagccaggacatggaagcaacctagatgtccatcagcagatgaatggataagaaagctgtggtacatatacacaatggagtattactcagccattaaaaagaatacatttgaatcagttctgatgaggtggatgaaactggagcctattatacagagtgaagtaagccagaaagaaaaacaccaatacagtatactaatgcatatatatggaatttagaaagctggaaaaacaaccctgtatgcgagacagcaaaagagacacagatgtatagaacagtcttttgactctgtgggaggggaagggggatgatttgggagaatggcattaaaacatgtataatatcatataagaaacaaatcgccagtccaggttcaatgcaggatataggaagcttggggctggtgcactgggatgacccagagggatggtatggggagggaggtgggaggggggttcaggatgcggaacacgtgtacacccgtggtggattcatgttgatgtatggcaaaaccaatacaatattgtaaagtaaaaaaaattttaaaaagaggatgaaacgattagatagcattactgattcaatggacatgaatttgagcaaaatccaggagatagcggaggacagaggagcctggcatgctgcaatccatggggtggcaaagagttggaaatgacttagagactgaacagcaacaagaacagaatgcattaggattcctaggagcgcttgtcatttgagggctttccttgtactcctgaagttctgtacagatgcaacacggagggagctctggaggcctgctttgcatttcccccacccctgcaaagcacacagggcctgccccaactgggagactcagatcgatggcccagggtcctcctggcttgtgagctgtggggacccttcaccttgggtagtcactgggcaggtgcggatagttcccctgccccagccaaaggtgaagcactgtccacatgccccacactcacacacgtgcgcctcaccccaagaacccaggatactcttggtgtatgaattgactctgttgtgttggaacatgtttctggatgtagctgctgttacaatgatgggagggggcaaagaaggcctggcatgccagtcctcagggtaagactgtgcatgattcctggaatgccgagctcctgggctgggcttcacacctgctgccttggctgtgccaggccctaggggcaagcagcagaggcctgatgggagcctgggggaggccaacctccacccagaagggtggtctcccagccccgctgattagaagggaggtccttctcccttcttggtgcaaatgcttgtaaacccacgaagcggaggtccatgccctgctcaggcccagatgacatctggacagcgcatcacactgaaaggaagaagagtagttaccaaggtgtcggggagcatcaccacggggcagcaggagtgccggagcagccggcccatcttccagacggagagcagcgccaccaccaggatcagcatgaagcccacgaaggcaaacagggccagcgccagaggcagggcctctcctgaaaacagaaaagacagaaaccggcttaggagacagccctgaagaccaactcacttaccagtcctgggcctccctggccttcccgggattggctctgcagacggatcaagagagcagactccggcaccctgagatctgacatatgccccagggacaagagtgaccaccattcaatcgtttttctagaatccagattggtttccagaaagccaaggaagattacagtctttttcttgggaaggaaaagggaggagcctcgtgcattaagcactagctgtgtttgcacacaccttggcaccactgccagaaggaaggcagagagccaggcccccaggcaggatgagggggcggtgcccaagagcacagcccagaagggagctgggcggtaactgaaaacaaagtgtgcttcacaattttctcttggcgttgatctgtattacggaggaaaatattaattcagaacacagtcacataa

SEQ ID NO: 41283 - DNA, 3524 bp, Bovine  19866880501810
attgggaaaatttcaactaattttataattcaattttttgatacaggatttaaagagttttccttgtgagtaaataattaggagaaactctgagactattaaatctggatgttatttccaaactaaagcctaaaacctataaactatgtaaagaaatgagtatattagcttcaagcagatggatatatttctatgatgggaggtgcaaaaaaaaaaaaaaaaaaaaggggaaagcaaaagaaggggaaatatctcaaaagaatcatcttttcagtgcaattaaaaattatctcagtgcagataagaagaaaaagatatatgagaacactaaagtagttcaacaggtaaatcaacaaaaattcagatttttaataatcacatagagaaatgaggcaaaaagccaaatagacaaggatatataaagaatagtaaacagcaattaaaatattataaaagattaaagcctataatgaacacaggtgtgtaaaaactgctaaggatgataaaagtttggataaagcctgtttcttgaacccaagatagtactgctgagggacgacaaggaaaaccatggtaagctcatattcatccaaccaagtcctatttagatattactattggaagcctgccctagttgctcacttaagtgtctatatatctgtgcttgctttgtaatttatacatctatcaccacaataatcatgctgaggttttgttttacatctagtggaaagagttaagctttaagttagagaaatcaaatgtcagtttttgctactttaatagttgtgtgacctttgaaagttactttgcttctctgagccttgatttccttttctataaatgttgatttcctaaatcacagttactgcagtcaacaaagataatataaaagccttagagcagtctcttgaatgtaaatggcatagaacacaggcagctattcattattagcatgttatataatgtttacatttcagtttctctgtaatctagaactgccatactacagaaattgtatcttatttaaacctctggctaccaacatagtactcacatgggagttgtctagcaaaatatttagttactgtgtcataactagaatggagcccaaacatggacaaagacacaagtgaatgaatggcatacacaatattctgaacatgggcaaaataaaatactgtctctgacataaaaacaaggcaaaaatacatacaccgataagtatgcctgttaggttttatcataaagatttttgaggactactttttttgagtgtcagaaacaaaatggagcttctgggaagagcagccaggaagtcggagactttagaatggtgtaaaactctcaacatctccttacctcctgcaggaaaaaaatcccaaattctcacacaacatatacggtctaacctcatttaatatctttaaatcttacctctagctccattctcataagcaatctatgttgctgtatcaaattacttgcattttcctcaatttcctttgtctttgtacaggtagtccaatgtgcctgaaagccctttaactagttctttgcttgactaatgaatgcttctcatctcagacttagttcaaaaggcatgtctaatggttttcattaaccctcatatttcttaagagtgtatctattttatatatttccaggaacccctatacatatctctctacactgcagaaatgcaactgtctaatcacttgattgtctccagctttagaccactttggagtaggaatttaaaaatctttgttaactttagtgcctggcaggtagcattgtaggcacacatataaacgtatctggagagatgtcatagggaagagagagttttcttccataagaagtgtccatggctttaagaaaataaaacagcattctttcttataaatgtaaggaactcctacttaatggaattgatataatggtatagagtgataaaaaactcataaaaaagagaaattttaaatatgtcagaaaaccatcaataatatttaggtaaaagctgtcaattttagcttgctcactactctttcgtttttagttgcaaacttctaaggcacttaggtggaatgagaaaaacaagaatatgaagctactaccttaatcaatcaataaatgtccttgacccattaaaaaaaagactatcaaactataccttcatgtagtgtttaaagatgtctgcagctgcatgcatgtcaacaatatcatagatgataagtttgctgaaggcagcaagtagattccttctcttgtgtaaggcctcaattttattagcttcatcttcttcatcaccctctaaccacagaaaataaattagttatgaactttgggccctttatccaaggtaaaacattgtagacaatctgtagaacaaataactaggatataactttacaaataggtacaatttagttttagataggataaaaattattagccgtactgattattttagggtgctacacttggttacatatttattaaacactaggcactaagtttctaggagattatcatagcaaagactagttagagaagcaaaccatatataggttttttccttatacttttgtcataacaatactgttgtccttttacctgaatattccttatgtgctaatctatttctacagagaagaaatttatagaaaaatttaagacacagggaaaagttttcttttagaaacatatatggggaggaatggaaattacatgaaggagttagttttcagttcttgtcttaaatgtggttacattataagctgagaaataaagtatattttgcaaaccatgttatgtacatacacatttttaaaaacaaatcattatcaaatgctttcaaacaagtggtgtttattcctcattttttagattctcaggtttatctatttctaatccccctcaaaatatctccacaagtctcagacgataaaagatgacacagttgtttcaggttctgtactgaccctctcatgtcttggcctgcccttatttagggacagtgttctttttctcttcttcacaagtgtattcataaaataacttattctcaacttctctcttccctttctattacctgggcctgctgtgaagcatcagtgcttttggaagttggaaatctttttgcttaggacaagtagcaggtaaatattgtttcctgagattaacatgaactcagagatccttttttcacagtctagtattttctaaaatgttctgttaaataaagaacattccaatagcaccaggtagatctgtggatttgatatgccatggatcttacttaagagagcttaaatcatctatttcacaaataacctattttatatagtatttatttataattatttatattcagtcttattttgctaagttttcattctgcaggctcagaacaattttgactggtgaggtttcataatattctcttagagtttagtatcttagagtaacattttgttaatttaagtaatataggatcactcctcaggaacagaaaggaa

SEQ ID NO: 41284 - DNA, 852 bp, Bovine  19866880576357
cttagttaagaatatgcaatcagcagataatagattctaagtttactactggtcaaaatgaagtaaaaagggtagtatcatgtgatatataattttttgttttctggcaaaagaaagcacaccaaattcatctgcagagaaactatgttttctagagctaaattccaaaaagttttatgaatccttgaaagcactggcaaattggaaacatcactttcatccttagctgtttataaatagtgtaaattgagaatttataaaggtgtatataattttctttcaaataaactttacacagatgtggttcttattgaattcatcaggagaaaaccagcatcactataaagactcatccattcatcaaaaccaagactctaatttcttacttacctccaaaccccttctcctaaacctggtttctagataaaaaattagtatcttcactcatttccactttaaaattcttggccttttcaagaggatttgattagatacataatttaagaactgggaattccccataatgagtgagcacaatttaactcttgtctccttcaaaatagctaagtcaatatccacagaaacactcaccctggtcattgtatcgagatagatcggcctggctgatgtagaggtcatgatcactatctagttcccagaatttacaataaataacatagaagtgttcataggagaagtaatctgtgatttggtttatatcttcctcttcttccaaaagggctagagtctgaaatggtatgaataaaaggattattttattttaaaaatacggagacccagctttggccattattcagattctagtacatttttattctaaactgaattaaa

SEQ ID NO: 41285 - DNA, 3189 bp, Bovine  19866880620533
tcaaactgatgtcatatacagtcatcgttactgcttgaaaaagtgttacatttatctgaaggttgtctatctttgagggcatctagttttcattaccatgccatcctgaaattgaatggtacagttaaatcaagcccagtgtatactctgtaatagagatgtatctattgatgtagtgttgaaagtgagaaagacaattatttcaaaattttctgtaaccagtttctatgtatatggaagtacacaaagcacatagttcattcaatgaaaggcagatgcaggttattacctacacttgaagattagctgtgggaagagatgggctctgagtcctttattctttcttttcagtatgttatgaaatattttaaatgttagcttttttaaataccagaattcctgcagacagaggccacttttatctgaagcatagaacccctgatattgcatccctcaaacagaagttaaaactatactggtaccttctggaccgcaaagggatctctctgttcatggtctaagtatttctccagattaaagaaagtgtcataaaagatgtgagccattctgcatctcttcaggtctcgtagagttattttgcctgtgtaagaacaaatctggtaaatttcaaaggcttttttcgaagtgaaaaaaaaacttttactgaagtttaaaaggatatatggatatgcttacttgattataaaaatttgatgttttttgaggtaaagttcacataaaattcaccactttaaccattctaatggtttttcacacattcacactgttgcacaagcatcaccactataacattccgtagcatttccttcacccccaaaggaaactctgtacccgtcaaacaggctcactcccctcccctctgcaatcctccccaactggctaccactaatctgctttctaaatttgccattaattgttagttctatgccaacaataaaggagaaacttaaatatttctgtatttagaaagcctgtatggaagactgggaagttaaataatttagaacaatccaggattacaacccccactctgttatgtagatggacaatgcaacttggctctttattcagtcttaccatcactggctggctttaccaggtcaagcatctggcacaacaaatcatggaatggcaagggctcaatgcccatggcttccatccgttcacactgctcctcgtagaagtattccagctcgtacatggagagcactccatccccatccacatccatacagcggaaccagtactcaatgctaggaggtaaggatactcattagcaatggcctgttaaagctcttttattcactcagatttattactgtttgcttcttttaaaagttatatatgggtatactttggacttagacatagttttacaaaatttattagaaacaatggcagtcatctttttaaattttgtcttccccagatccaggcattttcaacacttgcttattttgttttttatctttacatttcagttaagatgtctatattgttcctttcttgcatttctgatttaaggactgtggtttaattttgcactatgaaagatgaggtttcagttcttttgctactcattccaccttacccacatgccctttctaacctcagcatagacaaattactcaacattcagagtttataactttacattttccttttatctcttttatttgtttagttttgggatatagtacatgctactaattcaactaattcaaaggcttctgccagttttctatgtccataatcagccccattgggtattctagcaatttcatttccttgaaatcattttcagttccctctgacctactccaatctgggctggttgatctctaggcctgatttacagtttcaccctagggattcccttcacctttctcctgttccttatatctcacattttcctcattcttggtttgcttccttgtttggtataacacattcttcagtatcttcctaaacaagggagcatagcaggtacattttttggatgttagatcattgaaaataccctttatctaccccctaatgtggttggtatttatacagttatggcttgatggttctttccttcagaattttaaaggcactgactcattgtcctcaatttatccactgttgctgagaagtctaaagccactgatctttgactgcaaccctgtttgttgcctacagaggtttctgagttcctggtgttttaaaataaaactgatgaagtgccttggtctggaccaaattcacttttgctgggctaagagcctcctcagtttggaaactagtattcttaaattcttggacattttcttaaaattgttttgtttcttctctgcttctctttccccttatccactctatttctggaattcttgttattcaaatcagcatggtccaatatggtgaccactagccatatgtggataacccaatttgagatgtctttttttttttttataaatttgttttctgttaatttttgtttatttatttggctgtgctggatattagttgcagcatgtgggatctagttctctgaccagggactgaacccggtccccctgcattgggagtgcagaatcttagccactggaccaccaggaaaatccctgggaggtctttaagtgcaaatacagattctgaagactttgtaagaaaaaaacagtaaaacatcttatcaatagttttatactgattacatattggaaaaatattttagatatatggtattaaataagagatgtaagtaaaattaatcctgtgtttctttttactttcttactgtggttgctactgctgctgctgctaagttgcttcagtcatgtccgattctgtgtgaccccatagacggcagcccaccaggctcccccatccctgggattctccaggcaagaatactggagtgggttgccatttccttctccatcttactgtggttaattttacttaaaaaattaaaaaaaaaaaaacatatttaaagtaaaaattgtatgtatttaaggtatataacaaaataatgtgatatagacagtgaaacaatgactacagtaaagctacttaacatagcatctccccacaatattactattttgcaggatagtagggatgtagagtacctgaaatctaccctcttaaggaattttcagcatttaaaacaatattaaa

SEQ ID NO: 41286 - DNA, 1128 bp, Bovine  19866880696875
tgatgctgggaaagattgagggcaggaggagaaggggacgacagaggatgagatggttggatggcatcattgactcaatggacatgagttcgggtaaattctgggagttggtgatggacagggaggcctggcgtgctgtggttcatggggtcacaaagagtcggacatgactgagggactgaaatgactgactgactagttcctaagcatgtctgacttttcgttagaaactaacctgaagctgtggcattccctgaggtgaactcgccttgtcagcttgtctgtctccttggtcccagatggagttggctgttctacctgcccctcagaacctctctgtgcaatcaaccaacatgaagcacgtcttgacatggagcccagtgactgtgcctgaagaaatagtacactattctgtcgagtaccaggggtgagcgtttgttgttgttgttgctgttgttttgtttttcagtttctctcctttaggcagtagttgattcctagaggcacagccctcattccagagctcaagaaggctttgtgagcccagagaaagatgatttcctatgatctgcctcctctgtcttcatgggccctaagagaattgaagcaacaagggaaattgtcccatggatttggcagtgaactctctgggaacacaaaagtatataaacacattttcgtgaagtttctttccaacagtgagtcagttgtctaaagccgaagaaaatcttaagatgaaatgagtttggctctgacttgaggaagagaaattatttggagactcagatattttaggggtcggtgagacctcagttttcctgacagtacacttgcccccaggagccaaaacaaattgtgaccctataggtcagctggtccttctccaggtgtccaggctctcagagctgtcaaggagtgacagggatgcagaaggtactcagtaaagctcactaacaattcatacaaaccaagcagctacatgcatagacattctcctaggctcaggggtacagaccacaaagtttccaggcagaagaagattacatttagaggaggagacagtaaaaacttaaagaaataagtacactaggtctgcactgtccaatgggagccactagacacggacag

SEQ ID NO: 41287 - DNA, 2220 bp, Bovine  19866880887600
atatagcttgccttgcctcagtaaaagtccagagatgctgacttggtaaaaagtgctaattaataacaaatcatatgtcaatataaaaatcaatcatataccaacacaatgatgttaaacaatgagatataaaagaaatgtttactttcccaagagtctgagaggcactcattattgttaaatagtgataaccttccagcataatgaggccatctatcatatgatgattttacccatattttctaatttttccataattcattttagaaaaaatagaacagaatcaatcaagatgctattaataaaattctgtacggttaatccctctttgttcaaattagcatttttaccttagaagcgagaaatatccattattaatctatttctaatgtagaaaattatgtaggtgagaaaaaagcaaaaaataaaaaagataagccaacattcaatttctaaagtactgtcagagactataacagcaaatgactgagtataatataactataaatctgaaaaatagatcctttgagaatagaattgtctttataataccaaagaacaaagtggtaaaacaaagggaatcctacttagttttgacctggaggagaaaaatattttttcatgaaaatttcatgaaactggagaaagaaaatatggccaatcccagattgtaaatccaccgaaatattacttatatatattaattccacaaactgtgttctaatatgtcttaactatttagctatctatttatctatgtaccttcacaacaaaggcacttaactatgaagattgttaatgaaaagtttactacaaagtaaagcttctttattgaagataaatcagacaaacaggagagtatgctttacaagtacaattaaaagaatagaaaaaataaggaaaatgtaatataaaatctaattgttaacagtctgtttcaatttaatagtaaaaagaatttcaaaaataaaagggaaagttcagtttatcaccaatggaaaatgaaactacttctacctggagaacagacaaacgtgaaaaactacaaaatgatgaaaaattttaataaaaatgtggcaaaatatacaattaaatgcaatgcataaacactaacaaattgggacacactattaattaataacaagaaaatggggtattggtaaacagattaaaagtactactgataagatcactctgatgacttatgaagttctaaaacttatcttgtctgtaccctagaaaacaactaacctgattgtctctcttctcagctaagatataagcaatgtcaaggagcattttattccaaagccgataatcatatctggccataactgccttgttaactgtccatgcacatagtctttgaagcagaggattaaatgttcctgcccattttatctagtccccaagactcgtcctgcaaagtgaataaaaacgattatctttaaatctatccctcatacatatactataaaagaaaaaaaaggggaagggagaaccagagaagagattaaagatgaaaagaaaataatccttgaaaagatggaaattattatccagcctggaattaaattctcagcaagatttccacactttgttgaagggtaggactggtgtctcactttttatgaaactgaactttggaagacacgatcattaatgtacgaagagaaattactgtagtattctgaagtaaatttgagaataacttgaaaaataggttagcttttgaaaaataaggatacacataacattgatctcctatttttcctggtacaatgcatctgaaaaacagccaaataaatggaaattgctgtacacagacagaagaatgatagatgaaaagtaaatagaaaatataacgaaaagaaaaaagtacatataaagggcagaaaataataaaagtcatgaaattagaaaatatatatagtatcaggtaactttttaagtaataagtagtatatttatagtaccttgtcaaaaaagctacaacttggtacaaagtctctcacaacacagaataaaatgtgcttgatgtttgttctatcagaaaattttttcaacaataaactgtgattttacctttataaaaaagataaaattaagtaaaagatctgcctctttacctaataaataggaaagggatactcttaaatctcatttttgtaatggtaatgtgtataaattgaatatagtcagttattgctactaaaaggg

SEQ ID NO: 41288 - DNA, 1309 bp, Bovine  19866880899222
acctttattacagatttgtaggatttgctatgtatgattaaaaatattttcctataatctgtcattggttttttaattttgttcagagtgttggttgatgtataaagctgtttaagtctatattgtggcttctctcctggaggacttccctactccagtatataaaaatatccttttatattctttcaaacttttaattttatatatatatatataatccacctagtagttattttggctacatgttcagtagggctatttatagccatttctccaaatacatagtcaatggacccatcacctattaaaaaggaggtgatcctttccccactgacctttatcaaaggctaaatatatacatacatacatacatacatacatacatacatacatacatacctatagccactactacccctcatctctactttaatactaggcatttattaggaatcttccttaggaaatacatgtgacatattttcttatttggatactactgttgccccttttattattaaatacttttgaaatgtatttttatatttgttctttaaaaatgatcacttttaaaatatccaatttggcatttcatttggtctaagagtagatcaccttaggatttcacccatttgaaatgtaaactataggactgtcttcctaaagaaaagacacataacacatctttgtaccagaaagtatccatagtaatgtattaatataatgatctaatttaaatgaggtaagataactagcatataataataagcacatgccaatactcaatagtattaattctactcatttcttttccttcaaatttcttacctgctgtaaactgagaatgagggtcttggcacactgaattttatcaatttgcctagttttactcaatgtttccttaataatatcaccatagtcattgtaatactgtaaggaaaagaaatacagctttaaaactgttgacatttcatgagataaagaacaggctggtgaaaaaaacggaaaggtgagtaaagacatgtttaatttttcatgttaaaaacctaatgagagttaaaagatattgtctaatgttaaatatatacacattggacatttaaaattatgaaataaataataaaactagataactaggaaattcaaagaggagaagtgatatatgtgagcaaaattactcattctttacaacatggattcaacagacaccacttgtccagatcaagaaacagaactctgacagaaacatcttgaagaactaaaacctaaacagtcaaaattgcttacttctggggagagggcctaaaca

SEQ ID NO: 41289 - DNA, 2288 bp, Bovine  19866881067424
cttgaccctttgcatttcccatattttacaactttgagatataattgatatatggtgaactgtacacatttaagttgtgtaattaagagttttttgatgtatgtttatagccatgaagctatgaccacaattaagataatgaacatagccattacttcccaaagtgtcttcttgtatcattgtaattcattctttcctacctcccagccctgtcctcaggttcatctgctttttatcacactagattaatttgcatttttttataatattatgttgatataaacagaatcatacaaaatgacattttacaaaataatattttgtatgtacaaaatatgtacaaaaagtatgtactttttttttcattcacagttttctaaaaaactgagtctttgttgctgtgcatgagctttctctagttgcgacaagcagggcctattctagctgtgggtgcatgcttctcattgtggtggcttctcttgttgcggagcgtgggttctatgcatgtgggtttcagtagttgcggtcctcgggcgtagttgcaggactaatcttccgggaccagggattgaacctgtgtcgcctgcgttggcaggtggactcttcaccactggaccactagggaggtccactgtgtactctctttttgtttgttttgtgacatggggctggtttcattcacttaggataattattttgagattcacttgttgatggaattgggctgttactaatttttggctgttacaagtcatgctcttatgaacatatgtttgagtccatgtgtagagtggagaagagagacctctcctagctaggccattctagcaagattccaaacacagagccataaaataaagattgatacacacaggtaataatctaagcactgatgtcctttacataaaaacatctatccagtaagaaaataggcaaagaacatgaacagtgagttgacagaaaattgtaagatatttattgcaagattgcttgctatagcaaaactctggaaacaatctaaaagaccatcagtaggtgacagcagtaaatatgtgatacgtattttactatcctcatgtggaatgatcatcaggaagttccagaacagtgtgtggggcactgtgctagagagaaaataagaaggaaaaaatatataaatgctcccatatgcatggatgtcagagaaactgacagcagttgcctttggggatggaaattggaggcctggaaataagggctggcacgtagacttacattccactgtatcccctattctggttaaatattttataatatgtctttattatctttaagttagaaactagaaaccaaagcctatcagtgtctcagaacaccaaacattgattattatcattatctccagatggcttcacttaaagtgactggttcattttaggcgagctgcagaccagtgcctttcttcatctgtaaataaggtgataatagtacctaggctttaatgacagagtctggtgaagtgcttagaaaagtccttagtgcatagcaaggtctgcaccagggccgcttgttagggtgtggccctacagatgagtgaccctgaaatgttagctatactacaggtcattctgctgagagagaaccaggcaacaaagattttttgatggcaaggcagggaaaacatggctctttactttggttaggcatctgtgagcgtatcctaacctggttctgccaccatgtcaccaccttctctgagactgaactttctggaattctctggtttcaggacacctcctacttattcatcactggccctgacgttgtgaagtctgtcaccaatgaggacgttactcaggaggaactcgggggtgccaggacccacaccaccatgtcaggtgaggggccttgaggctcacctcactgtcgtcagacacggagaggaggcgttgctagagctgacagtctgttacaaatatcgctttatcgacagagtttatttgaatagactgtagtgtgatgtattatctacagatagtaataaatgtggatttatatctcaaactcgttaactaatggggtacttctaatgcttttctagtctttgaaaatgttgaactaactagaatgatggctgtaagaattatgattcatgtgcatatagttgaacttaaaaaattgcatttttgatgtgactttttaaaaagaaaataattatttggctatgctgagtcttagttgaggcaagcgaggatctttagttgtggcatggtgggatctagttccctgatcagggattgaatccaggc

SEQ ID NO: 41290 - DNA, 1728 bp, Bovine  19866881121438
caaatgtattaaggctagttctgcagattcctgggatggaagtataatagctagaatgaacagaaataatgactggcacatgtgtggtctgacaaaggatttgtaggcagttttaggatgtctgcgagttatggtttgattccagtttggggattctgactttacaggggcaaagggatagaatattcaattcagggcttgtcaggaaatctaagatacatggtagctataagcacagaataaaatgttaactagtcctcttagtttgaagtctatattgctgtagaaataggagtagatgaattttacccttatacttttaagaacagatatcctaagatatccctggtggctcagacagtaaagtgtctgcctgcagtgtgggagacccgggtttgatccctgggttgggaagatcccctggagaaggaaatggcaacccactccagtattcttgcctggagaatcccatggatggaggagccggatagattatagtccacggggtcgcaaagagttggacacgactgagcgacttcactcactcatcctaagccatttacataaaatgaattatcggaaatactttagaagttggatatttggttcaaagaatttccttattgacccattcaatcacttcaaatttggtaaagtttcctaatacgtaccatttacttttctatcttagaaagttgatcctatttattttttgatggctaaggatctcttgcagttccaggtcatgagccatcagtaattcttattttggctgtagatataaaatttttggattaaatatattctaattttgaacttgaaggaagggacagagtttatttttattaccagccacaatgcctggcataaattaccagtgcatatctactgaaataaaatttatttaattttaaacttctctggtcttctgactaacctacagtgtcgtactttccagtactaattgaactaaatgtacatctcataaatagtaattcaatatatgtttatatttaacataaaggagaaattcacctttaaaaacatccagtgggaaataattctaaattatctaaatgtccgaaggtagggaatatggatgtgttattgcttgagagagtactctgaagcattaaaagtcatgtttttgaacacactagtaacattaagcatcaaaaagaaatacaccaaagtatacataatggttatctctggatgactgaactgaggatgattttaatctttttatatttttcaatttttcttcagcaaagcctgtctttctctactaatcagataaagactcagaaaattgtgtttaatctaggttaatcaaatgtaaagctgttggtgaaataccagaatatcctgtaagaatgtatttttaggataatgtgaaagactcaactaaaaatctgaagtaatcaagtttttgtcagataggtagagaagtttgtttctaattattacaggtcccagtttctcaagatagcaacatggaggaccctttagcctacttttcacaattcttgtggcgttttaaactttattgcaaaaaccataagaaagttaattataaattaattgggtgtcatataacttgttatcttcatgtatgtgacatgtttagttggccagaggtatgtaactgttacctgtttctggcttcccctatgaccttggctgaatttatacaaatgctgttgtatgctcttatcacactgtgtg

SEQ ID NO: 41291 - DNA, 703 bp, Bovine  19866881144393
ttaaaaatagagcttggtgtataagagaatccaggcaggactcttgtagctccagtttctatgcagtaaagatttcctcaccttcacgaaactattattggtcatccattttcccctttgtttcactcttcctgcctcattcactgttccttactgccagtatccattcctgtcttgtatctcattccctcaaaaggttttatatcttgtggttgttgattctgctatgcctaatttcagtaattactgtttttgataagtgaaaacaaaaattgtctgggtggatgccgtggacttaatagcagatgtatggatggctacctgttaagtagaaagaatactaagattgggaatcaatagactaagcttctgtttctgtttgtaactagctatgtaattgtatggaagtccatcttggttaaaatgagactgtggaacaagttgatttccaaggtcattcccaactctaatgtgctttttatgattcattgaacatttattaggtgctggcttatgtgccaacactggcttaaagacacagagataaattaagtttctggccttgagtaagtggagaaggcaatggcaacccactctagtactcttgcctggaaaatcccatggacggaggagcctggtaggctgcagtccacggggtcgctaagagtcggacacgactgagcagcttcactttcacttttca

SEQ ID NO: 41292 - DNA, 1213 bp, Bovine  19866881311348
tgttgtgaagttatatttcaaaaccttacattgtaaaagataaaaaatagctatgtagccacaaagctaaatttctgtgtagctttcagaggtaacagaataccctggaaagatacagaaattgtcagaaaatctggttcttaagagtttttgtaaggtacttaaaaacttttttatcattcagttttcaattatgaaatgaggatgcacagtgtttttagatatatgtctcccacaacattttctcactgataagagtgacgagaatattttgttaaaactttccttgaaaagtctaacatttgttactttaaaaaattgataattggcaaaactaatacaattatgtaaagtttaaaaataaaataaaatttaaaaaaaattggtcaaataatagttgtttttggtaagtttcagtaaaccagattgtgtataacagtgtctatttagctcacttacttgtggagtgtggcaactgcttctcgtgtcttgatctggtccaatccgaatgtaagggcaaagcgacgtgccaattctttaatgccactgacatgggcagatgtcctatctaggttgggcccttgctcttgaacaagttcattaaacaactggtagaaagaaaaaaagaggaaaaagttcatagctaagaaatatttatttattgttagaataggtaatacaatttaaaaaatatttaaaagccatatggtaagatacgtatttcccttcttgtattaacagtagccacactttccccttctccaagtcatctactattatctactatttctcaagctcattttcatgctagttgtgtgattacatgcaaaccagaatttatttttctaccaaaaggaacatattttgggttggggaaaatgtttacaaaaatatactatgtattctttttgttgttttcacaggaatggcaatatgcagggttcagaactttgtttctcactcattacatcttagacaagaacattatgtaaaagaagatcattaagatatatgaaatgttttttcccatccaatgacaaaatacacaaaaaatgttctaaaactgagtgatgggattttataatcacatacacattacgtgtattgcatcaaaataacagaatcaaaactctggaatactaaagaatataaaagccatcgtcattccgccaccaaagttagacactttacatgtatctgcgtcctcttttat

SEQ ID NO: 41293 - DNA, 756 bp, Bovine  19866881404544
tcttgccggtaccccttcccactggaggatgtgcctcagcagcttgacgaattgtacaaaccatgagctctataagagcactctcctgacggtcggacattgctaaagtcaaacaaaacacattagcataagtagatagttttataatagccacatatcaaaaatgcacacaatataaaaaaaaacctgcacactattacttaaagactaaggttaagttctattctttgtcctttttatcttttcaataatatgtatctgtcataagtcaaataagaaagagatacacaaagtaaagaaaaaaaggacaacctctggtttcttctaatacctaatctctcgtaatatcatacttctgaattgggcaatgccaaaattttccgtctatatcatttcaaagtttacatatatttttctttttttagtaaaaaaaaaattaatagattctgagtatctttcaagtgatatgacgtatatgaataattaccttaaataattacaagttattacatagtttgtgtttcacagtttatccaacctgctctattaacattcactcaaattttccccaaattcttgtcacatttataaaaaattcaataacaagtatcataaatacacacattatgtaactaacacttctatttcagcagaataaatgtcaagagagggaataatgagtcaaaggttaaaatcttggtactgacaaatcaataagggtacttactgcaatccacacctccaactgcaatgatg

SEQ ID NO: 41294 - DNA, 1862 bp, Bovine  19866881461236
cttaagacggcttccagctaaagtctgggtgggacgaaggcagtcctttgagtttgatgctgccagcattgtcagcctacaccgattcctgtgtgccttcatttcacccaggcctgctcatcctctggccaccccagacagcaggcactgcaggggccagccttcctcatccagctctcagagcttctccaaagtctaactcgaaggcccaggctgcaagtctcaccttggcaccgggctcccttctccagtaggacacgaagaactcaaaatggggccccagatcttccagcttaataagcaggtggaagccgtccatggtaatctccatcccaggcggggtgaggatggctgttggcaagacaaggggagagtcaaagccagtcccagacaggactgatttctgtccagggagaccatgaccaaaccatcagtggaaacacgccaggctcatgggaggggaggggttttgatgcggcttcatggcatgcagaagcaagactgtactcagcaggtgctcagcaaactctttgtgaatgacgcgcaaatgaaaaaaacaaacaacagccatgtagtacaattcacatagatcagtgacatataccgtctgctgctaactttcaaacatcagcagatcagcagcttgtggatgggttggcctttctagtcccagtccaaggagtcttcatctcatagcgttatggaaagtcagagggttttacaaattccaagaatcagctctagtaattacagcctaagcacaaacaccatctttcatgttattggatccaaaacagagagaccccgcaggccccatggatactttccacttagtagaccaggaaccaaagagcccacacagacagtcttcagtccctgcctactgatgatggatccagaccttcctctcagatccagacactgcaagaccggaagggccaccctaattgtgggctgtggcttgggagtgtgttctggctaaatcctcctgcaccggggtcagtggacactcaacagaaaggcagttcctgcagggagttttcagagaacaaagtatttcctggcatctaaagagctgcttggaaagaggacaggaggacttgggaagtcaggggccaactgtgcaaaacatacccagattagaggtttcatatgagcacacagcaccactagaattgcctctgaaacacctccagtaagaaaggagatgtttgactcctccacttttaagttaaacatgattagaattggatcccctgatctccatctatgtagagaatagaattagacaaaatgaccacatgtcatttccgttcagatgattttctgacaacgttggggcaggaacttctctcctatgtactctacatactcatctcatttaatccaaccagcaagcttcagaaagtaaatattactcctacttacagatgacatagcagagcctcagagaggttacatgacattcccagagtcacccagtgaatggccagactttaagctcatgtcttcccacgtttctagactctgttgtgtggggtgatttttaactcccaaggaacaggatgcacttagatcacttaaatcagactctagggatgggtcccggagatcaggggttctcaagctctcctgtgacttgaatttgcattgaggttaagaacctctgctctcaacaggcttccctttaagaactggggatcctttccaagacagccttaaaaccagatttttcatgtatgaggagaagctggggtgggggttttacaaaggccaaaaagcagacgtcatgccctgaggagtctcagtttcctcccagctctgcagctgggtccaccctgcatgaggaccctcatcctctg

SEQ ID NO: 41295 - DNA, 914 bp, Bovine  19866882031376
aaggaataatgcttacaagtaaaattgagtgattactaccaagttgtattgatgcctgcagagaaatcatgagagttgaaaggccattaacaacaagtaatttttggttaagcaagaagccataggcctttggaatagcttacaaagagacttttatgtccatcaggggtagggaatacacagctgagttgcaggatgaagacctaattgttagagtagcagagctccagagacgttggaatgctcagctaaagcaggtctgcagtggcctccaagggcactgaagtacttgatagaggcagcaagttacagtgtagagtttggtggatggggtgcccatctgatttaacacatacaagacacagtgtatgtgtgtgttaaagcagagatctctacatggtgctatgtcctcgttaggaaggatacatgggtctaggaaccaagagatagaagcagaagtgacctcacttgctatcagacccaatgtcccaccaagaagttccgtgcttcctggacccaccacacttttttttttttttaagttacttggctgtgcctggtcttagttgtggcacatgggatctttatcatgtgggctcttatttgtagcatgtgggatctagtgccctgaccagggattgaacccaaggccccttgcattggtagtgcagagtcttaacactggattaccagggaagtccctagacccacaactcttaactctgcaggttagacatccaagtccccaaacagggcacacttttgccagaagatataatgaggacccctttgaactacaagctgaagcttctgccatggctctttgagttctgtgcgtccaggaccacaggtgagaggaatcactatccagaaagggtaattgactctgtttagctgggtggggggtgaggtgg

SEQ ID NO: 41296 - DNA, 1808 bp, Bovine  19866880624917
tgtttatatcttaaaaaacaaaccttgattttgtcaggaccaatcaagcctaacaaaatgaggaattcatggtggtcttttctaaagaagtttttggaatttggaattttcttgaaaatagaaatgaagtgccatgtttctaccatcatttcttttcttctcaatgtattttgcttaaatatcagcagcagcgtgtctgtgaaaatataattatcaccagctcgatcatatagtagctgtcaaaattttctgtgtccactaaatagatttttctatctttcttgtcttaatttaaatatgacctcatttaatttccttagctggaaatactgacaagaataaaaaaggaaggaaggaagggaagaaggaagcaagaaaggagaagaaatgacttcgtttcttctatcaaatgaccaagagaaaaactgtattttcacatacaaaaataacaaaattctcctgtacatccttaagctaagatagccactggatcttttgattattttatataattagacaatatgtgtgctcagtggttcagtcgtatccgactctctgcgaccctgtggactgtaacccaccaggctcctctgtccatggaattctccaggcgagtactggagtaggtttctgtttcctaccctggggattagacaataccaataagttaaaatagaaacaacttagttgtagtttcattgcttttcattatagaaatgctgcctgagaggaaatctggaatacagaaaaactaaacatattattcaacagggatcgagattgtaccatgtatcagtcattgtcaaatgctaagaatacaaaggagagagcttctttgcccttgaggaattcacattttctggggaaaatagagataagaaactttttttaaaaaaatgtaatttctataaacttccagaaagttgtgtcagaaacaaatgattgatatattttggtgtaggcttttttttttttttggtgtaggcttgtactgtgataataagtggaatttttcaggtgaggaggaaaagtgtatttcacatagaatcagggaaacctgcttggggaataaatgtgacagttacacaacgtcatataaatggtataaactctgtagtcatttgttcctgcgttcttcatttgaaataatgcttttggcattcatccatattattacatgtatcattaattcacttttcattgccagggaccattttattaatattgtatggatataccacaacctgtacgttcattcactagttgatggacgtttagcgaggctttttgtgaatgcatgttttcagtttttgtctttcaatttctagcaatggagtttcagggttgaatgctaagtgtaggtttaactgtaaaaaattgccaaacatgtttctaaagtggttgtagcattttcattcccactaacaatgtcaaagagcatgattgttagattatataaaaatgtgtttagttttgtaagacactgccaagctgtcttccaaagtggctataacattttgctcttgcagtgggaataaatgagaattcctgtcattccactttctcaccagcatttggagctctcagtgttccagattttggccattctaataggtgcaatagtagtatcccattggtggtgctagtggtaaagaatctgcctgctaatggtgagatgcaggagattcagtttctctctctgggtcaggaagatcccctggaggaggaaatggcaacccactctagtattcttgcctggagaatcccatggacccaggcagttgcagagtcagacatgactgagcaca

SEQ ID NO: 41297 - DNA, 1857 bp, Bovine  19866880888731
caaccagctccaaccagctccaacacaactttggtgaagataaccaaccccctcggagtggctggggtctcacgcaagatactgggtggtggcaggggtacgattaggaagttggcaggatgcacaacagtgaagacatttcactgtagtgcatgtgatagcaaagagaatgaatctgggctaagcagagaatgttcatgttttttcagaaaggaagaatttaaatttagaattgtttggctgagaacacgaggagcccattgctgataaggacacagacttggtctagggacttatgatattaaaaaagagacaaaagccctaccttactaattaagatagatttgatggcagaaacacttgttattttccttagttgagagagaaaacaaataatagtcatattctctatctttgtgaattcatagaaattttcctgcagaaatatgtctgaaagtgattttgactatgaaagctgaaaaagaaattcattgctcatttacctgcctttgtttctagaataagatgtgatatatgtgcatgtgtatatatgcatatacatgtatagttcattaatatatggatatctgacaaagcaccatgtgatatattgatgcatctaactttacatttaccaaatgtctgctagcccactgtttccaatatttaccttctggaaacttgcaggttgtaaagtgaataaaaattagttgtatattggtgctcatcagacattaatggaaaaggaaatggcagcacactccagtattcttacctggaaaatcacacagacagaggagctgggtgggccacagtccatggggttgcaaagagcctgatgctggtgagcgtctgaggacagcgcatgtaagtgtattgttgattcctttgctgtacagcggaaactaacataacgttgtaaagcaactactctaataaaaatttaaaaataaagactgtagttttatatgaagagttacttctcaatctgttacagtagctgggtctcagtttccacatcttctcccatgttagagcttttgaaaagctgaggcaccacatgtaagaagatctaaatgaatggtctcacaggggtgtacatggggctgttgtctttagatcacaacttccacaaatgatttttaaatatttaattaatgacctcatgtaatgtgatatatcaaaaagtggataatcatatacatttttaaattgttgaaaatttttattttatttgaattcaaatatgaatactacatgtttttttttttttcttttcctcttttgcattcaattttggaccttagtattttggttacagaccttaacattttccattttcccatgtaaataataaattaaagagtgttatagacaaacatatcactaatgaataaagtgttattgtaaatgaaaaagaatcagccagctcaattttaacatcatttcttaaagccttgtttcaaatctcattcaagtgctttcttgtcgttaacaataacagaagccagcaaaacaaaatgtgttcactgggttgatatttagacaaaattgaagactgtgtacttctgatatccatcttgtttgacccagataagacaaaagtgggggaaggggctcaagatggtctcattttgtccacaatcagaagtctttctgattcagtatgtggtctgaaaataatgggccagatgctcatctcgtgggaatcttcccatcagtctgttcagttcagtcgctcagtcgtgtctgactctttgggaccccgtggactgtatcgcgccaggcttccctgtccatcaccaactcctggagctgttcagactcatgtccatcaactcggggccatccaaccat

SEQ ID NO: 41298 - DNA, 996 bp, Bovine  19866881327661
ccccaataaattaaaacttttcaaaataactgaaatgttatcatgagatactacaacacagttctaaaaagaaaaaggacatgtttttgaatgccgtgtgtgattggttcagcaagtgtgccaagcattgggtcagcactgtgctcaaaccagtacctgctcacgagatgatcatactcttaagagtacgatgtgaaggggtaagcgttatacttaatcctgaagccagtgactgagggaccagacaggagagaacagtattactcttgagagagattagcattagtgaactacaggttggggggggtgcagtattccaacagtggaatgttttataatccccaagtttacctgtggcagtaaaagccagtgtcagtgaaaggacatagacattttcacatgtatgccttgcaacagtcacatctcattattgtctggcaaaagctttgctacatttttcatggcatcctaaggacgtgtctaattcttctacattgtatgtttttaaattctctgggctatcttttcaggaaaacaaatccctgagcgtgccgttttcagtcagtattaaacatggtggcatttcttcaaatatactttctaactttgtaggacgcatggagaatgtactgaaaacaactcgaagtcgaaatagaaacccagagataccgtcgattgaattagttctttccccgtgacaaacatgtattgcatttctttgtcagagatggcagtttttcttctgagccatcgcttaacttcccaggaacattgctataggatggctcaggaatgtgtgatatggcagaggtgggtcaatgacaaattatggggtttccaaagaaactcttcgcaatcagtaggtcatgttgcaggaaggcagtgctgtcccacttcagagaaaaattcccatctgtgcctgtggggttgtcctgatggacgcagagagcattttatggtcttcctttttcccctgcagaacagaaagggtcattt

SEQ ID NO: 41299 - DNA, 1224 bp, Bovine  19866881406366
ttctcccccagaaggctttcatttattttattttttaaagttggttcaagagattacgcagtacatttgtatcattccattcctaatctcagctccagaataaaggttcttccatctctcacatacatatctggattctcatgctcctcccgcatcagggaaaagtcaggtgtctctcgtgaaatgtgcttggcaggttactgaacattggcagaggacggcaatatagataaatacacacacacacaccccggctggaaagcatctttctccatccaactctgtcggtgagaatattctcctacacgtctcagcccacatcaccttctctaggcccttttattcccctgaagaacagtctgggatcttccaaacggatgtgtgactttctcagcaaagaaaaagaaaacagtcaaataaaataatgttaaaagtctggtagcaccagctcctccatagctccgcatgcacacacacagtgaatggacgcatgattatttacaccactttacagtggaactctggctgtttcatgggtctctgctggtgcccaggcccagtacatgtgaaatctagaagctgaaagaaaattaaaacctaggtgtgcaaaggagccagaaggaattgttgcctttccctggattagaactggaggacatttccttctgtgatttgctcttgccacaacagggctgcgaagagtctccctgacatggggccagtagaggaggggagagagaaggtgaaagaaaaatggacagccataaaaagatttataatttacttctgagataaatcagcaaagggaggtccaaactgccacgtgctctgaggccctgggctcctgccctgactaatgcgctgcagcccattttgatctacgctgaaattaacaatcagccagccactttatgaaatattatctttgttagctttaccactaacaaaaatacacttccaatttttcacatgcacacactacatctattaaagcaatctgggaaattagtttgagataaactgtacagcaattttattcatagcttccccatatctcacactgttaatctgcatcacagctcactaaatagtgcctaatgtttattgcatttaactgaatgtatacaattctgagggtacgccagggaccgattatcataattatacatgtttctatggaaacccacaagtctatcagtttgattcattatattgttatacctt

SEQ ID NO: 41300 - DNA, 1582 bp, Bovine  19866880413898
ctccgggcttggtatcgggtgttcactccgtgatggcgttgttctgctcttttggcaggcagctcatttgcagaagctcgtcctgacgcccctgtcagccctgctgtccctgttcccagggcctcagaagctaatccagaaacgctatgacaaactgctggactataacagctacttgcagcgggcggcggcggatgagtcagacttggccaaaagggaatatgaggccctcaatgcccaactggtggaagagctccaggtgttcaatctggccgcgcggaagatcctcctcaattgtctgtgcagtttcgtcaccctgctcagggacctgatgatcgtggcccagcgggttcacaccaccacggtgccggtaagcacagcagcacgatctgttagaaaccacgccgtgcaaaacagcctgctcatagcgtgcttgagtgtggtgtgcatgtgtgtggtgtccgttttaactgaagccaggcagagagtgttctgctccttatccctcttccccacaggaagctaaaagcaagtttcctagtgcaggtttactgtgacttacacacacggagttctttttggagattccttttcaaacaccgaacatctttcagcttggctctctttgttggcagagccgaagtagctccatctgcctgatgcgatcttgaagcttatcaatttatattttgtgttatcttcctattcaacagtttctaaatgttaaccacgactaagacatggatccaaaaataaggccatctcagtgtagtgacagaaataggatatccgtcaaaccagtctttgttttgcttttgtgtttctctgaggaatagaagcctgatgtgtgtgtgtgtatgtgtgtgtgtgtgtgtgagagagagaaatatgtgcatatatatgtgcatatatctaaaacagggcttcttggtggctcagcagtaaagaagccgcctgcagtgcagatgtgggttccacccctgggtcaggaagatctcctggaggagtaaatggtgatcaatccactcccatattcttgtggggaaaatcccatggtcaggggaccctggtgggttacagtccatgggatcacaaagcctcggacatgacggaagcgactgagcatgcatgtgtatataaaacatagatatagtagtacgaaaaatatatatctatacctatatagcttaactttccattagggtataattttataatcattttctgaagaagaagaaagatatttacaccctaatatcaacttaaaaaaaattagctttgttacctggcctttcaagtgtattacttatctttcagctggttagatatctaatggacatttggagaaaaatatattgtataattaacttttaacttatcctctgaattaagttggataaataggtgctacatttacttggctcaagagaaaaagctatataaaaatgtataagcagcctcacacccattctgactccaaaccacctcatctcctgctctcacccccattgatattagtttatttttattgtgccattaaaagtctaataaatgcaaatatgtgttttatttcttacacaaa

SEQ ID NO: 41301 - DNA, 1614 bp, Bovine  19866880763395
ccaaggagcatgcgtcttttaatttcatggctgaagtcactgtctgcaataattttggagcccaagaaaataaaatttgtcactatttccacttttaatatttgccatgaagtgatatgaccagataccatgatgttcatttttttttttttaaatgttaagttttcagccagggttttcactctcctctttcaccctcatccagaggctcttttgttcctcttcactttctgccattagagtggtatcatctgcatatctgaggttactgatatttctaccagcgatcttgattccagtttgtgattcatccaccctggcattttgcacgatgtactctgcatgtaagttaaataagcggggtggcaatatacagctttgttgtaatcctttcccaattttgaaacagtcagttgttccatgtcaagttctaactgttgcttcttaactcacagaagaaactgatgttgaaagcataaaaaagaagcggcaattgttggccttcatttcccggaattcttccaggtctgtctcttattctatatcctgttcccaatttcccttcatttcttgactccttttcttctgatccttagatgaacttgctgtctctctctcacccttaattttgccagccttgttttggacaagtaattctgtttttcgtcttttaagcttctccatgacttgactattgatgacttagttatccacctattcctcatgtacaaaaaaaaccataaataaaagacatctgctccttttccctgtggcagccgagtggagcctgaaccaagatgctgtttgattatgaaatgagacctggtttaaaatcatcaaaaagattttgagtaggatccagcaaaatctggcacatagctcatcatgctcttcctggataggttaggatcatgggccatcccttactaatcacacaatgcctttgacagagattggcctccattgcaattcttagtacataaaaggacttcagaaattatttagtaaaagaatgaataaattattataagcaccagctataacatctagaacccattacactggtttttgagggtgtgtgtgcgtgtgtgtgtgcttaatcactcagttgtgtcccactctttgcaaccccaaggaccgtagcctgccgggctcctctgtctatagaaatttccaggcgagaatactggagtgtgttgtcatttctttctccaaggggatcttctgaattcagggatcaaacctgcatctcctgcattggcaggcagattctttaccacaagcgccacctgggaagcacttttgaaggtgtgcatgaatttttaaaatatgatgaatctttaattagtagaacatatttggtggagatttccatttacatttcttttaaggaaagaaagcaggaaacaactcagcacatctacttgtcatcactttcagaacatctgtggttttaaaacaactttgaaaatagtcacttgcctagagtataaggtctgacttctgctgtataagcagtaaaatgttctaaattcatatgtactcatacataccctcatagagggcaattaataaaataccaattatggaccccatatcttcttcacacactga

SEQ ID NO: 41302 - DNA, 1206 bp, Bovine  19866880781381
aatttacatgtctgttttcccacttgacaataagctcttggcaggtaggcagcacatcttgttcactgttatatcactgaatgagagaataaacatattgaagtgagaataatgcggtgaactatcaccacgtaagttcaattttaagttacagcattaggctgagagagcagagcctgggaaatgccaccactagtgtgaaacaaggatgaccagatgtgtcattattattacatctttaatggatgttgttgcaatggtatttctattcccttctgatccttctgtgatctgaggatctcctgggcagaccttcataatcgtgccatttgactctggttatggtcatgtgctgattaagctgcccctcaagaatatgaaattgaaacgcaaatgacacatcagtatctcaagcaccaccacaacctatgacagtttagaaacttcagattaaccattcggcaatggaaaatgagactaggaagccttcacttctaaagctttaaaaaaaaacatttctgagaaagcgtcttgcctaggttagttttcaatcacttcaaatcgtctggtaagctactcccaaacctttgcatttacagcacaaccctttcatgagcaaagcagttcaaaaggtggggcctacaatttagtgctaaggtcaacaaagctatgcttttgaatggtatgtattatccccagatctgtaccctccatgtcaggcagcaagtctaaaaagaccaaaagtagaaatatatgccagcaaataaaataattattatcaccaagaatgaacaattctacagtaaatttattaaacttcagtgcttttctttccccctaaaaatatatggcatgtaatgaagtgctcttgtttggtaagcagccgtcttggagagcactctcatttgctagagttgtatgaaacttgccttttcatgaaatagtttaaagcaaaatgttttactcattccaaattgtatgtatgaagtttcattttgagttttagtttcattagaaaatctgtgagtttgtaactgacttaaattaaatctactaaaccccaccctctacagccctattcaataaaaggggagttatttcgataaatttcagattaaaaaaataatttgctttttatgtaaatgtaagtctatgtcttcttatctaagactttgctccattaaacccacacccacacccacccac

SEQ ID NO: 41303 - DNA, 1748 bp, Bovine  19866880888823
ccacaaatactgagcccgtgtgcccaaatctgagcctgtgctctggagcccaggaactgcaactactgaagcccatgcaccctaaagcctgtgccccacaacaaaaggagccaccacaatgagaggcctgagcacctcagctagagaggagcccctgctcgctgcagctagagagggcccaagcaacagaagacgtagcgcagccaaaaataaacaaaattattttataaaaagagagagaaaaggtctatgtttaaagttggcttgcttcccatcctgatatcagtaactaacaacttatcaaagcaacggtttaaaacagtcttcatccaagtgtggtcatggaccagggctaagctgcaagttgactgttaccaacttgttaccggctcctttagaaacatttataacaatttgaccaagtaatttttatgactgtcagacctattaataagtatttggaacttgaattaagtttttctaatagttcattttgattgtaattttttaaagtatcaatatcagttcacaaaagattagaaataaaccaaaaaactatcttttaccacagatcatttgagaagcagtgattaaatatagttattctcaactatgccacacagtaaaatcacctggagagctggaattgatttttttttttttttaagagatttctagagcccccatctcctacatatttgaattcagtggttctgtggtgaagccagggcattgcttatttctaaaagctctctaagcaattttaatatgcagccagagttgagaacctctggtttaaagcactgctaaacaatatctggggttttcttagtgaaacaggaatgctgttaacttaaagaatgccatttacacaattaaatataaatcaagccaaagaaataatgatggtttttaagttcttctagatgagactgaagtttaccacgacaaaactgcacactcataatgagataaagaacaaagttgagaatgcactctcaacaactgctcctgagaaatatgcctcatatctatcttagcagccttatatacaggcctgccgttatgtttcattttctatgctctttcatgaggtaccccagcacctgtttaaatatgtctgaagtagctgttaaaaagaaaaacctaagtaaacggcagatgttcacataatttattcatccctgaaagtctggctataagagaagaaatgcatgcagatgaatactcagaggtgacagagaagacaaagctggtgccaatccttttacagaatgacacccaccaaaacctctcacagagacttgaattacgccaggagaacaatggatcaggtttgaattttaagcctgcaaactacactcttcctcatcatttgctcctgatctctaggagtgtacttccagtctgcttttcttctctcgggctaaaatgcacatgacctgtaattttttaaagccaatgtcagtctgtttattctaagattaatgttaattacaaaccaaaagtagcctgctgaaatttattagaaaatcacaaagacacaaggggacatgtttcaaattcagaatgttgggttagggacatttacctcttccttcagttcttttttctatttttttcccttctatttttattgcagggaaaaaaaaaaggatgaaaaagcagtcagtagattttatatgtgtgtatgctcagtgctgtgtgactctctgcaacaccatggactgcagcctgccaggctcctc

SEQ ID NO: 41304 - DNA, 1710 bp, Bovine  19866881054243
tcaggtggccagagtattgaaatttcagcttcagtgtcagtccttcatatgaatattcagggttgatttcttttaggattgactgatttgatctccttgctgtccaagtgactcttaagaatcttctccaacggcacagttcaaaggcatcagttcttcagcgctcagtctttattgtccagctctcacatctgtacatgactaccagaaaaacaatagctttgtctatgtggacctttgttagcaaagtaatgtctctgctttttaatacactgtctaggtttgtcatagcttttctttcaaggagcaagtgtcttttaatttcagggccacagtcaccatctgcagtgattttggagcccaagaaaataaagtctgtcactgtttccattgtttccctgtttgccatgaagtgatgggaccagatgccatgatctttgctttcgacatgtatataggcaatgataaaacactctatgttgtgtgctagagtatagtcagaagggtacttacctcatacttgcaagctcagagcaaactttccatgaaagtaacatgatactgagatatgagagcttaaagatgaattggaattattcaagccaagtagaaagtcagagaccacttggtggagatcaaagaatatatgaagaatagggacaggagagagcatgatgcatttgagagaaaaagcacattccagatgactcgtataggaagtgaagaggaagagggtgaccgcttaggctgtggtggcatgtggggaccagctcttgagttagtgatagtcatgataaggggtttgggttgtggccttaagtggagtaggaaatcaatggttagttttgagagggaggaaaatgatcagctgtggatgttggaagtatatgcctagtagcactggggagagtgaattgagagaacacaacagcaggggctatggcacccatggggagactggggtagtgacttaggaaaaattagagtggccttgaattagagattaggcaataaggagcgaaatggacagctccattggtgtcacagaggcagaagaaacagagccaagtaaactgcttggaagcaagatgaagcagagacagggctccagaatgtcacctgagtttctgagctggccaagggtagttggtggtaaaattcactggagacagaggtaagagaagaggacccagggggtggggggtggttgagagctgtgggagaaaaaagaaaccagtgatcaaaaaatcaagtttgagtcacccgggggacatccatgtgcagaggggcagtaaacagttaggtaatgagcctcaaacctggattcagactggagttagaaatttgcaaaccatctgcataaaggtagcagttgaggaagatacccttacactctgagtgagaagaaaagcggagctctagcacagaaccagagggacaccccctgtgaggtttgagagaaagaagagggacccccaaagaaggaagccagaggtgtgtgctgttgtaggagccaagttaggacaaacctcatgaaggaggtctgacctggttagcagctgtcacctgagacaagtaatgagaagtcccttggatataacagtggggcattcattggaatccttggcaaagtgagtttcaggagaagagtcctgtgacagaagccagattgcctgaggttgaaggataaacaggaagtgaggatgtgga

SEQ ID NO: 41305 - DNA, 1208 bp, Bovine  19866881105914
actgtcctggaaatctggtagatgtctgggtgtaacaaagaagtaatttggtaaccgtggatgccattttcctcccaataagtgtgctctggctctgcaatctcactggctattgaaatttctcagtggaatatgttttctttgggatggaaatttaaaaatccttttggaacagaagagttgctccttattgatgttagggaggaaaagagaaaagagattcttcccagttggaggaagtacatgacacttcccatgggcctctatcaccccctcttcctctacagatcagctcaaggttttattgtcaatcactttatgctcagtgttgtatgggtcataatatcacctttaaaaaggccttaaagcatttacatttgaaaatgctagataattttattaaactggaacctaaccagggtcctcttggctagccaacagaattttattcaaggggttttagtttcatggctgaagtaatgttacgtgaagattatcaacctttaaataatattccattcatgatttaaatttagttcaagaccagtgagtgttcaaaatgagacacagaactatagtctttaattctaggagagttgctgcagatgctaatttaactttatggagaaagacaatggcccatagcaaactaagcagagcatttgggaggccactggtattctgggcgaacacttcctaattaaactgtacacctccctctcctcttctgaagcccagcgttgttgtttatgacagaaaacttaccgttttttattgtgtgcattttcctccaagtttctggatttttatttctgctagcaaattttgaaatttatctaatttactggatagctcttcccctaagtggggcataaacttgaattaaaaatgaacttttacttcttggaaatatagaaatcttttccttttatggacatatgacataagaagtttgctttaactttctttttgtgcagtttcccagatatactcagggatacaccaagaattgtgagggagggaaagtggaatgcaagcacaggcaccgtgttgttgccatttcaaagcatcgagagaaccctactaacttgggagaatctgaacccttagagaactcaccccatccctggtgccattcttaatttctttctttatctggttctctttcccttgtctcacactttcccctacttcattagtgctggcat

SEQ ID NO: 41306 - DNA, 930 bp, Bovine  19866881198935
tgtaatcaatacaggtacagatccacaggacttttctacacaagcaaaacacttagggggatggtgtgcaatcaactgtacaattatgtcttagtctgtgtacatttttgctttttaacatttcaaataaattctttatcaatggaggcctttgagttttattggtcaaatcttaatggatttttttagtcaaaacatggcttttgtctttaaaataaatttttcttctctagtttttggctgtgaccagtttacaagcatttcaagaacatttgctttatatatttcaaactgcatgatttgaatgttttgcctatgccatgtatctaaccctaaatatttggttactacatgcacatttgttgattttgagtcaaccaaatccctagatgagtgaatatttggtttctgtatcaatccactgtcatttgtcaaactgctggccaacagagcaggacgtatagtttggggggttgaggagaggctaggtaggaaggagaagaaattaagtggcatattgtaaatatcagatctataattgtaaatatcaaacctgcctcagaatgaatggaaagcagatctccaatttgcttatataggaatatcaggttgactatatagccatacttgaaaatgcttttgagtggtgtcaactttacttgaatgaatttttcatcctgattgacgcacagtggtgtacagttcacttctaaagctagtggttaaccttgtgtaggaaacttctgccgtctgacactaagataatgagttctgtgtgcatttttctacgctttttttaaaaacttattttatggagatgttcggtttgtctataaaaatctgaggatggttataaatacctgtaagtattgtaatgttatgaatgcaggttatttgaaagcgtttattattatatcattcctgataacg

SEQ ID NO: 41307 - DNA, 1332 bp, Bovine  19866881244313
tgaggggtgagcaagctgggacactaaaatgatgaacttttgttgttatgattggaagaagagcagtgagctgaggtatggcctggtgtgctctgaaaggcagaattatttgtcaaaaaggcaattctgagcactgttacctcgaatatatttgtttatttttattgaagaatcttgtttatgaacagagacatatatcctcacatatgaagacacagggctcttaattcaggccttcatatctttcctcctactgattccctgcctagactggatggttcaaggcattcattctatttgaacattactgagggcttcccatgtgttgggcatgattctaagtacaaagacagaaagttaatgagacagatatggcctcttgtaccaactggcaggggtgggagtggcaagagatgggagaggaaatgggtcaataataagcaataaacaaggaaacaaacaccattatttcagacagagataagctcaacaaagactttaaaatgcctttctctcccaattccgcaccttcatcccattcctaccttatcatctctgagtgcagtgttttctaacaacctctctgcccaaccctgatccaggcgcctttggagtaaaggtcagatgctttttcttattgattttgtagttgtaattcctggcacatattgttttttgcttaccatataacatattcaataaatgctaattaactgaaatgaatctgttgaaaaaataagccactaacagtaggcttagcatcgaactattattgtacaacttaaggcttagtaagaatgatgtgattataatctcttacaaagattttatgatgttctcataggaatcatggtctatcgtttaacttagtagctctcatccctcccttaccatttttaaaatattacaacttaagattcacactactaaagtgatgttggtcagaaattgaatagaacagataaactgtatagttgagaggtgagcccagagatgctgaagacagatctaacatcttccagaaccctagagaacttgcttacagggacagagcaatgaattgtattactcagatagtgacacagtcctgaaggacaagcagtgctcaaccaataatttgaggctgctttccactactggaaaaccactgtgacctcatgatggctctggccatctgtctgtgggctctaaccagctcaggtctttgttcaatgatgttccaaggtaggcagaagaaaaactcttggcattgcaataataaagagtttcttagggtgacttagggcttcacaggtagcgctagtggaaaacagtctgcccaccaaggcaggg

SEQ ID NO: 41308 - DNA, 855 bp, Bovine  19866881259141
ataaccaaattttagggatattgtaaacatctagaacagtacctggtccaaaagaaaaaataaattaacaaatgttaagtccatggctatagctgtgaaagcaagactatatttttatttttaaagctctcagtggctgcagctaatgaggttgtgactagccctcttaacatttcattcacacattttcagtaaaccgaatgcaatgagagcaaaagaaatcattctgaactgagaatagggttatagtgactgtcttggccaccaactgatggtgatcataaatgatttgggctctctatttccttatctgaagactgaagggagtaaaatttatatctctaaggttcctctagatcttacaaaagaggctgtactgactatcttgaaacaattgggatgcaattttttaacaaccatttttcaacaggtatgtttccatgcttgcttttagatgtttttcttcttttaaactttaaattgaaggtttgtgttaactgaaataggatttcatgaattttgaaccagaaatacaacaaaatgcatttttataccagagtcaataatagcatattatactctaaatgaagataattttttaaaacataaacttctagtttagggcaacttggaaaataaggacttcaattaagagctatataaaggaaagacagagagataagagaaaacaagtggaactcttaaaggagaatttaaattacacttttagaaagcatttttaaaatagagtcatctttgcagggagcacatagtcttgaagggaggtgctaaagagtcagaaagaagacaaatcaattacaatcttcaaagatagtattatctcaaggaaacaga

SEQ ID NO: 41309 - DNA, 839 bp, Bovine  19866881297501
agcttattgctttaacatatatttgtttatttaacctttatctactgtaagggttgccattttcatgtaaagaaataaatggtaaagtaataagggggaaagaacctagtaattgtaatcctcccataagaggatttgttacgatggtctgaggctgttgctgttgcaatttttacctttttgatacacttattaatagattctattttgttaattaagacatttatttatggagcaccccatgtctgtgtagtaatgtgctaggcactgtagataattaggttcattttctacctttaggccactcgtgtattaatgaaaaaaatagaacaatatgtaggcaacaaatataaaggaatttaatagaggtacaaagaagatgttatgagactgttggaggatgagccaaggtctactgccttctgggaaaaggaaaaaaattacaatggaaaatgctaagaagaagaatatagccaagtttagtctaagtcgccttatatatttcttactggttaaacataacctttaaaagaaatgaattgtttgtgcaggctacacattgggatttgttattttgctgtttggcttctctgatatatctttaagatatcaaacttcaccagaagaaccctagagtggctttaaattgttgcattcaaataagtgtcatatctaatgatatattttcgtaggcaaatgacagtggcatccggtaaccaattagtagaatgtcaggaatgccataatctctaccaccaagattgccataagccccaggtgacagacaaggaagtgactgaccctcgccttgtgtggtattgtgcccgatgtaccagaca

SEQ ID NO: 41310 - DNA, 846 bp, Bovine  19866881409400
ctggcactgggtaatggaaagtcatgattacatctgaaactaacatggtagattacatggatgggaggaaggaaggggctgggagaggcaaggagaaaggagagggtttttataacatgttaaatggaaaaaatgtgcctagttctttatatgttttctggacttaattacagtgagcacattttagaaaagtcctcatgggtttgctctctggtttaattctgactcattaaggtgataaatatttattgaacaccctgtaagaccatagtatatagcttccccatcatcaagcatgctccagaacctgacagaatgaagagataaggtatccttccctaccttgcataaagccacaggatgataaattaggctaaattagaaagctcaatataaaagtacctttgtatgaacaaagtgtattgaactctctttaaaaaaatcaaatattaagcactcaaatctatctaaaggcagagcaattatttttatctaaccatgagaatatctatctacacattttgtatagcacaaaatatgagaataaaatctgattcttatctgttccaatcataattcctatgtacagatgaactggttcatgtctgtgtgtcacagaacatatatattgtaactatattctaatattgtaattagtggagtaggaaatgacaacccattccagtattcttgcctggaaaattccatggacagaggggcctggcaggatatagtccatggggtcacaaagagtcgcacatggctgagtgactgagcattgtaattagattattcattcaactatgtcacaaacacagtaattcatcccagaacagtaaacagatt

SEQ ID NO: 41311 - DNA, 764 bp, Bovine  19866881847572
tactcttgcctggagaatcccagggacgggggagcctggtaggctgtcgtctatggggtcgcacagagtcggacacgactgaaatgacttagcaagaacaacatattctaatttttaggaggagccaaagtttttccttgaataaacctggatggcactgaaagagatgaacaatgtcttcatcaactattccacaacaaagaccaaagcagaaatctgcaacagcctttgcagtgacattggagacctaacattaagaagcattcagaaaagacaatttctgtgaggggcacagtgtctcagcgtacttaaagcaacagctagacgacatgacctttaggttttcttctttaagagctaggtgtcagaccgtcaagatcgtatctactctcaagggcctcagtgcaggtattactaagtctccatttcttctctgactcattaatcaaggaaaaaattgtttggaacaacctgggacaaaggcttttaatcataacattctatttcctgctgcatttaagactggcaatttagactagctacatagaattctacggaaatatcacctacccagataaagaactacttgttttcagcatataattccatttttttcatttgcaaatgcacgcaccaccaccacccattgctataaaataggggttttaattttttagatgtgtttaaattttaatgagatgcaaataaaatgataacaggcataaaattaaggaaatggtgtcaagatacccaaggaagtggga

SEQ ID NO: 41312 - DNA, 1280 bp, Bovine  19866880515795
tgtatatgtgtgtttactggtaaataagaaaagagaactcctcatttatttcatatatgaaatttccgggaaagagatggtaaaagatatacattttttaaagttgtatctcaagttgtactgattccagaaatgactaacggtggacagcttttctccctgttagcaatgttccctataaatcaagggcaaaagttcaaatggcccaatcaccagatattcttatttggtagatgtgtgatgtcccagggcaatttcctttctaacaacacacatctctagtagcaagaaaagacactttcttaggtatcactgtagccccagaagactaagcaccacttgacacaaagtgaaagtgttagttgctcagtcatgtctgaccctttgagaccccatggactgtggcccacctggctcctctgtccacgggattctccaggctagaatactggagtaggttgccattcccttttccaggggatctttctgatccagggattgaaacttggtgtcctgcattgcaggagagctctttccctctgagccaccagggaagctccaaagcactgcttggcatatgataaatacctaataaatagctcatgaatgaatagttttggaaaaaactactaccgatagaataagtgaataaagtactcatgattccaaagtaaattgtccatgaaccaagctttgaaaaacagggatcaggagtcttctttatccttctttatttttggagaatagtgaaaaataatatttattgccataacagaaactgtttagaaagtatgatttgcaatctatggcatctagttgcttgagataattctgatttactgctccatatttcaaaaataattggaatctaggcaatgatttctatagagacatttccttcctctctgatgaaacattatttttttttttcaattggtaactcagacattaatgctaaagttaattggatagaggataacttgcctaactctataatgattcctcagtgtcaatcttttcatctccatggttattgtcatggattctctgaactccatgcctatgttgacaagcaaaaaattaaataaattcagtgataataactaagcaccaatatgacaagttaacagtatgcttacttatatggtctgctcatgattactgatctcaaatatcatttttcattctcagtgaaaggttagggaatgagtcaggtaaaagcaggacctctggaaaggattccagaagttttgaatgtgaggacttaatattctgtcaag

SEQ ID NO: 41313 - DNA, 2019 bp, Bovine  19866880601441
tctgactcttttgtgaccccactgactgtagcccacccaggctcttttgtccaaggattctccaagcaagaatactggaatgggttgccgtgccctcctccaggggatcttcctgacccagggatcaaacccttgtctcttacatcatctgcactggcattcccactagtgccacctggaaagccaaggcagaggggttaaaaagtctgagtatatagtgacagaccaggcatttattcctcaactttcccatatcagaggtcattggtttattcacaagtctagccatattagtaagtaatttaaagcctcaatttccttaacattaaagagaaggggtgaaatagacaaccaatggaaacttactatatgactcagggaactataactccaactatagattggagctctataacaatctagagaggtgtgaagaggtgggggatgggagggaggttcaacagggtgggggcatatgtattcctatggctaattcatgttgatgtatggtagaaaccaaggcaatattgtaaagcaacgatccttcaactaaaattaaaaagcaattaaaaatcaataaagagagaaagggtaaaatcatatactgcctatgtgatagtctgcagcacctaaaagagcaaaagtgaaatgcattctacaagttaaaattttaatttcccatattaaattttaattctgtgataagctggaggtaactctgccatgtttcatggggtcatgaacctttgaaaggagttagatccatcccacaggtcaggctggtttgtctgagttcacagggtttccaagaagttggaaatggcctcaaaaaattccttcttttcatttgatggggaaaaaaaatcatgcaactggttaataagtatgaagaatgttatccagtttcttgatggaatagcaaaggctaaatggaaaatgataaatctaacatatgtgctctgaaaattcacctattcacagatgaattcctcatttctgtgtaatctctctatatgtattcctaaaatgaatatgagatgagttcatttttcaacatattttgaaataaagcataattgtattttatatgtaggcagaagcaagaacttctgaaaaatcccatgcattaaaagaaatgtaaggtcatgaaactgagactattactgttgcctcctaggaaattaaaactgtactagaggaaaaagaggaaatatcagaaagcactaaaaaagaaactgtaatccaatttacttaaatgagtgtagataccacttttgcccattgtatgaacatggtttttaagcacgtagttctgtatgtatgtgaagaaaaaagcacactaacctattgacttatttagttgactaaaaatgatttaaaatttcttggtcatttatttatatgcatgcagtctattttttctcctacccacatgtgagtattctctgtttcactatccagaaattgtatagataattagaggaccttattatctgtggaagccaactatttgagttaagtcaaatcaatgatcttttaccctcaggagtctaactcatactcagagggagctattaggcaaaatttttccataccagttttgtacgtcttactctatactataaatctacttcatagaaattggaacaattattacaaagagtaaacagtactgaaaacatcttttagacttgatcttttatccaagagggagacccattagcaatcatatctgggttcataacaactattggaaatatttatttacaatgtaactgtacatacaaattcacataaaagctatgagtccactagaatgcattttccctcaatccttagagaagatatatcaaatagatttagttttttttaatgtaaatcatcttttgtgttactgttataaatgatccataattacatatgatggagatgtaatagtcttaacataaatataattaacaatgggagaatagattgttctgaaaaactttctatgaaggtcaatttctgtcattgcaa

SEQ ID NO: 41314 - DNA, 705 bp, Bovine  19866880640348
acacacacaaacatatgtacgatctgaaagacatcagaagagtatcaacatcaaccacaaaaaaaaaacagtgggtaggaatggaattgagatgcaaacatttctatagaagcagaaatggaattttcatgaagcaccaaagtcctgtataatcatcccttgaagatggcttctgttttctgaaagcacatcagtccacagacttgtaagtattaaaacatcaggatttttaaagaaaaatcatactctaaaagagcacatatgaattgactaccttcttgaaaatgctaaaacaaagccatttattcaccatgaaaagttaaattttattttcagaagatggactctaaaatcagcgtcactgattattgttttcaaaataaggctcagacgtatagcaagaaaataagatttatttggaggctacaacttaacattctcttagactttacctgctatatttgaaggtgtggttgtcaaatactcattctgggaagtcttgatttttgctactttcaacaaacatttttcatttttatgagaaaatgtttcatgaaaatcatattatattttcagtataatagcctaaaataacattgcagtcatatactctaaaattttcttgccatctcacccaaatttcttcatctcctttactataactcttctgtattttacttcctagagtcctctgatatttctttc

SEQ ID NO: 41315 - DNA, 1563 bp, Bovine  19866880723079
gccttttatataacagaaaatattattataaaaatatccacagaagacatttttagttccttgacataatatgtggaaaaattagagatttctatagaaattagaggtttaatacccaacactatgaaacagtaattttctttgaaatctatgcattaactattctgtcatttcttagagaactttttatagttaaaagtcatctggtattttcatctctctctctctctcattttctctctctccctccctttctaccatctatttagattcaacctaaatctatatgtttttatacaacagtcaaatcacactatagtgtgttgtggtgtgctacaaatcacattttagccttctccaatgttattacaaaagaattgcctttatctcaaaggggatatttccttatagatgaggtttcttgcaggtagaagtctcctgagacctacacttctgagtggcatgttcttaagcatattgcattatatgtcagtacaattagcatattcttccggattgtaaaaagtaacaatggctgaccgctcaatatgtaaggaaatggtctgtacaactatctaagaactaggaaacccagtccttgtgtggaacaaacaggaatagcaggttttgaaactattcgtttgaaaatgaatggaggaagcttagattcccagatggatcgaccgttcctgtcttatactgagacatcatgttcagtgttgatacatttctgaggaccaaagggaacccagggggtagttgaaagagaatgaataggaatggaaatatcctggcctgattttggcaaaacacagaagatgtacccatagagcaatggtacaaagattttcaaagactcttactatctgcagaaaggtccctgtgttcccagatatgttctactgcagcggtgcatgctcttgaaccaccaaagcactgagtctggatcttcccaccagcacgcgcctggaaatgtggtcagtgagcaccactgcataactaaacacagattcaggatgtgcaaaacccactgctcggtagaaaactataaggcaaaagagccacagcccaaaccatgattttggagaattttatgaggccatcctcttaattatacatcctggaagagtcattcaaagaaccggaaggggaactagggtggcctgggggacagcaagccgtcttaattccctggtgcagacttgttattttggtgtacttgtttaattcaaaagtaaattcagggagtaaaaatgcccaagatcatttcgacagctagctctttgtcctaaatctcatattttttaggtaaaaattattgaaattcaaagatttccatttccaagtaaagcagaaaaggaaaggaaaaggaaagtgaagatgctcagtcgtgtctgactctttgtgaccccacggactgcagcccatcaggctcctctgtccatgggatcctccaggcaagagtactggagtgggttgccatttccttctccagggggatcttcccaacccaggggttgaaccctgggtctcccacattgcaggtagacactttaccatctg

SEQ ID NO: 41316 - DNA, 1775 bp, Bovine  19866880888826
ttgtatcattactatttgaagtggcagcagtgacctgatctgagcacagggccttcttcccaacctttgatgtgctgtcggaagataagttaaatcccaggcttttggcatcaggttttaatttgatattgtggaaatgaattgtgtactcagtattaggacagatagtgactgcctattacctatctagtgaagtcattggaggcactgctcaggtggaacaatcaggaaaaaattagaatttgtcagctgcagtatgtgtctggtaatttgcctcattcataataagtgtttagaacatttctgattagctgtcaggaatttattgcttctgacaatagactgttgccacgtgtactctgggagagcactggttaacagcatatgggaactgtttctcctgctgcttgaagaaatatttagcagtccttcagttttagaaactatgagaaaacaaagtgctgagatcaaaacaaagaggatatgagcttcttacaatacagaattcataaacgtcttccactctgtgtctgacaatgatatatatgtgtattatatgtatgtacttaagtgtgtgtgtgtgcacataattttaaaagaatgttatgtattttttaaagtaacaagaaaccttggaaattgaaattcaaagtggatttatcctgaacagcagggcaaagctctgttttaggaaaaattaaaagcatatgtttcagaattcagctctaatttgcaatgaattgcttcagtaaaaccacttatatcagtattgttaatcttaatggttacaagtgacccacgttttaataatccagaccatcggtcgagtacaaatcttttttttcccctaattaaaaatgtttgaccacaagagggagttccttgccaactgtttacttatcctcaacagatattacaggcctggatttccaaagaaaaataccttcagatatatttagtttgttctgtgcttttggactaagaaaatgatgacaatctatttaaatttaggccttcatgaatttccagattaaaatataatttgcagtatgaaatttttaaggtaacatgctaatcacttttcaagaataaaatgatgtaccatgcttttgaaagagcttccaaatttgtacctgcaaaattgtgatgcactcgtttgcgaacagaacccatacagacgcactgaggagcttttgagggtggcaggttacctttatgtacaccagtttgcttactttccatgagtaaagatagcttcacttacataagttaatgcatatatttttgctgaactcggtaccatcagtgaatagtgtgtaggatatgcaatgtgacgttcaaactacaaaatttacatatttcaagaggaaaatgtgttccaactagcgacctccttagaatgtaagtaatggccatttccctaatgattaggtgcataatatacacagtaatttatccaaagactataaagctaaaaatatttcctagttcataacaatttgacttaaaagtatatgtaactcagagcatccgagtgaaatgtgcacttgagaaaactttgaaaaagaatcagcataattaggaaatgtggttagttattgaatactgttccaggctactttgcatttaaggtaaaagggtagacttcctttaaaatttgtgaacaatccccccaagagcatgatttctcttgtgactactcccagaaggctacaccatagcattcagaagtcacgctccgcagcatctttccttatcttttgattcgagcaaga

SEQ ID NO: 41317 - DNA, 3225 bp, Bovine  19866881007677
tagagaggaagtctgaaaaatccttgaaaattgagactgaactcaagatgacattaagctagagaaatggagaatctcactcattttttcagtgacatggttgtaggatattttgtgttatacactgtggaataggagcctggaaattctctctctctcacacacacacacaccacattgtgatttagttatattgattttcaatgggtgtattgaaaatatgcctagcactaaaactcagggaaaacatctggacattttggtctccgtaatgcaagagatccagttatttgaaaatacgcttagtgaccgatgtgtgtatgtgtgtacgtgtgtaattttttcttccctgcttggttccatgaagacaaaacctttatcatcatacattgtcattatgaaacatggtaatttcccaaatttacctcgtgaacatccaacacatttacctctcgaacactacttggtaggtccctcatactatcaacataagcacatttgaaggtgaattaaggaatgatgtcaactggaggagtgtcagaatccacaagccaaactcttaaatataacagaaatagcaatgggaagccagaggcacagagtgacttgttcatgggccactttccagaactttcaaagtaaaaaatttgtaatttagcatccttacatgataagataaagactgacagaggatgtcagccttaatagctgcactaagaatttacctctatgtgaacttttaagaaggcatcatgtgttatttctagtaatgtcttttttttttacttgattcataaattttgaatattagtactattgatgcctttatcatcatgattatgaatcaattttgatttcacaaaaccaatttacaaacaagtgcaatagacaaatttccttagtaagaattctgaaataagaacagaactttctggccctgtgtaccaagtcagataaggtgagtaagtttttaaaatcaaaatatcttacataaattacaataagccattcaaaaaaagcccagtttaaaatatgccaaaatatccacacaccgccactggactgagggcttcagttaacactgcaaaaagctatctttaatagctattggacgctcagcaggatgagcaaggctgggattagagataatgatacttgttggaacggcagggaggcaaaggaaaaagcgatcggcctcccttggctttgtaaaagcatattgggaagaaacttacattcaggaggacatgataccagacagtgatacatttaataatctcaatatttcttttttcttttaagttgatctgagatggctctttcgaatttaaatatagcattgaaatacattgttaaatctcttcatgttgatgccttcttttttttctgtttctttgcctacattctatctcaatccttgtcatcgtaagtgaatattagtgtgttgatgttataagtagattgtccaacaccctaacctctagtgcaagcgaattggggaagccagattgatgtgtctcatgagttgttgtggctgcgttacttccttcttctgaaacttagagaccttcccattatgttcaacaaaatacaaatatcatagactggagtttaagttcccctcctaaaagatattagtcttcccttttaactaacactgcccccatgtgaaagaaacactctttgaaacattcctttctggctcttgtaccatgaagataattttcctcaggcaggaaaatccatattttgctgatagaaatttatccaccatttaaaacctacatcaataggcatgtgttctatatgtcattctccacattctcttatgaatgaagcacctactgcccatctcttgatagcaatcattttgtaccactgaaatagcatgtatgccagaattatagatatttatgtaaggggctatcttcccatcatattttgggcttccctcatagctcagttggtaaagaatccacctgcaatgcaggagaccccgcttctattcgggggttgggaagatcccctggagaagggataggctacccactccaggtatgcttgggctttccttgtggctcagctggtaaagaatccgcctgcaatgcgggagatgtgggttcgatccctgggttgggaagatcccctggagaaaggaaaggctacccagactccacataagttatctgtgaattgatgagttagtcaaagtttgactaaagtaatatattgcactgatatgtttattaaccaagaaaacctaacttgttaagattttgcatctatttaaattcattacatttatcattacttattgttctagattgttcctccagtggcctaggaagaacttctgtttgttccctcattgccaaggatgtacattataagattaggtccagtgagtaaattgaggcccaagtgtttaattttctggctcattctctgacaggttaccttgggatggctgtttcttttgatcaaatgtcagagctcccatcaggaggtcctcttcccatctctcttcaggttccactaactgtcctctctcctcttaacccttcagacttaggtctgatactaaatctcttttgttactaatcctgagagaccgcactattttttgtggccattccccattccacacatgccacagatagtacctttaaaactctcttgaggtgtttcctgtttaattgtgtcatctgctttccaaaaggatcccagattataatacttctaaaaacatgaatagtttttggggcacatatacattgtcattgtataactacaattgacaatactcaacagccatggggacttacataaattaacaaataaatatgctttcccaagaggactatagaaacaatctgaaataattcagtcaccaataatatgattgcctgtggcgtgagcattagcttaggtactatttttagccattactatataaccaagaccctggcttccctggtggtttagaaagtaaagaatcagcctgtgatgcaggagacccaggttcaatccatgagtcagggaagatcccctggagaagcgaaagtctacccactccagtattcttgcatggagaattccatggacacaagtatatataaatatacctatctttccttttcagtatttaaagtagctgaaagtgattataacccttgcacagccaacatctcttgtcaaccaatgcctatataaactcaatacact

SEQ ID NO: 41318 - DNA, 1493 bp, Bovine  19866881020692
aatgtctggaagcataatatagatacatctttataaaagccttaaatgtataaaataagctaatataccttatatgctatgggattctcaggcattcttttccatatttgaaaatatatttccatgtttcctataaaatcttaattttgtacctactctattacaaggaaattgaagagctttctcacatattcagaaatgtttaaaaagctaagcactgtatcatttaaactttcatttaaatgttttcaatttatcagaatgtagagtaatagatgaaaaaatttgaagataaacttttatgacattttaagattaaaaacatgggaattcttttattctaaagctctgcttacctgaaaactaattatggaatgactttttacaaaataaacatttctgtattcatttttaaaatgcaacttcattttaagttgaacagctttgtggatatgtcactattttgcctgtatggcataagcccagaaatcttctctattaggtcaatctgcattatgcttggccaggaagcaactttttgttaaacaacaacaacttgatacagtcagtgcagcaggaatggtacttgttagatgctgcccaatccagactcattctcagaagctaaggctaatcctaactggcagaaagaacacagcaatacaaccagtgttactatgatttcttagatggaacatgatggaaacttgtcttttcaccataaattctgtatcttattacaattcacttggtgaggtaataactgacaaggttttgttatattaaaaaaaaaaaagtttttcagtgtttgaatcttgagaggtaaaggagaaattttcatctatgcatctagattcccatccttacttctgaaatgttatccatacagatttgaagaataaaaagattataaagaatcttttgttgtgttgttcagttgcccagttgtgtccaactctgtgaccccatggactgcagcatgctggggcttccctgcccctcatcatctcctggagttgcccaagttcatgtccactgaatcagtgataccatccaaccatatcatcctttaaaagctctacacaacccttataatctcaatttttctataaaacattttaaaagttgaagcttgttatttttttaaaaatacattgaacttcttttatttaaaaagaatctaaaatttattatatttatgaattaaagatacagaaatacttttaaggttatgtttattattctaaatccccacatgctttttttaaagtttcttgataaatgatgacctgttttaagtatattaaaatattaaaaaacttataagaatataattatttcttataacaaaattaccaggaaatatgaattgaaattaattatagattaacaatttgggttaagggggaggatcattttctacgttacatttcctaatatgacatagaccatgataccaattcttggtcatatttaatcacataactgaagta

SEQ ID NO: 41319 - DNA, 1056 bp, Bovine  19866881034212
cccgattttttgtgcatatgcatgttttagttaaatcactgacaaggaaaccaccagccttatgctttcactaatgttaggaacagcacacagaatttgtaatgttaggcacagcagctgaacatactacagaggagtagaaaaggagaaaaaaatgatgccattaaccatgcaaatgtgtgccacatctgtactaaattgccatttgcatgaatacagctaaggcaagcaggattactgtcattagagcaatgctgtttgcactgctatattgcatttaaggttgtgtgggtgtttccatttatactgccccccttctttttaggggtttataatttggttgtaataatctgctttgggatgaaacattactacaagttcacagagggggagcaatttttaattataaaattggattcaaattggttcagccatattgtagctagagaaaagcatttaagcacactaaccaaaaaaatatgttttcttttaaaatacaagtcttttgacttgaacttttttttcactttaaggcagaaaactatttttaccgtagcattttatgtttgttgatttttgtgtagtgtcccaccagaagattgatattatatacacaaattgtccactttaattctcaaacttccaaaagaggttatttcaagtacatgctttattaattatttaaaatatacagttttattgtatccactcctgataaattgcatactgcaatagggtctcttcagcccgtaacaagaaacaagacatcttacacatgttaaagaacaattttacaatcagtgttgcctacttatggataaataacaaattacatgagcaacttttcagtggcaagtagctcaagttatatagaatttttttaaaataaaaggtgtttgtctttatatatataaattttatatatatatataatttgactaattatatatatatatataatttacatatatatatttataatttgagtatattgcaagagtacttgccatttccttctccaggggaatcttcctgacccagggatcgaacccaggt

SEQ ID NO: 41320 - DNA, 964 bp, Bovine  19866881062211
ttcacccaaaataaaagaagtatggattgacaatgctcagagcacaggctgctgcaaaggcaaaataagtctttatatagctcacattaagtattattattttcagttgaatggcaaaatggaggttagcccgaaatgaagtacaaagatatttctttctagccgtcaagataattagaatcaggttggcatgcacctgtgtttgatgctctaaatatgttgtgtcaaagggtcccagaccctgggtcacctagctttcagtgatttccttcaacaactgttcagctacagattttaaaagatgagtgtcaagaggttccctgtcgcctgtggtcgctttttgaaatggattactgaaaatctaaacgacttggccatacacactagggtttcccgggtggtgctagtggtaggtaaagcatccgcctgccagtgtggaagacgtgggttctatccctggttgggaagatgccctggagtaggaaatgactacccactccggttttcttgcctgaaaaattccatgggcagaggagcctggtgggctcaaagagttggggtcacaaagagttggacacgactgagctggccctgtaaggagaatgaatgtaaaacacaacaacaaaaggaacacatgttattttattttcaaggcatcccattcaaactagtcactaacagtctgaatggagaaggcaatggcactccactccggtactctcacctggaaaatcccaaggcggaggagcttggtaggctgcagtccatggggtcgctaagagtcggatatgactgagtgacttcactttcacttttcactttcatgcgttggagaaggaaatggcaacccactccagtgttcctgcctggagaatccaagggatgggggagcctgatgggcagccatctatggggtcgcacagagtcggacacaactgaagcaacgcagcagcagcagcagcag

SEQ ID NO: 41321 - DNA, 862 bp, Bovine  19866881098483
caggcactcaactaacatttctgaatatctttattctgtaagaggtaaaatcgagacctcacagagacatagcttgtctaaagctgttttgctgtaagctgagtcccgattcttgtaggtctagcaatcttcccacagaactacatcacaaaagacaatgcaattggcccaggtatattcccactatttccattttcttctatattccctaaaataatatcctaagcatatttgctctctgcactcctgaacaccaaaacttaagatcctccacgaatgcccacctttgccccatctggtgggctcattttgcacactttagcatcttgcctatgctttcagagctaagcagtccccctattctaattgcctgagtgtctgccccatggccattagccatataatcccaaagcagctagaaagtaaaatttctcttagcacgtatttcatctttattgatacacagtgtgattatacctctgaagaggtaatgctccagaaatattaggtatgttcatatgagatccatgagccatttcagatgataaaaaaaaaagtaccactttatggaattcgaaccactccattaactttgcattgcataaaactatcaggtagaatttttaattgaacaggcttgaactttcttagtgcctatttcttcctttctgtattaaaatctcacccttattgcttctgaatatacaaacatgcatatacatatataaacactccacttaaagaaagctagaaaacccattcacttaattagttagcaccctttggaaaagatgctatcaacttttgacgctctagaaaagctatttaacacgtaaaagtgaatctgactctcttttgctct

SEQ ID NO: 41322 - DNA, 1112 bp, Bovine  19866881140349
tggtaatgatgaaaatgaagagttcagatgagagaagcttgagaaacaattgatggatttagtgactgattaaatacaggggaagaaaacttggatgggacaatggatgctctgagctctcaagcctgggtaaataaaagatggaaccattaattgaaaacaggtcaatcaggaaatgaagatgtttgagagagagagagaaatcaggttttgtttaagataatactgagatgttcaacagaaaatatttaccatgctgttggaaatttaaaatcattctttaatttgagagcttcagagtgatttgaactgtatttttggatacaaaaaacaactttttaatgcatcaaccacaccttttcttctgcatgtagtgtagatctcagtagaggagctctcatttggttagcactaatagacatttgaaactcctacatcttaaattttagctcccatttattatatagtagctaatttgttctcaagtaggtgataatagagattgaactcttaaaatagaggctgattattatatcattagaatgtgactttttaaaaaactcctggagactgtagaaatgaagaaaaatacattggcgacaaaggtgttgaaaggtatgattgtatataaaatcattgtgacccagccatgtgagggaaaaaaaaaaacacccatttttattaactctggtaaattgaataactgtttttgacatgaaaaggaaatgttgttgtttttattatcctatttggaaatatcagttgtagcaaggaaggatagaagcaaaaacaaacaaaaaaaaacacccagcaacatatttttctgcaaggagaagctatagtagatgaagctgctgtagggcctggaaaaatgagatgatgaaatttctggttggggcactctttttttttttaatggacctaagaaaaacaccaagagcagcatcaatgtagatgtatgataacacaggaaggatctttggagattggacagtctgtgacttggttcagttgctagaacattatgtaaactcaacatatgttgaccaattcagtgcagtgactacatggtttaaagagtgctggggagaactcaacacatgactgcagaa

SEQ ID NO: 41323 - DNA, 1469 bp, Bovine  19866881395824
actggaggaggtccaattctttcttcttaactctaaattttcacatactatttccttttagccagtgaagatgcactaatttttttttttaaaattgattttttttatcatcaggataaaaatattgtctacacgattgcctactgtagagtaaaaactgaagacgtttgttgaatacagagtattaaagcaaagtatcatgcttacttttatgaacaagaacatgttaatcaaatgattactgttagctaaaaatatttagtcattactcaaaatttgataaaatgtagtttatatttctcacatatacaataaattaatttcactatggatatgaaatggagaaggaaatggcaacccactccaagatgcttgcctggagaatcccaaggacagaggagcctggtgggctacagtccatggggtggcaaagaatcggacacgactgagcaactaacacttttcacttggatacgtaaagcctgtggtatgatataaagagaaagatcttatataggctaagatttaaaacctgtaggttttcgtcctgtggctccactaataattatgtgatacagaaaaaacacttaaccttcctttgtatcattttatccagctggaaaatagtaataataataactccctatgcagcacagatggctgttgtaaagataaaatgagataatagatgtagaagtgctgtcaaatataaaagtacataaacgtaggataatatatagatatgttcaaacaaaaggaaaaccagaacaagcccacaaaggcagaaaagctaaattggactgcagtgctttcaactctgaatagagttagataaggaaagataacctaaataaaaccccaaagaactaggttttcttttaataagcagcagtttgaaatagataacctctaaatgtccatattgtattctggatactggccaaagctctgaagtatttctaaacaggaataggtaggagactgcaagtgtgaagtctgtgattattttttcttacaaagtgattttattctcttaggtctcaaagaaatgcacgtgtaactgacataggaaatctcagctgtagtcacagttggcccatgcttgtacagtgatccagaacaattatttttcctaatctttcaagcttcatttttcacactagaaaatacagtacttccataaagacttctataattaaagatacacacatatataaactgggggcttcccttatagcccagtcagtaaagaatctgcctgcaatgcaggagacctgggttctattcctgggtcgggaagatcccctggagaaggaaatggcaatccactccagtattcttgcctggaaaatcccatggacagaggagcctagcgggctatagtccatggggtcgcaagagtcaaacaggacttagcgactaaaccactaaatcaccaccactacatatgaagtatggaggcatgcgta

SEQ ID NO: 41324 - DNA, 1081 bp, Bovine  19866881547061
tttgcatttccattaccaatgaatgagatttcctcttgttccacatccttgtcagcatttaatgttttcagtgttcaggattttcactattctgataggtgtgtagttttatcttggttttaatgtacttttacctgatggcttatgatgtgaatctgttcatcttctttggtgaattgtctgttaaggtctttagtccattttttaatttggttgtgtgtttgcttattgttgaattttaagagttctttgtatattttagataacagtcccttatcagatgtgtcttttataaatgttttcccctcttctatggcttgtcatctcattcttttgattgaatgtgtctttgacttacgcagtttgtgccttaggctgatgtcaccagatcctaagattattcttgcagagctgtgtatttttaccagatgttgcttctagagatcaaaattatttataagccggagtgtcaatggtctgactaaatttctttttataaatttctttttataattgtacttcagcaaagtgaagatttccagtaccttgacccctcttgttttttttccttagaattaaacagtcctgccttaatttgctctactatccaaggtagtctacaacctatcacttcaatcactctcttgtcagttacctcccttcccatttctgtttgctgttcaaaattctaactttatatcaatccaatgttggtatttccctcagctacaccagggatgctgaatgctgatgggaggaaatcacactgaacaaccactgcgggggttttccagatggtgctagggtagagaacctgcctgctaatgcaggagacataagagacatgggtttgatccctggggttgggaagatcccctggaggagagcatggcaacccactcaagtattcttgcctggagaatcactcagacagaagagcctggtggactacagtccatgggattgcacagagttggaaatgattgagcgacctagcgtgcatgcacccaaccactgcagatccatgatttccacctcaagtgatcctcatgatgtctggagagcctttcttcaattggct

SEQ ID NO: 41325 - DNA, 731 bp, Bovine  19866880715579
tgagtatgtctggtttgatttgaaggaatggcctctttttatttcaagcttactcaacacgtgtcaactaccccgcacggccgccctggatacgcaatgactggaaacaggagcagatagcaaaggacaggacggtactcacttccccactggtcagcgctttctctttttgttgacagcgtctgatcacttctaataataagggtccacccacagtaccttcggcttcaataattcctaaatctcgggctaaattctctcgaccttcaagaccttgaaactgggaaagaaataagatgtaagaaagtaaaacagaaatgcacaaaaacatagcaaaactattttcagaggtgaaagaaaactattttcaaacttaaaggcatctctaaactcaaagacaccatttttctaatgaatgaaatctccattttttaagattacacatctccacgtttcaagtcccccctagcaggcgcaggccaacacctgaacacactaactctgcaagaacaattctggcaagttctgtgaagcaaggacattggcgccagctgtctaacagctcagatggcttttaagaaactaagacatatcagctataaaaacaatccttatgcaagacactctacattgtcaaattttgttaattttcaacttgtaacgaacgcatctgtgtcaaaggcagcttcaaggacagacattaaaaagcatcattcttactgtgctagttt

SEQ ID NO: 41326 - DNA, 1433 bp, Bovine  19866880765722
aatgaataactggatatgtatttctctgttcttagaaagttggccttttacagacttttaaattttgcaaaataatgtttgtaaataagcagaaacaatgtttgcttaaacactctatttccaagttttctgcatcctccatttgctcagaaaaaaaaaattttttttaaacgttctctgctgtttctgaggagatccattgccaaatatttttataagcccatggcaattgtttttacctttttcaaagaaatggaaatagtggcagataaacaccacctcctgctccagtggtaagacttcaaaacgcacatgggtgagtgacctagtttgactgggtgctgctacgggcgtatcacacagacggtgctgcttaacacctagacacgaacagaaaaacgtgactcaggtttaggtgggtggggttttttagggagaaggttgcttttaacacattgatttcagtaattcttctcagtaactctgagcaagacttgctaggcaatagtgtgtgcccctgatgtgtcctcagagcatgctggctgatggcagagatgtcccctctgctttctttacaaagcgtggctttcctgtgcctggtggttacaccttctgggcagcatgctgaccccaacaacagaggcgtccaggccagcagctccccacaagggaggtgttaaggaaaattgttcaaatttcagaacttgattgtatattgggggtgggggatgggggaagcggctttccactgccccctcctcggcccacggatacagagtacaaccacataaaattactgaagcttccactcatgaaagacatttcaaaaccgtcacataggtcagagggttggcattcatctcctgtagaaacatgtgtccagaggcgtagggagcaagggaccaagctccaaaagtctcctcaccactcaactctctgtttcaacgctgcctcctgctctgagtctttgcagcacacgccccagaccaccttcatcacattttggacatttcacgggttcttaaacaatcacagacagctatacaaggttgctgcctacactatatttaaattcaagtggaggaatccaagttgtgagaaatcccagtacagagcacagtgtatgacagcgtcagcacagtagaaacaagcgcaccctgagccattctgcgaccctgccccggaacaagcgcctggtaacggaagggctgaagcaggacacgctgccaactaacagaggcgggcagtggtgccgttcactgcagagtcgcccagcagaagctcgtagagccgcctctagcaacagttccggggactctgtccactcagaggcacagctccctgttcgtatgctttttctgaatccccacctcactttatggccatgggtgatccaaaagacataaaatgatataaagtaaaagttataatag

SEQ ID NO: 41327 - DNA, 1141 bp, Bovine  19866880889151
actttaatctgtggaatggttccccacaggggagcgtttttgctccaggtctatcttaccgcaggaaagatcagctttgcttctggtgagtgattttaaaagcatcctaaaatatctttacgacttaaacacagttgccatcttggccaattttcatgaaagcagatatgggaacattaaaaagatggacttactaacatgaatcaataaagtcatatgccatgttcctgactaggaaaactgaaaaatgtgcacaggtatattctgcaaaaattaattttaactgtattgtgattatagtcaaaaagccagttgtgatttataatttaagaaaataaacaagagtttaaacaaaaaaagaacaacccttgctatatcagatacaacatatactctgaaggcacattaattaaagcagagtggggaatgggtcaaaaatatatgcataaactgtggatgagaacagttcagttagtaggtgcagaaaatatacagggacttaaaatatgatagaaaaatactgaacttcgactatagagggacagattatttgaggctcttgtggggaaatcaaccatttggggaaaagttaaagtctcacttcccaagtacacaaaattagttagggataattaaagtcattgtgaaataggaaatcataacaacaaaaagaaactataggtgaatatatatgtgacttggttgggaaatagctttttaagcataaaaatggagtgaattgcagagagatagactaacagatttgtccacataaaatttaaagactacatttcatatcccaaagtggatggtaaaggttttccacaaccaccatttcctaattcatgcaattacatctgaaacagatgagcaaactcacatctttgttaacatgaacatgtatatgaaatcttccttctcatttttttcttaggaacaaaaatttctgcctttcttcctatttggggtgggggcatctcttcaaacatgaaattgaagcattatccatatattttaatacatgtctataacactttttgatgttttctactacattttaaggaaccatctgtccaaaaattattttcaaaaattgaaaaattagcaattgggcaaattatagacttgtttatgcttacat

SEQ ID NO: 41328 - DNA, 1453 bp, Bovine  19866881092027
gcgtctgctggaaagaggcagctgaacaacctctgtggaatctccgagtaactcccgtcactcggtctcctcattcgttagacgcacaaggaggagggggctggacaacccggagaggccacgatgcttctcccatccagtgtcagacccaagaacctcataggtctggttcctgctgaggactcgcaagcgtggaggggctgccagcccatggcccggtgcaggggggctggacggcggcaggggacgaggaaggctgaggacgggaggaccgcgtgggccagcaccccttttgccgtgactacgggacatcccgtctagaaggtgtttgctgcatgctctgcgaacgaaagatccgaagaaaatccacatttctagacgtagatgtaaaaatgctccactcgtgtattttggttcatggtgacttttatgactaagtggagggattctgtgattgaagtaagaaaagcatctttaatctggaaatgaccgcaccctttaaaataacattaagagcgttaaggataaagaaggtctgactcttcacacatctgtatccttagctgaatcccagctctgtttcccgatgctgggagcctggggaggatggaggggaggctgccaggaaatgccaggctcaggaatggatgagtcacacaatgggcattgttttcctgggttgttcccggatctctgtgctatgggggtgggtgggcgcacagggcacagcgtcccgggcgcctgtagactgtgggtgccccaccgcgcgcacgccctaccacgagcacgccccaccgcgcgcacgccgtaccacgagcacgccccaccgcgcgcacgccctaccatgagcacgccgaaggaccaccagtccgcactctgcgtgtggcccctccggttcaccacctcaggcgccatgtactcgatcgtcccgcagaaggagtaggctctcttgtcgtggtcgatggcctctttactcagcccgaaatctacagggacacaccgcacacagcgctcagtctctgggtggtgctcagacccctggctgcccggccagccctccccacctccctcccggggccacgcggcctgcagaggctgagccaggccccgcgcctccccgtgagattctgtcgggatgaacacgtgcaggagtgctcgcaagggtaccaagagtctgtgttctgatgcccgacgccacttccccagaggccgtttttggcaggacacccttggatgtcggcggcctggggagaggctctggagttgctctgatggacgggcagggagaggacccctattccaaaggaagggaccagaaaagggtcacgggcacaagggtactcacgaaggtggcccccagtggtgaggcaagaagcagaagacagacaagtctgacggggctttggagctcctgccgtgggtcaccgtccccagatctcatcctcaaagccag

SEQ ID NO: 41329 - DNA, 1116 bp, Bovine  19866881344985
ttttgttaaggtgaggactgagacaggtaagggagtagttaggagattgttcctgacagcagcaaaagaaatttttaggtgtaatttaggtgtaatagtaatggattttaaatgttaatgaattagaggatccctggagcataaaggactatgaaaccatttattcaagtgtttccaatttcccctaaggaaagggatctatgagatttagtactgacttcagagttcctgtgataactttctttaggttactccaaaagtctaaagtatacatgaaaagagaacgaccttcactctcccctaacagtaaagaagcataatctttaattcaaaattatccctggctatacactactataaacggcatctcagaatggcttttaagcaattagaacttaaacataaatgaatacggtcgttaaagtttgtagatttcatacctctactttttcttgctcctctagtgctaaaaacacagctgctcggagttcagcctttacaaagcggggtggagaggaggaaaagaacaaaaattatctccagacaattttcatggcaagaagcacaaacaccgaaatttccaaagtcaaaacgaaaaccagcaagattacaatgcttaggaggcaggtgcagagagaggtcagagggcatcctgacgcactctgaagaatatgacacaagctctcgagtccactgttcgtgcccctggcactgtctctctcagcacccatgcctctggtttcagctgggatctccatccttaaccatgcccaccagtagtgtgaatgaatgagaaacacacgccaagaagcaagcccttggacatccgcaccccgcttgttacagaaagctggaggggctggccgaccggcagcacaggccagaggcgggggacagccaaggagtggggagcaactcgaccaccggactgtgggcgactgtacgatcggaggcggggcggggaccggggggagcagtgggcaaacgagccccaaacgtgcagtgggcatcagaggggacagtgagcaactggaccccaaacgtgcagtggggaccagagggggctgcggagactggaccccggacgccggggtcggcctcctccgactaaagccg

SEQ ID NO: 41330 - DNA, 2369 bp, Bovine  19866880392907
cttctaggtctatcctgttgctgcaaatggcagtatttcattcttttttatggctacataatattccattatatatatatatatgtatacaccacatcttttttacccattcatctgtcagtggacacttaggttgcttccacatcttggtttttgtaaataatgttgctatgaacactggggcacatgtgtcttttcgaattatagttttcgtcttctctggatatatacctgggagtgggattgctagatcatatggtggctctatttttagttttttaaggaatctccatactgttctccatagtggctgcaccaatttacattcccaccaacagtgtaggagggttcccttttctccacaccctctccagcataaattatttttgatagactttttgatgctagccattctgaccagcggagaaggcaatggcaccccactccagtactcttgcctggaaaatcccatggatagagcagcctggtgggctacagtccatggggtcgctaagagtcggacacgactgagcgacttcactttcacttttcactttcatgcattggagaaggaaatggcaacccactccagtgttcttgcctggagaatcccaggtacgggggagcctggtgggctgccgtctgtggggtcgcacaaagttggacacgactgaagcaacttagcagcagcagcagcattctgaccagtgtcaggtgatgccttattgtagtttttatttgcatcctctaataattagtgatgttgagcatctcttcatgttcctgttgtcttctctggaggaatttctgtctaggtcttctgcccttcatgagttgttttctattcaactagtttattcttcaggaagctggttctgaatcaactggcaattgtactagttttatttccagcccataaacataagattgtattattttctccagctatgttgacttgtttaaaaggtttgtagtggtgcctcaaagtgtttttttattagtatttttaactgctgaagattttcccctctatttttaattttcccaagtcatttcacacacaggtggcatcctgtttacttgacagggcatctaatttcactaaagtgaaaggcaatcacttcaatgtacagattgagaccaccagcatgtttaatggcttggatatctgtgtacaaaaagcaaatttgttgtgtctactgaagttgcaaagagcagcatattgggggctgtcaggtggagaagcttgttcaggaggatgttttggttgttttcaagtggtactagatgagaagacaatatctgtactgtcagacctgggtttgtactatctaggtgaaaataaaaaaaacttgagttttcttttcatggtcaatttttttctgtttattaaatgtgtcatcaaagacaaaattctatacaccatgattataatattaatatatcaaaaggcaagtatcccttttggcactgcaaggctggaaactgacatttatgcgtgggatttcatctgagcagaattctgggggccataccagaaaagcagtgtccacctgagcacaggaatcacttgctgtgaggagacaaagcacaaagttgggagactcgggctgtgggcttcatttgttgggttaaaatgggaaattctgagttctggtcctgcctctgacatttaacaacagtgaccccgggcaagctacttgatcacttttcctcatcctccaaatgggagtgacgtctgccttgggagagagcaacaagatacccagtgagggggcaaacgctccagaaacgggtgcacagtgggtactctgtgtgtataaagaccctctttcctcccatccgtctgttgcgcttttaaaatattttttaatgtggataaatattttaagtctttattgaatttgttacagcattgttcctgttttgtgttctggttttttggctgcaactcatgtgggatcttagttccccaaccagggattgaacttgcaccctttgctttggaaggtgaagtcccaaccactggactaccagggaagtccctgttgtactttttttaaaacaatgacctggatggggggagtgagtccatctcttgcatggcagccctgcaaccatttgagaccagccatccagtcctcacttcccaggactgccatctccctttagcctcagggtcagccctccaggttcccagggctctgagtgtcctgggatgcttatcttagaacacagcctatcaaacctcggggccgtagaccaccagtttcatagatgcagttgttcccatgcagagccccggcgggaaatcaccatccttatattagggatttttctagtaaccccaacagtgctaactttttggc

SEQ ID NO: 41331 - DNA, 1371 bp, Bovine  19866880406280
ccaaggaacaaaaatttcagagttctgaagggatgattgaataatataatgaagcaataggcttcataactgaagacaattctggtaaggccgagctggatagaagaccattgcctcgaataatattttccctttatatttctcagtctgtaattttaacctgttgaccctgcattttgactaagagctaaaatggttcaagatcaacagactagccctcaacacctggaagatcctgttctcataagcatatcccagaaatcataagcaaatgttgaccttctttttacaaggcaaaccgctgaggcagaaaccaaaataccagcaagtacgcagacatctaaggcttcatctaggcaggatgtaaaatgtcaggccattaatcttatatttttaatgcagtggttacaaaggatggggctgatgtgggattggaaaacaatactgagtttagagaattcctccccgcctcccttttttttaacccttaaatactgacacccactcaccagggttgggaactagcaaaagctacatgggattccagggtgagcgttcatttcccagcctccattccttggctgtcaacaaaggcagaaaatgcctagtcagggcccattggcgcttgccaacacagagacctgtttcttatttcatccggcagagtgcagagctgtagttaccatcactaaggtggagagcttggcatccctccaacaactgataccgtgaattcagcaagacaaacgaagcaatcagttgtgagacagaaaaacaggggtgtgtatattctaatggtaagccatggttaacacacagtgttaggtatcagtattttgtgtacttttgagtccagccacctcatgcgaagagttgactcattggaaaagactctgatgctgggagggattgggggcaggaggagaaggggacgacagaggaggagatggctggatggcatcactgactcgatggacgtgagtctgagtgaactccagaagttggtgatggaccgggaggcctggtgtgctgcgattcatggggtcgcaaagagtcggacacgactgagtgactgaactgaactgaagaatataaatgaatctacatttctctatgtgaaaattctgtttccacctacattcctcagataggttgactgactcaaaaacttaaaccccagaattctagtagctaaggcagttaaaaccaaaagaatgcaggtttgccttgactagtaagaaacaaaacccagtatcctctaatgtagcggtcctcgaccttttttggcactagggactggttgcacggaagacgacttttccttggactaggatggggtggggtgggggatagttttgggatgattcaagg

SEQ ID NO: 41332 - DNA, 965 bp, Bovine  19866880442316
atggggtcgcaaagactcagattcggctgcacgcctgaacaagaacaacaatgttagtcatggctggctggctcctagcaggtattcaataaaaatgtgtctgatcaaataataaatgaagtgctttccctgcccagtcctgaagcaggggttcactcccatcactgcgggaggatgttgctaacagaagctctgctgggaactggatttgtcggaatttactgggcggcttgggcagagagcggagtcctttgctttgcatttgttcctgggcttctcaaagggcagtgaggggtcagagagggtcaacaggcctttagaactagcaagaaaagctgtagagccaggagaaaggccatgatcccaaaaccctactctgttacataggtaacagtgaggaggtgctgatgttcacacggcattcctctaaacccttcacgtaccattgccttacctgcagggttcatgaccaatgctactggcctttccagcctggatgggagaggagtctgacggagaatgtgctcatgctaagtcatttccatcaagtccgactctgcgaccccatggactgtagccaggctcctccattcatgggattctccaggcaagaacactgaagtgggttgccattcccttttccaggggaacttcctgactcagggattgaacccaggtctcctgcagctcctgcactgcaggcagattgtttacctctgagccaccagggaagcccttggggggagaacagatacatgtacacatatacatgatacatgtgtatgtatcagccgaatccttttgctgttcatcagaaaccatcacaacactgtctgttaactggctatacccaaatacaaaataaatagtctaatttaaaaaaaaaaagaaaagaaaagaaaaaagactgttggcctttcctaaaaaggctcttccacaccctctggcttcgttcatactgtccc

SEQ ID NO: 41333 - DNA, 2584 bp, Bovine  19866880579030
ctgtctagtcaggctatggtttttccgtggtcatgtatggatgtgagagttggactataaagaaagctgagcgctgaagaattgatgcttttgaactgtggtgttggagaagactctttagagtcccttggactgcaaggagatccaaccagtccattctgaaggagatcagccctgggatttctttggaaggaatgatgctaaagctgaaactccagtactgtggccacctcatgcgaagagttgactcattggaaaagactctgatgctgggagggattgggggcaggaagaaaaggggatgacagaggatgagatggctggatggcatcaccgactcgatggacgtgagtttgaatgaattccgggagttggtgatggacagggaggcctggcatgctgtgattcatggggtcgcaaagagtcggacacaactgagcgacttcgcttcgcttcccttcgcttcgccatataagcccccaggatcctggtgggaacagaggcactggggcaagggactcgcccagcctctaagtcagtgaatcaaccagccatccttccccgaccacagcatccacaggacctcctgggatgtgtccacaggctctgcctacctctttgttccctcagaattccacagcagcactctttggaagagcggctgaaattcagcaccaggggaaataagcccatctgaacaattggttccaagtacatccctgaggcagttttccatggtcaaaggacacgaggggaagtgcagccttgaaacgaacgcagtggcagctaactccgatccagttacatcaaaaagacaacagtggtgggacctccctggcttaagctattgcctccagcatctttaccacccaacctaaaatgactgagtacagggtcacggggattacgaacaattcctgacttggttgagttgctttctcaataaacacgttaaccattcctggttttaatgtatgtctcaacttaaagctttcttcaaacaaaacccacatcaaagactaaaacttcaattcttcagtggttccaaggcactgtttttgtagaaaatgcctcactcaccttcggtctgaggtttgtattactaaaagttttcttcagggcagatcccagaaaccaccagctgtttgccaaggacagggggatgctgtggtcctccaggcccccaggaggatgggtgtcagctgaatatggttcatgcaataaacacagatactgtgtgctcagcggctacgtcatctccaactgttgtgtgaccccatggaccatagctgacaggctcctctgtccatgggattctccaggcaagaacactggagagagttgtcatttccttctgcaggggatcttcgtgacccaggtatctcctccactggcaaatggattccttaccactgcgccacctgggaaacccagaacacaaatcctagtgggcctgttagtgacctcccagcatcctgattctctgtgagatctcagattctccaagggggctgcgttgccccagggcccaagcttcagctcttccctctgttttctcggctgggaacatcagaggctctcaggcagccccccttattcccaccacactcccccacttcaccccctggcttcttaaaggagcccagcttcgtgtttttcctaggcttcttggatctattcaaagccatcaaaccaagggcggctcagattcatcggaactgaccggctttctgcatggagcaatctgaagttctcctggaaggggtcgctggaagctttcaggaaaagtcactggatttgttttcggaaagcttaatacaggctcttggcaaagcggaatgccgacagggccagatcgtgcacagagcagaggagaaaagaggaacttgcggttggagaggttcagagggtgacctcaaggccacatggctgggtcagaagggcgctcagatctcaggattgctgctctgcagcccgcctgtcccctctccttctcaggaaatcggggattctgaaaaacaggattttctctaagggaagtagctcagtgagagcagagcagaggcagcagggaagcctgggcccaaagtggacctttcgtcgggggcacagccagcctgccgggcgccagctccggctgaggtgccgagggccactgtggacggctggggctcatgtcccggcctgggtcctgcctctagctgggcctccacctggctgttcacctcccactgctgccacttcacacgctgcttgccgctcatcctggctgcccagagaccaagcctgacctcccgtccacggatccccagacgccttcctggcctcagttttcgattcctgccaaggttgctgcaccgaacgttttgggttaatcagacagtgctctgctgttttacgtgagggtctctacctggaattctttcaccttctccaggccccagatggacaccaacttggtcttcaagacttggatcagagacacatcatccagtgatcccctttgtacgttcgtctcctacaggccccaccatgctctctgaggaatgttgcgtgtccctctcaactgccggcctctgagctc

SEQ ID NO: 41334 - DNA, 1695 bp, Bovine  19866880633531
aagagaagagtcacttgggagagatcccatggcgctactttagagcttcccgatagagtgggtgggaagacaggaaggatcaccaaagtcctccacataaatgcagcagcagagaggcgggaacaggagccatgacgcgagaggggtgggaggcagcagtcggagcacaggctggaggtggaggataggaggtggtgtatattgactcccaaactgggcctctctgcacactctgaactcaggacagatgtttctttctatggcaaatacactccgtttgctctctgcaaggggcagggaaggcggctgcacacaagatgccacgcccggggacattcctgccaagaggaagggtgctcacttactgtagccggcctccttctctggggtctggaaggaaggaaagagaagaggtcactggtgcagctctgggggccatccacatccccccttagcttgttcccgtcccccttgagtgtctgagaggtttggaggtcatagaggcaggggaacctggggactccctgactggaagtgacttggggagggggcggcttgtgccagagcggggtggcgctaagagtacagatcaagtgtgagctcagcaaggagactccaagatcagagtgaaatggaaaaaggtgctctcgtggtgagaggcagagagggcgaggtgggcaggtgtggagtcggaggtcccactaactacccctacaagccctccctccaggtagagtgctctcccggtgactcaccaacggggacttgtcgttcatgtaaaccatggggtcctgcagagggggaaaataaatcagaggacttaggattctataaccaaaaactccaaggatgcctggagagcagttcactccagccaggtggggagccgaaaggggacaagatggcatggatctctcccaggggagcacggttatcagaacgcgttcaggggcttcccggctggctcagcagtagagagtccacctgccaatgcaggagacaccggtttgatccctggtcttggaggattccacatgctgcggagcaactaagcccatgcaccacaactactgaggttgtgctctagagcctgtgagccgcaactactgaagcccaagctcccaaaagcttgtgctctgcaacaagagaagccactgccatgaaaagactgggcattgcaaatgtagagtagcttgccacaactagagaaaggcccgtgtgcagaaacgaagacccagcacagccaaaaataaaaaaaataagtaaaattatttaaaaacagaaggtgtccagcagtggtgtcggggcatgtcctctccctccccttgctgggctttctcctcaccagggctttctcctcctgcctcagccactggtaatcttccaccatctgcttctgctgcttgtccaggagttgacgcatcttgagcctctcggcctcccacagctgctgggcctcctcccggctgctgggccggacgaagtcctcctcctgggagcacagcagaggacacagtcagcccagtctccggacccagggaggacagtcctctggagagccttgtgggagccacacgccttggcctcactggcctcagatctgcagccatctatgcagatggttattactgttggctccatcaaccccagtcacatgcagtgtgtctgtgaaatgctgaatcgcagggcatagag

SEQ ID NO: 41335 - DNA, 2845 bp, Bovine  19866880644346
ttctagtaaccccaacagtgctaactttttggcagctatttcatggtgacacaacttaaactccactttttaatccatgctgttgctcaaccacatcttcctcatcccaggatggaggagatcttttttctctacatgaagaacttcacatttagcccatttcactggttgcattctttttcccttggtatgtcttccctctcgtgcagatgtcaagggtccttcagccagagccacaatctcccctaatcctgtgctgatcttagtgcttcttgtctgacaaccacaaactccttaaagccaagcgcagcggtgtgaacaagggccagttcgaacagccattgctcctcaggttaacacagacgtttgatcagttgttggggaaaccatctgaccagttgtgaattcacctgcttgtcatctggcctcctcattcacttctcaagaaaatggggaagagctcaaaacacccaatggagcatggattcatcatggtgccgaatttcccagcccaataaccaacacttaagcacgcacaaaaagagaaatggggtttgctggagctgaaagctggaagagatggaaaaggctgagactgggactgatagtggagaagttggagaatttagttgatggttaatgaggacagggtgtggctttgaaaactacaacttttaggaaattggagagaaacagaagttccttgaaaaaaggagcgaatcttaacattctgtgcttctgggtcttccctcgtggtccagcagctaagactccatgctcccaatgcagagggccagggtttgatccctggtcagggagctagatcctacataccccaactaagggttctcctgccccaactaaagttcccacatgctgcaatgaaggtcgaagatcctgcctgccacaactaaaacctggagcaaacaaatgaatacaataattatatattttttaaaaattctgtgcttccatacaccttatagtgtgttgctatcttgcagcactggctggccataccactgccaagagcaggcaacatccagggtcagaggtgggcttgaagcaagtgctctagtctctgcccccatcctattcccaggtctcttcctgataaagccctgcagggctgggaccagcaggagacacccttctctccccgagtctgctgtcagtgaggtcacactggtagcttgaaatcagagatgccagaagcatttacaccagagaaatcaggaaacactgaaattgagccatctttcctctggattgctggttgtgaaactcatgttcatgctcagtcacttaagtcgtgtccaactctttgcaatcccatggactgtagcccgccaggctcctctgtctatgggattcccaggcaagaatactggaatgggttgccattcccatctccaggagctcttcctgacccagagatggaacctgcatctcctgcattggcaggtggattctctatcactgatcgacccgggaagcccattgtgaaactcatacaaaggcattatctgagcctctcctcctgcctcccatttctcacctatgcttcattgtatggcccaaattctattttctaaatgaaaatctgcctctccacagggtggtatgttgctaccacctcatttcccaacagcccttcagcaccctcctggccagctctgtatcatgtcacatgatttcctgatcttgctgtgttcccctttcctgagaccccagggacccagaggcaagtccttttctgtgatcctctgacacctaggggagaccccattagatcctgtatcacattgtggctgctttgcttaatccttttcctttttactggatgagtccctgcttatggggaccctcttccttcttctgtttatcttcttatctctggattctggcatgcctcctgaaacatagcaaagcagaaagggagagagaaaagtagggggaaggaaggggaaggaggagaagggaagaagaagaaaaagaaggaaggaaaaaaggaagggagggagggggagaaaaaccagccagcccaaatcactcatgaactggccagttagaagcaaggggagggggattttgtgaagggttggggaaacaggggcacccagaagtcacaggaggtaaaaatgctctgcccagctgtgaggctcagagcctttgaactagtgagagaacagaggttctatgaacaagaaagggcaggtgcagcacctcagccagccccctccagccccctgagagccagcccccatcaggggacctctggtcacaaagtgctggcaagagaatgagccggagtgggtattgtgtgcggaggtggcaggctgaaaacgcgatagagtctcagtagaggttttttgaatgacattgaattagagctggcattaatcacaaccttcctgggtccttcctttgcaagatagtggggagggatgcttggagaggaggggaagggattaaacaagtgatggattgggcttccccagggcaagcagaatgcctccacccagtgggaactggggtttgaaagggcttgggctggggaggggcactgtgtggagccagtagggcccggcttcccagaaacacaggcctggctccccaagactgcaaggtcattgccaattcgttaagtggctgttctcagcaggcctctgcagaggaaaggcatgtgttccccattttgttgatgtggaaacggcaagaggaagtgactcagagacagagtggaaataaagtgtgtgtctcatgacattctggcttctgctggacgcagaggactggcctttcaactgtgtcctggggggcctccttccacgtacagaacaga

SEQ ID NO: 41336 - DNA, 1113 bp, Bovine  19866880723337
tttgcactggtgcggtgttgtcttcctgaggtggagcatgaccatctactatgtgtggagagattgtcatccttcatggggctcgtagttctctgacggtcagcccaacatttaaccttctcctttggtcagccccctccctctgagagtctcaggacatattagtttgtgttgatggttgttggggtcacagagatgaatagggaataattgtgtcccagtcagagctgtacaaagatggaagagaatgctttgggtggtagtgagttccctgtcactggaggtgttcaagcaaaggccactgccactttcaaaacgtgggactagagggcccctaaggtgccttccaactcagacatcctatgaactgatgtgtatgtatcatttctgctcacatgaaattaaaccatgtctgagaacctcctgtttatatttatcccggcaagggcaggaagggctctagtactgagtcctgaagaatatgagccgcccagttgattcctggctcatctcccatcagagcccagtgtaggtttgtcttgaataaggcagccagggaatgcaggcctgaggcaagggatcctgtttccagctgactcagttaggcccagaacgcctgcccctggccctgccccgcaaagcccacttctcctttcctagcctcttctgcacgatggagccggagcccatccagcccggcatgctcatcgacgtctgcaaatacctggactccctgaagtaccgcgtctggaggaagatggttatgtgtgttgaatctggtgagtgggggccccaggcaggtgtaagaggctgggggaggtcatgctgggcagagggccagctgaacgaactccttcccgcttcccaccccataagacctgcaccacctccctgcactagtcacctttccagcctctttcacgaaggtccctgtgccctgctccgctgcatgtcctgctgctcaaaccattcctgacggagcgctttcctattttgggtcctgacacttggccacctctccggaaagagcagctgacttccctttttcttcagaaccatattatatatataatgaaagagaagagctcctcagtttagggctgcctctcccaa

SEQ ID NO: 41337 - DNA, 1294 bp, Bovine  19866880775457
gtagcaaaattgctgttagccttttacaagggctatgcaaggaaaaggtctcatgtacccaaaggcaggcatacaaatgatgccaggtggccaggctaggatggggaagaactgacccttagggactcaagtttgagtcatgatttgagtaggaggccccgagaatgggggtttatgggcagaaagctcagcaatgtgccatcaaaaaaaaaaaaacaaagaaaggaaggaaggaaaaatgaaagagaaagaaagaaggagcctggtatttctccatagttttgtctttctcacccaggtataaaatttcactcatacattactttccatctgttctcaaaagtatttaataaagagactacttaggcatatacaattaaagtaatattaaaaaaaaactccagagattcgatgcatattcattacacaaatatatatgctcccatggttacaaccagctgcatgcagaaaaggagacagagaaattaaaatggttgtggtaaagaggtgagtaagcattctcttttaatgcgtttgatttcagtgacacatatttctcaagaatcatttgggctacctcccgaggcatagtggaccccagcccaggcgtttgtgttccctagagaccaggtaggggtcagaaccttggggtctggttctataaaagtcatgaatctagctccccacatgtcagatgtaagtctatgtttggcataacggttcttggccctttcttcctttagttggtctttcactgaggtttctgaaagcacacaggaagtcagaaaaaagaatagcaaccccactcctccacagcttcaccacagatgagaggcagtggggggtggggtgcagagcacagcagatcccagaaagggccccgtgtcagaggaggggcgtggggactggtgggccctccgtgccccaccgggcagggatgggagacggcagaaataggtgggagggtagcagcaggcaggggttacgtccacagccaggtcttgtagggtctccagaggaacccagctccggtacctccctccttctgttggctgagaattttctgggtacctcacatacacccacaaaagctatagcatgtgaattcttttgaatcccatctaacttaaatgccaaagaaatgcttggttaactatgccaagtcaccttacctgctgggacctcaattttttcatctaaaaagtgagggtaagaggaagattttttctaacaaagtctagagcatgaacatttcactttaaaaggggttcctggggtggctcagctcattgtt

SEQ ID NO: 41338 - DNA, 1121 bp, Bovine  19866880824657
atcatggttttatagataaatacatcttcacagccagcaagtaatgcttccattattattgcatagtccattgattaattttcttctttaagtccaagtggagggcagaactcaatggagagctcaataattaggatccctaaattgaatacaccaaacagcttttcagcacatgggagatatggactttggagctcagcagtcttagggtaagagagtaggtccacaaaaaaaagcgggactccctctgaaatcttctattttctcattagtaaaatccttttaattgttaaaaaatacaagtgtgattgtgtacttatgatatgtcatactaacagaggcacaaaatatgttacttcactttcatctcttcataacattattctgtgactctaaggttttcccctggctcttgagcaaatagtactgtagttagtaactcctgtgccctggagaacctaatgtgtggaccactattagcccttatgcgtgcacgcatgcgctcagtcatgtccaactctttgccaccccatggccaggcttctctgtccatgaaattttccaggcaagaatactggagttgattgccatttcctactccaggggatctccctgatccagggatcgagcccacgtttcttgtgtctcctgcactggcagcagattctttaccactggcgccacttgtatcccttaccttgacctcaaatacttatcctaccttctcccataacctgttgtagtaaaatcacagtggagaggggagtgctgctggtgatccgcacatttatgcccctttatgagccgatgtccatttaccccaaaaacgtatgctgggagatgtaatctaatctttcctagcagatcttggttcccacttgcttactgaagcatctatgtgattttagtggtttaaagaaacattaaaaaatatgatatgatctctaaatagaaaccaaatactttggtggtcaactgaagaaatacttttagcgtggaagggaaaactgactttttttggatctatggagggagagttggaatgtcagtcttccgtgtgacttgagatatgaatatgtttactactgtgggctacttaagcatttttcaagggttttttt

SEQ ID NO: 41339 - DNA, 1220 bp, Bovine  19866880883339
ctaattattgatatgattgactggaggtatatattgaaataaaatatacacacatgggaattccctgccagtccattggttaggtctctgcactttctgctgtggcccagggttcaatccctggttggggaactgagatcccacaagccatgtggtatggctaaaaaaaaaaaaaaaaagcatacagtttaaacaaatacttcacctttgttcacttcaccttttgaacaaatgcttcatgattgtaattgttcaattgtaaaacctgttaaaagtgtttttaaaaaaagaaggttaagtgaaatatgctaaagtttactgtaagttgggaagggaaaaaaataccagtcttttccacaaaactttttctctctcttaatgaagaaaagtgtaattcaaaaaggctttgatgatggaaaattaaaaaaaattttttttgaacagtttttgttttatttaaaaattatttattttttattgaagtatagttgatttaaaatactacttaagggaattccctagcagtccagggttaggactcagcactttcattgccagagcctgggttcagtcgctggttggggaactaagatcctgaaagctgtatggcatagccaaaaaaaaaaaagaaccaaagaataattttaaaactgaattaaaattttaaaaataaatattatattagtttcatatgtacaacatagtgattaggtatttttatagattgtactccatttaaagttcttacaaagtaataaaatttaaagttattacagctatatttctctgtgctgaacagtatatcttgttgcttatttgttttttctttgttctcttctgtctctgcagatgaagatctgataaagtatggctggcctgaagatatttggtaggtaacaaattttggttctgctgtttacagatcgttatttactttctgagacttggccaaccacctgactcctgtgattaaaactacaactcatggtttgccatttgtttatgactgttcagtggtaaaaagctgaccaccagctcccttcacttataagtaccacgttaactgggaaggaggcctcagagatggacctcaggcctgactgaaaaggtcttcagaacataggcttacttttactgcctgtgtgtctcctcagagtaggtggctgagaccgccacactgaagccccagagatctccagatctgtcatgcaagagataag

SEQ ID NO: 41340 - DNA, 824 bp, Bovine  19866880890396
ttcttccctcccttccttccttctcttttcttactgccttttcttacttgtcttttctctccccttctctcgtccacgccctgtctgcctccctctcttgtgtttgtgcagagcactcttttatctcctttatatttgacttgtggatgaattaaaattgtaccatttgctttgtggtttgattgttttttttgtttggccttctgaggccctgcaaggaatcaattgtgctgtgttgggcagagatcaaaaagctaaaagaagccagggctcaacccccagggtacaggtaaagccagggtggtggggtcaggtacctgtgtgctccagcccttcgccccagtgcctgacccgagggcggctttccagtggggacccagacagcccttccactgccacaaagaaaagccaatgcaccctcccagccaccatccacgaaaccagggctctggggggctggagaggggtcccagctgcctgagcagtgactgcggctttatttgctctctttcctcatttgcaagttggttgggagatggattaaccagaaggagcatctctatatcaggaggtcaaggctgggagcatccctgcttcaggagaggtgggaggaggggtagcggggctggggctgcatccacagagcaggaggggtcagaaataagaatgacccccagggggttggttattggaatgaactgaggcaggtggactgggcctgcggtggccagctttccctggagtgtcagggagagcatgtggaggtgtgaaagggtgggcacctgagctacctgtcccctgaggcaccctcaccccacacatcc

SEQ ID NO: 41341 - DNA, 1000 bp, Bovine  19866880977845
tgtgtgtgtccttaagcctcacatgggaggtcattgcccaaccactcaggaaacagtaacacagtatgagcgtaaggtgtctgcccatggcccggcggagctggctagatgggcgccgtgtccaggcataactctgttttctgctgaactgaaacgtggcctcacagtccttctcaacccaatgttccgggctctcagaatcattgcctagggcagcacatgagacagcataaacttgtcattccttaatatcagttttgcaaagggtagctttgcatattaaccttaacatttgcctgtattctcagtcactcagttgtgtctgactctttgtgatcccataggctatagcccaccaggctcctgggattttccaggcaagaatactggaatgggttgccgtgccttcctccaggggaatcttctggacccagggaattgaacctgtgattcctgcattggcaggtggattctttaccaccagaggagcccattacgtattacatattaattaatagtacatattaataatatctccaataataactaacaattataattattatatataaataaaacaattctaattaacaataatattatatattaattaacattaatgaccacattaacacagtacagctagaaagggtagttgttggaacgggaaggagagagactattttctgctgctaggaccagggaagtctccctggagaaggtggcatttgaactggccttgaaagctggggaaggaggggaggggcccttcgaagcgcagggacctgcttccgcagccctgccccttcactaccgccttccccagccccgccctgccccgagcgaaccactcacctgtacatgatgatgttcatgtagcagctgtcgcgctggaagcaggggctcagcaggatgtcgtccccgcgagtgaagcgtacctccacgggggtagtgggccactacctttggggttcgcctccagcatggccttcagctccag

SEQ ID NO: 41342 - DNA, 1672 bp, Bovine  19866881001781
ttgttccactaggctcagaaaaattatctccctcctccccctaggaaaactaaaggggggcagttactcatctctccatctcttgacctcttgaatgtagtcccaggacctaagggtggtaaacagatattcctatagaagcaacatgaagcaagattcaccacccttcttggaaagctttaaagccaccagttcagttcagttcagtcattcagtcatgtctcactctttgcaacccgatggcctgcagcacaccaggtctctctctccatcaccaactgccagagtttactcaaactcatgtccattgagttggtgatgccatccaatcatcttatccccttctcctcctgccttcaatcttttccagcatcagggtcttttcaaatgagtcagcttttcacatcagatggccaaagtattggagtttcagcttcaacatcagtccttccaatgaatattcaggactgatttcctttaggatgaactggtttgagctccttgcagtccaagagactctcaaggtcttctccaacaccacagttcaaaagcatcaattctttggctctcagctttctttatagtctaactctcatatccatacatgactactggaaaaaacatagccttgatcagatggacctttgttggcaaagtaatgtctcttgattagcagtgaatttgagcaacctcctccagctaccattgttacatccttcaggagcaagaggttcatatgggttaaataatgaggtatcagccaaagatttagggctaagggttcatggactgcattccgaagtaggaccaaccagaggatcaggtacactggtgtaggtgggcattgcttcttgtgacggtcatttcagctggatctgtgctctggaaccaagagcaaaatcatctctggatataagagctcagagtggtctaatctccactgtatttggcacctagttttccataagcaaccccccttttacttacaagactcagaaaaacctctggaaactattaatataaactggatctagttttgcaggtgccaaaaattgtctttttaaaaaattcattaaattctgtatcctatcattcgtgatcatgtacatttcaattctagtccttcagaaggagaaaaagactaactttcaggaagtagaagaaatatcagcgttttcaaacaatttgtctttgatgggacagatggaagtcagatgacctgactggtgcatctgaagaggatttgaagaatcttcaaactaggaactttattcactcgtctatattgagatcaacagcttggaagagtctattttccctgatttacaaaaaataagttgtctttcggcttagaaaatactttttattttaaaaaagaaagactttttgagatcgtgagaatgtagaaaactttgaagactgacatcatttgtgaaattattggagtgacccttgttcctaaataaggtctctgttttgagatgatcttttctgaggaatgttttaaaaatactatcgaataccttaagcataaccttgctttctcttagccaaaaaagaacatagaaaattcttaactgaaactgttaagtctacattaagccagtaaaactcttaccataggaaaagacacaatacattatcttgctataatactgtattaggcttctta

SEQ ID NO: 41343 - DNA, 1558 bp, Bovine  19866881028053
ctcctcctcctcctctctctcctccacatccacgttggtctccagccagtgataggaggggcagggcttcagatccggagtgtctcggagctccaagggtggcaagggccggcttatcagaagccaccgagacacacagcccagaaaggccacccgcacccagtggggcatgttgtgggtgctggcggagcggtggtggacattgagcacgaagacggtgatgacaatggacagggtgacgaagatcatggtgaagagcaggtactcgctgatgagcgggatgaccagcgaggtggacgggatgatctcggtgatgagcagcaggaagacggtgagtgagagcagcacagagatgcacagggtgatcttctcgccgcagtcggagggcaggtagaagacgagcacggtgaggcaggagatgagcaggcaagggatgatgaggttgatggtgtagaacaggggcaggcgccggatgacgaagtagtaggtgacgtcgggcgtagacctcggcgcagcagtcgtacttcttggtgttgtaggtgcctgtggcgttgacgatggcccactcgccgctctcccagtagtccttcaggtccaccgtctgctccatctgcaccaggtcgatcttggccttgtcgtacgaccaggagccaaacttcatcttgcagttctgctggtcgaaggggaagaaggtgacgtcgatgctgcaggagctcttgtagatggcaggcggtgcccagtgcagcaggcccgaggagaagaggtgggccttggtcatgtgggtcaccacaaactccccatctgcactgaggagaggagaggcattggggggcggggggctggggcaccccagctgcccaacccaggctactccagataactaccagcagggggaccccaataacacagccagaccacaccgggttgttgggacttgaagaagcaagactcttcagcacacagacagctagagctacctgagttgtctttcaaacaccatcttcttagctacaaaagtaggaattttgaagaatataggaaagtaccaagaatttttaaaataatcactgctgttgatgatatatatatatatatatatcacatatatttcatcatcatctagacaacacatatagaatttttatatatttgtgatcatagggtatatacatagtttgatggcctgtttgtattcatttaatattttagggtaattgtgctgcaaccccatggactggagccacccaagctcctctgtccatgggatttcccgggcaagatactggagtgggctgccatttccttctccaggggatcttctccgggggactcagggattgaacccatttcctctatctcctgcattggcaagcagattctttatcgctgagccaccctggttgtttttttactatatccccccaccatctgccgcaggtggtgatgaagcccctctgctggaggtcttgtcttttctacctgggattttagtttcttcctcagcatagacctgataattttgctgagaaggaggaatccatccagttaacagccatat

SEQ ID NO: 41344 - DNA, 1404 bp, Bovine  19866881049392
tcatgagagccctgtgaaatatggcatcatgaggatttctagtttggggatgcagaaactgatgattaatgggaattccctggtggttcagtggttaggactccatgcttccactgcagggggcatgggttccatccctcatccaggaagtaagatctcgcatgtcacgtggcatggccaaaaggaagaaaagaagcagatgcttaaggagattcagtgacttgctcaaggtcactcagcgggtcagtggcagaaccagaatttgagcccagtccatagtccagtgcccaagttggtgttcaggggcgggtggcaagcaagcatgctctgagatgcagtgttacctttgaagccacgcatgcccattggcccagtagctcccagcttcccttcatcacccttggggccgggcagtcctggggtccctctctcccctggcagacctaggggagacaagaaagttttggggcctcagactcagaactggaagggccctcagtgaccactgtctggctcaaccatgcatcttcctgttgcctctgcttcttgatttttttcagttaaagatgctgcaaaaacagacctcaaaaggccaacacaaactctccccgtcagcacctttaacccaatgagtctggatccctccccaagaaaggtccgagtctattgtgagcaatgtcggaggtgccaaactcatttgggcgagctctctttagctttacctatgctggagatttagatttgcaaaaaaatcttgagccttttgaatgtgccaggcactttcctgaatgctttttattaagtatcttatttaattctgcccataatctgaggtgttattccacctgtattaccaatgagaaaactgaggcccagagaggtgaggcaacctgcctaaggtcacacagcagacactgttggagacaggatcttagccctaatgggttggcttcatctcatgctggatgaaaagggcttattggtacttagggtaggaagaagaggaaatcactccttattccatagaaaaaaaaaatagaaaggtcccttccctgcaacaaacacagggaagtgtagagaaggggatggcaggctgacaaggagggaggaagtccaaaagctcaataattggggtgagacaggctgttgatctatcaggccccagggctcctggccccaaggcccgtgacaccagctgcaggtcaccatagagaccagaagtcaacaattgcttttacccagtgaggcctccacccctggaggcctgacctaagcccaaagttatctctgcaaagcagggcactctgattaactaattaattgttctttcctgctttgaatgttagttcgttttctttgacctttttccaagacatgaagaaatctgcctttcacttatgattt

SEQ ID NO: 41345 - DNA, 1811 bp, Bovine  19866881069997
tttcctcggcaggcgacctgctccagaaagccgtcctctaacctgagtgccatttgtcaccctttcaggaccaccgggccccaaaggtgatccgggggatgcagggaaagaaggcgagcctggaatccctggactacctggacttcgaaggtaatggaggccccgggagggacctggacataccaggaagggaaggggctctcccatccatccctgactttctgttttattgttgatgtcggtgatggggctctcaggacagtccccaattgactcagcttcagacgccctgttctgttaaaagactaagaggttgttggtgtaacgtggtgtgttttagtctctcagtcgtgtccggctctttgtgaccatgtggactgtagctgtcaagctcctctgtccatgggatttcccaggtaagaatactgaagtgggttgccatgccttcctccaggagctcttccccacccagggatcaaacccaggcttccgtgtagcaagcggattctttaccatctgagtcaccaggaaagccctgctgttaatataagtcagttaaaaaaatatataagttctttctgatttggaaagcttaaaacattttttaagtagtgtaacactaagatggagcaaatccttttccatagaaagtaccaggatctgaaggacaagagtgcataggagtcttacagctccctgaaccccaggtcagggcccctgagaccaggatcatcggaaggaatcaagggcgtcctctgatccagagcaacccttcaagtatgccacaccccctcggcatttcctgggtccccagcacttgaccccttgcttctgcggaaaccaccccagtcagtagacacccgtcctctcctgccctctgctacctgccctagtgacagcctggaaggtccagtagctgacagggagggtactttgggaccttctggaaagaatgtgttctccttagatgccttgtctcaggagttcctgttccattgccttatcaaactttgcgtcccagcctgtcaattctggagcctctgctgtgaacagcatttttctaggagagtgtagagtcttcttggggcttcccagggggcaggagacgaaggagacatgagtttgatttcctggattgggaagatccccagggggagggcacagcaaccctctctggtattcttgcctggagaatcccatggacaagagaagcctggaaggctatggtccataggtcgaaaagagtcaaacataactgaaatgactgagcatgcacacacttagagtcttctaagtcagcagtccccaaccttctcggcaccagggaccgatttcatgggagacaatttttccttgaacggtgaggtggggagatagtttcgggatgagtcaagtgctttaaatttactgtgcactttttttctattattattacttcagctccacctcagatcatcaggcattagatccttggaagttggggacccctattctcagtgatgtaagaaaaggggaggcttatcaggggaaaggtatctgcttatttatgtcaggaataacacctccaaaccctctccttcctaaatctctaaggaggctgcaaacagggggaggaggcagaggcttggtggaggcggagctcacagcctggccttcactcctggcctccgcctctcagcgcagctccctaaacttcagaagttaaggatccccaagggcttccagagcagtctttttcttcctcagtcagtgatgggatggggggacccctgggcatatcgtgcatgagattcagaattccatgacagcag

SEQ ID NO: 41346 - DNA, 1421 bp, Bovine  19866881071884
tttaaaatgattaaacaaggcaatttaagtgatacagacaaacttgaacactgcgtgaagtggccatctccatttccaagggccagagcaatggcaaatgggagtggaaggtaggacacttttataggataaagaataaggaacaaagaagagataattagagaatgaatagggaataggaaacaagtgtaaagctgaatgggcttccctagtgtctgagatgataaaaaaaaaatctgcctgtaatgcaggagacctgagtttagtccctgggttgggaagatcccctggaggaggacatggcaacccactccagcattcttgcctggagactctgcatggacagaggagtgtggcaggctgcagtccatggggttgcaaagagtcagacactactgagcaactaagcacataaagctgaactggcatttggattggtatttgggttggcgtttgggatgctactttgattctgataaagcatagcatttagaaggacgcaaaagttatctgcattttgacctgctgatgtgacccccctgggcaggagcggttccatcttgggcctagaaatatatttcaacaacacataatccctgtctgcagacaatgcttggtacacttgtggattcatggaccctctgcctttattcgagtccttggaggtgtgtgattcccaggttgggaaccactgttgggtaaaagaaaaaaaaggcaagaagcgtgcattcaactaacctgggaggaaatccatggccctttcctatgagcacatatcaggaatatatgtgtaccctttcccattagcacacaacaggaatgcgtaggttggggcagctgcagggtccatggtgctgtggcctgtctcctagggatctccccagtgccgtctgcaaaggacgtcggagaagacttgggagtaggatcccggctgcagtggaacacagaggggagcccccaggagtgtatctgaccttgtttctgtctccttatctgacctgacttcctggcagtgacatttaccagatggagaaggacatcgccttagagcaggagaggaatgctcgctaccgacctcccaaaatcttagagcccacagccttccaggaacccccacccaaggtgagccaagccccgaactcattggccccagtggccccatgaatcacagcagagcggggaccctgtccaacccctcccagatctgactgtgcagctccccttacagtggtggtcagatgggcccctgcgtcttctcagcccttccacccaaccatccatcagccctgaggcagcccccatcagtcacctcggcagatggaacctgagacagccagagagcaggcaccttgtggggctgctggagcaggcagtcaccctggaaacatttccctcgggagacagtagcactttcccttttt

SEQ ID NO: 41347 - DNA, 1367 bp, Bovine  19866881136650
cagtcattttaaataagctacataccctagcttaggactgttctctggttcaggatttgtgctgaaaatattaataggtacatgaaaggcctataggtattgaggtcttgggggccttttcccatctagctcttcacccgtagagcaaccattaaaaaaaaacaacggaagatcatgttgctggaaaagtgatttctggttaagggcagcctggtggtaacaagcctctgggcttgtttttatggctctgtttccatgagatttaatatatggtacgtgtgtacagcccgaccagcttctccatttaactagatccccagaggaaagggcctgaacctatgattttcttacgtcttgagaacatctggttttttctcttagtctatttagtatatgctgttgccttagtggcaggataatttccaacagcatgccgtaagcaggatttgcatttcatctaaactctctatgcattccacataggtattgggtagttgaagtgtaaaccaccaaaacctctttcctgtttcccactgtattgagttcaccctaagaggctgagaatcaaaatgttttctggctgaattcgaaagcaaagaacatgggagagcaaaaacaacagcagggtgccgaaattgtggccagatgtcagaaccagctcagaagtcttacacaatcactgaggatggaatactcatctttgttaggcattaagtaggcgtcttccctgagggaaggttcgaattccctgttccatcttcccagtgtcctggaccacaatggaggaaggaactcatcaattacagaccactcagatcccagcacatgtttccaaagcacttcttgtttttcaggccccatattcccagaacaagcaaaatttcatttcttgttgggtggtaggaaaagtcagagctgcaagtggaaatctttagccattgaggatgagtaaaggctggtggagtttagtcttcctaacaggcagttgtgtggagggcttcccagctcctactctgctccaagcttgcgctgcactcccgaccccagatccccagtgttaggaagctgctccagacaaaaatattacctcttagagttcacccatattcctgttcttattttcggtctctctcttttttaaaaaaaaattatttatttatttttggctgcaaaaataagtattttattctgagttgcaacatgtgcttcttgctagtcatgacctgtgggctctgtagttgctacgcgcaggcttagttgctccacagcttgtgggatattaattcctggataaagggtcaaacccacatcccctgcattgaaaggcagattcttaaccacgatccaccaggaaagtcccgtttttt

SEQ ID NO: 41348 - DNA, 922 bp, Bovine  19866881349594
tgtgtgtgtgtgtgtgtgtgtgtgtgttcagcttctcagttatatctgactcctttgtaatcccatggactgtagcccaccaggctcctctgtccatgggattttaccaacaagtatactggaatgagttgccattcccttctccaggtgattttcctgaccccagaatcgaacccttgtctcctgcattggcaggcggattcctttacccccgagccccctgggaagcccttcatacgtgctcacagaaaacattaagaatgccttacccagacaagcagaaactgtcaatggattcagagaatggtttaaaaatagtgcttaaccttattaagaagagactggagatatttggaccatgtctccaaagcttttaaatcaacattatggaaagcaactcccacaaatctttctaaagacagatatatgggttggcattttgacataaaggggcgtttgagaatgcacttatgtctaacgggtcccagattattaattacttttttggttggagtgaattattatgccttttacattttatttttcagctgtgctgggtcttcattgctgtacacaggctttctccagttgcagtggtcaggcgctactctctagtttcggtgcacagacttctcactgtggtggcttcttttgttgcggagcgcagctctagagaacaagggcttcggtagttgcagcacgtgagctcggtagtcgaggcttgcagggtccggtgtactggcccagtagctgcagtgcacatgagcttagttgctctgtggcaagtgggatcttcctggaccagggattgaaccagggtcccttgcattgcaagggtgattcgtaaccactggaccaccagggaagtctatgacttgtaaaatagagaaatgaatacaactgcaatggaaacaaatagtaa

SEQ ID NO: 41349 - DNA, 1429 bp, Bovine  19866881367921
aggagcctggcgaagctacagtccatggggtcccaaagagtcagacacagctgagcatgcaacacattaatacagcatagtgtaataaacagtaaaacgctgtctgttattaaagcacagggggtggtacttgtgacttcatgaaaaatttgactatgaaataatgaagtggaggaaactttaatggtcttcaaatatatgcttgaagtaatgaaggatgatgtttaaattggaaacatgcaataatcgaatttaaccatggcagatctgacagattgtcaatcatgaagcacttactgaggatctcctctgctcctggaactatcctaggtgctgtgattcaagaaactgtcagctgaccatcatgctgggtctgtttctgttgtttagtcgctaaattgtgtccaactctttgtgactccatagactggagcctgccaggctcctctgtccatgggattctccaggcaagaatactggaatgggttgccatttccttcttccggggatgttcccaactcagggatcgaacctgcatctcctgcaccgacaggcatattctttaccactgaggcactggagagccctgctgggtctgtgatgctccaccacctacctcccagttcagttcagttcagttcagtcgctcagttgtgtccgactctttgcgaccccatgaattgcagcatgccaggcctccctgtccatcaccaactcctggagtccacccagactcacatccattgagtcagtgatgccatccagccatctcatcctctgtcgtccccttctcctcttgcccccaatccctcccagcatcacagtcttttccaatgagtcaactcttcgcatgaggtggccaaaggactggagtttcagctttagcatcattccttccaaagaaatcccagggctgatctccttcagaatggactggttggatctctttccacaccccacccctcccccccaaaaaagagcataaattcctgctttctgccttcgtggagcctaaacctcaataatccacaataagagcttaggtacttacgaaaacaactggatttctctactttaccccactagcatgccgacattctggccaaacctttgaaggaggttgaaggaggaagagagagtctgttggataactcagagatcatccctagcctctgggagcttgcaccaaattctttgggagaatttgtgtcctggttcattcctgatatcacagaatctccctttttcagaagctcttcatcactctctgttttgtaggcagctcttggataggagccaagttctaccaagatgggtgggatgatttgatttatgacagcagagaaataggctttcagtgagtttttgagtcagaaccattttcgactccaaaataaattggacaggaagtgcgatccatgccaagcac

SEQ ID NO: 41350 - DNA, 1816 bp, Bovine  19866880358804
aaggaaaccaaaggtgggaaattctagccctgcttcttgagttataactggctgttaggcaggggtctatcttatgcgtattcggtgaatgtaacactagtttttcctacacaagatgctgtaattcactgctcaccaggttaggtcctgccaggtggctaagcttcccccctggtggttttgggtcttcaggaggtgccatcattccctctggtcccacccagctcttcagattgctagtgattttaagtacagagcgctcagtagcaagaggatcactgagttcacttgtttggaataatcctttcccagactgctaacatgttgatgatgtgctgtgagacacatcaatcacggtgttgtgaagaccacatggctgtgttgaccagcaacgtgtgactatttacattttaattatataaaaaataaaatcaagtggcttagtttcaacagcaacatttcaagtgctccgtagcacctagtggatagtgccattgtgaaacacttccatccctgcagaaagtccaccaaacaggactgcttcttagtgccctggtgagcaagatttcccaaacagctttggtgtctgccttgtgggctgcctcagagctctttcaaagtccaggcagaaactggctctaccccttgcatatcactctcttcctgagggccagggtgcctcttgtttgtctctgcattcccctacttccacgggaagcctcttcaaattcagaaattcgcaggtgtattggagaaggaaacttctgggcaatgactttttagagcaaggcgacaagaacgctagtctcatgagtgcaagctacgtagttctgttggctttgtttagctcttcatcgcttggtcacccagttatcttctgtcagctgggtgtcacaaataagtgttcctggttacaggtgagcatagggtcattccttaccaccccccactcctcgaggtaccctgccctccaggtacctcatgcaacctgatgacattcctcagacttccttgtctggtgtctttgtttcttccttagccaaaccctccgcgtttatctaatttatcttatccgatttctctctggataagcagctcggtgtacgcacttaacagagcagaaagagaacttgtcatttctgaagaaagaagtgaggcggcaaatgtacagggtggaacaagattaggcaggatcaaaaggcaaagcaggatgctcataacaaagacagtttaaaaattacagccttcactgttcaccctattggaatttaccggctgtcagcgcaccagcgcaccgtgggtgtgaactgttaggcatccggatgagagatcggcctttattccttctggctctctgatgacatcctctagcaaaagctcaatgtcatcattaaaaagaaagaacagcacactgatgaattaatttgaaaatatctgaccagctcttccagtcgcaaatctggaaataaattaataggtgttttgcatcaagtacaacagcatggagttaagtacctggaaaaccagtccttactggctgtgttagtcagagttctccagagaatcagaaccataggatgtgtgtagaagtatgtgtgtgtgtggtagtgaggggaaggtatttttaaaaataggtttgtgtacctgtggtgactggcaagtctgctgtcctcagggaaggctggccagagttgatgctgcagtctggagtccaaagacagcctgaagtcagaactcctttctctttggggatctcagtcttgccaatccttcaactgctagcatgaagcgcacccatattatgcagagtctgagt

SEQ ID NO: 41351 - DNA, 1102 bp, Bovine  19866880395344
ctggttttctttaaaactgatagaaaacattagaaagttaatacactgatttatcacagaaaagcatgttgtgtttagagctcagtgttttaagattataaaactacattcatcagtgaaatatgtcttgaacataaatgatttgccaatttatctttctagtggatctcttcacatctgccttaaaagtgctatttagagatacattaatagagtttcagataataaaacagttgtaaaatctaatttataaacagaaactagtttgagacacagtgctagattgtgaatgatacttaatggctcaaaagcacttataaagcagtgtggttctgattttgttttctgaattaaactcagtgtcatgtaaggagttaccctataattattcttaacacaagatgaaattcattaggtaactgtggggcgtttgattatttcctagctgaatgtcgtgctacctctttagctggttgggtgttacaaagcacttgagaattacggtttgaaatgatttctatgggagaggatcatacaatgtgtactttaaacatcatcaagctattaaaaaatataccctttgtaatcttttttttttccctctcaaaaaatacacgttcataccccagtcactcagtggtaaagaatctgcctgcaatgcaggagacacaagagatgcaggttcagtccctgggttcggaagatcccctggagaaggaaatggcaacccactccagtattcttgcctggagaatcccatggacagaggagcctggagggctacaatccataggattgcaaagagttggacacgattgaagcgacttagcacatgcagtttcaaacttttgcagaaattctagcctgaactttaattaagttttaaattcttaagataatccttaatctgaggtacacaggcttcttagaaaaagttcatagttactagaggagtagtcatagagagtctgtatataacagtagttgtagattaggtcttcaggttctttcactcaaattttttgtattccttattagtcaaatagcattattcttttgcgatttttgactatggcctatatctccctgggtttgtattaat

SEQ ID NO: 41352 - DNA, 2256 bp, Bovine  19866880540969
catctgagtactgagctacgtggccccttttagaagcttcttcgttccttaatttgatgagcactccccaaagcataccctccctgtggtcgctgtgtccatctcacttcaagagaataacctgctatgaagatttactcactttcaaagataaaagaggatagcatttttatccaaaactctcctttaagaacccccctggggcagaacacagcccttttgcctgcaggctgccttgaacatctctgattctctgcaggtatctgaggcctgtttggaatttggtctttggattctagtgatcttacctcggtagagaacaaactctgtgccttgttcctgttgttttaaaaagaaaaaacaaaacaaaactccaagtattttcagtgattaaacagcggaaaatatacagcaaaaattacttcttgactacattttctttcaaatgatgattaggctcaagaggtgaaacttattttagccctacccttgttttttttttttttttataaaaagctttttatagtttaagaattataattaaatttcctctgatttattaaacttaggttttcaaaaagagaatgatgggatttcttaaactattaagtttcaaaaacgaagactacttatttttattctaatataagagatgagagactgagagggaaaattttttccatctgtattttgattagaattttttaatgttcaaatttctggtaataaaccacagtaaacaaccagtcattcattaagaggcaactattgaaatggcgatatttagaggagaaaaaataaaacatgatgtgattaaaaccccacgcacgtcttcacttcaaggcaaacgctgtgcccatctgggtattaagaaagtgccaaatatcactgggatctagatttaactcatgtcataaagaagcactgtgtttcatttgtttacaaaggacctggaacctcatggaaatgatagtggtgatatggacctgaagagaactcaacagtaaaacgaggtactgatttataaattatttaaatacggaatcagtcacaacatgaactttcaatgatctactgctccactcttaaggataagaggtaatattaaagaatgttaactttcggctgtaataggtctctgctctaattttctcctctggaaatctttaagggttagtcagtttaaaaatcctggctacttttaagtcagaagggccaaagaagaggagacacagtttgtcctgaatgggctcaaagaccgtcctaaggagttaagccctggatgtgttccctgaactgaaggtgctgtctctgcttgctttatggtgaggtttgggaaggactgagctccagagccctctctccaggtggcgggaagtaggaagtgccctgagccagccacttccagcacacgttccaggtatgcacattcagaaatgaaactcaagctggccaccctgccagccaggatgcccaccctcagcagggatgggggttttccttccacacttttgtgcccactgagtctcacgtgaacagaagacctgatccctgatttcagtataagaacaatgatgggaattttccgtgaattttctttaggaaccgatggctaccataaatcccacggaaatgagctttccctttacaaattcctttgaaaacggcagacaaaggcatatccttgcgctaaactcatttgtaaataagtttttcctgtaagtttattacaacacaaccaacagtcatcatccaatcctataatgcacatgtgagacattggttttcacaaatgatcttttgtgatcgttaggaaaaactaactttctatctattctttacctacatgagaacaaacatctccaagagtgattctaagctaagtagctttataaaatcagtctttttttttttttggccatgccgcatagcatgtgggatcttagttgcctgaccagggatcaaacctgtgccctctgcagtgagtggaagaacagagtctcaaccgctggaccaccagggaagtccctaagaccaggctttatgcttataaacctatcctccaattggcaacaacagctctatcattccccttagtttctactatgtacacggagaggcaaacaccggctttattgatactctttactgtttccgattttcttcttcttagcacatcataacctgcgattgcctgtgtgtgtgtttgtacactgttttgcacaaacactgtgggataaatggaaggaagggagg

SEQ ID NO: 41353 - DNA, 1215 bp, Bovine  19866880556959
aagggaatgtgatattcagacttccccccaaggctgatggaaaaggtgctggattagacccagcactggggtcaggacagcttgggctgctgtgtggagcagggtgttgggggctgaccaaaggcaacatgcagctggtcatgggtaaggccctgtgtggtaaacatggtcagaattgggttgtctgtctttcaaagaagtaggttatttggtctggctggtggctcagctggtaagaatagagtcggggtccagcagggggtgggtagtgctgtgtgttcaacttcatggtcacagcgcataaacagctttaagcggtcagtgcccaggaactggtgctgggtccagagggacatactggagcctatggacagctctggatgccaacagctctctagagctccactctatcgataaagtcacttttctgcctgacattcttaatgccttatttaactggggaggactggggcagagtagaagttaggtatcacaatctgagaagtctgttactattatcatacctaatcttaaactctttcctgaaaatgattataggatcctatcttacatgagctctatgcattttaatattacaaatgtgctaaaagtgaatctgaaatgcagtaaagcttaaagtccttttacaagacaacacgatgcaaactctgtccttactaaacaggttcagttcaattcagttcagtcgctcagttgtgtccgactctttgcgaccccatgaatcgcagcacgccaggcctccctgtccaatgtgtgtgtgtgtgtgtatgtgtgcgtgtgtgtttaaagctggtgaatctcagctccattaacaggggaagttagcaaagaaaatgcaaaggaagggaatattggttataatcaaaggtatcccctcttttggttctggacaagagtcaaattggactaaggcagtgttcttcaaattgttgggtaatccattagtgggctgtgaaataatttcaatgcattgcaagcaacacttttataaaaatgaaacaagagaataaaatagaaaacaagagctcactgcacttagtgcaactattagttcataaagcactatttcacacttatgtgtgttgtgtgtattttttcctgacacaaaacataatccttttcatgagttccaggcaagaaaatggtttattagaaagaagatgaaggatcatgtttgagatgaggtaggaggat

SEQ ID NO: 41354 - DNA, 795 bp, Bovine  19866880596770
atttaggattgggggttgtgattcaataacacggaaggctctaaaaaccgatggtatggattcacacataactggacttaagtctttcagtgtctgttaaatgcttcagttaaatgctacaaatgatgacaaagttattggttcaaaatatcatataaaggcacagactttttctctgtatagaaacatatatataaatctataggtaatttctagcgtctagcacgtccactatgattaaggggaaaatgtgtttttctgattatttgatttcccaccaaacacactacgcattttacagcagatcagctgcttctatttgaaagaatgtggtcagaaaagtaatgcaaaagctgccactttggttttgtctgtaccttccaggtcatatcgtcgtacctcacttcctgacacaaacaagtttttacttgttgtcagcaacaaagtcctaatatagctgcggaagagaaaaactgcattgcatttgcctcctgcaagcatcatcaacacagttaccggaggaatgttgattccagaaaagctttaaggctggtacgatggtaattatgtatcaaatgcctgattctatttctgttattattggtttgtcatttctgagccacccaagaactggctgaactcgcagagggacaagtccggttcttctttttgcctcggtaaaatttaatcagacctgatagaaaactcattgctctagggggaaaataaagtaggagccacgaaatgtcattttacagagcgggggggttttgtgactgtaggaaaggatttaag

SEQ ID NO: 41355 - DNA, 1834 bp, Bovine  19866880623132
tttaatggtcactccttctaaatcttatagaactaagatgaatgatatttttaaagttagggttttaaaattttttccgtattttcccatgaaagcaagaatatgaagtgtgacatagaatgaaagattcttctaatgctgagtgttagagcttttgaagttagttgtcagtgtttcagagctgtagtggtgttgtcacctcctatttttgttttgtgatcttgattaacttcttagttaatttttcttttggaggcttaaaaaataaatggacaaagcgtatagtggttcgaaccaaaaatgaaagatcttacaccctcaacattttcagtttgttgttgttgatactacataagtagtttttcctatctgaataacgagatttgtttttataaaccgttccttcttttaagagtaatttttaaaaatattctggtccataaaagcaaattctgtatttttagaacttgctttatttcatgaagtacgttcactaaatatactttgagtgtctctccaaaaagggtgacaaagaacctcctggtatgatttagcaatagctcttatatatctgctgcaagttttgtcgtcatctcctgtatgcatgtttgacttgatagtgggagggaaagctcacttaactgctcatccctgtctctgtagaaatcacactggtgtccactaagcccgagaagctggctccttccaggcaagacattttccaaggtatgatgatttgatgtgtagaggaagtagcccagctccctaggcattgtaactataatgaaggcccccactttttattcaattttattagttctcagtatgggaaatctttatatgactgaatataatttattgtcatagcttcctgttgttaggactactggaatctgtgggagttggcaatttccagttgtcagcttactgagaatgttgttcttaccctgtatcttggttaacgggactcaaatcagatgaaattaggaattgagtttcttttttattttttgcttttagtaattaactgtgaagtgaagtgagagtcgctcagttgtgtctgactctttgcgaccccctggactatacagtccatggtattttccaggccaggatactggagtggatggcctttcccttcttcaggggatcgtcccaacccagggattgaacccatgtcttccaaattgcaggcagattctttagcacagctgagccaccagggaagcccaattaacagtataaactcttacttaaaagattacttcactaaagcctggggacacattattaattgagtgttcttaaaacattttagctacccagagtaatatcttcccttgtcttattttgcttccttcttttctttccttttttcttgatagagcaactggctgccattcctgagtttgtgaatctaggacccttgttcaagtcttctgagcctgttcaacttacagaagcagagacagaatattttgttcgttgtgtcaagcacatgtttaccaatcacattgtgttccaggtgagagaagtgtcataactggctctggtaagggatttagtattaattctcctttagtttagaatacacagaagaactgtacaaaaaagatcttcctgacccagttaatcacgatggtgtgatcactcacctagagccagacatcctggaatgtgaagtcaagtgggccttagaaagcatcactatgaacaaagctagtgggaggtgatggaattccagttgagctatttcaaatcctgaaagatgatgctggggaaagtcctgcactcaatataccagcaaatttgggaaactcagcagtggccacag

SEQ ID NO: 41356 - DNA, 1375 bp, Bovine  19866880703881
caaaatgccagctagatgaatcacaagctggaatcatgattgccaggagaaataccaacaatctcagatatgcagatgatatcactctaatggcagaaagtaaagaggagctaaagagccttttgatgaggttgaaagaggagagtgaaaaagctgacttgaaattcaacattcaaaaaactaagatcatggcatccagtcctatcacttcatggcaaatagaagagggaaaagtggaaacattgacagacttaattttcttgggctccaaaatcactgcatacagtgactgcagccatgaaattaaaagatgcttgctctttggaaggaaagctatgacaaacctagacagcatatttaaaaacatcattatgccaacaaaggtccgtatggtcaaaggtatggtttttccagtagccatgtgcggatgtgagagctgaaccataaagaaggctgagtgctgaagaattgatgcttttcaacctgtggtgctggataagactcttgagagtcccttggactgcaggggaatcaaaccagtcctaaaggaaatcagtcctgaatattcattggaaggactgatgctgaagctgaggctccaatacttcagccacctgaggcgaagaactgacccgctagaaaagcccctgatgctggggaaagatcaaaggcaaaaggagaagggggcagcagaggatgagatggttagatagcatcaccaactcaatggacatgaatttaagcaaactcagggagatagtggaggacaggaaacctggcatgctgcagtccatggagtcacaaagagtcagaaatgaattggtgactgaataacagcaacaacaagaaggtcttcaaaactgttttattgcagtaagtgaactttagggtcctcatttcctggtctaagttgggagaaaaaaattaaagtgtactataatgaaatacttcagacttttcctggttctctcctaagatttctcccaatctgttctacataatgggttggcagatttctacaatcaactgagaagcccagcaactttgtgagaagtcagagaccccaggtaaaatatttcttctctgatctttcagaccaaggacagctccaccagttataaacactctgagctgaaaacactcttatagtgaaggggcattttcagtgcagactgatgtgggaaagagttgtaaaggaagcacagattatccaaggataacaccctctcagacttttagatctaaaatctcaactctcaccaaacctcttctccgacggaattaatcactggcataacagccgcagcaattcaggaagactttcactctcccttttaccataaaagctgtaaagtcacacttgacattccttttg

SEQ ID NO: 41357 - DNA, 2721 bp, Bovine  19866880807150
tcccaacactttgtggcaaatagatggggaagaagtgttaattaacagtgacagatttcattttcttgggctccaaagtcactgtggacagtgactgcagccacaaaattcaaagatgcttggtccttggaggaaaagctatgacaaacctagacagtatattaaaaagcagagacatcattttatcgacaaaagtccatatagtcaaagttatggtttttctagtagtcgtgtacagatatgagagttggaccataaagaaggctgagcaccaaagaattgatgctttcgaactttgatgctggaaatgactctggactgcaaggagatcaaactagtcaatcctgaaggaaattaaccctgaatattcattggaaggactgatgttgaagtgccaatactctgggccccctgatgcgaagagctgactcattggaaaagaccctgatgccaggaaagactgagggcaggagaaggcgggggggagacagaggttgagatggttggatggcatcaccgactcagtggacatgagtttgagcaaactctgggagatagtgaaggacagggaagcctggcgtgctgcagttcatggggtcgcaaagagctggacaagccttagtgaccgaacaatgacaacagcaacacggatggacctagcaattgttatactaagtgaagtctttagagaaagacaaataccaacacttctatgtgggatctaaactatgacacaaatgaacctatttagagaacagaaccagactcacagatagaaaacaagcttatggtcaccaaaggagaaagggtaggaagggataaattaggagtttgggatctgcaggtacaaatcactacatacaaaataaacaacaaggtccgacttatggcacagggggaactacattcagtatcctgaataatctataatggaaaagaatatgatggattttgctgtaccagaaactaacacaacactgtaaattaagagtacttcaattaaaaaaaataaagttttccatatctatcttcaaaagaagtctggatttgttatctcctttgtaaacaggaggaaaaaaacttacttttcattttaagcaaaggctttatgaattcttactaaaaaaaattacatgtaaaatgttacatatatacagaaaccaaagaattatggtctggccctagcaggcattttagagttgaatttttactaccaacagctgctgcttattaaatcgaaaggttggggcttttggttttagatagcaagctaaaccttaaccacattttccttccttcccaacatcccactttaaatggcagaattccagccaaaagaaaaacaaagaaacaggactggaaatgtcaagaaagtaccaagagataagaaattctgaggaatcttgagaaacagcagttgggattatactgacaaatcacagccaaggaaaagagagcccagctcactagcaatataagatggaaaatttctgagtaaatcatcaaatacaaaaagcaggagtggaccataaaaaagacttctgtggcgagcttataataaggacacaggggcctgagtaagaatgagagcagagcttaaagtgactccaaatcttcaccacagacgttaggtgaagacaggaaacaaggcagctgtgctttgataaccatgtatatgtcctaacctgccttcctatcctcagtttatgcatcctataagaaagcctgcatgcatataagcttgcatcccgtaagaaaggttgcaaaactgtcagtcagagtctggttaaagtgagaagtctattgaaaaaaaaagagacatacaatgcacaggaaaccactgtcaactaccttctttaactgatatgacctttattcataaattttaatgtttagacaagaatcacatgataatatgagaaaaaaaaatcagcaatgtaaagagagggaccttagatgaacaaacagaccaagaagaaaagataaatcgcagaaaggaacaggaactctaaagaaaaagcacaaactcattatcgttgtagaaagtaaatattacatgtgtaacacaaaaataaacttccacaaaaaagaggcacagtgtatgaaaagacattaaaaagtaaaactataacagaaaatcaaataatagaatgaaaacaaaatgtgtttagtaaaaacaaagtcatttcagatataactgacaaattatcagaatatatagcataaagatatagaaattatgattaagatatagaaaaatgttaagagacacagaggataaagccatggaagtaaaaaatctgtctgaaaagtacaccagaaagagaaatgaaataatgtagaaaaaagaaataaaactttactgaacaaaagaaataagtgggtgttgtttgaaagagcctggggtgctaagcacacacatacacacatatatacacacatctcctagtgaaatttcaaaaattcagggattaaaagaaaattctaaaagcttccagagagaaaaagcaggttattatatacagaggaataagtatcaaactaacactagaccttttatcagtaataaagaatgctagaatacaactaagcaattaacttaaaaaatttcttggaatttaaaaagatatggaactaaaaattctatttcctgttaaattagcaatcccaatagtgagggaaaaataaaggaatttttggatcagcaaatatattaaagtt

SEQ ID NO: 41358 - DNA, 2427 bp, Bovine  19866880845437
ctggcaggctatagtcggtgggatcacaaagagtcagacaggactgagcgactaatacacacacatatttaaaaaataacataacccatattatagaaaggatatgacctaaatacagaaaaactgagatttaggaaaaataaacctataatccctttagcctaatatacttaatatcagcacttgggttcatttcctcctagtctttttctgtatgcatacttaaagataacatcatactgtatacaattgtggatcctgttcttttaaatataattttgtttcataagcattttccttgttgctagccagctttttataactatccttttaacagtgaataatatatcattaagtaaatgaacagtaatttacttaactatctccttatattgttagatgtttagaacatttccagtttcttgatattgtaaatattgtatccatatacattttctttccatatattatcttcttagatttcatttccagaatttccaaaacatattaataaaatgttccaggacctcaccattttatggctcttcgtatctattgccaagttgcttttcaaagggattatatcaatgtacagtccccaaaacggtgaatgtgagtaccaaacttcattgtacccttgaaaccattggcttgtttcattattaatttgcttttactgctttagtttccgggttatgataataaatacatattatatcccgatggtgataagctatatggagaatagtaaaatagggagaggaaagtgccaaggagaggtgaagggttgggttgctgttttatataggatgatcagggaaggcctttagggttcctacattgctcttctacacagggatttgagtaaaagttgaagaaagtgagggagtaaggtaggagaatagtcggaggaaagatgttttcaggcagagaaagcaccaggaatggcgcttagaactcacactgggcagtcttggaggaacagcaagagaactagtgtggccccagggtactgagaagagaggggccgggaaggaggtgagatcaaagggaaagtgggccgccaggacgtatatgactttcctgagcatttcgaggatgtttcttttattctgagtaggataggaaggcattgcagggttttggaaacaggtgagtcaggaattgatcagtgtttcatatgattagctgatttgttcagaatggattaaacatgctcaaaacagcatctttcccagtgaacctcttacatgctcagcatctccatcagtgctctcagccatcagtactcaaaaccacagtcatcttttgcatctcaaaaccaatcatgaccaacttctgtcagttctgcctccaaaatatctcttgcatctgccttctctatgcattcccattacctgaacccactgtgacagtttctaactcttctgctcaccactcatgctatatacttaaaccgtcagaacaatcatcctagcagagctgatcattcacgggtgtgctctttatctttgttggcccttccttccccctcccaaataaggtccagattcttcaggatgaaattcaagctctaccacaatctgattctaatctagcagtcaaagattatctcctattgttattaagaattaactctgccttcctgtctagtaagtttccagaacctactctgtactttttacctatacctttgctttcaatgtctccccttccctgcatcttctgtttaaagcacccttcccttccagccccacccagaaatcctaaccatacttccagaaccactccaatcaacactttcttcatccccaatctccttggctggaattgtgcttattttcctctgtgttcccataagttctactccattacccgcatattctgtatcatatgccatggttttgttaaatatgctcttttctactaggtgacaagttccttgagcatgattgtcttgtttatccttgtgactcctacagcacttattacaatgccatggctttagtaggtgtccattaaatgtctgtggaacttaaatatctaaaagctttgttgccgaaacagaactagaattcaagtcatctgattttcagctccatattcctttcccaataccattttatctttttgacttctttctatagttcattgtcaccccatctgaagtacatctgaaactgctaaggaattttaaggaaggatgactaaacaaaaaacaaatgctgaaattattttccgtgtagctacttaagtcaaagtgaatctaatttaggggcactaaaattttgaatttgaattaataaaaaaaaaatggtgcatgcaggtttagaaacactttagcttatcagggtttgatttttgagctgtacttaatcttataggtgtcaagttgctatgtttcttggtatgctatgaatttgtagt

SEQ ID NO: 41359 - DNA, 1314 bp, Bovine  19866880860363
cttgcctggagaatcgcatggacagagaagcctggtaggctgcactccatggggttgcacagagtcggacacgactggcagctcagctggtaaagaatatgcctgcaatgcaggagacgccaggttctattcctgggtcgggaagatcccctgaaggggtgggtttccctggtggctcaaatggtaaagaatccacctgcaatataggagacctgggtttgatgccggggttgggaggatctcctggaggagggcattgcaaccctctccagtattcttgcctagagaatcctcatggacagaggagcctggcgtgctactgtccatggggtcacaaagggtcggacacgactgagcgataagcacagcacacagtgaacctaactgaaggcctacccattcccttcttttctctgtaaatctgctgacgtgcagacttgatcttaaacaaactatctttcccatgtgcttatggaacatggaaaccagaggaactgggagctggggacctccttgtcttcatttacgcttcaaagaaaaagtaacttcctatttagggattcaaactttttgtgctatttattctgtaaaatttggtcttattattctcttttggaaaattttttttaatgattccatgacatattgggacacaccaaaatacccaaaaatgcctcatcctaaaacaaagacatttgttgacaagaaaagttaagaggaggaagaaataaaaccatgttctagttttatttccacttaaaagagcaaagattctgggaaatttatgtatgttaaatttataagtgagcccttttcccccccaagatttatttggcgtgaaaagttacttcctgtactgtaatcataaaataaaatgttatttactcctgtcataaccattcacacacttcctgtcataaaaacttgaacttggctggaatgttaaataaaacatgcaaaaaactacaggtaggaagcgactatataaatacctattatcagtgcatattccgatttaagaaaagaatcacctcttcttggaaaaactagtattatgctttatcatcttgggtgactaaatcccacttatggcccacagaaggaacttaaagggtaaaaagcttgctctatttaccgagttcagtcaatagttttctggcggctttaggatgcctcccaggggcgctctgtgtgtaccgggctgccgcgttctggaggggttcatggcccagaatcagagtcgaggagtcagaacgcacacagggtcggtgtgaccgctgttacaggcacgtgcgtgttcttcttcaacgcctg

SEQ ID NO: 41360 - DNA, 1750 bp, Bovine  19866880891050
cccatgaggggaattgtggtttgagccttgggatttttccagcttatatggctttttgagcggcagggttaaaggtggggactggctctgataatattcctcccaggaaagtagctttaagaaaccctactgcagaggaaaaattagctagatatcccacaatggaaaagagctcttgtaattttaccttttcgaggggctagagaggtagtatcgcctaggggaggtgcacagggcaccgtgctgttggtcattgggcaggtcacttaccctctcgatgcatctacaaacaggtagggtaatggtaatagtgcccccctcaaagaactgttgagggtcagagaagttaatatatacagagcatttagaattgtgcctgccatctgttaaagttagctattatttcttttagctctgtgtttttgcaatgtgttgattttctgagaaagtgtaggggacatacaggaagagtggtcagaagatagttcaagcgaggatggtcacttccttctttcccctcctcacactccccaccctcctaccccacagaccctggagctgttttgtgaggcagtaacgtcatatttgaatgtatgaccttgaaaacttctgattaagtagttctgggcaaagttctgctggttggaaaataaatcaggcctcccacacatacctgctcagccaagaatttgtttgccccgggaaccgtgggtaggcggggatggaagcaagcacacacccaggcttatgtgaactctggtctggctggggaccatggtgtcacccttctccctctgctcaccagtgatttctagtcattgcttttcattctcaattctagagaaagaaatctttttattttcaaaaattgcttttcttcctctctcctttctctgactccagggaacttccactcccccctccctgcttgcttgttctctaacgtttggctctttatctgccctttgatactgcacttgtacagatttctcccaagcccaggcagtgagcatgcagtgtaagatgatggaccttagggctccctgcatggatcctgagtttcagggtatggggcaaggccctggaaatgtcccagaatttactgttggttcttgtaaccaggaagagaggcttcctgcctttgcagtggggcgtatcacaggctctcctgctggctgtctcctatctcacggagaagtcctctgcacttccttctataaaaggaaaggggacagcagttcatatgcaaatactgcaccacccactgcaaggcggccaggcctctgggtcagaggctggtcagttgtcccatagcagctgcatttggctgggtagatatccgcagagcccagacctgtcctgtttccacccagggctgcagcacaggggagaagaaggtgggggtaagggaagccgtgagggaggcaagggtgggaatgtgttcataggcgtctgtggggggaggggatgtcaggctgatgcatggtttcaggtgtgggttcacctgcgccgtctgttctttgggaaaggtgctaatgtggtttacagaactcctcccaaagagaaattatggtcattagcaatggtgctgtagttcccagatgtattcatctgcctgtcactcccctgagatgtcctttcatgctgaccacagagcacagaattgtcttgttttgagaattcgccagtagcagggtaaagagcagattaacttgggtgtagactctttactgagaactaatggtaaagg

SEQ ID NO: 41361 - DNA, 1114 bp, Bovine  19866880902677
aggctgggggacagtgtgtgtgtgtgaaactgtggagttagaaagctgggggacaggctaggaaaggaaagaacaggctcagatgtaaagaccatgtgtgacaggttggagagtgggactttcatttgctcaatcttaactttagtaaactccctccattcaaaaatatagaaaatgtcaatatatttataatgtaaaggtgcaaataaatgtgccaggcccttaggtaaaaagatgactaagacatgacctctctccccacagctgattgtctaggagttgaataagcatgtgtgagaggtctacctctacacacctgttggcattacaattcaatgctatagactctttaatgtaagctttaacagagtgctatgtgggagttcaggattaacagcctggggaaattacaacaaatttgaaaggatgtacagtttaatcggattctcaaaagatgcaaaagagcttcagcaagcagaggaaggtacacaagccaaaggaaagaggccagaaaggcatggtataaatggaagcagtaaggagatgctagtacataggtgctgagaagagaatctgtttaggaacaaatctgaaatactttatacttccaaggaaggaggaggagaatagatattttgcagtaggctctagtgagcttaagcagtcaagagattaaaatgttagagataattgaagccactgctaggaatcctatgaataacaggcctgaattcagaaagcaagtgaatttactcaagtatactgaaaacagatggtggaagtggattgccccacataggaaagggtgtacctatcaattacagaatctgtttcagtgcagtagggggttcattgatgaatgatcttggttaaactgaggtagggttttctgcaggaggaaggtggaagaagaaagtagaaattaacagaaatttagaatgggtcagttgagttattttaaaaaaaaaggagaagatgggactatggtatggacaaaggtcaaataaaaatggagaggcagagcagatggtgagtcatagaagattatggggtatggcgaatcccatgctggttcaccgaggccactgaaaatgaggaagagcagtaaagagag

SEQ ID NO: 41362 - DNA, 1166 bp, Bovine  19866880910015
ttaaattactgaagcaagatgaggctgtggatagataaatatgtatgaggatgcaaacatgtcagtagtatcaagccacttcaactgggtgtatgatttttagaatccagctaggctggatcagtacagttagcaactttcttaagcagtctcgagccattcaccttttctaaagctgcacaggccatgccttttagcaagattcctgttggaaagccacagtagccagcaagaggaaaaaaaatgcgacaggagattttctttctccttctctcctgagtttttttcagaaatgttgaaactaagatataaacatgactcaaaagtactgagatatggggaaaatttgcaaaggtgttcagatgattcttgcttttttataaaagcaccacattcgcgtctggctgagtctctttgagacaccccaggcaataatctgagaggatagcctctatcaggggaacactttctgttcccagtgaagtggcacatttagttcctggtacaggctcacttaattcctattagtcatttcacagcagtatcttgggaagaaaaaaatctcaaatacttttgggtgatttcacaagtaaattaaagacagtccctcttttctcacagttcccatttgtttacaaatttcaagtcagtaaaacatgtttgcctttgtggatatttctctgctgatgtacctacctggtttccactctactggggtacctagatttatggccacaacatagcaggtgggttctggaccacacagcctggtttcccattgaattgatggtgaaattttaatttcttggtctgtgatttgaaggttgttctgggacactgcttagaaacacaggtcactgtaagtaagacactggatctgatcaaggtttgtttgttattttctatgttatttaaggacgttagatgaatgcttaaatttgttattgaagagttaccatgaatgctgaagatgcccatacgggattattattgtaggttggtttgtgacagctggccttgatttagttatttcctcaagaagacactttgaacaattatttaaatgcctcccctctgcaattacaataataacgatgatgatgattttgcaactgaatatgtaattcaggatgcatacactcaactactgtttttagcttgtttct

SEQ ID NO: 41363 - DNA, 1460 bp, Bovine  19866880979445
ctgggtttgatccctagtcaaggaactaagattccataagccataccacatggcccaaaagaataccaccacccaaaaccaccaaagaatgtgaatttagctcaaattttaaatagctaaatcctacccagtcattgccagtgataaatcctgtaaattctctgacagtagatttacagcccttaacctaaggagccattagaaatgatagtaaaccagattttctcgtagaacacagagatgcctttgtgggaatctgtattttttttttctcttagaactctgaagttacagatcttgaactccagttcaattcataacgtaaaaacctgaaaatcaaagggtaattctagtttatcttccacagtagccattttctggaagtaagacttccaaatacgtactatggtgtcctcaaacactgcctagctttattgtaaacacagtgttacgtggatattacctgagagccacagggttagcaacaataaagggggaaatgttgagtaaggaaatagaccagttgtatcacttggaattatgaactactttgtcttctctttctttttatctgctgttgaaacagttttgatgaactattaaacaattatatgtaatgtcctgttttgactgtttggcattttcacttgaaagtattgaacttcaggaacagatctatataggagatttgagggtttgttagagaaggaaaactagaagctttttgcccatggatttgaaggtccacagatctaaatgagaaagaaagttcttcgtttctaaccataaattaatctattgcagtgctgagaagaagcctgtcaaaagggatgaaagctcagttattctgaacagtctttagaaagcagcatttcttggttagttgcttttctcgctgccccaaatagctgatgcagatcttgaaacagaaaatccagttataatgggctctagatcttaaagtaggtgagcagtttcttatatacagccagttccttgataaggatccagaggaaaaaccagcaataaaacattttaacacacaaattttgggggctcccagggaacttgtttttttatcaagtttaagctgttgctgcacacagctctgtaccatctgggatgctagcattcacagcagttagtctggatatctgagctgtctgccacgcgaataccaacctgaaaagatcgtcattcttcagtttcattcagtgcttaatgaatgcaaaattaattggcagaaaggaaaaacactgtgtgatgtactgaacaggcctttgtgcatgattaaggagttacctcaagtagccaattttgagcttaatttctctccttttgttaacaaatctcaagaaaacctttgttacagttcagctagtgtcatgtggttggcattcattttctagccctttaggaagaaaattatcatttcatgcttaacttcaacccatacagaa

SEQ ID NO: 41364 - DNA, 1732 bp, Bovine  19866880985599
gagccacaaaagcctttctggtagtcgtgtttctctgctgctgctgaaacacaaagtcagacaaggaatcctactaaatttacatggccacctgcagataaacacaggtcccctttgatgcctcagtaaagcaaagaacttacatcagtgattctgcagagagccctgatggctgggcctcggtacacatcttcctttccagtcatgtccttagtcagactgagaaaaatcaaattattaccataagattaaagttttctcttttgtggagtccacccatacttaattccacttgtccccataattattttaatgaaactactgattcaacaaatatttattgagtatcttctttggataaacataaaaattattggatagaagaccattttaaatctaaagaacacagcagggagcaaaaccaagtctttgcctttatggagcttacgttctagagggaaaagagacattagtcacatacactaagtacatacataattttaggtctatccatgacactgcaatctcattcctttttatgactaagtaatattccattgtatactgattaccggcataaaaaacagacaatgacagagagcctcatgctcaaatcccaagttccccaaacctaactctttaaaagaaaatgactgatagccaaaaggcacacgaaaagatgctcaacatcactaattattaaagaactacaaatcaaaactcacaccagttggaatggatatcatcaaaaaaatcaatgaacgataaatgctgtagagggtgtggagaaaaatgaactcttttacactgctggtgggaatgtaaattgatatagtcactatagagaacagtacagaggttctgtgaaagtgaaagtgttatttgctcagttgtgtccacctcttgacaacccccacggactgtagcccgccagactcttctgtccatgggattctccaaggcaagcatactgcagtgagttgccattcccttttccaggggatcttcccaactcaggaattgaacctgggtctcctgcattgcacatgggactctatagcatctgagccaccagggaagcctaaggaggttccttaaaaaactaaaaatagaactaccatatgacccagcaatcccctcctgggcatatactgagagaaaaccataactcaaaaagatacacgtaccccaatgctcactgcagcactatttacaatagccaggacactgaagcaacctagatggccatcaacagaggaatgaataaagaagatatgatgtaaagtgaagtcgctcagtcatgtccaagtctttgcaaccccatggactgtagcctaccaggctactccatccttgggattttccaggcaagagtactggagtgggttgccatttccttctccagaggatcttcccaacccagggattgaacccaggtctcccgcattgcaggcagacgctttaccatctgagccaccagggaagtcccagggaagacatgatacatacatacaatggaacattactcagccatcaaaaggaatgagactgcagagacatggatagacctagagactgtcattcagagataagtcagaaagagaaaaacgaatattgcatattaatgcacatatgtggaatccagaaaaaatagtacagatgaatctgtttgcaaagcataaacagagacacagatgtaaagaacatacatatggacaccaaggcaggtaga

SEQ ID NO: 41365 - DNA, 1425 bp, Bovine  19866881033071
acagcacattactgtgcatgtaaacagtctattcctgaaaaacaaaacatttctgagatgtagaaaattagttaacactcatagtccatgtttgcatccttattaacattactctatctattaaaatcataaattctttaaatattttaaatagatcatttgtagtaacaaaataatttgaactactctttcattaaaattttaaaaatctcccacatagtacagtacatctgtcttgtgatttttactgcatttgagggagaaagaatcaatgacatggaaccctctgattaagttctaggattgtgtaccagttctgaggggtgggaaagaccatgcaagccccctagaattgttggatctttacatcctcaacacaaatgtgcaaagagacacacaaatgcaggactcagatacatctgttctcattaggaattcagaggagaaaaactaaactcttgtaggtgtattcaggaactattctatttaaaatattataaaattcaattttcccagctgaggcttaaaaaagggatactctgcttcttggtttcagttttcaccttacaaaccagcgtccttttcaacacatgttcagcattaatgtttcatcattttgcactttttgttggtgatttcactgtttgaaatgaccccaagcatagtcctgaagtgttatctggcatatccaagcactggaaggctgtgatgtgcctcaaagagaaatatgtgttagatatgctttattcaggtatgagttacagtattgttgaccctgagtatactgttagtgaattaacaacatatattaaataaggggtctttaaagagaaacacacagaaaacaaggttatgcattaatggattttagaaatattatgtcctcaggaacctaattctatacttccccaggggcagtggttcagtattcgtgaattaaatgtgactttatagcgcatgatgagacttcattgtactttccattggtgctatgctagtagaggccctaatccttagttctcaagtctggctggagactagtatcacaagtggaattgaaaggagaagtaactgacaataaagctccagtcgtggagattctgatgcaatggataattgcatatatgtctgcctgtgagacaaatatatagggaggcttgagagcaactttctagctcactttgccacacaacaaggaactgagtggctgctctggtacccctattggggattctctgggagggcaatgtgtgtgcttggataaggaaagcatctaaaagacaaatttttctagccagccttgggttatttttgaaataaaatggcttgagctcctataaaaaaaaacaatgccttaaaaatcagaatttttaagtgttttgagcaagtatcactttattttaggggaggggacacagccaagtt

SEQ ID NO: 41366 - DNA, 1177 bp, Bovine  19866881105811
tcttttactaagaggaccatgtcttcttgctaatgacaaatgcagaggagtggaaagaagcctgtcagaaatgtggcatgtactatatgagacctaggcctatattaaaataccatcttgataaattccaccaaggaatcagacttgggtttagtaaagggatgcttccctggtggctcagatggtaaagaatccacctgcaatgagggagatctgggttcgatccttgggttgggaagatcccttggaggagggcatggcaacccactccagtatctttgcctggaaaatccccatggacaggagatctagtgggctacagtccatgcggtcacaaaaggtcagatacgactgagcgacttttactcacttaataaggtgatagggaaaattgttatcacagaagtaaccaatggctaaatcaaatgttagtccttgagactacagacctacagtactcttgccaaccattcttacttccctccacttccacgatcaggtagttttaaaattggtcactgtcaaaggcaacattgctatctacggacatggatgtgactgaaaaggtggaataaatagtgttttaaaaacctcactatccatgtgttggtttttaaaaaagtattgctagtatatcttcattattatcaaacttgccttaataaataatgttaaatataaatagcaacaatagtgtcaggaatcctttgtaactgttcttttccgggtaccatgtgttgttccttagtctattgctccttagtctattcagaatctacttgtaataccccaaaactctggggagggtggaggaaagacattaaaaacaaaaaaacaaaactcccaaacccgttcagacaaagccacacaacctgggtttgggaatattctctctggcctagagccagtcagggtgtttggccttgttcacaagaagctgacatcttcacgtgtggccttctggggagctgccaccatcagacttctgctgtagcagcagtagtgcatggggaggaacatgacagaatttagggaactattagatgcctgttggctcagatatcaggagcagctgtgaagggaaatctatttcaatttagatccagtgaaaaagaactgagctgttattatcgaagtggtggggatgaaactttgagcatacttgaagatgaccaat

SEQ ID NO: 41367 - DNA, 773 bp, Bovine  19866881134128
atttcagccccacaggccctcagttctcttcccattatcctgcacatgtcttttcaaggcactttagggttaaatatgtatttaaaattctgcatctacatatggaattctaaagtgtacagcaaaatgaatcagttatacatatgtccactccttttttgttgacgatcacacttttattcactgaatgtcctttcatggtctctgatatctcttttttatggggtgttctttgcgttttattaaatatatccccccactctctccgaaatgccagatgtgcttttccagttctagactgttcacttcattgtttcttctggggacttctttcctcttaattctggtctttttcttctgtgttgcagattttcctccaagttggtgatccttgcctggtattcctttttgtcctaaaattttctgtgccagtagttcccatctaaaagttaaaactcttcgcatctttgtgctaagtcacttcggtcgtgtcccactctgcaaccctatggactgtagcctgccaggctcctctgtccatgggattctccaggcaagaactggaatgggttgtcatgccctccttcagggaatcttcacgacccagggtttgaacccacatctcttatgtctcctgcattggcaggtgggttctttatctctagcgcctcctgggaagcccttcaattttcactgatagtcaaaactgtttgtatgggttcttcccccttacagcacactattctttcattactgaaggtgatgtgttgagt

SEQ ID NO: 41368 - DNA, 1146 bp, Bovine  19866881195528
aaggctttgaggttacaaagttccctaagaatattaaggataataatgaaagccccagcattttaccattcactctatgcctaacataatgctaaacgctttacaacttttttcctagacctgaactttctaatatggtagccactgaccacaggtggctattaagttcttacaacatggttagtttgagtctaaccatatgtgtaaaatatatattgggttttgatgacttagttcaaaaaaaggaaatgtaaaatatctcactgatattttttacatattgaaatgatattttggatatgttgagtaaaatacatcactaaaattaatctcacctgtttatttttacttgtattaatggaactactagaaaattttaaattatatatgtgactcacatttatggattgtgttatatttctattggacagcatttgttctagtctattcttcacaagtagtttgatcagctggactatattaccacccccaaattatgggtgaggaaattgaggcttagagaacttaagtaaattgcctatgatcacacagctgtgacttaagcacaaatctgctatctctaagcctgaattcttacccattattctatgctgtctccccagagtccagaagtacaatccatttggtgtagaaatggctatgatcattagctatggcaaaatgctgttttcatgtctccattgtggagcacgagaaaaatcatccatgccattctgtaaggcagaatttaggttgtagttgggaaaaattgcctatggggaagtttctgaaatactaactctttgtttgtaacagcttggggcttactcaccaaggatagaaggtagatgaaactacttcagaggttactttcatttctatgatcctatattgcaattcatgtcagattcacaggtcagttgctgctgtaatgctcagagtgagatggagtaaagagagatgaattagtgcttcagtttcaaccttttctcctgtaaaatgtaaggctttaatatcatcccatttcatttgaatttgtgaaaacctcaatgggacattcttcgtagcaatggctccctcttctaagctacaatgaagagaaggtggcaaaacagtttaggagagaaagagtcactccattttctt

SEQ ID NO: 41369 - DNA, 802 bp, Bovine  19866881246490
tgatgtggtgaaagatgcattccccccctcaagtagatcccaaaaggggacagtgtccctggaacctgatctgggttgtccgcctgcttccgaagcagggaagaggtcaaatgtgcagacccgtgctgccctctgctggccctctggagtctgtgccgctgcagcccacagtggcagaaaccagttctgaaaacattaataggagccttctgtgcaggctgctttcttgcccttcttgattagaggtagagggtcactacagtgttttagttcataagacgtctacctgaacgcaccttgatgggcagcaaaatgcacagccctgtgtctgcggacagtctccttagcagcagccgcaccacctccacagagagaggaggtgtgtaccacttggtggacagaaccctctcaaactgtgtgtcttaattaagcaggatgcagaaggtgctccttactccccttctcaaaaactcatctctgagtaagaagagaaaacgcctgactttgttcctctgtggctctgggatgttccctaagggctcatactgtcatttaaattctaggtgctgatcttctgaacaaacgctccctgaggatttctgtgcctggaacttctccgtcaacagactgctgtgacacctaacgtaagtagaggctcttggtcctaaatcagtctcaagggagctttgttctgttttgatcctggaggatccccccagtaaaattctttaaatggtcatcagtgttccttctctgtttcttttctcggaaacactcaacttccgattactatcagaaaaag

SEQ ID NO: 41370 - DNA, 2052 bp, Bovine  19866881405454
ttttactgcgaattttttttacgcactgtatattcctctggaattttttttttaaagactctgaagctgcattgttgagaagctggtaaaatgtaaacttttcatggcctaacacagaagatcctaaactggctgctcatcaagattccccttggatactgtcaaagtactgcctctttttactcacaaaggacctttggaatcagaatcttaggggatgcctcttagttaccttcatatttataaatctatcaaaacactggttctgcagcagcctttccatatgcttatgtttaggaaatactagtatttattttggaatgttaccagtttaaaaatttcatttttaagggtacttagaggaatcttcttaaatgatcttagaagcaatggctaaagtgggtgcctttgcttaaattctgttcttaagtttatttttttaaacatatttttctaattttcacagagactgtttatttgtttggtggctgggatggaacgcaagatcttgctgacttctgggcgtacagtgtgaaagagaaccagtggacttgtatctctagagacactgagaaagaggcaagttttcagacttgagttctcacccatctttattacgataggggtgtggggatacacttctctttctgagtgatttgtgttcttttctaatgtatgtcagcagtggtagcagaagaatttgtggtgacaagtttggcttacgtattcttgcattccagcttctatagcaggttcttgaactacagttacatgaacaagtctatattatagagataaatagaaatgggtatctaatataacttagattttaaccattttagttaaaatgtaactgtataaaccatcttttttctcatgtttgtgtcacctctactcttattttgtacatttatttttgtttcctctggaaatacgtgcttttgattcctcactatcttgctactttggcccctccatatttgactatattatcagtttccacaaatggtagatattttatttttaactaaaattgtttatatgtattcataagtgagtctattgatgcatatacacataaaacttccatagtgaatagaatgtcttgaatttatgattttgaattaaataagtgtataattaattatacactgctagaaggcacatattcgtgtttttttttaatatctttgtagaattttttattgtacttttccatccaagcagttttagattacaaggtgaaaaataaactaaaaacaattgtaacagcaaatgaaaagaagaagaaaagacttaattcaaagccaccagttttaatctaggaaggccatttttttaaaactctggtgctatgtttttcatcttaggaaactggattcttgcttacttggtgtgttcctttgttaagtcatttgagtattttttaatctttctaaagaggtcttaaaattattattatccctgtaaaaacggcctttgccttttcagtattaagtaccattttctgaaatgattatttctctcctcaaaaatacaaaggcagatcttaaaagaatacctttcttattgctcttaaactattttaaatctaggttgattgtgtctgaattgtttttgcaagaagtttacaattcatcctgaaatcctttctcttcactgaattgtgtcgaattaatgcctaagttccaccagttctagcacccaatactgagtttcagacattttttcctctctattcctttcagctttgtggtttctttcttaaactttttttgcctccattgttgattccaaacctagtcttcattcattaacatagtctttaaaaaatttttttctttgggccacatagcatctctgcttaagccctataattaatctcagtctgtttcagttatctactgcattctatatatcacaatatattccatatattacaagtacccacaaaactttagtggcatataataataagtattttgttcaccagtctgtaggttgactgggctcactcatgtgttgagagtcagctgactgtctctagtctag

SEQ ID NO: 41371 - DNA, 2968 bp, Bovine  19866881507620
tggaaggattgatgctgatgctgaagctgaaactccaatactttggcccctgatgcgaagaactgactcattggaaaagaccctgatgctgggaaagattgaaggcaagaggagaagaggacaacagagcatgagatggttggatggcatcaccgactcgatggacatgagtttgagtaagctctgggagttggtgatggactaggaagcctggcgtgctacagtccacggagtcacaaagagtcagatatgactgagcaactgaactgaactgaactgatgataaaatctaaaactggcattagttgtgatttcagggtttttcagggcagcaagaatttggccttttgttctccaggccagcaggtctgggctctaggcactatgatttgctacacgtaggaactagccaccaatacttacttgcagccttttaaaatttggcttaaatttttctaaaagaagacaacaagatgtgaaacattaagaatgaaacaagttaaattcaatactttatatgtaagcaagagtggagatacagaaaaggagaaatgaagcacataattgcttaaatcgtccaagctttctctccataatacaaattcttggattgaaaaatagttcaatccaatagtattgtaccttaataattaggttgggtttcctctgcggtaaatctcaggaagcgttggttattaaaatgaatgaagtagattacccttccctcaataattactacttcagctaatgtgaatattacctgtgtgattgaatctactgcatttttaagacacctatctccacctaatttttggagattcagtaatttaaaagtcaacagtgggtgggaatttctgtggtaggcagagggacagaaaaggtcaatgttcttcgacattctttccttcaaatcaagttttttggttttggttggttttcagtgttttgttacgtatggagacctagtagatgtaactgatttatcttcgcctttgtgtttatagatttctattttcttggcttcaggtccttggaaacatttgttttgatggtggcaggagagttagtcatgttttatttttgttgttcccatttatttttaagatcttttagttcaagtccacttacaaggtgttttataacctgtatttatgtttccacaaaaaaaaaaaacattcctagtagtaattctagtacactcataaaaacagttaataatttaatgcacatcagaatgattctgtgatattagtaagctggaactaggatatgctttggaaaaatgtgtttgaaatttgtaattggatttagcatttacatatcaaatttcaagtttcttagatcaattatttttgagttaccaagcagccaaattcttcttttcttttcattactgagtcaacaaaagttggaaaattcttttctcacatattccattctttaactgagcctgaaggtaaatgactttttaaaaaaccacatctcaaacaaacaattttacatgaggttatgagtaaatgaatagaatgggctctactggcactgcggatatacgtctaattagaactctcaatcttccaaacatatcatttactgacattgaggtttttaattcttaactttgagtccattgtgatggaaacaagtgacccttgttggaaatatgtcacgaatcaactttctcaggttgacctttagtttgttggtcaccaaatcaaaacactatttattcccaggcttaaagatgtctgtaccttcttaaatttgttgtaagatcaaggaagtaaagcactgctttgctgctgtgaacaggttgccttctctcttttccttgaggcctcttagtttcgtcatgagagatgatacgtcttagccagctccatgcgtgaagcaatattaagcatgttgcacctcttgcacatcctccgttgtgggtgggaggtagaatactctggttttacagtgagacagatgaagatcagccttcaaattgacttgacatactttctagttcagagctccataccaggcaccagagagtgttacaaatgctctcaagagccaatgttcataacttaaaagtagtaacataaaatttgcatctattagattactttttgaccttgagcaagcaattttacctccctccaaaataactatttcatagtgttattatagcaaatcattgatattatgtatatgaaaatacacaaagcctagcacatagttgcaagcgaaggttgaatttatgtgaagcatataattaaccacccctggaacctcaaatggacaaatgaatccaaagtgacatctgtctctaatcagttttaaatcagaaaatttcacttctaaatgaatcactccatccaccaatgactttgcttcatagtctacattcagaacaaaatgttacttaagtgatagtctgttaatgtatttcataacaggagctgactatggtttctttaggagaaaatcataggtaaacaaaaagaaagaaaattatataaatgtaaggtctttatttagaaataaatgaagaagggacagttatctgataaaagaacattcaggatcatgatataattaaatgtctacatgtaattacaaaatataattgtatttatattggtttaaaaattttttttctgatcttaaaggaccaattttcttgtaattgaatgacaaactctgcagtacctcatattaactattaataagctaaaaatacccattacctatctttttcttaattccatctactgtcatgaacttacatttatctcagctatacaaaaagaatgatttaaattgcttgctctttctgcttattagaaaggaggagaaagaaccatttccccgacccacttaactatgaaaaaaggactctcccaagttgccaggaactaacacagtagtaaaattacaagaaaattttgttaagaaatcttttctcatctgcaagtta

SEQ ID NO: 41372 - DNA, 1518 bp, Bovine  19866881805913
aatacaaatgatgtactaaagacaatggagggcagagatggacttctatctacacatgaagtcagtattttgttaaatggaaaaagcaagttatgagagcaactgctgagcctgccaagtacaagttatgtttgatatgtcatatagcatatagaaagcagtggcttcaccagccagtcatttttttaaagaccttgagatgggttttaacagtataagggggtgacggaggatgagacggttggatggcatcatcgactcaactgacgtgagtttgagcaaactccaggagatcatgaaggacagggaagcctggcatgctgcagtccatggggtcacaaagagtcagacatgactgaatgactgaacaacaaccccattctacagttggtaaaaatgagaggtattcaaaaggaaagctgttttcttaggttcagcagtcagtgagggttggggagagcatccgccagcatcctgtctgtcctacgccatctacgcacaatggccacccaaggccatgagttttgatttttcctgataccagagcttagaaccctatagaaattattttaagttgatgaaagaattttttggcattgattttttttcttaatccccatgacctggttctagagaagttctgagctccacatccctcatttagtcacactgacaaggccaagcaacaacctttagccaactgctttggacccaccctgctttgaaaaggctcattccacccaggtggccttagtatccaatggccaaccctgcccgctgcgtggaaacaatagataagtgcctgagctggcactgccctggtatgtgggtgcggttgggaagcttgaggccaaactgtgccgacttgctgtctctggattagcactttctaaagctagagaagacaagagtggcagtgggtgccactcttccttccttcaggaggtaagaggggtctgtaggtggacagggagcttgttcatcaaattcctaggaagtagtcaaagaggaggaggaggaaagaaggtccatgttatatctactgctttttataaatcctgcctccagggaaacaaacatccccagaagtgtggcgctgcaccagtctgtatcaaccctcagtgttggacaccacccaccacgggttgggcagggatggtgcaggcctggcagagggtgagtagccggtcctgtgccaaaggcttgatgtggcaggaggtgacaggacaaaggtcctggagcatgccagctgggcgccagccttctttgctgtcagaactggtctcggaaaaaagcacagcccctggctatgcttttgaaagaggcatttttactctatgaaaacagctgcccctcccttcaggcttccttcctgtgactgaacaggccagaggggaaggtcaagggcagacaggagaaccaggacaaaggactaaggtgtggattgtacatggagccgtgctcttatcctagctcacttactacttcctgcaaaaaataaagttgggtgggaagagg

SEQ ID NO: 41373 - DNA, 1256 bp, Bovine  19866880445552
gctacctgatgcaaagagctgactcattggaaaagaccctgatgctgggaaagattgagggcaggaggagaaggggacagaggatgagatggttggatggcatcaccaattcaatggacatggatttgggtgaactccaggagttggtgatggacagggaggcctggcgtgctgtggttcatggggtcgcaaagagtcagacatgactgagcgactggcctgaactatatatatacagacatataaatgtatatacatagctatacatcacttaacaccttgctgggcacagagcagcccctttgataaagatagttattacattaaattctttatgttacagcaaatctcctttgtaacatcaattttatgtattttctcaatgtaaaatagttatcaagtctccatataatttcttcatcttgtatttgaaaatcctaattattaagctactcctcagttcacctctcttgtcaatgagtaaatggacatttgtaacacttacctgactggtgattttacatttatctgcttgatttcattaaagtgtgtcttgtactaaaccattccaagaaggcagggcccatgcctgtttttgttcaatcctgaatcatcagtgctagcccagggccagacacatgttagagcttaagaaatagttgttgaatgaatgaatggctggctggatggatagatattatatctgctcagtgagtggccttcctggaaatgggtggttctcagcaagagttggggtgtggagagaaggcaggttgtcatacaggatacagattgtcatatctgaatcacctggggtgatttttttgaagttactgtcagcttctccccaagacatgccatatcagagcttactgtgtgctacttcaggggcaggaaggcccactccacccaagatatacctcatacagccagtcactggtgacagaaatttctttcataggatacaaaacctttcattcataatcagagataaaggttaaggtacaaacacctttggccctctgtgctatgatagaaacaccactgattagacataaacacatctggtcttaggtttgacttgactttggatatgaatatatgacaagaagggcttcttcaggtgactcagtgataaagaattcacctgccaatgcaggagacacaggctcaatcctgggttggaaaagatcccctgaagaaggaagtggcaacccactccagagagaggagctccatggagagaggagccttgg

SEQ ID NO: 41374 - DNA, 950 bp, Bovine  19866880589974
aaatacaactataagaaagtgctgtaaaaaattttggaaccactaagatatactactgatattaaactgtattatcagtttgaacaacttccacaaatttgaatacacagatatacaaagtttatcagatgaaatgcaaaatcaggttcataacagaacataaactgcattataaattaataaaagcaaaaataaatatggactcaaaacaaactcttttcaataaccgaaacaatctttctctacatgactttctaatgaggaattcattttaattggaagtgactaaatgtaaaacaatgagtaaagtgtggggatagcttaatatagtgtattgacatgattccttatttttaatgatttttccctttaatcaaaaaaggatcaacatgttctataaaaaaagaaaaatcaagaatacaaatggttcttttcattaaagcaacaaataaacaacaaagttccacaaaaaattactgtttaaaaacaataattatgttaaatactgtgcctatatagtatattttaaaaacttactagcctttctagatacgtaccattcattgctctaggcctgagttaataagcgaagactatgaggctcaacgaaaattggccctaggtctgggatacagtgatatcatattatttccaatccttgtacccacggaagtatatatcaatttaggaaaatgactcaatcttgattatctcaatggcctcaagtaggcaagctgactgaacaacatgagcttcatgtaagggttattgttcttttatggccaagcatcctggaccccctttacaggagaccttagttttcctttgagaaatacccaggggtgagaataatttggttctggtgatccgattaaaaactgactaatttaggacttccctggggcacagtgaataagaatccacctgccacagcaaggagacagagaaga

SEQ ID NO: 41375 - DNA, 1360 bp, Bovine  19866880656182
acctgaactttgtgcagacaactgcgcttcaaaactcatgcagatgacaagttctcatttgcttaaccccatagttatgtgctgagcaagtttaaaaacaaaaagagcaggaataagtgtggaaaaaacttatgcaaagaaactgagaggattcattttgatttcttgttcttgacctgacgtttgtttcttgtgtgtcttctcagtgcagtatcaaattgtcgaggctggttttataaaagcatgtatctattgcatgttttcttagggaaaattaaattatttgtgagtaatcggtctctgaagaagtaccatccatgatgctgacaagactcttgtgcacttatgcagcttaaattatccaaagaacttgaggggttttgttaaaagtatctgctggttgggaatattcatattacatccgagatgattaaaattgcaagactgtcctcttggcagattcctgagtgctgcaatcagtgaggtttatatttggtggtcagtggcatagctaaagaagtagctcagaaagcttgaaatctaagatggcaggcactgtgttttagctggtgggtggggtctgggactgactctggaatcagatggcttaattcaagtccgactctttctcctactagctaagtgactttgatcaagacactggacttttcaagcttgatttccttatttctaagtgggcatgaaaatactatctacttcatagggttgttgtaaaaattaaataatatatgaaaagaaccttgtatagagcatggtgcatagtatatgctccataaacattagctattattattcatacaaagtaataaacaggcccaggtatataattttcaggccccaaggccaagtgaaactgtggggtccgttttttaaaaatgcaggaaaaataccattaaaggtgttaaaatataaaacatttcttttattccattccctctctttcttgactagtcatgatattgttcttgcttttacctagtagattttatgtttttagagcccttcaggtttatagaaaaacccagcagaaactacagagttcccatataccctccccgcctccagtttcctcttttattaatgtatttatttccattagtgtgatatatttgttatcaatagtgatacacaattattaactaagatgataatttacattagggttcactcttagcattgtacacttctatgggttgtcacagatgcacagttatgtatccaccattacaatattctcaagactaatttcactgccataaaattcctgtgtgctccaccaattcattcctcccccatgctcccccaaatccctgacaaccacttgacctttttactgtct

SEQ ID NO: 41376 - DNA, 1200 bp, Bovine  19866880674502
taggtacatagaaatgcattatgctgtttatttttgtacataattgaaaatttccaaaacaaaatgataaaacctgtaagataaacccctggaagaatggacatggaatgtataacttcccaacccttagaagagataaaaatgaataagaaaacaaaaggcaagaaaagggaaaaagggcgggcgggaatctaaaaaacatttcaagcagaaaacacaaaacaagatggtagaaacatacctaaaagtgccagtgatgataatagatggagacagttaactaatctattaaaatatagattggggaattccctggggcttcagtggttaggactcctcatttccactgcagagagcccagattcaatccctggtcgggaactaagatcctgtaagccaagtgggctgccttccaccatacccaaaagatagattgggttaaaaaaattcaactttgtatacacacacacacacacacatattacaagagcaatccctaaaaaatgaaaaggaggaaaatgaagagatagaaaactatctactaggctaaacaaatgataaaaagctgaaattaggtaaaacagttcaataaggtaagaatgaaatgcactgaaaggaattagtagtaaagtgaccactggtgatcgtgacaaaaatggtttggggtcacagtggggactcaatcagattgtgtgtgacatgcagtcaatgggagagaaagaagtagaaaggcagaaggaaaggcaagtggaggaggcacattcctagttggggaagaggagttacttaccgtttgtttatcagtttgagcctgtgtaaatattgatgccatgaagccagagcagagagccaaggaaaagaaatgggagagaactgagaggaaagcaattgtggggagcaaggctaaggataagatccaaagcaccaggagagactttagcaacagacaagaagaaaacatcttctattttattttatttctaatttattaattggtccattacacaaacaatacataaatgcatactcaaaaacatcaaacattacaggtaaagctaatgcactccaccaaactactgtgaacagtttggttagtacccttccagaccttctctatacatttttataatacacaattaggtacttcagatgtacactatacagtatttgtgtgaatgggtgtggtatgtgttttaacat

SEQ ID NO: 41377 - DNA, 1275 bp, Bovine  19866880724230
atacactcatagtacttgtataattttcttttactttataaagtatgtgaatgccgcaatgaataaatcataagtgacccgagcaagagcagtctccgcggcaaagtgggagagaggaccgccgtggattgggagggtggtgggtcccgccccaaaggccacgcctcccacgaggccctgccctatcctccctgcgtggtctcatcggtgcataggtgaacagtcaagctgtaagatacagaaaatccaaatacgttgtttatttaaaagggtttccaaaatgtgtcttgtcataggattttaggtccaggagggatctttgagaccagctctttcagttcctgatttttaaggatgagaaagctgaggtctaaggaagctaaaacagttacccaaggtccccagactatttggctgtacaccaagaggacaggcaggaaagcatgcccaggaaacttctgaatgtttgggaacctggaggaagtaaggagggaattatgtgttcaggacgaacatccagattagaattcctgcaaagttgctgacagccacgtatgaatgaccgtgtccagcgataaatcaccaggatgaggaggatgaatcatcccaggctttgttctttgcaggacagcacatttttctctggctctccctgttctatatcaggagattgtttccaccggggtcaccgggctgaaggacccactaaatttggcttcattcctgtcttggcaagctgccatggccggggtggtggaggagtgtttacacgtgtcaggccctaggaacatttttgctgttctgtctgataaagcccagagtcagatgggcagagtggtgaaacgagcactggacatagagtcagctagcttgggattagttgctgttccgtcatgaacacagctgtgtaagcttcagccaatcttgtagggagttctaagcatgcaaaataaataggttcagtgtgattcccccaggtcttgtgttttgggaaactatttggggaagaaaagtagcttccaagctaagtaaccattttcagaataggttctctcaagcagaaggagaaaacagtgcaatgctgcactggaaaatatgtgggttattttcaaatatctttggatactgatttctaacataattccacagtgataagagaacagactctgtatgatttcagtacctttagaccatgaaatgtttacaccttgttttatgtccctgaatatgttccagagtctcctggtttatagtctatgggaacttgaatagaat

SEQ ID NO: 41378 - DNA, 2486 bp, Bovine  19866880767783
tgaaaagaaatagaggaaaacaatagaatgggaaagactagagatctcttcaagaaaattatgagatacaaaggaacttttcatgcaaagatgggcacaataaaggacagaaacggtatggacctaaaagcagaagatattaagaagaggtggcaagtatacacagaagaactatacaaaaaagatcttaatgacccagaaaatcacaatggtgtgatcactcacctagaaccagacattctggaatgcaaagtcaagtggtccttaggaagcatcacatgaaaaaagcttgtggaggtgatggaattccagttgagctatttcaaatcctgaaagacgatgctgtgaatgtactacactcgttatgccagcaaatttggaaacctcaacagtggccacaggactgggaaaaggtcagttttcactctaatcccaaagaaaggcaataccaaagaatgctcaaactaccacacaattgcactcatctcacatgctagtaaagtaatgctcaaaattctccaagccaggcttcaacagtatgtgaaccttgaagttccagacgtgcaggctggatttagaaaaggcagaggaaccagagatcaaacttgcagcatccactgcatcatagaaaaagcaagagaattccagaaaaaaatctactgctgcttcattgactacactaaagcttttgactgtatggatcacaacaaactgtggaaaattctgaaggagatgggaataccagaccacctgacctgcctcctgagaaatctgtacgcaggtcaagccaacagttagaacccaacatggaacaacagactggttccacatttggaaacaaatacatcaaggctgtatattgtcaccctgttatttaacttctatgcagagtacatcatgcgaaatgccagactggatgaagcacaagttggaatcaggagtgccaggagaaatatcagtaacctcagatatgcagatgacaccatccttatggcacaaagtgaagagaagctaaaaagcctcttgatgaaagtgaaagaggaaagtgaaaaagctggcttaaaactcaacattcaaaagacgaagatcatggcatccagtcccatcacttcatggcaaatagatagggaaataatggaaacggtgagagactttatttttgggggctccaaaatcactgcagatggtgagtgcagccatgaaattaaaagatgcttgctccatggaagaaaagctatgaccaacttagcatattaaaaagcagagacactaccaacaaaggtccttgtcaaagctatggtttttccagtagtcacgtatggatgtgagagttggactgtcaagaaagctgagcgccgaagaattgatgctttctatctaactgtggtgttggagaagactcttgagaatcccttggactgcaaggagatcaaaccagacaatcctaaatgaaaccagtcctgaatactgactggaaggacatgctgaacttgaagctccaatactatggctatctgatgtgaagaactgactcacttgaaagaccctgatgctgggaaagactgaaggaaggagaaggggacaagagaagatgagatggatggatagcatcactgactcaatggacatgagtttgagcaagctctaggagttggtgatggtgatggacagggaagccttgtgtgctgcagtccatggggtcataaagagtcggacacaactgagcgactgaactgatgaattaaggagacaaaagacagagctgtcttactgcattctctaagtctaataaatcttccattctacacttgggcttcaaagtgtggaagacaggaggaaggaaaaggggaaacaggacagtgtgacctgagatacagaaaagaagagaattttctatttgtctaacataataagcagtagctacagcattagtatgtctcacaggaaatagggactccctcattcaccatgatccacgtattcccctatccttgcgtatttcaaaagaagttttaaaatctatatactctttaatctgattaaatagttgcttgtaataaaaaggggaagggtggtagtaactatgagcccaaatgaaaaatgcagaaaagacctgatttttttctagctgttttccagctgctgcttgttctttcagctgttcaattgctctcagtttctgtaaacaccaaacaggagtcaaaaggaagaaagaataagtaattcagaatgcacaaactactttcaaaattaaacataaaactgtgtacattaagaacatgaaatttggtatttttcaaaaatttaatattactatatatgtacatctatgtatatgtacatgtatgtaaatatatgtctaatttcaccatttatttcagtacctcatggtacttggaccacatctttagctttaagagaaactcagtaatgtggcctgggaagcgctctagaaacctgattttacctccaaggccaccatcaca

SEQ ID NO: 41379 - DNA, 1404 bp, Bovine  19866880798613
tgtgcagccttttccgtaaacacaattgcgtctaaatatagaaactgcctagtatgcgcctccatctcaacacaatgactccacggccactgggactggccttgaacgagggccaaccgctttgaaatgcagagacactctgtcattggaggtgaaggaagcggcttccagggatttccacgagcgggcaggcagctgtttacttattccccattcttttgttatttttgtttgattttgccagtaaagcttggggaggaggaaggaagaagagaggggaccatggaccagaaggaaggaatagaggggtcgggggctaaggaagaccaggaggcgtcagtgataacgatgggatggaggacatgactcacaagaaaaggagaagtggcaggtgacttgttgaaggaggacagatgaattggagaaggaagagaggcaagattccaacatgctctgtagccgtctctacccagctggcatggtcaggacttcacagcaaggtcctggtttcctgagaatacaggatgaagagggccagttttcatgtcagtgccagattccagattgtttatttcctgctttataatcccttgagtagcgtaactgcctctgggaagagaaattctcacctctagccacactcccttccatctgtgtgtgtatttgtcggggacagggtgatgggaggagttaaaaacagcatcttcacaattagagaggatttaggtatctgtctcatcaaactgagaccagagaaaataaactgaaattaaattgtatggagctaaatgcaaagagatgttattaggcaactgttagagaagaaaccccagttaaaaaataaagacctggggcttcccaggtagttcagttggtgaaaaatccgcctgccaatgcaggagacttaggtttaatccctgatctgggaagaacccacaggcagcagagcgactaagcccatgggccacaaatactgagcctgtgttctagagcccaggagctgcagctactgaagcccgtgtaatctgagagcctgtgctcctcaacaagagaagcaaccgcaactagagagcagccctggcttgccacaattagagaaaggcatatgcagcaacaaagacccagcacagccaaaaataaaaaaataattaatttaaaaagtaataaagacctgaattggatattggagaaggtgatcctaggagagagtttttcagtgatgattctgggagaacatcttttttttttaacttttttatttttgtactggtgtacagccaattaacaattctgtgataatttcatgtgaacagcaaagggacccagccatatctatttctcccccaaaccaccttcccatccaggctgctgctaagtcgcttcagtcgtgtccaactctgtgcg

SEQ ID NO: 41380 - DNA, 1608 bp, Bovine  19866880815178
cgatactactttgctgacaaaagtctgtacaaagatatggtatttccagtagtcatgtatggatgtgagagttggaccataaagagaaggctgagagccaaagaattgatgcatttgaactgtggtgttggagaagactcttgagagtcccttggactgcaaggagatcaaaccagtcaatcctaaggtaggtcaatcctaaatattcattggaaagactgaggcagaagctgaagctccaataatttggccacctgatgcgaacagctgactcattagaaaagaccctgatgctgggaaagattgaaggcagaaggagaaggggacgacagaggatgagatggttggctggcatcaccgactcgatggacatgagtttgagcagtctcagggacatggtaaaggacagggaagcctggcctgctgcagtccgtggggtcacaaagagtcggacacaactgagcaactgaacaacaaaggaaaaggagacgaagaggaagaagaagccatgaggtaagggcctctgaatgatcacctagaagccatcaacctgcattggactgcaatggaaatgggaaagaaactctattgtttgaagtctctgagatttcagaattgatctatttcaggagctagttttacttcacacatataaaagctcagaagaagcctatggcgagcagaggcaattcaaaaatcaaggtgataacttctttgaactcatctcctctgtaagtaaaagaccaagggctgataaatacaacagtctctttaggcaatcaccaagatcatgtaaagggaagattccctctgctccccactgctatcctaggcttcaggacttagaggatttatttatcttcttactggctccatctttctctctctctctctctctcttgtttttctgcccctcccctcccatggcttgtaggagtttagttccccagccggggtttgaagccttgtcctctgtagtgaaagtgggagtcaaaaccatgggaccatcaggaaattccctccacctgtcatcttttaaaccacttttattctagacaaaaatgttggaggataggaaggatactggctgttttaacctaactttttgtggaaaaagagaaggtaaaggaacagaaacagataaacaggtgaaaatcttagttgtaaagaaaagggcagtgcgaccataagaaagggcttcccagggtgttagtgttaaagaactcacctgccaatgcaggagacaccagggatgtgggttcgatccctgggttgggaagatcccctggaggagggcatggcaacacactccagtattctttcctgcagaatcctatggacagaagagcctggcgggctacagtccatggggtcacaaagagttggcatgactgaagcgactaagcaccataaaggcaccgtaagaaaacattgtcacattttggactttttggtttgctaagggaggtgattctttagtttggttaatatgttgatgggtcttaggtgggcaaagctgggtttagagttcagtttgtgataagttgctagggaagagccgagttgagttactctgcatgaaagtgtgagaaagagaattgaaaaaag

SEQ ID NO: 41381 - DNA, 1168 bp, Bovine  19866880868256
ttcttcctagactattaaaagcttaaggcatgtgcctttcaaaatagtttattcaagaaaggtcttttccaataagatttcaaaattcaataaaggaattataggcattgttataggcagagagggagagatatttttgaaaaaggaaattgcccacagcactttaaatctcctacagttattaatatccaccatttgttaatgatgatacgctgctaaggactattttatgtgctttcattgaattttttttctacagactgatgaggttgagattcatatttgtcttctccaagatatcttggacatctgaattagggactgttcctgggaaatctgccaagctgtctccctcttctttcctaacttggtttaaagcatctgctcattttcccccaacatcatagctccattctactctccacatcccactggactgtaaactcatggctgagaacattcctgtctgtcacctacctgctgacctgagtgctctgctcatgctcaaagggatttgcggcagcctatgtcttacacatatttataaattccatggaacttaaatgtgcaacttttttcatagaagatgcctaatagatttatacttgaataatggatgaattccagtgttttaagtgttacattcaactatttctgtagttcccaggaatagtcagagtcaaacagtcaaacaggaaaaatttttagtctatcaacatttctgaggataggtttcataaatctctatttttttttttaaagaacctatcccactgtcaatcagtcatgtccaactctctgtgaccccatgtaatgtagcctgccagctcctctgtccatcggattctccaggcaagaatactggagtgggttgtcatatcctcctccagaggatcttcccaacccagagattgagcctgtgtctcttatatctcctgcactggcaggcaggttcttttttttttttttttaagaaatctctatttttagcaagttcccccagtgactctgaagtagccagcttgatcccaggctgaagactggcatttgaaaattcatggagcattctatctttcttcaccccagagtcctataaaatgtccccttcctgcccctgtccatgctgtcctaaaccattttctcttagcagaccaatgccaacaaccaa

SEQ ID NO: 41382 - DNA, 987 bp, Bovine  19866880902415
attgaaagcctcagcactcatctgaaaatgtataactgtgtcgcctgcagagtttgtcttgggagtgaccagtttatatttcaaggaagaatgaatgaaaaattgtggttgagggggtcaccacttcaaaagaaaaatatctatacatgtaaacttagaagagagtaagatatgaaaaaaaaaaaaacttcaagggtaggtgagtgaaggatgtaagagaggggaattgaacaccacaacatatttttcctttcagaagaccatctgctgaagttctgagcatgagaacaaagtgggatttgaaggatctggaataaatgaagtgaaagaaatgctgagaaatcttttgaaggagcaatttccagacaagcaagggaagtcatgtggtttgcccttctggtcccacaaaagtatgcacgttcttggagagcaagctctgtggagggttctctggctaaaagaatgtgattcagggcccataataacagagccctcagcaaggggaaggtggacgtggggagtgaaggcattcaggctgggacaggagacagagtataggttctatcagacagaatgaagaaggaagatttaaatggtgaaactataaaacattaaaacttaaaaaaaaactttttattttgtattggcatatagctgattagaatattaaaacctttgacaccttatacatcttttacttcacctgcttcctcttaggatacaaacactgatggccaggaaaatgaagggattttacaaagaaagatcttgaaatcaatgcactgaggattaaaaacagcatgaattttagaaacaagattgatggcaaaatatttttttactctcttaaaatatggaatgccaaaaaggaaaaaaaaaaaaaatctttcccaaagaaagcactaagtgataatccttggcttcttcagcaatctgttttaaaggttatagtattatcagtcttctaaaactgctgatatgcttttt

SEQ ID NO: 41383 - DNA, 907 bp, Bovine  19866880989628
taaaatatttaaataaataggccgccgacgccgtccccgcttcgaataccctggatcagccggggcaggtcagggtgggtggagggtggggagtgcaatagcccttgatggtcaatcttgttgaaggcaagacaggtaaggggtaaggaggggacagctaagaagccaggaaagaggctggcagctgagatgtcacagctgatttcctaccattgcctcagccaagggagtgtccaattgtgtctagaaatgtagatttgaaactgtgaaagggagtggatggggaagatacaaagagagacagcatgtcttcggacatgtgatagattgttgtgactttaatgagggtgattataggttcgttttctggagtcactgtcagtagatgaggtgaaagactgcaagggtcctactggttctcttgctgtgatctttgcttctcaaccagtcactcattggctgctaggatgtgaggtcagtctgagacagtcctgcacacaccaaactgagccatgccaatgtcaagtgcattatccatttggaccagataatcaccatctctctagagaggcaaaagcctgacagtgcatgatggaaaacttagatgttttttcagctgccaaatgggaaagttcttagaaatggtgagacatgggatgcacacggacatatattcatgcatgtatatatgcatgtttacaccatgaacagatagacagacatacgcacacacacactcacacacacacacacacacacacacacacatttactttcaaaatggacattttagcaggaaacagattttattttagacacaatttttattttaggttttattcaaagttgggttctcttggaagctctctttgagatgaaggtcagtatgcaggatgtttattcagta

SEQ ID NO: 41384 - DNA, 945 bp, Bovine  19866881012093
aatatatttttttctaaaaattcaaggaaatctacaaatatattactagaatgaatttaggaagctcttgaatacatggttaatgtttctgaaaatcaattctatgttgatataactgttagaaatagtttaaaatgcaatattatttgaaatatccccctaaaggataaaataactaagaatcagtttaatgaaaaagcactcatcttgtcttttgagtggattcttcctttttaaatcttttcttggtattcccacttttctttattgcccccaggggctccactcctgacctttcaattgtagacacccactttctaagactgcctgacttgctcctgtttactcaagatcattaaaaaaacaccttgataaaaagcatcccattcaggagtgactgcacatactgctaccctgtcctaggccaaattcttgattttttcctttcctctgccaggtggctgtgcagatatttcatttcaattcagggtccctgtcatcaagttgtgaagcacaaaaataaatcacctgcttactggcatcctcctaaagattttgaagaaacaataaaaccagtacaaaaatgtagtttaaaagcaaaaccttttctaaacaacagggtcctaaagtcagtatcttgagataaatcataatggaaaagaatattaaaaagaaaggatttatatgtgtaactgaatcattttattgtacagcagaaatgaacacaacattgtaaatcaactatacttcaatgagaaaaaaaattaaaaacaaacttctcatttcgtgtcattatagactgacaggaagtttcaaaagtaatatagatcctgcatatatttcacctagttttccccaaggacaatagctaacatatctacaggacaatatcaacactaggaaatgacattggtactatgcacagacccattcatatttcacatt

SEQ ID NO: 41385 - DNA, 1584 bp, Bovine  19866881099034
aatatgttgatatataaacagatacatagtgaaagtgcttttattttgggacaaatgacaacctaagaactggttattttaaatgttatatttaaatgtacatttttttaaatgcagaaatcaaacctgatgtttttgataatctgatcttcttttaaagatctgttttcttatttagaaatgagaaatccaaatagtatgagtgttataacttagtcagaaatgcagatatttataaacaattccagagttgagtgaccagcctccgtaagtctcttacctttttctttaagaagttttatcttctagaatctaaatacgcatttcagtgccccggtttagtctaatatacttctactggtagttgcagtgcatgtgttacactagcagaatgaaaaggcaagaaggcagataaacattcttcagtggacatcctttcccttctcatttctcatccataatttttatacagaaaaaatttcagggaatcttaacaaagaatatttccaatgaatgaatgaatgttaagtcgtggcaaacatatttgtaagataattcttggtttgtttctattgtaccaaaacttttctgacttaatggtggttctttttccataagaaaaaccataaaccattatatgatgcatgtggactcttaacattctgttttatttcattgatatttgaagtttacaagtaaaagtatttaattcttgatctatgtctcagctataaaatttaaaagaaagtgcagtgcacattctgattaatatatacttaattgagcgggctaaggggtcttttgaaattacactatctcttgttcataacgtcttattcttatatgccttttgtcctgttggtgttttgttaaatacaatttatttttgaaaggaaatagctcttaccacacattttcttttgatgacagtgtttttttttacctagtttttaaaatctattaatatctataatttaatttcctcaattttgtttctttatagatagttggttgccactttaggtctattccagtgaatgaaaaagacaccttaacatatttcatctactcagtgaagaatgacaagaacaagtcagatctcaaggttgacagtagtgttcactaggagagatggaattaaaacttggatgttcagatgttaagactgcttactgctttttcacgtgtagaaatgttccttctgtattttttctacagaggattttctctggttttattttctttgttttgactctaattagttggaagctcatgtacaatgagctttcctagattaaaaaatattttaaataaaggttattactattatagttgcttcagtgtatttattttgtggaacttgatttttattttaaactgacttttagggaccagtattaattgaagtttaaatttgaagatcactttattatcttttttccctttttttagttctgagaaactaacaaaagtaatagatgtcatccatttgctctctctggggcaatctgatttggaattaaggatatcctaaatagtattattttttaagtgctttttagtactaacaagttcgaaatagca

SEQ ID NO: 41386 - DNA, 1036 bp, Bovine  19866881133775
taatgcagcctactatagccctcatggacatatattagtactagctggatttgggaatctgaggggacaaatggaagtgtgggatgttaaaaagtacaaacttatctctaaaccagtggcctctgattctacatattttgcttggtgcccagatggtgagcatattttaacagcccacatgtgccccacggttacgtgttaacaatgggtacaagatttggcattatacaggctctgtcttgcacaagtatgatgtaccatcaaatgcagaattatggcaggtttcttggcagccattcttagatggaatatttccagaaaaagcaataacttaccaagtagttccaagtgatgtgcctagtgaagaacctaaagttgcaacagcttatagacccccagctttaagaaataaaccagtcaccaattccaaactggtaagtagagttttactgctttggtaggaaaaggtttttcaatgcagagtttcctagatcttttcttttttttaatttatttattaatttttattggagtataattgctttacaatgttgtgtgtgtttttgctgttcagcaaagtgaatcagctatatgtatatatatattcccttttttttaggcttcgttcccatttaggtcaccgcaaagcactgagtagagttccctgtgctttacagtaggttctcatttgttatctatttaatacatattatcagtagtgtatatgtcaaacccaatctcccaattcatccctcctcttcttccccgctctggtatccatacatccattctttatgccctagatctttttctcatgcatgtttttgtgttacttggtatctgattagaagatataaactctagggtagaaattgtggaggacctgctgctgaagatggtgaaaggttgttagcttggcaaagtaattaatgtaaaatcttgggaaagatgagtgggtgtgacttaactggctatagagtgtgggctcaaattcaaatgcctgtcaagctaggctggtagtgtgagacagtggtga

SEQ ID NO: 41387 - DNA, 829 bp, Bovine  19866881317877
accgacgctccgctcccggtggccgcgccgccagagcgagggggctctcaggcggggcgctagctccgaccactgggcctgggcgaggcgggctccgggtctgaaccctagcggggcgcgggccgactgacgacgccggactgtccggccgagcgaggcgggcgcgcgggaggtgcagagcaggccgccagaatactctcgcgctgccgctctggccgccgccgggagcgtggaatgtaagaggaaggaaacgaacacaacgcaacaacgagacagtgcagcagcccgtcgcctcaaactgcttcgggatccgctgccaacgtcagcactggactggccccgccccgcggaagtgcaggctccgcctgctgaggaagacggagagggagggtgaagtccggcgcaccgaccctagccctgcccctccacgcaccgtaaagcgcggccccaaagttgcgcgtgcgcgcgttcgaggtctttttagcgtctctctccgaccggaagtgaattggtcccgaggctcatgacctaggaaacacaagttcgccgtctccacgccggaggagacgtgttggggccgggttcggccctcgtgaactctgacccaagtatctgagtttctctttccgggacaagatggcgccgtccacgccactcctgacagggtgagttctgaacgagcgagggactatttctttagagcagagttttttctgtctttgaccttgggcaccacacgagaagccttggcgtcagatccgcctttttttgtggattgcggtagagccggagggccttttggatttcttgatgtagcgtggcaatcgga

SEQ ID NO: 41388 - DNA, 1111 bp, Bovine  19866881319665
cttgctacatagtggttgcccagttctgggttggttgaagtaaaatgagtacagaactgatcccatggacaaaaaatcaaccaacaaaatgacagcatcacatttcttacatgttccatactcaagcattatggtatcatgtttgcttttctgaaagcgaaagtgttattgctcagtcgtctttgactctctgcggccccatggattgtagcccgccaggcttctctgtccttggaattctccagggaagaatactggaggggctagccatttccttttccagggcatcttcccgattcaaggattgaacccaagtctcttaggttgcaggcagattctttactgtctgagccaccagggatgcctgcttttctgactgggaccaaaagaaactgtatttgtattctttatcatttaaataaagatttaattcatcattaacttattgataggaataattcatcattaaatgggaaacaaagtcctacttcctttccaaaacacatttcaagaaagtggcataaatgttggatcctttactgggcgctggattcgaaccccacttctgtctctcctagttgtgaaatttggggcaaaacagttcactttcttggattttgatgtttgtacctgtaaaatgggtgttgtgatgcttgtctctcacttttcttgtgaggatcagttgtgatggtagacgcgaaggtgcttttagaacagcatagcattcctctgtggatgtgagagaatgttatttgaggaaaaatcttggtgtctagacttacacacttatctaattaaggagcacagaaactatttcagttgaaaggttaactggagataatactccctttcaatcaagattcaactctgcagcattttgcaagtttatattttcagttacattgtttcattagatgttaaaagatgtttcggtacagtttacataaatggcactgctgaggaaggcagggtgttcctgcgtcccaaacccttagctctgcagggcatgctgagtgtcccagggcagaggacgacgctataattttaccaaaggaaggtgggggcagggccgacaaccaggccaaaggccagtttgcctcctccaaacaca

SEQ ID NO: 41389 - DNA, 694 bp, Bovine  19866881383947
ctccggactcgccctcctgcttccctcggcgtccgagagcccggagctgacgccggcactggttcgaagagccggagcggggcagcaccgcccctcacgccgccgccgcctccccttcgccctcccactcccacccccagcctaggcctgctgaccgcgcggagctggattgaccacggcggcccgaagacgcgaggaggaagcagccgacccgcccctgggatagtgctctcgccgccacgggggggattgaattgaggcgccgcgactgcgggaggcgagaaggaaggaggagccgccgcacgagtgagacgggggcagagccgtagagaccgactcggataaggaaacgggaggaggatgtctcacggagcggccggcgcccggatcagcccgtgactcttagagcggcgggcctcagaccccagcacggacgcggactttgtctttgggggccagtgttctgcccttcctggtttctggcaagatcgcggaggagccgggtgcctctctgcccttccagccttcctcaccatgtccaagatgccggccaagaagaagagctgcttccagatcaccagtgtcactacggcccaggtggctactagcatcaccgaggacaccgagagcctggacgacccggatgagtcacgcacggaggacgtttcttccgagatattcgacgtttctcggg

SEQ ID NO: 41390 - DNA, 1322 bp, Bovine  19866881425549
agatagaagtgtttcctatggtcgcacataacagacatgaatctcacccctcctgcagcctctgaacatctatccattagtgaattagcagtctttgagaaagcctggaggggtgtttatatcaggttctctcagccttctcactattggcattttacatgggaaaattctttgagggaccgtctagagcgttatgggcttgcctggtggctcagacagtaaaaaatcttgcctgcagtgcaggagacccaggttcaatccctggatcgggaagatcccctggagcaggaaatggcaacctaactccagtattcttgcctggaggatcccatggacagaggagcctggtggactgtagtccatatggtcgcaaagaataggacatgactgggcgactaacactcactttcactacagcattataagctatttaatagcctccctgatctactagatgacaacagtaccaactcccaattgtgaataccaaagatgtctccagatatcaccggatatccctaggggcaagggaacaaaattatcccctggttgagaaccactggtttataagcaatggaactttctagcatggtgctgacaataacaaaactaacagctgttagcactttttatagcccctttatctcatgctaccagaatcattggacaaattggttaatttttaaaatctgctaaggttgaaaattactttcaaaaatatataaatgcctttatctttaaatataaaaccacttaataattgtttgatgttgggccattatcttgaatatgaatccactggctggatttctaagttgtcatataatacattttctaccatttttaattttgtgtcttttaaaatgggacagaaatttgattgttttcctttttgcttttttattgatatataactttgtctgttttttaggtttctcaccataccacatttaatcacgttttgactggagaggggttgggggaacacttttattaagtgtctaccaaacctagctttcaaataaaaccagaagtcatatacactcacagctcaagggctgctgaatacttaaattacataattaccccaagtagagccaaaaggttcattgaccattgccactagctctttgctactaacagaatcacatggggatatcagagagcagattcctagccacagccttcctaagccagtatgcctaccaggtcagttttatcaggtggaggctggctaagaagtactgtttgtgccagacactctatttgcattctcttttaaaccacaacaatccaaaatcatagtatgttagtattttttt

SEQ ID NO: 41391 - DNA, 1382 bp, Bovine  19866881495264
actgtagcccactaggctcctctgtccatgggactctccaggcaagagtactggagtggggtgccattgccttttccgctccaaaaagctagatactactaatacacaaaaagttaaatcatttcattctcccccttcttaggatacacacagtaacatttgattctttgattactttgtactctttgttaaagattcaatgtagtcacaaaatatatgctaataaaaattgtttgacttgagatttaaacttacatcaatgtttatgaaacacagcattcctgtgaattgaacattagtaaaattctttgatctttgataggatcttaaagtttcattgtttagatagaaataatcttaagttactgtaaaaaacttttccaaaggccactaaaatataacttaatcagtttaatccaacataaaaatttccaaaaaccagtttaaccaaaaatatttcatgtgcttctttagcgttacatgacatttcaacaatgctaagtcgcttcagtcgtgtccgactctgtgtgaccccatagacagaaggccaccaggctcccccatccctgggattctccagacaagaacactggagtgggttgccattttcttctccaatgcatgaaagtgaaaagtgaaagtgaagtcgctcagtcgtgtccaaccctcagcgaccccatggactgcagcccaccaggctcctccgtccatgggattttccaggcaggagtactggagtgggctgccattgacttcaccaccactgagccatacttcaacttaaaaagtgtgtgtactttgtgaaaattcactgagctcttcacttatgaagatgtatattaaacatctacattttccccagatgtattatagattacacttcaatcaaacatatactgagaatcagacaaaataaaaacccccaaattttctaacattttcatttctttgaaaatcctctttctttcactttaggcctctctctcagggaggatatagtctcacagaattacttcaagctttaataacacttttcagaagctagaagagctaaaagatgagttctagtttccacttaattttcctactgatttctatgaactgtgcattaagcacagaaagttactgctgtgagatactgcagggagaaccgtgagtcttctccaatagcagggaaactgaggtttagcaaaatgaagtgacttactcagggacatgtgttctttagtaataaaatgacaaggaaaagattttcaaaataaaagtggcaatgacagtctgtggtccaaaagcttccatgatttctccttctttttaagaatgaaactatttctgagagggagacgcaaccggcttattatataaatgcagaactttaatta

SEQ ID NO: 41392 - DNA, 1376 bp, Bovine  19866881655607
tctttgttatatatatatatatatggaaactatatatattacctccatgtatattataaacccaacaatacattcttataggcctactttacataatcttctatcttgaagaacctgtgagacaaaagtggagcgattatatatttatagagtttgttacactaaatttcttttttatcatgtctgattcttctggtggatgtgagttatcactaccttaccccaaaacagctttgctcccaccctcctcctttgtactgttattgtcagataacattttgataaaatgttgacacatattatgtttctataagtgaaaatcctaacaatgcagttatatgcacacatcctagatacttattttttaaacaagagaataaaggaggggaaatgtgcaatcacactgtcttttgtaattatgcatcttcaccaacacttttttttttccatatagatttgaattactctcttgtgtcacgtgcttttagcctgaagaacttattttagcattgtaagtcaggcctgctagcaatgtatcttctcagcttccctttattttgaaatgtctttatttttgaaaaataattttgctgaatatagaattcttggttgacaggtttttaaagcactgctggcctccagtgtttctgatgggatgtcagctgttaatcttatatgtaatgaactgttttcctcttactgctttttaagattttctctttatatttgactttcagtgctgtgtgatatatttcagtgtgaatctctttatatttatcctagtggaagttcatcatgcttcttggacatataatttctaccaacaaatttgggaaaatttcagccaagactcctaataattttatgcccccttttctccattatgcatatgttggtgcacttaatagtgtctcacattttctttgtggctctgattatttttcttcctctttcagattacataatctctattgaatttgtcttcaagttcactggttctttcttctgccaactcaaatttgtagaaatccccaatgaattttttcattttgattattgtaccagaattttccagaattttttaaaaataacttctcctgcttgatattctctatcttatgaagcgatgtcattgagtgtttttgttttctgtcacaaggtgaggtttgcaggatcttagtcccccaaccagggactgaatctggtccatggcagtgaaagcactgagaactaaccatttattcccaagttttcttttaattttttctaagatgtatttatttttggctgtgctggttctttgttgcagtgagcaacggttactcttcactgcagcgcaagggcttcttacggcaggacttctctgttcccaagca

SEQ ID NO: 41393 - DNA, 1788 bp, Bovine  19866880182955
atatgctatctaggttggtcctaactttccttccaaggagtaagcatattttaatttcatggctgcaatcaccatctgcagtgattttggagcccccaaaaataaagtctgacattgtttccactgtttccccatctatttcccatgaagtgatgggaccagatgccatgatcttcgttttctgaatgttgagctttaagccaactttttcactctcctctttcactttcatcaagaggctttttagttcctcttcactttctgccataagggtggtgtcatctgcatatctgaggttattgatatttctcccagcaatcttaattccagcttgtgcttcttccagctcagcgtttctcatgatgtactctgcatagaagttaaataagcagggtgacaatatacagccttgacgtcctccttttcctatttggaaccagtctgttgttccatgttcagttctaactgttgcttcctgaccttagagatattcattaaactatgagatatttattcatacctcattgtaaccattgttacaatgtttgttgtaaccattgtttcaatggttacaatgaagaaagaagattatcaagttctgaggaggatatggtacaactagaactcttatttgttgtgtaaatttttataattatgttgaaaaatgatttagcaatgtctactaaaactgaatacacgcttacgctgtgactcagcaattctaagtatatacctaatagaaatgatctgtacaagaatattcatagcaatactgtatataatactcccaaactgaaaattcacaattaacccattaacaataaaaagaatgattctggtatcttcacataacctaacattcacataatggaatatagcaataagaaaaaataagaaaaaatggtacatggtgatatgaaacaacaaataaaccttgtaaatgtcatgctgagaaaaagaactaaaataaagaagcatatcaacatgctgtatggtagcgtttatttaaagtacacaatcaggcaacactagtctatgctgtttgttagagtcctgggtattcttataggaagagtaggacgaggttagggtgtggtgactggacaggagtatgaaagggtcttccgggatgctggggatgttccgtttagttctgtttcccaggcgtgcatgtctgtgtacattcattcaactgtacatttacagtatgtgcacttttctatatgttacatttcaatagacatttttaaaaagtaatgtgttcgatgttattaattttagtaaactactttgatacatacaggaaaaattcctccataagaacatcttcaaatactgtcaagtctgcatacttttaggataaataagtttttttaagttatttttttctaccaccagcttgattttgctcaaaataatttgtgagaaaataaaagttccctttaatattgatgcttccttgatgaatttcataagtggatagaggagactgacatagaatccagtgatgccaaagagaaaaaatgtgtatcttagaacgctgggtctttaaaatcctgacagttggcagttttctgcctgaatctcccttggggccgctcaggcttccctccaaagtgcttcaatagtagcagcatcctggcagaacggtgagtttaaaaataaatccttctgagtaccaccttgaagtttataagcaataatgaagtgctgcatcacagaacagcagtgaagccacatcatgatagattttaagccacagtggtcctctgggtttagcagtaatat

SEQ ID NO: 41394 - DNA, 3238 bp, Bovine  19866880366751
tgaaacatagagtttctctaataatataccacaaagtatacatgaatatagctctttttccatctgtaagacctacaactgtgaatgtctaattacacagagctggtgtctactttaaatagtctctctgcccatgctatgtcagtatatttctagtataaaatgtggcaactagacctgtattcatttataatactgatcttgagggatgggaatcaggctaatttaagagtttattaaatccttataagttttataacttcataccagaaaaaagccataattgatttttaacaaatgtgtggataattagatttcactatttctcataaattactaaaatgaatagtatttctgtccacagtaagggaaacaataaacaaaataattcctttgtggtttgaactaagtctgtctttgttccaaaaacacccccaaaacttgtgccatgaataaatatgtcagtgggcttgaatttctgtcaacgttcttgggatgatatatttaacactcataatgtttttcaattgacatatgtctattgctatcacattaagaaactagcaagttcaaatttttttcctgcttcattatttaattacatattgataggttgtaattgctggctaaacaccttagatattaattgcttaactagtgataattctttgaatatggtataagtttgtgcatgtatacacatccatacacactgatatattcttcattttatgtttttatttatttatgttgcaaatttaaggaccacaacttccattcacaagctcaaagccatttatacatctactatgaaacaggctgtgtgttcatcctgagtaagacatggtctctgctctcaagaagctagtagggaaagtacaatgagcatatgttacaagggcaatgagtgagttacatacatcctttctgggtacataccacagattaaaccatatcttaaaactgtgacaattgaacacacaaacaagctgatgtcataggtttatctatcttgctttctcaaatcaaaaccatgggggaatgtgtggcctgtctgtgtgtgtacagtcactctgaggtcatctatgaggcaaagaaagaaaataatttcatgctctcatccaccttactcatccatgtattcatagttgccctgaccagaactgagacccatttaggaacaactcaagcatcaggattattaattctcaatcaagatgattcagaactgactaacctttgtacccaagggcgaagcagttcttttacatttcaaagtcatttattctgttcctgaagcctgaaagtcacactggcccttcactgtttgttcagctgatcacaaatcagaggtaatgacatttacattgttaattgactttgccccaactgttaactgtgttaactcctggtttggtgtactttcttctacttgagaaaagcttatttgaccttctgcatgaaactttaactagaactaattatctgaacaagaacattcccatactcatacaaccacaaacatgcatacatattaaatagagaaatgtaggaaattctctaattacctattctgtattcctagtccatgagaaacagaactaatgggcaaaacaaattaaagtttgtgttattaatttacccatatatagacattaaattacttgaaaaatcggggcatattagaggagtacctttcaggcaatatggttgacctaagtcgatgtgatgatgacctcttaccttaggcttgtagaatcaagacaaatagaaaaaagtatacatttcaatggatgaaatcctgaataatgtggagaatagtcacaaataatctgactttcctgtacagcaaatttcaagcaactaaatctttgcttcttgaatgtttctctgatcccagttattagactatattgactattactggtgtgaaatgaaaaatgagaattccaaactcagtttcctttattaatgagcactaaatgacctgaaaccaaagtcagataactaaaaacatcccactggtttgcttaaagtataactggtagagtttaaaatatctgctaattgttaactgttttaatctgttgcttgaccagtcaagaataagtatcagttcaggtcagttgctcagtcgtgtccgaccctttgtgaccccatggaccgcagcatgccaggtttccctgtccatcaccagctcctggagcttgctcaaactcatgtccatccagctggtgatgccacccacccatctcctcccctgtcgtccccttacacacagatattgaggtcacaattcagatgctcacatctcaataaaatccttactatgaattttaacacttataagtttgtaaagtgtttcgagattagtcaatagcctacatagtttgaataacattttattctaaagtctagtaaaatgtataaatcgggtttgagttaaattcaatgcaataggatttaatgtgtgcttaaaaataataatcaacaatttggaataattttctatgcagcaggtgctgtgctaagtgatttctgggcattatataatttaattttcattagaaccctatgaggtggactctcttatttccatgtcacagagaagattgaggtattctagtgagttaagtaacttgccaacttactgttattaagtgacaaatcttggattgaaaccaaatctaagtgactctagagccaaattcaaacttttatttggcctactgtggactataaatgagaaggcctggaataaagtctcagtgtcaattaattattagctctgagaccttaggaaaaatcactgaacttcccccaacttctattttctagtacataagacagagtcaataaaatgttccaaccattctcacagagttactatgacgattcaagaactaatgtaagcaagaaatttgtgccttgtagagtgctttgtaaatattttattacattgcaatatcttaacattttataactcctaaagcattttgtggtgccagtccgatattaaaatggttatctcattagagagagagacttaaggaagccattggaataatctttattctgccataggaaattttaggtagataacctaggatgacacaagacaagtatttgaaaaaacattcaccctttgtatgtgtcatgataaatgaaagagagatctgtgttatggactgatacttgtattctcccaaaattcatatgttgaagctttatttctcag

SEQ ID NO: 41395 - DNA, 2125 bp, Bovine  19866880374636
tatttgcttctgtttttattaatgtctgcttcctaacatcttttgactaattttggtacatgttttctaggttttaagatgtatacatgcctcatttattttcaatttttgttttttaatatgaagtcccatttaggagtgcgatttttaatattttcccttccattaacttttagataatctatcacgtttagtttagatttttctcttctctctttacttgatggttaataggaccgagagatagaaataacatgttatcttttgttctagctttattattaattaatttagcttggccttgggccagtcactcaccttccatgggcttctgtgatattgcctgtgtgagaatcaaaccaactaaatatgataatatttgagaccataaattgctatacaaatttaagtcatttaagtccatgttttaattatttttgaccaactcactattcacaaataaattaggataaccctggggatatcagaattgcttaactttacagttttaacttcatttctgcttgttgtattagtaatcatctctcaaattgcctgtaagtttataattttatggaaaaatagcaagaattcacctactagatcagttttatttatttttttatatattagttgattaagttatttgaaggagagaaaccattttaaaaactcaccttctgaaataatctgtcattatcatttaagagtgggaacaaaacgaactagcattatctaaattcagttatgtgtcaagcacttttttaggtgttttgcattcaattctttaaacaaccattgcacagatgaagatactaggaaagcataagcaaactgcccaaagttataaatcttctgatccagcccttcccagctccctccctataaaatgagtcaataaagatagcagggttaaagtttttatctaaaaattttcagagaatgtaaattagttctttttttaaaattgaaaatatagatcatgattaagtaaaagtaaatgtggttttaaaaggcagtggtccttttgtttctctttgaatctttttttcttcagaagagacttttatttttcctttttgtttcctttaggggagaatgaaagtatctgagagcaatcatttactttgaactacaccattacttcagaattttctatcatgctaaatattaagttcatcttatgtattaattcaagagttcttatatgtagtatctaaaatacatgtaaaattcttcagtagcattcatttgtaatatttagttttttgcttaaaactacctaaaggcattaactactattatttctgatgaaattatacttaactgaggaaaaactgtagcctaatcagctttgcaattttctacaagtacagttctctgtagataaaagatcattactactaactagactggcactgatttgaaaagagggaacatttacagaattatatgagttctgagtatcagaacccagaatgttcccagaaaagagaaatagagaataagaagaaatgattaaaattgctgtattaatgaagatgttcattacgttatatataagcacaaacatatagaaacagtcttaaagctcaatagcagaggagtggttgtgttgatagtgggaaatattacaaaatatattcagtgacataggaaaatgttcactatataacaagtgggagaaaatatgtagaactggatgtacaatagatgtcacacatgtaaataaaaaagcatattgcatatgcatatgaatgtatatgtgcatatctacagaaacaagtctagaagaaaataccccaaaatatgttaaatactgcaggtttattgaaaattttacttttttttctgtattgttacatttttgtactaaactgaaagaaaaaaaaaaacaaacccttcatcttaaacattacagtgggagggatttcactacaaaaaagaaaatgtatataatttctaaaaatagggaggcagaactagctaatttagataatctctctttaaaaatttatagtaagttaatgtcaagaactaggttacgttctcaagttccttttgggtcttaatgatcctctgattcaactggagtaagggcaagcacaggactaaacacaggcag

SEQ ID NO: 41396 - DNA, 1898 bp, Bovine  19866880410339
tggtgtgaaacatctgattgctgtacttattttcatttcagacggagtacatttagcttttgactgttgggtgtttctccttgggattcattttcctcatgtgttttgaaattgtagattgtcctctagatggaaagtgtttgttgttcagctttattgtccttgctttgttctctcctcttttctctttcctcctgagcagctttgcagtgacttctacctggacctacagggatctccagtccagcaactatcttctgctgtctgattagggtcacccaagctcccatggagatactgtggctctcagaggtgcagccagaaaaccaggttggggaggagtggggccccctgactgcccagcagtgtctgattcctacagcagctagctgtagtgttttcaatctccttttgtaaggagggaaaaccccattgctattactgatttctgcccttcacggagtgcatgctttggtctctctgtcctcacagaaatgaaacttgttagcatctctgcgtggatctgaacccaggaaccctgtagcttcagccccacttgccacttatgtttctttattgtcttgtgtgtatgagagatgtgtgtgggtgtgatatccgtgtggtgggcagtgattcaaaatgtatacaacttaagtcaggaaaaaaaaacaattattgtgaagacatgcatttcacttcctcagttggaatggcaccttttccaaagtagggatgaaaactagagaggtggttgtttcctgcaaaataaagatgttaaacatgagttcctgtcaagagaagtagcaacctaaagataaggaagataattttttttcccattttcaaagtataatttgtccatagacaataagaaaaatatgatcagctgattccttctgatgagatagagtaagctgtcaagtgcttaccatctggttcagctcctaatccagatggactgccagtagtaatttatgaaaggtctgaaagcaacttgctgctcttgggaaagaatcattaaaacatattagcactgggatttactcccattcctcagcctcagtttgtaacaaatgcaaaggtgtagggaaactgcttccatataggaaatataacagtctatttttgagccagaagtcaatatgtctgtgctctctagggggaaaaataatttttctttccccttccctcacctctcctggcttaatgaataggggagaaaatacttccatggtgaggtttctaacaaatgtctaaagaagccttcagtctgccctggagaaggaaatggcaacccactccagtattcttgcctggagaatcccatgcacagaggagcctgataggctatagtctatagggttgcaaggagttgaacatggctgaagtggtatagcatgcacacacacaaactatcattctctactgttgctctaaagtagaacagagctgtatgaaaatatagtaataaattatttttgtgcaggaaaaaaaaaaagaagccttcagtctgtcattcctgaacctctgtgatacttgaagaagtcaaaattgatatcaagaataatccaatataccccgtgttcctactacaggcaggaaccatttaatccattcatagagtgcctgaagatcaagcagtatttccaatgtaaattacagagccacagattgttaggcttagaaagcaggtccactggtcgcttctctcccaccccatcagacagcacctgagcagtgtgtcctgagtcaaaacaaaatgcccggggaacttgcttctaccaaatttctattgtccgcccacagttcttgccccatcacttattaacactactgtgaagtaatactgggtggctaatggaattctattaatttactttcagttcatgtaagaattg

SEQ ID NO: 41397 - DNA, 1178 bp, Bovine  19866880423178
catggggtcacagagtcggacatgactgagcgactgaactgaactgaattgtaaaaacagtttgaatgtctggtttgacatataaagctctctatatagtgtaaataaggcttagtataaaatcaggtacagagtaggaattacaaaagaaaacaatttagatttttaaaaaaatttaatatattcaaaacagacacctacctgcatcaccttctgctgaatctcttctaactgtgtacgcttacttcgttgcctacaaacttcctggtagcgggtatattgctctcgcagtgaatctaataatttcataacctgtggctgtgcaagcagttcatcatccataggagaccatgagacccctccatctgagccattaaatcgacgctgctgtaattcggataacaattcatgccctttacaaatgaaagatacttacaattaatatccataaagaaatacaaatcttatttctcaatcttctcaattttagtcgcttgtttttagaatatacctgcctatgtttacctaacaggtcttaagtactaaaaagcaatttttcaatttatatagaaataaacaggaaaactgcatgtatatatacacatatggatatacacaatttagtttatctatacactatgttctgtatcataactgtatcatatacagacagtccttgacttagtgatggtctgacttacaattttctgactttacaatgttgcattcagttgaacccatatttcaaattttgaattttttctttttctgggctagcaacacacagtatgatacttctgtgatgctgggcagtggcagtgagccacagcttgcagtcagctacaccatcacgagggtaaacacccgatacactgacaaccattctgtactcgcacaactcttctgtttctcactttcagtacattgtccaataaattacataagatattaaacactgtattttttttttcaatgccattctcccaaatcttcccatcctctccctctcccacagagtccataagactgttctatacatcagtgtctcttttgctgtctcgtacacagggttattgttaccatctttctaaattccatatatatgcgttaatatactgtattggtgtttttccttctggcttacttcactctgtataataggctccagtttcatccac

SEQ ID NO: 41398 - DNA, 1338 bp, Bovine  19866880438495
cagaacacatcagagacaggatgaaactagttagtctcaaaaggcagcagctgagacatccagaaatgatgactacagagagctaatagctgccttcttcccagagacctgctgttcatagtcccgcatgtcatcagcatactccagcattagctacaatacgttaagatgcgtttcacagccaggataagcctcatttctttccattacacatttctctccacatgttaacaccttgtaattaccaaggcagaattgtttaacatgctttgagatcatagactccaagtatcgtaaaagaaggaactgtaaacattgcactgaaaacttgctttaaagctttacctgacctgtcagtttgtagatgaacaactgataataagctttgaatggtgctaataagagtttagaattctctctataaaaaatggttgcccttcctccccaggtgatgtagtaaatttagactatagctcaactgatattagtagacagtggtgtcctcaaaattttgctttggtaattctccttcaaatttgattatttttattgtgtccgtatgaagaaaaaccttcagatttttgatatatcatattcattaaaagacattttcctatttgtattgataatgtattaaaagttgtttgtgcttaataaaaggcttcttttaaacaccttatttaatttggtggttatatcctgtttccaaacatgagtgccttaattaaaagggcattcttaggcttgtgaggatggtttaatatttgttttttcatgttggttgcatgtattttagccaggaaattcatatgtaagcatgtatatataataaataagcatgttttatcaaaaaaaattattgtgaagaaaagtttagatgttagtggaacactctcattttctcttcttcaacttgaaaaatgttatccaaattactgttctgaaaatattttgtctttgggagaggagggctgggaaaggcatacatagttacttaaatgtcatcctctatatcagagtaatctttcaggagctaaaatagcaattgttaataacatttaatttgtcatgatagactagatgcaagattctggtgtagtataataacaaaaattgtacacatcttttagaaattaaatatataaaatgttaatgcttttaagtttatattaagtttaaatggtaaaatacatataattttgtgttcatctttgtttcagaaaatgtttttgagaaagattaaagcaattttatagtctgtgatcaatacaaaattatgcaaagtatgctcttttctttccattgtctactgaaatgtccatgtatcatacttccagt

SEQ ID NO: 41399 - DNA, 1246 bp, Bovine  19866880457201
attgaacagaaggtagagctatccggccaaacactcaaactccagaatcaaagacttggtcatctggaagagtgtcatgcatccaacttccacccccaatgcttgggtggttcgttatgttatataaactctcacccacacaagaaacagcggtgtggagattcttggggaaaagccaaattcagcagctttgtgctttctgtattgaggctgaatccaccatacacagctgataacattcaaatctcatctcatgagaagagagtggagaaaatgaattactgttgctttgagcaggacactgtttcatttagggaatgcaaatcttttggctctttgatgcagctcaagattctgcttattataaatggaaaacagtctgtcatgctttggtatttgcattgacatgcacaatatcagagtgtactaggaggagatattttattttgtttcagctaacttatttcatggacacacttgaaatactgtacctaccacagaaatgtcaaaagcttcagatagcaatttctaggaaggaatggtcatgaataaaaataaatatcggggaacaagatgcagtattttttccttccttcatttcaaattcaaataatctaaatttttgcatttggctttttttttttagatttacatttatgaatgaaatgtcagttttaaattagatctgttcacaatcagattattgagccccaaacacaataaaatactgataatttgtgcagtgttgttaagatgtacataaatcctggttttggcagtttggacttagtcactgaaaggtgagacacccacttctccacttatacctaatgatgatttacacctgattatatctgctttgggcttccctagtggctcagagtggagaaggaaatggcaacccactccagtgttcttgcctggaaaatcccagggatggtagagcctggtgggctgccatctatggggtcgcacagagttggacacgactgaagcgacttagtagtagcagtggctcagagggtgaagtgtctacctgcaatgtgagagacctgggttcgatccccaagtcgggatcatgctctggaaaaggtaatggcatcccactccagtactcttgcctggaaaattccatggactgaggagcctgcctggccaaaggccattggaaaacaaagcattgccagcaaaggtccatctagtcaaagctatgtttttccagtggtcatgtatggatatgagagtt

SEQ ID NO: 41400 - DNA, 1451 bp, Bovine  19866880499823
agagagaagagaaacttttccgctttcagtttctttcaaagccttcagaggttttacctgtctctcaaaatcactttcaagtcctgtcttagcttaggtttgtttgacacaggtattacaatggagatgcagctggaaagcttactgaggagtgctctcaggaaacccacctgtaaggaactgaaaaaaaaagtgaaattgttagttgtgtccaactctttgtgaccccatggactgtagcccactctgtccatgggattccccaggcaagaataccagaggggtagccattttcctctccagggtatcttcctgactcagggattgaacatgcatctcctgcagtttaggcagattcttcaccatctgaggcaccagggtaaggaactgaggcaaagggaaaagctgaattgcagttggttacagatgaggcctcaatcaattttagggggaagtctaggctgagttgagccaggttgaggacagggggccaggccattgtagtcccatcttagccagttatcattagtcatgggctgctccctcaaagaaacaccaacttggaggaggcaagtctttacagctgatggcaagaccccggaaaagaacatgggcaagcccatcagcagcatctggggttgagtgcatcaaggctgaggagtgggttcaggcggcatggcatccatgaccaggccctgaacgatgagatcccttcccatgacagaactcatctctctagccacactggcctccttactagtcgctgaaactgccagacatgccctcctctcaggacctttgtcttcttcttcctctctctggaacacacctcaggtagtcaattgtctggtttgcctaggctgggatggccctggttttagcaacaggatgcatcctgggaaaccgttagtcccagacaagtcaggatggtaggtcagctgtacctcctccagaagcccacatgtctcactcatcttttctgaacatcctacttataattgtaccctctaaatctcacatacatattccaagttcccctttccgacttttattattttctgtaccacttaataccttctaatatatcacttatttctatcatttagcttaggaaaataaacttgaggacaattttggcacataatagacatttcaaaagtatgcactgaatgggtgaaataagtgtttctaatattttgtagaaaacagttcctggcttgtaccaagtgtatgccatcctttaatgattacttaaaatttagatggtaatcatttatcattgttaattacttggcaattatgctggtgaaaggtcaaaattgatcacagaatcatttcttcagtaagtgaatgggagaagggatataaaattaaatcattctactttcgtgggttgatgggaatgacatgctatttttaaattatgggaaataatttaacagactacttat

SEQ ID NO: 41401 - DNA, 1558 bp, Bovine  19866880582645
catagggtaggacttgcttgaatgaacagtggcataaaggctttttcataagaacatgaaaaattcacgcatattcttaaccccctagctgattatgaatcactgatgaaatcccagcaagaaatgctttaccaaacacaagtgactgcatttgtgcaagaacctaaagttggagaaatagcgcctggatatgtatactctgagtatgaaaaagagtatgaaaaagaacaagccttaattaggaagaaaatggccaaagatactgtaatggtcagaacttttgtggaagaccaggtaggtatgacaataatgaccaagtaaatcacttcacacattattctttcctcctgcggtgccccggtttttgtttgatattttcatttttgagtgatgggccagggttatattactataagcagatgcaggtgcactgccgatgagcttccttaatcttcataatattaatatgttgcacatatgactttggaaataaagattacatgtaagtaggaaaaacaattactaaaacaacaaagctcattactgccgacattttttcatcggtaggatagacatcacacgtataacccatactctgagaataccattgttcaagacaccacagcatgaacttccaaagatgactgggaggcagattaaaaaataatgactcatctaagtctcactgaaaaacagataaaaaagcaaaattaaacacttctagatgtttcttcctgttaaaaattttaatcaaaccttatttctgaaaacaaatactcttaaagaatttctgtcagtcagcagttatctttttaacagactgtcatcttttttactacataggaattccacatttcttcctttgaagagagacttattaaagaaattgaatacagaataataaagactacattagaagaacttcttgaagaagatggagaagaaaagatggcagttgacatttctgaatctgaagctattgaagcaggatttgatttaagagtcaagaattatagaattcttgaagggatgggtgttacatttcattgcaagatgtctgggtatccattacccaaggtaaaatataagcattgatcatacctccatgctacagtaaagacacgcataggttatagtgtaaatcctttatgtaaatcttacttacatgtgcatgatattattcgcagattgcatggtataaagatggcaagcgcatcaaacacggagagagataccatatggactttctacaagatggcagagctagtctgcgaatacctgttgttcttccggaagatgaaggcatctatactgcgtttgccagcaatatgaaaggaaatgcgatttgctcagggaaattgtatgtggagcccgcggcacctctcagtgctccgacttacatacccacgccagaaccagtgagcagaatcaggtgagaatcatactagttcaggttgatcagtatttaaatcgtttaaaacaccaaatatctcagtagcaaattgctgtcatgtagtggggggtagaaggctaaaatacccagaagtctaccattctc

SEQ ID NO: 41402 - DNA, 971 bp, Bovine  19866880586453
acaggtattttcatggttgaatgacagagttttctgtgatttgtctgatgggtctatgacgccaaagagagaatagaatatacttacccccaccctccagaggtagggtcttttgttatagagccttcatggtgtgctttgaggagttttcgtgtttttcacacaaagttttattgagaaacagagttatgtgacaaaagtggatgggagatatatattttatattctggtttgattcatttatagtgctgctgaaatagagaaaatgatgtggaatttttacacatacagaacatattttcctaccaaggatctgaaacaacattcaataaaaaggcataataattaagtcactaaaagataaaagaaaaagggtaatttttgaagaaagccagttatatgtgaaaaatctatgctaataaatttgcagttgagtataaaattcagctttaaatttactgcaacttaatctaaaaatgtatccatcatatcttaataagaagaaatgtagtgtaccaaagacttaatatcgaaatgtttaaaggagtttattgttttcattattcatttgatcttcacataaaacggggaacaaaataatgagcaaagagaagtatcttagtatttaaatgacctcatcatttgtgaacataaacactgaggtctcttatttccataagtagtgttatagtctattatttattttgaagaatatatgactattatttaaaatgaaaaatttaactcgtttggccttcattactcatgtccatgcatttccctcaatttttaacaatcttatattctatggtggagcttagtcccatgtttaggatcattgaattttataccgcagatccacagaaggcttattttactcacataagggttatttatgaactctctcatttgttcatttccattaagatacaaagtgagttacaacaaacaaactggcgagtgcagactgg

SEQ ID NO: 41403 - DNA, 1779 bp, Bovine  19866880621715
atgcttttgaatggtggtgttggagaagactcttgagagtcccttggactgcaaggagatccaaccagtccattctgaaggagatcagccctgggatttctttggaaggaatgatgctaaagctgaaactccagtactttggccacctcatgcaaagagttgactcattggaaaagactctgatgctgggagggattgggggcaggaggagaaggggacgacagaggatgagatggctggatggcatcatcgactcgatggacgtgagtttgggtgaattctgggagttggtgatagacagggaggcctggcgtgctgcagttcatggggtcacaaagagtcagacatgactgagcgactgaactgaactgagacatttttagttgtcacagctgggatggaggaaagaactaccagcatgtaatgtgtacaggtcagagacgctgctgaacatcctaggatgtacaggatagccccccataagagaattatctgactcaaaatgctaatggtgtccaggctgagaaactatagactacagaaatatttagggagcaacatggacttcactttagatattaactttaagttcaatgccagatttattcaaataaaatgacatgaccaccagaaaagcaacataactgctttagagatcacaaaattgaaataaacaggtgcaaatcaaagcagtctttaaatatttatgtatatttactaaagtgtttagaagggatgagagctgtaaactacattcccagcttgacagaaatacacagtgactaaatctagcattgtctgcaaaagaggtatgcacttcacttcggtaatagtcagcaggatctaaatttaggttatactcttagcgtattaaaatagcatcaagagctcaggaagtctaaaaccatcacactccaagtttctgtctatacggttaatagctacttgccagagatccctgttgcctgtttgattacagtctattaaaaacatattctttgcaaacttctcccataaaccaggaaatggagttaaaagactgattctacataaaataattagaacacaaatatcatgatgtaaagcattcatagagaatataccttaacttccatagttttgtgagaaactttatgaggcttttatactggttaccatgaaagtaaaaatgctttctttcagagttccagtgtcacaatggtaaatgagtgaagcaaacgaacatttttagttgaacagaagatctataatattaactgcctgtaatctgacttggataaaagttgaactggggaaaggctgagacaagcctactattaagtgattaagattgtgtcttggtaccttaatttatctgtttactctctcttctattgaaacaaacaaaaaccagatggactaactcaaggatatttctttttttttcactccactttagaggcccttctaaaatgtagtttgctatttttaaaaaattgcttcattttctgaaattgtagctcaaaatatattccttgtagtaaagcactctcaactgttgcaatctagaatcacctaagcagatgcataccaggagaagaacaaacctagaaagtgttcagaattaatgtcctacagcaaggatgatgaaggctttttttcttctaaggggctatgactcaagaataaaaagaaatcagctgtttcacaaagtaaaattaaataatgctagatttctctgttaagcaacgtatatataatgccccctacttgtggcaggttcttttcctgtgttagata

SEQ ID NO: 41404 - DNA, 1808 bp, Bovine  19866880624407
caccaggctctaggccatctgtgctacagaagaggtcagccagatgccctgcctttctccattgctcagacttcattttatcgagcatggtgtgggtcagaactcttctcgaattatttttataattttgcatgtgctaagagtttgagacttcccctaatttcctgagcattttgtaacatcctttgtcaaaattgtaggtaacagaaacagcaagagtacctgcacctgttgaaatccctgttactccaccaactttagtctcggtgagtaaagttgatagtgttggatcacatgcatatctagtcaaataatgttcatatatgcaaagatcagcttctcaaacttgaaaattccatgagtgtgtctgcaagtatgtaagaccatatactattaggcaaggagagggggaattctgtgtgacagcctcagtcacatagccagcagattcgatgagtttctgttatgtgtaaggcatgattgcaagactagtctagccctctttgaaatctgtcttactatctgaaaaaatgtacgtaaataagcataataaaatataaaatgtgataagcacttcagtagagggagggtgcaaaggaaagtttgattacttctagttgaggataacatggaaagcttcgctgaagagacaacattcgctgctgagacttcaagctttgttaggatttgaatatgtgcaaacaacggagggtacagggatgccctcttatatgacatcagtacagttccaccttatgaagttggaaacaccttacatttatttcaaattgggagtattccaatttccaaaggagtttctttacggatagttccacagtcttgatgttaagaaagcattttatgacagttagaatgtacaaggtcaaacctccacgtttggtacaacatatagagatgattcatgcatctgcacacgtatcaatacttcctgtttcttctttctttagggcttgaagaacgtgactgttattgaaggtgaatctgtcaccttagagtgccacatctctggatacccatcccccaaagtgacatggtacagggaagactaccagatagaaagttccattgatttccagataaccttccagagtggaattgctcgccttctgattcgtgaagcctttgcagaagacagcgggcggttcacttgcactgctgtgaatgaggctgggaccgtcagcacatcctgctatctagctgtgcaaggtcagtggtcacacccccacggaccttccacacactcctcactgccacctggcacttctttctacacacctggtaatggagcccccttttagaattgagggtcaacttaactgtcatgctaaggagaggtcagtagtgaagcgaactaaatacctgactttaaccaaagaaccgtctgtcttcttctagtgtcagaagaatttgaaaaggaaacaacagctgtggctgagaaaattaccacagaagagaaacggtaacaccttcttttgctaatgatttttcactgtagcacagttttgcttggttagtccctttcatgttggcaaatggcagtccggaagctcacatgaagggcattctctttccagcttcgtcgaatcaagagatgtggtaatgaccgatactagcatcacagaggaacatgcagggccgggagaacctgccgctcctttctttattacaaaaccagtggtccagaaactggtggaaggtgggagcattgtatttgaatgccaggttgggggcaacccgaagccccatgtctactggaaaaagtcccggtgttcctctaacctcaagat

SEQ ID NO: 41405 - DNA, 1139 bp, Bovine  19866880626877
taacatagctctgattactacctgtccgctatttttgtttaacttattttggagcttcctcaccagttttgagttgcgaagcaaatgtatacaaacagaaaaagagcttcctaaattgcacatttttgcacctctcgtgcactctgcaagaagacaataaatctatgtatttctatgtcattatcttcatttttaacctgttttcatttgtaatgatgctacataattttgtggctccctaatgcaataatgtacagaagataaaaaaaaatttataattgaacaatctgtctttctgttcactgaatctgttgcaggttatgctcccatgcccccgtttctaagctgatatcaacaagactggaatgtttgtgatatcaggggcaagaggtataagacagcaaaataaaatgaactcttttagagcatctatatctgcaatctgtaaatggtaaaatgtctgtgtatttttttaaatgtaccttttcaataaaagtacaaaaaataaaatctgtttattttcaaagttattttctcctgagacacctccaatttgaactcatctgatgaaggattttcagtaggtgtaaagattgcttctaacgtatttagcattttcacttcttattttcagcatatttatttgtcatgtttattcattactgttcacagcatctgcacgaagtgagactttactgctgttttccctctgaatctctaagaagttggaccagagttgtaagtgtgacccaaaatcacagtagcagcctgccaaaaatgttgacatagtttttaaacattccctgagtcttctaaatcccaaactcatcttttattcaagtccaacacaataatgatctccttttagaggaactgattccactctcccctttgaccttctctaatcagccaacccctcttttcttccacttcattccgtttttaagtgtaaagagcaatacatcctggttttttctggttatctgcttaatgagctgctctaatacatagtagcttaagataaaaccattttatcgtatcacagtctcgggggccagtaattctatcaaggctcggctgggctgttctgttcctgagtcctcaataaaagatccctgggtagtatttggctggtagat

SEQ ID NO: 41406 - DNA, 2108 bp, Bovine  19866880676045
tcgatgaatgatactggatgcttggggctggtgcactgggacgacccatagggatggtatggggagggaggagggaggagggttcatgatggggaacacgtgtatacctgtggtggatgcatgctgatacatggcaaaaccaatacaatattgtaaagttaaaaaataaaataaaatattaaaaaaaagaaacaaaactaatcaatcataaaaccctttataatctaagtactttattacatgcacctaagtcctttatctgtggtgtcacggactccagtctggaccatcatcttagcgctccacactgggttcagattatcagtgttgccaactatcatttccccctatgaaggtcggttggtgcctcaaaagggcatattttatctctataggcccaggccctagatcggggcccaatcacagaagtgctcaatagtttattagtccaacagaattaaactatgctgctctgactgtgaaccctgatccagcaagagatggtaaatcagagtcaattagtcactgtgtggccctttacatggttaagtatttcatgaaagttcatttattaatttactttgagtcacttatgtttccccattaattttcatttggttcacatacccaaaaaagaaacaagcaaactgtgagattttagtcatttaatggatgactgcagcccaccaggctcctctgtccatgggattctccaggcaagaatactggagtgggttgccatttcctactccaggggatcttcctgatctagggatcaaaccctcatttcttatgtctcctgcactggcaggctggttctttaccattagtgccacctgggaagcccaatgtatggaaacatatgatgtttatgaaaaaaattagaaattttctcagatagttaatataaaaccatggtcaagactaatttgtgcatgctaagtcgctttagtcatgtctgactctgcaatcccatggactgtagccctctaggctcctctgtccatggacttctccaggcaagaatactagggtgggttgccatttccatgactgattcagactaaaggaatgtccaagtgaaaccagtactatcaagagaagtttgcatgcatgctcggtcatgtccaactcattgcaactccacagactgtagcccaccaggctcctctgtccatgggactctccaaagcaagaacatcggagtaggttgccatttcctactccagaggatcttcctgacccaggaatcgaacccacgtcttttgtgtctcctgcattggcaggcagattctttttcactgagcctgggaagcagtactaccaaatctttgattatattaaattagaaactttcacaactatacagaacttccagttaaagcactgttcctaaaaggacatttactgaatatgcttttaaatgtctaatttatcacgagttatttgcatacatgtatcaaaatccttgaaagcaacttttcatcacacagattaatactgtcatctgaagacttatttttgctattaaattacttggcaaataggtttcttgataggtagcctaatgtttatgctaggctaagccagtgacattcataatgtcttaattagtaaaggctgaattaatgagacttcattattatagcaatattttaagtataacatgataggaagtgcaagcatttctaaagaacaatctttactaacacaaaaggtattgttttttaatgcagaatgcatctatctaaatttttatttatgcacagcatgttaactctgaaataataagacttttagcttcacttgttttgaacagtagattttaaaagtgtgtccctgactttatgatcaaaaaatatatatttcttctgttatagaacaattccaacatctgtactttgagttatacttaagtgtacttttacatttcattacacactaaatcatcaaaataaacactgaggattatgaatttctaactcttaaataactgttttggtatgttgtttctttataaatcactgttttcattttaaagataatcaatcatagaatcatatagtaacagaaccaggagagattctgttacaaatttaggaagggtt

SEQ ID NO: 41407 - DNA, 986 bp, Bovine  19866880686932
attgcccttgatgtgctgtgggggcgggggctagacttgagggtttccacccgggaattccttcctagcacttctcaggaaacacgatttatgactccagaaccctgggagaatcagttgagggaacgagaagaagtagtaaagtatccgtgaatactgaagcttaaaagcataaagctgttactggtttgaaggaacccatctccgtcagataaaaactagagcaagaaacggttgcttatagagttgagtgtacagttacctagccagaacaggagtatagaagaggagtggtttccatctcgttttgcctgggattgtctagccctgtccactgcaaaccctgagctactcctgcaaataagataaatgtgtacacgtagtatgctttatacaaatcctgtgagtggtgttctaagaaataagctttggaagcaaaataaattcttaatttggcaattctgatactcgtctgtactcttaaccttgttaggctatttgaatgttaacatttgaatactatccagtacgttctctggtgttttccaaggtttaaatattccctagagactgaagttctttgtaaacactattaagtttaataatcctatttgttaaacagatttttttttcagatttctgtaataacaggaaaagtatgaagaatgtttgacatattttaagagtaagttatgatttagggaatttgtgagaattctaatttcttgctccaaaatgctaaaggcacacagaagtgtgttgcgagtttgtaagcactcacataaaccacgcagaaacgggcaccctccagcctggggcgaacccgcgacctcagaggggtctccagggcccttcatgtgcagcctgggcgagagcccgagtctctgggtgcctggggccgcccacctgtccctccactccactgatctccgagactcagccccccgcccggcctcaagcgcgggtgttcccagggcagtcaaagg

SEQ ID NO: 41408 - DNA, 1909 bp, Bovine  19866880756269
aattgaagaatagagtggttactttctcagcttatacagtaattcaggtcgaatcctaacaaatcctatttcttaaccccaaagacttgacttctagatcccatttcatcatttgaatgccacagcgttcaagttataattagttcaatcgggacttatccataccaagtttacccatactatggaattctctatggccaagtggtgcttaggtgtagaattccttctcccttctcaaagcatcaggaaaataatttccaactccaaatctaaggactcagtttgaaagatgatggaaatttttaccttagcaaaaatagaagctggaatttagaaagtggacgtttaaatcatgattcttgaaatgaattatttaccatattattaataagcaacaaatggttaaataatgcatgagcttcccaggtggcacagtgataaataatccacctgccaatgtaggaggcaaaagagacgtgggttcgatccctgggttgggaagataccctggagtaggaaacagcaacccactacagtattcttgcctggaaaatccctggacagaggagcctggctgtagggtcacaaagattcagacaccactgagcacaggcatgtggtaggccccagcttctaagatgaaataatatagtgagtaaatccatttaaattaaagaaagaaactcgagacttgtaaatggtatttttctttctgatttatattgtcgagcctccaaattctataaaactcttactactttaccctattttggggcatagcactcataaataatcctagttacaataaagcactggatttaagacattattataatttttaaatcccttaaaatatttttttctagtctgaaagttttgttttcactattacagttatattttcattttacatcatcaatttatctctgaagcatttgagctttccttctgaaaattcacttcattgtgccttgagtgggccagggttttttgattgtggttgtctacatccttaatgaagccatgctgccaacagccgggaggagtctgaggctttttacacaactttctaactaacatctttgcttgccacagttcatggatgctcacagaagactcgtgacttctgaatcagttttgaaagacttcactactcaaagccaaagcagtaaccagagtgtcagaggtcacatcagttccccaaatccctgtttctcctccagaggcaatgcagatggggccctctgaatgagggcatcactgcagggaagaatcctaaacttggggaattagctgttttgtaacaaacagtaagcaaccctgctctttgtctcaggggaggacatttcctcaaccctggaggttgcaaatccagcactgagaatagcccaggtaaagaggggccagagtcagagtaagtatccatcttacttacacacagtaagatggatagaagcagtgggggatttgcccctcatatgcaaatctgggtattggcactgtgaaaaaaacaggacatcagggcttaaaaaaaaaaaaagaagaagaagaagaagaaacttgggtggctcagctggtaaagaatccagctgcaatgcgggagacctgggttatccccctggggttgggaagatcccctggagaagggaacagctacccactctagtattctggccatggactgtttagtccttggggttgcaaagagtcaggactgagcaactttgactttcacttttcactttacctcgagaaccagtttcatgcttgataagtgaaatcattttttagcaagcaacctcttgttccaagtttgttaaagctaagccaatattctttaacttctgtgtcaactaccagtgtgaaaaaatgttagtgccataggtagtatatcaattagtgaatgtga

SEQ ID NO: 41409 - DNA, 1474 bp, Bovine  19866880758877
cttgattcttaattcttttgttgccctaacaaagttagggtaaaagtaacttaaggtagggtatatgtaagcaacaaaaggtagggtataagcaactaaagggaagaaaaaaatttttataattgaagtgtcagtagaacttcatagatattggcctctcaacagaaaataccactgaacacgtacatacaacagaaaatagagatgtattgaaatgctttgaaaatagcctctgaatttagtcaaatcacaggcctacatcttgctaaagttttaggctatgaacaaacagtgatttcttctttaatagaactaacaatgttagtcccttcattttactctattgacttgcaccattataacatttatttatctataacactaattttagatgggcttgtcagcagcagactagctagttaaatatgttataggaaataagcattttttaaaaatctatctttgagaaagacaaagatacgtatgacatcacgtgtggaatctaaaatgtacaataaagtagtgaatttaacaaaaaagaagcagtctcacatatatagagaactagtggttaccagtggggagagggaggcggggaggggcaatatagaggtagggtattaagaggtacaaacatttaggtataaaataagctacaaggatatattgcacaatttaaggaatatagccaatattttataataactataaatggagtataacctttaaaaattgtgaatcgctgtatcatacaactgtcatttacataataccatacatcaactatacctctattaaaaaaagaaactgttttcataaaaatatgaaacccaggttaattgttaatggcctgaattccagctgggaagactcttaaaatcaagagaactggagtttccagaacaggcagaggaaacgaacgatgctcacgatgcccaggtcctcctgagacgctctcgggcaaagcaggcgcatgtagaccatctgcatgacctggctctctccttgggggtggatgtcatctcatcagtgcagcagcctgtaagcaacttagacactgttattttcacatgatatggctgggagttgggctgtaatatgaaagaaaccgggcagaccacctggtatacgttcaattaaaaactacagtaagccattgggatacttatttgtggtaagtttctaccacgtctaaaaaatgttttaaggagaaaaaaaaatctgattttaaaagtcttgtttaatacatctattctcatgctcatgtaaaagttatagaattgctatctataatggcagttggtttttcacatttgaaataaagaggaactaaacttttaattttatttattttaaattgataccccaaattgtaaaccttttaagtatatacggagtgacttggctatgtgaatctactaaagtctatgagatttaagtacagaacaagtttttctaaacaaatttagcaata

SEQ ID NO: 41410 - DNA, 1642 bp, Bovine  19866880785671
aagtagagagaatttgcattataattcattgtctgctagaggacttgcagagtcatttaaaatatgaacctgcctttctcagctggtttgtaaagagctattgattatattcttgaaagatagtaatgtctttctttttataggagttgccattttatttgatagattcagtgatattgatttggcatttctgcaagccttgtgccagggatatgcaaaagaaaaatgatgttggaacatcacaaataaattgtgattcagtaatagtatagaaggttttagagattatctcttaaggcttcagatatcatttttattctatttggtaggagtgggaattcctatgtttagattagagaatttttcagagtgggcttgaattgcgcttggtaaatctcactgttactgaatgcttgctattttgcagaatacgaagcattgtgggctgtgtaagagttaccgaacatggttcttgtcttcaaagagtttatatttagtcagggaggcagtgaaggaggaaaccaagcaaaaggacacagagttcttaaagcttgtatctgctccttgtaaaatcagttacgctgcagtgagctttggtgagatgtcatagattctaatggatactgtaagaaacaccccagcccttgaaaactgatagttgtatatcgtgttctttctctgtatagttttctctttgctttgcaaaaattactgtttgatcttagtaccaagaatagttccccttctgagtgcttttctgtttatctcctgaactgtggactggattgtcccttaggtgatggctgttagaaagccagaccagatttgtagcctaccccagagcagccttatagattttatgctgtatattttttcaacttttttcctggcatcatttttggtattttccttattcttttctattattttatatctatgaatttttttatagttcatgtattcctgtaagtttcattaatcctttcagaacaaagtaggagtaaatgtaataaatatatgtgaaattcatggaggaacttatcaaggcaaacaaatcaatatgacaaataggttttatttcacgggcctgctgagattgataacgatggctgcctggagccctgcattgagaagtatcagtagctggggtctgtttctgttttgagaataagtgcatttgtgtcatttctttctggattcctcacatcagtgatatttctctttctctgacttcactcagtataacaatctctgggtccatcagtgttgctgcagatggcattatttcattgtttttaatggctgagtaatagcccattgtgtatgtgtaccacatattctttatccagtcatctgttgatggtcatttaggttgattccatgtcctgattactgtaaagtgaaagtgaaagttgctcagttgtgtccgactcttttcgaccccatggactatagcctaccaggttcctccatccatgggattttccaggcaagagtactggagtggggtgccatttccttctccaggattactgtaaacagtgctgcatgaacattggggtgcatgtatcctttcagatgatgtttttctttggatatatacctagggattgcagaactatatggtagctctatttttagt

SEQ ID NO: 41411 - DNA, 2311 bp, Bovine  19866880787482
catgaaattaaaaaaaaaatcctttgctttgctcatctctgattaaaaagtctgaaatatgtactaactaaaaagcagcaagagttagcacttgccactttttataatgaaagtcaggcagaaatgaaaagtaaaacctattagtgcaattaactggtaggcaataaaaatgaaaaattgggttgtggctgttgccaggaattgaggagataactggagggtatgtatggacaaattaaccattttattacagtacttataaaaggaattcatgaagctagtcttatcacaccatctattatattttcaatatcaaaataagaataaacaggcatctttgggggtattcacaaagtttatggaactacaaatctgtatttgtatgagttcttttttaaaagatcattactttcactgattattccaaaaagtaatttatatccacacagtgtaagcaatcatataaaaacacatgcagttgcaaataaaacctagccaaggggaaaaaaacacaccacagcacttcactaaaggcaggatgaagtctaggggagggcaaagaagccagggtagggaagacatgaacaaataacttagtactagatgacatttacattcgagataattttcctaggtggaattttaggcaaataaaataaaattacaaacctttcacctatctcaataattttcaaggggatgaagttcaaattgtatgaacttacaatgagtcttacaatgacttcactggccatcacatggggctgggtagggaagcaaaccaagcactacttaaatagcaaaaaagactgctcaagaattataccagggtttctcatatgtggctgggtatccatactattcttgaagatgaggacatttcatcttaaacgtagctaactgctttaacctatgttctatgaagcatttggtaaccatttatacagtctagcaggcaatactagctttcctactaaacaggagcagaaatcaggtttttgactttaaaaagttaaagatcagtcattcaacaaacattctggaggtctaatatgttccagatgttgtcccaaattagatggggtaggatgagtcaaacccaagaaaggacattgtaaaaatgaaaaagggtgatgattaagcaaatcaacaaggcaagagaaggcccatgaaggtctgtcccctcttgctccaccctgactttgaactttttcccccttttctgattttctcacactttaagcatccaggatcctccctttaacagtgacataaatgtgtttatactcctgctctatttgccttttaatttttttctctaagctgttatcctggagaagggaatggcagcccacttcaatattcttgcctggagaatcccatggatagaggagcctggcgggcttcagtccatgaggtcacaaagagtcggacacgactgcatgactaatactttaagctgtaataataataataaacatcttaataagagcaggttagatttacagaactcttagcatgtgccaggaactctactgagggattatctcgtgcagtcaccaccatcatgtgagacagatatcactgttaccctccttttacaaatgaggaatctgaagctttgagaagcttaataactggtcgcccttgagtttgtaggtttgaagtcaggattcaaactcaggcaggagtctctccccctactcttccccgctaacggaccaccaagcagggttatggatatcgtgtgtagcactgctctaggaggtaagatttgtgaagaaaggaggagtgtttctagaattccctgcagcccagacaagctacacagaaggcctgcttggtgttcaagtaagtttcctggagaagtgagtctcagtcttcttctttctgaccaatatatgcctttctaaggacgagcccatttcttcttgggctacttcaggaaatccataaatgaaaattggggctgccctgttctctttccccattgtaactgttgggcttgcatacagaaaaaaaaaaaataaagttccagaaatacttagagattacacagagcaggtgatggccatcctttgcacctgtccttgatttactacaaagcagacctcagctactaaatccttgtgagttacagctttccagaagtttggcaaaggatcagttttttaatcgcaatattgtcaaattacaggagcacaaaaagaatgactatttttcatcctttccttttccattattggatttatggaaaagaatgagacaatagggtctcattagaacttcaaatattcaggaactgacactt

SEQ ID NO: 41412 - DNA, 786 bp, Bovine  19866880792695
ccccctgattattataaaacaattagagtcaaaacttaatttttcaaacagttgtctgttagacttctcctcccccatacataattaaacataattaaacataataaaataattaaattttatttccttccaaacgattcacatgcagccatatttaaaaaataaaatggcagtctggtagctgtttcatgttttcctgaaaatgacctttccttaggttcagtagaactagcccaaagatattctatttcatcgtctcttccttactcttcccacctctcatttttaagagcctactttcccttcaagtaaatgaggagtaacatttacctgatcattcctagacaacttctttcattcatatttgccattcttttgctttcccaaactgctcggaagccctagtctaactccctctattccatcctctgtgtttaatcacaggtttcatatgagtcctcccagagctgcctgaactcttccttgttactcccatgtttgcagcccacctgcacttaagataatgtttattatggactttaagttgtagatatgattcttctaccactgtatgaagtagatgattcataaatatctgaacattctaacaatcctatttggtgcccccaaacactaggtccttggtgtttcaaattcacttccagatttcttgtccactttagtatgaaaactaacaggactctgtgacatacacaaagcttaacaaaataatattactactagattgaacaaaagctggtgattagcagtgccataaagaaaaaa

SEQ ID NO: 41413 - DNA, 2014 bp, Bovine  19866880802051
ctgatatgtttacaaaataaacaattaatatttaaattttttgacagtggatgtgttaaaatgtgtgtgtttgatattagtgggaaagcacaaatgaggacaattttatgaggttaagatatgaagagatagtagaacaacaatgtgaacgccctaaaatcacttatatgtactcctaaaagggttaagatggtaaactttatgttatgtgtcattcactacagttaaaaatataatttttatttgtaataacaataaataaaataaagtaaaaagaaaggaaaaatatgtacagtcactaacatgtatccatcagaaaaaaaaaattttatattcttttttccccatgactgtaccataacatatattatagacttcagtctggacaaaggaagagggactctgtcatcaacctgataaccactgagttatgcccacttgtttaaatgggaaaaaaaatcaacatctatttgaaaactgtgataaatgaagaaaagctgaggcttaaccttttaattctaagtgatgacatttaaagtttaccttggattaagaagtttgaggctgataaatgataagtgcaattttatttctgtttgccttagaatgtatgtactttcactgaagatgatttataaggccaaaagaatgttcatggtgaaatggggatcagtttctttctgacatatgatctcctttgacaaacttgctggcccttctctcttttggtcccactggaaatccatttaaatcctgaacctttcccagctcaaattcaggactattgcagatacaagttgaaggcagcaagcatgaattaccttcagcaaccagattttcagaaaaaaatctagccatgtctaattttcttacctgcgcattctaatatgaaaagttaacttcccatctaatacccatataacttgttcatacatttttttttaaaaaaaaaaactgaatgccatggttgcttcgctatggtatcattgttcatgcatgcagctgttttaaactttagttagctgatcaacaatggggaatggtggagatggccaagacaactgctcaaccagagcacagaaagaaggaaaaccacccaaaccttggggcaaggataagtttaccctattcaaaatctttaaatgttgttataatttgtattgataaaatttatgaaagtcttaagaaaatcaggagaaagatcctttttcaaatgcacagtgtgattttcctatctttccacttgtccagctcctccatagttgctatagaatatagctgtaattaggaaaaaaatcattaagacttaaaactgcagttcttttgaaactaacataatgagcatcttcaccaaatttcccagggagcagaaaacttctctcagggttagacataaacaaaacttcttagggaagaagcaaaagggaacaaaatggggaacaaagaagctggcttgctattttagtcttgacgaagctggctgaggctactttggcacaaggatgcattatttgtgagtctgttgttggcaaggccactttatgtgccggacatgggacattttaaaactaagacaatgtctttaaaacaaaaacctttcattagaacgatggcacatgactagccagaagcaaaaatacaaaacaagtagttcatttctcttaatgtccatttcatgagctttattttttgcccatcatttttgcctactccagaaaaaaaaaaaagttttctgatgctcattttcagtaacagaaagaaggctctaatgttataacaccccagggatgcttcatttgaaatgaagtggccccaaactcctaatttaacccgagtgactagctacaactattaatggtaactttaactttagttctggagagatttcaggaccagactttcttggcctcctcctgttcagcaaccacatgactgtcttcctgcgcttacgaccagtcttgcagaagcagaaagtggggcagcctggaaagaggagacaaggctccattttaca

SEQ ID NO: 41414 - DNA, 1571 bp, Bovine  19866880861713
tctttgctttgttcccctaccgcccctttctctcatgggcctggccccagatctgtttagctggggttggagagagcgagccccatgggttttgtgttagatgcttcagacaagccgtcaacttttatcctcatgacacccttgcggtccatactgcaaatccacagtctcttacccaaaagccaggtgtgcttcagaattctgattcatttcacattatggaaaggtagcgctgcacaatatacattttataatagtaagcccccagtggacccggggagcaccttgccatcaaacaacataaaccctttctgccgggaagtgtaagaatattcgcactacatagaaaaacacgtaacctcaggtcgctttaggtcaggtcttgctgccaagtgaattatgaaacgcttctggtttgccgagtgcggagtctggaatgtggacaaaggagtgtggacctctgaaatccttgctttttggaggaggcaactgaggttcccagagtcaaactctactcagagagggcggatctgggtgaggacacaacttggtccagctccaaagcccatgctcttttcacggcacattctgggctcctctgctggtctgctgcctgatacaaaaagggataaagggcagacgttgctgattctcagctgccccagcaatcagtcagttcagttgcttcttcgtgtctgactctttgcaaccccatgggactgcagcacgccaggctaccctgtccatcacaaactcccaaagcttgctcaaactcatgtccatcaagtcagtgatgccatcatatatacacacatggcatatataatttctgaaagtcagctaggagacccagaattttgggattagactaaattttttcatgtgcagaaccaaaaaatagatatttcctttagaatatgtgttgaaatgaacatgtaaaatagaccaaagaggacacgtagattaatatacctatttgggaagtcacttctgtaaaaatttgagtaattttattcacaagagaattccctttaataaaaagagctagaaaggagcagcggggggaggcggggaagccacatttatttagtggttgtgacattttccaccgtagagtcaagggaaaattggagggagcagagctgaccacctacccctcctacgctagatggttccagcctggagaagtagaagacttggaggatggtgacaaggctgtgtggaggcttaggggttggggctcgagagtaggagagattatctggggaaagtctgcagtgcgtgtggaaactactgggagggaagcaaaggtgagagagaattggtgtttattgtgcataaaggatgcactacctgtacattttatataactttgaaaaaattttcagcgtttaataattctaaaaatgtaaggattctatggattccctggtggttcagcagtaaagaatccacttgccaatgcagaagacacaggagacatgagttaagtccctgggtcagggagatccccggagagtccaatattcttgccggaaaatcccaggacagaggagccggggactacggtc

SEQ ID NO: 41415 - DNA, 2001 bp, Bovine  19866880870581
ctcatgcagttaaaaagcagcaaaactggcatttaaacctaacgctgcatccaaggcctaagtgccgttacttctcacgctcttgcttaacacagtgacctatattatggtatgagtaaggagggccttcagcatctctcaaatagaactgctcattttttttagatgtaatgacagtaaatttatgtctattaaaaacagtgccttatcttttattgatgacactttaacatttacaaacacagtatgtctgggatctgcatcaatgatggggagggggatatgcatggagtaggactggtcatattgacaactgttgacagtcaacagataacgggtaaacagtggttcattttactactctctctgctcttgcatctttgaaaatgtccaagatacaattaagaaaactaagtctttaaacataccaatactgtaaaagaggaagatacaatctttaacaactttttttacattcagcaatattttccttatttcaaagtcaagagacaggaaacaggctacccataattttaaaaatttttcacatattcaccatcatatcctaaagttcttcatgtagaaagatctgagtatttggtctccagctaagactgctgaggaggaagagaccaattctgacacatgcaataaccagaagataaaaagacgacggcaggcaggcagaatgcctactttcaccactgcgttggaactgcagacttaattcctgtccctatacatttgtctcactttgtgactggaggcattttttcagaagtctccctctcactgtatcatactcttttataagtaattaaaattattaagaaaagcaaaatttatgtccacaataggcatttgctgtgatggatgaacagaatggctggtcagaagacaggaagagctcttggtggagactcaattaactaccatattgtttgactcagaaaagaacgagagtccaaaggttttgcgtataacatattaacacataagagcatatttcaaatttaataacaacttgttttacctatacagtcaatagagccaaaaaaacttacttctaaaatctaaagtaggtattagctagctcagccgtttgaatgtgtctacttgtttgcccaggacaaagcctggcacatgaccaacgcacaataaatattcgttgaataaactcccttcttacagtcctgccagctttctcatttaggtgtcactgggcaaaataattaggaaggaggagaagcagcaagggaaaaacaagcttaataattttacctgacaaagcattatgaacagagcatgcatttgctctgtagagaatattaaattacatagttcagggacctttactgaaatatcttggggcctggcccatcgggatcatgaatgaagagagacattttataaagccttctttatgctgagccaactcttaattttggcttttagaaatggcttgtttaactttactacatttatagtccaagtgagttttcattatctattttcaacacttgggaaaagttactatttaacatgaacactttttcattttcggaagttgcatctccactttaatcacagcattcatcatcagcccctcctccaccttaccttctccctttaacatctataaaatactttgcagttcctagttctttcttgctatatttaaatggctcctgacttggcacccacatctcacctggcagatcatctgatctgtagaacccacaaaaccaccacagaagaaacttcagactcctctggatagccaaagaagaagcttttgacagcaagtatttctaataattgaaacaatatcatgtctgccatcaacgaatactatattctggaaggaagatgatggcaacagcaattagaaagaatactattttttctgttgggacacacaacatacaaaattaatttttttaaagtgagaagctatatcaattatttactttacagaaaaaagatgtaagtttaaaaggg

SEQ ID NO: 41416 - DNA, 661 bp, Bovine  19866880870858
aataataaaatattcatttcatgtataaaattcttggttattatctaggatggccatttttaagcctttatgaaactagataacaggtatggaataaaaaattttctgacttctaacataagttgtacataaagtttctaaatctatgtatgacaacagttttatattgctgattctgtttttttaaaagctctggcattatgtaaaaaaaagaatctgatgtagaaatgtaattttgccttgtatctaagtgagttgaagaatcttctttcaaactcacattcaccatttgaatttatgacatagttatgacagatgtgcataattctgagttacttgaaatgttgtattaattgaaatacatccattacgaatgtttcttgggatcagttgctacaaggtcccttagaatcaacagagccatcaatattgttatactaaaatgtcaaaatcaaaagaaaaaagttttaaaatatcttttctcccaaatatgctattaggacaatttgctttttcattatctatttctccatttaaagctgtgaactgctatatctgttatgatgacaagatccaaggagtcaataagaaacagattgctgggcaggatcaaaaggattcccatttttaccactttcttttttacctacaattctcatca

SEQ ID NO: 41417 - DNA, 1073 bp, Bovine  19866880965307
ctgaaaatcattaaattgtgcactctaagtgtgtgaattttatcttcacatgcctgtcatattttgtttaaaaagggcatatcagagcctgtctcccagagagccacctgcaccagcagttactgatctacagtatgtagagactacagactaaagaaaaacatgtgttaatggtggaaaggagtgttttaagtctcctacagacaggttataccagctatataaagacaactaatagaattgttaaagggatagttactaaaataatacaaggcttattagaaataaaaggtgaaataaaaaatttggttccaactcctctgtgtccctccaaaaccttgccacatcatcaccctgtttggattctctaactctccagtgtctagactaaggacaaccttctaattgtgtttttagagaacaaattgtccaagtgataactttcttggaagtagaccataactatgagtccagggtttcttccttgggtgaaaaccctatgcctatctctgatctgcataaaacgctcccactggccagtcaataattatgaacaataaagagcatctggcttcaggaggctcctcccctcctctcacctacaatttttggccagttggaggcaagagttgaacaagaggatgatattctgccccacatgccagcagggtttgtgtactgtgtatctcagcagagtcttagcagccctggcctttaccatagggaagcatcgtgtatcactgtcttagacattgagcaagaagaccctttttaacagtattttctcctcctgtgccatttgctgactgccagcataactctgtggtggtttagttgctaagtcatgtccagtgacttagcatagctcttgcttgcaggttgcagctcagcggtcttctttttgtgctttaagttggggagggagatggatataagcaagaggttacattcatttttgttttgttcctggcaggcagtacatgccatactactacccttcctgctcttgtgcgcacacctaccctgatgatgcagccttcactggatatcaaaccgtttatgtcatttccagt

SEQ ID NO: 41418 - DNA, 864 bp, Bovine  19866880980735
cacagttgttaaaaagttcaaaattagctttcttaaatttgactttaacccctaaattttagatttttaaaaaagacccagctatatggcatatgatatagctaatgagtaatgaagagtaatatccattagtactgagaaaactgatatagtttacttttaagttttctttttttttttaagaactgaaccccatcatttagaggttgtttagttttgtttatatttctcctgatagctgctaccttgacaaaggttggcatatcaacttgacatttatccttgcaaaaaataaaaataaaaattatattttttatctgagtgctattgcttaaaatgtttacttctggtattgatagcccattaaaaacttgaagattgagaaaagactttaactcaaatatagtgataaggattaatttctggtatagatatactataagttgcatgtgtaaagtctgagaaatattaggaaaggatatgaattagtcattgtctcattttctttgtctatagaggatcaacacttactgggttaacatcaatatttgagggcaaaaccttgaaatattgactaaatctaaatccttgccgtaatatttgagacaaccccaaatcaaatataattatagaaattcagacacattgtcattactgagttgtcctgggaacttttatgatggctgactattttaaacaaatgattatctttgacagaggaaatataaatgagagcctcattcaagaatctcctttttcatgccataattggataccagacgatgttcagataggtcataccagatcaccagtaaagacaggaaaaggggaaagaaggaccaggaaagcgagagagagcagcag

SEQ ID NO: 41419 - DNA, 2277 bp, Bovine  19866880990107
aaaatggactaggaaatagaaaacaataaaccagtgtcacagacaatgaaagaatagtgtttgaaaaggaaaagatctatatatttagctataaaatagctataatactttgtatattaatatatgcaaaaaaggatgacgtattagaaaagatcagtatacttaacatagatcaagaaaaaacaacattctaatagaaaaacgatcaaagaatatgaatggataattcctaaaacaagaaaatacaaatttccagtaaatgtattaacttgtaattctggaaattcaaattaaacatagaggaaatgtttgactatacacttagaaaatttttcttaaatttaatgcaattctcagtgctaatggaaacatctactgagacagttatttggaaagcagtttgtcaatatgtatcaagcaactttgtaattgttaacaaatttgatactgcaatttctacttccaggaatttctaccaaggaaataattagagtgatataatgctaatgttattttacaacattatatcagatggcaaaacggaagttaatctcaatgttcatcagcgggtcaatattctcaatggtctccttcctccagttttacagccttccagttaagcctccttcttcctgctagggtgttctttctaaagttagtacacagtagtaaaaagaagaaaaaagaaggaggagaatccttcagcactttgttgaatgctggtaacagtccagactccttggaaagtttagagtcttctgtgattttgtattgcttttcattctggccttaatggtcaacttgtgttttctgtctcatgcaaactgacctgtttttagtaccctcaactcacttgaatgtttaatgctcatgtgtttagtctgccttgaatgatgcctgagtctgcacacagtcacctaatcaacacacactgtctttcaaaaactcaagtgtagcgtcttttcctgattccccttctcctacttccaacccccccccacccccaccagacagaagtgatcactcccttattagtgctttatttcattttgttgtgtgtcttctttgataagtaaactgtaaaccacttgacatcagagaattctctttttattttcgggacctagtttaacatttgtagattttaaaaaaagaagggaatgagttatcaaatactacatagagggaaaagaggaagaaaattcgttgaatatgataagcagtcattgttaactctgaaagaactgtttcagttgattagctgggaggcagcaagtagtgaatgaatagagaacaaataatcatttcaagtctagatgatttcattttttcccaagagatttattattgaatggaaggggaaagaaagagaataacttaaaaaaattatttgaattttgttttttataaataaatagaaacgtaagtacgtttgcaggcaaagaagaagaaactacagccaaatgaaagttctggcacatggcaacattagtctgatattaaaatatgagtatagtgagtgaccggagaaggcaatggcaccccactccagtactcttgcctggaaaatcccgtggatggaggagtctggtaggctgcagtccatagggtcgctaagagtcggacacgactgagcgactccactttcacttttcactttcatacattggagaaggaaatggcaacccactccagtgttcttgcctggagaatcccagggacgggggagcctggtgggctgccatctatggggtcacacagagttggacacaactgaggtgacttagtagtagtagtatagtgagtgactccatagtttgtgcattacatttattattggtaagtaggatgaggaactcttgttggctctgtcattttcccaacccttttcccagccgcccccaaaggaagaaatactaatcagatcagtctaacatttgatggtaccagtcaggttcagagtcagtgattatgaaccctgcaggttttatgtatcttcttgtctacttggtgctaggtatgtggaacaaacaagctttctcttcctttcttcctagcaatatcatatgactatttctatatctgttaaccttttatattttccatctgcttatcttctgtaaaatttcttcagatctgtcctttaaatttaccagtatttttattccactgtgcataatatgtgttttaactaatcaattgagactttcttaacggttgtatttttcaaaatttttattggaatatagctggattataatgttgtgttagtttctg

SEQ ID NO: 41420 - DNA, 1537 bp, Bovine  19866881056352
ggaaggtgtacccttctgccctgatgagctgtatccactcaagcaaaactactgcgataagggtttggggtgggtggggaggagcaagcaaaaaaccgtaatactacattccagggtctatacactgacaacatactggcatcaacagtttggggagtttaaagtgtactctgtactcaacctttctgagccctgaggccactgcttggtagattaaaaggtcaagggtaaaaagaaagtctcctgatttattgtgtgtgtgtgtgcatgtgtgtgcacacgcgtgtgtgtgcgtgtgtgtgtgtgtgttcccacctcgcctatctcatcccttgtaatgcagaactccaggctgcgggtcagggcccgctcatggtcctcggtctgggctcgccaggtcagacagtccccttcaagcatgtccagctgttgctgcaggttctttgcagaaacgttagagcagttctgaaaatgaaagagaagtgaaagtgatgaagggaatgggcaaaacggcaatgagaacaacatgctatttacctgcattgtgaaactcataaacgacaataaagaaaataagctcctgatttaccttaaacttctttgatttcagaaggaagccagacaccaatatccaatgtcgtgaaagacaaacttacatttttagtttcgaaacttgagttttgaagagttgctcatcatacccaatgcctcagagacaccattcaatgtaaggtataatttttacttcaaaaggcataaaatatgcattagaaacatttggcttctacactgtaattttcttgtcaacttgaggttagcctcaggttcattatgcaagtgctcccatctctactccgtgcaggggctcctgaagttaaagccagacgtgaattggagaacaatttatactatttgtgcaaagtgagacatcttccttgctcttttcttttaaaaataaatctactaatgaaacaaaactctttaaaagaaagctccttcttgggaaaaatagtctattaacagcaacagaaattttgtatttctttcagattaaaaaaatcctttagatttactgcattccatataatttgggagatcaaaccagtcaatcctaaaggaaatcaaccctgaatattcattggaaggactgatgctgaagctccaacacttttgccacctcatgcgaagagtcgactcattggaaaaaaccctgattctgggaaagactgaaggcaggaggagaagggggatgacagaggacaggatgactggatggcatcaccgactcaatgcccatgagtttgagcaaagtccaggagatcgtgaaggacagggaagcctggagtgtttgtagtccatggggtcacaaagaatcggacatgactaagtgaccgaacaacaataacgtagtttagtagatatcataaatgaactttaaaataaaattatccattatgatttttattaatgttatatgtattggatagaattaacacaatcttttcttccctcaaatcctcaaattaagaatttgaag

SEQ ID NO: 41421 - DNA, 1788 bp, Bovine  19866881066482
taaatatgaattgtttattttgtaaacatatcagctgaatattatcttttaaatatttttctgagttctaatggaggaatagttttcaaattttgaagttataattctttccactcctttataatattattgatttatcaattggaatattttatgtggtctctgtgcttgtaatttaaagctaatgctcaacacttttatttatcatataaataacactgatgaagtataggtatagcaaatgcaaaaattgaatcagtataataatttccatgtatgcaattagggctttattgattgttcttttcagaaagtggagaaggcaatagcaacccactccagtgttcttgcctggaaaatcccatggacggaggagcctggtgggctgccgtctatggggtcgcacagtcagacacaactgaagcgacttagcagcagcagcagttttcagaaagtgttaagtatcaaaattttgtctttataatatgcagaatttgaaataagaattgagaagatgagcattttctcgggcagatagtttttctgcattttaaacctaaaatccagcatgtgcacaacctttattccctcccaaataatttacttgctgtcactgaaaagaattttaatgttttcctgacttcttgccatagctcaaatttatcaaccatgacattgttcattcttggctgttaaatgctcccatataatctgagatgctttatattttctctgtacttctctttgctgacattatggagtgagtttcctgtcaatgtgtttatccttcttgaatctggagaagggcccagaaagcagtgtagttaattgaactagactgcttagaattttgcttcaccaatagagctgaactgtttgtttttaagagagtcatcatctatgccctgttttcagtgtacagccccgtactctgttcatgcacaagttagcgtcgccaccctaggcaacaactgtcactttacattccatttctgaaggctctctgaagttaatgatttatatctaagaagtaaatctcttctggaaactgtctgtgaaaaatagtttttaattggatttgaacaaatacagcccttttcctactgactctcatactgggtctccttttccacctcattaatgtcctcattgggctaaatattaacacaccactgacctctgcaacatgaacagctcctgggagacttaataagttttttcatgataactgtaagagcactggatatggaaggatctgagacaaatattagcacagagagactagaatgagttgtaaaatagtgtcaaataaatacaaataagaaaattagagttgttaaaaatctatcacatattaaaatcattcttgtttgaaggccaaaggatgttctataactgtaatcctaattataaattacaagacaaaaattactgagaacaatttataattacctacacttggggaatatgtttaaattcacattatatattcacttagcagacttgctttctatttaaaatcactctgaatacatttcaaaggttgtaaagattttgaagtacagacatcttgattcactgcaaatgaatatcaatgttctcattttaaggaaatcaccggtttctttttattgaactgtagctcaaagaatcattcaaagaaataaaaaagaaattcaacaatttgaagtttaattacactaagaaaaatgaaaaagctcgaaatctaaaagctctcaaatatcaaattcaacaagtggatatatatgctgaaaaactacaggtaat

SEQ ID NO: 41422 - DNA, 1006 bp, Bovine  19866881078594
ccccatctgtcccaacgtccttcattttcctgtgacctggacaaattaagcaacataccctaatactagacttagtgaacacaacgtctagagtccaggtctctggactactagctgctataagctaaaagtgtatgaatatctgcaataccatctgtatgtgtgtaaatagacgtggtacataattgaggcatgatacaagtttatttcttgaatatcaatagtgctttcaaagtattctgagtaatagaaaatgaaataaaatttcagattaaggaaaagtccctaattttagcaatcaatttactgtcaatcctaattaatataaactttgtaatagcaattaacagaggaggtcaagttaaaggcaaattgttttaaatgcttctggcaatatacaatacattccataatagagtacagtaaactggctatgaagtttttatagttctgtccaataaatttccttccgatcagtaccattaaatgtcagtacagtatacgctccaataggtgtcagaactctttggttgcaagtatgagagccaatctgaactggattggggtggaggcatgatggattttctggatatagcttaagggcacggacagaagaacagcatttctgaggacttctgagccagaaccagaaaccaaatcaaagtcaacatctttctcagagccccttctcccaatccagtttctttctggcctgtcttcagtctgtacagcttcaaactagtttgttttaggttacaaggagaagagctacgattgcactgagtgggcatccttctgatggattgttcatgtagaataatatcaggggggtgaaaatttggggtcatatgaatggtcaaacactgagcagtagaacaacctcctagagggtggaggcctgggtatcatcacaggcagctcccatcatgggaggaagtctccttcaaaaaaagatgaggcattaccagtaaaaggggagaatggggaaccaggctacaaaaaagaa

SEQ ID NO: 41423 - DNA, 1003 bp, Bovine  19866881109122
accctgatgctgggaaggattgaaggcaggaggagaaggggacgaaaaacagtgagatggttggatggcatcaccgactcagtggacatgagtttgagcaatctctgggagatggtgaaggacagggaagcctgatgtgctacagttgatgaggttgcagagtcggacacaactgagtgactgaacaacaacacatattttggctaaactctaacagttttttgtgaaggtattacaagaaaataatgttttacattgttaacacttttagaactttggagtttccaaatggtacaagtgaaaaagctaaaaagaaaggaatgggtgtttttaccatctccttctctttagtggtaaaccagttttaacactctggtggataatttttaaatggttctaggttgaaggaataaattttgagttcttttccagacagtagttattttgttaatgggagatgccctaaggcacctctgcaccttactgaagctgaatgtctaactctgacagtagacctttgtgtgcaatcatatggtcagtgcaaatgtaaaatgttccattttcctggctggctccacaggcctggtgattttccacactgccagggatcaagagagttgcagcaaagctgtagtcatgctgctgggtaatttaagaagcctcttcaaagagcatgtcaaaagttcagtttaacaaataagactttcaatttacatctgcaatgggtatgagatttaattgaaggtttactcatacctcattgcatggacacatacatgcccagcaatgcttcaggtgctgacgtttctattcaaacattagatgagtaaacttaagaactgaaattcaatggcgtatgtacccatattcagattaaaaatgcattttggaaagtctaattggctgatacgatgtattaaggaagcctggaccatgctcaattccaattcagctgctcctttcaatgtagggaaaaggcatttaggtaagatctaaattacgt

SEQ ID NO: 41424 - DNA, 791 bp, Bovine  19866881154324
cttttagggaattcccacagtgagaataaaaaatgtgacaaatgaaagaaacataataaacttaactggatatacggattcttttgaaaatttaaatgactaatgttttacaattcaattaaaattagtatacttaatatgatcatggtatgtaaacattgctcaactcagggtggaaaacagccataagctaatagtgagtaatttatagagcgggaagaagaaaagtttcacaatctaattactacattctattattcctcttgtcaactgtggcaaagctaaaatgcattctgaattatattaagagaagttactactgactggaaggacatacaatcagagttcaatgattgcctctgaggtcttttgggctaaccctttgtttttatacaggaaaactaaatttctttgtatttattatatcttatacgagagaaaatttagttcacagtggcacctaggtacattaagaattttgtgaatttactataattttgaaaaaccaaaagagtcactttagaaacatatatgttgatatatcttaaatttgaatgcttattaatttctagttttaaaaataaaattcaggaaaatgacaggaaagctaattatcttactatttgtatataatctgaaatacaaattaccatactggctcaatattaaaagtatcccaccttctttttctaattttaaagattctgaaattgtgctacagcttaaaatttatatgtaaatgagatacagtagtactttcctcatcccaggccagtatcaaattaaagctg

SEQ ID NO: 41425 - DNA, 1859 bp, Bovine  19866881163062
gaggaaattatggtaaaaggaagaatattttgtcctttttaaagagcactgggaaaatagagactatatcacaatgttaagagataatcatattaaatgagttaagcactttgaattgtcttaaaagattttaaattacttccagtattaccattccatttacagtgcttgaaattttaattcagaaaataaacttgcatccagtattcatttatgttttctgaattctcagggagaataggataggttgccctgggcatccttggacatcctttggaaaaataggtcattctgtgttgaagtaggtagtgtgttttttgttcaaatcgccattgaatctttgaaatgtgattcagtctatttgtccatgctgttaggaagatcgattagttgtctcacttgtcgattctaatgtgatttgacaagcattgtttgcatggccgttatttttttctgccttcctcattcatatatggggtagatgtaagtataaacgattgacttggtatagcctgtaggcagtcatggattaatttaagtaagaggaaatgcctccttctttgttcaaccacataatggtaacacatgaatattttattttaccattttaaagtgggagaagcttagaaggtgaattgaagtgacctcagactcccatttgtttgtggcctagtgtttcttgtgattttctgctaagcagagagtgaagatgtaactgtttacctcaacagggtaaatggaagcagctcttcaaccatagtccaccaacttactgaactctgagtacgtatctgtccaggacttatctctagtctgagcacaaaggtgatacagagcagttgggatggttagaaatagtccctggccctgtgtatggtttcaatctgctaatgtgccggagtccagctccagcagccagggattcaacctgaagaggtgaacggtgtcggccaatgagacagtgtctcagttttcttggactgcctgtttatttcaagtttaagattctcttttatacttttaccaaaacattagtccagaggtttgacattttcagttccccctctcccagatttattatctccacaaatcattgttgctcttcaaacagagttcctgcttcagtgattctctccaaatcagccttatcatctattatctacctcctctaatgtgttctatagtttgtgatgacattgtaactcatgctacattcctcagtttactacttatattcctaaatcctgtttgcccctaacatcctgagctcactacatcttaaaaaggcttctagctatgctgctgctgctgctaagtcgcttcagtcgtgtccaactctgtgtgaccccatagacagcagcccatcaggctccgccgtccctggcattctccaggcaagaatactggagtgggttgccatttccttctccaatgcatgaaagtgaaaagtgaaagtgaagtcgctcagccgtatccaactcctagggaccccatggactgcagcctatcaggctcctctgtccgtgggattttccaggcaggagtactggagtggggtgccattgccttctccgttctagctatagtgtatctaaaaatccctaacttctataagctatagtaaaatatgctaactttacaacattccttaaatctttaacttctaactgttttaattatttctaagccctaaattcagtaaactccttttccataaacattctcctcacaaataggcttcagatagcaatcccacacatggcctcaagctgcggcctatgtgctcatcctggaacactcctttgtaaaaggccttgagcaaatgtcaatgattaactttatgaattattttatgagca

SEQ ID NO: 41426 - DNA, 4174 bp, Bovine  19866881178517
cagggatgctgtctgatgcatgaatcgttcaataaaaccaattagatcttcaacatttactcagtcgacttctgtcttttaacatgcccaatgaacaaatgtataattattttgccactgtgggtctcacaaagggaagcaaaattctttctctaagcccacaatggtggctctgataacacagtaatacatggcccccgagagcctgcaagagtcactttgtactaacaaactgaaatcaaatagactgcagcatggaacttgacaaacagattgctgcatcaacaaaggtcagaatgcacaatgatcccccttatccaatcaaatctctgtgctaataaagacagggcttgagaactacttagctgccaccattcattagcataaaaaacttagcagttgtttaccatttcattagcattttaatgacagacaatttgccatgttaaacacagattgttttaaagtactggtagatcttctgaataaatattaactatgctttcatcaattccctcacctcaaccttgctgtattcacttttaaaacctgctcttcaatatcactttaccaaaattgattgcttcaaaggatgtttctgcaaatggaaaatgagtagaataaactgcacattttacacaagttagtttgagttttgacccctctgtcatcttattccagattttgctgctgctgctgttgctgggaaacatttctcctcacctcaggatgtccaaaagtcagtgggagacacaagcagcaattggaccaaaatgcattgcaccctgcaagaaagtgcttaatttttctaaaactcaagaactcactgaggaacaaaaagattgaaaatataatgagcaggtatttcaacacaaagggtggtataatgttcctattatgatgctattctcatgggacagagccaatactgtcttttataccaacaatttggcatttatgtaaaatacttcctatgtgtatttctgtctcaaagcttagtatataatcttacatacatcataataaattgagtcataatagggatccaccttatttgaaaataaggctttttatatcacactataaatatacatttatttatatcaaattcctttgaacacctcaaagatctaacagtcaccactctcactgtagaaattacacacatccatatattctcccataagaatgcagttagctctctctcataaatttcattttgatggtaaaagccaagttgtattcattgtactgtgaaaccaataatatgtgaaaatcaactcactactgcctctgtaacataataggtgccttattatgtcaatggattatgctataatccagcacaataaaacctcagttgaggacctggtaatactggaaatatctgctgtagtctttgacctttagaaacagacctctgaaggtctattcaggttttagctagaggttcttctttatagaacaaaatacaaacaaacaaaacacctaatttttagagggtatgccagagacaaagaaaatctgcttggagaagcattcacagaatgaaataaaatatacgtctgtaacctgtagcaggagttccctctgatgccattattacaatatgtatgcttgctttagtgagtactgaaataaaagagttcacgtactgtaaaaatctattaggtagagacaatgtggattatagaattcacaaagatttctttaaagaaattaaaaggagcggcatttcagattttccactaaactcagatttttgtttcatctcctttctagctttggtgtcccttatgttgagtaattttcccttttgccaggacaatcaccaatcaacagctcctcctctcctttcctcatcatttccattgttttatcattctgccatgtaagaaaaacaagaaacaaagggtggaggagggaacaacgtgaatagtgtatgtgactgataaatgattatgcttctgaaaaggccacacggcgtagtaacagagatcacatttttatagtgtctgtactaggcactatccttagcacattacatatgtgttttacatataagtgtataccatatccatatatactcatttacatataaaattatgtatttatatatcacatatcactcacatattattattattattaaatatatacttaatgtatattaaatgaatatatgcacaattatgttcacaaaggtacttacaataatcccatgaacaaactgctgttactaagccctattttatagatgggaaactgaggtacaaagaggttaagaccgatcgcacatagtttgtacaaaaaggagccaggattcagacccaggaaagttgactacttaattctgtttttactactacgctatggtaacagaattgaatatctgaggatatctcagttgtatagacacattctctagttgtagatagaaacatcagcaaactatgagatttaaaatctaggatttcctttgcatctaggaactatttaaaacttttatttgagctcaatgtagtattaatactgaaataactaaaatatataagattttttaatgctctatcagttcacttcagtcactaaatcgtgtccaattctttgcaaccccatggattgcagcatgctaggcttccctgtccatcacacatttatctaaaaataaccttccccaaataacagcattatttaattcagtaaatacttatagaagatcaactgtacaggcataatgctgataggaagtataaattgagtcagaatttaattgcgaagagataataaaaaaaataataactaccatttaatgagattctactctatgctgggtactgtgctagtgatttgtggtccttattttatgaaattataacacaactctatgaggttggcattattatctccattatacagttgagaaaggtaaggcttagagtgattaagatcattaaatatgtggtagggccagagtccaaactcttgtttgtttaactctaaagcccatgccattattccaaaaagtaggctatttataaagttatgtggaaaagattcttgtcatcaaatacatagagaagatgctggtttcaacaaaatctgaaatggttctttgctagaaaacattttggagtttttaatacaccaataggtactatgaatgtctagggagatatagcttctcccctcagtttgagaatgaatcaaccctttttattttcacaggggtctgggataaccacgatactatggcaaatcctttaggcaatgctgttttgtatacactaaaagcacctattcaggagaacactgatgactttcaggtctaccattttcttgctatatgaccttagacaagtgaatttacttctgtagacccctatacctgcattgaaggactggtaggagaactaatggagatccttctatacaagggacttaaccctgtgcctaacacctatcaagtgttcattaagcttcagttactgtagttaggaaccattcctatccctctgacactatgccatatctctggagagcataaacagttaaatccatcaatacttataaaaggtgagatatgtcagtggtcatacattattaacaaaattttaaggaggctccagtgagaaagaaattagatctggttaggagctgggttcataaatatttccatagatgaactatctcataagataaacctgagggaatggttaatattttgagaggtgggtatgggagaatggtgaaagggaccgcataaacaaaaagcatagaaatatgtgttaaaatttaaaacttgcttaggcactcaggaattcttactgtttctggatcagaaggtcaacagtaaagagaaaagcagaacatctttgtgaccttggagtaagcaaaagtttcttaaacagtaaacaaaaaagtgataattatgaatgaaaaacataagtatagtttattaagaataagaatgtaaggataagacacaatcaagggaatgggaagaccattcagagagtgtgagataatattgacaatatacacattttgacaaaagacttgaatctagaataaagaactcctacagatcagtaagaaaaagaacacagttggaaagctgggcataagactgaaggacagttcacaaaagtagacactaaaacagcctataaac

SEQ ID NO: 41427 - DNA, 1599 bp, Bovine  19866881231314
acagatcagactgtagctgagtcccaggaagctgtgtttgagtgtgaagttgccaacccagattctgaaggcgaatggttgaaggatggcaaacacctaccgctgagcaaaacccatcagaagtgaatctgatggccgcaaaaggagacttatcattgctgccaccaaactagatgacattggagaatacacctacaaggtggccacttccaaaacatctgccaaactcaaagttgaaggtcagtgatataacaacagagggacccatttcaaatcatgttgggtttttgacagttatctaaaagtcaaacagtttaatcattttggatgccataaatcctcattttgtaaaatcattataaactcttgaactttctgagccatataccacaggtgcaaaattgcttctgagtttatgtgaagaagccatgtcttaggttccagctctatgaaacagcaaattagatgctcttattctctagtcttctttcatcctcctccaatccattgactaagctattggtatacagctaagtgaagttgctcagtcgtgtcctactttttgtgaccccatggactgtagcctaccaggcttctctgtccatgggattttccaggcaggaatatcggagtgggttaccatttccttcttcaggggacattcccgacccagggattgaacccacgtttcccacactgcaggcagactctttaccatcaagccaccggtaaagcccagtatacagctaaacaaacttcatctcattcaagtatagaaaaatcattgtacaatgtacttttcaaactgtaccctaggttttccagagtaatagcaaagtgtcttttaaaaactctagagatgctgcataactacaaaaaatgttgataaccatttatttgcaagatggccaggtaacaatcttattcaggaattttcttacttgatggtatcatctttatttcctaaaccaatcataaatttgtcctcagctgtcaaaattaagaagactctgaagaacctcacggtgacagagacacaggatgctgttttcacggtggagctcacacaccctaacgtaaaaggtgtccagtggatcagaaacggagttgtgctggaatccagtgacaagtacactgtctcagtcaaaggaacagtttactctctgagaattaaaaactgtgctgtggcggacgaatctgtttatggcttcaagcttggaaagctgggagccagcgccagactgcacgttgagagtaagttgacttataagcacttgacaagtcgccacctcatggttaccatgaagtgaagcgtatctctaaatggcttcatcttttcccatcagccgtcaagatcattaagaagccaaaggatgtgactgccttggaaaatgccaccgtttcctttgaagttagcgtttcccatgacacagtgccagtaaaatggttccacaagaatgtggagattaagccgagtgacaaacacaggctggtctcagaaaggaaggtccacaaactgatgctgcagcatatctccccctcggatgctggggagtacacagctgtggtggggcaactggaatgcaaagcaaagctatt

SEQ ID NO: 41428 - DNA, 2245 bp, Bovine  19866881243816
ctccagttcagcatttccccagatgttccctctgtgatgcaccacttctgtttccacagtgagagcacatgggggcagggtggagacctgagcagtgtgaatggtgccccatggaccatgtctccttagattatgaaaaaaattctcattttctgaatcaaattcaaaggtgcttgggatgattaaaggtctcagtaaagtcacttctcagtttcctacaaacaagcaggagcctggggcactgactgagaaccttatgtggcagagagaagtggtttgggccccagttccaggtgggaccagacagcagacctggtcacagaggaagaactctcatctggatgaagtagttaaggctcatgtataaacctccaacttgttcacccctgtcttctgactctggagggaagccctacataagttatgtctgtgtaaaaattactactgaacttggcagcttaagtcaggaaacatccaatatctcctactttgtgtgggccaataattgacatgacctacctgggtcctctgactcaagatgtctcacaaggatgccatcatctgagggttcaaccaggggtgataattgtcaaatgtacttgactggatgttagcagcattttggtggactattgatctgagagcctcagtccctgtctggctgttggctagaggcctgtgtcctttccttgtcatggggttctcccataagaaggtaacaaagtggcagctggcttaatcagaacaagagagagagaaagatagattcaccaggggaaacagtcatcttaaagcctaatcttttaagtgacttctcattacttctgcaaaatttatttgttagatatatgttactatgccagagaaggcaatgacaccccactccagtactcttgcctggaaaatcccatggatggaggagcctggtaggctgcagtccaatggggtcgcacagagttggacacgactgtagtgacttagcagtagcagcatgttactatgtacaattgggtttgtggggattacagaaggacgtgaacaccaggtgacaggaataatgggatactttagaggctgttatcacagcccttgtttctaagctggatgaaagtgaaagtgttagttgctcagttgtgtctgactctttgtgaccccaatggactgtagtctgccaaggctcctctgtccatgggattctccaggcaataatactggactgggttgccgtttccttctcatgggatcttccgaacctagggattgaacccaggtctcctgcattgcaggtggattttttactgtctgagataccaggaagccctggaaataggtttaggtaatttttttcaatatagataatggataataaaatgagtcttatttaatgtcacgatttctttaacatcatcacaatttagttaagaattaagcaaaaagtatctgagatgcttaccctaagaaaataaggctgcttacctctctgattcatttacaatttttgaaaggtttatttactttgtattttgggctgggggtcaacatttgagtcaatttaatgataaggtgtgtgccaactcctagtatgtccactagggtttaactaaggcaagatggaagtaaatgaacacagggaaaatatgcctttaacctctcttctaaatcataaggggagtaaatcatgaacttcacacagaatactgatgaagcatattctataagttattatactcaaatgagaaaattagctctctgtatatgaacataatcttgaatatgtaataacgggaacatttataatttatgaaaatacctaattggctcaaagacttttgcatagaggacctcatctgttagaacttctaaatcttagaatttttatgaaatacatggatatcatcttctatctttataatatgatataaaacattaaggatttactaataattacttactattcttgagtatcttattttatgatttaccccaaagctctcaaaattatccacttctctcaaactaatttcaaattctatattaaactgacacattttagttaataattttctactaccttgaaatataaagagtttacagtgatttcagagttacatcccaagttcctaaagggtttgagagtgctgctatctttcagtggagaaatggattgtcattgtgtgctttctaagagtgatttttgttactcagtgataagtaatgcaatataattcaagtctccgcattaaag

SEQ ID NO: 41429 - DNA, 660 bp, Bovine  19866881250832
cgagcattttaaggtatagatttggaaacatgccaaaggctatgaccaatattgctagagagtccaaggttaaactggtaaaatagaaaaataaagccaaccattattagggcattttttaaaaattatgtggtttcatttttcaatttcaatgagtatttttccagagtacaggtataagctattcatataaaatacatgttcagtgatctctaaaactgtactttctaccaagcctcctaattcagagtcacgtggtttatcctaaaacagcgttaacactgtgcctggacctgtttcatgtgtgtttcaaagagttgaacagtttgtgcccatggattctgggaaatgctgcttttacaagtcagtgctatgggacttctataaataaaaacacaagttactaacagagaggctttaaaggacttgcctgagcagccaggaaactagacgttatggttattatggcaactctcatagacactctcatccaaaacagtggaattgtttgctaggcccacagcccttgacacggtgccatttgcaggtatttgcatattttgcttcccactagatgagcagtactctggaacactgagatattttcttaatttctcaattgctacatatactagcttatagtagatacgcagatttatt

SEQ ID NO: 41430 - DNA, 1966 bp, Bovine  19866881277425
cttggtttaataacctgaattcagtgaaaaaaaaaaaaaaagcatttgggtatttcccttttctgtcgtttacctgtttcatcttttccctctcgcaagagtcacacatgccacttttctaatattgtttatttcactaagatttctttttataaatttcttcgatgttgaagatggaataaaaatattcccttcatagttgcttctatgataggcaataagccagcccctttttgaaaggtggcataataactgagctgtgaacaatgtggttttactctagagacatcattatttttagcctatttattttaataaaagtaaaacacagaatacaggttttaaatcgttgttataaaagcagttctaacatccttaatatgttggttactttcaagcatttagaaacttttcaaccttaaatatatttctttgaggacaaagttactaaaatgtgagcacacgtttatatttataaactaagtaaaatagcatttgtttatcataatgttcagtagacaataacaatttcaattactgtgtttgcccattgatagtatttgaagtatgggatcagttatctgaataatttatgaaaaaatgttggtctctcagattattaaatgaaattgcacttggattacagtgcagccatttatactttttgtcttattttgttgtctttacaattgcatgttttttacagatcaggaacttcgtatttatgaatttaatatcagtaaattcattatttaatatcattatttaattcattattaaatattagtttcactccaaaaaaaaaaaaatgttgtctgaagtgtttcttgtttttatccacacaaaagatggcttggttagcatttattgttgaagaactactgtgatattgtgaaaaaaaaatatcttgcccttgaatttacaacaatttttctcagttaacaactggcaagctgtcagggaatcagtcttaggacactcagaaaaatgcaaaatcatcactcaggcactgggaatagaaagtgattcaggtttgtcaccgcttcttggatggaacaacatggggagaaataaataagcaagaatctagagtgtgcaaaataaacaaattatttgctttatacagtgctgcagctaagtgctcatattcataagaaacttttagaaatgtgtcattaacagtaacaatccaattgcatgaatgtcctttataattagaaatcattttcttctaatgaaattaatccacaaaaattaaatgagctcatcttgctagcaagtgctatatctgtaccttcttctaaagtggcacattggtattctccagggatcttgcaggatgagtttgatggggaagagtcttgcttcagtagctctaagaagtcacaagctgctgtttcatagcagctgaaagaatgacacaggtcaaatagaaggtgccatttcccactgggggtaattgttgccatgagaaaatgacagcccagtgtaaccagatggcctggttttgttaagaggagttggatatctgaattttcatatgcaatattctaattgttaaatatcaaaaaattcagtgtttaaaaaaaacagtctgagtccatcaaatactttcttggccaccagttgccaaccactgcttgaaagataaacagccccactgggtttgtggttgctgcagagttcctgctaatgctagaaaatattggagtagcaatgggcccaattgcagtgtttattagaacttggaaatgatgtgaataaaccatgatcctgactttaaaaattgactctctgcttcaggtacaagaagggccagaaattgtctgcagatgggcgcttgcaggttttacacaaggagacgagacacttggtgttcattccgaaggtatgcgaggcagatgcaggcctctatgtggcgtgggcccaaaaccctagcggcattctctcctccagtgtcatcctc

SEQ ID NO: 41431 - DNA, 1462 bp, Bovine  19866881286375
caatattgcttttttggctaatgccacagctctgggaaataatcaaattttctttagtgctttaatgtatttgaagagcttggtaaatcattagcagtgaatcaggatacagctttgaattctagaaagagatgtgttgagtgcaaaacccagtcaaattatactatctttattccctcctaatttaagagcatgcaaaccaaggcttatatagatatgcagatgtgagttttatttcaaatccagttgtttcataatctgtttttaattgtactcataaacatcttcttgtagaataagagtagaaatgttgagctaaaattgtaactttcattattgcacaagatgtctttcaattttgcttttcctgttttgatcccatttattgaaatatgttctatgtagtttcaatgtagcctacattcctgagtctgaggatggcactgcaaacagtcattccccctgttgatctcatgggtttgacattggagaatagatgtgccgtcacctttaaatggagattgaaacttccatcagctgtgtgtgtcacagagcaaggtggagcatagctgcggaggtggaccagtggtactccggtcctcccactgacgtattttgggcagccatgtgtatacaattgtaaccagctcctcctgcttctagtcttgtcctgctgctaaccatttttacagccattatggtggtaaggcatctcagtgctcattttcccatttggaaatgggttcatagtctacctcttgggcaattgatggttttaatttcatcttgtaaagatacgagaaatggaaagtgctctatgaaggctaagggtaattatatactttcatgtaatttgtcatcacactgcctcctgcccactatttctccttcagatatttgtttctttagaatattaaaaattacaagagtggagttagtatgtgattttgaactgtttccacgtaggaaaatgatgttttctgaattgaaactgaaatcctttccaatttcttaagactatctctttttcaaagatttgaaattaaactcagggggatatatttagtatgatctcagagagaaaaagtatataataggatgacataagatgaagtctatccttttcttataattatccctgtaatactgaagaatgttctatgcctttctgaaacatattattcagaaaagaggatcattattttagttcattaaaaaaaataagcatgtataggagaagcatttgtttttagattttaaatgtagtctcatcatgttagggtaaaatctatagttgaaagagtattcattatagatttttgatagaggggaggaattaattatgttgctataaagactgtctgcaaataaaaatatttaaatttaatatattcaagtttatattaaaaagttactggatgttatcgaagatggaaatgtgggctaagtaaaaatatatgtg

SEQ ID NO: 41432 - DNA, 1390 bp, Bovine  19866881339032
aacttaatccaattatgtaaagtttaaaaataaaataaaattaaaaaaaaagaattatgatattggcataacaagaaaaatatctcagaatgattatctacatgtgagcaaatcttaagaaaaacatctaaacacagaaatgatactatttgggaaaatgtcctatgatttcaaatggaagctaaagatgaccgtaaaacaatgaagagctctgatagccagaggagaggaaggtgggcttcgggtaatgaggaagagaagaaagaggtttctaccttttacaatgaccttggtgctacagctcgtgctgccagcaggattctgagcctcacaaatgaaatccccagtgtcctcagtaccaagataattcatctgtaagacggccaccgaatcgatgaaagccattctgtatttatcgctggctgggagttcatgttcatttctgtaccacacaactctgatgtctggggatccagttattttgcattcaagtcgtgctgagtcacctgctttcactattttggtcgcttctagtttctttacaaactttggtggttctagagagtgaagaaaaggggagattatgagggaacataacagatataaataacacaagttcagttaagtagtacaaaagaaaaacatgaaacatgaacaatgcctggccaatagaagggtattttcttgactgggtagatgcattgtaaaagattagagaaaggaccagagccacaggcagacagaaacataaaacaatcaaacttcccacacctgtcacaagcaatgttgtggtacaagagtcactaccaacatcattggtaacttggcaagtgtactgtccagtcttggaggcatccactgagtagagatttaagaagctagttgacccttccaagccaatgaaacatttaggtccagaggcaagttccacatcatccttaaaccacttgattttaaatggtggtgttccttttagcacagctttaaattccactgtagagtcaggtatggcttgttgtcgctcaggtttcactaagaagcttggaggttctatagatttgaagagaaatgcatatgattaaatgccttgtagttggattatttcaacagttttaaggccatgtaagaaaacactactgaaaagaggtaatgactgaatatttcttgaactcaatacagatgtatctaaagaaacagaattatggcgatttttagttttaaaggacaccaggaaagagtgttacatttaaaagcaaccagagagaagagccagaagaggttaagaaagtctaaccttttacagtcaagatgccgctgcacgctgcatcccctggctacgtttgatactcggcatgtgtatttcgcagtgtcttctaattccagggttgtt

SEQ ID NO: 41433 - DNA, 885 bp, Bovine  19866881373968
tcttgacctgtctagattattttcacaaagctggtttcaaagtctcttggcataccttaactataatttgtttccatttcaactcttgtctggtggtccttgcccctgggcactaggttcgggggaaagcctctatgaatagatactgaagctattttatgctgctgctcacaaggaaaaaccaaatatacccagaaggtttcctgtgtagagtgtggaggagctctattcaaaattctggcttatcttaagccacaatgaggcttttaagagaatgtgccttacccttcacctcacattaaaaaagctgcactgggttgaggtaactggagttcgggacactggggacccatgaggagtcaagaagatatagtcagtttatgcctctctggctacttaaaaactattccctgaaaatctgcagctaactcagagttgtcattggtaatgattgtaagtgggctagaaactatctctatttaaaaggaatcccaggtggactcttcctgtgaagtaagaaatcaatccttaatccctctcttttgcaatcaggaggagctctgcaagctggatttgcttaatgctcgtaacacctgcttgcagcatccatggggcttcggaaaagctgggggtaatgtcagtatcacctccagctggccaatcccagctttcagcctcagacagaccaccacattgggctaagtcccagggagattaggaaatccttccatctgggtatttatatgacatctattggtggaacccattgatattttttgcaaagaaactaaaaatagcacacattgagagcaggtaagacaggctgactctcaacatgcctgctagacagggaaagagagaggaatatacacaacccatggcttt

SEQ ID NO: 41434 - DNA, 1592 bp, Bovine  19866881386689
tgaggttttgttgatgcccttgaaatttctaagtgtaccaaaatttcatacaaccatgatagtctgtatgtactagcatatattaatttaatcctttattttgcaatatcctgcaattgctatttcaagttgagttttcaaagaaccctttaaatttctagttctaccatataacaaatgaaactaaacattacctgacccagaatttactgtctaacccttcgacagcaaatatgagaacaacggatgagtgacaatttgtgtgaggtttagatgaagaaacagatcaacgtatgataaatttaacagcaactctaacctaaatgaaaatggaaacgccagattctcccgagtcttaaaagagagactagtcacaggctatactggggataaagaatgtgacgcacttgaatggaaatgaaatttttatcactcagtaaaaaggcgaaaggtatccatcatatgaatgatttgccattatttgttagtacaattatacacaataaccattacatttaccgaaaacttactacatgcctactatgaaacaggtaagaatttctactttgtatggaaaatgtatcaattttcattttaataaatattatgttgtctcagcaaaaattaacatgaatagtcaaactttgcctttgttttctaagctgcatatcttccatcactccttgtatgtggtccacattttccttattctcaatggttacatcctttccataggcccaggatgcctgattggagatctgatccagaagaccttgacctttttcacgcaaaccttgcaatcctacatctaaaacaaaagttaccagatttaatctcttaaacaagagaagctttccctcccttaattaaatcctctcagcagatactgtacttggattgctaggataacagctttgtacattaaactactttggtctggagccctctgaatatttcaatcaataaaacccatttaaacgtggctcaaattggagctccctctcattcaaattctccctaatgagaatttctaaaaggtgaacttccgtagacaactaattacttttcaaaattgcaagtagaaagtgtgagaattcctgtcttgatgagtaagattttcaattctttcctttctgtttttacatagttcagtttttaggagaacatagaaggcaaatgctttgttcaaaaaatatatcagagccacaagacattaaaacagtcaagcactgtgttctcactgtaaaaggacactgaacattttgaaaataggtgctatcagcttatactcaacaagaagcaacacttaggatgtatttataagactttaaattaggtatgtatattggaattcctttagcatttttaaaggaaaaacattgctcaagaaaacttgtgacatttttgaaataaatttcatttggcaaattagatactaaacatgtaattacatcatccattaaaataacaaagactataagcaagtaaaatgccaatacaaacatgatttttcaaacccattccctcaagtccttttcaaaattaattaaattgggttcagtcacatgccaccatttcccactaaatcgctg

SEQ ID NO: 41435 - DNA, 654 bp, Bovine  19866881391831
agcagatctccatacgcatgtcccctgctaggatgtcccctgcacggatgtcccctggacgcaggctggaggaaacagatgagtcacaactcgagagactgtataagccagtctttgtgttgaaacctacttctttcaagtgtgtagaaggacagactgccagatttgacttaaaggttgtgggtcgacccatgcctgagaccttctggtttcatgacggtaagtgtaagttttcgctaataagttattaaacacaaaaataaacttatctgtgtgtctaaccacttttaaaaacaactattttaacgtgattccttttttgctgatttttctgataggccagcaaattgtcaatgactatacccataaagtagtcgttaaagaagatgggacccaatcactgcttattgttcctgcaacacccagtgattctggggaatggacggtggttgcccaaaacagggcagggaaatcttcaatttcagtgattttaactgtggaaggtatttgctccgaagactcaaaataaataaccttatcacttgggttttacacaagtagttcagccctactcactcagaatcacaacctttctctttcagctgtggaacatcaggtaaaaccagtgtttgtggaaaaactgaggaatctcaa

SEQ ID NO: 41436 - DNA, 1050 bp, Bovine  19866881434353
gtatagtgaagcacgaaaatgtctgaaattcgcttctcctaatttctagcgttgaagaaaaaggagtccatttctgttttgtctgagacagtgatgtccacctgtacccagaggtatgtggcctcttatccagacctttgtctggattagactccttaattttcataagaaaatgtcaattctaccaccaggctcagctgacactgatacatgtgtccttcattgtcctcatagattatctatactcgagcatctctccacagaggataaccttgaactctgctgtcccaaacacagagcttgattactttatatatgtttatatattatattcatgtgtattattatatctgaatatatattatatattcagataaaactcccagatggccatattgtctatttctctgggacttaacattttatcattgatccttacaactgtatcctacaaccaccttgccgagctcctcacaaaattacatttgctgagctgagtttagccccaaaaccatgtgcttgcagtgaagaatcttataagtaagagccctattgcattaaatgtagaagaactgttgaaatagttgttcaccatatcattacattataaaagggaatttttcccaaaagtcatcatgatctttctaagcaatagatttgttttaatcttatggacactataattgtatcatcaacttaaaaattacagaccacaaataaccctctgtcttagctgctgtaaagtcctgggccagatacatggtgttcctccaacaaatgtccagatgcttgtttgttgaactgatctctgattttcttctggcattgactttctccttttttttttttcatttttatgtgctccttcaaaccatatgaggaaggggagaaaagaaataaatggatagataaatgaataaaagcaaatttgtgttgggaacttatggctgatttcaaatcagcacaatgagcatgagagttttcttccttcatctgtttttctagaacaatttacagagattcaagagttggtgacatgatgatgacatg

SEQ ID NO: 41437 - DNA, 3966 bp, Bovine  19866881437603
tgtggcggccggctccggggcgagtccccgcgtcagcgcccgcggctggctcctttgtgtggccggtgaccggccctggccggcgggtgggggacgccggccagagacccccgggctgcaggagccttctggacggctctcttggggcgtgggggcttggcttaccccgggtatgctggccggtaacatccctccagcctttgcaggagtcacaaaaggaagggagagcgggttggcagggatatctggatggtatttatttttatatgtgaggtagacttgtattggaaaggaaccgcagtctggcaggctcttgagggtttctgtggcatttcaccccgcgatgcaccatttggacatggcagctgctgcgactcccccgtggttctcctcttggtgctttgacatctttcttaaacagacatcacctgagaagttggaaatgctgttgagtaactcgatacagctgtttgacaggtcttccgtctcttcacgttttgtctgtaccaagtaaacccaccgtgtatgctagcataggttggcaaaccctcaaattgagatcaccgctcaaaaatacccccatattgggaaatattaacctgtatggtttactttggcttgatgaaccttattttcttagttgtgagaaacttttttttttttttttttacccccaaagaaagaatacaaagtaaagaacaatttatctttgtttacataccttgggtcctgctgttacctagctggtttcattggtatgctattttagtataacaatactaaatggaaggaaaatatcttccttttgctttgagcaataaaatacttctttgttctagaaccaggaagcttttatacataatactttgtgtggccaaaagttagtgactgtctttaccccgtgaccaaattcgtgaaaaaatacccaaaggacttagaaagcattacccagactctatagattgtttttatattccaaattccaggaaatcattttgttgtatatttagtcaaacaagctagactaaatttaaccttaaaaattgggcctactctgtaaattccccagcattagggaatgaattgactgcatttaaagaatttaccaagcattttgatctctgtgttggaaggagctggtgatggacctagaaatatgacagcagaatgcagaacatggaaacaggtagatgaagcttgcgaagttccatctacttaggttttagttgattgatgggtatatctgaaaactaaatgtccactaatttaaaaacaaaatactacattttgacctattttttaaaatgtactctataaagattccttcacacttgtctctactccctaaaaacaaatgatactaataaggatattcttttgaagaaataagctaatgccaaattaatctgatctgtagaaagtttttctgacataattagtagtttcactgtactaaaaataccatttatctgtgtaacatctaagttcaaagagctttcatagctgttacaagcaacaggaataatctgaaaaaagtaatgtctttactatcaaaaagtaggagaaacttaaatttctacaatagttttattaaaatataactcgtatactgtagaattcacccttttaacatgtacaattcagtggttttagtttattcataagggagtgcaaacatcatcactaatcaacgagcattttcaacatcctaacaggaaaaccctcataccattaactgccactcccattccccctcattgacacttggcaggcaccggtctacctttctgtctcggtggatttgctgatttaggacatttcctataaatggaatcacataatacgtggccttttgtgtctttcactaagtgtagtgtttcccggagttcatgcatattacacatgtattaagatacctcctttttatggctcagtaatattccactgtatggatatgccacattttgtttatctgttcatcagttgatggaaatttaaggttgtttccactttttggctattatgagtaatgctgctgtgactgttcatttataggtttttgtgtggacttatgttttcagtgatcttgagtatatagttagatgtggagttgcttggttctaaggtaactctaactatttgaggaactgcccaaattattttctgtagtgacttcattgtacattctcatcattaaagtatgagtgttacattttctccagccttgttgtctttttgatgatagctattccagtgtgtggaggtggtatcttacggtttttgtttgcatttctgtaatggctaataatgttgagcatctttaaattcttattggccatttatatatctttggaaaaaatgtttgatttataatttttcagtttatgttttcacatgtatttttctcgtttagtctttgaaataacccagttaaatcggtttactcctattttgctgctgggacactgaggtttaaagaggttaaataatttgttcattttttaatcttatggagttagtaagagtcaaggtctgaatgtatactcagatcttctgactctgcttcctgcattctttccactttatgaggcatacagaagttaaattgtgtttgcagctttgcttggttaatcatcgacaagagtaggggtaaaataaataaatcaatgaaaccaaacaacaaaaagcaggtgttgcgtccacactgcctcatgttctccagattttgttatgctttttcaaataaattctttgatttctcctatccttataaggtagatatcatttccatattttctttggggaaacaaacctaaaaacagcttcttagtggcactgctaaacctagaacttgttcactgagacattgcactttctgttcccctggagcttccatgttctctattttcccactaatttataccctttaaccatagagtaattgaataatttcacagttttcataaacatcaagttatttctaggttacactgaaattaatttttatttttgaacagggcagtttgccagattcactttgaagtgtaggattactaaggtgtgtacttcagtttttatgtgttacgtactctgaaatccttgtctccctagagggtaggtagaggccgtatgttacttatttgtctttgcatatccattgtctaccattgtgcccagacatgtaagaaggactctaacctttgttggatgaatgaatacaaatgtattttttccacttgcccccccaaatcaaatccaataaaagtcattcttagaataaaggcagtacaaattctaaagaatttcttatccctcacgtatgacctgaaaaataataaatgataattaaaacttgacttaaaacagcactatctgatggaagaaagtaaatgttcaatgctgggcttaaaaaaattggctgcaggtatctggaggctagcacaaatgctcagtgcccacacatagggttataccttgcgtttgtgttagataaatgaatgcacagtgagtgaataaaataattagttttgactgtgatagctagaggaggtacgtcaaatggctatcaggtcctgcttttcatttgtatattttaattgtcaaatatgatacatgttaattataaaaaattcaaataatatacaggggtatagagtaaaggcctttcctggtggctcagatggtaaagaatccacctgcagtgtgggagacctgggttcaattcctggatggggagaatcccctggaggtaggcatgataacccactccagtaatcttgcctggagaatcctcacggacagaggagcctggcgggctatactcagtccatgcggtcacaaagagtcggacatgactgagcaactaagcacatgtagagtaaaaggcaaaaatgtcacttcactatttgtccacatcccttccttcaccccaaagactactcctgtcacaggtcaccttgttagcag

SEQ ID NO: 41438 - DNA, 665 bp, Bovine  19866881494260
accccaacaaataaattcttttaggaataagatttagtctgtagatggaggaaatatcatttgaagaatagcatttgaccttttcttgatagaaaatagtcatattttcaaagcatagtggagaattgagatagtttctcactaaaaataaataactctgatgaaagaaatgtgtctgaccaaggccagaagcacttatgctgagtgagaaatagaaacacatgactggtaggagttggctttaaataagtgccatagaagtacagcaaacctatacatcagatatggaagaatgattgtttcaatccccctaatgtggtattaaatcgaaaagctctattgcactagtgggaaagagagatgttttgtaactcagaattatgggctacaaaaatgctcaagaacttcaagggtagagtttcttcactatgaagtgtgcaaataatgactttaacttgccaaatttcatataatttatgtatactttgccatttatcctcttgataaaaatgaaatcataccaataagaatttttatacatgaaaaatccaattagcaacgttctctctaaacattctcaaattctgtgaaataagtcattattgattattttagcagatatccaacagttaatataattaactccatgatgattaaacatcttg

SEQ ID NO: 41439 - DNA, 953 bp, Bovine  19866881602001
gccggtcaagatatttgtgatgctgtggtgtctgtcttaggtgtgttgacagtttcctcttcttcttgctcttttctttctttcaaaacatcttcttttagttagtgcgcctgattgattatcatcctttctacctcagaaccgccttatttcattgagcctctggaacacgtggaagcagtcatcggagaacctataactttacagtgtaaagtggatggaaccccagaaatcagaatttcttggtataaagaacacacaaagctacggtcagctcctgcatataaaatgcaattcaaaaataacgttgcctccttggtgatcaacaaagtggatcacagtgacgtgggagaatatacctgcaaggcagaaaacattgtgggagcggtggcttcttcatccgtgcttgttatcaaaggtgatgacagttttctctgcaagtctcactgtgtgttgacagatccattttcttaaaaacatcacaatgttaatggattgaaatacgccatggttgttttctctcttgtaaataaggattgtctataacttctttacagagcgcaaacttccaccttcctttgcaagaaaactgaaggatgttcaggagactcttggcttcccagttgcatttgaatgtcgcatcaatggctcagaacctctccaagtgtcttggtacaaggatggggtacttttgaaagatgatgctaatctgcaaacatcttttgttcacaatgtagcaactcttcagattttgcaaactgaccagagccacgtaggtcagtacaattgctcggcttcgaatccccttgggactgcttcatccagtgcgaagctcgtcctcttaggtgagtaactcatcacatgacctcttcgttataaagcagcttcactgcacccagccaccaaggactggtgccacatagtgtctgctccacgtctagagcacggaaact

SEQ ID NO: 41440 - DNA, 685 bp, Bovine  19866880403789
tttaacttaaagaatagcatgttgccgtatcactgaatccttatgcaagagtctcctttatcattccttcactggagtttttgttagtaagcttatatagcttttttaactttttcctatttttcagacattttattaaaaataggttatattctacccattctttctaattaattacatgttagttactttaatggagaaggcaatggcaacccactccagtactcttgcctgggaaatcccacggacgaaagagcctggtgggctgcagtccatggggtctcgaagagttgaacacaactgagcgacttcactttcacttttcactttcattcaccggagaaggaaatggcaacccactccagtgttcttgcctggagaatcccagggacgggggagcctggtgggctgccgtctatggggttgcccagagtcggacacgactgaagcgacttagcagcagcagcagcacacctgtgtattgaagtgtttcagacttgtggttttacatttttcttgtcacaatttaaaaacattttatattgtctccatatgtatgctaaagtaatttgtcaaacttttggacccagaataattaaagtttggcattttcctggaacttgcagctgaatttaaggcttccaccaagtggttataggtagtcaatgctatttaattcaagaat

SEQ ID NO: 41441 - DNA, 805 bp, Bovine  19866880478358
ccggtaggggtcccctaaagcggaggccgcgacagttgccacttacactttcttcttggctccctttttacctcctttcgtaaggcgcttattcttgccgaccgccatggtgccgctcagagagccaaaagggcggaaatgcaattcgcgcgagaacttaggcgtgcggggcgggacgcgctgtctacgtgaccttcgacattacgctcttccggcctcaagaatatcgcgacaacagagacaggcaagcgtccgactgtgcctgcgacagcgcccctcatgtgtgtggaggctgtgcagaatgccgcggccgttagttgagaggctgagctccggaagtgccggcgctggtaatctgaggtgcgggctcctggtaatgatggttcccgaggctctgaagtccggaagtaggtttccttggaagcggacgcccactcagcgtcgttcaaagctaaactcaccgtgtcactttcaagcctgtttcttcttaaaccccaagcctgtgggattcgggattagacagcaggtcctacgttcttatgctagtttcagtaataatatttagccttgtggcttgtctgtacttccttgtatttgagatggaggcgatagtgtgatctacctcgtaggattaagattaaataagtgtaacattgaagatactggttatgttttgcttgttgttgaaagctgctggttggttagtggaatacgttcgccttgtgagcatccatcaagctgtacactaactagtgtacttttctgtaaatttctaatacattgataaaaaggtgttttgggggcg

SEQ ID NO: 41442 - DNA, 918 bp, Bovine  19866880479768
agaactaggtcggaaggaaggaagacaaattacttgcattactttgaggcagatggttgtctatttcttctgaaaagtcagtctgagttgctgaagtaatagtgtgccgtggagtggcagcagcattattattatttgtagtgttaacttgaacttggttgatttcttttatgacttgttcataagatggtgggagctgcaaaatgaagaatgaagattttaaacagctgtaggcgatagccaaggttcttatctttgaacttcatttaaaaataaaatgcaaagaggtaatgcgatatttactcacctcagcaggaaccagctcactaggcctccaagggcccgctgcagaagctgggggaaatgccagtcctggcgggtgggctcctggaaaccacgaggtgggcctcagcggctcagctgccacaatggtgatctctgggcgcctggaaacagacagaagcctcagtgaggttttgtctatttgcaagtgttcaaagatttatgaaaataactatcagccaagaaagtgacataaagcctgccagtcacagaaatgacctgtctggcctgggctgtctctagcagtatacccagacaggcttcgaaggagcaaatgacagccatcctccaagacactggcctcagagagttagagatacacctcgagcacacttcactctgccttggctgatcagaattcagatccaagacccacacaacctcgttctcccagggttctgctatctggcctatggtacaaacataggtgcatcgtaaggtagaaaaatgcattggtcaaatggaaatgtttcgtttcctgttattccaaagtacatactctgaaacaatactatataattagaagaacagcggtcttcctcctcactggacctctccctcagtcagttatcttta

SEQ ID NO: 41443 - DNA, 1210 bp, Bovine  19866880802017
atttccagtcgagttgtcctcagtcttgaaagctccttaacgcttcttcctggctagtgcctatcctaccctcacagacaattgttgttctatattgtttaaacaacagattaattttgccttttctagaacgtcatgtaggaagttcatgaaggacttacatccttacatccttaaaggaaatacaaagtatgtgttcttctgtataaggcttccttcacttaacaaaatgcttttgagattcatacatgttatgttaatcagtagtttatttctattactattattccattctatgtgtataccaccaaattttaattcatttttctgcttaaagattcagggctatttccagtttttggttgttattagtaaagcatttcttaatgttattgtatctattctttatggacttaagttatggtgaggaaatttctaagagtagaatcgccggtacataggataggcttatggcttaaatttcaaatatagaaaaaacggtttcccttttctaaatactaaattgttgctcctatcagtacttggctcttgtatgagtaaactagatcttgctagttgtttcttttgtggtcaaatgtcagagtaaatcctccagtgttcgcccctctcccgtcaaaatagcttgttagcaaataagtcgctacagattttcttaaacaacaggcttgtgaagttttgccttcaagcaggtaattcacaaagaacattttgtattgttttgtgaatgtactaccagcacacgtgtacacacacacgtgcacacatgcaggggggtggtcatcccccctccccccaaagtcaataatcttcacgtgatacaagctaccgtgatttaagcacagcattttggattgagggctcaggtggctgttgcttctattttttagtgtatagttaacattggcagtcacccttataatgatgtgccaccagccaccccagtacattggctacgccatgcctagcacagagaactggatttaattggtggcagtgtttgctgtcacatgataggcactgaagtaaaacagaacctatttcacttcgtgttatctctttcgatgtaacaaaagaaacaaaatatattttaaaatattggaattgtataattttcacttctgaatgcatttattgggatcaagtgtctaagtaactttatttcaaaacgaataaagctgttaagggaata

SEQ ID NO: 41444 - DNA, 2577 bp, Bovine  19866880804396
aggctccaaagattaaaatgtggaaaaagtaataatgttttattaaataataattgcttcagagagtggtattgtaccttacagcgtggggacgtcctggtgatactgaagcaggcagaaggtaattacttggagtgccggaagggagacgatgccggcagagttcacctgtctcagatgaagatcatcacgccgcttgatgaacatcttagcagcagaccaaatgtgaggaattgataccgtaccatcctcatatcacacatggcagcacatttcatagaactattaattatagctcatcctcaggtttttattagcacgtttattttaaccagagtaaaaattacagtagcgttttattccattttaagaataaattacttctaagagacttgccgctgccagactaatcactttgatacagagtgactaccgggtggcttgccttcctcgtatcatgctgacttacagcatccaggacacgtagtcattaattttcaactgtgagagctatttacttttgaaataatgtaaatacatttaccaaagtactagagattggttttctagcagaatggataattattttaaggagggccctataaaggctgacattaaaacacttcccagtaagatttaaggtgagtatagaccttgtttctctgatcatagctcataaaataatgaaatgaaatgttacaacactctgaattcactatttaggcctaataaatctgtggagcctaggagaatacaatgattattgaaggtcatttgttgagcaagaaaaatgccattgaacaatttacagaggcatattttttaaagagctgcttagggtacccagttaaattttcactgtcttaggtaatgtggcgaacatgaagaatgagacctatcagtcattaggccaagttaaagtctttggtttgccatcatcctagtttgcataatctcatccagttcttcttggagggcagtctgtcatttgaggtttgccaagaaactaaagattccgagtttcagagagcagagaagatatgtgttatgctggccacagctgggaatgttgacatttctgacttcagccctcgtggggaaagctcttctgtcgctcactttctctttgtttcaggaagcattacccatctgtgaccactgttctgcctctcttttgaacacgttggtgggtagccatggggattgtactgccggaaagctttccttgatgacaaacagaagctgaaaaaattacagcttattctttgtaaacactcacggttttgtcccttggaacattaccttcctcatgcttgtgccatagacttgcagaaaggtgaccaccagtgacccacagctggtgaaacccaagtggggcctctctcaggctctgggtcatggctaacattacccttttcagaaaagtaaaacctacttgaaagcctagtgtgaaggtaaatatccctaaaactgtgttaggctctcccctgccttagtcaacagaagacattgcactttatgagttaaggccgggctgtccgagcagggaggcagggattgtcacctcgcgtggctcccacagctgcgggtctcacttcccctcccaccaccggaggcagtgatctgacctctctgaacctcattttttaaatgtgtgaaatagatatgagaatcctcagagttgattatagaattgatttatcattatgattccatttatatgaaagttcagaatggggaaatccagaaggtagatcagtggttgcccagggctgggggaaggtgagggggagtgatggccaatgggtgggaggcttctggagggatcataaatgtgtcctaaagttagattgtggtgatggtcacacaatgctgtgaatatgctaaaattaggtacactttaaatgcttgaattttatggcaagtgccttatatctcaaagatccttaaaaaattaaatgagctgattaatttaggtaatttagcacctgtaaggtgcttagtatagtgaatagtgcatagtgagcaaacagcgtatattaactattctcattactcattagtattagctattatagtcatactagaaggaactttgaaatatgttagattttcctcccagatacccccactaatggtgtgttcctgcccctgagttgttcctgcccctgtggccagccccgttcgcctgccctctcgcccttcacctgccaggccaaggtgatgagcagcatcaaggggacagccgtgcacaggaggcggggaaggggagcgggaggcacaggctgcctgcggtcccacctccacccatttggctggtgtctaggcctcgggccatctgcaggtccatgtttatgtttggtgtggggtaggcctctgccttcactttttccagatgtaaagccatcatagtctaacaccattattggagcagtcatccctttgtctacagatgtaaatcagaaaaaaatgaaaaccacacatatactaaattggataaatagtaatttttaaagcccctccaggcttcacatatctcatagttcctttacaatccctaaattcccattatgccca

SEQ ID NO: 41445 - DNA, 2195 bp, Bovine  19866880956289
taatcttggctgtctatagaattagttggtaagggtttttttttttttttttttttttaaatgaaaagagaatctcactccctcttccctagattctgatttaattggtctgggacaagacccagacaggtattttaaaaaatgttttccaggtattttaatgcaggcaagattgaggatggttgttatagatctagggaagctttttgtgttatctacaatattctctatttgaaatttcctcttattgttagaactattcatcttcaaagcctaccttaatatctactctagtagtgaaacttttcttgactcttttagcttatcctaaaataatttctctggcctctgaattaatagtatttcatagctctattgcactcgttttgcagttaattacatattgccacatgagctttcttatgtttcagtaggggtatttattacctttggtttttcacttaaaattgtgtgtatgtttaatcttctccattagatttttagctactgagggacagtgtctgcaccattgtatattcagtaatacagtgctacaaatacaggtgaaggtaaatattttctgattgaaatatcacacttaagaatttgaatcatgtcatagaaagttctgtatatcctcaataacaactaagctggggctgtctatttgaacagcagtagcaacatcaaaatgatgttatctttcagcaactctgtggattatagcatgtttatgattttctaaaccacagttgggtttctctcgtggttcagcagtaaagagtctacttctcaatgcaggagatgtgggttctatccctgggtcaggaagatccccaggaggagaaaatggcaacccactccagtatttgccagggaaagcccatggacagaggagcctggcaggttacagtccatgggttggcaaagactcaaacatgacttagctactaaacaacaacagcaaactacagccatctttcagacttcgattttaaggggctcagagtctgctgttctggaccttgtactgttactcattgactcccttattcatttaggcttgtttgtttatagggcatctggaatataggcacctaatttttatctttcaggcttaaaaaggaaaatgccctcagcatctgggaatgtccattatgtttaaacataaatactcattgtaaatgatcaggagtagtttcagttttggtcaaatttcatgccttccttaatattttttagttaataaagtatatccactagtaatgcagtgaaaaattcttgattttgatatgaaagtaggacaaaagtggtttttattttgtgccaagattataattacaatctttgtagtaatgagctgctataacaaaattctttttttctaataaatatttcttaagataggctttacatatttttgtatgattttctttttttgatctgttttttagttattcctgctgtttttttttaatttcttatgagttactccagctactagttttctccagaacaaagacaatttctagcttttgagaacaattatgcaaagtataaatagtaggtttattataaagaagtgtgtaagttcatgaataattgctgattgctaaacaggaatcagttttctcagcactgtaggaacagtgctgcaaaagcacggtgtatgtgggatgtttacttcatagtatgtgggggtgttcacttcatagcgccgctgtaacaggagcgttggcctgcttttgttttgtaaggagcgtgtgtgcttctgggtatgtgtccgtggctatatgttgtctgttaacatggaggttactatcaagctaattaagcagcttgctttttagaacgagtgtggtccgaatagagcaacctgagagtattactggaaagaacggtaaaatgctggtctgtttctttgatttgagctcttcattttgatcctctaggtgcagttgacactctacacttacctgtccacggaattcattggtacagtcaacatatataatgccattcggagagttggcacagtgcttctcataatgcatacactgaagtactactactgggcagtgaaccctcaagatcggagtgggattaccccaaaaggattaggtatttcatctctatctgtatattatgttacatatatatgcaaattcaggattttctcttccctccttctttcc

SEQ ID NO: 41446 - DNA, 1021 bp, Bovine  19866881084458
ttttgaaaaataattttcctgtataaaaacacactggatagaaatgattacattttgttccatttccttccactatcagtaaagtaaaatttaatattatttttcaggaagatgttttggttttataagatgccaacatataaatatatttgttctcaatattttattcagtatttttctatatcattttattttgtattctttatagtttaatgttttattagctgccacataatattgtggtaaatggacctaactgttggtatatctttcagaatcagatatcttatttccgtttatttaaaaatttatcctttacattgtctctttatgttctttcctaatgtgttttgtttctacttatcttattgttcttttttgaaatttcatgtttgttttatgatcaatagtacagtaccttggaaattttcataatgcattcatactaaaaagtgcagtgtttttcccactgaaattactactcagtttttagtacctgacattttaacttggtaattttagaaactgctcatttcagtctccaaatttaatagaaaaagataaacagaaaagttatcttctgtatttaaaggagtgatgggtgtaatacccttatacttatcctcagtgatcgtttttgcttacttcagaattctgaagctctactagataggttatcatctatccgtattataaggcgctgaaaacagtgctgacgtctaatctcttttgactttctacattgtgttgcctactgcatgtctttagtgcttccctgagtttttattttaggtttagattattattattattattttttggtttagattctatattacattatttttttatgtttatagcaactgaccaagttggcaaatctgtgtgtgtaattttccttttcaaaaaagttttttatatgtaagtataaaatacttgtattatgttttttaaggataatggagtaaaggaagatgaactacaggccattcttaattatctactcactatgcataggtaa

SEQ ID NO: 41447 - DNA, 2301 bp, Bovine  19866881159986
aaaacattttttatgtctccttcatcaagtaaatagtaaaactttgcatttgattttttttttctgtgtaattgcagaagaaaagctgaagttatgcttggacatgggttgttttcattgttagctgaaagactcatgcttcagacaaatttcatcacaatgacaacgtataacgtcttatttgaggtaggaatgcagtgagcatttaatcttaactaatttttagcgaaaaatacctatataattgagttgactaatgtgtagatgaaataaaagcatttaggtttgatgtatgatttttaaactagttatttaaagacacactgctaaaaaaaaaataaaaaaaaataaagacacactgctatatcttaatctgttagtctgtgagttattaaacagtgtggacatctctgtttaactattttctccattgtattgactatttgatgtctcattttataattactttaaaatagggttataatgttgattagtgttgtacttaaagttcattaatagtaatagtgatatagtgattatgctaatccaatctggtctttcatttctgtagattctcatagaacagatatgcactcaagtgatacataaacaacatccagatcctgattcttcagtaaagatacagaatcctcgtatgtatttaatatactttgtttttgatatttggtttttttttttcaagatttattgttacatagctgacattacaaggttgtgtaatttcaaggtgtacagtgtaatgaattgatacacgttgtgagatgattaccacagtaatgttagtgagcgcatccatgggctctacgtggttttaattttttgtgttacatgtggtgaatacccttagcactttcaaacgcataaagcagtattgttatctgttgtctccaggttaaagattacatccacggaacttattccaccttgtaactggaagcttctagtttttgagcgccttcacccatttctcccgttcccttccttttaacttgttttttataagtacatcttgttaccaaatggaaaggcactgaagaacctaaagttgatattgttggaaacacattgtttagataacatttcattatagacattaatataatagtagttttgtttgtgtttgatgttgactataatttcaaatttaccttaggtcatggggaaatgtttatatacagattttcaagaattatatgcataagatatatgttcagatttttggtaaagttttgactgtactatttaggtgatgacaggctaagttacatggaccatgcaggtggctttctttttaaattcctgtcaagttaagaatacgaagtgtggaattgaaaaatatctgtcttcttaattgtttaagaacttagtcttggttaataatcttttcttttgatatttagaattcttaaggacttataaaatgtgtacatttctcatcttgctttttaagattagtgatattaaaacaactggtttgtggaatttataaattaaattactttttgtgtgatgagttgtgttcatgtttgtgatactgtttcagtactaattttaaaaacacatgtcatgtgtgtgtttaatttttcttagcctccaaataattgtgatatcattattttatagagtaaaaaaggaaaaaatacctcgattatattgttgttgttcatttgctcagtcatgtccaactctttgcaacccatggactgcacatgccacctttcctgtccttcactatctgctggagcttgctcagactcatgtccatccagtcggtgatgccatccaaccatctcatcctctgtcatccccttctcctcctggcttcagtcttccccagcatcacggtcttttctaatgagccgacccttcacattaggtggccaaagtgttggagtttcagcttcagtatcagtcctgccagtgacttttcaggcttgatttcttttaggttgtattaatctgatctgcttgctgtccaggggattctcaagagtgttttacagcaccgaagattgaaagcatctgatcttcagcactcgccttctttatggtctagctctcttatctatacatgactactggaaaaaccatagctttgactataaggacatttgttggcaaagtggtggtgtctttgtttttttaaaatggtatctaggttggtcatagcttttcttccaaggagcaagcgtcttttaatttcatggctgcagtcaccatccacagtgattttggagcccaagaaaataaagtctgtcactgtttcttttttgtccttat

SEQ ID NO: 41448 - DNA, 770 bp, Bovine  19866881338540
accagtggccagagattctcacgttaaagagcagaattcccggagcagtccggtggccgcgcaggaggaggcagccccgagccggcccccgtccctgtgggaaggtgccagctgccccgagggccaggccgcgatgaacacgatgagcgcagagcagagccgcagcactgtcatttccaggatcaaagcgcttgagggccagacaagtacagaaagctcgggactgcccaagaagccggaaattgtgccccgcacaatcccgcccagacctgctgtttcctcagggaaaccctctgtggctcccaaacctgcagccagtagagcctccggagaatgggactcctggaccgcaagcagactcaggggggccccctcccccacactctccgccgaaagaagcaaggagcagccccgtcaccaagcccgaattgccaaagaaaccaaatcctggccttatccggagcattaaccttgagagtctgggtggagggcccatggctgagagccccaatggtgggaagaaagccccgactcctgctcctcggcctttactgcccaagaaatcagtgtcctcagaaacctccccctgctctgtggctttgctgaaaccagtcactgtgcctccccgactctcggtggcgtcacaagccaaagccttcaggtcactgggagagggacccccagccagccccccggttcctgctcagcagagcaagcctccgggtgacatcgacctcatcagcttcgatgatgatgttttacccccacca

SEQ ID NO: 41449 - DNA, 748 bp, Bovine  19866881410323
tttaaacaagtcattttcctcataattaaagaagacatactgagaatctgaataatcatgcatctgaagtgtttaagcttgttaattctttatgatataaatgctcgcatcctttgtatttcgtgcaaaagaacacaagtaaaacttacttaacacaatgagatgagatggattcccgtttcccatttcctcctggaacatcaatctagtaaagacaaaaatcaaggcaacaattgtattatttcataagataaatttaaggctaagtaattaggaaatttacagctgaggttaaccagtttagctaggtattaaatcgacaaaacacaccatagatgctaaaaaggtatgaaatccagaatttgggttttgaaaaaactccataacttgtgatgtggccctccttgcatagacaacccatcttcctcttatttgctggaataagcacattatgtcattcccccctaactggggctctctatctcacatcccctaagttgaaaacatcaggtgaggagggcttagcacagaaactaggcataggtactatctagacgcctagccaaagtgttggtagaactctgcaatacttccatgaccccaaataaaaccttttaatcaaacttgtgaagctctcccttttcataactctgggccattttttccccttcactgtaagtagggaaggaagagaggacttagcactcagggagcatactaggggtgagcacgttatataatacctcat

SEQ ID NO: 41450 - DNA, 1613 bp, Bovine  19866881425575
tgtatggtatattacttgtactactttaatgaaaaagcatacagaaagttcatttcatagtatttaaagcaatttgtcctagaaaatataggcttattcaaagctagacttgaacactgcaaataaaaggtaactgatcctgcttaccttctattctctctactgttattaaaaagtttaatcatgtcagaaagaaatgctctgcgaacttccatgctctctgggcactgcacagaatttcgaagtagcgttgcaattacttttagtatctctgtaagacaattcataaattagtaaaaaccacaacgttacaaaaaattcatgatgcaagatcatcagtatatttcaattttatttccctgacataaatgtctacctaaaatatccttttctgtattataaaaaaaattatctgtggacaagactgtcaaaacattcactagaaatcatatataaacaagaaaggaattttttattttcatcattagacagaatacttaaattttaaaactttgtagtaaatcaaattaaattataaatgaattaaatgactgctgacacctctccataatctctgccagataataaagttgatcttaaaatatacatatttaaaatttttttaaatactcaaaacatatatataaaatcaaaatctcagaaaaaaagaattctcagcttcttcaacaatatgtataataggcacatactttatcctttatcattgtgaattttagaagctatcaagattttcttccataattctaaaagtaaaattagacacaaaaatatgaaaactaaattaaaacctactaaaaactctaaataaataaaactgttcctgtaatactcttaaatattgactaaatttgtactataaattttaagaaaaggaatgcttaaaatatataaaaatcaaagtagaatgatcaaataataatatcccaaagttttacacaaataaaaattgaggaattctaaacctgcaattggccaagatttttggtgtttctaaagcaaaaagttcaaaatatcaaataaaagatattttatcataaacttaatgacaatttttgaattcttctaatgacgaagtctacctgaacaatgattaccatgacaataatatccactaactttgaggatatactactgtgagacacttttttagaaaatacagatattaatacatataatcctcacaaaatgataactagatactattatcatctggattgtagagatactattatttacccatttggataaattaatgtaccccaaaatcacttagctgttaatactgaaaagcagacataccattttttaaataccacagtgtacagattatcttttctgctaatatattacacagacaatatatttaaagttcttacttcaataagtcatctttcccataactacataaaatatattttatattatatatattaccaaggctggatgaagcacaagctagaatcaagattgcctaaagaaatatcaataatcttagatatacagatgataccaccactgggggcagaagaggaactaaagaatctcttgatgaaagtaaaaagaggagagtggaaaaagctggtttaaaacta

SEQ ID NO: 41451 - DNA, 1019 bp, Bovine  19866881835171
tctccctctcccacagagtccaaaagactgttctatacatcagtgtctcctttgctgtcttgtatacagggttattgttaccatctttctaaattccatatatatgcgttagtatactgtattggtgttttctttctggcttacttcactctgtataataggctccagtttcatccacctcattagaacatgattcaaatgtattctttttaatggctgagtaatacaaaagatatttatagtacctgtcaaaagatctgacctgcacaggttgttcagcagagagatcaccaagagctccaaggcaggctggtggcagaagggcaggatccacagtgactccatctgctggtatgtttactaagcttcggagaatgtccttcacgttgacattttttgaaactggaactgatggtgcagccttgctatccgattcattccctccatcacttttggtttcctgagatttactgacttctgaagaaagagtgcacagtgcctcgttgacggcatcgggaccggcaccgacgcgcggaggcactccaggagcagccacgtctgcgccgctgcctagcccaggagctgtttctcccccagtgcctgagttccgccttggagcaggtgatgtgctttcagattcctccacagatgctggagttaatgggcttgatgctcctggtgagtcctctacatcttacccagaaaaagaagaaaagtaaaaataaaaaagatttacaaataattttaaaaaggtacattcactcctaattgttttagattatgaaatatacagaatgttttaaaaggctaaaacaaattaatctataaaagtgtactgagtaaatatacatatagtgaaagtagtttaataaaatagtaataataaataaggttagcaaagtatctgagaaaaccccaaactgaatatgacataccaatgggtagcaatacaagattgaaagccattggtctgcaagaaaaaagtccaaaatcctttagggtatactcaaggttcttca

SEQ ID NO: 41452 - DNA, 870 bp, Bovine  19866881992317
tctatgaaacaaaccaaaacaactgcctttttctatcagcctcatttcacttgaaaattatattttgaccctccaaataaaaagaaaaccctctaaaaattcataaagaacccatattctaaattagctttatgaaaaactctacagaccttatttttcttgtctcatcacagattcaagacttctagtgatcagtggaaatcagtgattccttccaaatatggtactgagtccaataaaccattaattctatatttgacagttgccttgactaagtttacttcataggtggcactttgctggtttaaaaatttcccaatggaaaattttatcaacccccaagtcagaataaaaattgaacttgctttcttcctagactgattcctctttctgcccaagagtgcaagagtcacaggggagtcattaatgaagtcagctgcatctagtttattctggagacaccagcacctgagggatttgtcagaggtacaaatttcagtcctcaactttgccttgtaatgaaagctttttaaaaattgtatttctctaacactgttgtcttttatggtgcaatcatcagttttaaataaaatatatccattaaaagatagcatgagaggtgtcaatcagtttattaggtctcaactgtataggaatttcaaaattcatatggaataaaatggaacaaaagctgtcactatagcagacctagtaaagtctcaactagtatggatataagaattgggccataaagaaggctgagcactgaagaattgatatttttgaattctggtgctggagaagactcttgagagtcctttggactgcaaggagttcaaatcagtcaatcctaaaggaaataaatcctaa

SEQ ID NO: 41453 - DNA, 2028 bp, Bovine  19866880460468
ttggttttgtaatataatagcacgtgaaggtcagtatggttatgagagaaaccttagatgctgtgacaaatccaataactatcagggtattttgttcataaaagtaaagcatttctcaaaatattctgctgatttgttaaggtactgggaaatattttgctggctctggggctgactttctctaggatgctacatagtgtcaacagatttgacagttaagcagtatcttctctcaaggctgccaacaaataaacacagaaggttcagatttgtattttggagtaaggaagagccccagaaagaataattagttgaggtacacaggtatttgaagcaaggagacaaaaggacaaatatctgcaggcctgttatgtatacatccagcttcatggatgtatacaatgctgacaaattttcatatgggattttaaaatcctttttcaggtaactcctccgccccaatctaacaggctaaccaacttagcagaaaaattttactttcctgtttatgtctcctgcgagtgtttgaaacaaagggtgattcgcatattacaaggccaggaatctgaaaagaacctcaggaaaagtttcaaactacctgaagctcctgcaacaaatataagactgcactgccctccagaggtgactcttcggcaaatacttttaatcctttcatgccgaggaccaaatgctgaggtaatcctcattgcaattttactcttgctatctcaaatacttattaaatatacattcaaaactcaacttaatgttttcccctaagaagaatattacattttcatggctcttccaccttactcatttccatttgtcctattcaaagtattatttgccttagcttttgctaaatgttaaatattaattttttgttgtttagcagagcttatttattcatgtatgtattttcagagaaatcagactgaatacgtagcctaaggaaactttagcaaaactgagaaggctcaaagatgaaaaaagtatgcttaactgaatattttacagtctaattatattgtcatcacttaactaaaatttgaagggtacccacagctactgtgagaaaaatataaatttattctgaactctcttcttcttgagcttttcttctccaaagccatgtaaactatttctgctccacataccacctcaaataaggaacaattttgtggactttcccttttgtcactttccctttattccctataaatacaaaattttcaagatttaagacaaagctaacaatttcatgataaaattgtgataaccagtatgaatgactcaaaacacattaatgataagtattaaatcataaacatttaattgggaaatttaaactttatctctttatataacaaatatttatgtagagcattgaacatattaacttttttagttatcataacaactatgagattggtattattattaccatctaccttgcatgaatgagacacagtaaggttaactaactgttcaagatcatgagctgagatgtgatggagctgagattcaaactcaagtagtactttgctatcagagtcctgagtcttaactccctgaatttaacccaacttaggtggacttttcaagtgatgatagtggtaaagaacctgcctgccagtgtaggagatataggagactcgagtttgatctcttgcctggggaatcccatcagctgaagtgacttagcacccatgtaaatggtaacacatatatagatttttccttcacatcataaaaccattaataagacttaaaataaaggtaatacttttcaggtagattttttaaaatttaaggcacatagaaagctttaaaaatgtcaaaaccctggtacatggaaatactggaagttagaatgaaattgtaaatcactttttgtgatgagtttcaaatatttactaagccattaatctttgaggaaaggtaaaaaatgaaggaaatattgaaaaaacattatggaaacaataccatcttctcagagtaaaaataaattatataaatagatcg

SEQ ID NO: 41454 - DNA, 1149 bp, Bovine  19866880699706
ttgggggtgttttgcactgactgaccgtgcaactagaaagaggagatgtttactgactgtatgtgtgttctagtgggactttaaaaatcaggtaagttcatattggggctacagtttcccttgcagccgtctctagccagatgattttatatttacagtgtgcctacagaatcacatctatttatagacctaccttttgaaatgtgtttgctacaagagttgtgaaggtagttttaatttggctttttttccccctcagcccgaaatgaaacttcttaaggatgaaataaaattattattagcagatggttattttaatcgtcttcaaagcttttggggagtctagcattgtcaggcagatgcagtggcataacacacatataaaggtgttatgtgcaggtgcaacattttaaagaataacagaaacagactgcgatttctagtttctctgttgtatatgcttgtgccttcaagaagctgagctgatgggagatgaagcttgtcagctttatcagtttctgtttgttagaagcgcagactctcagggcaatagcacggtacatgggtacttgtaattgttgcttttcatatttatccctagctagttctgaaagcctgagggactttttgtcttggttctcttccgaatgcttcagtctaaattggcttaaagttctccctcacatcttctgtgtttctgtgtgggcttaatcataattatagatcaccacctagatttccatattaagaatgtggcataaagcagcgtttacttggtagaactagatgggaaagaaagattccacaggttggcttcatatctgttttagcattgaacgccttctcatctctgtatctgtgtttgaagcaagttctctttgaagctcggttatttggaatgattttaggatccttctgttccagagtaaaatatcaattttgggtcattttggtatgttcacacttaagtgacaggacttacattaattcgtggtgcctgcttattgaaagcaaacataccagaatgtcagtatagtttattacctttgcgcctgcaaagccgacagaagcatggggagggctcagcctgtatgtctctgatggaactggtcacttagcattttatttgtaaatatctaccagctctat

SEQ ID NO: 41455 - DNA, 1809 bp, Bovine  19866880979270
tttaattttaatttgttaaaataacaagacatctaaaattaagacatcccccaccttttggcatctttttccaaacaaggtatgattgtaaaggatagcctcttcctaaatatttaaggccccgtgcaagctaagtggagattatttaaagacttaagtacacagaaacctgacacactcatttttaatggggaggtagactgttgtttatttagcttttgaaatctatcctaaatttggctttatggaaccaaaaaagtctagctttaaattaacagactgctttctactgtccaagggataatttgaacttcactgagacatgtctatgaatggaaataaaaataactcacattaaattctaagtacttccccacacgcatttcacttgccacaaggcccattgttccatgcaatgcttttaaccagcctgtaggaaattttcactgaaacaatttcccataaccaaggaaaggcaggccaaaatgatttcacttaaaaaaaaaaaaaaaagctttgcaagctttcagatctagggtattgaaagcagctctgtcagagtagcaggaatgggaaatggaaggctcacgcaatactcaaagattcagttggtggctttaattttagcttactctcctccttcctctctaaaaaatttactccagatgaaatgttctgcttctgattctcacctcacttcatccattcgtttaaaagcttaaacttagaaatatttcaaatatctagaaaagtaacaaaaaatgatatgagcaaaattcctgatttaaaacaggttaatttttgccctatttgactcagatctctttatcctcccttcttctttaccatccaggaaatctaacccatcttatggaaacatctctaatcatttcctatcaaaatgatctcttttccaaaactcttttttctcctaattctaatattcaccaattctacattttatctctcatccaggataggtatgagaaaatcatttaatgtaagggaaaatatgtaagtaaagctaaaagtacgggaaaggaaaagttacatggaggagacagggaccaataataaataatatgcaacatttacaaacattttacttcattctgggcttggctctgaaaattaacttggataaactcatataactctgaaaacaagtccatgaggtaaaaactactggtcccctcattttacaaaatggagaaatttttggaaggtccttaacaccatcaagtctagttcattacaatgtctgctggggaatgcatctgatggtcaaacagtgaggagtgtgcagggttaaatacaggtgaacaggtcgctttgtggcagaatttagaacccttaaaaaaagagtatcatacaatctcatattgctaagaaaaagatggtacacaatgtttttctaacttctttgactaaaagacagtcattgcttcacagagcagctggtgacacttagagtctcccaagtgacttctccatggtcatgcagctgattgccatgaacttgaagtcacaactgagttctggttgccaggccaggccttgtctaggcacaaatagtcaaaaatcttgaaatgtaacctatggaaaatgtatagtaattttagcttttatgagtgggaaaaaatagggtacagaatatactgaagcggagacacattaactgctagtacaaactacgggaattcagaaatgacataccaagttgcctactctagggggtgacagaaaaaagagcagaaagcaagaataaaatcaaacactcaagaacaaagtaaccctacagagtttcta

SEQ ID NO: 41456 - DNA, 1708 bp, Bovine  19866881022264
ttgctcacattagcttcatcctaaagagaatcatcagttaatagttatgtatgtaagtgatattagtatagctatatttattcatcagtaaatgataagcacagagtttggatttcgggaccctcaatcctattatttccatcacatcaaatcgattccttgtccatctacttctctcaatgaataaacaatgcaaaaccaccatctacatttgattatctggctactgccaacacatggatgagctggaactataaattgtagataaaaataaagcctcatttagcaatgcaaatttttatgaaaacataatgtatcgaatttacgatttacaaggtacaaccatttgtaacagacattaaatgttttatacccttttctttgcaaagaagttcaatgaaatatttattgcatatgtgaaacatcaaacagtccctcatgataattccacaacttaaaattaagacagatggatttctaaagatcagtctatcttgaaattagtataaaaacaaaacaggtacatttgaattttttaatcaaaaatgaatgggattgaggaatattttccaatttgctgtaccattattcacaagagtttctgatagatttacaccaactttcaacaattgcagacttttatcattaaaattactacctgaacatttgagataggtgacccaaaaataacctttgcacaattttatttggagtagaagcctcctaaaatatttcaatcatattgtaagtgaacaataatatggactttagcagtaacagattttttaaaatgtactttttctcacatactacttcaatatattcaaagaaaataggtaacagccatcaaaataagtatttatttattagttgtagtactattagtaaagcacaagtgttatttatttcaatcttgacatagtccatataaccacagactttgatcttcctgtgctgaacacttccttctagatggtttaagcacaaacaatgaacattcacattttcaacataatacaccgttcagaatatggaaagtagcattattctcaattccaggtgaagatgcaaacaggagtacagcagaattcttcaacaaaagccccaaatctgagaggttgggagtatcgtgcatcaccaggtttttgataagaaatttatgccaatttccacaaatgtttttccattcattaatttaggatttattggttgtcgaccatgagcaagaccccttactaggcactggaagtccttcccccaaaataagtttatgtccttatgagagttcattatccatcagaacaaacagataagtataatgggtacaaaacaacgtactcaacagaggaatgaaaaagggagctggcagtgagaacacagagcaaagggaggcttcccaagggtagataatctgctgcagcccctgctacaacaccactgcctagtttagagttggagtctagtgaaagtcttgaaagtgttggtcattcagttgtgttgactctttgagaaactatggactgtagcccccagcctcctcactccacgggattctccaggcaagagtactggggtgggttgccttgcccttctccaggaggtcctcccgacccagagattgagcccaggtctcctgcattgcaggcagattctttactgtttgagctaactgagaagccctagtccagactagagtctagtagggatc

SEQ ID NO: 41457 - DNA, 790 bp, Bovine  19866881034528
tttacctagaggctgcagtataaatagatatatatttattagggctgtttgctcttatataaatatccaaaacatgatctcaaacgtggggcccacaaaacacagaaatttaaagaaagggttgcaagaaagaaaaagtctcccaattcttgcctgtaacaatggtgatggctactaatgacattccgatgagatgacctcaggctatgtaagtttcataaagggaccattagtgtcaaggcccttggtctcagtcccggcccagttagttgtactaggaattactaccatattaagagatcggttatttttctgaacttacaataccaggcagagccattttctttttctgatgttttatttatgtgaactagccttgcagagttggacacaactgaagcgacttagcagcagcagcagcctcctaagagggtaattaaaatatttatgccagaaagctacaggaggtattagatgacgtctgatttttctatggctgagagaatatctgcttatgtgaaagtcaacagacagatccaatttaggtagtggctcattcattcacttttactttatcgagtgccttctgtaactcaagaactgggtactgtaggtacaacaataaaaaagacaacaagactctgccctcatataactgatagtctagtgaggacaaaccattaggctggttcttcaatatttactgattttaacaggattcatttctttctagcatcaaattcacaaacacacacacgaaataataataatagtatttattgagtaccaa

SEQ ID NO: 41458 - DNA, 1304 bp, Bovine  19866881116013
aagcaccaagtgaaaaacacatatattgaaaggaggtcttcagtaacttttggggactaactcggatctttcccgaaggtgagataacccaccagcactctggatacaccaaataccctgagctggaacgcttggtttattggcttattagcacttcccaaacactgacagacaaacctctgctgcaaactgcttctagttgagcagcttagcaccttttcacttggcaagagatggatttccaaaactaggctttgattcacaaatacttccttgactaaattataattccttaaacctgacttttttttttttaatctttgccacaaaatggagtttgctttctgtacctctcaccaaaatagggcgctttttgtaaagcttatatttcactgttcttgtaagattatctgcttgataagaatatcatttggagtactttttcatttaaaaaatttttagatagaagtcctgaaatacattcctaggctcattctcttgcatttcaacaggtcaaaagaacttgtaattcttccttcttgaagcaaaatatacttaaatgaaaacaaaagtaaggaaagtgggaggagcaagtatttaaaagttatatttctttcagtattattgtatactctattgtcacacatttaaaaatgagagtttaaagactaaagaaagtccagtaaaatttattttcaggtccttataaaaatatattatctttacaatgttaggtgtgtgtgcctctgtgtgtatctataactgccataatcagaaagcattctttgtcaaaacaaacttctaaagctttggcacagagttttgtaaagaaagttcttatgactgacaccagaactaaaagtcccaaggggagtgtccatccagcaaaattttctttcatcattaatactgcccaatgccctaagcagccctggtctttgcgtccccacggcatgccggcatgcccaccctgtcttatagcatctccatcccctacccctgcccaggtctgccatccttgccattcccctactctgaccacaggtaaaccaaatgagaaataatcattttccaaaaaatgaatttgaagaaagggtatatttttctttcctagcagcacatacaaatggatgcagtgccttcaaactaaaacatttacattcaccagtagaacaaaaaaactcaatcattaaagttccaaaagaactatttttcaatgatgatttaaccctacaagaaacaaatataatctgctctctgccgcaatggataaagacaaatatgaaattaaaaattaaaaataa

SEQ ID NO: 41459 - DNA, 1023 bp, Bovine  19866881865807
aaattgtaggcttcagagttactaaatgttttttgggtggcatgaatcaccagttttccagttatatctgttttcctgctacttgattctcaccactaagtcaatcttaaattttgggcctctattgtagtcccattccatttcaaatggtcaatttctctctcaagctaggctgggtgtggtaatagagagaccccaaaatgtcagtgattttttgccatatgattttatttcttctttatttcatcagagaccttgtagttttagggttatatatcagtacatctttcctcccgtatggacccatagagatggtacctttgaaatcttccacacctagctttcagtgttgcgtaggcgctgggagagagacagtatctggaggacacctctgggttattctgtagatgctggatttggagtggcacaggtcacttctgtttatgttccattagagagaacgttgttcatgtttatgtaactgtgcagaagtctagggatgtgtatcttagaaaaagagaggctttgagcaattagctggtagtctctgccacaagatggtgggggaaattttaaatgtgtcaaggatatgtgtaagaaaaaagaacatgactacctgaatggcagtcggacttgtgactagatgattaaggaccaaatggtaaaaaggaactgtgaactaatgactactatcatgtgatattctgaaagatataaacattctcactttttttaatctagcaaagaagagtgtggttaataaaaattagtctctacagctgtatgtgtaaagagtgtgtgacttcctgaggatataatattttatttattttggcattttgtgaataggactaacgtgttctctacacacatcaattagtgcacttgttttgaaaaaataagatatttttagatttcaattttgcttgcccctggagaaagagacagcattatacacatacacacacacacacacacacacatacacacaaacacacacacacgattgagaagggagttgag

SEQ ID NO: 41460 - DNA, 1039 bp, Bovine  19866880695345
tgaggagacagtgttattattctcttggggtttttaaattctcatttatcttttgtttccagtcagtccacaactatggtttgactattaatctacaacatagaggaaatgtcccattcacaaaagtggtgtactccaaacctttgagagttggttattttgggaacttagaatagtttttcctccaataaacaatactataaatgatggtgaggtttccagagcagccccacaaaagtcttcttaactcataatgttattgaggccctggacttctactgtgaaaatgagtggagagcaattttgttgtaacaccaatacacagactcaaagatggatgatacagtatcccttctcttgaattccacttaatgaaacaacccgatcaatgaaagaaaacaaagggaaagatagagactttttagggaaagacctctacttattttgcaggctggtagcagcactttattgttattttgtctggccggtttcacgtgtacagcttttttgccattttccgtcacagacatgacacaaaggagccatgataagaacagatttgaggctcacatcaaaggatgggggaggaaaagcaaaaagtctgaatgagatttccttgatggggtgattaaagcatgtggttgcaaggaggagactgtctaaatctgtattaacttatttgctaaggaaattgaggagaaggtggaagacccggtgttagtgtctcaggtctttgagcctggaagagagtccactatttggacaggcagttccttctctgaccataaggtggtgccatcagtccagacagtcgggcccccaagggggcgtggcttgcaggaggaggagctctacacgtggaagccacgtttcccactctggctttggaactcagacagcctggaccagccaccaagtattaacatcaacctacacaacactgcctcatcattcaacaacttcccatcctccaaggcaccacctgctcacaaccaagtaagaacatccttctaggcacagcaatccacataaagattcc

SEQ ID NO: 41461 - DNA, 637 bp, Bovine  19866880735238
tcctgggaagagctgggagaggagggggcctcccgagagaggagggacctcccgagagaggaggggcctgggctgccaggccttattacaactacccctctgttccctttggcatgcttcatcttgcagctgtgggctgggagacggggattggccatgccaggtgccagccaggatgccagggctagagcagggagttctacctgagacatcgcaaactatcaaaactacagggcccctgcagggagagcaaaatgcagagcctccaagaatgcacctctggtacatcatggcaggagtggggttaggactgctgggtcgagtgagtggagacaggaaagggaagcaaagatgagaggcggagaagtgacccaaggaatcctaccactcgccaaaggccgggaaaacacagcctggccactccagggccaagacaaggccatccctgagttctgagggattggagagattctttgaattcagaaaaacatcagagtaactccacccactgttcctggaagggggccacgggatgacaccagcaaccctggcccagatgcgggttataagccgtcacaaggaagaaagagcaggccaccgacttgggggaggctgtccccagccccagccatcctgc

SEQ ID NO: 41462 - DNA, 1348 bp, Bovine  19866880799089
catggtaagattgtataatctggtcccctatggtcaggtggggcctagatctggcccatgagttgtgagtgaaagtgatgagtcatttaatttctatttcccatctgggatggtgactgaccataaggaagatggtagctgttctatctgcttaggagcccttgcctacccaacaatgaacatgtaccatgaacaagaaatcaacttttgttgttaaaagccactgggatttaaaaattgttcattactgcagcaaagcctagtctaacctgtctgatacatatacccgagtttcatctactttactcctcagcactctggaggatgggagaacttgacaagtgttttatcaaattgcttattttctcccccaaacctatgactaatatgttagtgttcttctgtcatttttggtcatgttcagtggcacagaatttggtaaaacaggaaaaaagagaaagaaaggccaaatgtatttctttgcttcttactgagctgcatatgagctggtgtgggatccatgggagtagttcctcctctcacaatctacaaatacctacacttttccataccacttctagttcccagtcaccttctgctatgaagtttctttttgaaggtattatgcaaggcaacttatggggagtgacgtttggtccacccttctatggaacaaatgttttcctagatatctagcttgggtgatgtgaacaagattccatcaacatagagggcaatttcttccacatgtgataacattacctctcactagaccacaaatccagaggcaaggtaaactgaataagtgactgtggcaaaagcacccaagtagagaatacaatgaactaagactaagaatccaatcccaattctgatatcatatttgtctaccagcctcattggaaggcaagtgaaagaaacccaactcacacaatttataagaacactagaaaataaaaacctttccagttctcaaaaaatgtcaagaagaaactatcccctctatgacagcatactgttgcttttttgctggctctgttctcagctctgcttttcccaagtggcagcaaagatgaccacagcatgtccaggctctcatttcagcagctcagcaactctgggagaaagagacaccctcttttccaagggctccatcaaaagtcatagaatgaaatttcattggcctcatttcagtcacacgctcacctctgaaccaatctttgtggccatggaaatgcaagtgttctgagtggccagtcctgggatcatgcccacctctggagacagaggttggagcagcctcagtcaaatcacgtggaccaagagatgggaggggtaagtctctgca

SEQ ID NO: 41463 - DNA, 1249 bp, Bovine  19866880875203
ctgggacctttatataaagaggtcctggggactgccctggtggcccggtggctaagactccttgctcctaatgcaggggcccacgttcaatccctggtcagggaactagatcccacacgccacgactaaggcccagtgcagccaagtcaatgaacagcaacaaaaagcacgtagtgatttgaaacatataatttaatcattatcgtaatttgcatcgtttggtaactgcagctcacagggacaaatgcttttccttcttgaactatcaaacccttttttgatctgatctcacgtaagagtttgcaaagagggttctgaacttccccgagatgctggacgaagcaagataagcacaggaagggtcccaacgtgaacccgagctgcctccctccctggctggggcttgggggggccgttgctcctgctgggaacccgagctgacctgggggatcaccaagcaggctgtcgctcagtgtccccaacaccgcggcctgtcaggctgagcccagtcccttctgctcagcgccagacacctccagaccccggagtcaggaggccacggaaacaaaggcctttatctcacgcaggctctcgtgcggctcagcggggctgccggccctgctctggacagcataaaaagtcaggcccggatgacaggcagaatttagagcccttttggatggcagctgggattcaagctgtcagctggaggcaagtgatcacagtcgggctggtggggactctggtgcgtgcgagagggcaggggtgacgctgtgcagagctgccctgcgcctccttctatttataattccccttgataatagggcccattcattccctctgcaggccactaattgctctggagcggagggatgacagcctaattattaacttcacaaaaattaaagttgggccgtgtcaacagggtccatttgctgtcacccagatgcaattcgttgcccttcattgtggcaaagggcagttagaaaaaaaccgaaaaccttggcctggttccagttccagcagacttttattttctggcctcaaattatcgtggggaggttctgcttcgaggagacagaatgcctctttcctcttggccgtaaactgcggtaagcctgccgctgctcctctgacaggagttgacatttttggcccctggaaatatgggatctgagggttagaagggaccttagagagactaaaagccggcaggtacggctgcagtccagcccacgggtgcgcttca

SEQ ID NO: 41464 - DNA, 1770 bp, Bovine  19866880911698
tccctagccttccaccatttagaacagcttttaaaagataaaaatcgcacaagacccccagaaaggtagaaactgttattcctcctttacagataaacagactccccagaggttgagtaacttcctgcaggtcatatctggagaggccaggacttgacctcaggaatccccaagacagagtcctggtttctctcctccatgacacaggcactcctccaaggggtctgggcggccacccgaagcttttggattctctgcagagtcacatcaggcctgtcaataagtcacaagatgccatgactcatctgaagacaagataaacaacagggaggcccggtgggatgagaggccctgtttcctaggaagttgccttctgcagggctgaaagagtacacagtcagcaggcaggaacctcttctgcaaacaccagcgcagcagtttgcagacaaaggaaaagcactgctggtcctggagatgggtggcagagctgggagccgtgagctatttccatcctgaaagggcttttgtcaagcccaggccacgagcctgagcatatagaattccaagcctttcccttccaatttctccaaaaccagaagggaaggtccgtctgggctgatctaatgtgagttctctactgcatcccttccaagaatcccaaaatgtttaaccagtgtttctggataaaactgcagaccctccaagtgaccttgggcacccatttcctcttcctgcacgccagctctcaggggagaataagatggctctcagggggacgaaggtgatttggcagagggcaggagcttactgcccctagcacccatccaaccaggtctgtctggacacaacaggctcatagggaccagtcaaagcgcagagcccagatggcccaacaggaaagtggcaggtggtcaggaagggcggggcagagagtgcagaggccagcaggagggacccagcccagggctcagggacggggctcagtcttgcaaagactcaggccacaagaagaaatctactgtcaaatgaaggatccaagtagagccttgaggcttggtcatcaggaaatatgacaagagataggcttgctggactgtaggtcagagtgaggtgacataatgctgattcagccagagagaacttagaggaaattttcactctccctaatcagtcacggagctgatgccagagtctgcaatcgaggcaacttcgaatgtttggggatgagaggacagggaagccccagaggcaattcaggaagcagcacatgcctggccacctccctcctgtccacctgctcagaaggaccttctcctccaaaccatcacagccaaacaggtagccttcaaagcagccccaggactctgtgacaacactcagaacaacgtcttgcttatccatgacctcttcttggacacctccagtttgaatggaccttcccaatgcatgcattttgtctctgactcaattctaatttctatcgctattggctcagcagtaaagaatccacctgccaatgaggagatgcaggtttgatccctggatagggatgatcccctggagtaggaaatggcaacctactccagtattcttgcctgaaaaatcccttggacagaggagcctggtgggatacagctccaccgggttgcaaagagttgggcatgactgagcaactgagtacacattgttattttaaaatgactgactcttactcgatcccagcacaatgcagggtactcagaagagcttagtaaatatctttgtctttga

SEQ ID NO: 41465 - DNA, 1680 bp, Bovine  19866880125323
acatgggaataccaggcccacctgatttgcctcttgaaaaacccgtatgcaggtcaggaagcaatggttagaactggagatggaacaacagactggttccaaattggaaaaggaatacgtcaaaagctatatattgtaaccctgattatttaatttatatgcagagtacatcatgagaaatgctgtgctggaggaagcacaagctggaatcaagattgcagggagaaatgtcaataactttagatatgcagatgacaccacccttatggcagaaagtgaagaaaaactaaagagcttcttgatgaaagtgaaagaagagagtgaaaacattggtttaaagctcaacattcagaaaactaagatcatggcatccattcccattacttcatggcaaatagatggggaaacattgataacagtgcctgattttacttttttgggctccatagtcactgcagatggtgattgcagccatgaaattaaaagacgcttactccttggaaggaaagttatgcccaacctagagagcatattaaaaagcagaaacattactttgccaacaaatgtctgtctacacaaggctatggtttttccagtggtaatgtatggatgtgagagtcagactgtaaagaaagctgagcaccaaagaattgatgcttttgaagtagtgttggacaagactcttgagagtccgttggcctgcaagcagatccaaccagtccatcataaaggagatcagtcccaggtgttcattgaaagggctgattctgaagctaaaactccaatactttggctatctcatgcaaagagctgactcatttaaaaagaccctgattctgggaaagtttgagggcaggagaagaagaggatgacagaggatgagatggttgaatggcatcaccgactcgatagacatgggtttgggtggactctggggtttggtgatggacaaggaggcctggcatgctgcgattcatggggtcgcaaagaatcggacatgactgagccaactgaactgaactgaaacctcttcctaagaaataatacctaaaaaaaataaaaaagaaaaaaaaagaaataatacctgcaaaattgtatggttttcttttaatacattttttttattcctgacacatattaggttgaactgtatgaaactgccaatatttgaccttttaaaaaaaaaatcctcaaagatatccgtttcatgtggcttaaagtaaacataactattaaaaatcagaatgagggtttcgtggctcacattgaatccctggatataataacagaggaacatgtcaccccggaggaggtctggagttggagggatcaagccataaacagtgggtcttgtgagattcctcagaggaggggggccaggctgcaagcctggaaggaaggaggcacagagaagagagggaggagcctctgtgaggatggctgtccggggagcagccatctgtgaggatggctagggggccaagcggaaaaggagagccagtggactggagggagcgctctggactcctctgctgtaaattattaatccctgcatttgtttgtttgtttgtttctgatgcagttgtgtgcattttttaatgggaggctacttgctttgcaatgttgtattagtttctgcagtaccgcaacataatcagctacatgtatacatacatcccc

SEQ ID NO: 41466 - DNA, 2889 bp, Bovine  19866880400898
tggtagccattcccttctccaggggatcttcccaacccagggatcaaactcaggtctcctgctttgcaggcagattctttaccatctgagccaccagggaagccccaaatagagtatactagctaataaagggctttctgagtgattcagtggataaagaatccgcatgcaatgcagaagatgaaggatatgcgggttcgattcctgggtggggaatatcccctggaggagggcatagcaacccactccagtatttctgcctggagaatgccatgaacagaggagtctggcaggctacagtccatgggttcgcaagagagtcagacacagactcagcgactaaaagcaagagcacttaaaatacctaatacaacgtaaatgccatgtaaatagttgttgccaaagcatcacaaattcgggttttggtgtttggtactttctggaatttttttctttttcccaacatttttgatccactgttggttcaatctgctgatacagaacatacagatatggaggactgactgtgtgcccaggaaactatcatcataatcaagtaaatatatccatcaccccccaaattttccatgtgctcctttctaataaggcagagcatactgctatgaccataaatcccccttctatgtgtagaaccaacagaaattaacacatatgttcagtgaaggcatgtattagaaggctgatagcaatattgttttaatagccccaagttggaaattatccaaacactcataaacagaagatggatacatgaattgtagcagaggcacacagcagaaactcatatgacaattagaaagaacaatctccaattacacatattcatatggctgaatctcataaaagatgagagaaacaagtcagatgcaaaagagtatatactatactatttcatttatacaagtccaaagccgggtaaaagtaatctgtgcttttaaaagaatcaggataatagctgtcctcggaggtagaaggggagctactgaaagcaacataacaaggctttaggggtacttataatgaactatttatttactgatccaaacagtgtctatatgaatgtgttcaatttgtagaaatttatcaagctattccttatgtgtaattttccgcaatgtactcccataattttctttttgtaaagttgataagctttatcaaaagttttaagagtgttaccaagatctttctcttttatgtagataccgagaagacggccagttggcagcgttagtacagtgcggtgaattcacaataaactagaaagccagggttatatagcatggtgcatctggggaacgttgtaaccagccaggaatggttattgctagtcacagagctgaaagctctcaataaattttgtttcctccattgcacactgtctgatgattggcaaagaaataaaatatagaatcaagaaagccagaatgccctctgcaagaataaaatgtactgccagtatggcacacagctgtacctcccaccaaagttgtatggagctgatgagaggtccaagctgcttcatgacttggagagcttgtgtgcatccctttgccagaagcacagttagaaaaagcaaacagaaagtatgtttctgctgagatccctgagggaaggaaggaaaattcctctccaaccaagagaggaaaggagaagagagtatcaacttcttgtctttttaatgatgaactctaggaagcaaaggagaaattctttatctacctgaacaagtgttattttcctttagtcctcacataatgcccaagaactacttggttatcagagtttatattaaaaatttcaactcttcttgtattggttttcaattttacaatttctgttaatgacgcaaggaccatagcaagcttcttatacagttttcttgtaacttctatgtggctttgtaattgaaagacaaaacccgacaaaactaggggaaaagtgaatgccaaaaatgaacaatggttaaacacgtcatggcatgtcacggagtatcacagagccatttaaaaagtcaatcaatttacttctagaaccaagatggtggtctctaaatagcattttctaataaaagggagcattcttccttggagaaatgactcaatccagatttggtgtagaaatatactaagtctagtataccttattgtgccagaaagcatggaaaacatcatgaattactggggttttattaaaagaaaacaaaaggagaaaatctgaggggttcccactggccaaggatcaaaccatttggacatccaacaaataatagctgcaagtaaaagatatagatacgaaaatctatgagtccaaagatgtaactgaccatcactacgggttgttaaaagaccaactcagttttttaaaaattgacaagcaaaataaagcctttattctgcctttcctaataccttgggggattaccaatgattgacaaaggagaggtcctcacagaagaatcccagaaaataaaagcagaaacataccgatagattcagaaaatcatgcttcaactctgagtgaaataatgcacataactagtgttcacttctgaatgctaaaaccattcagttcagtcacatcgtcgtgcccgactcttgcaaccccatggattgcagcattccaggcttccatgtccatcaccaacccccagaaattgctcaacctcatgtccatcaagttggtgatgccatctaaccatctcatcctttgtcgtccccttctcctcctgccttcaatcattcccagcatcaggctcttttccaatgagtcagttctttgcatcaggtggccaaagtttggagtttcagcttcagcttcagtatcagtccttccaatgaatattcaggactgatttctttgaggatg

SEQ ID NO: 41467 - DNA, 1573 bp, Bovine  19866880445056
gctgttcggcctgtgtttacatcatcacccaggcaccgccatattgtccaggtatctggacaagtttggccagacttcccatttgcttgctggattttgttttgggaccttatttgtatgttccaccacttaattacttctcttctcattcacccaaactcctatttttgcttctggtcaggaagtcttcctctcccaagtccttggggatgcaataatcaggttgaagtgaaagtgttacccactcagtcgtgtccaactctttgtgaccccatggactgtagcccaccaggctcctctgtccatagaattctccaggcaagaatgctgatgtgtattgccatttccttctttaggggatcttcctgacccaggggcggaacctgggtctcctgtattacaggcagattctttactgtcttgagccacctagcagaacaataatcaggttaagttgctgtttcttccaggcattttgaatgacactctctcccctgagtccattttcagaaaagtaggtcgaagtcataaagaatagacttcctgcgtggagactttactgactcatcatcgttaatcacttccttgggaacaattgggagaataaatttcatgtgactccaggcaggtatcaaggaagatcttctgttgagccctgtgagaatataggtaatttaacagagctggaaaaaaaaataagttttccatttttcaaacctaagatttcccctttcattatagaatctcaataacttccacttttatcatttcagtacatcctgggaaatgattccaaggagtttattgtatagttagaagagataaagagtacttcaatgtggaagggacataaaaaggtgttcccagtctaccacaggcacagaatgttctcagaagtaattccttcccggtgggttggatttattaaaccagaaatctgtggctcaggaaaggtaataagccttgtggacccttcagttctggattgcttttacctaattatgaccctttggctacagcccataataaagagatattcacactacaaaaagtctctaaagggtaactccagacttgacctgtacttattaccacaaatgtttgaaagctctgtgagagattttgacttataaccagtctagaatcttctcttggtagaccagacaattgtccaacgtcttttaggaatagggagcccagaagcaaggcagataccctggcctttattccgcaggtgggatttcaaacaggcccgagctggacatgttgaagtctagcttctatagggcggcatagctagaagctgatggagaccaacatcctacgtttttatatctctggcagagaacaggcccctagagactgagccaccagcaggaatgcctgtaaagcagccagcccagctactgagcaaaggagcccacagtgttctcactgtggagagaccctgatttttccagtcatctctttactgacaggaagcagcatttatccagcccttaaagaataagcatggagctgctgaaagcagagatggggctccatatataaaataagcctattttattcgtgg

SEQ ID NO: 41468 - DNA, 1825 bp, Bovine  19866880500440
tttccctctcgggcacagaaaggagcttcaggtacacattagggacacagagacctggagggaaattcgtctctggaatcgcacagcatcaatcaccagccgacacgccgtttaataggacgtcattaatgagcagcagacacgtccggcgctgctgcagccggtgtcatcactgcctgcctctgagattcatcagctagttaaaatattcttgaaaaagtacatttaactttgctctgcttcaaatcctcctcacgagaaggaataaactatgttgattatctctgaggggatatttttttaaagcttttaacaaatgtttagagcatcctttaaagtgtgctggatggttgtgcttacactcgtctcttcttgtatatcccaaggggcatctgcagacatatacataaatcactcaattttaagcaagtgtatgtggagagctggctatatgctcaggttgatctgagcatatagctcagatcagaactggacccacggtaggtctgacattgcggtgatgctttttctcatgattcctttttttccataccattacaggccagaagacaggcttatatggatactctaaaggaagaagaaaatcaaaaattgcaaaagatgaaggaagagcagcaccagaaggtattcaaagaccatattagcatttggttgcggtactagataatgttgaagagcttgagagcagtaatatttatatacatgaaaatcctaaaaacaaaacaaaacaccacaggtgttaaaaatggtgagatgtgagtatgttttaagagtatggtggtgtgatggcggcttctgttcaactacttattggctcctgctacttactcagcctctgagggctacagtgtgtctgctgtagttggtgccatggtccagggagaagatgatagaacacttgggaacttctttttttttttaactttttattttgtattggagtatagttgcttaaaaatgtgttagtgtcagatatataacaaagtgattcagttacacgcataaacatgtatctatactttttcaaattcttttcccagttagcttgttgcagaatattaagtggagttccaggacacttgggaactttgggtctacaaaatataacaagtgccactgccatttttaaaattaaagatatatgatgttgcaaataatgtccagagaccactataatgcataatggaaaaaagcaggcacacaaaatcgtgacactggcttaaatgttcatctaaaaatacccaaggaatgaaacgacgcactctacacgtacacaaatatgtgaggtgtttccaaaaaacacaatattccaaataaaatgagcaatagaaatcagggaaatgaacactgagaaaagtacttaatgaataagaaatttctgacagggtaactgaaaacagtattgtgacttgatggtcatacctgctttgattcataggctcagaggctcctcaaccaaggatgggagtcatgagagagatgggagtcagctccaaggggccacttcgtcccaggtcctttaaaaaagcaaaaaaaaattattcagctagtgggagaccattatcttccccatatttattttcgaactttttttcttgttctatttgtacttaatatatcctgccatttcttccaggatatccctcaagtctgtttcttcaattattcaattaccttgaattctaacgcccattctgatttccttaatttgggtttggtttttcctcttatgtctttgctctacaagggtagcttattatagcaattggagtgtggaaatcatattataacatattcatattat

SEQ ID NO: 41469 - DNA, 1163 bp, Bovine  19866880604666
catgcttccaacccatcaaggtttctccccctcactggaacacagtcactgggtaggaacccactcctttgctcagactgagctgctctctgaactctgctggagggcggtttccaagctccatgtgaagaagcctgactataatgaaacctgtgttctgttcctgatcttttcccagagagggattctgttcagattctcaagcagaaaaggaagctcgctaatgtaacacctttctgctttcctccaaaaacaacagcaataaaatcctcagttttgccagaagcaagaagccctgcaatgttccgccccttttaatagtgctaaagaaaagcagggttccatctgcttgccatttacctccggagcctggaagccccgcaattctccgaggagcggcagagatggaggaagctgtgtgatggccgcgagggcgtgtgcccgcgcgcagcgtgggaaaataaacacagccagtactaaggtgtctgtgccttccgctgccgggggggggcggggggaggcaaggggagacaggaacggtgtgggcggtccagagagcagcagggcgccgtgttttgctttgtttttttctttttaaaattagaagactctaatgctcgctaccttcccagcccactgttccccgggaacgtgctctgtctcccagttctgccaagatacatatttctcctcctctggaccaccctgaaggtgtgatttgggaatggccctagacaaacaaccccgatgccagccccatggtgagtgcccggccccagagaaagctccaggggggaggggctggagggatgtggtctggtcaaagagcatctatctctgcttaggactctggagacgccatttctactccacacttctggcttatttggagctcagattggtgtggggtgggggagggggtcatttaccaccgactagactgccagtcttggaatggagtagcttgaatccaccccctttaaggctgacctgaggctgtgcccattctcctgatggggaagtaaggccctagctggagaggcacatatagacctcttcttagtgagaccccatgtcccaaatcatttactcaagacatggccataggaaagatcaatgcccggagagagggcaagatcatgcgagggcatcagaaagaaaag

SEQ ID NO: 41470 - DNA, 1148 bp, Bovine  19866880641014
aatgcctgtgaggttgctttctaattgtacacattaatctgcctgtgcaagctggctgaaatacacaagcagattgcacatgcagatggagcacacgggatagcttttatgaaaggacctctggaatgtactcctgcagtactgccttttccttaacaatcgaacgactgtgactatttcagttggcggctgagaacagaccagattaatggtgcattaagtctgctattctggctggggacagactcaaatttcatggtggagagttagttctaggattcttgagcatgaaagtgaagggtagaaataggcttctaaccttggcatagttttcatcattattttactctgtcattcttcactgcttataaagggtgaaacgtgatttttcaggattttttttttatgagtcaatagtactggtagatttaaggatctgaagtaacagttaataaacctgtgtgtgtgtgttgttataatcaaagaaaggatgttgttttttagattttttcaaatttcagcatttttaatttaaatggtaatttattttgagtcacagtcatctttctaaccatgtggcttttggatggatgtcaagacaggtttgaatttggagactatataacgagttatgggggctagggtaaggtgtgaatggggcaatcagatggattttgggtgcaggtgttaggaaaaacagtgctctcgtacggatttgctggaaaaatgagaattgtgtgtgttttaagcatttataattttaattcctatctaataatcatttaatataatagattatacatttgtatggttttaaaaatatagaaagtgcgtggctcttttaaatgctatttcaaagtaatgagctgctctactattgagaacttagggtatttcagccatatgaggcatactatatacatttttcatttaatttttagatcaatcctattagagatatatcatctttattttaggtggagggattgtgtaatttaaattctacccttcctttcgtgcttaagaatcctagaactgactctccactgtgaaattagagtctgcccccaaagtcacagacgcagtgaacgatgcagtccgatcttggtcctgaaatttggggggctagggaaaatgagcatttgaga

SEQ ID NO: 41471 - DNA, 1681 bp, Bovine  19866880680147
tgttctgggggagcacaggcacctctgggccccaagggtggcctgtgttcaatcacaccacaggggcacctgcaaaagcaatcaagagataatgagacacacccacacgcaagtgtatgtcttcgattggggatattctccatcctcttaacttggtgcaccttgacccactctgtgcctccaatgggtgagaagtgagctgggaagttgaattcctgagccccaaggtccctgggctatatccagtgtgccactcattttcacatacatcaccatctgcaaagcactgggaacgcatgacccttgcacccaaactgtgtccttggacttgagcatcagtatcactctcaggccccacccccatcctgctgactagaacctgcttgttaatgtccccaggagactgatgacatccaggtctaaggagcatgaccagagacaacagtaaccagtagcgaaccctcagattagttccctgaggtaatcaagggaaaaggactcaggtgagagaaagaccgtgatcacagcatgaaagatccggctcatgttaatttcatttgactactgaaagcagctgcaccctaagcttgtgaagtgggtgaaaatgagtttagttgctcagtcgtgtccaactctttgcgaccccatggactgtatcctgccaggcttctctgtccatgggattctgcacacaagaatactggagagggttgccatgcccttctccagggaatcttcctgacccagggatcaaacctgagtctcctgcattgcaggcagattcttcacccactgagccacctgggaagcccaaaatgttaccactcccacaccaggagttgaacctgggccgcctggatgaaaaccaggaatcaagaccatatgggaagtgctaaatcttaaaaaaatccaagttttaataaacagttttgaagccactattatatttaatagtatggagcacaaaggaattttgcctgactgcagacacagaaagtgagcaaccacctctgtgattttcagaagattttcctcaactctctctcctgtcccagatatttgcttcaaaaacaaatttactctttctctgtctctctctgtgtatgtgccttatggaactgttctaattttctgagtggaaaactgttttgcatgttcgcagaggcaatcaaattaatactgatccatcatctgtgtgtgctgtgaatgcactctgcatttatctttttggttcattttaaatggcatatgataaacattgcattagactgtgtgccaaggtctatttggcaatgacaagcatgttttagttataaagctctccctccaggcacctagcatcaaatcattgccaaaaacaaggcaaaactcctggacattttctgatggttattgagcttgagatggagtgaaataaactagtgtatgcttctgtttaagaaaatagaatttgatcttctggctcctggactcatttgagttcagtgactccttgagttcatttatctcctatttggaccaggattggatactttggagaaagatggctttacgtttgcatgttcacttggggtctctttttcatacttagttgttcagtcatgtcctactctttgcaaccccacagactgtagcccgccagggtcctctgtccatggggattctccagcaagaattctgt

SEQ ID NO: 41472 - DNA, 2410 bp, Bovine  19866880700680
atatatatctatgtatagatatatagtatccgaatcattttgctgcacacctgaaactaacacaacattgtaagtaaactgtatttcaataaaatttttttaaaaaaatttttaagaaaatagaagataacggccttgctccctttcagactttctgacactcactctagcagcattgggctggtttgaggaaagcaggagcccagaagagggggtaggaggctattatagtaactttggagaaggcaatggcaccccgatttagtacttttgcctggaaaatcccatggacggaggagcctggtgggctgcagtccatggggtctcgaagagttggacacgactgaccgacttcactttcccttttcactttcatgcactggagaaggaaatggcaacccactccagtgttcctgcctggagaaccccagggatgggggagcctggtgggctgcagtctatggggtcacacagagtcggacacgactgatgcgtcttagcagcagcagcagcaatgagaaatgatgacggcttgaaggaaggcagtggtcctctggctggaggcatgaggatggatttctgagctctttgcaaggtgcaagtctgcaggatttctctgcaggaataggaaactggctattcattttcagaaacaaccctcgtgtggcattcatgtgctaactcggctgatgaatacactattctcgtaactaggttggagaagaattacaggaagggtatcattaagatgttaaaatgaatgcattacatatgttaacaagtgtatgaaccctgtattatatctggcaaacggggtgttaaatccttgttcaaccagccagatgtccctgcagctgcctttgggattgcagagggaggcagccacctgagaccccagctaggagctggtgccagtggcttccagaagcatctggctagacaaattgctcctcctgtgctctgactgacaggtaccgcatggatggcgcaagtcacatcgccagtgctcaggtgggctctttagtctgatgagaccagactccaagcgacttgacttttctcagggttatctttacagttgggagtatcctcagtgaagatttgtatctgtttatccatatgattttataagaccaaattaataacgttcacttttgaattggaaggctcaaagtcttgttgggggcggttatccagctgagtttgcagaggctgggttgagcgtttgctgtcaatgtttaaataacctggagcaaaattcccatgactgctcaaaaggagctgaaaatgctgacaggtgtttatatttattcttatggagtgcgatctctcctaagtggctctgatatattaagattgagccagttctgggatgtctctcccctacttctctttggcaaaatgatccgaaaataatataagatgttcaggggcgcctggcacaacagtctccccatcacactcccgggaatcgtacttagatgttgaattaaggcggaagttgaagagaagccatcctagagaccacagttacacaatcctattgatcttttgtgtactctctttcttgaaggagaaattgtgaaatcccaacatttttctctgagtgaaataaaaagtggaaattaaagaaaaaggaaatatcataccggttgttttcttgtccaaatgtactgtgacggcaaagatgaaaaagtcagtgcagtctaaataggaaaataccacaaggagattttcaaaatgtttggtaatttcctcatcatctattgtttttagaactttgtggagttggggcagaaggcagtttgaaacctgcagtctggcttgtcaatgttagacagtgtccactaggtggcagcatgtcagaggatttcttttatccttgaattggcagtgatttctttggctgtctaccagtagttcggtttttcttttttgtcccgttttgaagggttaaatgaagctctcacaatttagacgcaaattatgcttatttaaaaatgcataaattagctgaaaagccttcttgttatagtgtgaccataaatataagttcattcatgcatgggattttcctaggaacttacaggtaagatcctaccagtcctgagtaggttttggaagccagcgggtaggtctctttgtccttgaatgtgacagacgctaaacatgctctcttctgagaaggcagatcgccgatgttcctggggaacaggacgctggtttttctttaggagttctcagccaacagaagatagggcggtctgcccagctttctcaccctggagactgtttctggcttctgctggaggctgttcgctgggaggcgtgtcaaacctctctatacttctttatgcatagctgtgggcattctggagacaggagggagacaacctagattgtactgtgt

SEQ ID NO: 41473 - DNA, 1293 bp, Bovine  19866880706041
tgggaagcacctctttacaccaatcttaccattaaaacctcacaatcctaccttgaaagtccctctctgtagactgttgagtgaagcggagggtgtccggtcagaacccaagtgaccaccacagctacatttcagatttgtgtctgatcttgtctgagatcctagagcgccaggcaggtggccaagatccagcaggcaccagtttggctaagaggtttgcatgactttgtgagggtattcctggcttacttagcctgtggggcttcccaggaggcacagtggtaaagaatctgcctcccaatgcaagagacacgggtttgatccctgggtcaggcagatcccctggagaagggcatggcagcccaatccagtattattgcctggaaaattccatggacagaggagccaggcaggccacagtccatggaatcacaaagagtcagacatgactgagcatgcacgcacgcacaatagcctgtgattacaaagcaaggtcatatttccctttcagaatccaaattcttattgcaggagacctcatcctgcttgcctgcaggaaatggttctttctcaaagtgtcctcctgccatttctagaagtccctagagggtgtctcatctgtattcacaaatcaaactggcacctgctggcaccagaatgtgcattagccggggccagcttggccatgtgtcagaggccgtcaaaaactagcctatacaagagaataattgactcccgttgttaagaaggaggcggaggctctaagccttagcaccatcttctgagaaacctccgcgtcatgagagcgaagcagaggaagaagcaaacgcacaagctgaagtgccaaagaagaaagatgaggcagagggccaaggagactttatacccacagaagccacatgaacagaaacaagggaagccagaggccagggatgctggtatgaactgttgcattatggggctcccctgatgtctcagacagtgaggaatctgcctgcaatgcaggagacccaggttcaatctctgggtcaggaagatcccctggagaaggaaatggctacccactccagtacttttgcctggagaatcctgtggacagaggagtgtgacgggctacagtgcatgaggtcccaaagagccggaaaagactgaagtgacttggcatgcacacatgcatgcctacagtctagaacctgtctcaatgggtttggaacatctggagctattttgacggcctcaactgcctttgagagacccaccttgctcatatcaaagcagtcctctggtccttta

SEQ ID NO: 41474 - DNA, 1811 bp, Bovine  19866880750832
ctgtaacagtttttgcctgatctcaaagaaacatgcagtattacattatcctgatggaagataatgcattttctgttgactaattcaggatacttttcatcaagtgctgtttcagttggtctaattgggagcagtacttgctggaattaatcatttggttttctggaaggagctcataatagaggactcccttccaatcccaccatgtactcaacatcaccttcttcggatgaagaccggtctttggtgtgggtaggggtggttcactacatttgccccctagtctcttccattcacatcattatacagtatctgtttttcatcacctatcacaattggttttaaaaaacagaatattttcattgtgtttcagtagagaatcacatgaagaaatatggtcaagttgttttttgcttaacttatatgcaacccaaacgacaaagtgattaacataactaagctggtgcaaatgattttcaatgcttgacttggatattttgagtatgttgtctatctcctgtgtggtgtaacactgattgttttcaattaatgtctcaatttgacctctatcaacttcaactggtctactcgactgtggatcattgtgcagtgagaaatctccagcatgaaactttgcaaaccacttttaatgtgtttgatcagtcacagcacctgctccatacattacacaaatctttttgtgtttcagttgtgttttaactttttttgaaataataaagcataatatgccgaaaatgttgctttttctccttccatcttcaatattaaagtggctacacaaaaattcactaattttgataagtattttttaaatgcatgctgatatgacagctgtcacaacacaatctaacaaaattgtttcaaataaagttaaagacagctaaatgttactacagccatcttatggaaaacaccaaacttttttgctaacccaaaagatttggtctaaatttgcatgctgctagctcacccagagattccagctgtaattctgctggatgttttagcttctaagtcttactacttatagccttggggaaatcactcactgagtcttagttcccacgtgtataaaagaaaaagcttggatttccagactttagacctcatgctaatgagtcagatggtgcagtggcaaagaatttgcctgctaatgcaggagatgcaagagatgtgagttcaatccctgggttgggaagatcccctggagaagaaaatggcaacccactccagtattcttacctggaaaattctgtggacagaggagtctggcggattacagtctatggaactgcaaagagtcaaacccaactacacaactgagcacaacaatgagttcatagatacagattcaaagttctttggctaattgggattactgctgggaaatggtaacctcacaatgaccctgtctgctgtctggtcgaagtataatccataggaaatgctcacaaatcctttgctcctaaaactcctggtagtgtagacccagggcagtgcagtcatcactctccaccactgtcatgggcaactggaactttcccagaagggtgtcagcactggtcctcagggtgtatactttctaagcagtttccagaaagtcttcttcattaggcttgaggtgagaggactagcaaccttcctcttggaggaattggaagggaggagtgttggagaattagcatagcagtagttatcaaatgaaattgcttcgaaagtttctctcgctcttatatcctttcagagtcgaaggggcttccaagaatattgaaatactacaagcggggagg

SEQ ID NO: 41475 - DNA, 847 bp, Bovine  19866880755704
aacactctaataattttagatcctaaattatgctaatttgattttaatgatttagcgatttcctgtttgttcttaaagatttaaaaatagccagcagtgctttagttgaggcagttttgtttaatgtctattgtcacggaaactacaccctcttaacttttaatcattctcaacctggttgattccacacaccacttagggctaatgtggaaaggtaactgtattcagattctgatgatgccttatctgcacagaagagatttctgccggttggcactcagctgcagccattttccaagtcctgtcattttcatttctcagcatcacttgtatgatgctccctagctgagggcatttggacacaggtaggctctgcggggtcactcccaggggactttctatcagacgcgataaggaagaaataattgaatggcagcacgtctcctttgcgccactttggttcttttggagaaattgtactctttccgtctatcaaagtaaaccccccaaacaacttgtctcctctgattatgtacttcaggtcttaaacatatcagcgtcaagcttgttacctccactgcagcagatgatttaggagagctgataggtattgtttgaaatactgtgaacagaggatgctttgttagttacttcctgtctgctctaagatcgcctttgctcacaggcctcctggaacatgagatggatattaaaatgtcttagatgcccaggagagtgttcctagcttcagtggttgattcagagggatcctgactcagaagcattgttggcatctaaactctagactatccaggttgcactgcttagcacgacatctgcattaatt

SEQ ID NO: 41476 - DNA, 1857 bp, Bovine  19866880771719
acactagagcccatgctccccaacacgagaagcccacacagcaaccagagagcagtccccatgtgctgcatctacagagaagcccacgcagcaaggaagccccgcacagccaaaaatagatgcatacatgagattaattcaaaggattactctgctgtgcggagacaggtacagagtagaggcaggagaccagtaagagggcacaaccataatctaggcaagagacaggggtggtttggagcaaactggtagaagaggaagaagccagagccgtcagatttggggtggatatggagagcagaaatgacctttgcttggactgaatgtggaatgtaagaaaaagcagggagagatgacgcggtaaacactgccgtgttcagcacagggcccccttcagcagtaaggcacttgctcctcagaccccagggctgcttctggcagacagcactctgctgtcaaactccagcaagggcctcggctgaagaatgccacacccccttcccagggcagcctctagctgacgaccggctgacctcatggtacaaacactggagttctccagggctcagtctgtgagctccttttctatatttacttcccaggtgatgtcatttagtttcatggccccttgccacaacctgggacaaccacgatgagtcacctgagagtcagagcccccaccctgtgccccccaccggctgcctcaacccttgctaagactgcactgcagcctaaattatccctccatccttcttccctgttttgccttctgggagctgttgatcctcagagcattctctaataaactaacagcttgctaatctgtgtctcattctgctttccagagaacttcaactgcaaatgactgcaaggtttctggcctaaactgccaattattgacttagaggaggaatggttatttgttttttgtgggtaatggatatcaggagattggttttggttatattaagtttcagatgtctactatgtatgttaagtggaggaaatgtctgacctggggataacattggggaattatgagtacacaggcggtatttaaagcccatgagactaaacgagatcacctggagccggagtgtagctaagaagtaggaagactgagccccagagactgcaacattcagcagcagagaaaaggagggggtcagtaacagacactgggtaggcccggcagtgcgggggaggagaagcaggcgcccaaagtgaccaagtggaaacagtttccagggcttctgacaggccaaataggagcagagctgaggctagacctctggatttaacctttgctggatggcatcactgactcgatggacgtgggtctgggtgaactccgggagttggtgatggacagggaggcctggcgtgctgtgattcatggggttgcagagagtcggacacgactgagcggctgatctgatctgatctgaaacctaaggctaagtgaagggactgggcatgaaggtttgattagagtgagtttaggagagaacaggaagaaaggaatgggagacagcagagacacaactgttctcaggagctctcagagaaaactgtatgcgtgaactcaactttaccaaggaaaaacatacatacatgactgaatgtgcacatgtttctaaaatgtgaactctttcctaaggaatgataaataagtacgtgcttgcataaaacaaaatctgaaagtatataccccctcagtgttattttggggtggtggaattatgaatattattttcttcatgttcatttatactttctaaattttcaacaatgaaaatggttacttatacaattttttttttttaaaggactaaataaaggaaaccaaggaaatta

SEQ ID NO: 41477 - DNA, 1940 bp, Bovine  19866880778741
tgttactggtttttagactgagtcatagttttcctcttcgactcaactgtctaatctagaaatacctgatttcttgtgtgtgagctggctgtgcagtatagatccatccttaagaagtctatataaagaagttaaagacacagactcaaagagaacagatttgtggttgccagaggcagtggtgggacagggacggaccgagagtttggcattggtgggtggtttaggcgcgtccaactctgcaaccctatggactggagcccaccaggctcctctgtccatgggatttcccaggcaaggatactgcagtgggtagccatttccttctccaggggatcttcccctcccagggattgaatctgggtctcctgcattacaggtggattctctactgatggagccaccaggcaagtttgggactagcagatacaaacaattatgtgtgtgtgtgtgtacatgcaaatagggataatggataaacaacaaagtcttgctgtatagcacaggaaatcatattcaatataatagaccacaatggaaaggaatataaaaaaacacatttatacacacatataactgaatcacttttttttttcatacaccagaaattaacacaacgtggtaaatcaactacacttcaataaaaattttttaacaagttaaccttccaggttctaacctcaaggccacaaaaggctccggtagcccccatatattcctacttctgaagagagcttctgcgccacccgagacccctgtgcctctcatggcgacagctcgcacagccttcagtaacttccactagcgtgggcatcccgacagctctctaagcctgctctgcttgtccgtgcaaacagggcactgcctcttaatatgaacatcgcgagctctaagaaggttaaatagcacaaatggctctgctacatcctctatgggtctatatccctgccatctaatcattttaattccttttccattcattagaaaaggggaacgctcacagaagaggatccctgaattcatataagtctgagtaatagcccttaaaaaatgtataaaagatttcaattctcctcactttctcttctcagtcagattcaactaatggtacataatagagggagtcaacgtcttcctttaacacttacaatatgcaattttgcagctagagtaagaaagaagtagaaattttctgtctctggcatggctgggatttgtggtataatgtagctgagggataggaggtgagttctgtcctggatttccactgttttatcggcagtggcggtcagtctggatgagtccaaggctcaccaggagctctatgtggtcaatcagtgctggggcatgcgcaggtatgcccagcacagcaagtctgccactcgcttcccacccttggcacagtgctttagagaattcaggggctttaaaaaatgttttagccttatttttggccatgctgggtcttttttgctgcacatggactttctctggttgtggcgagcgggggctactactcttcattgttgcgcttgggcttctcactgcggtggccactcttgctggagagccccggctctggggtgcaagtttcagtaacaccagcacacaggcttagttgccccctagcatgtggaatcttcccgggccaggaatcgaacccacgtcccttgcactggcaggcagattcttaaccactggaccaccagggaagttcagagaactcaatgggctttagagcttgacctggcttagctgcttaccaggttgttgtttagtcgctaagtcgtgtccgattcttgcaaccctgtggactgtagcccgccaggctcctccgtccatggaattgcccaggcaagaatactggagtgggttgccatttcctcctccagaggatcttcttgactcagggatcgaactcacgtctcctacaccggcag

SEQ ID NO: 41478 - DNA, 708 bp, Bovine  19866880795291
aaataatcagaagcaaatgaacaagcctggaacaaggtggtaagaaagagcacattaagattcccatggtggtgccccaggatactatcaggagctttttctccagcaacttggagttacagtctgctcaagtctatggttgcccttttctacagaaaacaaagcaaagaccaccactcccagtctgatatttgaatcacacatatcatggcatcaaaaatatttcttatttgtgtttctattttgtgatccttcatttgaacaccttcagaagaatctaactttggggtaagaagatggaatagggaacagcctggttggtctggtgaaaactttgtgctgttaaaattctgacagctcaggggagacttccctggtggtccagtggctaagactccatgctcccaatgcagggggcccaggtttgatctctggtcaggaaatgaagatcccacatgctgcaactaaagatcctgcatgccaccacggaggtcaaaaatcctctgtgctgtaacgaagacctggtgcggctaaataaatattaaaaaaaaaaaaaaaaattctaacagctctcctattcagtctctccaccataaattgagtctaagaaaatatgataaaggcttgttatacagaggatccatcttttccaagaagtttctttcatatttctagctatataatggtcattcatttcattagctacta

SEQ ID NO: 41479 - DNA, 1243 bp, Bovine  19866880813821
acatgactcctactcacatactcttttaactcaataatttgtcaatttcacacacaatacatagatactgttttgattcctttctatctttgcacattgtctctactctgaatgccttagtgatacacaggagcatacattataaatagacacacccactatgcattctctacaatttgcctacatttaattatcttcaatatatatacgtttgtgagatctatccataaattttaaccactagatgcattccaaggaatcacgcatatcaaatctctaacagattattttctcaaaaatgattttttgtccaccaagtatttattaaggggtgatctcctctagagttaccaggtcagcaagtacttgattattttctcattttttaccagtttaaagatttctgtctgttcctttttttttaaataagtacaaatatacttaggcttcaattaaattgtaaaacccactgtgcttagttttaattctgtacacattgcaaaccccacaatcccatacattccaaagctttggtgctgtttaaataatctactgtgcacacaaaacacattacacacatattacaacacagtcgcagggctttcttccaccaaatctgtaagaacatttcattttcaaaaagtgccttttgccatagggtttttttaaaaatcattttgtagtgaaaaattaaatactgatttctttgatgtgctagtttcactgaaagaatatgttacaagagaatgcttactatttttagaaccatatttcactgaaaatcttcctggaaaaaaaaaaatgttccttggtttttattgtatgcctgggcaaagggggatttttttttttttttttaaagacttgcagtccaggcaatcacacagcaaacaaagggcaggtgtcattttttattgtgattggcattgggctaaagctgaaatcaggactttctccatctctcaaaagctattgtggaatttacagtaatcaccccagctgcctgcccaccacacagctgaatggcacaccaaaaaaatatttatctagagagaaggccacaacatattttttaaattctcattgtttttattcttcaacttggaaatatttattttttgagaaaaaaaataataaaactcacccagctgttaccactattcatattccaataaccaccaaagtgctggaggccacctggttgacttttgccttggagtcggtccaaaaaagcattatttac

SEQ ID NO: 41480 - DNA, 766 bp, Bovine  19866880832117
tctataaagggatctagattttaaccatcaaaatgtctcacagcattgacagcaatgcttcatttcttttagttcctccaaaaggcgttaggcatgagcccctcaaataactcgtgagatgagatctgaaggtacatcaagtggagaagctcagggaactggcccagaggggacttgtgatgggagctctcctgtgatgtacaaattgtgctgctaaactgctgtgcttggttttataggagaggcagaaagggggtccccagatcagctctcagtgtgtaaggtcatcttcactgtaggggagacgtagttggcacagggtagccatcctgataagcaggcagtggggcttggattcacgtgtgggtcacacactaacagatcctgtgctggcagcaccgccaggatgtcagcagccccggaggacagaaggtggtgtttctggttcactcagctctcagctttcccctgccctgatacctcgacttcctgtagctcttgttcatggtggaaggcagaaaggagacttgaactccaggtcagccttgtagccagctaccagcggaatgagatagcttgtgaaggaagagaagtaggcaggaaggagcactagtacagaaggggtgaggggaacagtaacccaactttacctcccagccctcccactcaggtggccccgaccagcctgtgtatcttggcagccttctctctcactgtcctctttgtgttggtgatggtgatacggtgagtggagatacagtagaag

SEQ ID NO: 41481 - DNA, 873 bp, Bovine  19866880839681
atttttgaggattaattggattataaagctttaggcattttaaagatagtgatatgtcacattaataggcccctctactaagaaattaatcttcagtgggcacccaataaaaatacattatttgattagaggtcaaaaagattactttttgttataggaactttgacctttatttccttattgctgaatacctaaatactgatggcactatttctttccttcaccttctattctttctattgattctagttaaatatagatcccagtttaatccaataggaaatccctctggataataaactcagtaaccagttttgaaacaattggtcaagtctttatacatattttatttatactatcagtttttgataaaggctcatgtttgtattgtcctttggtgtttacagtgagctcttccatcttttcatgctcattcagttgtcacttaaagaataaaatagctgtgtccattcctgctgagggcagcaatacaagctatgtggtttggggaaaggggtcgttaagttaggttttctccagggacataattttattggagacaagaagacgatgtgttttctactgtttggaagttcacatagcagaaaatgcagccctgagttttataatagaaatcatgcacattcctaacaagctttacaaccaaccctgtaacgattgaatctgatggcacctgaacctgacccagtgtaactttctgaggaagagaagaaagttaaaacttcagaggaaaaaacagagcgctgggggtgaaggacttgaactgggctgcaagctggaaattggaatgaactgaattgatttattgaaacatgaatcatctctgaacaatagtttttatccaagttaagc

SEQ ID NO: 41482 - DNA, 2551 bp, Bovine  19866880872632
ctttctacttaatacttactataaaaattcttttactaaatatcatctcctttggtttttgcacttgctattctttcatgtgaataaaccagagactaaactttgaaaagaggttttgcttaaaatttctaaacagcttcaacggttactcaaagatccattcaactaatttactttgcattgtgggctttcagagtcattgacttagaaacgaatgtgttttaagggcctacttgaagctttctgtctcctaaacatcttccatcccttccaggtcaagtgtgtggccttctctgattgattgcagggggatcaagcacttatgtctttcagatgattgacaagttattgattgtgtctactggcaaagaattaagctctaaaatgtttccaaaagaatatatatttttagatactttcagttaaaaaaaaagaatgtttatgtttgttatgagccagtagtggttaaagaattatttattctgagattgtatatttaagagaagtggggctgttggttccccgtaatgtgcttactaatatcctccagtatggtggcattgtgggagggaatggatgcagaagtgttattccccaatttttgccttctagctagcagcatgggcttgaacatcccttaatctctctaaatgtcagtgttatcatctacaaaatgaatggatttttcacatgccttttttgggtatatgatgtaatgtttttatgctgttgccaccaagttgcttcagtcgtgtccgactctgtgcgaccccatagacggcagcccaccaggctcccccgtccctgggattctccgggcaagaacactggagtgggttgccatttccttctccaatgcatgaacgtgaaaagtgaaagtgaagttgttcagtcgtgtccgactcttcatgaccctatggacttcagtctaccaggctcctccgtccatgggattttccaggcaagagtactggagtgggctgccattgccttctcctaatgtttttatatacctgtttaattaatgaagaaccctatctctctatttggatcacatttttaactaaagaaagatgcttttaatcaacagttgtcaataacagatgtgttgacaactggagacatcttgtccatatagctgctcattcagccaacattttacaacacttggagtttcagagagttcttagacttcttcaaacccatccatatactcatagttaagaattcctgctctagtaaaagtatgatgatttaaggaatattgcaactacttgagggaaaagaattcatgtatgttggagctgggagataatcataaatctgaaaactgtcccttcaaagggaaggttgttttgcttcatttttaaagggaagaagataatggattttgttgttgtttatttttacaatggtttacatattctgatttctaactctagtagttttttttttttttttcaaggaatatttatttatttattagtctgcacagaattttagttgtggcatttgggatctaattctctgaccagggaagtgtgagaatgggcaggctttcctggtggctcagaccataaagaatctgcctacagtgcaggagaccctggtgtgatctctgtttctggaagatcctctggaggagggaatggcttcccactccagtattctttcctagagaatcacatggacagaggaccctggtaggctacagtccatggggtctcaaagatttggacacagctgagcaactaagcacctgagaatgtgcaactctcagtttgcctcctcttcttataattcttcaccatatttgctttggccagctcacccttgagtgttatataggtggttaaaaaaattgacttgtctacccagtgcttctgaaattcatgaatattctccccgctaccaccctaccccaaatgacttttctcttggttttgccaccagctggtaaaacaaaagctagaacttcaaatgtgtgatctacgataatttgttacatatttcattatcaccttgggcagagaaagtgacaccagaaaaattaggtgtggaaatgactggaagtaagttttttgtaaccaattttaagtgagcattcagatgtactttggtaaaaagtaaattttgccttttctttgagtgaaaaaatgttaatgcagtaaaaatgtctcagatctttgatctgatgcctttagaataccttttaattagattatagttgtaaaaattactggagaaaaaggctagttgttatgaagtcagtaggagtggtgttagtcactaagttgtgtccaactctttgtgaccccgtggactgtagcccaccaggctcttctgtccgtgaaattctccaggcaggaatactggagtgggtagccataccctcctccaggggatcttcctgacccagagatcaaacccaggtctcctccattgcaggcagactctttaccatttgagccaccaaggaagcccatatgaagtcagtgaaagtgaaagtcacatccaactctttgcgaccccaggactgtagccttccagg

SEQ ID NO: 41483 - DNA, 1257 bp, Bovine  19866880882185
gaaattctagcactgatctttccccctcattttcttcctctctctgatagtcatacatttgaagacttctactactaagttcccccaaccccagcccctgcagcagtatcattatcagtaatatagttggaatttgggagcaagagtgtagaattttttgctgcttatatttatgcttgcattgtcccttgtttcttcaaaggaatttagcgctctgcttatgtgaagtgctttaaatgttatgagacgaaaccctgactgccaccccaggaaagtgaactgaagcttgatggaatttactaaagggtgttttgtaaagcagtggttaggaaagaacgctgctctcccagagatcccacggctgtagcatgagaacttggagagctgctaaaatgattaaaggtttacagaatgagccctgtgaggaaagcctggaaattgctgggagaagtctgagggattcgtacttaattatatagtcttctggtgctgtgtacttattcaattatgcattctacaaatatttatttaccacctgtagcgggtgaggcactgtaggggtcctcaggagttccaggtgtgaaccaggcacggatcgtgacccaaaggaacttgaatttagaggaaagataaaccacaggagtactattagagaggcacagatgataggcaaagaagttcaaaataaaagactattttacactgggcatcaggggggcgtgtcatagaatcagtagcgtagagctgggctttaaaaacaatgagatataccatatgatgggtgagtcagaattagcagaaatagggtatattagttcattggagtgcagggtttctccaaagtaacggatgaacacacagtctggaagggctggccctgtaatgtgcagtgcattcaattattttttttttccccctcaacacagcccctggttatcatcacttttctaaaagggagaaaagagagagtcagaataccagcatatttcttgtactgctttacgacgctgggctcatcccaggtaaacagaactaccacgtttcatctgtcttaaacgctcttgtaatagtctagaggcatctttcattttacgacatcctgtagttgggagttctcagcattggtgatactgactcattgagctgctgattcctgcttgggggggggctctcctgtgtatggtaggatgattagcaacatccctgcctgcacctacgaaaggccaggagcgccccctctgttgtgacaaccgaaaa

SEQ ID NO: 41484 - DNA, 1058 bp, Bovine  19866880903246
actatagaaagtgtataattatccctggttcttaaatacacttcaaaatgttatgaaaacattatcacctagaaatatgttacttgggtcttttctaaaggaaatgtctgtttctaaatggaccaggctcatgtgctatgaaaaaagggctgtgaagataggtaacaaaacctggataactaggagaattatgaatgaagtctcttctccttagtgtgagagataacagaatcctatccaactgaccactcagtcaaatcacaacatcacccagttttttgctgatgtgcacagcagggtggtctgagacgtccagcttctgtattttactgaagatctgagatctgattggctgaatgactggctgtaaagcagtgggtcacacgggcagaatttctgaagtatggttataattcagttgcaaaagcattacgcacattgccaccatttggcagagatgaatcagatgcccgctgtgtaccaggcacctgctaggatctgcaaattaaaagttaagtaaaataaaattgtgactgtcaagcaatgcaatgtttatcgaagatgaaatgcttgagtcaagtcattgttggaagggcttgagatggattttgaaaagagtacaaacaaatgaatagattggccaatcatccttacaactttactccaaactgaacaatttttattgggaaatgtaacggaatattttcggacctttttctcagaaatagcatggcatttgggaatgttattttcaatggagatgactaaccagtataatcggagaaggcaatggcaccccacaccagtactcttgcctggaaaatcccacgggcagaggagcctggtaggctgcagtccatggggtcgctaggagtcaaacatgactgagtgacttcactttcactttccactttcatgcactggagaaggaaatggcaacccactccagtgttcttgcctggagaatcccagggacagaggagcctagtgggctgccatctatggggtcgaacagagtcggacagactaaacgacttagcagcagcagcagcagcaac

SEQ ID NO: 41485 - DNA, 1035 bp, Bovine  19866880953186
atttaaataataatgaatttgtcacagaagtacattaagagccctatatgcaaataaggggcttccctgggggcccagtggtaaagaatctgctaggcattgcaggagatgcgggtttgatccctgggtcaggaagatccccttgaaaaggatatggcaacctgatccaggattcttgcctggagaatcccatggacagaggaggctggtgggctgcagtccaatggggtgctaaagaagccggacatgacttagtaactaaggaacaacagcaacaacattcaaataaatctctccactgacttcaggtgaatccactgttttctaaatcaatacctgttgcttagaatgatcaaaggcaaacttttgttagttcctccccatgcagatcatctcagagtaaaattattatggagaaattagggattcataaggcaagacagagagggttttttgctattgttcttgttattgggatttttattaaccacaagctcatacgactgcatttattgagagtgcctaactgccttgaaatgaaacatcacatgattctaacaagtgtgctctgtctagctcacccaaattaggaaggcttccctgtattcattttgtctctttcacaagcatccttgaggttctttattctgaattacttatgactgtgtttcaggtattaagagcacacttgaaatttacaatttttctaaattcctaacacttattagctttgttttctgcctagacctgttaacctaattttgtcttcaacacttcgggggataatacactgcttgtttttaaattctgcatagctctttctacattcagaaccccaaattcaagctttagtttactcagtatgaatttgatgatcctctgctgctgctgctaagtcgcttcagtcgtgtccgactctgtgcgaccccatagacagcagcccgccaggctcccccgtccctgggattctccaggcaagaacactggagtgggttgccatttccttctccaacgcataaagtaaaaataaaggga

SEQ ID NO: 41486 - DNA, 1364 bp, Bovine  19866880994049
ccagctcaatgcttctggatattgtgtctcataccacaggatcttttataatttaacttgacatcttattaatttccagtgaaatagttcgatgcagttgtcctgattcacagaaatgatgccgagaactacgcagaaaaataaagtagctattatcgcagtcaccatgattacttccacatggttcctgtatatcctgagccgcttcatcctgggaataaaaacaaatcacaggaacagttacaaaacagtgtttctttggctctcgataatagcgttgtcagattcctccctagtacttcagaatctccagtgaatgtctcacttatattctgcaagcgagtccttttgatcactgctgatcaccagcaagttcattctgctcccaccccagggagggcttccagtggctgtgcctccacatgcggtccctatgggctgcttagagttgtgatttctacccatgcccattcgagggtgacagagcctcacatctcgggcgcttagctgcagctcaggagtgagagcgatcttctgtacactgatacatgctgctgggtaaatgctactcacatgttgcatttctagtacaccactgaggtttcagatcaactgcttcttctttgttggcactgcattcattgtcatttctctaccgaggactcttgctcacctgctccaacagtccctctgtattcagaggggatactttgttattctcagcatcagttctttctacgagtagcattgtcccttgtcttagaagatccttcttgatccttttccttccattcttagcttaggaggctccttggttcctcttgtctacgtggacaagtccacggatgatccctccacatgccaggggacacctgacttcagggacacatggggcttcaatttgggacataaataagtacatgcctgggaccaccccagccaaaaggggggacaccttagtgcttatcacaattagatcttaaaaatattacttcccaaacatgtaagattatgagtgaccagaataatagacaagtgttacgggaggtgttatggcaccactgactcaatggacatgaatttgagcaaactctgtgggttagtgaaggacagggaagcttggcatgctgctgtccgtggggttgcaaagagtcaaacatgacttagtgactcaacaaagcagtgttatgggaagtgatgacgtactttgaaggagaaagcttgtcatgaaggcacttctctgccctctctatcattctggtctgggatgtgtatttttcttgaagaaaggtttatagagttgagaacctatgaagttctttttttttaagtgaaactttttttaatgaaaaaagtgaaagtgc

SEQ ID NO: 41487 - DNA, 1136 bp, Bovine  19866881099330
atgttattgcaatatattttatgactctattagtacatgttataaaatatgtacttatgaacaattactaccacaatttgatatacccaatccgttgatgtaggaatttggagcaacagtgtcatttttagtgaagaaattgagatgaataaaaaggtgaaattcaagattctatagcatgtgtgaaatgaaatgatccattttaaagactggatataactacactaccatagatatacttccatttaggacaaactattccacttataactgttaggaatacattaaaactagaaaattaaagtcagacaaaaatctcttaacaaaatgtcaactgtttcatccacaaagaacagcatgaagcttttttttaagcctcttcttttttgactaatggtttaaaacccatgctaattttcaataaatgcaagggatgattgcagtcagcagtttaaaaatgagaaaatgaatgatttaggaggcagactgtattaaaaaaacatctagtccctgttgaaattatcaaagccaacacagatatgggcgggggagggaatgaaaaggacaataaaagttggtgcagaacagacatactgggaaaattttatagggagaaaaagataaatcaattaaagcaggaaccacactgtttattgtgataaatcatattaatagaattcttctgaacaagatattcaattgaaggaaattttatttatttatataaataaatcagggttttaattgactgcctttgcttctggatgcaaaaagacaatgctgcacattcatggctgggtctgtatcaccgcagacacacgctttggcagggaactctgtgtgcaaccagagccctgtttatgaacatgcccacagcaggttccgaagaatacaacatttccaaagaggagggaagcatggaaatcacagctttgctcagaatgacattctaattactctcaattaacataaagagggtgcagctttataaagactagtgaaagcagctccatattttcttgagtgccagtgagggagtgggtcctggggaaggcactaaagaccgtggatggaataaagtgcttctgcttagattgtctttgctgtttaccttccggctttgcggctcccactct

SEQ ID NO: 41488 - DNA, 671 bp, Bovine  19866881164518
gagggagaagttttgaggagctgtaggtagtagggtaatcccgtgtagagatgctccttgacatatgtctacacggccttttcgtgatggaggaggggaggcaagaccggagttggatagctttaccacctgggtgcttggctggcaggacggtcttgatttctgtttgaagggtcttgaatcctgtggctgaaacacctgtgtgcttgccctattgattttggctcatttcttcaattgaacaagatcctcctggaatttcaatattgttgtccaaggcattagtaatctctcccagagctgcatttcctgtggattgattagtgccttagtcgtaagatcctcaggctattaatagaaaatatacagcaggattgcacccaggatggctcctcaccaagagcattcaacagcggcttccattttgacaccaaactagtaataatttgtgggtgttcaatatatttcctgacttgttacccatattgtagtcttctcatactgtctaatccatatgcatggaattcctcagagaatgcactgcagaaccattttttaaatgctttaggaaaatcaaatatgtacattacaccctctgtgaatttaacggcagacaccttcagtttgccttaattatggtcaatgcgcagaaggtgaacactgcgtgatac

SEQ ID NO: 41489 - DNA, 1466 bp, Bovine  19866881179014
acaccctctcaccagatttctttgccccagcctttccccactcccatcagttctctgcaggacttaacacaagtgctctctggaactacagatctacattccacatgtaagtgatatcacatgaaacttatctttgtctgtctgacttacttcacttagtatgacaatttctaggggagggataaattgagagattggcattgacatatacacactaccatttataaaacagataactaataaggacctactgcatagcacagcggagaaggcaatggcaccccactccagtactcttgcctggaaaatcccatggatggaggagcctggtaggctagcagtccatggggttgctaggagtcagacacgactgagcaacttcacttttacttttcactctcatgcattggagaaggacatggcaacccactccagtgttcttgcctggagaatcccagggacgggagccttggtgggcttgctgtctatggggtcgcacagagtcggacacgactgaagcgactcagcagcagcagcagcagtgtagtacagggagctctacgtaatactctttagtggtctacatgggaaaagaacctaaaaaagagtggatgtatgtggttgtaaaactgattcactttcctatacacctgaaaagcgtacagtattgtaaatccagcatacaccaataaaaatgacaaaataaccccacaaacacacacacacaaaaacaagtaaaaaactagagctctaatcataggactccccagcttaccactcttcagccatatcctatagcgtcctttatttgttagtgtcattgctactcatcatgctgatttgtatttgtttatccctgcctctctatttctcccactaggctctcatataggagagtgaggtctatgtattgtaatcccagtattcatcaccacatctggcttgataaatccaagttaaaagagagatgcttcaggagatgaaaggatttaacaaatgcctcttcatatctgggcatattgaagaggataaaggtgttcctgggaggattaaacaacccaacaaggaagctagacaaaaaatattcagaggaagcagagtggaattaaaatgagtgcaggcatccatgagtgagagaggaagaggacagctcatgtccccatgagctgtgaagctaagctcttctcagagtggcagggaacaggggtgtggagagtgaactcagagcttcagaaggaactgcaaggtaggaactgaggatgaactccgatacctgtgagatttaagccatgataaggcaggtggcacttccacagctaatggggagttgtgattctgaacacgtatttgaaacacaacaaatgtcacactaagaaacctgaggtaagagatatatgtccactttaagtcaataacagggcttccctggaggctcggatgatgaagaaaccacctgccaatgcggg

SEQ ID NO: 41490 - DNA, 719 bp, Bovine  19866881221263
acacacacaaccctgtccctatctgaaaaacctctcccgtgggcccttgttctctcctatcagatggacacatgtattacattttaaatagaactcgctctgccatacgaagtactagccttgaagatctgcagtccatgttgtaattttgaagaaggaaattggtgaaatgacaggagaaatatggcaattcacacacaaaattctttctcagtttcgttctctcttctccttatttgtatccctggcagtaacctcattaggtcaagggcttcaggcatttcatacagaattggtggatgttttcggcgacagtggtacatgttttagcatctggacagtgattttccctcctgtttgtggtgaggggagcagtagtttccatatgtctgtaatttttaaattgaaaagttaacattacacggtgaattttgcccaagggaagcctttcaagcaggagactgaagtttgtttcatttttcccatcagtcaggaaactcctccgacagtcaccagcagctcttagagaccacgcaatggagttaacctcagtggtgagactgatctgggaggatgctgttctttcatttgtcttcaggttatctcaggcgggcttcctaggtggtgcagtggtaaagagtctgcctacctatgcaggagacgtgagttccatccctgggttgggacgatctgctggaggaggaagtggcaactcagct

SEQ ID NO: 41491 - DNA, 1699 bp, Bovine  19866881235275
aaaaagcccaatgaacattgtgtttggtcgcccagtatatcaaatctcatgtttatacaaatgtcatacaaatttatttgtcagttatactttgatcagcctgggggtggggggacttatttgtcatgactgcaaaaggaaacttgggctgcggatagcaggattttgcttaacattcgtggcccaatcagattcaacattactgcctgaacagtctctaaaatttgacttgtagtcaagtttttttggcctaccaaaaaaaaaaaaaaaaaaaatgacagcatcccctgaagccacaggcttgttggtggtaggtattttgtttcattgctccctgaccctattctaagaaacctaattcgcccaagggagtctcacacaggaaaggagtgtttgcatctgtttagggaaatgtacccaaaatgacttaaaataatgacttacttagaacgcggaatccaatggaatggaatggattgataagccagtttgagcaagctgagagccacccaggcctcgcagttataaaaggagccctgcagcaatgcattttgcccagaccatctgccaagccccatccccattcaaggaacgttctctctctcagctctgttcaaaactccgacttttccaaacgcctcaaggcacgagatctcctcttaagttgcacttagactgctaagatggtgcggatttctcggttcagccctgcagaccccagggtagaaattgctctccgaggtatgttacccattttaaacttcctcgagcccttctggtgaccgcagcaagctgggtggtgggggtagtgctctgcccagaaggtaaagcctgctctaggtggccaggagaggtggtgggtgtgaacaaagcctgtctttcctccagggagagccgggctcagcttctttctcacttattgaacttaaaatgaactgggcaggcagaagtaaggggctgacatctcatctagcagaatgaaggatgaattgaggcaaagaaaaaagaaggaaagaaaacactgccctgccaggttcttttgtgctgcttcatttcccgtttctgtggctttgtctttttctctcttcacttgtctgccaaggaaatatagttgatttgtttatataaccctagcctcaaggttggcagcagctctgaagggttagctgctgctgctgctgctgctaagtcgcttcagtcgtgtccgactctgtgcgacccctgagacggcagcctaccaggctcccccgtccctgggattctccaggcaagaacactggagtaccgggttgccatttccttctccaatgcttgaaagtgaagggtcagaggtgacaacaaaagcttcctaaaatatattttgaaaatctgcagctagattaatttctttccttcttaatctttctccgtatttaatatatatatatataaaaaaaaaaaagctcaacctttgaccatgatttagttagcaagtttgaactgaaacttctgttcttgcagggtggtaatgacagtttacgtttttttaaaaatttagatccatctttgcacaattagcaaattattatatgacctttccttcagagtctgcaagcacttgcttgtttccgctaataagagaacatgttttacaaggttcacgttgattaattgacaaatgcgataaaatcaaagcagggctaaaatgcagcgcaccagc

SEQ ID NO: 41492 - DNA, 947 bp, Bovine  19866881265548
tgctttagcatctccaaaacgagactttgtttatcagaggacttacgtaccttctctcgatggagcgccatctgaatgcagggaggcgagcagagcagtgagaagacacacgttctctcccctgggagccttcgtggatacacttaaaatgttgaaccttcgggaacatttgctccttgtctctagtttgcatcccttcttattctcttgtcatgttgcttgaacttgtgtccagtgatgcgtttctttctgtttcgtgtcacagctgtttcccgggtctgtcgtcctcattattctgtggtttccttcaggttggaggtgggtcttctttgcatctgtatctcagcctgaatccaggtgtctggagaatggttggtgcttcagaaatatgtgttgagtgagacaagatttgacagtgtctcagatgctttgtgtcgtgtccctccgacttggagagcatttttattttcttagtgtccaaagctcagtccttggaacaggaacgacttgttttgtatctgtccaaggaggtgttgcacttctgggttagaaccacatcaacgacccaggaatatgcttataaagcatgcagatgcatctgcagtggctgtcagctcagcagaagaaattaattagttgaaattatcctttgtggcaccaaaggaaaaccagcctctctctccctagtaaacacgctttgctgcttgtagaataaaaatcccgagtgcagcggaacgcgagcacccccttctgccacctggggtcgtggtcctgcgtggtggtgcctcatcgactcccctcctgcctccctcctgctctgttttcttccctcccctgtccttgcctctgtaacagcaggctctgtgctagtctcttcctggcctctttttttgccttccctgacagttcttggcttcatgatgtactgttttgctcttttacatttt

SEQ ID NO: 41493 - DNA, 1372 bp, Bovine  19866881322968
ttgtcctgctggatctttatgtcatagttaccctggcatatatccaacccaactaattgcccttttatcagccctttggatggatccacagttgcctcacttagaaatgggatcaccaggcctctctgtgccctgatgtcattcccctctggtgcatttgaatgtcctttgctaaatgggactttggtaaatggagaccagagacatgcttcacctgctcaccactgcctgtgtatctggtctcaaaagcatccttgcagaacaccatatactgtaaaaatcaacctaacatctaaaatgtgtacattcttcagtgccttatatatgcgttttgtttttccatttgaaaaacaaatatgttctcaatatctattacactaaggaggtattagtaaattgagatttgtttgctaatgacttgaatgtccaaggcagggccttgcatatggcagtgggaaacagatgtgctgatatgaatgaaatgatgatgctgatcgattttcatcattattattagtcttatggtgggtaacgtttaggatacttgccaaattatagaactgtttccttatcagctttgtcccagttttataccttgtcacctgaaacagaattccttttttttaaagacatgtcaaaatttatttgacaagtgttatattgatagatgttttggagcagaatttctaaaatgtgaaaaaggtacatacatgaaggtggatgaagaaacaatttgttcaaccaaatggctaaacgcactgtgatcaaggctcgggatctaaaaatagtcatttttagagcagtcgcttcaatttacatcaaagtaacatctaaagttacattaagcccttggcagcattgccatctcttttgagggcctgccctacaaccctcacccttccccacccccaagctattagatgccaatatctgaccgtggactggcaagaagtttggtggctgtggggctgggtattgcagctcttggatttgcaagttgttatgtatttcagatctggaaacctctaggacaagtaatcacagaaactgcaaagaagatatcaactcctagcttttcatcctactataaaggaggatttgaacagaaaatgagtaggtgagaagtaagtcttattttgggttgcaagcctatctgccagcaaggccaagattagagcagttcacaggagaagcatgattttgaatcacccagataaaggtggatctccttacttagcaaccaaaattaatgaagcaaagacttactagaagcaaccaccaaacactgattgatgctcaaggaccactctgaaggagaaaaagggggacttcataaaaaatgtctttttaagttaatctaaaccatggcctt

SEQ ID NO: 41494 - DNA, 1299 bp, Bovine  19866881333095
aaccgttgaaatatcctggttgtgtgaaatataacccttgaccagccaaagccatttgtctgccttgcctgttgagagaagcacatttaaaattccacacctgggagtaacttcttggaaagaatatttcatgcaaatgaatacattctttggacttgcactgcaatttggattagaaaatatgagcttgttatgcctggacataaattttgttagaggccaccttgagaatgacagcatggattattccgggggtcttgtgtaggatccgtcacggagcaggttttggatgtatttgtctccacatcctgtgtgaggggtttgaagcttgaactgctgctgctgctggtttaatgctgtatgttgctagggtggaggccctgcaaggttcagaattttaaaataaagtgctggaatctgctgggaagaaatggagattggttattaattcccatcttgagggctttatggatagttactgggggggaaagaacttccaacaattaaagtcagagattaatattttgtacacgttttgtatttgggagaatgttatgttttccttgagaggtttgactttattttttaagctagcctgtgaaatatggctaaggaatattggagaaacttcaagaagtttctaagtaatgttgaagaaacttccagtcaagaccagggacactaatcctgccccagactttctttttcacaacttgccatttctgaaagcctgagcttggcaggcagctgagtgtggtttgagcaccttactagagaaagctttgggacagccttgctgtgaggtcatgggggcttcaggccctgggcagaacttggttatgagtctgttactgccatgtgcttggccatgcacactgcaaaaactttataaattgaaaaagagggaattctctggtggtccagtggttaggactccatacttccagtactggggcccaggtttgatccccggtcaggaaactaggatcctgcaagccactcaacatggccaaaggaaaaaaaagtaattggataaaaaaaatacatatatatatataattatagtgagtgaaaatcgctcggtcatgtccgactgtttgtgaccccatggactatacagtccatggaattctccaggccagaacactggagtgtgtacccattctccagaaaatagtagtattaaattaaaagttcatatcataaaattgtattaaattttatattatagtctgacctgcctcttgagcaacctatatgcaggtcaggaagcaacagttagaacggacaggaacaaca

SEQ ID NO: 41495 - DNA, 809 bp, Bovine  19866881380929
accagagtccatccgtcctacaaccaaggcagagggcactgactcctggacttttgttcaaagacattgggctttatttccataagtaatggaagtcacagaactgtaatgtttcacatggaacttagagaaacttgaagacttgagggcatttctcttaaatcaccaggccaaaagcttcataaatatattttccaccataaaatataattgtgaggtacagtgtatagtctgttttatctgaaacacattgtttatttgtgtcgcaatctgagctctccatcactgaattagcataatagctttagcctattttcgtcctagggtattgtttagaaggaaaaattaatacggtctgtttctactaatcacaaattccattttgtgtttctttgatattctttctttgatgtgagggaaaagactaaatctcttttaaaggaaggaaaaaaaaagtgtcagtgagtctgttcagcatgtatgcaatctcaagaatttagtaagccacataagatggggaggctaatgttctgtatttggggccgctttgcttgtttgaggaatttgattacaattcgggtggctttctaggcatgtaaactattcttaccctatgactatagaatgttttgcaactcctctgtttgatgtactaggccgctgagagacaagttagataaacaccaagcagacttttctagaagcaggagccaagggaactaagccgtccccattgtcctctgtgttcttcttctgtagaacaatgttgttttccctagaggcttcagcggtcattgccgggggggaaa

SEQ ID NO: 41496 - DNA, 1107 bp, Bovine  19866881485418
atgagcaagacccaatcccatggagaaccagaaggccaggggctggaagggtcagaaggcagcctccttgcgtcacgtccagagtccctctgctgtgtcttcctccctctagagcactgtgcgccaggcaagataatgactgagagctaaatgaaggtactttaacttcctctcgacgctcgtttgagttcataatgaaacgaaatgcaccagcctccctcactctcaccacactctttgggcagaaacatctcatttgaaacagcttgggctccctgggctctttgcaagaattggtggggatgagttttgatgtttacaactgtgaaaaatcctctgctcacagcctgagggagagcaagtccatgcgtagagtggggaccaaatcaccgggctccaggcacactagaacctgaaaccagaagactctagatggcagtggggtctgctgagtgatcaggatggggaagtgggtatgactaaacaggggctgctgaaaatgaaggaagatactgcaaactaaagaagcactgcggtactacattctagccaaaatggattaaataatcaatgtaaatccttttccatttgagtgaaaatcccagtaagtcagctcaaaagatttctggatcagcagcttaccttcaaggtggttaaagacagtcttaatttgtatctgttgtgtcagggttatctctttcagcattggttcaggatttttttttttaacaaagtattattattattattgggcttacctcgtggctcagttggtaaagaatccgtctgcaatgcgggagacttgggttcgatccctgggttgggaagatcccctggagaagggaaaggctccagtattctggcctggagaactccatggactgtataggccatgcagtcgccaaaagattagtggtagtagtagtatcactataattattatttgcattaaagtcagccagggctcagtagacttgcagtgagatgctctgatgtgtccctcagaatccctgggtgtgctaagttgtttcagtcgtgtctgactctgtgcaaccctatggactatggcccaccaagttcctctgtccatgtgattctccaggcaag

SEQ ID NO: 41497 - DNA, 1475 bp, Bovine  19866881509500
ctgagtgccgaagaattgatgcttttgaactgtagtgttggagaagactcttgagagtcccttggactacaaggagatccaacccagtccattctaaaggagatcagtcctgggtgttctttggaaggactgatgctaaagttgaaactccaaaactgtggccacctcatgcgaagagttgactcattggaaaagactctgatgctgggagggattgggggcaggaggagaaggggacgacagaggatgagatggctgatggcatcactgacttgatggaagtgagtctgagtgaactccgggagttggtgatggacagggaggcctggtgtgctgtgtgattcatggggtcgcaaagagtcggacatgactgagtgactgaactgaactgactgactgactgatctcctacatatgtacgacacctatggcagttttagctcaggccagagtacacgtgtatacatatctgtccttttaaatcacactgccttatttcttttcttttcagcacatattctaattttccaaagtcaaagaaataggaacatttctctagtttctataaaaacacaggcgtagcatgatgtcagtctggttgcatgaaagcagttttggacgtttaacctggctattgcctggttggtggaaaattacagtactagtgttactaacaccatgcctcgttctccattttgcttttaaatggtcttttcaacgttttgttctgttactgacaatttaattttgaagcatcattgtttaaaaaacattcaaaatagaaattgaagcacatcattgtgcttgacactagatcaaatatggtgttgtgtctataaaagaaataaaatagatcctgttagcctggcggtacaatacgaacatttaaataaatgtgaaatagcatagtgataaagcaaatgtgaaattttttcaacagtggtaaagtagagaagatgttgatggaattctctattatttacaccattatgctaaatgaaccgtaggctatttccttttttaaacctcagttagcttagatgtaattttatactttaaaaaatttaaggacagatacaggtatggttgagagttctctgaactacttggttagatgtcagatagactctcttgtgcctcctacttcctgtatttgcagttagatggttacttttttctgtttgggtcattcacatacatgaagggttgggggagcttgttgttattgttgtttagtcgctaagttgtgtctgactctttgtgaccccatggactgtagcctgccaggctcctctgtccatgggatttcccaggcaagaataatggagtggcttgccctcgccgtctccaaaggattttccagacccaggggtcaaacccctgtctcctgcttggcaggcagattctttactactgagccacctaggaagagctatctaaattcatgtcgaaaaaaaattccattgactttttag

SEQ ID NO: 41498 - DNA, 731 bp, Bovine  19866882113215
agactggtgagctggactgttagcttgagtgctaagcatgaaagtgttcaggactagaagttagaaggtgtatgatgcttaaatatttttagtgtgacagtttggggccagtatttttatatgtaagggagctcctgtttgtcatttataacgattctgaatttgaaattcacctcagttttcctcttgctctttacgttagaaataattcatcgtgaagaattatgaaaactgacttcattttatttaaggcgcagtgacgctgtctgtgctccatatgtattctgatggcactgtgtcagagagcagggggcataccctttaacgttatttttattatcactgatttattatcatattatttactaatattgaccaatattagtgaaatgcttttagagctgagtagtatatagttgcctttttaacttatttttatgaaaatgtatggtttgataaaactttgaaggcacccttggattgcttcacctccttcagaaagataacttccttcatagaagaatgttctttccttaaaaacaaacagaaaaaattacgtcttggagaaggactgttattttatttacctaaccatccacttcagaaaattctctggtcagatatttggcatttgaaaggtaatgtctgaccagtgaaatgtttgagtgtgttttaaattactcctgatcataagtttatttttctcagagattatcctgactgttaggtat

SEQ ID NO: 41499 - DNA, 909 bp, Bovine  19866880447753
ctctgaggaccaaatgagataatggatgtggaagtactctgaaagatatctaaagtgctccaggagtgtaaagaatgattattattattaaggatgagccaaggaaatactctgtcctaaagagcatcagtagcagacagagtttaggaggcgagttataaattctgactatctgggtcagcggtttgaattcctttttccaagggagactgtaaagctattattctgtgctcttttcctttggtgcctctttttactttcgaattatttaaatgactaaatcttttcccactttgcaaagcagaatgacagtccccagtatattttgctgccggagcacaaaataaatggggatgcagatccgtgtcattatgataaaacaccatcttttcatctttatctgagaatttcagactcctaaggaaagatgaccacctctcattatggaaaatgaatttgccagcaaagaaagatatctcttaacttgttctgggggcttcctgtttccaaaagcatcaaggaaaattagccctgtttactattcttggtttattaaaaatggtttcccttttctcacccactccccacatgtctaaaaatgatcgtgggataacagaagagaatgtagacaggaaccagcaaggaaaatgaaaagagtatgtaacgtttgattaaccaagatatcttctgtaaaggaatagaatctgctttttgaaatgagtagcaaaaggtctggatatttctaacccctgtctggatacactttcttacacttcagaaataattaacactctcaaagcaaaggagatgctttcaactatgccttgaaataaaatgttctttttgtacaaaccgcggctgggggaatggtttgctgtcaccttcaagccctgcattgtgactgatgac

SEQ ID NO: 41500 - DNA, 2315 bp, Bovine  19866880539699
acacaagagaacagaaaattaatatttagtgtttacttctactcagccatgaggggagatctagtgtaatctcttttcttcttccagtgaataacagtacctaataaagagtgagcatttaatacatatttctttttcttttgctgaaaatacccaggtctttcctggtggttcagacagtaaagactctgcctgcaacacgggagtcctgggtttgatccctgggttgggaagatcccctggagaaggaaatggttaccccctccagtattcttgcctggagaattccatggacagaggagtctggcaagctacaatccatggggtcacaaagaatctgacatgactgaatgacttacactttcacttcttttcatagactgggtggtttaagcaacagaaactacgttctcacggttctgaaactgggaagtataatatcagggtgccagcatagttgaattctggtaagagcccttttgctgacttgcagatggtctccttctctgtgttctcatctttgccatgttctcatctttgctgtattctcacagagtaagagctagctctctggtgtctcttcttaaaaggtcactaaccctatcatcccagggcctacccttctgacctcatttaagcttaaccatctccttatagtacatgtctccaaagacagtcacactgggggctagggcttcagcatgtaaaggactgtatttaggccatgacagcatgcacataatatgagttcagtaatattaatatcccctctcacaacttaacaactgaacaacaactctaggtaggtagatagataatctatggatataagagccatctctctgtctgtctctgtcgatcaatttcacttgggagaatcagaagaatatcagggaagagaaatcacagttagagcttgtaggttgaataggatgtcttagacaaacaaaggtatgccaagcagtgtgtgagtgtgctaagtgctcagtcatgtctgactctttgcaagcccattgtctgtagcctgccaggctcctccatcagtggaactttccaggcaagaatatactggagtgagttgccatttcctaggccaacagatctttcagactcagggattgaactcacgtgtcttatgtctcctgcaacggcaggcagattctttacctctgcaacacctgggaagtcctattccaagcagaggaaacagcaattcaagtcttttaaaagacatagcatattttaaaattagtgaaaatatcactggttttcagcaaaactttgggtttgcaagagaaaggttcatggtaggaaacgcaagagatattgtctgggggcatgtcattaacaatcaaggctaccaagctggggtctttggatttttccctttggttaaaggattcttgtgccttttatctctctctttttagataactggttggattcttgagggcaaggatcttaccaaatgttctttcgtaatccaagcctgagctgagaacactgccttaagaatgtaaaagggatgaatttctacataacctcagcatatgagagccatcgttatctctttcatttgttcaatgtgagttaaaggcagctagaagctctttcctccaggttggcatggaatctaacgttactctcttggattgtggtcagcatgggaacagctctacttctccttcatctgtgcacgctgcctctcgtctatggcagtgtctccctggcttacattgctatgtttgctggcttatctcccagcacagcaagctccgctccattccttaaatgctctgttccaccctcagtggtgaccttggctgcaatccttagcccccatggcccctacaggcacgcagaattattattttctaaagccatgctctccacctctaggtgctgctctgctactggcttggctgaatgttccttccaccttcaaatttctttctatttctttcttcaaatttctttctctccttgagtcttttgatatttttgtcagtaattttcaaaacacaaagcttttatttatctccttcactggggcactctgaattaacagcattgacaggtctgacctctgaaacccaaatgcctgtttaaaataaaagcctgattattatataatgaactatattcagtttactaaatagttaacttaaacatcaatatatgtatatatttttgctgaatagatgtataatttatgctaatgataattacaaataatacaaagacataataactccactgcagcttctggtattcattaccaatgcttcatttggcttctgctccacatccataca

SEQ ID NO: 41501 - DNA, 1182 bp, Bovine  19866880544298
ctccaaacaagtccatgcttttgacctgttatgttgcctcattgatagttgaatatgaaaacaaaatatgtaacttaaattaggctaataccgtttcctgctggaacatttctaggatcttaaaaaaatttttttttgtttttattatttttttaatgagaatgtttcctagttaatatgttagattttcagaggtggagagaacctaagagatcaactggcccagctcccttctttttttcagatgttaaaacagtagccatgagaaagcacttattcttaactcactgtcaggtaacatatcctggcctcctgctgtgcagtctcaaactttctaggtcaccctttgaactctccagcatgttcaccaggctgtcgcctacagtcaaccttgtttcacatcactaaattggcagactcaatgttaatttttaaaataaatggtgaaaattaggtctttacaataagttaaaattctcccaattgcacacaaaataataaaatagacaaattgcctgtctttggcttcagtttggaataatatctgagagtgggtttgatggtcttctctaagaaggaaatggcaacccactccagtatgcttgcctgggaaatctcatggacagaagagcccggcaggctaaagtccatgaagtcgcaaaagagtcggacacaacttaaaaattaaacaacaagacccttctaatcctctgccactaggcttacttttaatgtcagtctaatcataatgcattgtctttgggtgctcatttatctgtctctctcagattctgagctcctcaaaaacaagggccaaagttatatccctattacctagctcagattttgttggaattgatgaagacctatgaagatttactgatttagtgatgtgaggttggacctaggagatatggccaagggagaccagtagggtggctctcctggactgtgttatgtggaacttactgaagtcatcttcactgcatatttcccttttccacaaagctctttccttaaaaagctgttagaaaatgcctatgagtgaaactttggcacttttttccctaagcctgaaaatattaggagaatccaggtggtcaaattcagtgtaatcagtgtttctcaaggaacattgatgagtagatgaatgcagactgattatacagtaaatatttaatt

SEQ ID NO: 41502 - DNA, 1377 bp, Bovine  19866880569961
tggggttttgttggttccggcagtcctcccctgtgtgtcctcgggagcttggctgctttcaggtatctttagggaacagcagcatctggtggctgcctgaacagtaacctggctgcaggcttcagggggaacacatcgcagcatctgtgtttctccagcagaacagcagggctgttaaaatagctcttaggcacaatctatcactgcactgtctcccttgtttgcacaggctgcaactggagacatgagagtgtggaggttctgatgtgctagtggagcactagaataggaatcaggagacttggctttgccaaccactggatgactttggccacatcacttagactctgggcctcgtttcctgatcttaaatgtccagaggctttctttggtttttagtgacagttgctgcttggggaatataggtggcattcaacacggcaggcttctttgttatgagactagaaaatttgtttcatctctctgtgacttagtttcctcatctgaacataggaagggtgattgcatcataaaaaatgttcttaaaaattaattgggatgctgattagagagtcctagacatgatttgtgaaatgtaatgagcactcaacaaatgtcagatgcctttctacccttaagtcatattactgcttaatatctgtgctgtagtatagggctactcctgtttagtctgagcatagaatctgaaatcacgttagcagtcattacgatcaagtgtgatgtgtatattcccactctacactctagcatgttaatttctcacagatgcttctgtacatattgatccatttgccaaagaacacacctcctttactcatcctacaaggttaagcacaaatgattctccctcatgaaactatgagccttctctaaggagatgtgatggctcatttagtgaaaatgaacccagaccctgtaagtttaacaaagaacggagacaatagacttgataaggaatgcgtggattattccctccactcaggacatgtattatcctatactcctctgtcagccatgtgagaggggatgggagtgggcctcagcccaggaagatgcgcttgtctatctttttgtttcttctgcttccctgtgtgtactccctttttatgaataatttagtgtctggtacatagtaggtataatgagtgtgatgaatgtttggagaatgaatgacatgtgtatctaatgcctcaataatttttcattgagcatctactgtgtcaaggaggcaagcaacgtgaagtttctctccatattatttagctatgtgcattttatttcccagatgaagttaattgattcttaatgggatggtgggaatataggcagcaccatttatatttccttaaggcttcg

SEQ ID NO: 41503 - DNA, 1733 bp, Bovine  19866880604405
tgttgaatagataaaaagaaattggcagatgacccagttttcaggtcagcattgtgccttctctttaagaaatatttatgtctgctgtcttacagattaggtgccggttgtagagtagctataggaacaatctgtctatcctttctgaagtttctttattctttcccgaatgatgaagcctcctagatcccacctcaatgaacaaagctcaattttttactactaattgctttaagtaaggcttctgtgatctaatcactaattggatgcttgcatttaagaaagaaagatagctaattaacagaaaccagtattgccagtattaggggtcagacctttatatgtggtagcatggtgatgggagacccatggtgaagtttagaaagtctttgggaacttaaataggtttttcactcagagagaagttgaaacaacacacccaaacctaagagggaggaggctttctgacagaggatgaatccgtgggccctgggaacctgtgccttctgtattttgtcagcagtcagaaatgctcaaagtttaaaatgtaattactagaaatatgaaatgaaggctcatgagccacttgtgaaattgccctagaatagccaaggtgattacaattgaaaagaaatagaaaattttactcgcacaggataggccaaatttggccttacatattctatgtgctcagtagattcttactgaatgaatttctcatatgagaaatacacagaaaaaaatagatttctatataacttttattaaaaggcataaaataaaacctgaataaatggagaatataataccttattcatggataggtaaactcaatgtcataaagataccacttctcctcaagttcatctatagattcaaagctattccaatcaaagccctaataggttttttttcagggaaaatcaacaagctgcacttaaaattcacatggaagagtcaagggccaagaagagtcaagggtttttgaaaaacgaggagatggaaaagaagaagaactgacttgctttcatagttatcaagatttactctaaaattttctgtcattttgataatggctttgtttgagtgtttgctggttctgcaagctagtcattcagggaactagtttttggcaaacttgcctagagtcagtgtatactgaggggttaatttgaatgaaagtgaaggcatgcagtgtgaaccttgctgtcttggagctcagctctgaccatgctgagctgcagctcaggacaggagaaagagcaggggtcagatgtgccagactgaacccccggctcttccttcagaagctctgagacattgcatcagttactgaatgtctctgaatttcaatttcttaatctgtcaaattcaattaataaaagcctgctgctgctactgctgctaagttgcttcagtcgtgtccgactctgtgcgaccccaaagacggcagcccaccaggctcccccgtccctgggattctccaggcaagaacactggagtgggttgccatttccttctccaatgcatgaaagtgaaaagtggaagtgaagccgctcagtcgtgtccgactcttagtaaccccatggactgcagcccaccaggctcctccatccatgggattttccaggcaagagtactggagtggggtgccattgccttctccaaataaaagcctagcttgggggaaaaaaaaaaaaacacctcactgttgggctgtattcagttcagtt

SEQ ID NO: 41504 - DNA, 782 bp, Bovine  19866881139176
tttaacatgcctgcccttccttctttcctttgagggcatttgaaagccatgatatttgcagtttcccaggagtgaacattcctttgaaaggaggtagctaagagaaggcaaaacatcctggaccatatgtattcgaggccatgaaatagcacctgacatggtcaccatctctgactccctttggcttgctttcccttcccagtgggtgcaggacagaggcatggggtcagtaacagaggaattatcacggctattccaaaagaaggcatttacctaattgcaaaggaacacatcctggctgcagacaataaatggtgtgtgatgcttccatgaagtgagatggatggagctctctgttgctaaccggcccgtaaccagggtcattaatcacacgcggcacacccattgcctgtaatggacttcaccccggaaaactccaactcacggtgccagtgggttaaagggaaggcctcgcctgttatggaaatacacatctcccactgggactaaccctgggcgtttgccacccttcattccctgaaaggctcttttaattgattttctttcttattctctctgacctggcagagagcttacctgccagcctctgcctggacccagagacttggtctgaactgtatgaattgctaagaagcctctagtccacaagaaatctcccgtctttcctgcccttgacaagtaaagtaactaaatctcattagcagatcctcattgttgtgtgtgtgtgtgtgtgtgtgtgtgtgtgtgtgtgtgtgtgtgtg

SEQ ID NO: 41505 - DNA, 893 bp, Bovine  19866881144775
ctgattgggatttgtattttctttttttttttttctttttgataaagggagaaaacaaggacttgtttcctgcagccatttcttgggccattctccatgaggcccaggtccctgctcaggctggctggaacccacgcagagaggcagtggggatgggatttgtgttcatcagcatgcatttcttgaaactggccaccagtgaataatgaaatctcctcagaatattcttaagcttccttatgtgtttgattagtttttcccagtagggaatgaaagaaaggcatcagcagttgaaaaaacttgctctctatgtgatacaagtttggcttctggagtaatgttgatcttcagaacagacaggaaggtcagaatcattccaggttttaatggacagcccactactggaagtgcttggtcctggcagtgaatgggggtgaaggaagcaggagaacctgaggtcacttatcaactgtttcacagcctccttaatattctttgattcaatttccctttcgtaaaagaagatggattcttgtataatgttctttcatttattcattctcttgctagcccatagagcatgtactacctagcaggccctctgttaggtgtcaaggacgtaaggatacaagagtgatatgtgataaacaaggaatatacaactcccctgagcttcccaggggggtgcagtggtaaagaatccgcatactaatgcaggagatgcaagagatgcaggtttgatccctgggttggggagaaccctggagtaggaaatggctacctactctggtattcctgcctagaaaattccacagacagaggagcctggcaggctacagtccatggggttgcaaagagtcagatacgactgagcaaaaacacaaaaatacagt

SEQ ID NO: 41506 - DNA, 1240 bp, Bovine  19866881342136
tttggatctgaaaagagtatttcttatctgaaaagactcaaccttagatgctctggaccagagattaatcagtcttttgctaggaaaatggaagtgtcacttttctgaaaataactattttcatttgagtattttccagtctccagtgccaatcaaacccaatggagatagtcaagaaacagttaaaatagaaccctccatggagggacatcaagtggatagcttttgctgaaaaaagggtggtttcagacatttactgttaggagcaggaacaaccctagagggttgttgaggaaattcatgtttagtaacaaatgggaaggtattcacagagaaccaactcagaagattttttaaattatgggcttactggcagtgggggacatttaaagccatctggtctcataaactcataagtaattctatctcaagtattcatgagcattttatagaaggcatttgaagaactcttccatattatgaatccagcacatctcctaatgtcccacacaagacagaagaagagaaactgtgagcaaattgacagtcagagaggatgggtgactgaccggaatgatacaactagtaagagttgatgaaaaatgctctccctcacattgggctccattagtgttttcctaccttctttacttacactactctcagaggggtaagatgatctaactgggaagtaggtgaagagtaagtaggtactctgtccatctccacttttcctcctcctcccttgggagccagtattcttgtagaagacatgaattctctgtcatcattcctggtccaggagtcagccctattctgggattccaccaaagggaccacttggctaattgactaaggccacacggctacaacctgccctgcagcattaatagagatgctgttctggcttccatctttcttatgtgcccagaactgggcagggaagagggatgcttttactgttcccttccccttggggagccaatgcaggtactagatctggacaagctggacacaagtctaacataggaatagcacagcaaataaggaagctcgcaatagtcatgataaaacaacagtgtcagctttatcatcattcattaacaagggttttcctactaccttagctattcccatgtatctgtcttactcatgaattaaagtctagtcttctggagaacaagaatgatatagccatgtccataccctgtgtacccagcacagttcctgggcatgtcaa

SEQ ID NO: 41507 - DNA, 600 bp, Bovine  19866881842756
tccctgcccttggccttgtgacacgtgggtccagattcaaatgtcatgtcacatttcctcatggtaccaaagcacccttgtgagcagggaaccctaacagatggctgaatgccttcaaaaagactcccccagacagcctgagagatgcacggagccctgtcggtggtgatgggttgcaacatatgctcagcaaattatgccagagggaagagtggttcctgcacccaccgcatccacaaaacgctggttcaaatgctgcgtgtcgctgccttatacaaagtgccatttgcttttctaaaatatctattaaatccttgatctctatcctcggttccctggatttttaacggtcctaaaagggtataagggaaaactttttattgacgttgactatttcatccaaagggaaatgaataggaaaaggccattttctcacaataaaggttgctccctctggttcaggaattcctaacatgggttttctggacccttaaaaagcccatgactgatcttaaagaggcctgtgaaccttccaaaattacctgcaaacatgtatgtgtttgtgtgtgtgtgtgtgtgtgtgtgtgtacacatatggat

SEQ ID NO: 41508 - DNA, 1244 bp, Bovine  19866880526817
gcaggaggggagtagagcagggtggctgtggctcacaggcccccatctcacaccttctgcttcatagctctgtgctcttggccacattcttgccacacactcagaagcagcctcatgaggtgagaacctttggtgacacccagggatcaaaggacccatggctgccaccaccatgagggaaaagccgtgggccgaagcaagctgggctttccctggcctctcaactgttgaaattttaggaatcacctaaaaacgaacctccaaggggaaatccaaaagctaaagtgaagattcccctagaagacactagggggagacccatctctggcctgggaaggggaggaagcaactcaggtctagaagaattcagaccatgtgtttctcaagttgattcgctggtgacctctactaaatcaaccaaactgaaccgcacctttcaagaggacaggcagtgaccactgagtcagagtgatgtaatcagagaggatgaggaaagcgtcacgtgtctgctcactcccagtccagtttccagctaaggaaactatataggatagagaggacccggggtcacacagcaggtctgtgacgggacacaggttcggagccccagcaggcccggttccccacccaggagagatgggcagggccgcttacctacttggtgcgacccagggctaaaagacaatgctagccttttgttcaaaaactgttaaggctttcaaggagaggacagcagagcattaaaatccagaggagggggaggttgtgaagcctgtcctcggactgtagaaaggaatctctctctgagtcccacaggagggctgtctactccaggtgcaaagcagggcttttgcgggcgcgggtggtggtggtatttccacaggaattactagaactgctatggggagaggcagatttgacttagaaaggaaagctctcccaacctttgaggggccggagtgttcgcacggacctaggatcaccagaactccagtcttccgggaaaggactctcccacaggccagggctgctgcgaaaggggaaatccaaccagggtgaacgcggcgcgcggacagcccgctgccatcagcatcggaagcgtcccccgccgtcacgggactcggagccgcggcgggcccgcgagccggagccgggcatcccctgcctgcgcccggctcggcgcgcgcgggggcggcggactgcggcgagcgccgtatgggaagggccggggatgcatccctccg

SEQ ID NO: 41509 - DNA, 969 bp, Bovine  19866880554296
tccccaagggggaagtattttgaaaaagcagatttgagggtcccaccttcaaagatgcaggagccaagacgtctagagtggggcccttgactgtccattatcaaaaagtgatccaaagacagatttccgatgtcaggggccagggtcaacccgtgagcaccactgaaggcttcagatgctaagaggagccagcgcagtgctgagtaaggaacagcaactttcctccaaaagttccccgtgtatctgggggaggtagggttgcccaccccaggaaccgcacctccttggtgatagacggacaaatacaaagtcaaagagacagggctgcagcccttcaccaagacagtacagcagtttcccaaggtagctgggcagaggtgggagaagcgatgtgtggcagagacggctaagtgttcaccacaaccggcttcctcgtccacctgggctcacagctgtatttcacttctcagcctccctgtggttaggagtggccacgtgaccgagttctggccagtggcgcaggggcggagaacacgcacaccacttccgggcctgacccacagaatctcccgtgtgttatcctgagccccacctgccaatgtaactttccttaaagagggaaataaacttctgttgtatctgatgactgaaaataacggggctgtttgtgacccatcctgatcacacgggatgcaagagagatttcacagcgattaatctcgaccagcattcagccagcccggtttctctaaccagcggctggtgcgacatagcacctgcagggacgcgagtcctgatcttacacggcttaccatcttctggagaaaagcaacactgagaaggccccgggcagcagcaggccaccagtcccccaggaggggaccacagactccagccccagagggaggctatcgcaggccctgccaacacggagagctgagtggtggcgggcaggcttccgagaaagca

SEQ ID NO: 41510 - DNA, 1218 bp, Bovine  19866880559200
caagagagaatggggagcagcccgaacactgtggttttgatcttggctgaggaacatctggaggggaagagggcaggttttcagtcagcactgcattcagagttgggaattgttataatatcctgttcttggtcattcgttcatgcattcgtgcaaaattcagtgagcacgcacacgatatggcagagacttttctcttgagagccttcaccttgctctggacattggttggaggtcttctgattgcccactgctaacctgggaagtctgcaggacttctctcaaaggcatggattttgtgggtgcctagcattccgaggcgtcaagtccagctcagacgaccgtcctctgatctgcctgaaaacaggcccagtcaccctcgcctgggctcctatagcaatacctcgggttgtaattcttgcttttcatctctctcccccactacacagtaaaaccagcatggaaagaagtctggtctcttgtccagctttgtgtacctcctgtatcaccctgggatgcttagtgaatatctgttggaaaaatgagtgaatgagtaagtgaaagaatgggcctgaatcagaactcagtctgaatgggggcggctgctgtattttttggaactctccctaaaggaaggctcctttttccccacagggttcgcctctgctgacccaccatcctttgtgtgtgatgattccaatgctggagttctttcccctgttaattcatcaaaagagggaagaatggggaaactatttgtcggtcagcgcagggtggggagcattgatccctcccctgtttgctgaacaccttgaggtcctttcatcagaaactcagaagcggtaaaaacaagggacttcaatctcaaggatgacagctggtggattgatgaccagaagaggtggggaggcctttgcttttcttctcccagctaagggaattcaaatattcagggcccatctggtgactcactggcttgctgtgattaggcctcctttcctgcccagcaccgattcctgttctttactgttgcccaacaatagtttccctgacactgggtcccctggatgtcacccaaaactgaaatcaacacagacaatgctttgtaccctttaaaatctgggtagattttctgtcccaaccagcacttcatggaacagcatcgccatcgcctttgaactccccagtcccctctgcagtgggtagtgcctctcccat

SEQ ID NO: 41511 - DNA, 745 bp, Bovine  19866880692145
atgagtgtccttacagtagagactgtcttttcttcttatgcttgcaaaccctcccacttaacacagccatctcccaataaagatgacatggcttttgcctttaaaagagaactggatcaaagtcaattcatttaattggctacgaatttctgagaatgaaagaacccaccgcacattgcttcctgcgtctgctgtggaattgtgggcttacaagagccaggaaaatgaatactaagagttccttgtgcccagcactgttgttaagggacaagatcaccagggtctgtgcctggcaagctgaaagaccaaggtgtgtcctgctgacatctcaacagcagagcccacgagacacaggaagtccccagcttccaacatcctcccaactgtgcataaaagcatgttttgctcccaacctgccctctatcattccctgcactaaaagaatgatatgaagtcatttatgcagacgcttgtaagcttctgtttggcctcatgagacagacagccccataaaccacagtttgctgtgctcatgactgagatttgggctgccctggccttgccggtcctgccagtggctgctgcaggaggctgaacaggcctgactggtgttcttttattcacctgcggcacagttgggacctgtgggcctcaacactacacctttaatgattaggcaattagtgctaactattaactctgtgagggcaggacatcagagggtggttgtaagacaaatttcctc

SEQ ID NO: 41512 - DNA, 699 bp, Bovine  19866880770063
gcgatgtgttgagcagagaggccgggctcgaggacgcacaggtgaccctcaaagaggtactcctggtgctggggggccacgccggtctgctcgtacacggcctccaggaagatggctatcctagaaaaccaggaacagaggcaggagaggaggaggcgagggggtgtcaacaggcaggaatcagcgtcagggtgacccacacacagctaagacttgggctctgcttttcagagggagggactgggagatttttcttccccagggttgggagacaaagggtagaggtggtgtcctgaagcagatggagacaaagtccagtgtccagactctgccttcacggcccctcctaccacgctccctagaggcacccagggagccttgtcccctagggtcacccaggactaggtaggactcacctagtccccaagcaagctccagaaacaaaggggttctacgagcagtccactggggagtgcactggcggtgagcgtgtgcttgcacacacacacgcccctcaagaggtttctaatgcacgtcagctttgtaaaggttgctgaatctctcaagttcccagcaaggaacagtggttaacttgatggaactagtacttccccaacctcagactggacccagaagcttccgtatctgagcgccccacagaagccttgggcgggacaggcccctggggcccgggggcgg

SEQ ID NO: 41513 - DNA, 730 bp, Bovine  19866880782468
ttcagcatcagtccttccaatgaacacccaggaactgatctcctttaggatggactggttggatctccttgcagtccaagaaactctcaagagtcttctccaacaccacagttcaaaagcatcaattcttcagtgctcagctttccttatagtccaactctcacacccatacatgactactggaaaaaccatagctttgactagacggacctttgtcagcaaaagtgatttacagttgctggacctcaaaatcaggaaggtgaaactcaaaggacaggccagggaattctccctgctgcacagtggtgacatgctgggtgggacgacggagacaggaggtgtacagacaggaagtatctgttggttccttggtgttctctgagtttccagtgttcatgtgaaatgtggaagggataggagaaggacccagaatttacagtttcttttcaagcaagaagtgaaacttgagtcctttctgatttagtaataaccatgaagaaggagatgagtcgtttgaagactctgttctagttctgcctttggtagccatgtggtttactccagagctttttaaacctgcaggtcaagacctactaggtcaggagatcaaattagtgggccacaactagtgtgtaaaatataaaaattatcagactttatggcatatttattttcatgatatcttgttgtggtggtaggtgttggcttgtaaaaattagaaagccaccaa

SEQ ID NO: 41514 - DNA, 2652 bp, Bovine  19866880848343
actcacatcattttatttaatctttattactaggccataattggtatctccaattatcctgatcgcaagatgacaaaactcaagtatgacttgttaagtaatttaccaaagggccatacaattaggggcaagtggggttgaagccaagttaaggtttgccttgacttgtcaaagaggttgacagtggggatgggaaacttgagaaaccaagagtctgaagtctcgggggcattttgggggggacatcacagtttctctgggtccaaaacctggaacgtccccttctctaccttccagctgcagtggtgactcaggcccaagagtcaagtttggagtagcccagtgactcactatctagcccatgttttgactagtccacgaccagactggcttccttcctacttcctagatctacagagcagcttcctacttctacagagcagctttgaaggaagtgagaatgggatgtccccaccccatccagcaaaagaagagtctctgcgaagagatgccacctgcaccgtggtcagctagtgatgccacactgctgagcatcacccctgccccgctcccacaacctgcctggaaggaggcgctgccctggcccccacccccaagagcctctgcacaggcactcaagggagattctcatcacccccatctctaagcctgccgctccaagacagaatagctgctctgtccagggcaaaatgtgctacttcaggcttgtactgctgctgctgcttcaaagacaaacaatggtccccaagaaggcagctgtgccagccccagtcctctgtccatgcatacgaggggcaggaacaatgggccactgaaagccagcacgcctgggccatgtgcccaggctggagggcccctctgcaccctggcctaccaatacactacaagtgcagaaagaagaaaggggcaatttataaaaacgtggaggaatttctcacagttccatcatgtgcttagcccagtatgcacctgcacacgtgtagacacacaaagacaccgtgcttcatcacaccaactcaagatgcctttgccaatccaggttatagttggagaagcgttcctgggagctggggatgatggggttttcgtaggttttgtccttagaactacactgaagaagtcaagttctcactttctagaagcagctgtatctcagggctataaatgaaatcaatggccatccagaaagccaaagtacaaaggtcaccatgaatgacctgaagtgatacatgccaaaaatgacctcccctgggcacctcgccaagcccatttgttcagaaaacctttactgagctgcttctgtatgacagaccctgtgccaggtgattatgagggacaaaacaggcccaagtcctaccctactgaagtgtgacttgacaagaggaaggaaaagacaggaaagattgtctcattgcttttgcttcaaatattctttattataacatagccatggtaagaagcccccacctaaagaccaaagatttaaaactcatcagtagctggcaaagatattaggcaacaagactaagaaaatttcaatgccctctgactgtttttctattttgctttataaaaatgatacttgaataaactacagcttcccttgcaaaagggaccaaagttttagagcaaatttcctgaaaatcagacttaacctttggttaatatttcattcaaagattcaagtcaaaatttaacctcactattctgggactagcccttgacgacagttacacaattttgtgaatatactaaaacaaaaaacaaacaaacaaaaaaatcccaccaaatggtacatttcaaaggggtaaattttatggtacttgaactatttttcattaaaaaagttgaaccccatcaaaacagcatgtcctgctgagtgccatcctgccgactaagcggaaaatggccccacaaacaggcaccaaaaggaggaaggccttcttggtttccatttctccacgtgtatgggctgaatttcagttctgcattgaatattcttaaagcaaatcttaggagctgtccctccggacagcaaacttggccaggacaaggaactccactggcagatcaccatcccatcatttccaaagggtgtcggatcaaaggctggaagggaacgttttcatgcatgagctcaaatctaggatcagcgcacacgtcccggaacgcttccccaaagacatgctgactctttgtccaggcttggccacagctgaagttctaactacacctgtcctgggagttagaaggaagttcattttcttttttaggaagatgctgaaagtcacaaaaatggatgaaattcatagaaaaactagacctaataggatattgattgcttaacaaaaacagggccctgccacagcgacaatcgtggagactctaaattatgtaacacctgccaacgcaggtgacacagtcgtctaaaaactgtccacacttcagagaaccccaggaaattcaccagtcaggagagtattggggaattctgttcagctcatcgtttccatccaaagatatcagccccacttgatcctctttcaaaattcatctccttcttcaggaattttttctgattatgtaatacggaacctctttctatgactcccacatttttgaggagaaaat

SEQ ID NO: 41515 - DNA, 3901 bp, Bovine  19866880873178
aaccagctgtttaggaaatatttggtgattgatggcttcagttggaatgtaagatgatcatatatgacagatccctaggctggaagcccaggaggtaaaaggctttccctggtcactcagcgaagtagagaccgccccgaggacccagagccccgggcccctgctcagagcaatctgtgttactctcagcactgatgctggcagagatgttgaggggataatccttggtgatcgtgactggttcatgatggaatggaagcctcacagaactgtaagccatgttctggcttctcagctcaactccagctttcaactgaggggctgtggccaagacacatcaagcctccagattcgggcgccttatctggtccttttaacgagtgtcacgtgagcctgtccttttcttctttaaccgagcgtccttccccactttgcatgggagcagagccttcttagcagtttctcacgggactggcagagagagatcctgactgctaagttctctaaactgtaaggacttccctagggtggggttgggaaaagggcctgaatggttgacacgagctccttctccaggaccacctgggactcaccccagacatcctcccctttgtgttccagattcctccactcccactcaagcctttctcttcatgcctttagactttatccagacttggcccgcttttccctctaaagttacagctcagcacacatgtaacacccattcacccacgttattttgggagaaaggaaaactttacacggctctcaaccctgaatcccagctcttagtttatgctgtcaggctggacgctggacccaggttccaagccgtgagtggcacagggaggcaccatcaggtcaccctcgtgcctgaagcctgttcccagccctccactgatcccggctcgccaggtaacccacacctgtgtgcgtctcagctctgggatccccctgtgtggggggcccagacctgtcttcattcaggacctcatttcctcttctgaatggctcagtcttcccataagatagcaccccagtcctggcaaggcatgtgctctggggataagaggaccagatcaatttgccaggagccaggggcatttaatttcagaaccaggaggaagaagggagctgtagaggcagaaacctgcaggttggattcgctgagcctgcgccttctgtccatggttctgtcctggttcccgtctcttctccttcccctcccctccccagctttatgtgcagctccccagcctgcatcccccatctcacttctcttcttagctgtagaatgaagttttctgtagcctgtcggaggtctctcacgcccctcagatgcctacgatttaatgtgtccagaagcaggtcgtagctttgcccatgactgatttccctccctgtctccgcctcatcctcctattcccccaccttcggcacctgaaggacctcccctctcatgccttccatccagtctgtcactgtggcttctgcctccacggtgtggtctctcctttctgtcccccaccctgccctacctagctgggggcttgtcgcctcttcctgagatgctccaggaggttgcccaaccggtttccttctgtttcttcccctgctgtgtaccctgcatttgatggcatatcattctggcgtcccaaagccttcagagcctcccctttgcttctagagcaaagtccacgctggttcccgcctgctaatgttgcatctaaaatgccgcaatgcctggcctcaatcagaacgctgtgttttcgatcttcttttagcacggggctgagcggtcgggggatacagagatggataaaacgtgtaaagacctatggcctcagccacactgtgcagcagactctagttgctccccttccccacccatgaagtgtcgatggggcccgtgggcagagggtcacctggggggggacactgggtctgccctgcggccccgcggctttcatcaggaggtggcggcagctcccaagatggggggaagggggctggcccccagaatcagagggcctgggtgtaagtaaaacccaggaggaggccggggacgggctggcagcgacaggactgcagcagcctgggagggttggaggagatcagcttagcctctgaaaagcagcgactcctggagctggaggagactgtgatgggtcgttaggccattcccttctttctgaacaggcctgcatgtaggccccacaggcaggggagggaacctgtgctcagcacaccgtcgtcctccaacccattgatcagcccttccttgtccatggtgctactcaacgtggctccagctggttggacccctgctgcctgtgaggctacaatcctaggcttaaaaaaaaataaagcagggagggcggtggcagcacgtttccacctggcagaccaccctggcctgctgtcaggccagagggctggcacgttcaacgaggtcctatgtgagaggggcttagccaagggcgaggcccacaccccacgctcatccaactccagaacacgtgctcttcccaccacacacgtggcgtcttgggtgagagtcaagtttcgaaaggctccaaacaacctcaggtatcccagctctcgtctgctcacctgccgcaggaagctgtctttatcacattcgctctttgcctgctgctgaaatccaggccgttttcccctgttgggatctcgggaaagctggtcgccatacactatcggcgtcccttcaccagcgttcagtccgcgagtcccgccttctcacctcacctcctggctctccccgagcaccaggggtggtgttgggctgcccaccacactgtggggcgtgggggctgcagggacctgctttgcagcggaggatacaaggccgggccctgtgttggcctgaacatgtagagaggctgtgggcaggtacgacctccatagtcacacatggctgggaaagtgtgcgttagcgaggaggatgggcgagctggtgggtcccagtgttcatagaacatttccagctgcaacttgatgcttctctctgctccctgaaaaccaccgagtcctcctctcctgcccctcattttgatggtctgtaattctctggatgaggaaccgtgtcttgtcttgtttagcattgggtccccggcacatggcaggcacagaatgcaagcctgatgaaggaggaggggccttggagggtcttccccacaaaacgtctttccctaaggggtggcaggcgctcctggagggcacacagagtgcttcagactgagcgtgtgaaagcggatctcgggactgtgagaaagggaaacttgctgagattcgggatgtggaatcaatggatttttccagtgactctgaaaagaaaaatctcactgagtgagcagaaaatgcaaggacaactttccaaacacagagcggcccctccatcccatctgtgattgctcagctgtttgccccggagggtgagggcgggcagcgctgggtcactaagcaactgggccctggcaattgctggcaagagttagcctggcccgtccttcagtggggcctccgggggtcggggcagaggccccacgtgcaggggcgggagagcctcagggatttctcctgtctggctttcagccgtgggagtggcagggtggggagtggggaatagatacatgtctcccttgtttcactttcccagttttattctaagcatgtaaagaccccgggttggtgatcccagtcgtttgagcattctcagacagcccagctggactgggcagggaccccaggccctcaagtgggcccagctgtgggcctgggaacccatgcccccagccttccctctgggtgacctcaggaggcctgctccctgctctcagcctcacttttcccctctgtaaaatggggagacttgatc

SEQ ID NO: 41516 - DNA, 2978 bp, Bovine  19866880992599
aaaataactccattaatttagaacacttattattgcattttaaataatctatttaggttatccattcccccctactagaacatgaacttttagtctctataaagagaaaataacttaccccaatcagctttccaaagagcaaaatatggaaatatattttgtgcccagtacgtggaaaaatgcacatggaagtgatttgaagaattaacagaggtttacgaaggcaatgtacttctaacttttgtataagcttcggcttcctcgtccataaaacgaggaaaagaatagtgcctttttcatgaagtcggcacgaggagtcaataaataaccatttgtaaaggtgctcagaacagtgagggcccagagtaagctgcctgcatcagtcactgttattactgtatcattttcatggtctgctctgggctgcaggtagaggttggacagcaaaaaagagggatcctagaaatcaggaacttagggttaaagtcagatattctgagtcatggaaagaaacactgctctcaaacaagaccacacctagacagtcagggctgctgcgtctgctggagaattcggtacagcaggcctgtctaaatgtcccaggctcagttccgtacagccttgggtttgtctctggcctcagttttcttaactattaaatagcagctctattgatttcactagggagtaagagatgagacacataaagcctctagcagtgccggggaacactaggctctagtcaaatacaaatttccctagttcactggcgctcctcccatcgtgtggcaaattatcatatcgatccatttgaccttaggagccaaataagcaatcctaattttttttttctcctttaaaaactggcttaggattacagaattcatggcaaggcagggagcagggaacactgaagactgtgccatttcgttctcatgcccagaaaattctgaggccccctgtcagctgccgagacttccagagcccaggcgatccagaaatggaggtgcagaaagtgttggcaagacagggaatgtgctggccggacagaccctaataaatcatgggcaccgccaaggcccacggacgacagctgtgcattccagctctcgacgcacacccgccaggccgcgcagcgcatgtctgcgctttggaaggggtcaatttttccagtcggcaggcgtgagagcatgtggtttctgcatcctgattcccagccccctctggcttgcttctgctgggttcttggcatccagcttccctatccccgggctcactggttttcaaacgagcgctccttcactttggtctccagctacctggcaggagtctgggctgtgacaagggactgacaagtatgctggcgagacagccagatgagataggagctgggaggtgggcgaggggcagggagctggggcgagaagggcggagggctgaggtccagccctgcacctctgctctaacacagagactactcaatctgagggggtgggctgtccctccaagaaagggaaggcgtgagcatgggaaccaggagagctgggggcagctcccaggagactgcagggtgggagtacaggatgtgtaaccgctcctttctgcttcatgccccagcggcccgttgaccccactcggggcctcgtaccgtcatcgctggtgtggtgctctgtggtcacatcctgggttgagtcttcagccgaggtagtctctccatgagggctgtcactgcaacagaagcaagaggaaccaaaattcttatcttctctttcacacagcttccttgggcatggaatcttacgctctgatcacacactacaggcagatgcttataatgaaacacaaggctctgggaagtctctaggctagctcctgctagcttactactggagactacatggaacttacaaaatatcttgacacaaagggaacctcatttcaacttagaaatcttttcaaaaatacagaatgactcaggtcctcaaggctcatttctttaggtgaattagttcctggagggagcaaggtggaagggaaatactgggctttagcatcggatacaattgcatctgaaaaccagctctgacactcagtagctgtgtgacgctgggcaattacttaatttcttagagcctcagctacttaatctataaattggggataatggtctatatacttctatggtttctcacagaggtgtgcaaggatttagtgaaataagaaggggtaattaacaggcagtgctttctttccttctttcttactttgcttgatgtctctggctgctctgtggtttggtactggtgagaaagcaggaggtgagtcataggagtgagtgggaaacaaaagcagggggagaaagctggctctgggctggactctgcaaagggcacggcatgtgagctgggtcaagctcttgacaaaattagtggagcctaaggtcatgtggggcggagaatcgagaatgaacagggaagttattaggaaagttctttctatccctgatctggactgcagagcacgtgggggagcggcacaaggatgctcttgcttcccaagaagcagagaaaagcctgttcatttccaaggcttcttcctctggcagcaaaaagtgagtcttcccaggcagttccatggagataccaccatccttcaaccccacatcctggcttcagtgttcacctttgagcctccgtgagcctgtgtgtgggctaagttacagccctccctcctcatgagatgggaccctaccctgcgtgaagtgagccggtttatggaggctctccagaccccagagagcactgtgggaggaccgagaactctctgggcttccgaacagcagccgggacatccctggctctccagaagagacagcactgtgggaaaactttctccttatcagaaaatgtgggtacactttctcactgtttgctaggcctaaagaccctctgaaggagttgggtgacattttggaaacc

SEQ ID NO: 41517 - DNA, 1054 bp, Bovine  19866881293394
tgaacaggtaaactgtctaactgttggtactgttgttctgtgtatctctggccgagtcctgagtcttgcttttcagtcagaatggtttaaatcaagaggacccttaatggactttggggaaccctgcctgtctgtggttttggctccctttaaaccacctgcttgcatgtgccctgaaggacttctgagactgcagccccagccctaccccagtgtggttttatgaggggcgtgcctccttagtcagcctgccttggagctgccttcttaaaaaccatcattgtttctgctttgtgggtgttcagattcctttgaaagttcatgcctttcaatctctaactcgaaagcagtaatattcttagtacttgtacatggctcaatttacaaagcactttgtatacattaatctctggaaattcttgacagattcatgattataacccgaggccttttggcccctagtctgtcagttttggggattggagcagcgaaaggtggtaaggtgcagggcataaccttcacgagaggtgataatctggctggtatttggatgagctcacctcatggcagaccctcccagctattgtcctgaccttgttcaaggctcctttcctataccctctccataccttgaatttttacattccccaggaagcttgagatcaacagttaatgcagatattctaggaggaaccatctgaaacagagtggcactgtgtgccgagccgtcaaattctctttcttgagaacattaggggtcttgtcttttttttttttttttttttttatgtcttaaaagaacagtgtgtgtgcaccacagagctgagaagtgaaattttgtaatttccatctggagcattttgatagaaaagcctcaggcctttgcctagaacagtttaaccctttcaggaccctttcagagcagatgaaatttaaaactctagacatattgtatgtgcacacacacttgggaatgtggattgctggtatttaaacaagctttttctctggggaggtgtgagcggttcttcactcctgccaacaaaggtctttt

SEQ ID NO: 41518 - DNA, 1260 bp, Bovine  19866881324465
aacacagacccacagggtggatttgacaagggatctggccacgtgtcaggatggcatttgagagaggaagaaagtttcaaatgatgtatttcatcatctgacgctctgagacagggaagtcacccatccaccacttcagtggggctttctgaatccacccccactcccacccccccaacagcgatgccatcattgctctggggctctggatgctgcagcttcaggtccagactcctcttcctgggaccagggacaagaacagccagttcctacccttcgcgcattcacttccagaagcatgaagtgctgttgcctaagctcttcctgctgccttctcccctccccctggccacgttatcaccactgttgattattcatggggaagaggtatagacagggtcactggacgctgaaaggaatccggtcttcctccctttgggactatggagcttcagtctggattcttcctcctggaggctggccaacttgtatcacatgtgatctttgccagcttcagaagagtcccagggtcctcgccagcaccatctctgctttgcttggcttccttccaagcctggactcattgacaggtggagtagggtggacagacagatacaaactaggctttgaaaatatctcatgagctatgatggaacatattccttctctcagtttcctcatctgtgaaatgggagtaaaacctgctatcagggttgcagagcaacccaagtgatgaggtgaagggactttgaaaagccctattcagatgtcacttttcataatatttgaactggcagggagccgtaccctaaaagaacacagtgtcgctcaggccttttcctaagtggatctggcatctcgtgtgccgctcacaagcagagactcacgccgactcctgggctactttggcctgttgtccgctgtattttaagattgtacgttgtgaatgtgtagcgctgcacttactctgcagaggtcagtgtatactccaaggacgcaatgtggcccgagaatctggggcctgtttttcccttaaatattgaattcccactgagcaaggaggttccttttataaggaaatgtgtgttctttcactggccagacaaagcaggcaggctcttgctggtgcccaggggtcatgcaaagcccctccctgcaggattcatcatcctgacattggccttcgaggtcctggtgagaccaaaaccagcttcctttccctggaccatagtctctggggtaaccacccccacccagcaa

SEQ ID NO: 41519 - DNA, 2287 bp, Bovine  19866881339891
agtgaaaaagacacttggaggactgtatcaattgttgaacatttggcatatagttttacgactggcggggttgttgttggtaatggtgtctgtgtgtttatttgtgtatatgcatgatactccatgattaaatgaatttatgcagagcttcccttgtggctcagctggtaaagaatctgcctgcaatgcggtagacctgggttcgatctctgggttggaaagatcccctggagaagggaaaggctacccactccagtattttggcctggagaattccatggggtctcaaagaatgggacacaactgagtgactctcactttcatactttcacattagacagtttcttgtgaaaggaagccccaggtgaatacgcgtgtcctctgatttctgtgtgacttagtagccctcagctaggtgggttagtaccaaccagggatgtctgaacaccggagagggagcagagttggaatcaagggactacagagaggagcctctgtttgtcattattaatatttaactgattgtggacttgtagcctgatggaaacagttgagaaatgttctgatggctggcaggccaaactcaccaatcatctttctttcaactgaagttctaattccatggtggggtggggttttgttttatctttgttttaaaaagcaagggtcagaaacatgacttttgaaaggcagtactctgcagtgcctaagagaacagcctggaaccagaagacctaggtttgaatcctgatgttgccaattagtctctgtgtgaccctgggtacctctgtgttcctcttctgtgttttaaaaaattgagatgatagcattaccttctcaattgtgttcatgtgagaatttaatgaattaatatatggaaagggcttagaacagtgcctggtagaaggcaacttaaacatttagggcagtatgaatgttattattatcccctcccatccagcggctgtaacaatttgcctgggctcccggcacttcttaggatcacctttccgaacagtgagagccgttttccagctctgctcggttgctgagctgaggcgggaagagggtgccccgtgcagcacaggcggggcagggccactcctgcctgctgtgggcatcctcacggcgtgttggtggcctcgaggtcgtcgggaccctggcacctggcatttgcaccacttgtccccagcacagagcacagtctcgtgcctgataaaggcagtcgtctgttttactattaaatctcccagctcttggaaacacgcggagggacagcgggtgtgtaaatgacatatgtctcagcaggaggttgacactgggtgggagctgtgttggcaaaacgggcttttaataagggaagcttttagaaaactgtctccccactgccttttcagtgaaaattcctctatctcaagcttatccctacttcaaggactgtaacggagctctggttaatgctggatttgccaacaggagacgttcaaagttgatattcatttctaggattaaagaactcgtgtttattagatagagaaggaaatctggtggggactgggagggagagagagaggtagattatatgaagtcatgtgtgtgtgtgtctgggggtgggggacagtggccgtggtgagaatccgtttccagcattccaaaagggaatggtcaatagcacacaacccttggaactctcacagactgcctttattctcagggaatgtcccttgcaggttgtagaccctttcttctacagaaggaactcggggttaaccttttatctcgtttggtggatgcattagccatcttggaataggaaatggtctggaaaatgggaaaagctaagttcaactcaacactgagagagggatacttggacatgccgtgcacgttactagtggagcgggtcctccctggaggggtgtgttcagagctgtaaagggttacgtggtaggggttacagggtgaagggggaccctggagcttaccatcctgacctccccctcctgtgggagacctgttttatggtgggagtgcgaggtgtttgccgtggagtctgctggcacgggaacagggacctcctgggtgagagccccttgtcgagccttgatagctctgtctcatcacagcatcagtggtcgggcttaacccacctctctgcacagagtggacccccatgtgacagccacggagtcccacagacccagcccctctcttgggttctttgcagaagaggttactgggacacagacattgagtctctctgtagcaggcccaggaacctggggca

SEQ ID NO: 41520 - DNA, 600 bp, Bovine  19866881739203
cttgttggacacttgagtcctttggccttttgctccctgcattgtctcacaaacaggggaaggaaatgtgggattaggctgtgtgctccccggaactggggattctgaaagctctgctgagtactgataggattggcccgttggagagacttctcatgaaagctgaagtactagcacatgaaacagtggaagttcgacttccctgatagccacagaaatcacaaagttggctctgggaacgggtcttgagttggaggatcccttggaccaggtgttttaccctgtctctgttcttcagctgtatcatgggagtttattcattcccaggagtggaaaaccagaccccagagaggagctgggagactcaaggagaagtcttagctttctgtttctttccccccagggactgggcaaagaaaggccacctccttcctggaggtgacttgtttgtctctctgtaaaaccacctgaacacatgcattcgttcacatttcaaaaccactttattagcaaaatgaacaaaaggagaatggcatttaaattaaataaattacacaaatatctcaagagtcctggttccagggaaccacatcagtatca

SEQ ID NO: 41521 - DNA, 666 bp, Bovine  19866881743024
agagaatggaagaggcaatgtaatatttactatttgcctttcttacttttagatcaaaagtataaataggatcaatattttcttttgcacccgtgcaacagtctggctggagcaccctgctgcaacagatccagggggacacggtgggggtggggaaagcaccacttcggcctcctcccctccaggctgtgaccacgggctaggactgtggctgcttccccggagcctgaatttgctctcaggagtgtgggggtagaaacacagctgtgacagagacgggcatgagacaggcactcacagcatcagaacctagtgtacacatctacctttttaccttttgacacagtcagtgctggagaccactgggaccgcaggatgtcaaggcagatgctgccattgctgttgatgttgggatgataaattttggttgtgaaaacaacctgcagagatgagagacctcaagtcagacagaccacagggacattctagattgtttatctgtctggaaaatgaaccaagtaaggtggaaatgaccactactgggatatacctggccctgcacaatcctgggtgagctgggcattattccaaaccagaatgggatacaggagggtgcacctggaggagaagttccccaacccattccctgctgggctcttgaactag

SEQ ID NO: 41522 - DNA, 833 bp, Bovine  19866881974643
gccttgggtgagaagaccgtctggcaggcgtcgtgtgctgtgctcgaggtcgtccaggagggcataatctgggctccagcacttcctctaagacctctgcaagctccctggaaagatgagtcagaccaaactcctagaagtggctggctggaggtcctggccctccctggggctcctgggtgtgggaagctggctttcccaggcagttcttcacttggttaactggcccaacctgctctgtagactgtgggctgagttccaaactcccctgctcaggcgaaccacagggagatacagaaataacaccccgtagcccaccacagccgcccagcctcagtgctcggcctctttcgtggctcagaccgggttctgttgcctgcacttgggaactcagagcatcctctttctccttcctgccaggctggtggcagccgccagctgcctctgtctctttaagagagagaaggaacgaaatcaggaagtgggagagagtggagagccgaaggctgagtttcttcaggtctccgagacccgtggccaccaggatgctacggatgtggcccgtgcagggcagcaagccctgaaagtctgggggtgcctcgcagtcccacagcctgcctgtcccacagctgagatggggtgagtgtgcagagtccacgctgaggggaggagggttgaatgggggcgtctgggagccaggcggctgcaggacagcaatcagcgaagtgccagggtgctggccggccagggtcggctctgcgggctcctgcccttgccgcgtatctctctgaggctgctgccccccgccccgaggtgccctggcaccatctcag

SEQ ID NO: 41523 - DNA, 1119 bp, Bovine  19866880245857
acccaaataaagttacattcctatagggtgagggtatagtgggttttagttaaggaaagaatttacttagcctaaggtctaacgtgatttatatcaaaggttaatacttatttcttctatatattcattaatgtgtgtaagggcaggggatgtggagacttagcaacaaacattggctcaacaaatgaaaaacccttcaccaatacaatttctaatcagcccactatacttatactaatggttttctaacttttctaaggaacctgtttttagaaggtttaaagcatctcgtgcctctcacggttgggaggctgtgagcaatcacatgtggccggacaagcctgtcaggcaggctagagaaccttcagaggagtttgtaggttaaaacactcttgtcacgcccaggagattttattaactggagctctaagttaactccttctccgaaagaggtggtgggggacagccccccgtaaagtcagaggtgtaggtgagagcacaagtagtaaagtaggcaggctctggttatgggggtagatgctcaaggatttccagggggactcctgaggctcgatcccgcctttgcgtatgtcgagcctccttcctcagagtgccgcactctgccccaacattaacccacccagcaacttagtttaaccccatcagttttactgctacttagtaaattaaaacaacataagagggaaatcaaatagtgttgcttttaacccccagtttagcctggataaataacaactctaaacgaaaagaaatcaaacagggtatttgaattaaacacctaaggagcttcttaaaactacctaagctatacagacaaatgaaacatttaccataacaatttcagcgactacagttttcaagtctccacagctaaccattttaaatttaattttggctatctgtccaatctagacagtagggtacatctagggagggaagacccatgacttgctgcagcacttaaacctctaatcccacagaaatttttcttaaaatagctgaagtgaccagcatgggcactcttcttgagttgatattaacagcagataaagacatttttagtgaagaaattctaccccaatggcatacacatgcaca

SEQ ID NO: 41524 - DNA, 1472 bp, Bovine  19866880681791
acctcaggatactgctgggaagactcagtgaggccatctacggaaagcacaataacactggtgtgtagtcagcgcccaataagaccaagaatcagtattgttattataaatgataaacaggagaaaacggtgggaacctgaggtctgtctctgtgttatcaaggggtaagagtctgtaggaccgaaactggggcgatttcaagacatggttggggaggtagaccctccggtgactgcacttagttgggggaccaccctctctcccagcctctgttcccggggttcctccctccctccccatctccccactccacatcctgctgagccccgccactcacagccagctctcaccagcccagagccctctcccttcccaggcctcccacagaacctccccccgccaccaccaccactacgcctgtgactttgcaactttataatttgctgcggtaaacagctaccacccacacaaatgtgagtccgtgggaagagggacacgtgctggtcaggtctcctcaaagacgagaaattcgggggaggcccccagtctcatgctcctttgtgccctgcggcgcccagcacgccctggacggccagctcttggttaacaggcatctgggagatggaaacgcaaacagagctaactgtggatccagaggagccgggttcggctcccagaagaaggcgcaccagcagccactccatcattacgaggacagaccgccaccctgtcccatctccagagacggcgcccgcctgctcccagggacgtgtgtgtaagcgcagatggcagaaggagtgctgggcaagcaactctgccgccctggcctctggctgctcccaggccttcgtgaatgaggctacaagtccagtcactcctgcaaggaagccaccgtgactcccatccccaaggttccctcgacccaacaagggccaggcgaagcccagctctgcccacaaggcagtccagagcagctggccagccaacaggctgtaagcctcttacagattaaaggtcctaatttaaacctctatttgaggtaccacaagtgggtcagcgccctgcaggccggtcagcacagctgatggaaggagaagcaagatccgagaaaggctcctggcctttgcaggaaagatggagccagagaattaccgagctaagtggtcgttctgaggcggggagctggctcaacccaatctcccaggaatcccctccccagacagccagaactcgaaactcccctcccagtccacctgtgaaaaggagaaccacagggcaaagtaatgggtcgggatggccttcctctcccagccctgaccttggtatggaaacagctaatcaagttaggaagccagagaagagggcgcagggctgaagacgctgctcctcagggggtcacacctgtgacagaaggggaggcggcctctgctcccacccctggagagctctgccgggctctctgcccagctgg

SEQ ID NO: 41525 - DNA, 1845 bp, Bovine  19866880713883
gaaggaagagctgggaggacgggactggctggtgagtgataggtaccttctggttttattctttcctggaaaatgtgggataagaaaggggagatgtggagacctcattttcaatttctttgcaatgtcaagcccctcttgtgatcaaattgtctcgctgcccaagctagaccctggaggtagggcgagaccctggagccaagtttgccagtgccttgtttctccagctatctcagttctcctagaattgggagggggtctgggtcctcttataccccagcctctatactcctcttggaggcaacccctataccaggctaatacacgcttggcttaaggccccaaagccagaattgtggtcaatgtgactagacttggaactcaccctcgcctcacctccagcctcattcgctgggttcccagggcagtgggaagtgccttgaacaccctcacccagcccgccaaggtctggccctgagcagaatcttctctgtctggcagctgcaggactagcacaccagggctcccaggcccgacgctgtggacctgcttgtcccaaacctcacggccaagtgtccaggccccacgagcagggaagtcctctgcaggcagcactctggatacccggtgtctctggagagcccctgggtgacacggacaagggagagagggtcacaaagccacctcccaccccctttgtggagagaggtcaggctggagggccaggttggggtcctgggtcgcgctcagcctgggctctgaaacggcctcactgggtgaccttgggcaggtccctcccatctctctctcacctgtaaactgagacttcttcttccgctcctcatctgagggttcagcaacattccccttcctctggtcccagatgctagggggtcttggccagcgctgatctgactctctccagacagatcctgtcctcactctacagccttcagagccccccttagcttccttccgacatactgcctgccagccctgtggccgtgtgtgctctcggaagcctccctctgcctgctcttcaggatcgcgggcctcacggggcctggcagtcttcagtcttggtcgccagcacatagcacagtgccaggcacacggcagaagctccggttccctgagttaagactggacacagcttggcgtccccggctctcgccttgcctcccctgtcccctgacccgtctcagatcctcaccgctctgtgctctggcttccctgaggagagaggtgcaagctggcttctctgtgggtacccctgcagccctgccagctcccgggaactctggaaactggtacctgcagggccaggtcagatcctgccaccgcagggcaaggtgctgaagatttttctgactccagccttgaggtgtttgcttaagttgctgggctgctctgcccaaaacatgatcctgcctgcacgcttggcccaggccccacgcagggcacaggtacaagaagccagcaggtgctgataaggctagaggtggcaggattcgtctccttcttgaggagtttactagtgtggaaactagctgctccttagctggaccagctccaaggtgacatcgttagaagggcactttgtgactactttggctttacctgcataactcagtaaatcccccaaatctgtttggtatgagcatatgtgtgtctatacacacaccgctctaagatctgctgaagaatagggtggagctctggtcagatggaaactcagggataggctttaaagggagaacctgggatggagtcgggggtcaaaaggcttggagacacgctgggacccctcctctataaaaacagtgcttccaggacagtccctgt

SEQ ID NO: 41526 - DNA, 1524 bp, Bovine  19866880873576
cattgaatatacatgtgttaaatatcaagtcacggttggctctgatatatcctgtaaacagagtactatttaaattgaccttctgtttcgtagattttatcattcagaaaactaactgcggagttcacagaaactgaattctttctgaagtgccctaaagcctgtctattttttcattgcttaagaacaattatattttaatgctgttactcaattgccttttcaattctttggatgatgtatctcctttttagccttcatggctctttcccttgtctttaagtgaacaatattatttaagcctattataagctgaagtatgaaaacattctttaaatcattaagcagttcagtcttttgctaaaagcatttggccactaggtcctgttttttttggcaggttttatagatatttgcttactgtcgataaaatactctagatgttttaagagcaaatgtagtaaaatatgacttcttcagatttttctgaaacttttaaagaatgtgctttatagctcagtataaataacagaattctaagtcatataaagtgagttaagttgatacagatgccttctcaagactattttggaaaaaaagaataaagcatgtattttctgtacttccttacatttagtccagttctgcttttgaattggagcattatcaatataattctcaagccaatattccagggcttgttaggttgagggggaaggaatggaatgagttttctgggggctttctcttggctatcatcagtttcttcagatattttggtaaaataattgaccatgatatttttaatagaatgaaaagtgctgaaatgtagaaggagggaatatttatgttttattgggattttgctgtaaacctaatttttctatttctgaatgagagaaaattcatgcaaacccctaagaaagaatttgccttttttttttaatgtccacttaaaaacactccacttgccttattttgaaagtataagctgttgagagtaagagctaactttatacattctttgttattctctcaattttatgctgatttaataaaatttaattttcaacgagacaggggaaagagcaagtacgtgtgaaggtgtctcgtactttacctgttgatcttttgtgtttgcctgtccaaggatttatttacatcttttagaagtgttggtatatatgatacattttagcttataaaaagaatgtgattataaacaaatgcccatgttgctttttaattgagctttaaactttcataatccaatcactattttccttctctactattcagctcttactacacacatgagaacaccacagcacttaagtttcatgattcactgtaactggtgatgctgcagaagtaagacctctggtaatttacaaaaggtatatggttcagtaaaattacatttctgtgtcttggaaaatgtccattaacacaactggcttggtatctatctggactattaaaggacaatagaggtttaaacctctattatgttagaatgttttt

SEQ ID NO: 41527 - DNA, 1637 bp, Bovine  19866880968497
tgcccagaccctacccttcccccatataagcctgcagacctgtttgccttgcagtcttggagtaagggcaggaattggatggcgacaggatgtgagggaaaaacaacaagccctttatttggtctgggaacttcagggaagtcctggggcttcacagtgttcaccagtagggactgtacatcccattcaactgtttgtctctagacaagtccggtttaagtgtctcccttgcccctaccctcacatcaaggaagtccttcccttttcagaagaaatgcaggcctggtacttccttagcataaatcaaaacataccatttttttcagcctggcagggtggagacataagagcacaaagctagaaagtcgggaaccctttctagctggtctagaggtctgatgcaagcttgggcatttcccaggcgtgggtaactcatccttggtttccacatatgcaaaacagtgatgaatagcccctgtccccgccacagggctgtggccaacaattagatgagatggtgcgtgtggaaagcaccctataaattgtaagcgctctataaatataaagcaccatttttccttaaccttagttagtaacacaactccgtttttcatctacttgctaatcccagggagaccctagcagactagaaactaccaatccatggggttctttcccaaccctaagaccccagcccttcccatatcttctcattctaagcagaagacaaaggtgaactaagcaggagggtagagccctcatccaggaaggctcaccttaactgggggcatcaactataaagattctgctgttggagatggagaacagacttccggttgccaaggagtcagggtcagggaaggaaggattgggagtttgagattagcaaatacaagctactttatataaaattgataaacaacaagttcttactgtatagcacagagaattacattcagtatcttgtgatcaaccataatggaaaaaaaaagaaaaatgtatatatatatatatatatatatatatatatatgtacatacagagagagagagatagaactgaatcactttgctgtacagcagaaattaacacaacattataaatcaataattcaataaaatcttttttaaaaaagagagaaagggaaaggaggaaaaaaatgattctgctgttgggaagcacagggctgggagtcccagctgacccaaattgggatccagagactgggtgtatccgataagccggtgaatcagaggtcctccagacctctatttacaggagaggaagagttcctgtggtcaagtctccggggcagaggaggagaacccaggaaatgggcgtctacgttctctctcctgagccaagccgtggtgactacaagcaaaagctgaagggcagtgttttcatcatacttggggcccacgtgtgggttaaagaccaaactacaatgaatggagaggaccccacacagtggactgcagaataaagtcgctctttcttcctacagcagtctcaagactactggagccctcggcttcataaggtcattcatgagctcagagcctttccatctgttgtttcccgtttgccaggccactggtcgttgtgccccggttgatgctgggtcaccagcatgg

SEQ ID NO: 41528 - DNA, 1783 bp, Bovine  19866881319256
gagggccgtggaccggaaggactctctcatcacaccagcactgtccacctgctcctacgcgccgtggaacattcagctgcagttgctgagtaggtgaaatcagacttgccacctgtaccatcaaggtgtggaccccactgagcaccaccggacccatctcttacacaggctgaccgatttctcctggtgttcagagtctgtttttgtctagcaccatttgaaatcggttatgatgtagggggaaaagcagcagcctcaaggtctcgtgccaagtctggtcagcagcagcctgtggcttcctggaagatggatgggcagagagagggggagggaggttacaccttttcctactgacttccttaactacatctacaatactttatgcacaggtaatagatcatttagtggatttttagaaacaaatcaccatagtgtacctaatgtcctcagtttgctaaaatgtgatagtgctgtaaactccaaattggtttctgttaaattatctttctgttcatgcatcctgaccttaataaatatttactgtattaaacttaccatgtgtttgtttttcatagattattttccattcataattttatgatgataagtggggccctgaaaaattaatttgctatatgcaaatgttacctatttcataaagagttcaaagtcggttaaagcaaacagatattaaaaatgtagcccgttaagaatgaaattctgtgagccaagaaataaaatgagaaaaacaatgatagagaagtgttgcagacctgagttgaaggggaaactgacctcagtcgcaaataggctgcagccctggagcctttgcagtcagcattcccgcagaaatgtttgcttaactgaggccggtactcaaccgtggcctctagagggaggtgcactgatgaattcagcgatgttaggagagatgcagacgttctctacttttgttcttcctttctatcaacccttgaggacagagtgaaccagttctgtaaaggttctcaagagatgagccagatttgacttcacagggggtttcacttgaggagtcttcaggttggagagctgtgtccccttgattgacctttttgagcagaaagtgcaaggccagccctaatctacctgcaggactttgatttcacatctattctccatacatggtggcacctcaaccacttgggaagctttttaaggtcaagttcctgccagtctccccccagctggctgccctgcccggtggggtggggtgaggtgggtgaagcctctgttgggagaacttccctgggaatggggggcacctcccactgtagctgtagggctgtttggggctgttgactggagaattcaggttctggttcccaggatgtggtgggaacagttaagaccctggattgttttcttcacttctctgctgaggtagctacaacagacctatgggcataaaagctttgggtcaactgtaagaaactgaacagcttctgattcacctactgtgtccctggctccaggctgctgctgccaagtcacttcagtcgtgtccgactgtgcgaccccatagactgcagctcaccaggctcccctgtccctgggattctccaggcaagaacactggagtgggctaggtattgccaataaagcaagtcacccgtggattctgccagcaggttgctatgattccagtccccaaatgagaaagtgccagaagatctgggtttaacacgaaagcataaaaacaatgacttgggacatcttttccataaaagtagtttctggagtt

SEQ ID NO: 41529 - DNA, 466 bp, Bovine  19866881346951
ttgaggaaggccgtgggggaggagagcgcagagacaggtggttgagggggcgaacgatggtgcgggaaggcttgtgatcttaatgcgtatttctttctcgccccttcttcgcggtgtgggcggggggcgcggaggtgcgtgtggaggaggaggtgggaaggctttaggctcgggagaggcaggcgcagccagagatgccactgggcaaatgtccctgttcggtgcccgccgccccccaaattaatgaagtgggtgtggcggtgcaggtagaggagttggatgaagacctggccccgaactgcccggaactggctgcggcagcggccgggctccccgctgcatgtctgggagccgcatgcactgagcgctctgcagcggctgggggtgggggtggcgggtggccatgccctctcatcctcctggaagcttcagccacggggacagctccggagatgggggctgggag

SEQ ID NO: 41530 - DNA, 737 bp, Bovine  19866881398140
tgggcactgctcactgaaggtctcggtctcccatgccttcgtcagcctgaggcttagagcagtccagggggagggaaaaccaggtttttgagggggagggtaaaagccagagatatggcagctcatctccgacgagttggacctgtggtttgtgctccccaaataggttctgtctctggcagtctctccatggggacagggggtggggtccgtggcagctttgacgatctgtttggatggccctgccctttccccatttttttccctctgtgttcctccgtacgtcccctgccagggccgtggttccagctgtagttctccagtgaggctccctgcctcccgtccctctcctttccaggcccttctgcgtgcagcggccatcttgtctttcttggtcagaaatttaaaatggtttctcttcgtctccagagtgagatcccttcgctttagcaggatgctggaggttgtctatgactagtctcgtcttagctctcctagacagtctcacctttccgagtttgcctaagtggaccaagtattccgggaaaaccaggcaacttactttttcttgccttttctctctgttctcactgctgatatttcccatgcctcctccactgctcccacctgcggcagtcccaccatctcccaaggacctttcctgattactttcacgagaagcaatgctcccaccacccctgctcacgtcaaccaaactcccatatcttcatgcgtct

SEQ ID NO: 41531 - DNA, 756 bp, Bovine  19866881608284
tttaattctttatttgtgtttaaggagatttacctgaactggcttagaagtccatttgaaatgaataaagaacaaatatataggataataaaaataaacctgaaatttaagacagatagcagatagaaggagaaaatattatagataatgagaattattatgatcaaatatcaaaacactggtttccttactatttgataatttttgaatgaccagtgcaggtattaaccaagatactgtcttaaatacagaatatgcatcagtgaacattagacacaaggttctcaccttcatggaatttatattaaaatagagggaggtagactataaataaatagatgatatataaaggaaataaacagaattatgtatcaaaatgtaatggactaggaaaagaggagacaggatggcatacaacttcagttatgatgattaaggaaaacctatgaagaatagacatttgagttatgactgaaggataagaaggtgtcagcaaggtaaggtgctgggtaaaagcaatggatttgctatgccttaggaatagactagggcttccctggtggctcagatggtaaagaatctgcctgcaatgtgggagacctgggttcaatcctagggttgataagatcccagggcatggctacccattccagtattcttgcctggagaattccaatggacagcggagactggtgggctatagtccatgggggtcacaaagacaaaaggcaagtgtggctggaattttggtgatca

SEQ ID NO: 41532 - DNA, 1523 bp, Bovine  19866880548059
atggacatgagtctgagtgaactctgggagttggtgttggacagggaggcctggagtgctgcaattcatggggtcgcaaagagtcggacatgactgagcgactgaactgaactgaactgaagtatagataatctcctcttatctttcaaacaagaagccagacagacacaaaaagaatcttttttttcagtttccccatcaccttccttgtgtttcatctcatcagtgcatcctctctcctctttcagggttgatttgaggggttgagttaaggaaaagttgcttctgtgtcatgatgtcatcttcagatctttccaaacttgatccaacattgaaggattatcctttccatctgaattgcagggacttttcacatatccttccatcttctatggcttttataggaaaaccctaagcttagactctcaagctttgttctgcctttacactgggaaagtttgggaactgacaaagtatttatttaaaaaaactttctttcaataaaacctagtattagaaaccctcatttctctatgaaagtatattagaaaagtgtaagacccaaaattgaggaataactaccttgttttaggctatgtttaccttccctctgtaaaacaaggaattaaagaatgaagtagctagaaaaacatggaaaattagaatcttaaagggaaaaacccacagatttaatatctcaaataaacttccgctgtttcatcattaagactagtaaaaattctcatgcttagtcactgtgttcctgatgttggtccataattctcagcagaaagcacagatgtggcacaaactttgtatttgactgccactgttttttgctgcccacccatctggcaggccaggagaagataaaagcctgtctcacgtaaaagctcattcacttattcattcatatgctcattcattcattcattgagtgccagatgaatatgaagaagaactacaacagaaataacagtaacaacacaatcccacttttagcccaaacatagtctgtctgtaccactgtagtgtttaaagaagtcttcaagacttctctcagggccaaagcagggcattagtttatgttttttttttttttcgtggtgcagttaacttgagaaaatgctctggggaagcactggttctgtcacatttgctattacttttataatcaggaaaaagagcatcataaaaagacatgattttgacctcacccctggccttgagtttggcagctctaattaaaaagtgaatgtacccaatgtcttacagaataaagcccttttataacaaataaccttttgatggagaaaccacactgtttgtacaccaaaaagtaattttaaggcttatcttgagctaatgccagggtaaatagaagctgaagcttcttgcccttcttctctctttaccaaggaatcaaagcagatctatttcagctttctgctttacaaatattctactgtaaattttatgcaatttgcaaggacaaaatcctttccagtgacatttggaacaaa

SEQ ID NO: 41533 - DNA, 1231 bp, Bovine  19866880577905
tcatacatgtagaaacacgaattaaataccaatgagtaaagaaaacagtggaataggcagtgctgataacttagaggaatttttagaggaattacccactgataaattatgaagtgaataataccaaactggatttcaaactactctcccccatctttcccccccacacaaaatagtacattaaagtggctctcgtatagtagtaagccctgatattatatttgctaccactagccccatggctttcttcacaagtgaatattacaattaagcattcccttttatggaagtgtcataattaggttagacttgaaatgactttttgaaatgtaagtaagaatggtaattgtgttatttattgttacgctctcaatatctggagctttgctttgcatgaagaaggtgagaaatacagatttaagcaagtgagtaaatctatagctgacatttatatctgtttaccacaaagaaggactgtaaaatctatggaactgtcttgcaaagatacttcctttttgaaaatgccatgtaacaagtttttgttgttattcagtcactaagtcatgtctgattctttgccactccatggactgcagcatgccaggcttccctgtccttcactgtcccggagtttgctcaaattcatgtccattgagttggtgatgctgtctgatcatctcatactctgctgtccccttctccttttgccttcaatctggcccagcatcagggtctttttcagtgagttggctctttgcatcaggtggccaaactaaattggagcttcagcattagctctactaaggttcattaataattggtttgttttagaaagcaaaataaaaattaggtataatacacacgcagatctatgtcaaaatgggatcatatggcagcttttgttaattttctttttgaatagctagaagtaagtttgattacagtttttggcccaaaacactggcttttgatcttctatttgtataagagtgtatctgcatccatttctaccaactactttcttctgctaatgctatgttttctctggttctttgtacattttcattcaagtcctaaatgtggaccttttccaaggttctgtctggactctaacttagatcatttcacacatctttaaatataactcacatacaaattgtatcctaaaatgtcaccagtagtttttatttgtcactgcaatgtttttatgttacttgcccgaaaggtcaaa

SEQ ID NO: 41534 - DNA, 1600 bp, Bovine  19866880680207
ccccttctttgagaaacaattgttgctcagatactgaaaacttcactatttcccctaaagtcactgcaaattatttttcccctttaaggagtactttggtgacacttctttatatttttactttttactttatacatatattgctaatagtttctttttctaattatgttagcaacctccacagtaattgtttttgtaattactgacccttctcactttgccagagataataaaagtggtaagaattatacagctcaattcagtgctatgagataaacaggtgaacattgcttattagttataaatttattttatgtgaattagaagcaataaaactataatatcatactcaaagtttcaaagaaatccatcatataagaagaaactactatcataaaatctaattcaaattaaaattaatagaaataaaaatattgtaaagaaaatacttctggcatggccagttgtcctaccaagaattataaaggtggtgtttgactgaataaatgaaatttgaaaaatatttccctagagtaatgggtgatgtgtttagtaaacaaatggctgggagactgtttgttatgattcaggtcctgttttatttgtctcaaagttttatatatttttggaaaatatatgctactctcaactggactgttaaagttattttagcagatctgatacactgatttaaattcattgtgactttccactgtaccaagtgttccaagctgaatactgaccctattaagaaaagtgatattgcttatttaatacttcacacatttttgcacacacatacatagcagaagatagatacatacatagataatagaggtaaagttataagtataggtagtcgtattttcaaccatgatgctcttttgctgccttccctgtaatattcccctctcaacatgtagtcgtctatgttcttccagaagtgagtcagtttttctagactactgtgaatttgaaataaaaagaataaattccaggctaaaagaactttttatttattctatggttgttcaatccaaaattcttgttctttgttcctccccaaatttcaaaatgcatgactaaaactgatctccatgccactatactagaattgcattatttaacagttttggaaactttatcagttacatttagattggtccccaaaattgggggcaggagaaagtgaaagttatagcaactttccagaatgcctctggatatcagtggtctttctttcactaaatatagatctaacattatgcttagattaacataaatgaagacaaaatgagtcttgatgtacaaccaaattaaattatattttttacttgcccagcttcagagtgaatgcaataaagtgcccacatttatactaaatattaaaatatttatctaacactgactgaataggctacagcctaatttcaaactttgctatcagtgcaacttattgaaaaaaaagagactaaaaaaaaatgaacaaatttgtctccacctgtatttgttattaccttgtctttgaacaatattttatacttaaaaaatattgtccatatattcccaacaaatcaacgagtaggttatagcatcacac

SEQ ID NO: 41535 - DNA, 1287 bp, Bovine  19866880801758
tgttcaagtttaacagtgtactcgacatagtagagctgctgctatttttattaaacattatacctctttagaacatatttgagataggtactggcccaaactgataactttctccagatcattttgcataatgcagcatctttggtatcggagtgccaccactatcttaaacattctgactgactttgctgagtttgcagtggcaacaatgataacgccgatcgtaaaaagcaagtgcagagcagtgactgtcaaataaatcctaacatgttccttatagccagactgattttttaaattttcctaactagcataatctatattccagttaataatttagtaataatcagctccttatcttctgaaaaggagagtctgttttgaatcacaaggcaactgaccttgaaggtaggtttaatatatgcagatttctcatatcacctctaagctttactcagagtattttcttggttaatttaggtctcagctatgcagccctccttttgtctatcctaacagtaactgatttaattacattatttttcactctcctttagtttggagttttacatttattgtgtaactagttttaaataaaaatatgatgttttaatgagcaaatagaaaaaaatgaatagctgacataagctgtaaatattataaaaataataatatatttttaatctaatttgcctattaacaaggtactatgtatctttctctaatttgcttatttatttaaccttttttttagtagtgatgtgagttatttgcattgatcacattgaaagtggatctaaaataagggtttaaaattgtttccttcaggaattgaaaaactatgacttaagcagtgagctatgggaataatttaattatttaaagggaattagaaaactttgtaagcaaaatttatgaaagttcagttaaattttaaatgttgtccagcaattctaagttaggagtatatatcaataataataatagatatttttaatgttggtaatgactttggtttaaaatacctaatgagttatatgattttcctggtcattgcatgaccatcagctggatcaaagtagtgggggggggggaggggaaagacaaggaaaaattgtttttggttatctaaaaattatgtatagtctgggctttaagaaaggacttacttattaagctctttgaaacctaaaatcccatcccatttcaaacttctttgcaggtcagtgagtagcaacttactttgaagattaaaatacatatttgcatttgttttaatttttaggt

SEQ ID NO: 41536 - DNA, 1138 bp, Bovine  19866880805836
tgatggagtaatttgtgagaactgagttgtggaatctagggagttaagaaaaaccataaagagtaacctgggttctcttagtgggaaatgagaagctgaaggagaaatggaaactagcctttattcacagtatgctggatacaacatttcatttaatcatattattctccttttaaagataaggaaacgaaaacttaggtcctgtgtcctgcctaaaccatgagttttatagaagagtgccaggaatcagaaataggtttatgttttgatttgttttgctttactcgaaactgtaaattgtctccagttaataaatggagggggcttccccagtggctcacatggtacagtctgcctgcaatgcgggacacctgggtttgatccctgggttgggaagatcccctggaggagggcatggcaacccactccaggattcttgcctggagaatcccatggacagaggagcctggtaggatgcagttcatgggattgcaaagagtcagacatgactgaatgactcagcacacacacatacacacacacaccctaattaaaatttcagcacaattattcagacataaacaactaaattagaatctcatcctgaggaataaaaggagatacaaaataaaatattataaccatcctaacactgagttcctactgagttgcatccaataaaataatttcaatttaggaaaagagtgcagagtcttaaaaacaatataaccagtgtatgaaaaaaaatcacttcaataaaaaagaaagaaaaatccaaaggcccattgtactcttggcatattgttggcagatatttttaaatccaaactccagaacagagtgttcgagctacttaagggaaatgcccaggggcaattgacctgggcctggaccaccactcgggcctctacactggcacagagtactcagcactgaaattgtcagcacagttgaaggtatttacgggaaagccaagattgaaggtgaagggaaatgagatggaggaaatgaaacggctgtattattcaaatgtgctacagacaaattggaaaaatgcactctgtattccaggtaaatgtattaggttaactgattcccaggtgttcttgaggataactattcagcaaacactttttaa

SEQ ID NO: 41537 - DNA, 1015 bp, Bovine  19866880861867
atcagcactgtctctctatttttctttctctcttcactcaccacaactatcactagcctacacttctgtttttgtgtgtctgactcaggtacctctgtgtagtgaggaactcatctgtgtttatatctcaacagcttatgatttaagagcaaaaagctatttttacaccaatttagaaattcaaagaaggactctgattgtcccggtttggatcacatatccatcttttggatactatgaccaggaggatgtagaactgtcattagcacagcctgagatatttcttctctttggctacagaatgagataggctcaggcagagtactttgatatgtaacctgtcataacctatcagagccccaaggatctggaaacaacctcctggaaatcaggaattgtagtgtatcctttagtgtctttttccccctatattctcctctgaacggaaaaggtgatttcagagggcctctcttgagaggaaatgtctttgtgcttaaatttaatggttaaagctatagttttaaaatatattttgttttgttttgtagttatgtttgggctgaattaaaatgatattgttttcctttttttaaaacagtgatgaaatagatatggtattaaataatcagaaaaagataggatgtttgaagtatgatctaaagatattaaattgaactgattaaagatttatatcagttggtgacaaagaattagaaaatatatttatgttagtgatgaattgaaaagacctcttttatctgtctccccaaatcttttgcataaatccaggcctaacttatgctcctccctgtcagtcttggtaatctgtgaaatttcagtcctcatcaacctctcctttcactgaccctactctgcttacttgttttgaactgccacaaagtagaaatttgatcattcctttgaaatcacagaatattgggatgtttatttccctactcttttcttataaatatgtcttggctgtctcacatagcttatagatttttctacagaa

SEQ ID NO: 41538 - DNA, 2063 bp, Bovine  19866880873632
tttaaatatttgttgatcagattcctcaacccataactcattcactcatgaagcacatacctctttgaatactatatctaatataaatcacaaataaatatttcatgttatttaatggtgtcttgaaatctgcatgaggcatgcagaaaagtttttgaaatggagagaagtcagaattaacagaagaaagaccaaatccactgttttgtatgcggcccacaatgattattaatgaacacatgcactgggacatagataattaaaggagactcagaaaatacaacctagaatattatcaaatgcaaatcctttcattctcagattcttttttttttttttttgagcaagttttgacacaaattataactaaatcttattacaaggcactcaacattaaatcatacaatttttaaactcagaagaaccttaaaaggttaatttaaaaatggaagaactgaagttaagtgatgtaaagtgacctatttatggtcacacaaccagttaatagcagacatagatttactgacctgttaggcctatgccctttataccacattatgctgctacactgttagtaatgtcattatttttgtcattaatgtcatatttagcaataattaccacattttataaagaatttggggagtttgcctcttgccttcctgacccattcattcttttccaccattaactgttaagtggtaatacaaagaacacaataatacctctttagtcctatatgataataagcacccaagaaaccctcatttactggcattgaaggcacccattaaactgattttcagttccctattatccatctctatttcctaccactccctaaaaatcttatatatgggcagagatttgacccttcaaatgaaagaaaaaaaaaaaaggtactatagccctttttaaaattttacatttttcaaaacaaacatataaaataacagtactggggattgccaaatctacagtgacaattcttctattcatttttttaatttacaaaatatcttgttatccagagttattttagccatttctacatctgttgtcagaaacactttgccttcttcctattcaactccaacatatgatcaagatgcatgtgcccccaaaatctgccttccctacactaggcttttcctattttcttaagtaacttacacttattaatgagtgtatgtcacaggttagctttaattactaaatttaatgttttcccttatttttatatagctgtatagcagcagcatcagcttaaacataacttcctcaaagagatcttatctgatctcatcaaacaatgtaaaataaaacctccagccaaaatttctatcaataccatgatacccttttattttaattacatttcaaactctgaaattgtattctttatttattcatttatttagtgccttccccttgcataatgtaaattttatttttaaaagtgatcttaccattttaaataatgttcccctggatctagaacagggtctgcctcaaatcttgactcaacagtaaaatctgtttttcctctaaaacaagaagaaaaagacatggatatctactttgattacttatattcaacatagtcacttatggcaatcctagacaaagcaattattcaagaaaaagaaataaaagccatctaagttggaaagaaagtaaaattgtctcagtttgcagatgatacaatcttatacatagaaatatcgactcagccaaaaactgttagaactaataaattcaccaaaattgcaggatgcaaaatcagtgtgtgaaaatcagttatttccacacaccaactatataaaaaggaaattaaaggaataatcctatttataacagtatcaaagaacaaaatacttaagaataaatttaaatgaggaagtgaaagacctgtgttttatagtgaaaactagtaaaacactggtgaaacaaattaaatagaaataaagtaaaatagaaagatatttagtatccatggatcataagattaatattgttaaaataacaatactacccaaagagatatatagatttaatgtaat

SEQ ID NO: 41539 - DNA, 2879 bp, Bovine  19866880925925
aaaaatgataaatagccacaattgtccttgggaaaactataaagtggttgccaatctaaacacagagattcatgtgagatgtgagtctgctccgcttactagtgtattctgaaatgtctttctcaggtttggacctaaaaggagcattttgaagagatgattgaactaaacttggcatcttatactagagaatgcctggcattctcaatacattattgactctagaccaggcaaccagtgccatttctctgctccagatgaatatgtgttctcctgttgaccgtttgtgcgaccatcaatagacagtatgtatccaatgttggctagtatcaacataccatacatatccatccataaaccagacctccaaatattatcttttgttacctggctgcaagaactagccaaacaccaaagaagaggtcaaagaagggtaacaaaccaacaaaggaaggtcctgtggatgtttgagccaactatttgtgcaatttgcatgtcttccaaatccattatagttggactgtgtctttcatatatgatcccagtgcatgtctaatttctttatttattggaacacaaaatgttgagttggtgaaggaaacttaggcctaatgtttgtttgatgtcttatagccagatgttcaatctttaacagtcattagctaggagctgcttctcaaatggagaatcgttactgacagaggatgacaagacactgctccaaattatggatctgcccaatgtttcccttactggagctcagcagagtctccataaaagcatccataagtgcaaaagacacttaaagtatcattggtcatgatactcaagtcttaggtagcttacacagcagcctagatttgaagaactctctctttttatgagtcctactccaaacaggaacccttgtagtttgctcagcaaaatgatcagaagattgtaactaaatgtggtacatgttgcctccaaaatcccaaaatcccaaaatcccactatgcctctttttttgtggtagacactacaaagtacagcaatttacctttacatgaaagtgaaagtgaagtcgtgtctggctctttgcgaccccatggtctgtagcctaccaggctcctctgtccatgggattttccaggcaatagtactgtagtggattgccatttccttctccaggggatctgaccaacccagggatcgaacccgggtctcccacatgtctgtagacagatgcttttactgtctgagccactagggaagtatgacaaatctattccaaacaagccccagaaaatggaacatcattgcactgatgtgacaggtgcctggaatttctttcaacttaccatataaccttctagcatatctgtacatttctaaaatatttaagatacttatgagttcttgtttctcaaggcaaattagcatattttcatagaaaggatgaatgagcttggagttttgtgacatatcaaaagtctcaagatcttaccaattatatgatgactgaatacatattggtataaatgtaatttaaaacagtgaagatgtactactctatccaggtgaaagtgatctacttctgattgtccttattaatatagatagagaaaatggcttctaagtcaaaaactgcatacagcatacaagaggctatggaatatctatgctgtcatagacccatatctgaaatgaaaatcacagttgaaatcactaccttcctaaagtttatagtaaccctgcagtcattcccaagacccacctagattttgcaccggcccaaaaggagagtgagcacttggtagatagcatcacctttagcatctttgttttgcggtggtggtactactccaataagttcctttgttttggtattgtgtagtgtaggaggaaaggaaacctagtggggatggggtggaagcggcattgcagggggtctccatgttggttgtcttccataaccacttttactccatgagtcaggcaaccattgttgagtttgtaccagttgccaattatggttacaccaattgtacattcaggaaatatggaaataatcaaaagatggcactgcagacctactgaaacacagtgagaaaaagattctgtcaaggctctacaaatcctcatgctgtccagtggatcatagatggtattttaagttcccaggtatctttgttaactcatacttatggtttaatattttaatccaatactcagagagaatgataaatgtgttttcatattatgccaaataattaatacttttatgggttgtttaggtttactttttaagttaatttttctatcttaactgtcttctaatacattattgtaaaaacataaattttagaaatgcatataattaacagttttcttttaattagcctattcacaaatatgctcacttttctttctttttcaagtttgaatccttttctggatcttggcaatagcctagtgttaggtaggtagaatagggaaaaggagtccaaaatggcggtggctaaaagacaaggaaggttcaaggaccagagtgaagacttcaggcagaacaaacagaacaaacagcactcctggctaagcccaatttgcatagggcaggcccaggtggagggaaaaacacagaaaaggaggagccaaagcgctttctcttggactctctctcccgcgtgcatgtgtgcactctctctctctctttctctctctgtcttttctccctccccacgcactcctccactctcttctcttcaagtcttggattctcctgctatcttctaaataaaatagacctgtaacactgatttgcctaagagctgtagcacggtttgtccaagacccaagagctgtgacacgctgagggctttaatgtccgtcgctccaaa

SEQ ID NO: 41540 - DNA, 1363 bp, Bovine  19866880977344
aaaagaggaactgaggtgaaatgtcactttgtagtaaaataggcatttgaacaattgcaattgatttgggaagtaaaagaaatgcagaaagatctaaatgcaggtttgtctaaaatcgagatttcagtaattctctattttaaaagactaaattagaagtactggttttctttcacatttttggttttaatagacattaaaagttaatagaaggcttggctgtagataataaagatttctgtcatttgttgaagtagtgcaaatcaatataaaagctagagacccgcagtcacaacaaagacctcagtatggggctaccaagaaagatgacatctcaaattttcacagagaaaaaaaaaattataaaagaagttgttctttgaactgctagatatccattctactttttaaaataatgtgtcttaattgagtttttattgaagccacctttggagaccttaagaattttttgcaactcacttaggttttaatattgaatgtatctttttacaaaatgtaatgtaccacattgacttgcattaaaaattaaaatattttgaaacctttttaaccatttcagtcaaagtgggttccaaacgaaaaaagaagggctacaatatattgctgtaggaaagtatgtatccatggtatcaataaagtgtcaattaatgttcaaatgaaattagatttgcaagatcaaaaatgatttttataattatagaagtaactaaagtttggatgtaatttttcatagttatttgcatcataaaatagttgcacctcaaactctgtgatggtttaacataatgatattgagataaaaaagtattagtatagaaaattcttaacacataatataacatctcaagctaactttctaataagtattgttgatttctgcatgggtcctccctaattaaggagctgcttttatttttttctatctcttaaatttttagccttgatgtttagagatcaatttgcttcagacgacaattctgaaaaatccacgccacaatgaatggggccaaagtacattctagactattgaaaacacatagctttaagaagaaaaaatggtgacagaggtaggaaatgctgaaagacagagatattaatgtactctatattactgttactaaatgcatctgttcagcatggttcatttggtttctgcttaaattatattgattgttataaatatgctattgtactattctttttcttcttaccatcactaaataatttagaaataataaagaaaaatgctgactcctcaaactaaagacagttttgcttttacaaaattaaaataaatgtcttatttaactatatattttaagtagaggaatatcattagcaa

SEQ ID NO: 41541 - DNA, 2865 bp, Bovine  19866880988579
cccctgactcctatattcctatgtacagtgggctttagaatgcaatggcttttctcttaatctgaagggatcagtattacctggaatgtataatttagctgagcctctgcgaagccttataatgacctcagtcgttttgttcagccgttcttcaagagcaggcaagggactcactagtgagcatgcttgcaatactgatgtttgtactgtggaaaattttcagaagggaattctatttccctgagcaagtttccaagcactaaactctctttcaaataataaaagaggttagagactaacttagggaacagattcaatttttcaatgtggcgttaataggaacaaagcaaagagacagattgcattgacaaggaaacaaaaatggataatggatttaatggcttgagttctaatggaaaaactaacattctctatgagattgtcatatttctaaaaaatgtggctacccattaatagttcctacatggaccaaaaaaaaaaaaaaaacttatatggcattatataaatcattaaaatttttcagcaaaattaaggtgaaaaatatttatggttcctttttttattattttcattatttatattcttagggatttcttatatactcaatatcattgatagtaagatttgctgtattgaattttcacttgtgatttttaattttttaaaataaaaataccaataagaaggtaatttccatgtcagaaaaataatttgtggaataattttggtagatgcatatgatgaaaactggtagaatcagtggatgatcagatggctaatcaagggacattttcagttcaaaattttgttatttgtcccagaacaagtttccaagcattaaactctctttaaataataacagaggttagagactaacatagagaacagattcaatttttcattgtggcgttcatagaaacaaaacaaagagacagattgcagaccaccttccctgcctcctgagaaacctgtatgcaggtgaagaagcaacagttagaactggacatggaacaatggactggttccaaattgggaaaggagtgtgtgagtgtgtcaaggttgtatattgtcaccctgtttatttaacttatatgaagagtacatcttgtgaaatgccaggctggatgaagcttaaactgggatcaagattgcagggagaaatatcaataacctcaggtatccagatgacaccacccttaatggcagaaagcaaagaggaactaaagacgaaagtgaaagaggagagtgaaaaaattggcttaaatctcagcattcaagaaatgaagatcaatacatctcgtcccataacttcacggcaaatagatggggaatcaatggaaacagtgacagattttattttggggggctccaaatcactgcagatggtgactgcagctatgaaattaaaagatgcttgttccttggaagaaaagctatgaccaatctagacagtatattaaaaaattacagacattactttgccgacagaggtccatctagtcaaagctttggtttttcaaggctgagtgctgaaggattgatgcttttgaactgtggtgttggagaagactcttgagagtactttggaagctgcaaggagatcaaaccagtcaaccctaaaggaaatcaaccctgaacattcattggaaggactgatgctgaagctgaagctccaacactttggccacctgatgcgaaaaactgactcattggaaaagaccctgatgtgggaaagattgaaggcaggaggagaaggggacaacagaggatgagatggttggatggcatcaccaactcaatggacatgaatttgagcaagctctgggagatggtgtaggacagggaagcctggcatgctgcagttcacggggtctcaaagagtcagacatgactgagtgacctaacaagacaagtccctgttacataaaatattcatcgaagaccataaaatctttgaaaatcctatgattcatgaactcatattaatgtatatatcctcataagcccaaattttgtctataatttaggtgataaaaggaaatttgaaaatatttgataaaaacacttggtttaagctatcatgtcataaagtaaatagagggaatgataacaatgaaatgataggtagagttaatattttatttgatcaaatgaaaacagaaccacattttaagtgcggcaattgatcctagcagagaaaaaagcatgagaactcaaaaggctaggatataatattaatttgatattttgaaataagggcttcccaggtggctcagtgttaaagaatctgcttgccaatacaggataggcaggctccatccctggttcaggaagatcctcttgagaatgaaatggtaacccactctagtattcttgcctgggaaatcccatgaacaaaggatcctgttgggttacagtccatggggttgcaaaagaatcagacatgacttagcgactaagcaacaacagcaaatttgtaaataaattcagttttgtcaaggtataaatggaattttgattattttatgagagagaaagaaagagtgtttgctaatgggaagggaaacaaaaagtaatgttagaatgcctaataagaggagacagacaatggaaaattataaaatagaaaattattttcaatcctacttcatttcaattctatttcaatatatgttcaagtgcctgatgagctatgtatcagctctgtagagtggtctatcagctggtttcaatgagtttgccatagtgttattgtccttcaaaaacaattaggcaaattaaggagtatatcaatgaaaataattaaatgtacaagtcaaacataaggaaggagagaaaaaacat

SEQ ID NO: 41542 - DNA, 1423 bp, Bovine  19866880992568
ttccaggtccactaggtgaaaatgagatgatgaactaagacttctgagcttatctgtaatttaaaaattaaagaacagagagttgaacagatttttcagaactggcaatatttttacacgtgagagaggtagtctatacttttctgggtggaaggaaattctgtgaatcattaagttaaaatcaaattgggaaaaaggtcgattgagggattcatttttcattaaatatatacctctcacccctttccttacattttacattttaaagaggttgttttggttgctacatttttgttttctttctacctagttctgcttttctgtcatggcttacaatatcatctttcaaagacaatgctgaaagttctctggggacttgtgttgctttattgagtaatctttgatcagattgtaatggaaatccctgaaggtgatataaaatgtgtacatatatttgaatacataaaatatgtattttttttatttcatccatctttgacatgtctaaatatggacttatttagcatcttggcctcaaaacaacaggctcatcttgggggcatatttcaaaagagtgatgattttaaaaattgatgatgaaaataattggatttataaattctttgaaaatcagggatcctgtctcaacagcaatagtaaaaactgctactgaagtatacagaaactgagactaaagatgtataatgtccttgtcctattaaatatgttttaaattgtgttaaccatcatgatattcacaagcttggatggcttaaatgtttactactaatacagttgtttatttaaactgagagataatttgtatataaaagaaatatgtgattctacctctattgacatttataagtccaacgagcctagattttatgcatatattatgtgttcttatataggttcatattacgttttgacagagagcagggatacaaaaaattagggttatccatttgttcagatgtcactcattaaattatcatttttttcccctaaggctgtatttacacttggattgttagatggggtgtgctgaagaacaatctctaggatttgaaacaattgcaaatagccatattatgataagcagtcggagccaataagctgcttcaaagcaattcccttctgttttcttgtgaaaacaaaagcgatagtgagggttttaaaactccttttcagaaaaaaaaaaaaaaaaaaggcaaacaaataaattgccaccaacacaatgcaaataaaaatacttgagattacatttctgagctcctattttatgttatatcttcttttttgagaggtcagtcagttatgcccgtaagaaataacataggaagggaaccagaaaacacagtttactatagtcttagttcctagagaaacagagttaccacatgccacaagggaccacaca

SEQ ID NO: 41543 - DNA, 1151 bp, Bovine  19866881141138
ctcctgtctgactctttgtgaccccacagtactgtagcccaccaggacatctctgtctatgggattttccaggcaagaatactggagtgggttgccattctctgttccagcagatcttcccgacccagggattgaacccgtgccttctgtgtctcctgtattggcaggaaaattctatactacagaaatacctgggaagcccttttataagatacaagcatataaaagtagtgatgtttcctgatttagagatttgcttctgagaaacaaccataacaaaatccttaacttggcaatgatggtctattcccaattcctgtattttagaagatactgaaagagaaatacaatgtaatgagttccctttaaatcttcacttacacgcaaagtataatgccttcttaatcatgcctgaatattgaacaatttttccaatagttcctcctgatttgatttcagctgagtctgccacggagaacagaatctgcaacctaacaggaaaaattggggcagatgttacagctagactgaacagaactgacatttgaaggcttttcataattttccatccctaatattattgtcatggaaatgagagaagaaatggtgacaatgcctttcagtaagagacaatgcctttcagtaagagagcccagcagtcctctatctgatatgctaatcatgaagacatagaaatatcttaagcccaatgggtttgtgcttactttcccccactgtaatgcctactcaaatacccataactggctttttatgtgctgataaatgtcattttatttgaagcagataaaaaagctttgccatttaattgtaatataagttagttttggctatgaacaaaagacaatagagtgcaaaggcttcctatagggacacgtatttgaatggaaacttaatgcccctggtcttgcttttagctccatcttagagacaacataacaggcagtgtgtggactcccccatcccctgtgaaaaggatctattgatatattgtaaggaagatatatctgtagtagtagtggtggtggtagtcgctcagtcgtgtcccactctttgcaaccccatggactgtagcccaccaggctcctctgtccatgggattctcctggcaagaatactacagtgggttgcca

SEQ ID NO: 41544 - DNA, 1015 bp, Bovine  19866881224611
cgcttctgatactatgaatggaaagctgtggcctctggcagagctgtggggagggcgcgcgctggcgcgcggaacctgcggggaaaaggtcttgcagatctcagctcctagaggccctgtttccgagggcagctccacgccctccgcctgcacagaaaccttccccagacgggaggtgtccacttcctgcccaggtgctccacctctgttgacccggtgtcacagccgtcgcacccacattggagccggccaccgcctgggagggcgcagttagcggcgacgaccgcccacccgcacgcacgcttccccgccgggggttaaaattaaaaaggaaaactaaaaaactcgcacagttctccacctgccgatcctttctagattgggcaaagctcacagaccccttctaagccactcagatgtaaaggaccgcgggcgggatatggccacgggggtttcaggggcaattcaaagcctggagctgagctcagcgcatcccccacctcaacctttggggcgaatcaacggataaagcagcctccgccagaatttcaaaaactccctggactccactgaatgttttttgcatcagaagtgaaggattccagtcactgggactggcgtgggggtcgggggttgggggagaagagggtgctgccggtggaggtggggtgtgtgtgtgtgagagaggaacattctaaagccatcctgtcttggagtgtagggcccggggctttttctcccgccgccgctcactgccctgtaacccagtctctctccggaaaagcacagccctttggtccctagcgcagtccaaagcgaggcactgccgaagctttaaagctgcgaggcccccgactgtgggaaaggggatgataagccatttcatagccgccgactctacatagtagcttcaatgaggtctgcccctccgggctggagcagtagcggagtttgtctccgaatcccgggactttggtaccctcgtctgtattggtttgtcggacttttcaccggg

SEQ ID NO: 41545 - DNA, 744 bp, Bovine  19866881314298
ctggatggcatcactgactcgatggacgtgagtctgagtgaactccaggagttggtgatggacagggaggcctggcgtgctgcaattcatggggttgcaaagagtcggacatgactgagcgactgaactgaactgaactgaattcaatctgccacaggcatcctctcaattttattggcaatttgattctcaattgttcttcagtaagagatagtgtgttggttacgactgaagaagagttctatatctttcgtttgttctactgttactgttcttctaaagtagatcattgttgtgcatgagaaataggagaatctaatactggaaattataataatcattaacatattggacagataagaatgatttctagtgttcccgaacgcataggcgaatggaaaactaaggtttggcttaacacagaaaagcaaattcaaagatctgcatttccctaggaaaactacagtccttataactcaacggttgaaagatttatttccccgtggaccaaggtttcagcagatcaattaatagagcatgttcttctcttctgctgccatgtgcagaaagaaaaatgtgttgattatgccatttcggagcactgtatacacaaagtcaactttacgggctgggctaacctacagtgcaggacttagaaactgggacccagaaaataatcagtctctgtccacctggcagcgtgaaccatcatgaagtccagtggttggcagacaggggctggag

SEQ ID NO: 41546 - DNA, 803 bp, Bovine  19866881364327
ctgtatctaaaaatttccgtttttctctcatgtttgtctgtacactttatcttctgctgtgtcatatcttttactttcattgaagctttatgagtgtatcccatggcattttttgagttctttcaattatctgatgctgtataatcatcagataattgcgccatctggtaatcatcagataattgctgcagctggtcttctgagcaggttacaagaagtggcccttggctgtgtcattaaatgatggataaggctttgtttggaagaaaggaagatgaagaaatggcatatgaaggaccttgatgccaggctagctcccctacgctagccaacatttgaccattgacagcagggtaaacatagacagcttggaagtggctaggcctggagctgagggaaatacctaaatggatgaaaaaagaaattgagacagaaggaaagccagtcaggaattctgtgccttggctgctttaggctgctttggcaaaagtgagactaagaaaaaacacaagacttctcatctgccaacttaccaccatcgattatgtctgtaatgagaaaggacatgatgaaagcagggagtctaatgttcaaatctttttttcatcagttgcataacagataatcattaaaaagactattcagactttgggtgtggtgaaggggaaggtggggattaagagatcccctaaacatggaaacattcaaaatgttcatgcagtgtatttttgtagaaatgtgggtctcctaatatgttgagttggtgaaatgcagagtcatgcaaaaataccttaagagaggga

SEQ ID NO: 41547 - DNA, 697 bp, Bovine  19866881423287
aaaaaaaaaaaaaattcaacactgtagcttccaactagtatttattttatttttcctcccattgcattttttaaagcttaactttccacaacctctctctagataaactttaaacaatacatattataaatacttgaatatctataaaggtttaaatctattaaatggtgaaaactcattcttcttcccagcttccactagcacccagctctctttcccagaggcaatcattttcatcaccatgtgttcttccgaaggtggcctaaacatgtttaagcatatgtttatgtcctgtttgttttttacacaactgattaattgcagtgcatcttgttccgtgtgttgcttttttttttttttaacctgatgttaatataccttggaggctgcagaatatctgtacatatgaaaacacccaggtttatttttttgtttatttgtttgtttgaagagctgctcagcagtcattgcatgtgactactatcattatttacctgtaaatgagcacataggtgtctcaaaatttgatatttcagtaataccaccatgaataccctctacataattcatttggcaagtttaagatgggctccccaggtggtgcagtggttgaagacgttgcctgtaatgcaggaggcacaagagatgagggctcaatccctaagtccagaagattccctatagtaggaaatcgcaa

SEQ ID NO: 41548 - DNA, 1515 bp, Bovine  19866880504400
tggtttgatggatgtgtggaatcctatttgaatgtttaaatggcagtgttttgcaaatggaatgcattagtgcttaagcaccaatatcacctgaataaatccaagcttataagagtacaagcctggatactctctttgtatatgtataatccaggtgattttctacagataatgtgacacaatattcctttcttcctgaaacatgctgctggctaaataaagcaagaaagtatcacctgttcttgctaaattgaaacacatgaaataactgtgcaccttctaacaaaaaagacatcaaggaaactttgagttagtacttttaaattttgtttgaatcagatcagatcagatcagatcagtcgctccgtcgtgtccgactctgcgaccccatgaatctcagcacgccaggcctcccagtccatcaccagctcccggagttcacctagactcacgtccatcaagtcagtgatgccatccagccatctcatcctctgccatccccttctcctcctgcccccaatccctttcagcatcagagtcttttccaatgagtcaactcttcacatgaggtggccaaagtactggagtttcagctttagcatcattccttccaaagaaatcccagggctgatctccttcagaatggactggttggatctccttgcagtccaagggactctcaagagtcttctccaacaccacagttcaaaagtatcaattcttcggcgctcagccttcttcatagtccaactctcacatccatacatgaccacaggaaaaaccataagagtatagaaataaattattttctttcttcctttatctacttatattgaattgggaatgcttagtgttttgttgtctataaacatattaaaatattactatagccaaaacccatcactttttttttgccattaaaataatgagactttaattacaaaacttcataagatattacatgtagtagaaataagaagatgggaaatttgctgtaataaatgctttgtttaagtttacactttgtaaagaagtgtcacaaggcaagtttaatgaaagctgtatttttaagtaaagaataaaataaaaggcatttacaggcaggaataatttggatgacagtttggatgcaaaagctggcaagataatcataataatgttaataataataatgatagctgataatcatagaaacagcaaatccacatagaggaaatgcaaatacatgaggttctaataatccttgatttgagaaaaatctataaaatatatgtcctttagtaatgacagcaattcaacagttagtgttcctgagaactcttgatttttgtttgtttcatgtttgtaatttattttactgcgttccattagggaagaacgctgctgaacttcacagtgaggattttggtgggccagtgtaccaagactgagatttgaaaccaagagtgcattgatggatagtatgcatttttctttttaatggaaggattgaagtcgatatcacttaaaacatat

SEQ ID NO: 41549 - DNA, 1261 bp, Bovine  19866880581967
agaaaacccctggggtcagagttcagatcattattcttcctctgacttcttttagtgccatgagtgaattacataatcacccacagaacaaagaaaaatggagaatatcactggagcttgacacataagcctaaaaccatacctgttgcccattccttgagtctagtaacatcatccacagtgttgactccaaaattcccaaaagtcacttgctcactcaaatctaaagctaggattatttcattagcatagtaagtaattcgggtccagcagacccgaatgaaaccattacagcttacatttcaaaagcttcttttataattaataagttttgttatgtattcaaacagagaaggattagtattagtagtagttaaactacaaaatattagtggttaaacatatcctaggatttttctaacatacaccaatcaaaatgatcataatattttctctacttcctttcagtttatgatacttaatattctattctaaatggtgataagacttaggccagttcaagaagatccatgtcgattttttgcagctgtaaacatcatctctatttttaattcctcaaaaatagatctgtgtaatcaatcctgacctttgcgtaaaatcactctatttccaactgtcaactgggcatcatcactgactggttcatcttctccaaactctagattctatttccaaacataattgtcttccctctttgaatcgactcaacttcttctaatttgaataatatatgaaaatgaatagaacaattcctggcatattaaccagtgcttcctaagagttagtttcttttatcaaattccctatttctataataccctacaatgctgttagttcccaaacttaatacctcagatcttaggctataccttctgctctattgtctttatcaagccactagcacttctctattcctgcttcttctattgtaagccagctttcttcatacctggattactgcattgttgctattgttgtttagttgttcagtcgtgtctgactgttttgtgaccccatgaactgtagcctgccaggctcctttgtccatgggattttccaggcaagaatcctggagtgggttgccatttcctcctccaagggattttcccaacccagggatagaacccatgtttcttgtatcagcaaggcaaattctttatcagtgagccactggggaagcccaaggattactgcattagcattctacaatttacctccatctaaattcactattcccatc

SEQ ID NO: 41550 - DNA, 836 bp, Bovine  19866880665698
aaaatagcatagaaaatgttaaatctctatctttgaagaaagttattgaaggattttaatggcacaaaacctaacattttggtctcaattaaataattggaaatacaaaaaccatagaaacaaaatactataaactatagggtaagaagagaacagaaagttcccagccagggattttgtggcagctgagagctgtgcgctgtgatgtgcagcagggccgtgggattagacacagctcctggagggctgctgtaaattatacaccagcatatgtgcaaggggaagaagcagcccattagtaaacctttcaaatatagacgggctcccaagaggtcagtttgtacattattcacagaaataactttgactgcacaaagatttgtggagcatttcaattgccctgagataattaagaatttgttcagtgaacaaaaatggaaaccttaaaatcacagtggctgaacaaattattccaaaatggcttcatttatttgatagtaaaataaatctgggcaaaaattaacaggaggttcaactgtggtcacttaaaaaactgtctgaaagaatacaaaacaaagaacagagagccattgagttgttgtgttcccccttcaaagaaggctagagagcctccattgataattacaacacaacatgtaccatatctgattgaatttcaatgtatttcttggcttgtaacttggaaacttctcaaaatagattccctataatcatagcattggtacaatctgctataatgctcaataaaagcagttgcgcttggacaataagcaacatacaatattcatttctgctctgtgactgagtggctgact

SEQ ID NO: 41551 - DNA, 1133 bp, Bovine  19866880732625
taaaaatacctcaaaggttaatcttaaatcatattttaaagatcatcaaaattatactgaccttagccattttatagcactctcatcttctgaccaaagaaaattctcctgatttgtcactttacatttacaattatatgtgattaagcaagatttgaccaagaagtgacaggtcagattttctcatggtatgttgaaaatgcggcactgctgcattgcatatgcaaactgtgacactgactcagacgtgtatcggggcagaactgatgtcatctgtctcaaacaatggagaaagattctcagcatgtggcctagaggctatatcatgctgacgacaaaatggccaacatttattgcttgaggtcaattcaataatataataggattagccatacatgcccccactttcattaagcattatttgcttattcacttctataacatcgctgctttgttgccgtttttagccttcttattgtatcctcccttcttactcctttcactggactggctacactttagatatttggcatgcatctgtgtgtgtggtgctccaaatataaatgttttctcttaattagactagccacattagtatgggtttccttttataggcgattttcatttattctgtagttaaaatatatttggaatatcatcaaacagaaaagagagaaatgagacatttctttgtgctgaaatgtagcattcttttgtttcttcttccataccatattttactgtttttctgtgtatactaaacttgtaccaatcatgttttaaacagtagttgccatgctaagcaatggagataaaaatataagggagaagacatgattgtgaaatagacaaagatcaacacaaatatagacaaaataggtataataaattgttacagttgatgaaatagattaatgagctataatcatggcaaatggatgaggatatcctcatatgaggataaaaagagatttcaaataaaggttgaaaagttaaagcaggataggtattcattagctgaaaggtgagatatgataatgtaggcatactgctgctgctgctgctaagtcgctttcagtcatgcccgactctgtgcaacccccacggactgcagcctaccaggcttctccgtc

SEQ ID NO: 41552 - DNA, 835 bp, Bovine  19866880757789
aatggcgatgaagaaaatgacttttaatttcatgacttagaataatgtttcagtagaatatagggggctacaagtgggttaaaaagtgctaacctgtaaatgggtactaaagaaatgaagtattaaattagcattttgactcattctatatcattttactccctttacagaaaaaaggaatacctaaaattgttccatgtaactgccttagggcttaaaggaaaaaagaaaaggggtggagaaggaaagtaaatagaaggactttctagataaaataaaactatgttgagaaagtcattttgtggatagccattttcacggaggacattatattattagatatgctttagttaaagtaaaatcaaatagcagcatatcacagataatagtgttatagtagcacagaaactatatatgtctccttccaaagacctttgctatacattgtcttatgtttgccacaggaccattaaaaagcatggctaaatgagaattgaaattcatggaagtgtgcctaaattatttctagaaaagttaaaaagtaccagagccattagggtttaaaattaatgtgtgcatttttcttattaataattatgcccatttaaaacaaccattactcctataatgtgaatttaatgagaaaaatatacgagaatattattaattttctttctgttaatttaagaagaccttttgctggcatctgatgtaggtatcattaataggaaaaaatcaaagtcaaaaaagttgataagaattcaaaagtaagtttaactcacatatagcgtaacagcatactgccattagaatattagaaaatagtatacatata

SEQ ID NO: 41553 - DNA, 1337 bp, Bovine  19866880797168
tgtcactttaaaagctgaaaaatacagttttttgtttttagtcaatggaataatatgcatcacaaagtccattattatttccagaaaacctacatcatttatccctttcaattatcaagcatttcaatttcctctgataatttgatcccaaaattaaaatgcatgttgatgagatataatccttagcttttttttttttttctgttgggctgctcaaaactgagagaatttaaaaccttattcttcctagcttgattgaacccatgagaaaatgttcttccttcttaacagatcagtgtaaaatattatccacagggacaccaagcttacatgtgaatatactatccctccattgttaacaaagataaattactacctcattatttctccctgcatgacaaatcagctctactttttaggctgcttcaaatccacagatgttttaaaggattgctctttcatttgtgttttaggtactcaataattctgaatcttgatttatattggtggtcttctcagagaatagcatatgcgctaaatgaaatttcctgtgatctactgaggtgccaaatctctctatttgaagacagttccttctcttttttgaatgttataaaaagaaaggttgtaagttctttgaatttgacagtgaaatctgcagttgcttctgatggtgtgaggcactattagtcaagtttctctgattcatattgcttacttctttaataccagaaattagcatgatttagagttcattataaaaaagtaggtgggggagagtattctaggtttttggtaaataagtcgtcatctgaattttaatatcttcaaatactatttaaaaataaaatcacttgataaagagagcaaacagaaccatctgtaatccacgcctatagtatagatgatagaacatactagaaaacttaacttgcatgtatataggtgaaataaacatcccaaaccaggagatccacctctagaggccaagatggaccagaaagtcaggtaaacatcatgccaaaaatagagttctgtgcacctaggagtaaaaaatgagaaataaaatgatcatcatcctcaagaaagatggctgcccttttggggacaaaatactgagaagaatctgatacagaaatatggctctgattcagaaaaatggctacagaaaaactgaaggcagcggagttaaaagcatgtgaattgcagttttgggaaagcacaactttgtaagagggaagagacttttaaaagtgcttctttagtgaagcaaaagaaagaaacaggcagtagagtttaaaagatcctacaaaagcaaatcacaaagctagaagata

SEQ ID NO: 41554 - DNA, 1589 bp, Bovine  19866880873698
tgttgcccccttctcctcctaccctcagtctttcccagcatcagggtcttttccatgggtcagctcttcccatcaggtggccaaatattggaaatttagcttcagcattagttcttccaatgaatattcagggttgatttccttaggactgactgttttgatcttcttgcagtccaatggactctcaagagtcttctccagcacctgagttcaaaagattcaattctttggcactcagccttctttatggtccaatactcaacatccatacatgactactagaaaaatcataacattgaatatatggacctttgtcagcaaagtgatatctctgctttttaatacactgtctaaatttgtcatagcttttcttccaagaagcaagtgtgttttaattttatagctgcagtttccataagcagtgattttggagtccaagaaaatagtctgtcactgtttccattgtttccccatctatttgctgtgaagtgatgggactggatgccatgatcttagcttttgaaagttgagttataagcgagctttttcactctactctttcactttcattaagaggctctttagttcttcttcattttctgccattagggtggtgtcatctgcatatctgaggttattgctcccagcaatcttgatttcagtttgtgcttcatccagcctggcattttgaatgatgtactctgcctgtaagttaaataagcaaggtgacaatatacagctttatgtattcttttcccaattttgaaccagtctgttttcccatgtccaattctaactgttgctgcttgatatgtactaaatcaaagtaatttcagatcaaatttgccaatagatacctcaaaaataagtacttaagacactcttatgttaaataagagaaaataagtattcatggcttaagtgattttcttgacaatcacttatgtacaagcatttcatggtttgtatcagagaaaacatactcagagccagtactatacctgactataataagtgaacctaagagttcagccagcctcaactacagcagtttcattcagcaggatcaaaaaagccatttgccagcatgatgaaaccttttctgtgaccatagtctgcaaggctcagaattacccagcaattcaatcttcattacctctctgtctttaaagtagaaacccacttggctcatattttaacagtacatccctataataggatggctatgctgagatcctgggtagtaaaaaagtatgccaaggtgatttggatccattttgatactttctgaacctgaactccatagctgcaaggtcaattttccttaccactgaatagtttgtacctagagtgggatataaaagcctattttctgatgtattggcacccttttacggaaatgaaaatccaaggttatatcactccatgtggaaaataaaaagcttatggtatctcttttagatgagggtttgtgttgctctccttgatcattttctgagcttttgttactgtgctgagtgccatcacccttcttagagatgactgcatatttgagtctgaagcacttgtgggccctttagataaaaaca

SEQ ID NO: 41555 - DNA, 1110 bp, Bovine  19866880902639
tcccttgtaattcttattaggtgtctaggccttcctcccaagcccagctctgagtaaaagcctgttttgatgctcttggaagctatttatcactggcctatcatttttcttcacccaccaataaaagtcctcttattaccagaccatgacttcccagagaacagtttatatattctaacttatatatatataatctcactctccacttcaactgacttatcaatatattgactcaataataagaggtctcttcctaagaagggattagattactaagaaaaatatttattaattacatcaccaactcacattcatacacagaagcacttatgctcacatgcacataccacctgaaaatacatcaaagaatatatataccagacatgaagataatcatcttatatagaaaatgattttcctctctacagtaggattcaaatagggtgattttaaacagaaaacactcctgtatatattattaccagaatatacaatttataaacacaatttcagatatatttccattatataagaacaaatgttcaaatttttaaatgatttccatgcccaagttatatcaatcaattattatgttttcatatagtatgtaaacttttcttagagttctggtaaagccaaaatataaaaagattagatgagaactttctgaaatggaagttgcttattgaaagttttagttaatattccttaccaagcacaacatcatgtatgttaactctgacaagtagaaataatggcttgtctattcatcagcccagtgactgattctggcttctgagaaaaaatcagaacaacctgttaaccttagaaagatgtttcatttccttacactcccatatttgcatcacgtaagcaaagacagaaagatcagtctcgaaacagaagagaaataaactgaaaataaaatggaagcatgaatgactctaagagctatttcatattcatctaatggtttgtcacactgaacacctggaattgtatgtgaaaagtacagaaattttactgttacacatgcgtctatcaagtttatatgtttctggtcacctagcagtatggagacaaaatgaaaaaagtaaataagacttccaa

SEQ ID NO: 41556 - DNA, 1299 bp, Bovine  19866881002108
tctcatgccactcatctgaatttatgtgactttctgtctttaaaaaatcctcagaaatcatgcaaattaagttttaaacattaaattgaccctttgtgctaacatgcttatgatttactaacttcactcaaatgtatagagcttccagctggcatgtcaatagactcacatctggttgtttcataaaatatgagacaggtttcctttcagttcctaaagtactggcattccagtgtgaaaatatgaactgtaagtagactatgtatcaagtgtgcatcatggcaatgctataggaatgtgattgtgccacctaaaatctgttattacagataaacactagtgtttaaaatattccatgtaaaccattttaacatcagttgcaaaccagtaatagggttagtcgctcagtcatgtctgactctttgcaactcccatggactgtagcccgccaggctcctctgtccatgggattttccaggcaagaataccggagtgggttgctacttccttctcctgaaatgtgaaagagtccatggtaggaatagtaggagacactgttcaaactgatgtggtcatttctttcacttcctattgagatgccatctgtcttagtccattcaggctactataataccatgactgaatagtttataaacaacataaatttctcacagttcaggaggctggaaattccaagatcaaggcaccagcatggttgtattctgttgaacagttctgggttgcagcttctcacagtgtccttacatagtgaatggggtaagggatctttatgggatctctctttcaataacactaaatactcttgcctggaaaatcccatggacggaggagcctggtaggctgcagtccatgaggtcgctaagagtcggacacgactgagcgactttcactttcacttttcactttcatgcattggagaaggaagtggcaacccactccagtattcttgcctggagaatcccagggataggggagcctggtgggctgctgtctatggggccacacagagtcagacacaactgaagtgacttagcagcagcaaatattcattaaaaggactgatactgaaggttaacctccaatactttggccaactgatgcaaagagctgactcagaaaagaccttgatgctgggaaggattgaaggcaggaggtgaaaggggtgacagaagataagaaagttggatggcatcaccaactcaatggacatgagtttaagcaagctccaagagatggtgaaggacaaggaagccggcatgctgcagtccatggggcagc

SEQ ID NO: 41557 - DNA, 909 bp, Bovine  19866881267522
cttgattaatctaaaaaaattgaataattccagggccactaaaatccctaattcatacatatatgttttgaaacaggacagacaaactaagttatggcagtatttctattttaattcaaataagtagttgtttaagtcttaattttattttcttgtatctgaaatggacttttattttttataggatcttactatttgaatcactctctgctccccatcagaatctctagtctaatgatgagtacaagataataagtgcaagtttcatttcaacccttgtctgtatttcctgttgtataaacaaaaagaaaaaaatgtgagcaaagagaacatattatgatcagtatgttctaacttaaaaataagatatatctttacagttagctacctaattattttcttagaaaactaaaatctatttattgaaacatatatcagtctacatctaccaaaattacctctgcatgctctttatcaggaacttccctggtggctcagatggtaaagaatctgcctgcaatgcatttcttttttcaggtgcataaacacttattttaaaagaaagaaaaacttagacctcaaaaactttcatattaaaatgataatagaatccttcatgcaagtcagacaaatgtgttttaaaagagttcttcattatacaagagccatgaaacacaatcaatttccaaactgtgattcacatccaatttaaaacatttttctattatatgcatacttggtgacactctctttttcaactttgagaataaaaattacagagagaaaagagtagaaagcaagcaaagattaataggatccaacttcagtggtttgatattttctcagttgctaaaataaatcaacaaataggtcaggaaagccaccatctcatcttaaaagcatcaacca

SEQ ID NO: 41558 - DNA, 1678 bp, Bovine  19866881319484
tatctatatatagaaattttaaggaatatcattaaaaatgagtaagggtcaaattcataattaataacatgactcatcaagtgataaaaaaattttatgcatgcagtcaagagtgagagtgataggctgttaaaaggctattatacttactatcttatcagtttgagtgtagcatcctataaaatttttttaaaactatagaattatagaggaatttataatttctttcttcaaccctgactatgataatcataatcctaacagtctccttaagttatcttgatccacgtttctgctgtagaccaatgctgttgtttcttgcaaatgggtactagttagtacaggtttttaaacgtggtcactttttaaatcttggaaactatatacctgaggttcttttttcccacattaaatataacagagtgttagtggattaatgctgaaatccaggttgtttgatgacttttctgagtcacgcataaaatttttaagaatcttctactttaacactaagacaaaggcttgaacaattcttataaaatgattttcctggcaagagttaaaaacagacattcaaatacaccaagaatgtgtctatttgtaaaagaagaagagtctgtgagaagagtctgtttcttagaattttatctccaaggagtatcttcaagttttttttttctttattgcgtctgtctaggtttcagctgaagaatatattgacctttctaaccacaataccatccatgaacagttgatgtaggttcctttatgattcatgagctcagagtcaataaaacaatgcagtgagtcaagagtgagtaagaagacaaaagttacaaaaaaaggaaaatagaataggggatttaaaaatagactttgcttgtggcaaggctaaatatagtattaatattctccatcctgcatgcataaaatgttttttatcacttgatgagtcatgttataaattatgaatttgacccttactcatttataatgatattccttaaaatttttctatatatatacctaaggaaaagatgaggttgggtataaaaagcaacatctcatttattattttttgattttattacaaatcatgctcttcttgcatatattggaaggagatagataagacagtgagcatatagaccaatacaagattttaacaaacaaggagccaaggagtcaagaaatcgcccaacttctgatgtggatttggctccacacataccaagaacacctggctttaaacttctcactggcctattaggtttgctgtagtccttcggggatggctgaaactgaaagccataagatatgcctgatatctctatcccagtaaagcctgctggactcttaagactcaactctagagaccaagctttcatatctatctagaaacacatatctactgtgtttctcttgtaccttaaatgctgaaaaactcatattatcttaattcattcattggatattaatgtctttgaaattgtgagttgtgaatatattaaagttgtgtccctactgaacttgaatcaacactattctgttaaatctgtattctttccatagtataattctgagaaatattcagacttcagattatacataatattatatatgacagtttaggtaacatattttggaatattagtaagaaaagtaaacaatccatctc

SEQ ID NO: 41559 - DNA, 1728 bp, Bovine  19866881457934
aaaaattgagatcatttttgtgaaaatgtaatctaatctcaaatgaaagaaaggttgaggcttctcatactgtggatgtagcacaacctgtgactagtggacacaaaataaagggggaagggtgaaagtatgaaatgcttcaggacacagtctgccaataaaatgtttgcattttgggagcataaaggaatcagaagataatgaaaatatgcacatcattctttggaagcacagagaacatagtttctaactccctctaatggaatcatagagttttcgtagactaggtagcatttgttaataggaattttcaatgtgaacaaaggaagaagaattttttaaatgagaaaatatttttgatataaattattttaggaaatatatacaaaagtattttttccccataaatccatgagatgaaatatctgaagagagagagaatatgtggaacaaattccaccgaaaggaaaagtgatggcagaggcgagggtgaggtggaagacgaaagggaaggagagaactactgcaacagagggttgactttggacaaaatttgtcacccaacactcacagagagcataggaaaagaggatgattagaaattgacctatgaagactagaatttaagaatagtcatgtttcattgtgaagaatatgatattattgagagaagaaataaatgtgtggaattgtttggggaatctaagtagaatactgatatgtgtaccatgaaagtgaaagtattagttgctcagtcgtgtcccaccctttgagaccccatggactgtactcctccaggctcctctgtccatgggattctccaggcaagaatactggagtgggttgccattcccttctccagaggatcatcgcaaaccagggatctgcctgcattgcaggcagattctttaccatctgagccacaagggaagccctttgtttaccatggatgtttctaaacagcaaaagtgcctattaaattctgtgtgctgtgtgtagcctttgatctatatataaatgtgttttatatatggtgttgcagcaatatacacaatacatattgtatattgagttggccagaaagatttgttgaactttcttggctaacccaataacttgtgtgtgtgtgtgtgtatgtatgtatctatctatctatctctatatataataacgtgaagtaccttgtgtcttataaaggtagctaaggaatggctgatatctatcagcataagcacttgagtgggttgttcagtgactcagtcatgtccaactttttgcagctccttgaattgcagcaaaccaggcttccctgtcctacaacatctcttggagccagctcaaactcatgtccattgagtcggtgatcccatccatacatctcctgctcttttgtccacttcacctgccttcaatctttcccagcatcagggtctttcctatgtctcagcttttcacatcatgtggccaagatactggagcttcagttttatcagtccttccaatgaatattcaggagtgatttactttaggattgactggtttgatctccttgcagtccaagggactctcaacagtcttttccaacaccacagtgcaaaagaatcaattcttcagtgctcaaccttctttatggtccaactctcacatccatacgtgatgactggaaaaaccatagtttccaccatacatactttagcctgtaaagtaatgtctctgctttttaatatg

SEQ ID NO: 41560 - DNA, 945 bp, Bovine  19866881576502
aaaaaatgtattttagctggttatttatcacaatcctattcaacaacttcttttgcaaaagaagaggccttactttaaaataacttgatactgtgaaacttttattttgaaatgattcactaatgtatgagtcattatggatgattaaatataaattagaattagtgagtatttgttctgtggagtatgaattctaaagtggcctatcaaaaaggaaactaaaatttcaaacaaaatacatccttcaatactactgatgactttatcactttagcaaagaagaaataaaaagtatagcattcatattccgttatgttgtttttcaagtacttaaaattaatgactctaaagagtttttttttaataagtttttttttatgagaaatgaaatctattgaaacctaatttagacagccatatgcaatcatctaggtagcttcctcataatacttttatctaggtgatattaattctttgaaattttcataaaatatattcccagaaataataaagcatgaaataaaagtagtatactgatattttgtacaaatatggtagaatattatatgtaataacagagaacatttgttattagtggtgcttacacacttgtatggaaaattctcacaatagttctagttactatttaacaacttaatataatataaaatttgaagcatgcagactaaaacgcaaagtaataaagtataaaataatattattttctttatttacattttccttcagagaatgccttttgcatcactcattatcacgctctatgtgtggagagtgatgatcttttctgtcaatcagtctactccaagagtcaaagataaagttacagtcacaaggactgaaatgtggaaagatagatcacaatcctgctgggacactcctacatgagctttgattggccataaaaagggattatatcaatcagaa

SEQ ID NO: 41561 - DNA, 2045 bp, Bovine  19866881690626
ttctatccctgtgttgggaattcccctggaggagggcatggcaatccactccattattgttgcctggagaatcccatggacagaggagcctggcaggctacagtccatgggatcgcaaagagtcgtacatgactaaagcaacttaccacacacggcagcccacactgctgtgggctgaattgaagagccagtgactcttcaattcaggaatgtaaaggcctgttcccactgatcatcttctccttgtcccttctacttttttccctttccatagctgttgattccaagagtagtctcttattactccccacaaccccacatgcttatttcagtctttgtctcctttctcaggaaacccagcaataacacagagcaattaatgaattatttaaaaaaaaaaaaaaaatatatatatatatatacctgagtgatgtgttactttgagggataaatgctgaaagggtcagtttatagaagttaaaaaagaaatgtttttagatttaaggggaaaatatacaacctgctggccaatggaccagaacaggtatgtacccgatacagtaccttccctccagaaggaatgaaaattcattagagtacaggacttttgcttgtcacatgtgtacaataatagtagcagtggctttaccctggagtttgttaggctatcaggttccaccacagagctactgaatccaattttgcatttataagaccccaaggtaattcttatctggtgatttaaatcaatgattctcaaccctgcctgcaaaatagaatcaccagtgagcttaaaaaaaaaaaaatgctatgcctgagcctcattccaaatacagtccattagaatatctgggacatggtggctaagcattagcatattataaaatttcctaaggccatttataatgaataggcagatttagtactcattgatacaaagggtcttcaagatttcttttcccctttaatgtgttaggttagtcacaaatgcctatgaaatcccttaggattcccatcactaagtcttcatttttctcttagaatttttaagctgtttatctgattttccttcttccagcctcaggaaatcaaaatctgaaactgtatgctgatcaatttgtttattgtctgattctagcctctagaaatggcagctttctatttctttcttctcaagggactatggataaggtgaaactaataaatgggcagaggttagcttccaggtataaaatcaatgctcatattcactcctttcaaaatgctgtttcagtttggttagaaggatttttaatttcaacgtattttttgggtcagtcaatgaagtttggccccaagacaaatcaggcaatcctttgttctttcccaatgctttgagacccaggaccaaaataagagatgaaagtacataaatagttacaatggtatccaattcccagaccactgattcttgctaaagcaaacaggcacaagatgacaactggggaggaaagctcatcgtttctttctacataaaataggagataatacaaataggttgaataatgtagacctgaataaaatagcattattttagtaataaaaacacatgtattacatagcagttttaaatatgcctgaagtgggggtctactgacatgtactataaaaagaaacctttcattgactaaaataaaccagtaatatttatgaaaaggacataaaagtttaatatttaaagttatctaatgataaatgaagaaagtctaccagcatgtctaaatagaagcttttatttacatgaatattccttgtatgctaaagcccatgggaaaacaaatatgtatttaaaacatacattaggaatattttatcactgtcaagatggaagaaaagaaaagaaacatttgctcgtgtaagtggaaaattttccacagtttattgtgatccacagagtcgaaggctttggcatagtcaataaaccagaaatagatgtttttctggactctcttgctttttctatgatccagcggatgtggcaattgatctcggttcctcagcctttt

SEQ ID NO: 41562 - DNA, 1767 bp, Bovine  19866880342062
gattccctatctcattcatggatcttctttccagttctagggtaccaaagtaggtacaataagtagcgtttgacaggaaaattaggttccagacctactgtagtgggataatgttctcatcggacatgttcctgaaatcatcatcagattcagtttaatggattcaaagactcatttgttgtgaacaaaaaggcatattacttttagttgaattagcattatgttggcagagcttaagacaacttttggcctagttgatgtttggattcagttctctgaatatttatttcaagccaaatgtctaactagacagaaatctgcacatgtagtcatttattgtgacaacaactacatcattagacaaaccagtctggtcacagactatgagttagcctctatgtctttagccagcttccttctgtgggttccaatttaaatcagttcaatatgctttccagttcaaatttatatgaaacagaaagaaagctaggggaaaaatgctgtactcatttctattttttgcatattgtaagactagaaaggaattgttaagcttcatatttttattatgatcagaaattttaaaattaagtatccaacttaccaatttcatttaaatagtaaaattggagccttggaatttctttaaactggtcttattagaaggccctgaatttttggaatgaagcaattaagtgccatataaagtttttatagcatttcagaattctaagagaaagatcaccttccaaattgtagatgaacttctggtatgccagacccctctacctactaaaggcatattcagtctgctaaattgcaaatattaaatctttttgattttttaaagttctttattaaaagaatatagaatgaaaatatgatttttatagtctttagctaatagggcaatgaatctgccaaatgagaagttttacaaaacattcctttacataaagtactttaagtggtgatatttagtggtaaagcatgttactattgaaatttaatgcatctttaatagcagtcaagagatttcagagatgaagtcccatgaaataactacgtttgtttttaaattttggggtttgtgtgtctaaatgtatatgtttagaagtgtgacaaaataatcttatctgtttataccactttatggagcattttcacataaattatttcatcagatcctaacaactctggaaagaagaaaactggcattttatccctatgtcacagatgaaaataactaagaatctaaagattaaataaacttacctgatttctgaggctatgagttatcttggagaatactgttgttttattattttaaatattttttttaaacaatcactattgataatgtattatcaacagaagataagtgaagttttgtgtgttgtctatgaatgcacatatgtgtgcatacttatataagtaagttcttattaaaataatttggtaatatctattagacagtctaaataatatgaaaaataggaatagaggcctggactagatagtcatttcaaacacaggactctttctgttacactgtgtagcctccatattgtttgtgttactggattttaaaattaagtagatcctttccattagcaagcctaagatcaaacaaggtgtacaaaccatatgcctgctttacagctgtatttcttccaatcactgttaactatgatattcagtaattaaattgaacttaagtaaaaatggcttatccagttatttaaggggatataacagtggagactg

SEQ ID NO: 41563 - DNA, 1702 bp, Bovine  19866880380747
taccaattcagcatctcccttctttttccccataagaccattagcttttacacccattctcagaaagctcccaaagaattactgtcaaagacgatcagctcatgacacaaatcttttgaggtatctaccttagtataagggctatctcctctattatttattaggttttttaataattgataatttggccatatgagtcctaagtaatattgcttcagtcacagagtgcacacacatatgatatatactcattcattcttagataagaaactcttttaccacgttagaaatatttcctacattaataaaataacaaggcacataaacacacaaacacattatcttgttcccgaaatagggaacccattgttgtataaacagagtgacaataggtgctgtgaggacaagctgacttcgcagcccacttgttgcttcatgaggctctgccacttgttctgacatcatctcttaaatcctgaaaataaatcttgatatcaacattgtatccattgtcaatcctctctagtaactggggagtacaggaaaacaaatcatacatcaaggccttttgctctgctatttggaagagaacagaaaaggaacatctagactcgtaattttaagcacccccagctctttcgcaaaagagacagcagaatttgtttctgtatttcttgtgttttgaaaatatttattgaggattttttgcatcctagtttttattccaagaatgctgaatcatgatcactgtaataggccagagcaagctgtcagcccccacacaagctgttatcaagacactcttgaaaatatgttctatttctaaacagttgagaaacaatttttaaaaattatttatcataaagcgctttccaattgaattgccctattcaatatagtgcatacttaataactgccactttcgcttcaagagagactacaagggaaatgcctgtttagttagccaattacttaattctttgttgcctagcatagggttccattgtacgtgaaagacacagaagcagcactcccatcctgaatgatgtgtgcagtgtttttatttttctattttaaattttattatttatttatttatggtatcaaaacgttttattgaggggctttagaggaggatctatgagcttgggagaacaacgagatcacacatcctcgcccagcctgtatattccaagctccagggtgcaaaaagtgtgcagttgtttttaaaaatcctagtggctatgaagtggtttttgcttttagttaaaaaaaaaaaagtggaatgtgttttttgcttttagcctgttacatgccttaaactcatactatttcctgaaactaaagtatagaagtattcctgaaaagaagtatagagaagataaatgagaatatagagaagtatgcatttaaaggttttctttattgctattctttttaaatgtaaaaaaaaaaaagtagccactattggtggctgttttacctacaggggacatagacaaattgaatagaactcttcaattgtaagctgtatgataccaagcacagttttgtcactgtgctttctcattctgctctttagtggtggcattagcagtgtagaatcagcacttaataagtgcttgactaattctgtgcttttaagagagcttctgtaagtaaaactgagtgtagactcaggaaaaaaaaaatgaccaagaat

SEQ ID NO: 41564 - DNA, 2095 bp, Bovine  19866880431983
tggtgaaggacagggaagcttggtgtgctgcagtccatggggtcacaaagagtcagacaacttagcaactgaacaacaacatagctgaaaaagggggcatacaaatgtcaacctgatttcacattttacatattaaaacagccctacttttctgagtgacctcataaaatgtaaattatatgaatttgaaattatgaagttgaactatactaatgaaatagatgtctagggattttattttacactttaggaaagaaaagttccaacaaatattttagtattcctggatgaaaagatcattttaaagtttggggaatatcatctttagctttttgttagtttgtttcaccctcattatgtaagagatgaatcttgtttagtctgtgtctactgagtattttaaatgttttgaaatctgtttccttgagaagaacaagtcacttggagcaacccagtaggagttctgtgttcgaaacttctataaagctttaactatccccacaaaagtgtgatccctgagtttctgcctttcctggtcagatgtgttagctctatctgtacctgtctatatcttggaaagccacgtcagatgaaggacatcattagaacacatggctggtcaaaacatgctcacagaagtggtggcaccttaatttactcttctgaaaataaaccatgacatcttctctaagagtattaaagacactaccctttaagaaacttacacaaaatatgatgtagtttaaaaggagaatcataaaatattaaacccattattttaaattcctgttattacatcagttatttatttacttatactatatttctggaaatctctttcacttgcaacaattttaatattatgtttgttacttactcctaagttagaaacttccactactctaatgtttcctaggtttccaatgtcaaaatgtcaaacagcctctgtagttaacctggagctttcttggcagtgagttcagttaggctagtatatagaagtacccagtcttgaaagctggccccattcccttggactcccgaaggactaagaagttaacctgagtgctcatctagacacgtttggtccacagtttccaatcttgaatgtacattgtaatcatatttggagcttagccacaaaataaaatattgatgcacaggccattctgccccagagattctgattgaaatcttttggtatctgtccaccccacatgttttgcagagatgttcccatgaaggcacaatgcctttgccagtatctcaaatgactgaaaataaaacaacggtttattaaaggtaacactgcctcttgagattttgtttttttcctctgttccttttccccacagtatttgatgagtctcgccagctgctaatgtaaactaatatgattgtatatgcaatgcttctttcctttgaccacaccccccaatcaattatattctatctgatacagtcttggtcacacctaccctttttgatatgattatttaagcctactttaaaagcagttactcagctgccctgcagatgtcagactttctggcaccagaggtgtggcagacctgctgcccccaggatgttggggcagagaggaacccagcactatgctcagtgctcagaatagtgggcaccaagaatggtttgtagctggacatcaccaggaaaaaagaaaagctgcctcagttcccagtatgtgttcataactaacacttaccccaaaattaacaaagacacatgtgtccaaaatagtgtctgaaagaaggaaaaacaaaatgcaaaatataattgcatttctttttagggtgagagagagggaggagcaagcagaagagctggaaagagggaacaatgtagagagagagattaaggttgattgatgtgacaggtacaaatctcttcccaaaactcacatatggaagacatataatttcttttttttttttttttgcaacaaactgaagctatcttaacctaaagttaagtttcattttgagcccttattctacaagaaagatcactaaaatctcagatgattagaccattactcacatccccacttcactatttttttcttagagattcatat

SEQ ID NO: 41565 - DNA, 1568 bp, Bovine  19866880441266
ttggattctattttatacgaaacttttctgctgcataatcaagactgtgtaatatatgaggacagtgctgtatggttagactttacagatggtttcaggagtttgtgcctgccattgcctttctcactgaccatctgaataactgagaaaagagatgagaaaagttaattatatgactgactcttcagtgaacagacaaactaaacctaggtctcttagaggtcattcttttaaaaaaaggcattgtcctctgcaacgtttttgggtcactaatgatgtaaaagatgtttcttgaaaacagagcttaataatttgcaatggtgatttaaaaatctaattggactcttatcaactaattctcaataagctaatgtaatggctaattactgttattggtgacatttagacatgttgaagtctaattgtgcctttaaattagacaatgtaaggctatatttacagaagctgagttatttaacacttagcacggtacatctctgataggattacatagacagcacccattaaattattagagttagcctgtgatttgcagttggatacaaaatttgtacagaagcataatcatgatacttttaatcataatagtaatatgattacttttaatcatattaaaagtagctgaaaagcaaattgcaaccagtaagtaactgaaaagcaaactgcaaccactaatgcattgcacagaaacataaaattgttagttctttttttaagattacacgttgagagaaagggcattttaaattatagtctgaagtggctgttaattataaaattctatttatctttcttaataagcataaacattcatattctattatgaccactgagtctttgatcttacctcctttcaacgcagccatccctcagggtgatattacctggattacagagaggtcctatttttccttgatcttttttttttcttttttttttttttaattttatttaatttttaaactttacataattgtattagttttgccaaatatcaaattgaatccaccacagggtatacatgtgttccccatcctgaaccctcctccctcctccctccccataccatccctctgggtcgtcccagtgcactagccccaagcatccagtatcgtgcatcgaacctggactggcatctcgtttcatacatgatattttacatgtttcaatgccattctctcaaatcttcccaccctctccctctcccacagagtccataagactgttctgtacatcactgtctcttttgctgtctcgtacacagggttattgttaccatctttctaaactccatatatatgcgttagtatactgtattggtgtttttccttatactcaagtcaacaaatattttagtcagtagaaaagagtcatgggcaaagcagttaaggaaaagtccatacagaaacagacccagcacagtcaaaaataaaataaatcaataaaattaaaaataaataaataaaaatcctttaaaaatccttcacaaaattcttgacctgacagagtttatattgatatagaggagactcaagaaataaattaaa

SEQ ID NO: 41566 - DNA, 867 bp, Bovine  19866880493757
aagtatacagaagctgcagagaaggcagtggcaccccactccagtcctcttgcctggaaaatcccatgagcggaggagcctggaaggcttcagtccatggggtcgctaagagttggatatgactgagcgacttcactttcaattttcactttcatgcattggagaaggaaatggcaacccactccagtgttcttgcctggagaatcccagggacgggggagcctggtgggctgccatctatggggtcgcacagagtcggacacgactgaagtgacttaacagcaacagcatacagaagttgacatgtttatataaactacagaagcaataaactggtttggcaaggtacagaagaaaggaaaaagtctttaaaggtaggtcaagcattttacagattaagatcttaatgaccttgtcacttcacatctcaaggatcttaagttgtaaatagaatttagttaaagagttcatcataatcagtgacattatttgttaagacatttaaaagttacagaagaaacaaactgtaatgcaacattatggcatggtaggaatgaagtgagttaccaggttatgaaatgccttaactagtaggagatcacataattaccagaaggtaaaatagcagggtaatccatattttgaatgttatacttctctgattgagaagcctaaaatcatgtgcctttcttcaaattttaagtgagacatttgttaacatggcatacaacctcatttcatattccaccagtaaaatgtttatacaaaaaaaaaatatctagaagtcaatagtcactaatcacagtcattaaaatgttcattaagtagagaattgaaggaaaattatttccaagtatatgtgaaatt

SEQ ID NO: 41567 - DNA, 1081 bp, Bovine  19866880507049
atagaaaagtgttaaatatggtctgttccagagtgattttataaacttagcccaaggaatcaatcagtcaagagggtagtatctgtttttagttggaaagtagcacttgtcaatgtttccaggaagaatttgcaaaaatgtcaactcctttgaaatcaggccagaaggaaaactaacaatagttcagatgcaaacacatttcatttctcttttctcagaattcatcaattggatattgaggaagttcatttaaaatttaattatccaagttttccttcttttataacttcccctgatgtttaattaccccatatttgttgattattttccttctttcctatgaacatattagcatgcaaccataactatgttaaattacctttaaaaacacataaaaatcagtggagcatgctgttttcctcttcacatgaagtctgctctaaatatattagaatattttaacatatttgggaagtgtttattttagccccaattctaacacagcttgggctgaattaacctgttaagtggagcctgtgcttctctacatagcattctggattgtaataaggtgtatccaggtttgattttgttgaccattgatttacttgataaatattttcagaaatgatgagaaacatataggacttttaattgcctaaaattagattttttatttctaatctttttacagcaatattgcttcattcagaagataaccatgccaaagtatttccttcataaaaaatgtaaatcagagttttcaaagcacattctattattttaaaattcatctaaagggaattcatctaaattccctttagatgaattcatttaaattcatctaaagggaatagtttttattacacattaatcattttatctctaacactatgccagaccagcctacattatctcctgatattttgacttgctgtccagaaaggaatggtctgagggtttgactcttttgtgaaactgtcgtatgtaccatatgctaaagatcatacatccttattatctttctgttttgttggcatttatatgtagatatgtttgcatatgtgtccttccgtgtgtg

SEQ ID NO: 41568 - DNA, 906 bp, Bovine  19866880543681
tgaaagttttaaaaagaatgaagataactgaacctaattaaaaatcctaagaaacctagaaggaatgcttattaaacattaaaggaggaataaaataactctaagaccatgatcaagaagaacagagaatagtgaagaaaggaagaacaaatagagatttaaagagtgaaatgccttcagttcagttcagtacagtcgctcagtcgtgtccgactctttgcaacctcatgaattgcagcacgccaggcctccctgtccatcacaaactcacagagtttacccaaactcatgtccatcaggtcagtgatgccatccagccatctcattctctgtcgtccccttctcctcctgaccccaatccctcccagcaacagggtcttttccaatgagtcaactcttcgcatgaggtagccaaagtactggagtttcagctttagcatcattccttccaaagaacacccaggactgatctcctttagaatggactggttggatctctttgcagtccaagggactctcaagaatcttctccaacaccacagttcaaaagcatcaattcttcagcactcagctttcttcacagtccaactctcacatccatacctgactactgaaaaaaccatagccttgactagacggacttttgttggcaaagtaatgtctctgcttttgaatatgctatctaggttggtcataactttccttccaaggagcaagcatcttttaatttcatggctgcaatcaccatctgcggtgaaatgccttaagatcaatcaaatagcaataccggatgtgaaaagtcatcaagctcaaacaaatgtggaagcacagagctcaggaagtgtgttaaagtgcaagatagggtataggggacagagttagcatcaaataaaggcaatcagattt

SEQ ID NO: 41569 - DNA, 1136 bp, Bovine  19866880595882
ctaaatatgccttgaataaactttttttgttataaaactattaaaataactttttaagtaactgattctatacacaatactcatatcacaactgtcttacgtataatttaagaactgcagaccaaaaaaagcaattaatgtactctttctcttgagcctgagccttccttgtatccaaaagtattaagtttaatgacaaaggagaaaaagaagggagacttgtggaaaatatctagtaccagtaaagatattaaggaaatgtaatgtcttttgagtagtgtcctagagaaagtgctcataaatccatttgaagaaaaatgcatatgtattagatattataatctcccatttcagtgaattacattctgtaatccttcataatatattgaaggacatagcatagcttttttttctggcattaggtgagcagtggtatttgagcaatataaatgaagctaaagaaaaaagagtaaatttcctagacatattattttagcagagttctcagtttagaaatactttatacattgatttatttttttttctctttctgtgtgcaaattctctgagatatgacaggtggggaattatttttattttttaaacaacaataaaaacaaaattaaataaaagttgatatttagaacacttcttaaagtgcttaaattgatttatacagtcttgcataatacttaaaatattaataaatgaactctttaccctgaacgactataatgtaagaatcattaagaaactcagtgagaatttcttttgcaatgtgactacattttaaatgttttaaatgaaaattcttgaggtgttacgttataatttacagatggattagaaatttaagattcctcattaacagcttttcctcatttaaagtaacacatttctttttccagattcttctacttggacatttcattactaaggaggaaaatcacttaatctctctgtacctttttactctaattgatgtattgaattatttcttttcctctagagatagacagcacagcagagtcaagagcatggtttttagagtaagatagcaccagggtttgactcatggctctgtgcatgagttattggatcattttaaccacattttccaaatatcagggtttttt

SEQ ID NO: 41570 - DNA, 1114 bp, Bovine  19866880624703
aattagaaatactttgaaagcatcaactaaagccgtatttatttaccagaaacaaaaaatcagaggacaacaatggaagtctttgaagacactgaccctcctagaataattatcatcacttacgtaggtcatactatatatattagtttttttttttttttataaattcagtgcaaagcactaagtacattttttcctttggtatctgtatatcacttacatatcagacttataaaaaatgaaatttgttatatttccatgaagagaggcaggattttggagagcttgccaaagcgtgtttcccagtgttgtgacttacagtgttagcactcagacttatctgatatgactcttttagataagcttgtgccagacaagttcatgttctgtcaactccaaagccaagctaattcatgtatcagaaaccacttgattatattttcattaaagagaagtacatatcaaaatgaagaattgagttgtcacaaaggtgcctgggaaaagatttgctttaatgtaaagaaaaaatgagtttggtatacctaaaactaataattattttgtggtccattatttctttccttcttcacttgactcttcattctttcctaaatttcttggtcttgagaatttcaattgatagtgtccttcctatgctttgaagtttaacatacactctgtgatagatccagaaaccaatggttaagatagagtagtggcactggaacagaggtgcatacacagtgataaaaagtgaccttctacagaacataacttgacgagttgttttccatttgatgtttattggtgttttgtactattttttttttcaggaggcatatatgtaaatgttcatttcagtatatgttttagtgcttgttgtgaagcaagatagcaaaatttattgtacattgattgggaagtttaattatttagattttattttaaaaacacataatctggaaattatgtatttggtttaaaaatatttttactccacattctatgtcagtttgtgactttttatagggagagtcattgaggaaatataaaaatagatatcagatgattaggaaacgttgatgcagtagatctgttaaatgttctgctggta

SEQ ID NO: 41571 - DNA, 1375 bp, Bovine  19866880628052
tatatatacatatgtatgtgtgtgtgtgtatgaatatataaaactatatcaggagtatttaaaatattattttgataactgttttaatataactggtttgctttgtaaccctacatattttctttgatgtatttagaattaatattctgaacagagatccaaggcttcatgagactagctcaagtgtctacaatacacacagagttaagaatccaggtcctagctttcctgggccttgtatttatgcagagggacaaggaaagtgtggcaagagctaaatgtaagctgtttctctggctcaaacaaactctccctggcatttcctctgaacggacacagatgtgggagcataaaggaaggtggctcataaaattccaatgcgtttaagagtaagggtggggggagcaaaggaaagggaaagcaagaacacttgtcagtcatgaatggcttattggctgacttcgtcagcaggggagctgaatttgatcagttctgccatgattagtgtcactacagtcaagtgtaatttctgtataaatagaagtggtggataggaaaataattcagtccatccctctaaattgtctcagtcagcacagacatcaaaaactgtcagcccgaggagggggaatgcacacatatccaaccaagcctgtaattgtattcagtattcaaatatttcaaagtacagaatattattttcaacataagaccaaagaaaaaccaacgttgattgtgcagctcatctaactgtgaaaacagcatttgtttatttttcattgtctcattggtagagtaagcaagtaagtattttgtattttatcacttttcagtagaaggatattttcatctgaaaatatgtctctcttctaattccttagtttaatgaataatacctcctttcaatcaattgtccaagataggaacctgaagaaatcctttccctctttaactaaatggatcactaagtcctgttccctactgtctctaaaataatccacttctgttagacccattgctagttaggttagttcagaaatagtatcattattttaattacaacacaggaacagactcgtaactggtctccttggctcaaaacccttattgttgccaaagtttacttcaaatgctcatcaaaataataattttaaaatacactcttgatgtcacttccctgcaaaaacacacagccatgaaattctactaaccccagggaacatgtcataattctcatggtttatcaggtcccagactacattttttgccttcatactcctcacactcttgaaacatcaacaaaggagaaaacaacacaccaggcctatatcattgtttactcatatgatataaacaatgtttctaatgatgttaa

SEQ ID NO: 41572 - DNA, 1833 bp, Bovine  19866880643172
tctatactaagtgttttcaaataatggtattcagtcttaagtgttacatacattatgaatgtgtttctaatgaaggtcataatttttatgttaaatattttgcctcttaaaaagcaccactgcttcagagttcacccactgaagatcttctaggaacgctcccacatgtcaaaacttagcaaatgagtcctcagtagagtttcacctcatcttatgatatacggtaaatagtaaaaagtcattcttgacattcaaaagttatctgaaggtttacattgcaagttctcaggattttttaacatttctatttaatttgtgcaattatgcatagcctttccactggtttcctcacattacctctaaaatgacaaaatgatgaaatacactttttgggaaacatctcatccaacaagttttgaagcatcttcttaaattggttattatttctaaatgttctgttatcatttgataggtcacttaaaggtgttcctaaaaatagtccttgaaatatgatttgtagtctatctttcttagtttagagcaaatatattaaccagcagtcctgtatttgtgcattatatgtatactctgacttcattttctctgtgactagaacagaagccctcatacaaaactgtcaaatgtttctgacattcatggctcatagagcaagggtttcacagaactgcagaaggttatgttgattaagcagagacgtcttctataaattgactgctgaagcaaataaaaaagggggggttgtgaggaaggcagagtctgtttatccaaatgatcaaccaaattgcattcaacatgctgatatgggagatggaatactactgagcatcctgaaatgtaatgcttttctagaatattctagaaacattctgcatgctatacaaaaaggagagagtataaagtgctgtatattaattaaaaatgaaacaaaaacaataaaaaatttttaaagattttcctggatgacaattatgggactgatcatataacagcatcacattatctcaagggtatgaatcatagtatgtccaacaaaatcactgtactcctttcaccttggactggtgtcagggtaagcatgtcaatgagagctcttcctgtgaatgcctgaacaagtttcctgattaaaataatgcaattccgtatggagaagctcttccaaaagccacacgcttctcctacttacgcttctaaggtgcaacaggatgtgcatttttgatcaatcttttcaaatgatcattgactgcagctgaaatctatacacatttacgttccttgtatacctgacactgaatgcaacattaccagtgaaaaattaagaatatttatatgtatttaaggggctgtcagttctgagtttccatatgtgacattaatttctacaggcagcaaccatcagagaatcaagaagcagttcacctggcaaacttcagccctcattaggcgtaaaaagatattttgtcatttacatatgagacaaactatagccaagaactgactgtataactgtattgcaaaagatccaaaggacaattataatattaaagaaggtaaaaagaaaagtgattttcctatttatgaaataatttttcagtaagtgacattctactgatgaacctccataaatccagcgatctcctgaaagggagaattctatcatgcaataagaccatattcacatttatatagaaaacagatgtttacaactttgggctttacacttagtttatatatgtagcagttaattcacttaattataaattgctaaatatttacattctcacatttgtataaaatatctacttcttttaaaat

SEQ ID NO: 41573 - DNA, 2431 bp, Bovine  19866880644322
tatttcctatatgctctcttccagtctcagcaggatgaaataatataacaaacctgatttttaaaacttaatagatttgaaatttcatactagcactacaactaacaaaggaaatgtcaagaacatctaagtcctgtgcatcagtttcctcatctgaaaatgagaactgaatgacaaaatgaattcaaactacttagcatagtgattagcacaaaatatatgggagttctcttcctgtctcttccttctttatatgatcctcagtggtgtggaagtatttaagagtattaatttcttatccttaccacatctatgtgctgtgttctgttgtggttgtgttagtcgctcagtcatgcctgattctttgcgaccccatggactgcaggcccaccaggcttctttgtccatgggattttctaggcaaggatactggagtgggttgccacttcctactccagggatcttcccaacccagggattgaacctgggtctcctgcactgagggcagattctttactgactgagctaccagggaagcccatggtctttattgacagatatatttaattttagtaaaccctaatctcactagcaaataaacaattcatattttcttcccacttgtacgttggccatatcacttaatatctcttgtactgaatttttaattctacaatgaaagttttttttttcattttttggtctgtttttatgtttgtttttaattttattttcttgatgatatctacctgctatctatcatcctggaaaggttctgaggcaaagtgtgagtcatattttcttagtgctcagtttcctttcttagaacaaatgagagcatggcattaacccttccaaatcagcagagaatattatatttttgttttctaaacacttaggaactgatgttcaagcttgctattaaaaatgaaactccatgtgggtatctagggactttatttgggtttgattgttcattgtctatttatttcctagcataattataacaatgtgtcatggcaatattatccacatgcatttacatctagctatgtgttattaaagctagacccaccatttttattttgggaggggtgaaatagaaaaggatagatttattactttgccaagtaaatggggccacagtgcactaatgctctcaaagccatgtgtcctaacttggagaagacagtgagaagttttatagtaatcattctaagaggggatgatatgctcatggacatgcttctgatgggttgatggtgaagttagtaggagtcaaccttcagatccaataagtctggggtccacatgcttatgggcagcataccatccttaattattaacttctttcacctggagggagtttcagtctctgagacaactgggctgtggctggagtcaggagcgaatacttagtctcatgggatggggtcacgtgctctgtccctgtgcagtcctctctgtcccctttgtagatgaactcataggaaacgtactcagcagccttaagaaagagcacagggccggccaggttcttagtgttcatggtgatcacttgatgtggccctcctcacatccacctttgagctgatggggttcaggacacgacaccctcaactgtggcaccttgaatattgtaaactgaaggagctggagaaaacagcagaaatagaaaggtcacttttactgccaaactctgggctctctgtgcactgatgccaaacagaaatacagagaaagagttatggaggagagggaaagagtgctttatttatttgccagttaaagagggaacacagtaggctagagcctcaagaactgtgcccctgacccactgttactttaataaattattttactgtcctctgctaagtctgtgaaacctcaggaaaacaatgatgacaacaacaacaacaaaaatatgaatgactttttgagaggaaaagaacagctgagcaataaaaccaatttagttagtttttgaatgttgaatttaagccaaggtttcccggtggtgccaagcaaatcctattcatttttgttcatttcttaatttcttatttcctctcaaattattcaaatgcctctgctgggtagagctcccaattcagccaagaatttgtctccccatagattacttttatactgtatctgaaactcattaatcattgtatcctttcaaatccccattacacaagcaagaatgggatttaaatgcctaggtatctcatgcttagttctaaataaggcaggaacaatacaaggtgcatttttcacctctcacttactgaacttgccataagaatattttgatgacttattttaaatagctaagactaatttttaaatatattttctggattaaaaaaaaataattaaaacatctacttgtttgtttgagaacttgaacgtctaaagaaacagaagg

SEQ ID NO: 41574 - DNA, 2043 bp, Bovine  19866880652026
acttgggtctttactttaatttacctcattttaactctgacttggtaaattttatttaaggcactttgggcacaaatggcagttgtgttggtaatgctggtggtggttgttctcagggaacacttagtctcattgtttgaaagggtcaaaattatatttaggaacggatggggaagtgactgtgatggagtcctgtaaggcctcagcactatttatagtggatgcaaaactaaagggaaagttacctgatacttgatatgtcaaaaatggcaaaggaagaaagaaatcaggggaagaggtactgttattttattttttaatttattatcatcattattattatttttagccaagccatgcagcatacagatcttagttcccccactacggattgaacctttgcttcctgcagtagaagggcagagtcttaaccactaggaccaccagggaagtcagctactgttctcttagattttctgttgtattcttcccactatgttcaggaaaggagcttggtaatgtatctgtgatgtgtttatttgcagtagacttttggtgtctcttttgaaaatttactcttatatctaagtttcaattcctgatattgtatggaatgggagactgtcctggtttgaagaacaaacttctaactagatttgctcttgacattcccctttaacagtttttcccagttgccatgattccccttgtttgtttcctttctggaaaaacataacaaaaaatgtttgattctgtatctaccaactcctccctctccaactaattccaactgtatatatgcatagaaactgactggctgataaagtgtcttgatgccttataagaaaagatttttttaagtttctaaaagttcttctgggatgtattaactgttctagatctctgtgcttctggttggtttctagacagttcaattattaatgaaagtcaacttctagcaattccctggtagcccaatggttgggactatttgcttccattgcagggggaagggtttaatccctggtcagggaactaagatcctacatgctgctcagccaaaaattaaataaataaataaagtccgtagctaaacatctgcaaatgattttgcatttctcctctaggaatatcatcccattcttggtatccctcaaccacattcatggtaattcctttccccttcattctgtatcatttctcatgtggcccttttcagaagcaatcctttctttctgcttctcatcacagcaattgcctgagatcttgttatgcatcactgtcagctcagtgttcccaaggcattcagtgtatgggagacagaagacaaaacggtctggagacagcactcattgaagtaggcacaagctttattgatgactttagtttaagagtctcttccaagcaaagctgtctcctgatacacttttcggagaagagaagcgagctcacattcagctctgctgttcatgtcactgtcatcatgtgtacccatctgtgcctatcgatgcccatcaacacacccatgccagggtcctttcgctgttgcctctggtgtctgtctgtctgtctctcccctcttccttccattcttgacccattcttggtttttatgccttcttgatactagaggccctttctgatgctctgttcaggaagctggcatccacattacccttgtgggttaacaatatatttatataaaggagataaggtaataacttaaatgggattcttaccccaggcccgtgacatctctgcataattatgaaactaaatcagtataataaaattcaattctcagtgtccccatatataacatcacagtgattgatagatactcaataaacatgtgatgattgagtgaatgaatggatgatggatgagtttgctgggaatacatcccaccattcttcctcccacataccattttaaaaattccactggaggaaattccctggtggtctgtggttaggatttggtgcttttactgccaaaacttgggttcagtccggtcagggaactaagatcctgcaagccata

SEQ ID NO: 41575 - DNA, 4279 bp, Bovine  19866880697634
actttggtgtgtgtgtgtgtgcatgccaagcagtgtgctaagtcctgggaatataaagaaggatgaaatgtagtccttgattttacaggattacgattctgggaatgtctatgacatttactacctgaagtactcttttagcattaataagtttggggttagggactgttaacttatagctctatacgttctttataaaacacagtacaacaacttacaaagaattagcagtccataaagatcttgggatttctttggaaggaatgatgctgaagctgaaactccagtactttgggcacctcatgcgaagggttgactcactggaaaagactctgatgctgggagggattgggggcaggaggaggagcggacgacagaggatgagatgcctggatggcatcactgactcgatggacgtgagtttgagtgaactctgggagttggtgatggacagggaggcctggtgtgctgcaattcatggggtcgcaaagagtcagacacgactgagcgactgaactgactgactgactgaaagatctgctggggcttccctggtggctctggggcttccctatcagcttcccagatggtaaagaatctgcctgcaatgcaggagacccaggtttgatccctgggtcaggaagattccctagagaagggaatggctacccactccagtattcttgcctgcagagttccatggacagaggagcctggcaggctatagtccatgaggtcacatagagtcagacaccgaatgactaacacttccttttcatttttcaaagacatgctgaatgaatgcttattttttttaattacaacatctaaatcatgaagtagataaatttttctttgacagttttttgcagggctttcctcatttcatcagctaccttcactgactgagcctgggtcgttcatggtcaaaactacagtggctcttccaaggcacatcttctgccacaatcaatctagctctgaattttaaaatatgctttacttttttttctataaaaatctattccctttgtttcaatttttctaaaaacctgttttctccaagaaacagctttggtaaatagtagacaagaagctagacaagtgtctgaagtctgaattgaaagacctgggtgaaaatgctggttgagcctgtatgtttctgaaaaagtcactacattctaccattttaaaatgagaatagggacttctctggtggtccagtggctaagattccatgctcccaatccaggggtttgatcccaggtcagggaactaggttctctcatgccatgtggccaaaaaaaataaataaataaattcttagaagatgtgtgattttcccaaagggaagggtggaaaggcattctagaaaggaaggaaactgcatacaaaagcatagagactttacttatacagagtatatgcatataagggatcatgtcaatgaagactgtctcaggtactcaaggaaggcaataaagaagatacttaaaagctgtgatggccatggctttgttctttacacagcagaggcagcaaactggactgcttacccatcccttaggtatctgtgtatgagcgtgcatatgtaaattaaatttctcatgtttctactttaggaagtatacttattattagccaaatcatttcctggaacataacatgaaagacactataaattctacaaagaaactagggaaagggacttcaattagaaaagtaaataatgtaaaaaaaactgtgatttattttgctaattaaagacgttatcaagaacaaaataattcactttcattgttcttcaatttacttatgtactcattccacaaatatttgctaagcagccactctaggacagacactgggtaatgtttaaaattcttcagcaaactagacatggcccttgtcctcaagctatttattatatgggagaacagatggaaattaaatacttaaataactgccatagtgaaagtgctacaaaatagcatgggtgctatgaatgtaataatgggagaaattcagtaagacatgggagttagtaaatcttcctgcagaaaccatttttaaaaggagatctggaataaagacatgtttctatgtgtactggtggggagagtcagagcatgaaagggcaatagtgttagatttgaatacaaaaagggagttgggtataattgaaagatgaacatgggttttaacgccatcagtgatagcaaaagacaagatttataggcagggaccagaaaatataggaattaaataattttgaccactgtcttcagaggatgggaagctttaagaaagaaagtaaagccactcagcatatagtccatatttgtttgtacttcacactgtatttctttcatgaactcttcccagtgcttcattgatacctcattaattttttttttaatgaatgcttaccaatgcttccatgagataccatcttgattgttgaaacaactgtcactcattatgtacagactttttacatttttagctattgacttcctcttaaaaaaacaacaaagtgtttgacttgtaatttcacctttctgaaaatacaaaatcactaccacccaaaagctgaacctttaaaaaagctttgtaaaaatatattgtcaaatcttcagagcactgctcaattgtcactgcctagagattcaaagaaggaaggaagaaatccaacagttacaaaaaaccacctcttactaaggagttacaggtgctaagcaccctgattgacacttttatttttggaaacaaatgtggcaccaaattgtttaagaatatttacttcaacatttgattacatattttgattttcaggtagaaatttaacagtagtgatttcaaagaggcttaaatttactacaacaaaagctcaattgttatcactttcattatatattttaacatagtattttatatagtcataagggttcaaattaaggatcagaagaaataactacagtgtttaaaatggaaacattttcacattttatttttacacttttgaactttagattatgttctatgtgactgaagagagagatctttagaattgatttggacttgtacaaatttgttcaagtttaagcctgtcttttttgaaagaaaacaaagtgctccattttaaggatcagaaaaaaataaagctaatgaaatgttcataattatgattttcttaaaaaatgttttatttgattagattctactgtttggaatttagaattgaaaggtagctcattcccaaatgtccctgaagtgaaatgaagtgttgtgtccgactcttccatgcaaccccatggactgtagcctgccaggctcctctgtccatgaaattctccaggcaagaatactagagtgggttgccattcccttctccagggaatcttcccaatccagggatcaaacccaggtctcctatgactcttgcattgcaggtgaattcttcaccgtctgagccaccagaggagccctagttagtttttaaaacttattataaataccatttgctctgtctctttgaaccaaggtctttgcttaaaaggttaagaaataacctttatatacccagtttttctgagcaaagagtatctaagtatcatagagcaagatgggtttgttacttgcatttacttctaattaaggttaaaagcttataaattcattatactcaccatttaagccaaatttaaataccttaacccccagaaatgtaaagaaatgctttgcatctgcttaggatcttaataaattcatttttaatttaagtatatttgcaccaagggcatttttttcctcaaaaatgtattacaatttagggacttaaaaattttctattaaacagttttatttttaataatattatctgagagacattacatacggatagtatgttatactaatctgactcaattctagaaaatcctagctcatttatatttatgttagcatatatgtataaatcggagaaggcaatggcaccccactccagtactcctgcctggaaagtcctatggacgtaggagcctggtaggctgcagtccatggggtagctagagtcggacacgaccgagcgacttcacgttctcttttcactttcatgcattggagaaggaaatggcaacccactccagtgttcttgcctggagaatctcagggacggggaagcctggtgggctgccgtctatggggtcgcacagagtcggacacgaatgaaggaacttagcagcagcagcatatgtataaatagtcactaatttatatt

SEQ ID NO: 41576 - DNA, 1652 bp, Bovine  19866880713852
ttggtgcttcataaatatatgtcaaatgaatgaaatggttttttattaaataaatagtagaattttaaaatggaaaaataatgattattattctttaaaatgtgctttggtaggtatatacttttattttaaatcattgtgttatcagtagtaacacattgacgatacctgataatggctacccttcactaaaaacttcattgtgataaatgaaaaacttcaaagtgataaatttcattatcaaattaatctactctgatttattttttaaaatctcagaccttttcaacagtggacactactgctgtcaaaatacgacaagccttcttaagccacaatcagatatatacttcaaatatttcaacaagaaatacggaaggacccaaagtgcttttgttgctgttgggactttgtttattctatgccatatgaaatgtatcacataaaatcatggtagctgtaatctgtagaaactaccataatgtatgtgacattttatttctgttcgtgggccaattagtcagcacaagggtccctcattttgtgtaatgggcaatttgaagatttctttttagctgtgtcaaatataattgaatttatactctaataaaacagagatggatggataaaattctgtatttatacaatgaaagccttacggtctttccaacgatgggtacaacagcacagcttcagtgttttacataagaaaaccacactgggtcaagcagatctgattgattttgggcaactccagtaccaatacggctttctttgcacacttaagttctgcttctctgtcatttcttattcgataattcttctatgcaaaagcacagactagctaaaatcagcaaatcacacaaaacaacctttctagacttttactataccttaaaactacagttgtaaaatctaggtacatttggcagctgttattttatgatgaagattagaaaagcaatctttaaaaaaatccccagattatttaagcaaatataacaatacttgaaagaaaacttgacttgcctcagttcctagtacagtcactttaaaaagccaattaacatgcatacacatacagaaaattaatcacttatagtgtttgtttggactctggagctccattctggatctactgtcagtggtacaggctataatgatacctcaaggaccataaaaggtttggactatcttctttgcatgtacatatgcagattattaaatttgcacttgtaagaaattatttcaaaattcattatatcaaagtcattaaacattgtccatttaatgtgaatttgtgcattttaatgcaaaatatcaattattaaataaccataaagaataataagttgtgagaatagaagagagtaagtgaattacctactgaatgtctccatttgaaataagtttcttttgctctctaggatttttgcagacaataatataatgatctatctataaaatatcatatttaatgtttgttgctaaacttatctaagtacgtcgactctttattaaatctacttcttagcattactaaaattccataaggaaaatatttaaacatcttgcaaattgtagaatgctgcggatttctatttgcaagggaatgttgaaagaaggtgaaaggggtgatatggtctatattt

SEQ ID NO: 41577 - DNA, 1699 bp, Bovine  19866880732353
tgaactgaaaatatacactaaatctctctctgatttaaatttaaatcagacatcagaactgaaatgtatggttcaacaaattctattcagttttaaagagtttttaatatttcatatttaataataaccaaatgtaatataagaagtcactgtcacagtaatacgtattaaatacataaaatacttggatagctacttaaattatgcagataatctttaatgaatgggagttgataacttattttgcaacctctgatgtatttattttgcacaagtgatagttagattttcttaatttttaagaggcacttgagccaagacactagttcttgatccacccctttccctaagcaccacagggctgcatttgaagcatgatacaattttaattgcaaagatttatcattatgacatgtaatttctaactacacgaaatgacaatgtaatgcataggtgtgaaattgagccacacattgactatgcgaaaagtgatagcaatgacataggctgctgctttgctccatttcatttttctaaaagacattatctataagtagaccatgtactaactactttattatctctaccatcttttccttgcaaaactactaaataatattgtttgaatgaccctataaagcacatatcaaatttcatagtatttggtagatagtggatgaatttggattactactgagtcagacatgaactctagaactgcttttgtttcattttcttcccttttgtaaataagaattcaaacccaagcatatatagattaatatatattttaaaaaaatctttataacaacctagaggggtgggaaggggtaagaagtgggagggaggttaaaaagagaggggacacatgaacattctacactgactcatggtgatgtatagcagatgccaacacaatagtgtaaagcaattttcctttaattaaaaataaatgtttgaagaaaaaacagaataacaaaatatctttaaaatgtttcctccctctctctagaaccttgaataaaatcatttttgaaataatacagtaaaaagaacactagactaaggcaaggatcaaaaaacttatcttgaccaaatgtacaacttttggagctaaatcaaaacaaaacacgcaccaaatatatttatttaatctgtgttttaatttttttaaattctagtgttaatttttaaaaggtcatgaggtaagttcccaattagagcactttttaattctgttaatatactctatcagtttagttcctaatatctgtaggaataaacctaaatggcctgtaaaattatttttcaatatcataagaaataattcaattcacttatgcaatcttcatgttttttagaataatttaacttccttagtaaactatctacattaactaaagcttcattaggaaataaaaaagaaagactgaattgaggaatatgacctcctcatatgagtaatttcacagattctcaattcattcacacatagcagaagatgataaaagttcagtgtcatgtgacctccttccttctcagaagctctgtagcatgatgataaaggaaaatctggaattatagtaactggcttcaaatctgaacctcatagattaagcaacaggcctttatgtctcattgcttaatttgaaaactgcagtttcttcatcttcaaaatggaaataatcacagtaaccta

SEQ ID NO: 41578 - DNA, 3420 bp, Bovine  19866880761032
cattaaataatatcacatttgttccacttctgaattatatattttttaaaatataagacccatatttattactgttcttatatgcatttgggacttcccttgtggctcagtgggtaaagaatctgcctgcaatgtgtgagacctgggtttgacccctgggttgggaagatctcctggagaagggaacagctacctactccagtattctggcctggagaattccatggactgtatagtccatgaggttgcaaagagttggacatgacttttatttatatgtattttatcaaaaactatagctttagatgaagcctaaagtctttttgtgagttttttttttttgctttaaaatatctcacaaaccttcaaataattaacttatagacaactacatttaaacagcatacagttaaaataaaaattgttttaataattaaattagaaaccataatcagtatctaatgcaaattgtgtgtatctaatgcatatatgtacaatatgaattatatatgtatatagtcagaaatatattgatataagcacaattgttctttgatttctataaaattaaacaataatatagcagcttgaaatctgtccacagtctacaaattaatgcaactttattttgtgataagtttaccagtttatttttaaaatataaggattgatagttatgtgttcttatctaattttggtctgtcagagaatgagatctttattcttttaattatattcagatctcagacatgaagagtacttcatacaataaaattcagtaaattatttttactgtaaacacattcttgacttaaaaataaaatggcaaccctctcttcaaatgaaattctaacccttgtgatcttgtgtgtcaaggcaattatttataatatggtatggaaattagtatattcaattaaaagctgaaagttagaattaaataactcaattttatctacttgactatgtaaacatactgacagttttaaattgtttgacacaggccatcgtttgtgtcttttcagtctatacgagaagtcacaggctacgtgttggtggctcttaatcagtttcgctatctgcctctggagaacttacgcattatccgtgggacaaagctttatgaggatcgatatgccttggcaatatttttaaactacagaaaagatggaaactttggacttcaagaacttggactgaagaacttgactggtaaggaaaacatacaaaacagcaaatatacatgtattatcaatatagtgtgatagacacacacaaatgtgtacatggtttctgcagcatgtattacattgaggaactttataaagcattgaaatacatattaatactacttattcattttgtgagaaatgatgctctacattgccccagttttatgtacagatattgtaaatgcaatctgaaggatagcgtatgactgtatctcatctgagcagaagtacacgctaaggaaatgctcagtgactgaaaacagatatgaagcgggtttaagaatgctctgctcagtagtctcaggtgaatagtggaccatatcatcaaatctctgcaataacatcctaactctcactttcgttaaagctcagtaaatacacagactgttatatcttgttccactaatctagcttttcgtacaatctcttatttttggaaaacatatctaatgttatgtttttaacattaatcaaaacattaatacagttttgatttctcttactgagcaactcactaagtgccataagtagttcttcctcagaaagctttaatcatcagtgatttttttccccctaagattggaattaggtatcatcttgctacaaataattctgtgcaggactctgtgttataagctggcttttgcaattccattgatgtcttttcagttcatgtagttcagagttcataaagcctatggtggaagctattggtacaagaattttaatcatgaattttattacatgttcctggaaccaaaaatgtgctaattagtaattacatcagagtgggagaaaggcgtttgaactattaatttaacctgaattaataaaatgcaaaattaatatattttttgtgtgtctttgagtccacaaagtggccatgtttcttgatactggaatttgaaatattttagaagtattgccttaaaatattaagaaacaaataagattaatattgtcaggttattaaaattatgtatttatatatttgcagaagacataaaatatataattttaagttagaagtagcttgatagttatacagatgtgaactaaaattggagtatcttagatgaaggaaggagtgatgattatgttatttattttggacatgattgctatagacttcatgacataatggtaaatgcaaattgtccagaatttatatccttcatcaacatttttaccttttttttagttcaaaatactttctttactgaagagcagggtatttgactaaattgctacttgcatggaaataatgataggaggaagaaatttggaaatagagaaaaattgaatgattgaaattaggaatccaaaaataacatgatccaattaaaacttgccaaaagcacattgtgttttcttcttgcttttcctctgattatattaaagaaaaattgaataaatttattttcaaaatcttataacatatgattatgttattattccacaatatatgctatttgaagaatcttctcacaaagaaaattagtctttaaagagttattcatttccacatttacttaacctcaatactattaaaatataaaaaaggaattatttagtcacagttatgcaacatttgagtatatcttttctgttagcttccaccatgtcttgttattgtgactgttgtcttacttatgattgactagtttcatatcaaaatatagcattattatcttaaaaatattattccctaaattgccagaaaaccttataatattttcctgtgtagcagtaaagatggaaaattaataaatgagtaacaataattatttgaaatgtttagaaaaggtaagtatttattcaacagttattattaatttcttatttgaatatgaattaatgaaaagtacagtaaaataaatggtggaaattttagatattttggaaattttatatatatatatatatatatataaataatatgaatgatgactacatgccaacactattccatgagacagtctagaattattgatcatattttaggtaataagatcaatagtgttactcttattttgaaaatcagaagttttacagtaagtaccaccatgtttgggtataagaatatacgaggaaggacaggagacttgtaactacttaactctttatcagaaaggaattgggataaaatttgctcctacagtaatatcttagagaatttagtctccta

SEQ ID NO: 41579 - DNA, 1327 bp, Bovine  19866880766974
tgcattggccaacaggttttttttttttttttttaaatccctggcaccacctgggaaacacaggatattcagtatagacagtttaaattagatatacccaatgttctgtattgaaatataattttgtttgtaaggaaaatggagtattttccctggcttgttgtaatgaattttttaagtttatctcttattatatatatccatccatttcaacgttttgggaaaaaatgctatgattcaagggaaaaaatgaaagatatttagggagttgaggactatagtttttcagttatcaaataattacagacatgtataatatgaagatctttagaaattatatctcagatgataaattaagatttattttttacccattttaaattttagctgtttataacttgccattccattctttctgaaatggtggacattacttttcttattgctgttgttaaacctatatgatacggctttatttaagtaaacaacttttgaatttttaacagatatttatagattcaaatgcaggcttccctctgtgactctgtggaaaattaactacctgcaatgcaggaatcgcaggaaacttgggtctgatacctgggttgggaagattccccagaaggaaggcatggcaacccactccagtatcttgcctggagaatcccgtgtatccataggagcctggcgggccatgatccatcgggtcgtaaaatgccagatatgactgaagcaactgagcatgcagcacatagattcaaattcttttccttgacttttgctaatatatctgaggaggagtctttaataacaaggtttagaaagaaaggagtgaaatagaaaaatattattttgcaaatagtctcttaagttatccaagacttatgatattcaaaacctttaaagtttaaaagaaatctgttgatttttttgctaggaatggggggaagaatcataattgtatacataattttaattgtgttgatactaacatccctatgaacaattttgtatgcaaccaataattcatacactagagatttggaatattttcaaaacatccaaaataccagaattctttgttaaatatcttaataaggtgaattgagggattgtgaaatagtgaggatattttcccacggacaaattcttgagttaatgacacatcaaagaccatttttattgcctgagaatcttagtcccttaaccaacagaccatgctttcttcacatttcttccacacattcatgcatttaaagagattctgtatatttcttcttagattaccagagtgggtaatatatacattttacaaagtgcaaaaaat

SEQ ID NO: 41580 - DNA, 933 bp, Bovine  19866880802396
tattagaaatatgataattgtagtgagacttgaagagacctgaaatacctctggttcatcctataaatttgattctggtgcatacaatttaatctatctcagacttcaaacttgcatttagacataacttaatgtttcttttcattttttaaaataaaatttgaaacgttgtacttatttatgagtctatagatatttgttaccaatatcaagatttgttactttaccatgcaaatcctgtttggcagcatattttcttgaaaataatttcctagttataaagtgtaactgtggtcgatttagttcctttcatacatcttttttttatattgacgttgatgccactaaaactaatataaaactatttatatgatgtttttttcttccttgcaggccattaaaatagacaagagtttgctatgacaagaaataaatacattttgtcttttctcatagaattatccacacttttctgctagaaatcataatatccatacatagttattaatcaaaatcttttttttttttttgaaataaacactttcacctttacatcagttgaatgcctcctaagtgaccacagtctgccagatgtatgacttgccaatctggtcactgctctttaaaatttctttttgaatattaaaaaaaataaataaataaaagaaactacattagcttctaaggaagagcccgttctgtgccattgattaattggcattgataaataagccgcattagtgttacaagaaaatggcataacagattgatgtcaactggagctctctaggaataaagctgaagacaactcagcacaccatctggaagagacaatgagaggtggcaaatttcatgcaacaggggaaaggggagggtgcttttcagatgctacatatctgaactgacactttgatgtgttcaagtgcaatctcc

SEQ ID NO: 41581 - DNA, 3219 bp, Bovine  19866880805805
attctgcaacctggagtttgggaatgcctggtctagatggtgtaattttaaacgatgttcctgtgtttcccttgtaaacatttgggtcaagtgcactccaagtattttatggtcttaagggttcaggctctgagtaatatctaaaatctgatcttagaaagaataattcaagtcttaaaattacatgtttaaatttttaagggagaaatgttattttaaaaaagatagacaaatctaaaactctttttcattgttttcacaagatatgaaaaggaacaaaggcaaagacaagtctgggaaattcttatttcttaaaagaaccactaacatgtaaagaagtaacaaacattttgacatgtgttctttagttgcatatctctatcattcagtattgttcttttgaatatgtgttgatttagaaaaaaatgcaccaaatagctccttggatttactcctacatttttgttggcttattattctttgaattttcagtttactttgcttaaagaaagagcagagggaaaggagacttactgaagaccattaggaaaaggaatatagttagtctcttgctccagggtgagaaggttgagtaaaatttgattaaaatcaggtcaggaactatttagtgagcttaaggaagaacctgatttataaggttgtctcttcatacctgcacttgtttgttttaactgtctttaccagtgaaataaataaaaataaatgagctaagtcagataaatacatatgcagtttgactgaaggattagatggagtagctaacactattgactaactaaatcaggcagaatggttaaaccagtttgtaggcatacacatcattaatgagagcagccaagaactacgattgcttaacaaagatggcacaaggtagttagccatatgtttgaaatgatttaagtgaagattgccagaagcagaaatggactaaatgacctctggaggcacttttccagtcctatttttctcatttaatctaattttaatttttaaatctatatgaaggatacgaacacattttatttcaaaatgccttgggttttgtttaggtgacagacaattaaaaggagagaatttcttgcaagcaaacacttgaattcagtgctaacatagctgttttgatcaacaccaattactttaagttgtagggtaattgaatttactgtttaaaatattcattagacaactgcctaagaaagttttatgtatttatttgcacttttagaacaatgaaacatatttataaaatattgaaatatgtactttatatgcacaaagagaaataaaactctcccaaaatatgcctataatttgtaagctaaacttctttcttcccctctctgtcctcagtacctagtctaaggctgagaaaaaaagtttacctgattttcatttcacttatatccccttctagccaaatttctcttcggttctgttactgcttgtttttcctccatccactcagaagtaagattagtcctattttcccagcaatttaaactgaatcctatttaaggtctcccaaaatattccacctttatgacagtgaccactgtgagttattctgagctggttgttgctctgggagagatctgaagtacttatgttttaaaagattaaaaaaaaatatctttagaaggtatttatattttaaagaaacatgatttccaaatagccaaaaaagtgaaaacctcagttaaaattgtagccttcaagtgacttcaagtgggtaaggctctcttttgtctgagtcctatggaacactttctcagagaacaagtaactgagatctgatgcatgtgggcattcatatatgtacatgtatgtgtgtgaacagactgtaccatgggtgaaggttgtactggattggtccttgtaaatcctcacgtgtgaatccaggagactaaatggtaaaaactttgctgtgaaattaatcttaagaaaggcaaatgaaattgattagtgagcctgataatgaataaagcagaattaatttggagacatttatgaaaatattatggattttcaatatcacttttaaaattacaatgctagtttcaaaactatctgaaattataaggtaaaattcattgcatgggaaattccctgaaggcccagtggttaggactcatgagtttcactgtgggggccttggttcattccctggttgggaactaagatcccacaagccacatgggatggccaagaaaagaaaaaaaaaaagctgcaatgggattggatgattgctaaaacagataaaaacaaacaaacaaaagcacctgattcatttgtcctcaatctcttaaactgttagtgagcatttgccaggtgctccaaactgtgataggatagacattgtttgtgcttgacagtgacagggaggtgtcaggaataatgaatttaggaagatatataaggcataacacttgcctactggaattcacactttgttagtgaagtgacactaatataactaaacaaaatctaatgaattcaaaaccttatatacataactattataatgtgtgatacagttctcagtgtctggagttagaggtgcaaaagtggtaattaatgatggttgaaatagtcaagaaaataagatcttcaactgggcctttgaaagtggtgaagttaaaatatgatagggaaaagaggaccaggtcattgcaggaaaggatcagaggttaaacaaagttctggaaatgagaattagccccaggcaatagcagagtacaccaagaaccatgctccttgattcagtccatttcttactccatgacgcataaaatgttttatttaattttaaaatgttcggtccactaatgacctaaggcaggagaaaagcagttatcaaaattgctagtgatgtgtatggtcacttcataaatatgatttaatgattttgaaaacagacagaatagaaacagcatgctgaaagcaataataaggcacttttcaaacgtgtcaggttcttaaatcataaatccaaatgaaatagagtggacttttctctgatggttaatctgtaaaaatatctttggaaaaatacaggagtagcttattttctgatcgttcttgactagtaatagtaaaattatgcataagtgaattttatggtcatttggctttggagattctcctgttgaaataatttcaatttctttgtcctgaaagaatgctcttttattcttatat

SEQ ID NO: 41582 - DNA, 1786 bp, Bovine  19866880850381
gcctcctgcattgcagacagtttactgtctgagccaccatggaagctcagattgtcctaaagggactgacaatttgtgaagcccttgtagggtcaagttcagttcagttcagtcactcagtcgtgtctgactctttgtgaccccatggactgcagcatgccaggcctccctgtccatcaccaactccaggagtttacccaaactcatgtccattgagttggtgatgccatccaaccatctcatcctccatcgtccccttcacctcctgccctcaatctttcccagcatcagggtcttttcaaatgagtcagttcttcctatcaggtgcccaaggtattggagtttcagctccagaatcagtccttccaatgaacacccaggactgatctcctttaggatgaactggttggatctccatgcagtccaaggggctctcaagagtcttctccaacaccacagttcaaaagcatcaattctttggtgctcagctttcttcacagtccaactctcacatccatacatgaccaatggaaagaccataaccttgactagatggacatttgttggcaaagtaatgtctctgctttctattatgctgtctatgctatgctatgctaagtcacttcagccgtgtccgactctgtgtgaccccatagacggcagcccaacaggctctgccatccctgggattctccaggcaagaacactggagtgggttgccatttcccttctccaatgcatgaaattgaaaagtgaaagtgtattatgtaaagtttaaaaataaaataaaataaataaaataagaaaaaaaaaagaaagaaaagtgaaagtgaagtcgctcagtcgtgtccgactctcagggaccccatggactgcagccctccaggctcctccaaatatgctgtctaggttggtcataactctccttccaaggagtaagcgtcttttaatttcatggctgcaatcaccaccttcagtgattttggagctcccccactccaaaaaaagtttgtcattgtttccactgtttccccatctatttgctgtgaagtgatgggactggatgccatgatcttaattttctgaatgttgagctttaaaggaaaattaaaactttgtcaccatttctattttctgatatatctgaatttataaaggtattataagtgagcttcataattttattttaattcacacaccttcaggacagctaatttttctttttgccaattattcttgagttgttttaagagtctatgagtcaaagctaactactacttaatttttttcccctcaaacctcaggcttctggagagctagctcttctaacacatggaattgaaactcagtctcagccgtcttctttttcgtccctgagcttcttaaacatgatggacaaaatcatcttttatgtattttgcattgagcatgtgcttagttgctcagctgtgttcaactctttgagattccatgggctgtaacccaccaggcttctctgtccatgggattttccaggcaagtatactggagtgggttgctatttcctccttcaagggattcttcccaacccagggatcaaactcggctctcctgagactcctgcattggcaggtggattccttaccactgtgccacctggtaagcccatattttgcattattgtatatttatgtagctttttactagaaagatcatgctttaattttagagaagaaaagaaagtgctgatggcccttcaaagccctagaaaaatcgaaagtatttctagaggtacatatgtgtgtgt

SEQ ID NO: 41583 - DNA, 2943 bp, Bovine  19866880874010
accaaaaatgctgtcttttgcatgtttaacatggcctaaacagtacaatctaggagctcagttaagttctctgcagttcagttccaaatctttgtcaagaaactatagagttttttaaactggaatagcttactctttctaccagacacatagagttgataattaaagggtttaaactccattaatctttattagggaatgttcataacatggcacaaaggaaattcttgacttcattatgctcaacttgtacttttgtgcctgtgacaggtaacaccccttaccacgttcatattccaaaattatacttcctttggttagctggcaagtgaacatttgggaactctcacatgaagttgctgcctgcctgtcaaccattctgtctgcggagttaagaaatatttttctacacgtcaatagtaatgattcagttatttgaagattatcatttcctattccgggcttccaagatagcactagtggtaaagaatctgcctgccaatgcgggagacacaagagacgcatgttcgagccctgggttgggaagatcccctgaagtaggaaatggcatcccactccagtattcttgcctggaaaatatccgtgggcagagaagcctggcgggctacacagcccatggggctgcaaggagctggagatgactgagcacagtagcacatttcctattttgtcaaaatagaaaacctgatacaagtgataagactgataaatctaaagtttacacagtgaaaaaagatggaaattattagagtggctaaaagcagcacttacagcctcagtcaaataatcactatacttaagctccagacagaagggtcaaaaggaaattgaaagaaaatgaataaattcttgaaaacatcaaagtattatctaaaactaagtgtaatcaggaattttaaagtattcattagatttcgaggagtcaagtaaaattcttatgcaactactaagttcaggttttgtaagctggtacaagaaacagcattgctgtgcagtaaagacagtaatgagactgacttgtgttgctctgtcatttactgttgctatagaattagtcaaagtgacttaatttctctgaaactgtttcttcttattttatttcccttttttgctgactgattagtcatgtgacgatgaaacttttaaaaagtatatacattattaagcattctgtatatgcatagctgtgtgtggtattattaaaggcattataatggcttttaatgctcattgaatgctcatttcagtgctcattgagcactgccacataacatatgtaaaacatctgaaatctatgttatttcagtaaaagtgtgattttaaaaagagttaccataccatcttttagaagaacattttcttattattaaacagatatgtacttattgcagaaaatttgaaaaactctgcaaaaagattttaaaagtaaatgtaatttataaatccttacactagtactatgccagtatattactttttgggtgtgtttctgtgtgaatacgtatatgccaaaaactttaaaatgttgattgcattgacaatataaatcggtatcttgtattttctcttatcataacattaatatttcctttatgcttttcagtagttttgaaaaatatcttaatagtcaatttaataataaaacatttaattagttaatactatttaatatttattaaaatattttatattttgtaacatttaataattttagtgatagtttaaaatattaattttaataattaaaatattgtaataatctaatcataataagcaaacaatcaaatcatgtcttttttctcaacagtttaatccaagtattactgaaataagctttggaatagttcactgacattataaataataataaatccatatctggaataatttcttataatttactatatatgattacagcaacaattaaaaaaaaaatcatgcctgagccttaaaaatctcttgcaggtaaccatacctggtagtattatttctggttcttcacttctgatttttacattagatttaattccactgaaaaaggaaaaattacattgtaaagacacaagaaaggtcgttattatgcagaaacatccttaggatggcatgaagcctgacagcgattgctgctttcaagaacttaaggaaacaaccgctactctggaaagataaacccatatgggcgatgtgaatcttacagtcaggcccttacctcttatcctcatctcaaccttataataccagctgatcaagaaaaaagaaacagctcagaaagccttctcttcttgtactctctgaaatacttttgctccctcctgactatttacaaaagggaagtatgagaaaaattcaaaggcaaataatatagtaaatgttttccatgactgaacaaacattgtttggctgtgactttcatagtctataggaatcctgagtcaacagttttgcatctgtcagtgttcctttgcaaatctcaagagagcctttaaaatgagatagaagaccatccattgagctggcttgaatatacactgtctctgagagctctataaatgcagattacctgacctctctgggtcgttctcggaatcccatgctttgaatacggaaatgacagttgacatgtatctgtaatacagcactcaaagaagtttaacataagaggactaatttatgctaataagatcatttcagcaaagaagagaagtgcaaattgctttgttttaaaacgcacgaattaattggattaatatttcattttaacgcacgcttgaatgtacgctagatgactaataaatgtgtatgaggtgaagtaatattcattgaatgtactcttcctgcttaggaaagaaatagtgaggatgttatctatattttaataacaggaatcaacattgcattccattcactgattcaacaaatatg

SEQ ID NO: 41584 - DNA, 955 bp, Bovine  19866880935057
aagcagcactcagccatattgtgagatctacaggaacaaaatgatccaaagaatatttctagcttaaggtaaattacttggaaaatgatctgatcaaaactaacctacagtgaaaatcctgtgagtcagatggaatcagtgaagagtggcacattcttatgaaggtgtcaatttttagatcaggtccacaatttctaaaattgatactctagccaatgttttctaaagaagattgtttgcttgtcatgtcaaacagtgtgcattaactagaaaaatgaaaacgacagcaatacatttatgtatataagtaagacagaaacatagttgaaaggaaatgttataattatgggatcagagagagtgaccagttcagcagatttctaggactcagctttagagaactaataagtgaatttatggaaccgtatgaaggtaaaaagggaatttcttctgctgtatcactgatcagaagagagagcattactggaaaagtgaaacacgggaagggggaatctccagggaataagaccattttcttttttttttcttcactagccatcatgttttctgtcacaggtactaagataatctactcaggccataagaagccacacccttggtttatctcccattcagggttcctgaaaattcccattctctgaactgcattcttttccatctctatagcatacttaggaaaagctgaggaaatttagcttaatgggactctttcaggaaaattccctacttgagactttaaacctgtcattattctttcttgtcactaacatataccaagatctgtatgttcccttccctaagagaaagtatatatatatatattctaagaaaatatgtaaggtcaacaaactcccatattaaagcccatttattaagaaagcatgcttgtttgcttatgacatttagaaaaggaggaaattcttgctcctcaggg

SEQ ID NO: 41585 - DNA, 755 bp, Bovine  19866880944464
tttttttttttcaaaccatttttaaataacaaaataatttctagttgttaaaagattcattttgacctcacatttgctaatcacacaagatgtgatgatgttattcatcacacaagatgaataccaccatttgctatctacaaagcaaaagaaccattgaataaattggacccagccatgtgcataatcctccctcagctgattctctctgcattgtaccagagtgggagtgtggctttttctgcctcttctctgtaacatataaaaggttttaactttcacttaaaaaagaaataatgaaagaaagaaaaagcagcttctgtttgtacataaacaccaggcatggagattctatactgcatcctaggagaaaccagggagccaaaataatgagcttaaaacctcagaaatctgtgtctatgattcaattatttgaaagcagctactaaataatatcttacatgataccagcacattttcctttgtaacatgtgcttctttgtttatccaccccagaattttgtctttattttaattgctactaagctctttgcttaaggttttatggcttcatcctcttatactaccagatttatagcatgtggccactgaagttacattcacttttcctctttcatgtttaacatcattgcctcaaacttttctgaatgcatatgaggtcatttatctctccatgtttctattcagcctaagtgctgaatttatgtgtgtgtgttttcttttaaaaagaaagt

SEQ ID NO: 41586 - DNA, 949 bp, Bovine  19866880979012
atagtttcagagatgggaatggtggcatatcaaggagaaaattaaatttcatcattttggctttaacacgtaggctataaaagtgacagcttggtgcactgtagctgacagttcccattaactagaagctaatgttgcagagtcagtccaaacactgagtcacggcctctggctacaggaaggtccccttcatactaggattctcacaccccaccatgggaaagaaaagctataaatattttccactagtttcctcctcaaaatgatataatgaatatttacacattgggacccttttcctatcctgaatcttcttggaaaaacacctccactgacacattttattggtctgagcaggtggctcaagctagccctccttcccttcagagtaaagaataagcatatatcgggtttaggtttcggtttttgaatcagtggtaaaacaataaataaaaggttaggaaacatgttttgaacctttacacagttttgttttgttttttaattgcaagttggtgagaaaacaagtaccaggaaaaattggctaaaatattttttaaactttagaaaatgtacgtgtttaaggaataatttgaatgagacttaaaaaacaaaataaatgctaaattgattggcttaatggaaattgaagtacaggagactatcaaaagaaaaataagtcctttttaaagtaagtttatattcatttaacaaggtcttttttagtattagctgttggccataggttctgtgagttagtatgtgtatatggtgggaggggagggaggtgaagatggtacaaatacccagtcagtatttacaaagtgctcacgttataattaaggaagctcacaaatcacaagtgttcctgaaaagagcatagatattaacagcagaaatgagagtgtgactgcttagggccagttctagacatttccaagtaggcaac

SEQ ID NO: 41587 - DNA, 1186 bp, Bovine  19866881003714
atcattaaaggatagtgtactatgctattttgaggtaaccctaccctttgaagttagtataatgaagatcattacacatctctctgaaaatttcattgacatgcctataagaattgaatactgtaatgaactgaactaaatagactttgggcacagttataataaaatcttaaggcatgtacagtagaatatgtaaaatatggaacatttagctcttaaaaaataaatgccattataattgattttgttttctagttaaaaggaaaagtagagtttacaggtactttctgataacattgtagagtacactaccaatgattatcttttaattttgtgattatgtatattttttcaatgctttgacataaagtgaaaaatacatttttgtcctaaaaatcctgtaaaaattgtattctttaagtataaatagctatacttttaatgtattttagttttgagttagttctgcattttaaaactcctaaaagaatatttgtttcttaaccttcacaattaatcacctcagtattgttttttatttttttttaatagaagaagataactaatgaaagaagcactgtggtatttactaaacagcggatgcagtctttttgtacttaagaacaatcagttgagaatataattctgtaatgattaatcagctcttacagatttctgtttcttctacctgtcacttaatcttataccctatttatcccatcagtatttgtacttcaaaaatactttacacttatttaaggcatgccatattttctaacagctgtgatacagttttttttttgtagttatttaaaaactaaatatatagaggttattgtgaatgtatatttcattatttttctttataccaatttcatcttatgttagcagaaatattttgaaactgtttcttggaattacattttatttcatttcaaaaggttgctagaaaagaaaatgaatcagatttaataaggacaaaacactaaagattagtgtttgctctaaaaaagagtgtatgctctaaagaaagtgtatactacagtttacttaaaaaagcactgttttctcaagagaaaaatatttgtacttatttttccctgattctattttcccagttctccttcaagggtaaaataagcttgaatttttacccaaaaagaaaaacaacttggggaaaaagcca

SEQ ID NO: 41588 - DNA, 2871 bp, Bovine  19866881038713
gccttctaatttttgaggttttaagaaaagtatattttgagcaaatttaatatcctgatgtgaagtcactttaaatatctattctgaaaccttgtctaattttggattacatgtatacatgcatatacgtacattatgtgtgctatatcataacttctatattgatattatattacatacaaattagacctataaattatatataagataacgtataggttatgagttgtaagttacttatatctcaaattacagatatcacacaagcacttgtatgtatacaaacaaatgtataaattatttctgaaagcacattttgataattaacataaaacatcatccaaagttacaaactgttcattatttgacaataaaaactattttaaaaaataataaaaacaaattttataccatacaaattatgaactctaacacagaaaacacaagggaagaaggataccatttaatccaagtatagaggttctagatagaaaaattttgtcctaaaaaggacaaaacagaaactctaacaggttgcactggcctttgaatcaaattctagttcctccatcaagcatgtgatcaatgggaaacttatccttttgagccccaatgttttcagttctaaaatggcaatatactgtacaaagctgtagcaagatcaaaagagataatatgtgatatctagaagaaattcaatacccattttctccccatgtcttttggaaaattactctagcagtatgccatgaaagaaagtattcacaacaatgttttccaaacatgaggctcccacacaatcactgtcccctgctgcagagctatgaagtatgtaaggaaagctagaaaaataacattttcatcaaacattttccagacccagatatgcttaaaagcgctaagcactggcaaattacatttagatatttagttattggcttgtaagtcttctctacacaagtctgggcatggtaaacatcaattaagccttgtgtacccaaaatgcaaacttaataaggaaatagtgcacatcatacttctcaataaaccatctggagatttactctctttaagtttaggcacagttctctgaacattcagagttcattttaaactctgttgacactgactactgcaggatttcaattcataaacatgttggtgaatacgatgtgttttgcttggaaatggttgtatgttgcctgagcaaagtttaaacataaaaaccaaaaacaagcaaactgaaaatcccaccaagccttctgactgaatgtgttaaggtctgcagaaataaatcaatagctggatcttcttaggaaaaggaatacttcttcagtgagtgagagaatatgaggaagggtttagagtaaggtggaatgtagtgtaactgtcaatgataacttccattaatttgggtagcatttaagaattcgattacttaaaaatccttaatctctttgaattcttaccaacatcctgagataaattttattaaagatgaaaaaatgcaaaagatttataatgctttagggaatcacacaaggcaaataaaccttagaggttcagcaatatatctgtagctagagggaagtaaagcttttaactcaacttccttgatgttttttgagaacttaaaaacttgattaagatcagatagttagaatcagacaggcactgaaatgaacatttactactattccctcgtctaatattcatgccactataccattctgccttacaatgagagaagtaggacaggggtgagtggccagggactaatcatcccattgctctctgtgagtttaaaacaaaaagacaggaacccacagagtgactacttaacccacactactctcagagcaaaggttgcaccatctgctgagtttctatccccatcttcctgtgaaattaactggaacagatgactgacatgatgttctcagtgctcataatttttacaggaagaaaattaaaaaggtaattaagaaattaacattcaggatttgtaaagactcttgattatattttagaggtaaacctacatccatcagattaacctcacaaattttttgtattagaaattttgttttatcttgagaaagattcttctgagtgtgttttcctaatgctaggacttgtttcttaccctaagttttttaaaaagttaggagtactaaagacacgatatcataaatttatgaacttgcatctagaagagcaagctattaaccaaaatggtttcaggtccaatagccaattttcacatttctccatagaaaattatctatagttcagggactaaatgtgggcttcccaggtagtggtaaagaatctggctgccaatgaaggagacatgagagacatgggttcaatccctgatccaggaagattccctgcagaaaaaaatggcaacccacacccatattcttgcctggagaatcccatggacagaggggtctgcaggctacagtccacagagtcacaaagagttggatacgactgacgctacttagcatgcacacatgcacacacagagaataaatgcttcccctcctctttgtctaaagatactgttctaatttgaagctgaagctccaaaactttggtcacctgatgtgaagagccaaatcactagaaaatatccttatgttgggaaagattgaaggcaaaaggagatgggggcagcaaaggatgtgatggttggatggcatcaccaactcaatggacatgagtatgagcaaactcaggaagacagtgaaggataggatgcccggagtgctgcagtacatggagtgacaaagagtcggacacaatttagtgactgaacaacaacaactctcctaatttagactctagtttagaaagaccttc

SEQ ID NO: 41589 - DNA, 1212 bp, Bovine  19866881044303
acttatgaagggtactgtgggcctgcattgtacgtacagctgtgactcaaaagttgaaagtgcttttaagctcagttaaatcgtggccgcattgctccacagcacagcttaagtaaattgattcagtggattaatgtactcatgtcaggggagacaaacttatctgctgtgtgaagtctgaagcttatagtagtattatttagtaggcttactggtaagaatgacaactctctctgttcataagaactgagtcctacggtttgcgatggaaggtttaggtgtgaaagagactaagctttaagtaataaataatcatgattaaaggaacaaagttatctctgtccctgcaagatatatgaatcacacttatctcatttaaaatagatactgcatgtctttttttatctttaagcacagtatcaggccagctttctccagccttctatatcagcctgggtggttatttcattttatgcatttcttttgtcatctcagttaggagctgtgctggggacgatgagccaggcatggatcaaaatattacagtttgattctcccaaccttacacattttgcattaaagcagttataattgtctttaactgcaggttgtataagtcaaattttctaagctgattaccactcaatatattcttcagtttctagttgctttataagggacacttcttgcttagaaactaattgaaaaatataagtgcacttgacaatatgttaaaacattgttgcctcttaaaccaaaatgtcactccaaaaaaaaaaaaaaaagaggaaatgaatgcttcaacttgttccctaaattgattaatgaaaaacattattttaaccaaaggaaaacttctaggggaattccccttttacttctacagtattcatcctagctatgctacgctaagtcacttcagttgtgtccaactctgtgcgaccccatagacggcagcccaccaggctcccccatccctgggattctccaggcaagaactctggagtgggttgccattttcttctccaatgcctgaaagtgaaaagtgaaagtgaagttgctcagtcgtgtccgactcttagcgaccccatggactgcagcctaacagactcctccatccatgggatttttccactagctaggttatctcaaaatctttttttttaattaaaataaaatagcattgaaattaatacaaacagtatctttgtt

SEQ ID NO: 41590 - DNA, 738 bp, Bovine  19866881063313
ttcataactgactaaagccatggctaccacattaaatagcaaaatatttagtagacatgaaaatccaaaaatataaaattttaaagtagtcaaatcatagaactcctcttcctcctttcctctgaaaaatttcccaagaatgtccttaacatacatgtctccctcaaatttttatctgtacctgcagttttctgttcgttaagctacagcaggaatctgtgaatggtagacctttaactgagacagacagttaatgggaacagtagcagccctgaggtgtgtttatacagtcagactcactgcctctactcctgtgatatatgaactacttcaggaagtttcccagctgtttcagtggataaatcatggcagtaggagctcatatttaaccttcactgtactggcttgatactttgtagtccttttttttttttaaatctctttggctatctggaagagatttcatataggcattattttctccctcagcctcctcccacttcctttctgccagatcagagaaactctgagacccttcttatgatttgccttcatgtctgtcaggaaaaaaaaaaaaaaaaagattcaacactactagagttcaagtggtttataggttcattccatgactttaaagcaagatagttttgtgtaggtgcattcaatggaagtctctgttacatagtagccattattacatagctgatattttctacagttttaggcaatggcaaccca

SEQ ID NO: 41591 - DNA, 1362 bp, Bovine  19866881064916
ttaacaaactttggtgctgactgggggaggaagatgatttcagattctctcttaggttggcttaaatttcatgaatgataattgcagaagaagcaagcaaatgtataaaactaaagttttctttagcatttaaacaagtttaccttttagaatcttgaaaatattttcttgaaacaaatgaattataactcctatagttgaagcagaaaatattatgacaacaattattgaaagaaaaagttgaatttagggatataaaccaatgctgagagacaatgtttgtatatctcctatcttctaatgagaattggaaactttacaagtaacatctccttgattttggcagtaagtaccaaatacccttgataagacaaaaagaatatttctgaaagtacaatgtaaaaggagtaaatcttaaaataaaccccacgtgtctgggtagagcatctaaaagcttatattttcaacgagtaggctaaaacctcttcattcagcaactatctccattccatgacaaaatcgattttggattgttctgttaataaggatgttgagtcgtccttatttactcttaatgtatgttaaaaagtgttacaaaattttgtcctaaataaaaacattggccatgtgaacatatcaaacatcaaaaaagtaacagaaataaccagatgattaacaagcaaaagcagataaaggaaaatatgagctctctaaaaggtcaaagaaaattttctagcagctagaattctgtgcatttgccctctgaggctttctgaaaacttctttggggcaaaataaccttccaagagcagtcgttttgaaagtggtttcaactcttcagatgtgctactgtctaaatcaagaaaacacttcctttgtctgcttattagtaggtgcttgagtatgcagaaaggatgaggttccaagtggaaggtacttccccaatgcctcataacctgtagttctaaatgctgggctgtttgcacattgaaaaggtagcttttaaaataagcatagacattttgtgtaaaaagatatcctgtgtggtttttctttagaataaggggggaacaattgtaaaatatacttcattataagctgggatcttgggtatagattagttttttctgtttttgttattctcttggaggatttaaagttaaactgaggtaacatcgaagcaaaataaggaaaatatggaaggggatggaattcgtgctagacttttttctgcttttactgctaaatttcactcattcttacaggcactataatactcgtagtttgttgttaacttttacagacgcatttacattttagaagagcatgtgtatgtgtgctcagttgcttagtcttgtcaga

SEQ ID NO: 41592 - DNA, 1319 bp, Bovine  19866881081439
atagtcaaagctatggtttttccagtaggcgtgtataaattgatgcttttgagctgtggtgttggagaagactcttgaaagtcccttgagctgcaagaacaaaccggtcaatcctaaaggaaatcaaccctgcatcttcattggaaggactgatgctgaagctgaagctctaatactttagccacatgatgagaagagctgactcttcttccagaagagctgggaaagatagaaagcaggaggaaaggggaatgacaaaggatgagctgattggatggcatcacagagtcaatggacatgaatttgagcaagctccaagagatggtgaaggacagggaagcctggcgtgctgtagtccatggggtcagaaagagtcagacatgactgagcaactgaacaacaacaacaatattattattatatttaaatatagtgtttttatttccttcacataatattcttgcccaatttatgtcattcttgaagtcatagcttaataaaaattaacaataaaaaagatttcataggtgatttatatctataaaattatatttgttatatttataaagttgttaagatggagctaatttacctaagtgagtttgaaatctttttatttcatatatttccaaaataaacacattatcatcctcagttctatatttatgtaagtcttccaaaaattatcagatatatataagtgaagctttcagaatattcagttgccccccatcccatttcttcttctagcttttcatgcatcctacctttgttcccaatgcactaggcaagcactggcctatagctaatgcactcaaagtgcagacattccccagaaaattaaacaaaagggaccaaataagaaaggcagaacagtttctttaagtatgctgaatactttgcaataaggcccaccaataattttttagtcctagaatcattgctagtttgcctgcctgcctccttacaagaaaataaaagtatgtttgtaggaaagtaaagtgaattatatgaccaataatgatagtttatttcataataggaagtctttatggtgttttttccctgctgacataaaatatatctcatacatggcagaacaattagaggcactctcacaatcattcctaactcctgttgtgcaaattagaaggaactaaaaatacatttgaaggtgctattagaatagactcaggaaggaatatacagtagaaaaaaggaccaactttgaaaactagtgcaactatttgtgtgttttgattttcttaagtctagaacgagactgatgtataagctgtcatctctaccttaaaccctag

SEQ ID NO: 41593 - DNA, 1814 bp, Bovine  19866881126476
gaaatatatatctggtattagagttgataaattaaaactggtgctgcacagtacataaagttgtagacttctgtcagattgcctgttatggtctgaatgatagctcctttagcctgtatgttgaaatcttaactctcagtatattagaatgtgcctgtatttgaagtctggtctttaataaaaaaaataataataaaaagttaatcaaattaaaatgaggtaattagggaggccataataaaattactgatagctccctggtgactcaaattgcaaagaatttgcctgcaatgtgagagactcaggtttgatccctgggttgggaagattccctggagaatggaggaatttctctatttctaaaggaataacatgtattaccaaagtttagatgagagaattacttgataccatttcaatctacaattgagttacaatatagttgcacgtttgaggtcttttataaatatgaattttccactctcaaaatgtaaaggaggaatatgtgccctcgtgaaatcactatgataacagctgcccttcctacaaagcatctgagaaatggcctttgaggattcagaagttagaggtgactgctttcgtgactggtctgttattatttttaaatgaaagggtgagcggttgcagaaatggtacagccaaagtaccatgcttgaatttgacaagcctgccaagatacactttaatatccatgtaaatatttgcctgtaaaaacggaaaacaaaaggattaattaatttataaagaataaatactttcttgagtcatctttgctggtgacaacaaggtcttatgttagttacaatgttcttaatgttcacttcaaacaaacacagcagactatgtacctatagccatctgtaggtacagttaggactacagacatgatatgaattgagatcagggtcttgaaaataggcactaaaatgcttttcatatttagcatccttatccaagtcaaaactttctaagtggatgttaactatttctaataactatattaactcatatttatttagggttttctatgtgtgaaatttttataggtcttatatcatgtcctagtcacatcaactcattaagtgctattatctccattttatagatgaagaaactaaagttaactaatatacccaaagtagcatagacaaaaaaagtgaatgaagaaataaaaaaacaaacatttgtcttatttcagagctctaaaattccaatcatttcagatatagctttggaaaattggtgtcaattactccttgaaaagtcacaaccattgcaatatgagctaaattttgacttagaaataccatactctaagttttctttatgaaaaaagtaagccagaacacatttcaaaagaaactacaggatcctggtatttctagattcaaagtatattaagatgtacaaaaataaacttaaaatttttaaagagtatcttcaaaggtgccaagaaactagaggtcttttcaaatggatatgcacaaacgagactctatacatgaatatacaatataaatataacaaaagagtgctaattttacattagcactgaatgccattaccaggtaagggctgaatgccattaccagatggaaaaagcaagttatttggagagttacttcttagctatattgcccacatcataatatgtgattaaatatgtgttcttaatcaacttttcgagaaaaaaaacattaaatccattatttttacttaatttcaaaactaaacaaatttatacctaaagatttgacacatagaaggcatttaataaatatgcacttgacttt

SEQ ID NO: 41594 - DNA, 727 bp, Bovine  19866881192173
aaaattgttatttttttgaaagtggcacttcaagaatttgtttgaaaatgtctttgtatgcaacatttatgtgcaacaaagactatttgttcttatgacagtgagagtattcaggaatgctgtgaaatgaagaccagggtcaggaaatttatacaatccagatttaatgtgttctctggaatgtcaatagttttgaatgttcatattgctagggtaacaaaagaaataaaatgttgcatctaagtttgtaaacttagaaggtactcactagaaactgaaggatgagttttccaaaaatgatagatcctaaatactaggaatcaaaatagttttctaaactataatttcaaaagaaaattctagatggttaatcaacgaaaggcagtaatctgcttttccatatatttaaaatttctttagagaaatttaaaaattccaatgaaattaggtattatcttctaagatagtcctcttccagacctaatgttttccaaattcaccccttttaaaggcttaagttccatcttgaacctctgtgaaataagttgctgttttttgatgtcaaagagaaaaatacaaattaaacaacatgttactatacctgtcagaaggagaacctatttcttttaaaataatgtggatcttgagttataaaggcctgacctctgtgctgtcccaactttgattctgtaaagttaatattagtaaaatacaatgaatctaggaa

SEQ ID NO: 41595 - DNA, 625 bp, Bovine  19866881300406
tgtctgatatttattagtcccagaaaaatatctgacaagtgaatgaatgaatggattccttcaataaaggcaaatctaacaggggtattatcttctgtaataacactgacttaaaaggaaataacttcaaaatagaatgggaggaaacttatttgcaaggcttaaaggattttgctttaagtgaaccacaatctttgacaatgccagccctttttgaatgtatgtggaagtcattgatttcttatacaaattaaagcagctgtaaatttaacttacaagtattgattgtgtatgtgtgttcagaggttgggttggtgggtggattgttggagagatatctcttaaaataaaatgttttcaaatataaaaatgtgcatgcatagacttttgtatatattactaaggtaagcctgtgcattaataatctataagttaaaaagcctacaagttaaaaatagcaaaagggtactagttacagttgagtggcacttattgcggatttactcactgcaaactatccttgatatgctgcctgtctcgtcgtggtaaatggcagtgaaggtcagtgaatctaatttgacaataatgagtctgttctgcaatgtgttataatattgtgccccta

SEQ ID NO: 41596 - DNA, 1097 bp, Bovine  19866881372393
aagaacatgggttgtaaattcgtgttgccttccgtcgatatcaagatccagttataaatacctctttttctttctgacgtcacgatctcctcttgcatgaccatcagtttgaggggcaaaagtttaaggttgtcacttccattgtgtgagaatatccatccctgtaacgctctcattcatagagcagtgtgcagttcaagttgttactgaattatgtgagtctgcttctctgatctacattttgatgcgtagcaacatggttatttctagttcagacagttatgtttaaaataaatgtaatgagtaaagacttttgtgggaaggagtgatatatgattttaattctgtgctttagagctcaagcactggcacttacgctcccatctttcttttaaatctcacactaaacatttcagattcttactgccagggttgtagagattagttcctggaagagtacatatgtgggaagggtggaagaacaagcctatgccaggaaaaagcaggaaagagaatatttttgttaatggaatggctgatgaactcataatgatactacctaaagagtgtgcagaatagagaaaaaaatgctaatgtcaattgaaacatataaaaggtaggtgttgccaaatgaatttctttgggtgcataactggatgttttactacttactctcagcctttttaaaaaacttttttgatttgcaagatgcctgcctaactttttacacagatactgacaggttaatcctgacatagacctcttctgcagttttatatagccagcttcctacctagacctatgcatgcaccttacataaaaaccaaatgaggtatgggtacacagatcagcatgacaattcaataattgtcatgacactgattttaaccaatatgaatgccaaatagtgttttacaaaacaatggggaatagttatcagatagaaaaaaaggcaaatgttattttgcttttattatcaaatcttactagttcattacattcgtttactttttcaactggagaaggaaatggcaccctactccaatattctgtcggagaatcccaggacagaggagccggcaggctacagtccatgg

SEQ ID NO: 41597 - DNA, 756 bp, Bovine  19866881386404
gttattagcttaatttcctttctttctgtgagatttgtgataaggaatttgccatttcttcatataacaaacttggtatgatttcaatatttccatatgattactgttatcagggtcttttgttgtttttgttatttaaaaatttttaaaacgcctttatctatcagataaatggattcaaatattacagaaagagatcaggaatgagaatgaggactaatagactttattcatgtttaggatatgtaaacctaatttttcaatattcagacatgtctgaaacagagacagagtatttgacaaaatattttgtcttctttccaaaatcatgaattgcaaagattctatatgtcacagatataactctatttcttaatttctataacttactacagtaaggcactagaaagttgacaatttcttttcttttccactgagaagacagattaagatgatttctctttcacacaacccaaaacatgctgtcagactgaaagactcactgactgcttagcatgaaaatgccaatttgaaaagctagctattatccaagagggctgcccatactgataccttgtagaaaagactatttatgcataaactatacacattgttagaatttgtataatagaaaaacttttaatgtgtgagctcctttaggaaggtgaaaattgttttcacaataaataatattttatctttttaaacagcttaatgattcccatgaatctattttaagaacattcctactcacaa

SEQ ID NO: 41598 - DNA, 1936 bp, Bovine  19866881419989
gttgagacccattaggttggctgaaaggtgaaatgggcaaggagttcagaaaaatattgcaccaaaaattgtttaaaattgaaaaatactatcatgtctatttgtatatacatagaaaaatgtaaaaaagttaacattagctaattttatattgggaaattatataatttttaaatgatttttatctttttgttcatttttttaaataaatgatttagtttataataagaaaaaaaaattaaagcatcttttaagagtcaatgaagtgaagtaaaacttactaactgattaactcagcactcaggacaatggtctcactctttttaataaaaagcattggcaggtaaaggctcattcttcccagtgaactctatgaaggtctcacatttgattttcttttcagtttcctttcatttaaggaacctctgtaaccttggaaaaattattacaagtctagatcacaagcagagagctattagtgatatctaaggggaaacaaattgcttttcctaaacatgtctgattatgatcattgtatgtacataatatttacacattttgtgaaacacatgttaaatttaaatgttaaacactgttcaagaattctacatagttatttgagttgtcgaacagggacagagagacatttcacatgaaattaaagtcttatttatgttagctattgcattgataaatttaatactgcttttgctcagtactcagaaattaaaatttaaagacttaaaaaggtaagactttgtcccctgaagatgggaattatatgagtgtttataactgctgtgttaacaatcaagttcacattagcaaaaacaggtgaggcaagggattgaagaggtaagatccattccaatttttctcatctatgtgcctcttaatagatcaggaagtaatgattcatgaggcagtgaggctaagaaaaactattttttacaggaagataattttaaaatacatttaaattatagagttttaactaataccaatctgatttgcttactattgtatccctccatgagtagcactataagttacacatgttgactgaataattgactaggttatatatgttgaatgaagttttcttttcagtggatattatttttaggatattatgtacaataaaattagtcatctgagaaacaaaggtaaactctattaagacaaattcaagcttaattaacatgcttgttcagttcagtttgaggaaatacagagttaagtagtttttctcttaacttcccccatatgaaaaatccctccatacttcatttcattccagaaaggaggcaccataacttttagaacagacactctcaaaagagggtacaacccaatggaaaactatattcaagaaaggtctcaagtaataacaaaataaagacataacattttggctttcacttattaagtacttgagaaacctgtgtgcaggtcaggaagaaacagttagaacttgacatggaatagcagactgcttccaaataggaaaaggagtatgtcaaggctttatattgtcaccctgcttatttaacttatacgcagagtacattatgagaaatgctgggctggaggaagaacaagctggaatcaagactgctgggagaaatatcaataacctcagacatgcagatgacaccaccattatggcaggaaagtgaagaagaactaaagagcctcttgatgaaagtgaaagaggagactgaaaaagttggcttaaagctcaacattcagaaaactaagatcatggcatctggccccatcacttcagggcaaatagatgtggaaacagtagctgactttattttttgtgtgttccaaaatcactgcagatggtgactgcagccaaaaaactttccttggaaggaaagttatgaccaacctagatagcatattaaaaagcagagatattactttt

SEQ ID NO: 41599 - DNA, 1327 bp, Bovine  19866881435791
taaaaattgtgtgtgtttgaaaagatcagacaaggtttggaagtaaacagctgaagtaataaataaacatgaggtcagtttaggaacaaccataattgctttgtatgacaagatttgcatagcaaacacttctgattaatgtacagtgaaggccacatgagtgggaaccagccttggtatctttttgggatctgtgccttccaatcttgaaagtgtagttttagccagtacaattagtcattgttcactaaaaggctgatagagccacagttcctatttaaatatttgaaatcattatttttatcttccagctatggtgattttatttctgtggttaaaaaaaaagtgccacattttacattaatagtgaatttccattcgcttcaaacatatttagaaaacaggcaagagtttcatcaggatgacccttttccagtcataaatttgaaaatataattgcgtatatgcatcaaatatttcaattacataaaaccatatattattttctagaatacctttgtgtcttcttattgtctgcctttttaattaacactctgctatcactgattatttgctgtccttacctagggtcaaatgcagtgctcaatacagtgaaacctcatttttattttttccctttttcattataaataaaattatcattatattctttcaaaaacacaatctctagagaaaggaaaatgtgggaaagtataagggaggagatcatacttctagaaatatttagtttggtgtctttaaacatcagtgtcctactgaaatgggaaaaagtaatagaatataaattataccagatagtagaaaggaaattttttcatttattgcaaaaatttgggtgaaataatggatatatgtgtatacatatatgtaaatatatgtaagtgactaacatgtattcatttcacagcaaatactagaaaataaggttatatatacttaaatgtaatcatgttaagacaaaatgaaaattaattttcgattttgtggtaaatactaccactgattcatgctgtttaagtaatattttgtgaggattatgattcaaagaacatgatgacagcatgcagaacagtattctgaagagaaatattagcgaggcagacaacatctacaataagctttgtatctttagtataatgcataacatctccagagagttgtgtgtgagtgtgctcagtcgctcagtcatgtccgactctttgtgaccccatgaactgtagcctaccaggttcctctgtccttgggattcttcaggcaagaataatggagtgagttgccatgccctcctccaggggatcttcccaac

SEQ ID NO: 41600 - DNA, 831 bp, Bovine  19866881550670
ctggagtcagagaacctcagaataccactgaatccacaattattcattgtgtactgatgaatagaatagaagagcttggtatctctgtttttgtggttagtaatgtagccataaaccctcctctcttccagagatacagtgatcctcatttgtaaatgacatcagggaacgtgaagctccttttcgaagctaagaactgattgtcactcttggttattgcagcagacaactttgattgtaaaagctttccttggacacagtagtggctcatctctaagaactagtgaaagaagcctttttgtgtttttctgtcagcactaattcttactgacctttcatgttgacactgttaagtcacatttccagatactagccattcttacttaaatctgaggacgatacttcagtcatagcttggatcttctgaagatgttttatggggaatgggatttgaaactagatgagtgtcatattagcacattatattaaaataaagtatcaatttcattggtatatatagtatatttaaccaccaaatgggcagccaagtctcgggattaaactgagaaaacataattaattataaataattttatgtgaggttcatataacaattaattaaagaaacagattatagtaagaataaagcactttaagcttttaatgactattgcatgtttagtcactttggtcatgtgtgaatctttgtaaccctatggactgtagactgccaggcttctctgtctgtgggattctccaggcaagaatactggtgtgggttgccatgccgtcctccatgggatcttcccgacccagggatcaaacccacat

SEQ ID NO: 41601 - DNA, 857 bp, Bovine  19866881556100
tgccatgagtgcatcatttgacactgtaatacaatctgagtataatttacttgttcctttgggttagtgattgttgtcccatctggacacataaatgtcaaaagaagcagatgaggcttattaaatagctctatgttataatagagttgtaagctaaaaggtcattaaatcactcattcaaatagtaagatacatatttaataagtaagttcaaggtattaaaagacatctaacaaagtcttaggttataactagaatggaaagctccaggttggtttcttaaaacaggtaaagtctaaatagacaaccgaacagcaaataaagttgcactaaataaagagacaagtggtaaaatgtcccaagaaaaattagagcatatataataaaagtccaaaggaaaataaaaagtatggtatattgaagaaactctaagaaattcagtttacctggagcttaaactctgagaagaagagtggcagtagatgagactgaataggaatgtggggccagaatatgatataccctgcacatcattctgtatttggttttatgctgtgactttgaagtgttttaggtacggaagtgacacaatcagactattctctattaagagctctcaggatagaagcaaaaagatcgattagaaggtagtttgcattgattcagggaaaacccaatagtggcttcaaataaaacagggacagtggaaatgcagagaaatggctggacaaatttcaatgatgttaagggggaactatcaatgagatttgttgtagatttattgactgtgggactgaggaagagattaggtactgagattgtattacagtttctggcttgaactcctgagaagattg

SEQ ID NO: 41602 - DNA, 669 bp, Bovine  19866881590402
gtttctgacacttgtttcctggggatgaaagtgggacaggaaagggccaggaaaaccggggagtgacgcggccaagggggcccttttggggagccggggagatttccggaactatacggggctggtcgcgagggcgtgggaggcaccttgagaagataaagcccccggggagtggcgagagggagagtttcaggccctcggagggtgtccttctgacctcaccaagaaaacagcgcgctggagttttcccgctccgcccccgccgccgccgcctccccccgctcccccctcgcctagtaaataacaagttacaatcctcaagcctttcaaaatgaccttcgaatggcacaatgtgcgccgtttgttctggccgtttgcaccctcccaattactccgaaattcttcatgcataccaggtcccaggctccagccacctccggaattacaccaacaccgacttgagattccaagcggcctcttagatacatccctttttatctccctccccattccgcgtcccttcatatttcccctcaatgggttgattatgcacattgacccattcagaagcagttgcgactgacacgcaggcttagccgagaggaatttccaccgggcgacctactggggggctgtctggtgcaacctctgccgctgggggaccggctg

SEQ ID NO: 41603 - DNA, 796 bp, Bovine  19866881613270
attctaactggatgaagaaatattccttgttcctggctcagagaagagagagcagatatgtagcaaaacaagaacaaatataaagaatattagtaagaacaggaatcccaaataataatcccaaataatttttgagctcttagtgccaagcattgtacccagcgctttacatacattatttcatctgaccctcatagcagttctgtgaagcaagtgttgtttactcttcctacttaacagaagaagaaactgaattttagaggggttaaataaattgcccaaggtcacgagcaaacggtacaactagggttctaactcttttctgctttaaaatgcatctatagcgtcttcctttaaaaatgtagactcttattagaaatttgctcttagaaatattgaatgcacctagcgtgttttatagatgaggaaagtaaatgcaagtgtctagacagatctaagactaggaaccttacctcctggcctcccgtttagaactgttttcagtagagtgcaaattttcaccttttaagctgtttggactttgtagagtgctgagctgctggaagcatcatagagaaacccagcagggtgaggattgttaatagattttattaatttacgaaacatttgttaagcacttactacatgccaggaaccatgacagtgtggtatggaaacaaagactgatgacaaaattatagctataaaatgtagttaagaaattgatggctttagaaatgtgattataaattgcatttgttagcttgcataaatttatatatacagtctactcatg

SEQ ID NO: 41604 - DNA, 1381 bp, Bovine  19866881637242
actgactctctaattgctagctgataaggacttctcaatgaaatcaatagctatatatgcaatagtttacagatcattaattttttctataaataataactcagttttcagatctatctattagttcatcagcaagaaactccattgaaatatctcattgatggagtcctatttaaaaagtatattataaaaaaaaagtatattataaatccattaatcttgagaggtagtttgtgtgtgtgaacttcaaaggcaaattaatgagaacattttacaccaagacattttaggcttattacttactataaagcttttggggtcactttcttataacaatcatcaattttaaaatcacattttcattccttaggcttacagtggcattttagaaatgtgcctatttgttaacgtggttgttttgattttaagtacgagggcttgggggagaaaaaaaatatatatgtataaaaacagctaagtccctttggcaggtgaaaaaatggtagaaacataagatgatacttctggctattatgcctaaaagagtctatttaatgtagtgccatggatctacctaatcttttccaatatgttacccatttttcttcgttatctgtctctgtgatgtctcatctctccaactgactgctacaggctagcaatctgtaacaaacactcattctcaatctttagatataataaaaaagggagactacaagattaatggccccagccataattataaagtctcaaaccacagatattataagacctttcaaattttactcagggtggaagaagctgggttatcactatagtgtgaagataatggtctcttagtgaagaaaatgttgagttatttgatctgggaatctgactgtgttttgagtactgttaggaactgtggagaggaaattctttgttcccttaaggagcttgtaataatttcatccatttcagttgtctcatgataatacctatttcttattaattcatgggggagatagctctatattggagttgtcaagtagaaggcagatgagaacaggatgctcatggagactatgccatacacagatattgggaattttatactgttcatcgtgaaatagaacctgtatatcacttcttaagtaatgagtactctgacaggatataaacaacaaatatgggaatatttgaggtcttcttttcccacctgctcaaacattctgtgtctcccagcctgatctttccagtgcattggaccaaactgtccctcatacctacacatacacacacacacacacacacaaacatacacggacacacacacacacacacacacacacacacagtctccctcgaatgttgtattgtacacttaggatataagtgcatt

SEQ ID NO: 41605 - DNA, 1459 bp, Bovine  19866881681738
tggagtggtttttattttaattactgggtgattaggatagccaggtaaccaggcccagaggaaggagaactgaacctgatgtgaatccttattttgcaaacccataaaataaataaaggctatgcaaagaaactttcaatgaaatggtagataatttatttgagactgtccatattcttttacccatttgatcactaaaaagtgagtataaaatgctaaattagctgtctgtgaactagacattgcttttctctaaggaaaaataaattcacaggaaaggtattatttgttagcaatcagtgttcaatgttttatgtttaacatgttttgatatggtatttatctctttcagagaagtcacttatagaatgatctttgacccctgaagtatggctgaggcttgagacagcatgaacaaattcctgattttctggtcttgtctataacttcagatttttcactcaagttctttttctaaatctccagctatcctctgaatatttccagttaagtgttccccattcatggtaacttcaacaaatattcaaaccaatcctattttcttcccaaacaaggtttgttctcaggcttctgtgttcttgtctctgtcaaagaaaccactactttcacaatccttcagacaagaatggttatagtaattgattctatgctatcatcttccttttttgtccaccatcctttgaaaagtttcttaggccagtatctttatctctttttggaccatcattcctatccagactttcataggctcacagctaaagaataactgatggaaaaggaaggaccagtttggtgataccaaattactgaaagggactgatttaagttaatgaatggattaaaatttgagttggagtccaagaattctccatttagatttattcttattttattttttgaaaaaaatatttaaaataaaaggcagtattcaaacagatgttcccaatatatttaattttaaaaagaaaagaaagtattaattgtgatctgaaaaaaagtgaaaatgctgagtatagaatttaagcaaattaggaaaaccatcttagtaggtggtttaagccatattattttttcaaattaaatataaagtcagcatggagatgctgatcacttgagataggtaaattgtgtaaggattgggaaaatgaaacctatatattaaaatataaaatacttctttacctgcattttaaaatatatgtatattatcaaggttacatgagaacaaaattttatctagtagtctcctattatagtatatgcattggaaagacttgaaaaaataattattgtaagctattaaaaatgagaattgctcagtcgtgtctgactctgcaatcccatggactattgcccaccaggctcctctgtccatggggatactccaggcaagaatactggagtgggttggcatgccatcttccaggggatcttccca

SEQ ID NO: 41606 - DNA, 1277 bp, Bovine  19866881750989
tagagaaagcatcaactgacataatggccttagaggagagaaagcttgaaacttttaattaaccacttcacttagatagagattgagaacacatattctttacattttttaatgtgattttgcctcatcaatgaaaaaagaaacttaccctaatacatatataacttatatataatatatatacatgtatatataaaaaaatactatagtgtatgtatatatgtgcattatatgattatatactatatatttatgtatgtgtgtgtgtgtgtatatatatatatattttatagatacatacctgatgtatgtatatatactttgctaaaagaaaatcttccccagtggttatgactgataagcacttttatttgcctgaatatatctagatccaaagagaggggattaaatggttaaagttcagtgttttgggttaaataattagggatataatgatgttctaaatcataagatcctgaaggtacatcttaccaagagcctccaatcaagagaagaaagcagttacttattggtccaatgcttaattgcttcggttgtgtccgactctgtgtgaccctatggactgtaggccagaaggctcctctctccacaggattctccaggcaagaatactagagtgggctgccaggtcctcctccaggggatcttcctgacccagggatcaaacccatgtttcattatgtctcctgcactacaggtgggttccttgccattagtcccacctgggaagccctattggtccagaggacaatttaattcacatgatcaggtcacttaatgagttactttccacactgtttataaaaagcccagagtagattcaagtaattccattaatgtgctgggacattttatggccaaaatcaagacatacaatatttcccattgcattaaaaaaaatagtaagttttttcatggctaagggcagcttaaaggtctgaaagtttccagccaattctttgtgcctttcaccctaatccatcactagtttgccaaccactattaaaacactttcatgtctaaatgtaaaggcccatatcctgacattgatccaaatgcggaactcccattgaagtcgatgagagtgttgcatagaaatcaatgacaggatatggacctcaaggctggaccatctctcccctggaacctttttttcattgacactcagaaatttgagagtattacaagaagtgagatacataaagcagagcatttgcacatgggctccatggttctctgttccttccctggcaaag

SEQ ID NO: 41607 - DNA, 2265 bp, Bovine  19866880434213
ctagcagtctgttaatgaaagaaaggaatgtcttaaaactcagaatggcaccaggcccctcacccataagatgcattttgggataatcttggcaccaaatgattcatcctgggccataaaatgattaacttgaatcttgaagaagggcaaatcaccatataaatagttttatttacatagattagggtaacaatatctgagtataacatactggtttgtcaagtaggttctgagccaagaggtggaaccgacttgaagacagagtttggggataaatgcatagtacattagcatagcttaagacaaacatttccttaagagaaatgcattggttatctctaggtttgagaatagttaacttcaggtgaaaccatgtgtcattatggcaacacagtattttaagagaaacctccttttaaatttgtatagagaaggaaacaatatcgctagtttgtttcttcttgtcgcttaagagagacaaaaaatgtctgacacttgcaggctatttcctccgtttggagacctctgaccttcctgcctgttaccctctcagtatctctttggtaggtaccattttgcctgaaggtttcccaaggggctcattgttaaagaatccatttgccaatgcaggagcctctggagacataggtttgatccctgggtggggaagatcccctggaggaggaaatggcagcccactccagtattcttgcctggagaatcccatggacagagaagcctggtgggcgacagtccatggaatcccagagtgggacactactgaagtgaccgagcacacacgcactcatcttgcctgaagacagtgggtgtatatggagttccttgccctaccccacacattctatttacctccaatcccagtttctctaccatattgtgtgtaaatcttgcataaacattgctgcatctcagtgactttcttggatagagatcattaaaatttcctgcagctaatgaatggtcaagatacataaatcccaaatcacctcttttttttttctcctcaacactttatatgcattctgtcatttaactctcacaactctgaggtataattatgctattataggaattgagaatttccatagttcaaatcatttgaccaacttgatccattaataaatggccaagctcgtctcaaagcaggcttgtttgacacaaaagcctgaatttgaagctctcactatattgactcctttgataatttaccatttaattatttccatgaaagaataatctatattctcaggataccttaataacaccagagggaaaggtgggaggataaatagggagattggtcttgacatatgcacactgctacatgtgaaatagttaactaaggacccactgtatagaatggggaactccagcagtactctgtactgacctatatgggaaaggaatctaaaaaaagagtggacgtaggtatctgtataactgattcattttgctgtacacctgaaaataacacataaatcaactatactcccataaatatttcaaaaactaacattcattcagagcacaatatttttaagcttgggtattactgggtaagtagattcgatccctaggtcaggaagatctcccagagaaggaagtgaaaccattccagtgttcttgcctgaaaaatcccatgaacagaggagcttggtgggctatagaccatggggtcacaaagagtctgacatgtcacatgacatgaatatttttggatattctcttgcctggtctcaatttcagaagctaggttctgggaaagctatatttctggtatttttataaaccaacagaaagattttcctattcctaaactttggaaactaaaatctacaagtcagactttccaagaacggcgacttttcactacaaaatcattcaggtccctttaaattccatcagaaaataattataatcattatgttcttagcattatagcacactagctaaaataatactctcagtgtttctaaaataatgtgataatatgccatacatgtgacataaaagataattaattttcaaaatgacagctgcaaaaatctcgtccttttaattttggagagtagaaacatatttctcaattgtgaaacatacagtttctacttataaatttcttgagaggttgtagaaagaacaacatcaagatttcagaaaaagcacacagaaagaaacaatgtatttagcaaagctgctcttcaactaagaagaaaggataaaagtcagcaaaaaagtttacga

SEQ ID NO: 41608 - DNA, 1833 bp, Bovine  19866880458467
ggagagggaagcagggagggtcaaaataggggtggggaagtgggattgagtgtaagacaggctcaaggatgcattaaacaacacgggaaatacagccaatattttgtagtaactgcaaatgaaaagtaagcttttaaattgcctattttaaaaaaggaaatgaagcaactgaggctagaaatattaagtgacttaccccaaatcagacaaatgtttgggcaaaactaggaagagagagcagtccttgcaatctgtccctccccagatcctgcctttacccatctaccagagagaaagcaagcttctatacagagaaagtgcctctgatattctcaagaaaggcaatacccaacagactgagatgatgaagctattgtgctttcatgaatgactgttagcacaccgcccctaggggcctttgctagagaacacaggaaggaaagagccattgaatgtggacttcagagtccactagctgggttcaaacccctcttctgccatttcctagctttgtgagcttgggcaagtgctttagtttcctgatctgtaaaaatgggaacagtaataatctgatcccagagtgttgaggtgaggattaaatgagacaactcaaggaagaagtgtttaacatgatactgacacgtaacttaaaagaagtccttctgccttctgctaataacctcccaatcgcaaagtgtattatagcatatttattttatgcacatgcaagccaaggctagtcaggctaatgtgaaagtctaagattctatctgattttcatgaccaccggcatcactcagtatattcacaaatgttccaggaagaaaacatgcactgggcacagccaataagtataaaaattgctaagtcaagttcatttaaaaatcacatggtaattccctagtaattctgggttaattgcatattaattaccatcttgttatagcatcaatgagccatacatttgatgtgggaacctgcagcagagattaaacactaaaacgaaccttctctgactgctgcaggaaatgatccctgatcactccatatagtcaatgtttttcagaaaaactttctatgttactcctttgttttcttctttttttttttttttttggctgcgttgggtcttagttgcagcacacaagatcttcattgcatcacgtaggatctttagttgtggtgcatgggcttcagagtttgtgggctccataaccactgggccatcagggaaatctttacgttactttttttttttttaaagaggtcagtcattaccctaagtggtaaagaaaccatcaatgcatggattggcagacacaagagatacaattttgatccctgggccagaaagatcccctggagtaggaaatggctacccactccagtattcttccctagaaaattccatggacagagaagcctggtgggatccatggggttgcaaaaagctggacacgactgagctactgagtgcacacacatacacctttcaactagagtttcttctagtgtaagtatgtaaagagtagccaataatatcggagaaggcaatggcaacccactccagtactcttacctggaaaatcccatggatggaggagcctggtgggctgcagggggtccatggggtctcgaagagtcggccatgactaagtgacttcactttcacttttcactttcatgcattggagaaggaaatggcaacccactccagtgttcttgcctggagaatcccagggatgggggagcctggtgggctgccgtctgtggagtcacacagagtcggacacgactgaagcgacttagcagcagcagcagcagcagcagcca

SEQ ID NO: 41609 - DNA, 1281 bp, Bovine  19866880506316
tgaagttgtagaaagagcagtggtgtcatagagagtgaggaaaatgcttgtatagacacttgccatttaatctcactgagccttcattttctcataagtgggaagtaggtgtcagattggggtgggtggatgggtgattggaaagatactgccctggatgaaaaataaaatcattttctacagatgttaagactattaaattgatgacaaaattctaacttcctcattatggcattctaaactaatgcagaaccactaatgttacaaacacatagaaaattgttcaccattcatttgtgaacgactctttgcgaccccatgaactgtagcccgccaggctcttctgtccatggaattttccgggcaagaatcctggagtgggttgccatttccttctcctggaaacatgtagaaaagcatgtctcaaccagcaggtttataatgatctgtttacaaatttcagaaaatttgccagcctatatgagctggcataagcacacatcaacacaatcccaagatgacagaaatattcatacctagacaaatcagaaatgtcaagttggtccaaaggtgtataaatagatacaagacttagtgattagggaataggattttaatgtccatacagagtaaaagatgtagctgtgggtccagatgagaccaattgctggaacagacatcggcaaagagctggggtccctaagagctgcccaggttgttagctgaatgagaaaacatttttaagtcccaagaaatggcatggaaatatcccctttatgttttgggtgagagcaatgaacaaatctccaattaagaactgaagttcaaagctcagcctttgcccaggtatggaatatcaatttacactccacggacagacatgaatcctaagctgataaattaaacatgtgaatactgaccctggacaggagaattctcagaggtgcccagtagaagcaaaacaaaatttccctttagagcttttgtcttataggaggaaaaggattcactcaggaaagaaatatttgagctgaagataaacattcattcaaaaattacacactccacgaggaaatgaactataatgaagggattcagcagatacaatgaactgcagaattagtattctaagaacttgagagagtaaaataatctgaaaatataaaaattaaaaaataatagcaattttaaaatagataaaaatacaagaaaagaatagtcattaacaattagagaaaataaaatgtggaaaagaatgtaataactaaaattaaaagctca

SEQ ID NO: 41610 - DNA, 1391 bp, Bovine  19866880516477
ttcatgttgatgtatggcaaatcccatcacaatattgtgaagtagtgaaagtgaaagtcgctcagtcgtgtccgactctttgcaaccccatggactatacagtcaatggaattctccaggccagaatactggagagggtagcctttcttttctccaggggatcttcccaacccagcgttcgaaccgaggtctcctgcattgcaggcagattcattgcagctgagccacaagggtatcctcaaattaaaataaatacatttttttaaaagaaaaaatattggaaaataaataattcaaatatttttgaaaatctcagtgggttaaacaaaaatctgtctgaaggctatatttggatgatgctggatgatcctactttctgaccttacctggtaactttggggatggataaatggtacagatcagaatatactatctcaattattaattacaaatacactgagagtgagaacaatgtgagatcatctttccaaccatagagtgccttttctggaataggtgtttagtaagtttttgttgaactgcaggcagccttcagagggcggactggagaaaatgagctggctggatggagcatgctattttaggttagataggttgagaccacactttctgtaaactgtatcatttggatgttttattaatcactgctgccagtgaatttaaatattttaatgattggtatattttactcttagcatgccctggggctttttttttttttttttaaagaaatggcagttttaaaaaaatgaaaatagaatccctgctcaatcagcattcaaactgccaggtgacacttgggtgcttcctccactccaaatctgggtcagcatggcattcggggactgggacacctgccctgccttccctagcaaaggactggctgaaattgggctccttaggtaaagttgtctttcaggttagaaccctgaaaattatcccctgaaacaattctctctttggaatgtgaatctccatacttctagcaaagcttggaagaaggggaaaaaagaagacacttcgccaccacacctcaatcttgcctttgtaactattaaaatatgttttctaagttatggatcagctgtctttggggtagcctctgggcacaggcagatctcgtttcatggctgctgctgctactgcattgcttaccgtgcgaaggtgtgtgataaacctgttacgagcaagtctctcagtgccattttcaacaacatttgcttactttgtgtcttggcgtcatgttctggtcattcttgcaatattttaaaccctccaccagcaataagattacgaattcctaaaggctcaggcgatgcttagcattttttaacaataaaatatttagaaaatagggttttttttttaat

SEQ ID NO: 41611 - DNA, 1887 bp, Bovine  19866880637257
tccacacagtcaaaggctttggcatagtcaataaagcagaaatagatgtttttctggaactctcttgctttttgatgatccagcggatgttggcaatttgatctgtggttcctctgccttttctaaaaccagcttgaacatctgaaatttcacagttcatgtactgctgaagcctggcttggagaattttgagcattactttactagcctgtgagatgagtgcaactatgcggtagtttgagcattctttgatattgcctttctttgggattggaatgaaaactgagcttttccagtcctgtaatgtagggtaaggaaaagatgactcaacagtgactcatagttttcttcattggataactgagtggattaatatgaaattcaaatgagttacagagagcagccagtttcaaagccaaaggggagatgaatttagctttttgtatgttgactctgaacagcctgttagttatccaggtgatggagaagggtgcacattaaaaataagagatctgaacttgaatatacgtttggcatttatcagtatacagataatacttgaggtcttgaagaatatatggggttgaaagagaagagggctgagtaagagagcaaaattagacgacttccctggtggttcagggttaagaatcccttgccaatgcaagggacacaggttcgatccctagtccgggaagatcctatgagctgtgaagcaactaagcccacgcaccaccactacagagcctgtgctctagagcccaggagttgcaactactgaagtctgtactgtggagcctgtgctccacaaaagaaaaagccagcacagtgagaagcccgcaccccaccactagagagcagccctgcttgccgcaactagagaaagtcggtgcacagcaacaaagacctaccgcagctgaaagtaaatgaacaaaatcattgaaaaaaagaaaagcaagagaaagaggcacttcatatgttacactgagctcttgatcttacccttctgcctacatccattgctaagatttaaaattctatattaaagcaaagatagccatgtgctaaaatagagatttctaaagaatgaggagttcattaccttggatacaattaaattgttcaggtgttgagtatccgtgaaaagataatatcataaatatcatttagggatgttgatcatatgaactcccaatctactgaaataatgcttaggattacattggaaaaaatgaaataaccttgctgaagctaacaagaaaattgtaattacaactgtatatataatatgaagacataaataataataaaaacatgcaaataaatagccactactcttcagatctcaaaccctggaactaggttagtaactcctttctcccaggtattataaaatgtaattacttgagctttgtaattacctaaagtctgagcttaaatcagccatgctaccgaaggcttttttataatctatcacacaccaagaacacatctcaatttatttgtcttcatttgaggaagaataactgagcatcagggtaagtcaatcaagaaaccagaaaaagcgctgaagatataatgatacatgcatgatgaatccaaacaaggtaaactaacttctagcagaactctgtatctgtcatcctgcggatagacgggcatgtttcactttatattttgtgaaggtgttaatttcctgcctcagtaagattggctctaatgctaggtggttccaaggattttcaaattcaagaatataagaaggcatcctgtactaaatcttaataggtagggctctcctttccattagagcaggggttcccaacctccaggatctaatgccttatgatctgaatccaagctgatgtaataataacagaaataaag

SEQ ID NO: 41612 - DNA, 1208 bp, Bovine  19866880655791
tgaggaaactggggcacaaaataattagatgatttgtccaaaacctttaaaagtttttttgtttatttttggctgtactgcgtctctgttgctgctcatgggctttctctagttgtggtgagtggggcctatcctctattgcagtgcatggacttctccagagaacacagtttcgatccctagtctggaagattctatatgccacagtgcaactaagtccctgtgccacagctattgagcccatgtgtccaaaatccttttattgagttcatcttagagtccatctctccctggcctcagaatagatgacctacaccatgagcttcaaaactaataggtccaaatcctgatgacatgtcctcttcaaaggttacttccattagagagaaaaatgtgcaaaaatgtgggccagtcacacagaatctttagcatgtatatgtcattctagtgaagtgcttttagaaattggttccctagtgaaggaaggattggaaaacttagccctgtaagaaaaatcggcaggggaaatgtcaaatcactccagttctttgtcctcaagctctgacccaataattctgggtcattggaaagtgacctaaaaatataaagactcaaaatttcattcagttgggtacagtttcaaatgcaaacaccactgcatctctgcatgacatttagtgtttccttttttactcctcaggtctttgagtcccaggagaactcttcaggcaagttttttacggacatacaagccaaatactttgagagtgtaaataaaacaacaacaacaacaaaacactttcactttagctcatgggacccaactgtttcagttgctgcagcaggtagaactttaaagacaagcacaaaccagaggagaccagattctacattaatgttaggtcttcagttacaagctactttggagaagagtctgcagaactctaaatctcagccttggtccaaaaaaacaatacatgactcaaagcatctttcttagaatcgagggagaatgccgctggggcctggtgggtttgtgggtaaggggtcaggcaattttccattttcttgtactgttgataaccttggatctgttcctaggtatgttaaggggtcattttgatttgatttcagaaactcctaatgggataacagatccccttgcaaataccaccttatttttctgctatgaatcagttgcatacaat

SEQ ID NO: 41613 - DNA, 2399 bp, Bovine  19866880683999
ctcactgattcctaaaatgttgatgttcactcttgtcatctcctgtttgatcacttccaatttgctttgattaaggacctaacactccaggttcctatgcaatattactgtttatagcatcagactttacttccatcaccagtcacatccacaactggctgttattttgctttggctccatcccttcattctttctggagttatttctccactgatctccagtagcatgttgggcacctactgacctggggagttcatctttcagtatcctatctttttgccttttcatactgttcatggggttctcaaggcaagaatactgaagtggtttgccattcccttctccagtggaccacatattgtcagaactctccacctaaaggttgagaaaaaaaattgtccatcactgactcgatggacatgagtttgagtaagctccaggagttggtgatagacagggaagcctggtctgctgcagtccatggggttgcagagtcaggcacaactgagcgactgaactgaaaaattgagaaaaaagtataaagaagggaaaaactgtcctttttttatccatggataatcactataaacatttttctgtacatccataatctttttgcatgtagagatatatctactttaaaaaaaatggtgtctgctcatcaattcttctttttcacttaataaaatatcatgagcattttcttaaaaagttctttgcgatcattatttttaatgatcatacagtattctggctatagatgtattgtaatttattttaccaacacacccccccccctccattgtttgacatttaggtcatttccattctgctgttgtttttttaaaaaagaggttgtgataaatatcatcacgcataaatctttgggcacatctctggttactgccttaagataaattctcaggcatgccgaattgctctccaagaagttgttcaagtttacaggcccatcaaccatgtagaaaagtgaccccaagttttaataaatgctcacttagaatggctagagaaccctacaaacttattagaaagggaaagctatattttaaagggcatgtaaaccatattatctatcttattctcatgtgggattaattccaggggaacttagtttcaagggtattattttactgggtggcttattttaaatattggtgcttggacttccctggccatccagtggttaagactccaccttccaatgcagagagcgaccggtttgatccctggtcagagaggtaagatcctagatgcctcatggccaaaagcccagttttgtaacaaattcaataaaggctttaaaaatggtccacatttaaaaaaatctttaacattggtactagtggattgtttaaaaagatgacctaagaagtgtgagattttgaaaatgcattaaccattacttatgattttgtgccttgaatttctcgctccctgaatatattctgcttttataaagaaaattgatagaaaatcatatttttttaatctgcagaaacgattccatagctcaatgtatagaattaaaccctatccaaaggatgagacacatctgttttcatgtaaaaatccaaggtcaaagaggtacctcggacctcatttatgctctcaactgctatgaatggcagaaacaaatccaatgggaatatttccatcttccaaatggagtaactgaaatgcagatgtgtaaactgactttgctatcattacagaaattagtgatactaccgcaaaactccaatttctttattatgatatcatatagtagaatatcctaccatgcttttaaaaaaatcagaatccaacacatagcaatacctgtgttccacatgtctcaacaaaggaaggtcttttccaaggtgatggatagcaggcaggagcagatggccaggaggagaatgttccagccgggggctctgaagggacagatgggttgcaatgccctgagtctcttgaccacatgctcagtgatccacaagctttaagagccttgaagaggtggctactgtcatctagccaggggggttgcaattgtagagccatacacaccccaaacacagagatcagagttattattggtcagaaatttggtgtctaattgaaaatggacctggttctctggcaagatcctaagaaaaatagttcaattaaaagttgatacaactttgatcacaatgctgcctctatataaatgtgtgtgtgtgtgtgtgtgtgtgtgtgttagtcactcagtcgtgtttgactctttgcaaccccatgggctgtggcccatcaggctcctctgtccatgggattctcctggcaagaatactggagtgggttgctatttccttctccagaggatcttcctgatccaaggatcaaacctaggactcca

SEQ ID NO: 41614 - DNA, 1040 bp, Bovine  19866880833427
caactgttaccaaatgatgaaccactatctgatgtccttaccactcaaagcccatagtttaattaacttttctaatttatttctctgctcttccatctcctgattcaatcttattcctttggaataccagatattgggagacagaggccataaagggattggtgaataaaaatttctctttctgttctccttgtccctctgctaacattgaactgttattctggagtttgttatttttttctcttttggcccacaccacatggttatgggatctttgttccctgaccaggggttgaatccaggccctcagcagtgagatcacagagtcctaatcactggaccgccagggaattctcatagagtttgttatttcttttgaagtgatattttgtctttacattaggttgccattttcaaggctctcacaaccattaatatcatggaggtctcattacatttcattggcaagttcaaggaagcctgcgtcttcacgtctagggctcagctgggaaggagatgggttttggacactatcttctgtagaccatccatgccattcccgttcttacagagttaataattcacccctcagctttaatttaaaagtttctaattcattaacaatgcaattttcaaaatgagatttggtatgagatgcttaataactaaaatgctctatcaatcttttccccccttagaatctagcttctaggctgggatttcagacagccaagctcacgcgccacagggcagtcatccgaacgtagatgtcagaataatactgacaccacagtcctcagcagcactttacagtttacgaaacacatccatatgcatcgtttcacttcagcttggcaacatctttggagaggacctgggtctgcctgtaattaatgagaaccgtgagttactgttctctggtctcaccttggagggggcagtattcgtctaacccagactgaggcctctggccatagactacattatgcagcactaatgatgcaattaattcctacattagctgacacatcattccttaa

SEQ ID NO: 41615 - DNA, 928 bp, Bovine  19866880838174
cggtgtggaaaatcagctgtgattcattagacatatgattgtgaaggagaaaagcatcactctggctttgagaaaagttgcagaaccctcattctgagaaacacattttttcaaaaaataattacatcctgaggacatgggattcacgctgtaaaatggacccattccataatccatgacatatatacatgcactgtgtacctatattgaaaatcttagataaataggtataacctattcatctttgtcatatatacatatatatagaaaggaggggaaatgcagattctattaaaattattaaaattgaattttaactttactaagtatttttgagctttttttttttctgtgcagagacatggggaatttttttttaagtcgggtttttcccctgtctggcccataaagaggcttggaccccctagtttataatcccctaaaccggctcagcctttgcccggctctcgtggtctcggtgtctccttccgagcacacagaaaactgatggctccatatgtgatggcaggcgctgtctacccgaagcatatgtgttcaatcaactttaatacccctacagtccggaggaagggaaatgctaggccctgggaataatcatcgtttccattacattagcgaggtttgctggtgtgccagaggggcagggctctctccatcactccgctaacactggctggcagctcggagaagagcatgggtgcccatccaggcaggaagtgaaatatatgccttctcctctcgctcttcccgatcatcttccctctattttcccccttacctctggggtcacagagtctactgtggttcatgaagaaagtggcttgagctgttttcatcaacgctgccttagtaagactttccattaagagaataaaatcaaaatgggtgtctcatgtacacactgcta

SEQ ID NO: 41616 - DNA, 1411 bp, Bovine  19866880874277
agagatggagattacagttcaaaatacgccattaacaccaaattacaaaagtctttccaagagccagacagaggcacaaagtaaaagcgaagttttaaaggtataatttgaagagtcaggaaaacatacaaatagaaagtaaaagaaaaagaggaaagttacatgcagccagataggaaaggacatgatttttccaagtacactttgggtactttttcttgtcctgcctactacattaaggaatattatctatacttttattggtgtgtttgagagtccttaaaaaacttggtgattgttatattatcccttgtattttttttgaaaaaaatatgatactttgttttaaaaaataataatttcatttgtttgtttcttttttggctgtgctgggtctttgctgccgtgagggctttcctctagttgtggcgagagggggcttctcactgcagtggcttctcttgttgcggagcacaggctctaaggcacgtgggccgcagtagatgcagtgcgagggctcagcagttgcggttcctcagctctagagcacaggctcagcagctgtgacgctctggcctaggtgctctgcggcatgtgagatcttcccaggaccaaagatcgaaccctgtatctcctgcactggcaggtggattctttaccactgagccaccagggacgcccctcgcccaattatgataatttctaaattaaaagatggacttgggaatttgagtttattaaaaagactccaggaatggtaaatgaatgagatcatcatgtaggaatattctaaatgctatctgcattgcttatatatatatgtatgtatgttgctgttcagttgctaagttgtgtctgactctttgtgatgctgtggacagtagcacgccaggcttctctgcggttcaccatctcccagagtttgctcaaatgcatgtccgttgagtcggggatgttatccaactgtctcagcctttgctgtactccttcttctttttttgtggctcatatattgggaggcacgattattgtcttccagcaagaaaatggaagcaatttgcttcagtttcatccttcaaacgtttattgggtgattactacatgctattctctgtactgggcactaagcgttcaaaaatgaaagattttgctttcttctctggaaaactcaatatcctgctaaaatctaggagtgcccacagtggcttattttcctttctggagagttctgtgtctaatgtttctcatcttatttagtcactacttttccccctatcacttttcatcacatcatgaatgaacaaaaattaatcttctcctattatagcttcaccttaattctgattattcctcttaagtaaaagttatttatcttcaagccttacgattgctttcaaaaaaacaatcactg

SEQ ID NO: 41617 - DNA, 1090 bp, Bovine  19866880876095
agatttggtgggcttgtgcagctaattatagcatcagagtatatagaataacaaaaggagcttcacaaaccccaacttgctatgaggattcagagaacttggatggggactcaatagctaagtaaaattcttatacatctgtcagttgtcattgggaataaaggcttctaggtgattgcccaacttcatggtgaggcaacagcattatttgtttgtgtaaagaaaaacagtgtgaaaagtcaggaagactgagaagatctagatttctaattttaacttgacctgctaactagcaagtgaacccaggcaggtcacttagcagctatgattgtgtatcttcagttttctcatgcaaattggtatggttgttctgagtactacataaaatcaagtctatgaaattatatttaagctatagaatactatattgccttagaggttgtaaaataaggaaaacagttgaatatcgttaggaactttatctatcatgcttatctgttttgcctgctaaaaatgtgagtgctcaagagaaggtcaatggcacagaaatattccctgttgcaattaagtcatctgcataaacatttgatgaaccgtgtacaaatggcagtggggaaaatgggtaatattgatggattcttaattttaaaagaacaaaaatatttgatggccattctgtttgatagcttctagtgaaagttattatgtaatattgatctttctttccataatgaggcttgttctgagcgctggcagctgaaggatgaagaatggaagaacttcattaacaaacaatccttgagtgactattgtgtgtttgatttcaggcaaggagggaaaagaaatgcacacacaggaaaaatggcacagttttttcaaataatctggaaaattgtttttctgaatgagaaaacacatcaccttttattcaatggccataagtggctactgggtaccatattgaacagtacgtatttagaaattttctatcattacagagagttctgtgatcacatcctttgaaaatgaggggttgtgtccactttgccagtgaagactctacttcctttatttggtgactcacagctag

SEQ ID NO: 41618 - DNA, 735 bp, Bovine  19866880912073
ggacggaggagcccaataggctacagtccaggggggtcgcaaagagtagaacacgactgagtgacttcacttaccctcacgtttggctttttttcagtaactggttaacagataagtaattcctgatttttctcaaggcgacctagtcctcttggcaaaagctcccgcttcaaagtaaggagactgaagtttgggaaaattgcccagaaactgccctcagctgacgggtgaccagtcaaccaacaagtactgcttgctggcttgacttgtacactgatctagacattgtggggaaacaaaaagcaaaagtagttcttgtcctgagagactttcgggttaaagctgggaaaaaattaattagctactaaactttgctaaccccctgcttcttagcctccagcatggattagaaagttttcaccacctcttcaccctccactcaaatatttgatctctgtgggccaaaggagattgatttttctgggaagacaccatggtggactggccaggcaggaacaactttttgtctactctgaaaaatggtgtttgggattgtcttccaggtaactctgtcctccatgccaaagaggcttctttcccaccaggcacgtacgtctcccccggccccgtctcatcaacagctgatgctgtgagagtctaatcctccatctgccttgactctccatataccttttttatttttttaaaaagtctttactgaatttgttacagtat

SEQ ID NO: 41619 - DNA, 1634 bp, Bovine  19866880915651
tcattttatttttatttatttattaaaaaaaaaaatagaggaatagagacccagatgtggacaacagacgtgtgatcatggggtgggaaagggggtgtgagatgaattgggagattggaattgatgtgtaaacagacaatggggagctgctgtatggcacagggagctcagcttggtgctctgtgatgacctagaggggtgggatagggggagagaggaaggtccacagggaggggatatattgcggacatatagcttgtaactgatttaatctagttatagcacaccttcaccttccaagtgggggagttggttttcaaaagtagtcaaaaccaatttcatcaagtgtaaataatgggtaggtggtcaggctagcttctattatttttaataaaatataattggtgtatatttagcattgaattggctttttttagtagtacaaatactgcctacaaaggcaattgcaaaccctgttctagttacaattggactaaagaatacttgttacatgcatcacagacctactttactctctttgaaagttttttgttgataaaaggagatattctaggatgaagagaagatggtgttgctggattcaccttccttgtttcactgcttcagtttccatgacactaaggcagttcaataacttaaagttgatgggatggctatgaaaattcatatatcatcttttctctgaaattttatcatgtttgaaatgagattctgctccataagaaagatgattccatttgaaacctttaactcaggtacaaatgaaaacaatgaatgattaagagattaaattctattttttatcaataggaaggtctctcctttgcagaaaaacagattactgatcggagttcacttttctcctatggagagaaaaggaagggattgtcttcatggagaatggctgattttaatattaatttacaggagtgaatccattgtttctttaaaatgatgctttttctatgcagttttggttggattttaatgtaacatcatactcataaatttggctttggatatggtcttttgagtgggagggaggattttatttgtcagattaagtcacttgtgtgtatatgcgtatgtgtgtgtgtttaagcagggaaaggaagagagagagagcaatcagaaaaaacgtaacctctcattttagaggttacacaaaatccaattgacctttttaaaaacatctaattgtcatgcactcaggtactttccgggctcaaactggcagtcaaatatcacaagaaaggttattcttgttatttcaaaacctgtttgaaccaagaagtattgagtgtccttggggagattccaattaaactcatcatggtcttctctttaattaattaattacttaatgtttgtcaagtgttttgaggatgctaagtgaaatgtatgtgctaattattatttatgaaaagcaaataagtcattaatggtttctatttcctcccaggtatgttgctttatctggctaagttttatgaacccaaagaatagtgcgtttttgtagttttctaagatggacagtacaaagtgtcatttaaatctaaagacacataataactaggtaatattttttccctctctttccatctagtctatgt

SEQ ID NO: 41620 - DNA, 812 bp, Bovine  19866880921632
ataaaaggaaggacaaagaccacgtttgaaatacccagaggccaattatcttcacagcatctaggtgacactatatgggttaggttatggatcaagttattttctagttgctctgcttgctttttatctaacaactgcccacatacctaatgcaatgagtgtctttaccaacaaggaacacaattagccatctcttctctctgcttcccttctactctcttccttcctgtaaccttccagagtgattactactatgtattttggaaaggctctgtgctctgcactgtggaagggcctgagataaagcatagttggtttttgctctcaaatagcctagaatttgtcagagttctaagtgtgtagagattgttctataaatgttggttaccagaacttgcaaattactggggaattaatgcatgggaggagtgtttatcgagaccctgaaaaaaagtgaaagttgctcagttgtgtccgactctttgcaaccccatggactgtagcacactaggctctactgtccatggaattctccaggcaagaatattggagtgggtagccattcccttcttcaggagatctttcagacctagggatcgaacccaggtctcttaattgcaggtggattctttaccgactaaacattgtacatattctctgccttcggggagctggcagtttaggcagggagggggaaaaagtagcacacattaaataaatatcgaacaattaaatttaaactgtgagacggtgattattttaaatataaataggcattttaaaggagaaaaactagggaattccctggtggc

SEQ ID NO: 41621 - DNA, 1967 bp, Bovine  19866880956941
tgccttgtagaaagtaccaagttcttttattaagtgtggctgtaaaataactgacatattaaaggtgaaaaagcctcaaaaaactgtatttaatatatgaaggcaccagaaaaagaaaggatttagcgttataggtcaccatgatgatcataaggattattcagtcattaaaaatgcctagtctcacaggattccctctaggatatacttcatatgacattgaacttggtgccattaggaggaattatacacacaaatatgtaacttgaacagtatttggtcctgccggtaattgttaacaactccgctgttttataaaatctattggatttacgctctttgactttgttttgcttcttcctgagagccttatgggcaatcggccaacttgaaccaatctggggatggcatcttgtggccagaggtttctccaccattgtttcccaccatatggccctccatagccatcaggagctctcttacccaagcctaaggcttcagttggcctctggttctgccatattattcacccgctcctttccactccagagaagcagttacaacataaaccaggtgtacccactggaataacttgattgagaagattaaacaaggatcagccattaagtttcatcaagccacatttttgctctatttcatagaaacagcaggtgagtcagactggttgcttgctaaagaaaaacacattaagaaggtttaaacctcaagcaggcatgggtagagaagtgtcgttggtgataaaaatctaacccataggacatttctacagctatcatctagatgattgagatgaacattactattttaggtttaacacagaggatttcatgcctcaaggggtgtttttgaatccccaagccagtacccagcaccactgaaaaatgtctctccacgttctgcagctacatggaatctgatgagaatatttagagcatacgtctttggcaatgggtgcttggctgctgcaaatatatcaaaatgactgtacttgggcaaaatgggagaaaggaaggagagtgacagtttaaagaagattaaaaaaccaaccaacttttaggaagattaaaaaagagagagtcaggaggatcatttataaaaggaaggatgtaaattctttacaacctgattggttttccctggaatttgcttggtttaatgaaactgttattcctgaaggactgaaagcccttttttaatgtgaataaagcagtactaggggttgacatattgttagtctttggcctcaggagactctctctgaagacctaattaggttacaaacatgtgaaatgagtttagtaatccctgtgcgggagctttcagggtggctgatttctgaacgttggatgcttaacgcttcccagagtatcctttgtgaactctataaatcactgcttttctgcctttcatacaacaactaagtcatcatcaaagactcatattcatcagatgaccttttctatagtgaaaaaattaaagatatcttggggttttcatggacttcctttatgagagtgtccctgacaaagcttgcatattacctaagtttttttttttttaataattttcctgccaaatggaatagcgagtttgatttatgattttttaaatcaatcattccaaggaattaaaaagcacactcttcaattgaatgaaatgtggcttgagctttaggagctaaagctttgctggctagcagcctttaacagtgaactaaggccaaagttttaccaactcaggaaagtcagaggaggcaagtgagacagaaaagagaatgacctttgggggtcacaggagggcaaaccactcaaacttgttgaacttataactgcgcaatggaaataataatatatacctcatattgtttttctaaagaatgcgataacagaaagcattttatcaaagagaaagtattgtacaaatagaggatattttcacatatacag

SEQ ID NO: 41622 - DNA, 1795 bp, Bovine  19866880973184
ggtcccagttccattcctgctcaggaactagatcccacaaccaaaaagctcacgtgccataaggaagatactgcaagccggaactcagacccagtgtggcgaacataaataaatacgtgttttctcaataccaccattaaaaaaaaaaaaagagtcaaattgcacaaagtctagtgatcaccaccacccccccccacccccagcccatcacccaggtcaatggagctctacgccaggagaaatgtgcaggaacattttaggttgtcacagaggctggggactatgggcaggtagaacgtgtaattgctaaatggtccatagctctccaaacaggtccaatacaggagagttgtcctccaggtacaagaatggtagccatggagaaacacaaccccttacccataggggaggtagatcagcatctaggtcaagagttctaatggttctgcgttcccctcccctcaaaacaggaaggaatactgagtaatcagggtctcacccagctctctctaactcagtttcaactgcctgacctttttttctttttttggccaaggagaaggaaatggcaacccactctagtatccttgtctgaaaaatcccttggacagaggagccctcgggctacacactccatgggtcgtaaagtcagatacaacttagcgactaagggacaacaacctagcatgcaggatgggaccccagcccctcgcagtggaagcactgagggttaaccaccggaccaccaggggattcctcagcctgagcattcttactgagattcggtttataagaactatggcaaatccagatgtttatctccagtgggggagaggaaacatactggtatttgggttgtcctcccatcatctatctgaattatattgagtgtgtttttgtcaattacgtagagaattcagaccagggcagtttatctccagctgtgcatgatcttcttccctaactggagcatgaaagattgcaacagtgtaaacaaagccaggactaaaatatgttccttctatgagtctgtacctagtaatggttatattaatcaccattatcattgtagttatcctcctctgcatcatcagaatcaattcagcaactgtttctcttggtgatgtctccttattacaacatagtattaattgtatccgagttgattttctgctcctactgctgaacagctgtgtgggagtaaatacccctcaatgaaacatcagcttaggctgccaggactcaggaaatttatccagatgtgagcagcaagtccagggggcagctgtggaatagaatacaccagcatcacctggaaaatcccatggatggaggagcctggaaggctgcagaccatggggtcgctgagggtcagacacgactgagtgatttcactttcacgcattggagaaggaaatggcaacccactccagcgttcttgcctggagaatcccagggacgggggagcctggtgggctgctgtctctggggtcacacagagtcggacacgactgaagtgactcagcagcaccagcagcatcgatactaaattctgtgatcggtgtccagtctgaggaattctgagaattgctttccaatactgtgagccatccaagagttaacagcttgagttttactttctgtttaatataggtcagagacattatctccgaaggaacttttgtctggctcccttttaaaaattaaaaaataaaaatgcaacctccatcaagagaaaaaccacatggattccctaaacatctgattaaaaactataactatcccaaatttctat

SEQ ID NO: 41623 - DNA, 1329 bp, Bovine  19866880983181
gtccatctagtcaggctatggtttttccagtggtcatgtatggatgtgagagttggactgtgaagaaggctgagtgccgaagaattgatgcttttgacctgtggtgttggagaagactcttgagagtcccttggactgcaaggagatccaaccagtccattctgaaggagatcagtcctgggatttctttggaaggactgatgctaaagctgaaactccagtactttggccacctgatgtgaagttgactcactggaaaagaccctgatgctgggagggattgggggcaggaggagaaggggacgacagaggatgagatggctggatggcatcactgacttgatgaatgtgagtctgggtgaactccgggagttggtgatggacagggaggcctggcgtgctgcgattcatggggttgcaaagagtcagacactactgagcgactgaactgaattgactgaaatatctttcccaaggttatacagctcaagtttgggtcgtgcttgtctaaggattcctgtttgaatgccatgtctgtgctcttcattcagctgcttcttttcgtccatggagtaaaggaggtgcaccgagatcataaggtctatggaatgaatgagaatggatgaaaagggagaaagagattacagatcatcattttcaaggatagtagtaggtagcggaaggatacgcatttgagatctattctgaggtctgagaaacttgtgtgtgtttgtactttggaagaaaggaatcaagagaaaagagggcgacttccttggtggtccaaaatgataatagaatccagatggagttcttctctcctttggattgatgggtgggtgaccacttagaatggtgtttgataatgaagacaaatggaagtacacacataatggaagtaggtcttaagaatataaacatccgaatctaaggaaagggattagaagggaatttagaccaagtacatttcctttcagataagtgctctcctctgaatggtccagccaaaattgcaaagcccctgtcaataccacctctcattacacctagcttgatgtagcttaatacgaagcaatatgccccattaatcaaatttaaggcagtaaaaatagaatctgggagttgttatctgagtcacttttccccaggtaaataggaatgtgtttttctataaattgctttgaggtgccttgagatttctttaatcgaatcgcgagaaatgatggccaatacttatttgatggggtcgtgttgacatgtcttttcttccattacattttcccccagataataaggctccacagacttcggtattaaaaaaacacaaga

SEQ ID NO: 41624 - DNA, 1821 bp, Bovine  19866881010142
acttttgcatctaggaagtgatggagtcaaattcaaaacagcttgtctgatacagaactacgtgcacatttcatggcattctgttgccttttgattgtctgagtcattaatgcactagtaaaaaatggatgacgctctgaagtcagagccataagcaagatctcctctggataaactttattctcacacatggctaaaggcagttgtatcttaagtcatcaagagtaacgtagaccaattagattaataagatacaatgaaaataataatgaccaagcacttttgcttgtgagctatccttttttttttcctctctaatcacaatatgtatctacctgtctatcaacctatctatgttctcagttgcttacttgcaccccattctttgagactccatggactgtagcctgccaagcttctctgtccatgggattttccaggaaagagtactggagtgggttgcccatttcctactctactctctgtctatctaattgtctatctacctaagtagttcaggctaagctttgcagctgaatatgaagaataatggaatacgcaacacatgtgtatgtgtgagtgtgggtttgtgagtgtgtaaaagagagaaagatggagaatggtgacagtcattggaaagtgtgtgagaggctggctttggtcaaatgctaataaaatgtgtaatatatttattgggcacagccacttaagtggtcacgaacatgatgtgagcaagtgaattgcccaacgtagttaccaaaagggtcttctcactatgggtgctgtatctgagaagtttcttggaaactgaaaaagattctgtttgtttcttcctgtaaaaggtttttttttttttcctcaccagaaaaatctagagattgtccataaatcaaatagagaggcagcaagaagcagaatgagagattctgctgcccctctgggttcttacatttttactctataaatataggaaaagatcagttctcctcctttgaatcattcttcttaactgaaggaaacaatatctcagtgctgtctccaaaactgattaattttgcataatctggacagataaaatctccttcagtgctgaggagcatgaaaagagtttagtgcagtgtccttgccatacaattagttattgatacaaatcttctgactgcctttgaagtggaattgaagagctttataataaagataataaagctatgaaatgtagactccatattggctgaaattagataattagcttaggatttctccaattacatatttaggagcaggagaaaaatgaggacctgatgcctagcaacacaagctaataatgtaatctatacaaattaatgagtgtacacggatactcaagaaatgctaagcactgtagtgcgaagatggagtctggattaacagaggaagagtggttaaaacacacacacagccagcataaaacaacctacccttagaaaacagaagaacaataaaaagtcaggggaaaaaatgtattaaagggtgcagaaagcattctagaaccccaaacaaaccactccaggtctatttttaaatatagaaaactctaatacaattgatttgtattttccacataatgaacttagaaattagctttgtttttaaagctccagatgaaaggtgttgactttctcctcatcttatctaaatggcacaggtatcatgatgatatttaagggtaagtgatcccttcattggcactcagccttgtatatgaaatgggcttcctaagtggctcagtggtaaagaatctgcctgcctatgtaggagacacaagatacatgggtcaggaag

SEQ ID NO: 41625 - DNA, 1342 bp, Bovine  19866881051039
ttactgctgtggagtattatctttcatacatagtattttagagtttataaagcagtttcatatatacaattcatttaattctgctagctggtgtaaagcaggtattaatatttccccattttatagatgagggcacagggctttagaaagtctttgcagtttgcctaaattttcacagcttgttgctggatcttggaactaagatttctaactacaagtaatctttccaggtagcatgtttatccagattgacagacgatgtcaaacagggtattcctacagaaacggctcatttaggaacatttgaatctttggccctttcatcatcttactgaagttttgctcccaagggaaaaaaaattgcatgtagacacagaaaagtcttcccaacaatcctgttctctaacgtctgatttttcctttttccctttagcacaggaagaaaagctaattgaaattcatgccacggtcttatgaactatgagtcagaagaaaagaaacacttaatcacttaacgcaatgattatcttttcaagcaagcaaaagggaataggttggggaggggcagggaagaggagagcttgtaagatatcttatgggaaactctttggaaacacgactctttgatctttgcagtttttcggagccctcctgtgtaactaaatatatacttctttcttatactgtagccaataaaggggcttcccaggtatatcagtgctagagacagcaagagactgggtttgatcacggggttgggaagatcccctgggggaggaaatggcaagccactccaggattcttgcctggaaaatcccatggacagagaagcctggtgggctacaatgcctggcgttacaaaagagtcagacatgactgagctactgaacacacacacacacacacacacagagtcaacaaagagaaagctgtagttctatatttgctttgatgtcaaaagacaaattcaagtgtgtgtgtattgatcacccagggtcaaatctttatgagaatccatccaactgggatgatggatgcattatccatttgggatacctgggttccttctatgctgtttacaaggccaagttagatttgtttctttgagtcaagcttagttattaggaggacagactctgtccttgactactttctgcccatcctcttcgcccatcaactgttctctcctctgtaggtaggctccaaagtcatggtttatgtctgcatgtagtcacaattactctagaagaatccccctggctccccatgaagaacacattctctgagcttatgcagattgcactgtcctagtaaatccagttcgcagccagttttgccctcc

SEQ ID NO: 41626 - DNA, 1644 bp, Bovine  19866881111997
cagcaaataagcaaacatgacctagcccttcttgaaaaatactaacagacatcttagttcctaaattttgttagtttcaagcttaacattttcagattgcctttctaactccttttccttttgagaatgtgttcatggacatattttgtactaggcttctgctatttctcattctttaaaaaaatttgtttattatttcattatttttggttgtgctgggtctttgttgctgcgtgggctttctctagttgcggcaagagggggttactctttagtcgtggtgtgcaagcttctcattgtgatggcttctcttgttgcagagcatgggctccggaggacacaggcttcaggagctgcagtgtgagggctcagcagttgcaacttgagggctccagagtgcaagctcagtagttatggcgcatgggcttacttgtcccgcagttgtgagatttttccagaccagggattgatcctgtatcccctgcattggcaggcagattcttgatcactgagtcaccaggcaagtccccttatttctcattcttgactgatggtgcgactgtgccatgagaagtgcttcttggttccattttttcttggatttgtcacaagactatgatatcaaatatttaaggtcctatgtattctgtgaataatagcacagtggatgagatacaatgaccttttcagtattctgtattgtgactagctatagtcaatccattcatttcactctttttatggcctccctgagctggagagaaaagagtgaatggccatccgaatcaaaatatgatgtgccaaaaggtcagaatagtaaagtacactagtatatttcatacaatatattaaggcattaaaatcctaatatcttgccctggtgccagaatctataatgggaaaagaaaatggcagtttaggaatttgtccttgtgagaactggaacagatccaaatggagaatgactatttctcattttaattacagtaaaattttattccctatattcgaaaacctaaagatggtgttacatttttaaaagcatatgtgttgggagtttgttgacacatttaatctcaccactaaaggtgagacaacttgtcttctctaagctcctgccatctggtagattattttctatagttccccgcatctttctaattttatctcactcttaaaaaatatgtttatagtgtatatgaagatacatacatagcaagatagatgacaccattgcttttcttatttctttcctttgctttttatatgtgattaaaaagtttaaacctaatttcacaaataatcaggtacaatgccctaaggtcagaattctagctcaaggatattgttgcttttatttaactcttctaatcttatgagaactgaaaattcccacacatttttatctagggttatttcaaccaaaaatgttgtcaagtgttgagccagttctatggatacaatagtctaagaaaaaattctcatttcagtagatgttataaaattaattcagatcaaaattttctatcaggtccatgctgaaatttatactgaatcagcaaagtgtggtctgtatatttgtgcttgtatgttctccctcacaatacaataaaaatatttattttattaatgagaagacatata

SEQ ID NO: 41627 - DNA, 765 bp, Bovine  19866881130882
aaaatgtatatgaaaagtatggtgtgagacagtgtgtgcttctatgactaactatattaatgaaattaattctgagacagttgaggtgactggaggctagctcaaattataatgtagtgttctctacatatcagagggctggaatttttaacaggcagatacccatgtattacatgtaacatctgagaaaagtttatcttaaaaaataatttgatagcaacctgcagcgagaactgaaatcgggagatttttcagatgagtagccaattgtgttctggctgactagagtaagtaaaccttctctctccttactgatctgcttaattggaacgggaggtgacagtgtgagggacggaggttcgctttgtacatgtatcgcatagtaggaattattatttgtaggctccaacaaagagaatggttctgaatcctaagaggtccacgaggctggatctgtatgatttattattcagctaaaacctctaaagagggaaataagacctcgttgtcaactctgatttatattctctcattttgcaattcagtgagcgagtcaggtgggtattgccgaaaactggttatggatttcacccaaagacgtgggattgtatttgtattcagagtttcagcttcatgagctttgtatgattttatttttagaccttttctcgtatttaatttttatttatgcatattcttcacccactcggaccagaatggcaggacgtagctgcttaatatttaagccatttttcatgcatcgct

SEQ ID NO: 41628 - DNA, 1091 bp, Bovine  19866881230528
atcttcccgatgcagggatcaaacccatgtttcctgcattggcaggtggcttctttaccactgagccatctgggaggcccttgaccagggatcaaaaccacaccctctgctttggaaggcaaagtcttaaccactggactgccagccaagtcccacatctttgcacttttatctatccaatccctcacttggttttctctcctaccaactgctttaaggtcttttgctcaatagtgtgtatgtgtgtgtgtgtgtgtgtgtgtgtgtgcacgcacactcacgctcagttgtgcctgactctttgtgaccccatgcattgtagcgtgccagtctcctcggtctgtgggatttcccaggcaagaatactggagtgggttgccatttcctactccaaagactcttaatgacccagggatcaaacccaagtctcttgtgtctcctgcattagcaggcagagtctttaccactagggccgcctgggaagcccttaaagtgacactgattaaaataggagcaacagcacatcttttatcagggaagatttcagacttacattagagaggctgctaagaagaacacccatgatccactacccagattcaacatgatcatcttgtttcatctctctcaatcacttcttcccaccacccctctctgaaatatttcaatgtgaatcctatatatcaactgatatcagttgttcatgcatgcgtgctcaatcgcctcagttgtgtccgactctcgtgtgaatttccaggtgctgttctcagagtatgatctggagccccctgagggttcccaagactctattaggaggtctgccaggtcaaaactatttttataataatattaatatattgtctatctttttcattctcattctttcatgaaagtattttggagttttgcaacagactgaatgcagcagcagatctgagaatccagctttctcctattaaaccagatatgacagctgaaaatatttacaggaaatgtttaccaaaaaatatgggcttccctggtggctcagacagtaaagaatctgcctgccacacaggagacggtggggtttgatccctgggctggggaag

SEQ ID NO: 41629 - DNA, 1663 bp, Bovine  19866881259780
tatgcaactccccggagacagaaggtggaggcatacccaagatttatgtgcgatgctggcaggaggctgtaaaagcaggctgtgtctggcccctacacacacacacacacacacgcatgcatgcatgcacatccctgccaggctgcagaggtggtcaagagaggaaattctacaaaatcactctgagccggtaggtgggagacccagcttcatttcccagttctgccactaacaggtgtgatcttggggtttaagctcctctttgcccaggacttccttgtgtgctaggcaccgtgctgaccaccttatgaaatgttcatctgccttagtcctcagaactgccctccagtttcagtattagtctgcttcgtaaatgaggaaactcatgctcaggcggttaaagatgaagtcctgtatccggaaaaatggtgagatgggcttgtccgatgacagttagcaagggtctttcggattccggatgttggccttcccagattcttattccttgaacgggatcatctggggctcccgtggccacccgcaagcagccagacgcagtggtgttgcagaacgggctgggagctctgggtacgacgggtttatttttttttttttgcttggctggagttggtgaccacatgataccagaagctttccccccgccgtggggctgcttggcgccacctgttttccttctgcagtcatctgccccttcgccaccccgccctctgtcctgcagcccaaaaccggtgtgaccctggcgtctcatggttcctcagccttgctggtatgtggcagcctgggagcgcctatatatagaaagacacacaagcacagaagccacttcctctgcctgcgtctcagtttcctcctcagccaaaataggcctgtgactccccgctcctgacctgctgagctcatcggcccaactccccctcactccgtcttccctgaccccctgccaccccccgccccaccctgccgccaggagcaggagctgatctctgccctacacaggatggaaggggccccgtgaaatacaaatcgggcaggaaagaaacaactctttgcaggacttacccgcattgtttgttgcaaaaggggaaaagccaggaagcgcccactggcagtggcttgaaatgggctcattgaattcagggtatttttagctgctttgctcaccccagcagctgagaaggccacctgtcccgagttgttggcactccatccccgctgggatggcccaggatctctgcttttttgctctcgttttccttgcaacccttttggccccgtttcatcccaacctctaccttcctgatatggaaatctacaggcagagtgaatctagagcgtgactctgaagccttcactgttccaattgatggtcctgggctctcagagtcagcttctggagaatccttgggtaagaccattaaatggagccatccagacagaagggcccccaggcgtcctatgccagagcaagcagaaaggcactgcgtgtactgcctaattgtagccatgctgcaggcgaagtaggcgaggctctgggagatgtgacatcccctctttctgagccaggaagccggcaggcttctcgccacttccttatttactctgtatatacctgctaaaagagcagcagtctgtccctcaaaag

SEQ ID NO: 41630 - DNA, 1419 bp, Bovine  19866881281691
ctgcaacacaggagatgaaaagttcagtccctgggttgggaagatcccctggagaaggaaatgacaaccccagtattcttgcctgggaaatcccacgggacacaggggcctggcaggggcggactgtagtccatggggtcgcaaagaagccagacgtgacttagcgactgaacaaccaccaccaatattgtcattcaccttattttattagagagggaagctggaatccaaccatctctgcacagaacgcccataatgactgattgcacagcctgggagtattgactggcaggggcgagcagggtgcagagtgggtctgctggcagggggttaggaagagaaatttaccttctcactgtgaagttcacttaaaaataatataaaagcacatttagcgatgttgtagtaaagaggatcccagtaactggaatttttcacagatttctctgccacatactcataatgggtggggtggcaggtggccaaaggagggggccaaagctcccacagcggccccatgcaaggaccaaggccttcccatcccctctccatccatctctgactctctccaggtgggcagaaatgccactgttcattagagcaaatgtttcaaactccttttaagagatggctcacaaaatgatcctccaggatttacttctgatggccaaattagagagctggaagtttaagtgaaaagactgaaaggccctaagggaagacagctagagaaataaagaagttctgacactgagtctgggatgtctgtcctcctgagagctcctttatgtaatccataatcgttatcaggctgcctcgctccagagccccatgctaccatcatgatgctaggtagctctgagcctcgtgttctctcatctttaaaaaaatgaaaacattttctgagtcagtgtttgttaagttggatgccaacttcggaatcgcctggggagtttgtttaaaattgcagaatgggacttccctggtggtccaatggttaagaatccacctcccaaagcaggggacatgggttcaatccctggtcctggtaataagatcccacacatacaggacaactaagccccaggcaacacttagacagaagcccaccccttactgcaatgaagagtctgcatgctgcaactaagacccaacacagtcaaaaataaatgtataaataaatattttttaaaaaagaaaagaaaatgtagaacattggaacccacttgaaaccaagaaaactggaaacccagaatctgtttttgtaatagtcccttcacagtcaagttggagagagaaatttctgtgacacacaactcacccacgcagaagaggaggctacagtccatgggatcacaagagatcggacacaacttaacgactataccatcgccaccaacctgaaaagtcagttaggga

SEQ ID NO: 41631 - DNA, 1826 bp, Bovine  19866881339537
atatgtatatatggtagctatatataaacatataaaaatgaataaatataaatagatagatcattcctctgtccatggggattctccaggcaagaatattggagcaggttgtcatttcctccttcaggggatcttccctgccctgggattgaaaccacatctcttatgtcccctgcaagaatactggagtgggtagccattcccttcttcaggggatcttcctaacctagggatcaaacttgggtcttctgcattgcaggccaattctgtactgtctgaaccaccaggaaccccatatatatatatatatatatatatatatatatatatatatatatataacttcttgctatttgtttccaagatacacaatgtcagatgctccgctagtggtggcagtgaggggccatgggtgagggggtggacaacgggaggaaggaaagaatgtacctgaaggaagaggggtcggacaggaacagcgtctcggggtgagacaggggccaggcagatagatgctcctcatcccgacggcgcatgtcccgggtaaagggattgatgagcacaggtagcctgtggcctcttggcctggcatccggtcccatccctgttacctcaaggccttctaaaccactgagccgacagcaattcatctggaaggacagactccatgaccttcctgtatcctcacgctgcattctttgggcgtcgagtcccaaccagtccaggactggtgaagctctgtccacacgcggcttttcgagaggcagatgaaacctttcgggtcccgggtagctcacctctgtggttgttttgcccatttgctataaatgactatctctagcacttggttaattatgtgattacagcacccagtgacaaggagaaaattaaaaatccatgctgcattttctagaacactttattgctctatgcaaaagagggcaaaggcaatttagctgagctgctgtgaacaagagctgtttccttccccttgcttcggcccctccctcacttcgccctggggagaagctgagttcgcagctgactaaagcaggaaagagagcaggtgtggaagaaaacataaattaccattatctgtgacaattctgggcagggccccccacagagaacgcgctcagccagatggtgtcccctcctaatttcaataaagcccaggaagttgtggactttgggccagtgcattagtgtccaacacagactcagcctgggctccatgtgtgatctttatttctttatgttcacctgttgtgactgcgcttccttagaaaaccccaggaaggacttccctgctggtacagtggataagactctgcctgccaatgccggagacacaggtttgatccctggtcggggaagatgccttatgtctctgagcaactgagccaatgagcctcaactactgaagcccgtgtgcctagagcctgactctgcaacaagagaagtcactgcaaggagaagaccatgctctgcaactacagagtagcccctgctcgccacaactagaggaagccctctcgcagcaaggaagacccagcacaaccaaaaatataataaataaataaaaattaaaaagaaatacccaagagacaccaaccaggacgccctgctaatatgtcaagactacatatctcagagctgagaaacccgagttggcctctgaactctgccccgtgcctggtgtctgctcatgaccagtgctcatgacctctaagctttggtttcctcgcttataaaatggagtttgaagatgcacatttttttcctctctcacattttaccatctctgaaatcaggatgcccttgta

SEQ ID NO: 41632 - DNA, 1141 bp, Bovine  19866881397483
tcagtctcacaaataaacccagattcaaggaggtgggaaggggaaagcctcaactctttgatgggaatggatgcaaagtcacatggcatagcacccatggccagggataccaatgtagaaaggggaataattggagccatctttgtaattggcctgattgatgatgctaaatacatttcagccaaacgaatcagtggccttaaaggacacctaatccctcaccactctaagcttcaatgctctctactacatcttatccaaattgtcacccagcttttgcttgagcaccatccataataggaaattttaccttcaattatagcccacttctggaaccaatgaactgcattaaactgaagaaattactcatctgtttttctgtgaaatattagaatgatcttcaaaattcataatagatttaagagtatgtttttaataagatgccgtgcatggtttctgaaatagggatcatctctccttccttctctatctctccccccgccccccaatcccctgtcaaattagtataaaggattcatgtgtttttgagaaccagtgtactacaaaaacatctacccagattttgtcaaagacccagaggtcagaaactgatgcactccagatggtgtttttttctgtatggcttttacgatggtctctgctatagaacagttcctgctgcgctgaaagaggtacttccaaagggctcacctggcatttccaaagggcactgcagacattctgagttttcctggtggcgattctgtgaggtcagggagagctttccctcttctcaatttatgggtagaggtttagatgcgggaagtgtgccctagttcacaggatatgttggtagttgaacttccataaaagctcacggcccgagactctgtcagtttgctgacctgtgcttttataggtaggtgacgacaggttgagtccttggacttggcttctaccctgaagctctcactcagctgcaagtcagagtctagactatacagcaaaaagggctgtcagagtcttctcttttagggttgggttctgatctgcttgtgaaaacagtttagtgggttgtagacaagcattttaaaaagggaaacagagtagagataaaaagaataaaatagaaaatagattt

SEQ ID NO: 41633 - DNA, 2236 bp, Bovine  19866880420336
ctaagaactaaagcaagatggaaaaaaaaaaatctaaattcattatttggattatgttttactttataaatctcaacattccttaaggaaaaagccctgtagttttactagtgctcataaagaaaaagtgtactataattttcagaagcaattgtgaatttgaacaccttacacttctcaagaaagatctgagtttagtcgacactaccaggaactgatgtcaataatcaagataaaatttccttctaaaagcaaaaaaagtaatttctgtattaaattgaagtgagatctttgaaatattctaacaatactaattttacttttatgctctgctttaaccttcacattcatcctatgagacagatagaatttgaaatcctatatataggtgttggagattgggacttggaaaagctgtgtaacctgttcaaagttacctgaccattcagtgacagagcctggattggaacttgcacttcttggttgctgtctatttatttcatgatcccgtagttcatcagatagactagagaatgtcacagtagcaaaggaataagaaaaaccctgaattcagcttcttttagtaaccttgaaggaagctgccagtgttccaggacccaatgcaaaggcacttgaagacggcacacacactttgcttattagcaagctgatcaggctcatccttgtggaactagtcggagagaatgctcaagaagtttcagctctaaaggcccttgtttcccaagttctttatctttgagttacgagataagtagcaacaaaactgtgcctatcacttcctacagaatccttgctctcttttctcatatcccctcacccagcttacaaaaggaaacacaaggaaatttaccagcctcactcagtgggcccatcactgggagcctttgcagtccacaagtgtaatggtccctgatcagttattggaacagatccattttccacatttttgtgaacattactgctaactgccttatcagaggggcaagaatttaggcggcatagcccacaagtttatttttcttagttaaaagtaagaacatagccagacagtagtctggggctggggtggtaagtcaaaggaagtagaagacacaaaagaaatgagggagagagtggccacactcagctctagggagccttagatttcttttgttgttattttctaatgtctgtgaactaacaactgttaatggaattttaagttcagctgagtccagcaatgttgaatctacaatgaagaagatcagtcctattctaaattccaaaactcctacctataatattgatacatttccccaaaccttattagtgcctccaacagactgacatatgctataggttctttgacagtgttggttcacaaacattgatgttgaacttgagatcagtggttcccaacttgaactgcatataggaatcccttgagagctttaaaaactactgatgtctggaccccagccccaacagtactcctgatttagttgagttcgataaggcacatcagatttaaactcccacagtcttgtagacaagactacaatcctcctgctgtagaacaccagacctgagatccagatatttccctgcctacagatcagaggattccgtgggcagaattagttagggttccagtgaacataaccatgtgaggtcttctgcagttctgcaaatccactttttaaaatgatgactggagcttgaagacagaagtccaccctagcagacccataagctacacttgccaacaatacaaaacctcacagatttaagtcaaaactacaaagactctttccatctccttccaaccaacaggtagaattatgcggccaaggaagaacccttcttgatctgctccttgcttcctggacatgattttcagtcaaactatacttaaacacgagagtacatcttctgccctataattcaggttgacctggaagttatactatctcttcccttattttgtgccaaccacatgcatctgacactcagaggaataggaataggaataataggaataattcaaaattttcagaattagaggtatagctaattcaactttaaaggttttctaagatcatgcatttagcaaagggcctaacatctccacctttagtacacttaggaatacgtgagtagtaaatttattatccatgttacatagaagtctttgtggacttttccagagtctcaaatctaatcatgggtaagccaa

SEQ ID NO: 41634 - DNA, 1039 bp, Bovine  19866880566015
tagagcttgggggtaagaaaaatgggtgaaggtcaaaaggtactaactcccagttataaaataaaccatggggatggtataatatacaatatagttaccacagttagtaatgctgtattgcatatttgaaagtcgctaagagagtattttgtaaaagtcctcaacacaagaaaaaaaaaattgtttactataaatggtggcaggtgtaactagacttattgtggtgatcattttgcaatatgtacaaatattgaatcattgtatctctgaaactaatgttgtatgtcagttataccacaataataataacttggtctggaaaataaaaagcaaaatagcagatacaaagtttttagaatcatgaaggaaagagatcagatgatgtgatcaccagatttaaaatattacaagaggtgctgaggaagagaggaaaggtatgacaaattaagacatcctgtttcacacccagaactcacaggagtttgtaaatagattttaagttaggtgaattcagatctgttactacctctgaagtaaggaagaaaatgatctttttttttttttcccctcacagtgctatgacctattctggaatccatctgctgagatgctttatagcagatataacaggaaatcttaagactactggcttctaatttagttgaagattcaaaattgtttgtgccaactgcagttaaagacagaatttcaacattgttttaaatgttgtgtatctgtaacttgcagaaggatcacttcagctttaaaacctgcatatgtccaaaggaagaatgaatttgtgcctataggggcagaaaggtttatacatgattgagttatgctgttcattagaagagataccagcagtttttaacaaactgacaaacaagaccatatagaagtccataaaatgaaaatctatttcctaccgtgtagatgatagagtgttagttactcagtcgtgtctgactctttgtaactctatggactgtatgtagcctgccaggctcctctgtccacagcattctccaggcgagga

SEQ ID NO: 41635 - DNA, 1624 bp, Bovine  19866880569734
tttttggagtcaatgaccgatttgaactaggctttttatttttctctatggcaatgactggagaattccatggtcagaggaacctggctggccacagtccatggggttgcatagagtcggacacgaccgagtgactaacacacacacacatagcaatgacgcagttcactgtgtcccaaaaaaatgctctaataaaaggaaggaacacaccaattttagagttaaataaataactaaaactaaaataaaattttaagtgaaataaagcttaagcaaagaatctgggtctgttcccctggtaagtcacagtaatgactcatccccagattgagttggcagtcttcttccaggaatgactcagtagcttcattcgaacattgctccttctgattcactataaccagggtgggcagagatggggtttgatcatctttggaagagtgactttcaaaatgagcttatttatttatttgtttctatatttgttcactttggaaacattggttcaaacaaagtactatttgaatgtgtgcaactaatgaaagcagttctgattaactcgggatggaggctcagatcctccaccctttggttcccactgatttctggtcacatccatatttattcacatttcatttgccttaagacaatgagaaacctatgcgagtcgtggatgatgaggacttggtagaccagcatctcatcagcgagctgaggaaggagtatggaatgacctacaatgatttctttatggtgctcacggacgtggacctcagagtcaaggtatgggttcctgtttgggatagtgcagtgccattccttaagagagaaactcattttggggggatcagtgagtctattacacatatgactgagcacaaattatttcataaatgggaaattttggaaatggtccaaatagttaccactgtcctccagaatttgtggtctatggaaaatattggattggatgaccccctgtagctcagttacttgactcagactaaattcttctgtaacattaaagtcatgcattcaccagacacttgttgaatagctatgatgtgtcagaccctggtgataaaaaatgaagagcatttagcttcggttttaagaaaactcagatttaatataggcatactttggaagaacctggaaatttatctcctgattcagcatgggcaagacggtagggctttacacccaatatcttcctatgatagggacaaaagttctgaaccatgaaaaattatgccatgtagtcataataataataataacaataataactaactttattgagttctttcattatgccaagcactcacctcaaatgtttacaattcttatctcaaacctctaagagaaataacaaatattatctttgtttcaaagaggccaggaatctagagtcgttaagtaacttgcctaacttcacccagttaatgttagacttcatatgcacacagattggttccagagcccatgcttacatgaaaatccttaggaaaaaggctgcctgggctattagaatacctggttcagcctgaagcatttttctggatctggagagagatcccttcaataattcattctgcttttgtgttttgccacctctaatgtg

SEQ ID NO: 41636 - DNA, 1329 bp, Bovine  19866880725366
ttgattctgaagtgggtctttgtagctgttttctgaatccctggaataaagagggttgatttgcgatggaatctccagagcctgcagtcatacattacaatatgttgtaaatccagagggtacaatatagatttcacagggggccctgaggttaattgaaattccatctgtttcttctctgtggcaaacttagtatcctgggatattagctcaggataagataggggatttataacttttttatttttaggctaaagtagaagtttgtctaaacctgctcctccctatgttctacctcctaccttcacattaaaagaagtttacaagacagcctttattttccccacagctgcccccgagggagcccccccttttttccagtgcatgccgggcaatgccatgtattcttagactcccaatggcccccattactgtcaattagttacggaatgctacagggattcatgcctgacagcccgggcaaaggcaggagaaatgggctcagtagggagcgaggggcctgattcttttttgtgcacaagaaatacctttctcagcaaggcttttaatggccttcccttctttctttccttctgcccaagcactgcgccccccacgatcccaacgcacatcatgtacacataggatcctatgttcacacccaacgtgtttgtgtgactgttgcaaaggactgtgagaactctcagagcggaaggctctgacgttttcttacaatctatgaaaattacttgagctttaaaattctgacttatatctttgctataatctgattcctaacttcctttcttcagaaggtttcttgttactaaaagcctcttttgcctctttctgattagtatcttttcctccctctgaagaagaaatgtactctctggtctcagaacttgggtgggagcccgctgcaccatgatggccgtggctggcatctcctaccacgtccatgtctttttgacttccgtctctacttcttgccttcctctcctctaccttccctcatttccccctttgccctcatatctgtgcctgtatcattccacttacgctggaggcttgaggctaggagttttgtttcactcatttttgttctctctttcattttgtacccacaccaaatatctacagtggaaagacacagagactttgtttcattcaccaaaacacctgcactccataggatagcatctggcacaagcaggagctcttaatatttgttgaaaattaatgtactagttaaaaatcatttgcaagtcattgatggctctcagggttaaggagaacccagcgtcacaccaaaatggtttgcctatt

SEQ ID NO: 41637 - DNA, 1385 bp, Bovine  19866880771237
catgatgatgaaggaaatcattaaaaaattgatttgtaagcatctttaacaactaatgttctgattttaacactgtacaaatcagattttatcttgaacctaggaactgctatttttaatcctcaacatacattcatttttgcttttattcatttgaaacttcttattaaatttatccagattctgccaaagctctctagtcttcgtcaagggtgacaagggtttaaaagcaaacattccttagaatgctaagtcacttcagtcgtgtccgactctgtgcgaccccataggacggcagcccaccaggctcccctgtccctgggattctccaggcaagtacactggagtgggttgccatttccttagaatacatcctataaattgtccacatggtcccaatccagctaaaatgattcatagatccaagcccattttgtgggatttggtcatttcacagaatctgcccctggacctaagatttttgaggagggacagcagggagggtgagctctgctgtgtgctgatgaggactggccctataaatgaagcacttgcctagtttctcaccctttaagaactccaactccaaaaagtcagtggttaaattcaggtagtagtaagtttcttcatgtatttgtttttccatgtctgactatagacagcaatgacactgcagaaaaattcagcttcaaaggcaacttattaaatacgaactgtatgccaggcattgtatctaaagcctccagctgtgactgctgcctctctgtgatacccatggtttctcctcctcctccttctcatccctaaattcaggccattcctccagtgtcctgggacaacttcagctctctgtttgcttcaggagctccaaatctgctctggcagtttttcaaagtaggattcactgtataccttcatcatgagcacctggagtgcatgtaaaattacaatccttggacccagatctatctggctcatggcccgaggagcaccaatcagttgtctcagggccaggaactggacaattaggtaataccctacagccccaagcctaaccagctgggtgaacaccttgtgtttcccatggaaaccccaataataaccatggtctaggctctctcttcactctggcttctgcttcctgaccaaaacttggtgttcctcccatgaccttgtgaggtgtggtgcagtttcctctttgggtaatgaatgagtaatatattccattttcctttgacattctgactttgctgcaccaccagaccttaataaaccctgtcctgaagtaatgcacaatgtaaataaaacatacttataaggcacttaaaatataattatcctattcaagaagtcaatatagaccaaaaatctcttggttgcatttt

SEQ ID NO: 41638 - DNA, 1231 bp, Bovine  19866880843049
ctgcagtgaatctgtagattgcttctcccaccccaccaccctctattttgtggcagaaggcaccgtattctaaaatgttttaaccagaaacaaacagaataaagaaggaaaaagaaataaagcagaaattatgaaggagaagagggtaacatcatctgcagggtgtgaacgtgcgagggtgagtgtgcaggcaggtcgggcagaggcaatgaggacctggcctggctacaaaatatctgagcttgtggagtgggcagaggtgtccctgtcagggatggcacagcactaaggccatgttcagaaaagagcagtggggcagctgtggctggagccaggttggaagtgcctgagaaacgtcaggtgcagcattatcatggcacctggtcccctccctatctgtggaagtgcggggcttgtgcataggatttgctggatggatcagagtaaaattgcaccagctgggctttaattctggattgcagactggtccctaaccccagcccaagtttggcagggggtcatatgagtggagaattattagtattatggtctttatgagcgttttaaatactctgtgttttttgtattaaagtgtatacttctagaatgagagatcatgtttggcttctgtcacaaaccacgcatcaaattaccaaacacacacacacacacacacacacacgacacaatgcaagggaaggaaaactatccatgaaaagatccttgtgtctatcctggttgtacagctctgtcattgatcaaattaggataagttacttctctacttccccatttataaaaatgaatatactgatgcatgtttcataagaatcatttaaacagtatctgggatataactcaattgattacaattagatctgaatagtgggtcaaatgcatatgtttctctggagagaaataaatgtatataagcacaaatcaggaagtttagtcattatcacctaactcaccaaagaggaaatgcttcctcttaagtttctcgtgagctgcaaacacagtggagttgagagcaggggatttctcattagtgcttatgtgggagatcaggagaagaaaaagactacagctaggtatatggaaggaaaagagagaggtaaggataggaagaagaagaagggaactcccttcagaaaatgtcttcagcttttgggatacttttcacaatttttctccctttcacagctggtgagtctgttgggagtggtggtgg

SEQ ID NO: 41639 - DNA, 821 bp, Bovine  19866880874606
tgaaaaatgtggaacttagggttattgcatttccttccaactcccaatttttcttaataagctctgagaattttatccaggtccactatagtgtatttcatctattctaggactcctatgttttcatattacaatctgaagttggggtgtgttaagcaatggcatgttaatatagctgctgcctcctggcagtaaggatgaagttgtctttgcttgcacaagctggcatttggcatgggcatacaacttcttgatatttcagtcaccaaaccacttaaagaccatttgaggagagaataagtgtcctggttgttgtctgaacgccttttgtgatacctcctggtaagatcaagaacacgtcagcatcaaattttacagaatgagtgtcaatatcttggaagaagatcttggagacagcaaagaaactctcttaaaatacgttagcatcatcacatctctcattggtacagggaactatctgcctggaaaacctcagacatcgacaactctgagcgtcaagaagtgattcaagagattcaggctggaagatgttttagaaatagtttaatttatttaacttgtagtttccttttttatgcaatcagaaaatgctacatgagaaatacaaagcctttaagactctttaaacaagataaaaaaggacaattttaaatgactggaaagtgatatatttaacagtttttcttagcatgacacaaaatggtggtcccccttagatttgagctgtcctggaatgatgaaattcggaagttctttttaaaatgttttattatgtacctttcctttcaagaattaacagt

SEQ ID NO: 41640 - DNA, 923 bp, Bovine  19866880880281
ctgtggcggattcatgttgatatatggcaaaacccaattccaatattgtaaatttaaaaaataaattaaaaaaaaagaacagaaggaatagaaaaaaagaaaatgtttattattcttatctagtttccttgggagatgaaactccattattgtatttcctgaaattgagacaatttgggccccttacttagatattgcccctatgtaatttcagaggcaataataaagaaatacatttttattggcaattttaaactgtggttcaccttgccaacaatttaaggacaatgcacatcagcctggttcttgcacctgccctcctcaagcagctggtacagactgttctagcaaagaggaggaaagatgcccaccatgggaggaggggtgaactggaagcataatttatacaataagaaaagtatgctctgaagtcacttgtactttctgaacttcagttacctgtaaaacaggtaagaatgaatggtctttatggagaataaggggcaaaagaaataatccctcaagttcatttgaggtagagattccacttttactgtaattataagaaagttcagatgaagtaaaagacagagttgtgcaaataggcacaaataagttaaatgctagtggtattcacatgtgacttgaatgcagttattaatatctggactcactaaatcaataaccaataatcaagattatttggaaaatcaattttaataacagtgacaaaaaaaataagcatccccattactgacagaggctggcactgtcaggatgctaaaatccagggactctgactgcctgccttcgggcaagcttgtagatattacttggtcattgtttgctggtaaaaagtaaaatagtatagaaggaaggaggggaaagagggagggaagaagggagaatatttagtttatatc

SEQ ID NO: 41641 - DNA, 1113 bp, Bovine  19866880898968
ttggttttcgtcatcccaacctctcctacctttgcaatctagtctctgccttttcctcctatacccaaaccctacccccaacatcagctttcaaactggcagttattaaatatagggtttattatctttatgatgatgtgtgtgcaaggatgaatttaaatgacacccttccatgggcctcagaatctcctctggagctgtactcacagtccctaagagaggagcctggacacatatctaccaaatctatcaaacattgatcatactttgttaccaaacctctaagtccctcaatgactcccaccttagatgcttacactttgggcacaagcaggtattgggctgtaggcaacagagcccaggtaacgtgttgatagagcatagtcatcaagagaaaatatggatttaatttaaagactgaatggagtagtgacatttctggtattatccaggctatagagatatgtctgacagtaggagaattttctgggcaagggaccttcccactccattaggttgcatcggcaacctgcagcctcccaaaactccagggccctgggtcattgcaggcctgcctttcccccagggttccccaccttttgtcctgtgctgacgtccgtccatcagcacagtggctcccacgggcaggactcttacttggggttagggagtgagtgctgcatgttctcctagggcgtgtgagtcagaatcccctggtgaagcactttgaactgcacccctccaggatgattctgatatccacccacctccaaggcttgcacctactgtttgataagtgccacagagtttagggctctggagagcagaacaggagagacttctaaattagccacacgtcttagagctgtttctccacccaacttggacagaagtctcccagacagattatgtcagtgcagctagagaggagacttgttaaaatctgtgctctcactggctgagaaaatttttcccggaaccctcagggactgatggtgggactgtagactggcccagtcattttggagagcaatttggcagtacttggtgaaattaagagtgcctacgcccctgtgacccagccccaagaaactcaggcacaggttcattaag

SEQ ID NO: 41642 - DNA, 2732 bp, Bovine  19866880955313
tacttttaattgatctaatagctaacagggttcaaaataataatagccacactgttttcagttatacaattgaattattggttgtttatatataagtgaaatgaatgacaacattaatacaaggaatggccaaagttgagaatattagtaattctgaatgttggccaggatgtgaaacaacatggaccctcattgactgctgacaagaatgcaaaatggtacagcaactttagaagacagtttggtggtttctcagaaaactaaacatacttttatcatacaatccagcaatagtactccttggtatttacccaatggagctgaacagcacatgtccacacaaaaacctgcacacaaatgtttatagcaacttaattcataaatgccaacatgttgaggcaatcaaggtgcttttcagtaggtgaatggctaaatgaattggtacatccagacaatggaatattatccagtgctgaaaagaaatgagctctcaagccaagaaaagatactgaggaatcctaaataatattaaagtgaaataagccaatatgaaatggctacatactgtacaatttcaactacatggttttatttaaaggtaaaactatggagacattaaaaaaatcagtgattagcaggattcagaggggaagagaaagagaaagaggcaaaacacagatttttaggtcactgaatctttgtatgatactataatgataagtatatgacattatacacttgatcaaatccatggaaagtacaaccccaacagtgaactttatgtagactatggactttcagatgatagatatgcgtcgatctaaattcatcagttgaaattaacataatgctctggtgaggcatgttgatattgggggaagagggtatgcaagtgaagagttaggcggtatttgggaaatctctgtaccttcctcttaattgctgttaacataaaactacccttaaaaaaataaatcctaaaacacgaacacttttttataattagtgaatgtttaatgttatcaaatacataaggcaaccttatgattttcttcctttggacgggtaatagagtcaattacatcaacaggttttaattaaactctcctcctggtgactcagaggtaaagaatctgcttgcaatgcagagaacataagagactcgggttcgatccctggatcagcaagatcccctggaggagggcatggcaacccactccattatttttgcttggagaatcccttggacagagaagcctggcaggctatagttcaccgggtcgctgagttggacacgactgaaacaacttagaatagcagcacagttgccttgtttttggccatttatttcctgccgcacctaaatatttctctagccctttacatgagtcagaatctgctactgacttttgacttcatccaaaatgttcctccccactcccaatttctttccgctttccctggccctagattgctttctttctttcttcaaagaacaggttattttctcccttgactagatataatacagaagcgtggaagccagtgtttctcagaatattgtgaactatcattgggatcattgcaagaaaaaataggattcaaaggtttatttctggctacccaagtatgctctaatcagcatcacttcactcgtttattctgcgtgtttacacttatgagtaagattccgtttgtacaaagaattctggttggaagttgaaagttaaataaagattaattatttatcatttatatgttcttatattccctgagcctcattttctgaaaattgtacccacaattttcttacctctatttaaaaactgcaaaaccccaaatagaaatttaaggtttcctttttagccttggggctagaaatatcaaagcaggaaaagctacacaccagtaaatattaacatccgaaaattaagaattcaattgactcaataaaactacaaaccaaaaaaaatggagaaaaaatactacatttgtctaaatatagaagtttagttttattccattcgagggtccccagtattactctggacttcactagtctgtgcaacattggaataaagtaaaatcagcaggtttgctagataatgcacaaatctatcattgctactagagcaaaccataaaacatcttataaatggatcaagagcatcctcatcactattgaaagatagctttaatttttgctaaaaatgtcatagaatcagacttaccagacatcgtgataatgaaggagatcagtaacatctcagctgaagtccccccaaacttctgcttttggggtagtcggtgtttactttgatacaaatccacttaaatccgtccagatctctatctttcgatcacttttgtttactctcaattcaacagtatgatgcatcatttttcctagccattttagttggctggttaacaactgacaggaaatgtctgtgagttttgctaagtgataaggcaaaaaaaacaaggcttactattcattggttttcccacggtactgaggtgatgagataaattacacagcaatttttttttttaagttagcatttttggaagtataaattacataggtaaaatgcacaaagcttaagtttacagaatgatgaatttttatatgtgtatacaccaaaagcaagataaggccatttccattatttaagaagtttccttcatgctccgtctttgtcaatatccttcttcagaaaggaacacta

SEQ ID NO: 41643 - DNA, 1220 bp, Bovine  19866881027909
ggtggatcagatctgggggcttctgaccatgaggcataactactcacagtaaatttgccatgttcccacaagaaccgcggcgagttagaccttagctgcccaacactgagttgtatgcctcacatcatcattaatatgaaaaactgtgaaacctctacattcagccaaattcttctgctttccaaaaggatgtgggcgccgttcagtccgtatttccagtgactttccatttagtttcacagcttctctcagcccccgctcactctccccaagcctggccagagtcaaggactccgaagggtgtgtgggaccctatttatgagggagttacctacagcatagaggctaaaggaggatcagatggtgctgctcataggcaagaagactcaggatacagaagaaagtgtcagaatacctctctggctattctatatcagaatacctcccccaccctgccccactgaattacttctctccttgtcctccatcttactgactttcaaactgtagacagtttgcatatttttcattttagtgtccaaaacttaagccagaaccatccaggacagttatataagtagttaggcagactgacctttgttaccacaagaaaatagccctctggaaacccagattttccttttgattccccaccgacctctcccgtaaagcatgccccaccttagctaagagaaaatcagtaatataatcattaagttgtttcagagaacctagctggaagtggtcgattttcatggtgctgttgctgacagggccaaagatggtgatcacggagactttcctggtggccatcttgcagaaactttccagatactcatctcgctgctgcacatacatgctgttttcagccttgggagcagtgatcagctggaggagggcaaaagcaagcaaaacaattaactcacagtgatagtttcacactgagggaaaaatcaaagggatgatctagactacagggctggtggtgactgacaggatgtgtgtgttagtcgctcagtcatgtacaactctttgtgaccctacagactgtagcccaccaagctcccgtgtccagggaattctccaggcgagaatactggagtaggttgccattcctaaactagactgacacctaaactggatcattttgttggatagttagcataattaaagccaaaagagaccattggaaaggcctttttaaaaaatattccagacag

SEQ ID NO: 41644 - DNA, 954 bp, Bovine  19866881092750
caactagggacattcagggctagacaggcagggctcaactgtggttccataaaaagtgggttcagtgaatagaggtttgcccttgagatgagaaagtgaattgacaaagttaaatcttctctatatcaggcttttggtccaacatttctattgtccttaagcttcccttaccatcctgagccttagcacccatcccatgaggcaatgtgagtgcgtcagctgcacccactcatggtattgctggtttgttttttttttcctgccttgaagactaagttctctgtgacagcagcttttatcccagtctcaaccttttcttccttggcaactcttctcaaggatcctgaagtcaaaatcaatacttacctaaggaaatgtagtaggggcagaaagcttgatttgtatcaagggaaaccatttcaactcctgatactgggccagttaaatcattattgtgtctctaaatcccctaagaaatctaagaaaactacaggctccatccctagagactggagcccactgatcttatgtgcagccagagctgacatagacccttgcttatagatacagacagcctagaatcactcaacatttgaaaaaaccaggggcttgtgaaacatctgaaacaggtgaaccagggacttggtaacggtccagtgggtaggattccatgcttccactgcagggggcatgggtgtgatccctggtcagggaactaagatcttgtatgccctgcaacagagtcaaaaaaaaaacaaaaaaccagcaacaacaaaaaacacgtgaatcaaatactgatgaaatatataattttagggtaagatatctttaaaaatatatattggggaaggtatagttaaggagttgaagatggacacatacacactgctatatttaaaatggataaccaacagggacctactgtagagcatagggagctcgcctcaatgttat

SEQ ID NO: 41645 - DNA, 2085 bp, Bovine  19866881368344
aaaatggaaagatttttggaagatgcaggggaaaaaacatacaaaaagtctaacagcactattcagttgaggaaagaggatgattttgaaattattttaagaagttgttcaaactgctagtttctctaggccttgacataacaatattcaactcattaaggaacaagaaagcttcaaggaactcaggtcctgagtctgtttttgaatcatttaaggaaacagatggcagtgtcctttcctgagcagaggaaaaacgaactgaaagaggtactttttcctgtgcagattatttagcattctgactactgcagtgaatctcaactgaaagcaataattttgccttcatggtatatttggcagtgcatagtggcaagcagcacagtactataaaatgtggtacactccaaaggcattttttcctaatttgttctccagcttcttttcacataaaaatcttctggtacaaaactataccttgtgttgctttattttttaaatcaaggctgttataaaagattgcaaaagagtttaaaagaaattaaacacatgccattctattctcctcttacctgtattatgataagtatctacccatcccccatcgccatcatcttcttcaatgatagcttccaattcatctgaatattccatctgtttacaccgcttatagcatggaactataaagaaatgccaagggcagttactaggatatattctgctttctgtaaatccatttttaaaagagagtttattccacaaaatatattcctaccatcaaaatattaagtgaatattatattttatttctaataagagtatttaagagttacactcaatcaacagacatataattatttgatgacacttatctttccctaaatagctttgtgagaagacaagtagaaaggctctactgagagtgttcaaagtatgctctacctttatgatctgtgatcagcaaacctgaagtcagagatgacattgttcaacctcaggctaatgaataacatatcattttagtactttactctcagaacatggaggcactacttgtcatactcagaggtggtagaggtgacctctggtttacaacgttaaaagtaactttcaatatgagcttcataatttgtatttaagctccagctattaataatggataaaccagtgtaaagttcactaatctgctaaattttactctcttacacaaattggtgccaagttcttcatatagcatatgcttcgatcaacaggtattattcacataagcctaaaactgaaaaattataaggtaaaaacattgcagtgtggggtcaccaaagtgctattaatctcttgattttttttaaaaacaagcaagatagacatgaccaatcccatcaaaaactatactgatataaactgaccaatcccatcaaaaactatattgatataaactgtattgatacaaaagtgatgttttgtacatattttgcctttcctataatgagtagaacacaaatcaatgcattgttatatgtcattagactgtgaatgtaacaaccttttgatgttttcaaattagcttcataataacctcattaatttcataaatacttgtttcagaaacacgtttgtgcctacaggtaatctttcaatgatacaatggataataaaacctctagctttgagattttagatatcaaaagtagtatcaattataccttccatgaaaaacttaggtttaaaaaagactgatattaagtagctgaaaagattataattatgaagtccacttaaaaggtccaacaagggtgtcttttcaccttgcttatagtttcctttgttgtgcagaagcttttaattaggtcccatttatttatttttgcttttatttccaatattctgagaggtgggtcatagaggatcctgctgtgatttatgtcagagagtgttttgcctatgttctcctctaggagttttatagtttctgaaggtcttatgtttagatctttaatccattttgagtttatttttgtgtatggtgaaaagacagccttcagaatgggagaaaataatagcaaatgaagcaactgacaaacaactaat

SEQ ID NO: 41646 - DNA, 1468 bp, Bovine  19866881403973
actgaaaacttggatgaatggtgagtcctgtgctctttaaaacgcatcatgatgttatttcctaagagacccaagcttcccgaatctagaggaattcagattatctatttcctaatcatagaatttttgctgctgtaggtgaaatttctgcatccctgcaccccttaaagtcccaaatatctgtagaattttcatccatcatgagagaagggatgaagaagggaaaaagtagagtgatttttttaaaaacactttttttgtgtatgtaccggagtttccctacaagggttttcaaccaaaccacactccccaagggatcaggcatctgggtcaagagaatttctccttttaaggtcttagtggaacttttgttctctgcagagttggaaggaagcagaaaatcaagcagtgttccaaatcccatttggaactagaaaggccccaataaatataaatacaatatacaaagccccccaaattaactgaatgaattaaccctcacagaaaatcagaagtatgtatcagtgtgccaaaaaaaaaagcagaagagaaagaaaagacttatccaaagccaccaaatcgacactcaagcttggatctgatcccagccagccttgcagccagagccacttccaacaggacaagaataagcctaccgggcagagtgctgtgaagcacagacacttgcccttctcatagggaaggtcaccctgaacagacacgtctgctttgtgtttctctggggtttcattagctcactcagaacgctctcctgccttcttcctcagtgtctccaaagatgtacctggataggaagttttccagtgactgcttcttgtcttccttgcaaatgatgccatccttcttctgcttttccatgtctttgattcgggactggaaagtatcgatcaaatcgaacacagacttcattgctataggcacctcataatattgctgttgaaggaaaagtaagaagtatataatgcattaaaggtgtttcttccctctgtccaaagggtggagagcctgggagaattcatgggagctctggggaaaacagagcctggagggctcattcgtttataaactctctcctgcaatagtacctctgctgatgttttgaggttctgaatccatgaaacaacttcctttaccttccatgaggatttcttcttaactctttttattggaaagggtccatgccttcttcaccacacatatcctagatttacttccctatctctggaactaacctggttcctgttcattacacgattggaaagtcagaaactctgtacctaacacaaaaaatcaaaagcaagaacatgtaagagtatctgacctcagcaataaaggtaattttccaccagaaggatgcctgctctgtggtcatcaggaatctacatgggacgcccctagtggcccaggggttagttaagactccatgctgccaatgcaggggctatgg

SEQ ID NO: 41647 - DNA, 1646 bp, Bovine  19866881886638
atgagttagtcttttaagtcatttcattaagatgattattaggcataaagtaaaaattttgaagattgatctgatctaattcattttcccttagacaagccccctaaatgaccttttgaagtaaacctctggaatcttcttactatggaaagtccttgccaaaggcggactgattgtcctattacttctgttggaatgatcaatgtagtcagagaggcagaggatcaatcaagctatacattccatctacagctctggggaccagcatagaattgttctctcgcaaaggctgtatttatactagcgtaataagaacttctcttcttaaaatacaatgtgagtttaatgttgatgacaagtgttgggcagcaagtacagaaccaaatttcctatgtcttgagaagtttcagctggtgtatctacagcaccagttttcctaacaggtagtaaatagctttagaggggcctgtttggtctcagggactcattccagctgacgtttctacctcaacggcccagttatgctgggcagaataaatgacacttggcagaggcaatgctcaggatgacatcaaccttttccacctggaaagaactgaaatcaccagctcatttttgatagtttcctagggagtaggttgggatttaagaaattgtaatttggaactcaatttagcaaaaaagatgcctttttcccaattacaccagatggtacatacacagcaccttcgttaccagctctttaatcatacatcccttttctaagttggcaggcctatgtggttggaatcaataaacctaattcttcttgaaacattacatagtcaatgtgctgtctgggagagaaagattaatgagtctcggttcttcctttaattctactcagcttctccctaagttacactggaggtgacagtgagaaaagcaaggatttaggaatcatcacagaacctagcacataatggggtagtggacaagacgtggttccacccctggctgtgtcatgctctgtgcaacctttgtgttgttttaccttttgggctctatttccctgactctaactgaggggttggattgagtaatcttcaaggtcctctccatctctagaaatcaatgaattgtatgctttagcacattttctactatctcctttgctttgtttgtgttcctctctgcctttccctaaaaaccgagtaggttgatgggacagctctggttaaggatgagctggggatagtgactaagactgctactactgctaagtcacttcagtcgtgtccgactccgtgcgaccccatagacagcaacccaccaggctcccctatccctgggattctccaggcaagaacactggagtggggtgccactgactaagactagctaggaaaaaacacagatgtttatttcctcccctttactcaagtcctactttcaacagaaacctccccaagacaccagatggctttgccttcttctggaagctggctctataggagccaactcattctttctcatgtcatttcccatattccttctaactctaagttgatcatctccaacttggggagtgtctctgtatgggcactggcactgctgtgttgacaaactggctctttcaaaataaagtcctaatttgtagcatttgt

SEQ ID NO: 41648 - DNA, 1414 bp, Bovine  19866880109678
atagaacagtcttatggactctgtgggagagggagagggtgggaagatttgggagaatggcaatgaaacatgtaaaatatcatgtaggaaacgagttgccagtccaggttcgatgcatgatgctggatgcttggggctggtgcactgggacggcccagagggatggtatggggagggaggagggaggagggttcgggatggggagcacaatgatacctgtggcggattcattttgatatttggcaaaactaatacaattatgtaaagtttaaaaataaaataaaattagagaaaaaaaaaagtcaatcaatattagatcatttcattatcagattgtcagaaagattggtatttcagaagaataacactgcatctggtcttatgcagctatatatgtaaatattgcattaaaatataattagatttttcctctctctagtagagacagacgacaacaaatatgtctgattaaaattaatgatgatatattgaacaagtaaaggttacataattacaactccagtttaaacagtgcctaagctacctgtcaaatatttaatgcctctttattaagacaattgctattgaattgctgctttacccactctgctccttccagtgatagtcattgttgttgttcaattgctcagtcatatccaactctttgcaaccccatggactgcagcatgtcaggcttccctgtccttctccatgtcacagagcttgctcaaactcacgtgcattgagttggtaatgtttgggagagggcttttcttctcacaaggaaaacggaagtgcagttaaaccattcagaccagttgagccatgatatgtcatacagaatcaatttacttccatctccttccatcttccatctctttcctagcttggataataattaatttgtgggtttataaaattaactcatcaactttctcacacaactttcccttaaaattgaagaatataaattgaaggaggtaaaggacagagattaatgtgaaaaaaaaaaaaaaattacagacttctcaggctccctttctaagcctcagttcagttcagttcatttcagttgctcagtcatgtctgacttgcgaccccatgaaccgcagcacgccaggcctccctgtccatcactaactcctggagtttacccaaactcatgtccattgagttggtgacgccatccaaccatctcatcctctgtcgtcctcttctcctcccaccttcaatttttccaagcatcagggtctttttcagaagagtcagctctttacatcaggtggctattggagtttcaacatcagtccttccaatgaacacccaggactgatgtcctttaggatggactggttgaatctccttgcagtccaagggactctcaagagtcttctccaacaccacagtacaaaag

SEQ ID NO: 41649 - DNA, 3171 bp, Bovine  19866880346371
tctattttatatatgtcttgtggctcagctggtaaagaatctgcctgcaatgagggagtcctaggttcgatccctgggttgagaagatcccctggggaagggaatggctacccactccagtgttctggtctggagaatacatggactgtataatggggtcacaaagagtgagacaccactgagcgactttcactttcactttcaatgtatacatatgccagtgttactctctcagtttgccccatccactctttccccaactgtgtccacaaattcattctccatgtctgcatctctattcctgccctgaaaataggttcatcagtaccatttttctagatcccatgtatatttatattactcagccataaaaaggaacaaatttgagtcagttgaactcagatggatgaacctagattctgttatacagagtgaagtgaatcagaaagagaaaaacaaatatcgtatattaacacatatatatgtggctgatttttaagagctttcttcctgagctaagatgtttgaagcatcccaaatcagcagtgaattcattgctcctactttagaaatcaccactgggtaggagaggctgcaaggggagatacaagtcaaggagattttaccatagtttaggcaagtcaagatgacagctccttcttcttttcagtcttggaaattcccaagtgaaagacagcatggcactgataaaagggcagaatactttaagatttacttccaatttctatcacttaccatgtataatcttggggaaataatttaaattcagacagcccaagcatccttattcagttgggtagcaacattatctatctcatagttattttggagtcctgaaggagacaatatgtgtggagcactttcataatcataaagcaccattcaaatggcaattatttaagtaaggtcttttaggaatgccgaacttaatgctataaacaaaagctaaatcaaagttcttggaaaagttgggtaacagggcacaaaatattttccatattcctttacccaactgttcccccaccataaaataacttcctggatgtttattttccttcttaaatagatacttcccttctatctaattatgcagcattctacagtttcatcagctatcagcaaaatcaagctgtcctcacttgacttagagtatcatagaaatgataaactgaacagcttagaatagcacaaactggagagcataatgcaaccatctcaagtttagagtcttaaccagtctgcacagattgtacaagttaacttttaggagcttattaaaactacacacattcaatagtatcatggtttgtatttcatagcattttaagttctcattagcatgtggtcttcacatcaacagtgtaaaattgtaaattaaatttaaagaataggtttaaaattgccttcaatactgacttaaaacattaaagtgaaagttgctcagtcatttctgactctttgccaccccatggatagtccatggaattctctaggccagaatactggagtgggtagcctttcccttctccaggggaatcttcccaacccagggatcgaacccaggtctcctgcattgcaggtggaatttttaccagctgagccacaagggaagcccaagaatactggagtgggtagcctatcccttctccagtggatcttcctgtcacaggaattgaaccggggtctcgtgcattgcagtggattctttaccaactgagctaaacagggaagcctaaaaccattaaaaaatctattaatttccaagctttgaatgtgatttgtatgatttaagaataatgcattctttagttacattaatatttattctgtcatagacatttctccctaagaaaaaatgttcattaagaataacttttttttttaatgtcaaaattcactttggtgtgtgtgtgtgtgtgtgtgtgtgtgtgttcctcaggaaaaacataatgcactctctcagacaactctcaggcttcattaatgaacatgatcttctctaagctttgaagaatgtgatttctaatgatataatcagagacatacatctaaatatttaaagatctgagaggcctcatcccctccccaatcactcagaccattttctatacatcatgctcttctctgaaggaaaggttgcctaagtccagtctaagatacctcatctagtgtaagagtcatttaaacttagctaagttaatatttattcatagaacatatgagggggtaactctttgatctagttctatatctgtcatgtcaaattagttctacatctctgttctcaactacaagtcccctactccagaagccagattggtagaagatcctaggaaggaccatctatgcagcaatggaccagagtgccctggttcataaccatgccctggggacagtagagaagaactagttgcattctataataatttttaaaaattcaaattcttttttgcattccttaccaggtgttctctatagtggtttaccttagtgaggatgaatccaaagtccctagtccataataaaagtgtgttccttctttggtgttttcacaaagactgcacatgcataacgaacttacattttgagggacagatcttgacaactgaacaaatgatcatctggctaattccatattcatgtgtgactcatggctcatccagcagtgctgtcaaatctcctttatgagaagcaacagctgctttaaattaagcatcattactaaacagctcttctctaaagatgtgcagaaaaaattcctttgtcttaaaaggtagatggcttttcaggtttaaaggactaaatttagagaagtccatatttttcaataggtttattaacttgacactctatttcctttctcctctcaaaaaggctttgtgaaacagtggatagccaagaggcggccctgtattcattttggtttgctagccactaactgatatcttcagagaaggcaatggcaccccactccagtactcttgcttggaaaatcccatggatggaggaacctggtaggctgcagtctgtggagttgctaagagtcaggcactaatgagcgacttcactttcattttttactttcatgcattggagaaggaaaggcaactagtccagtattcttgccggagaatcccagggacagaggag

SEQ ID NO: 41650 - DNA, 1813 bp, Bovine  19866880615070
gctcctctgtcctgggattctctaggcaagaatactggagtggattgccatttccttctccaggggatcttcccgacccaggaatcaaacccaggtctcctgcattgcaggaagattctttaccaactgatctaatagccttttgacttcaagagcttgcaaactccaccctcagataatgctaagagaattcattctgaaaatgcagaggcatggaactgagatacatctgtgtagaagactaatccccccccccaatcatcttttccacttaagaatatcttgcttattccataaatatccaatctcccttccctttgtggaggcaggtatgaaaactcttctccacttaaaagttgtttaattttaacttttattttacattggagtatagttgattaacaatattgtgttagtttcaggtgtacagcaaagtaattagttatacatatacatgtatctgttgtttatgaaattcttttccaatttagattgtaaaaattgttgagggtggttttaagttagaatactagcaaatgttgtacagtatatacacaactatgtaaggaattctgaggtaaaacatagtcatttttggtggctgtgtgttttaaagacttaatggaaaagttaattatgaaatatacataggattcaggcattaagtagaaaatatgtttcaggtaagcaaaatagcatggtaatgggggaaaagaagatatattgaattgagagaagagataagggtgtgttatgagttgaaacagaatgaatataaaaaagaaacagctcaagtttcagagtttgtatttgatatggtaaataattaggtgaaattaggtccttacatacaaaatgatgcaatgatataaaatgacacaaaaattgtggtgactattcaattatcagattttctgatgatctatttccttcataaataaagtactgaacttagagataatttgaaagccttcttctttgctatctatgctatttctgttatctatgtgctaacttgtttatataagttaattagtaaagtttcccataaaataaaataaaagttatggcatctaattctgtggaactctggattttcagctattgcatttttgccttcagaaaaggacaacagatcgtcaaacaacagcaataataataagttctgctaactggtttctgccaaggcttgctttatttcaaaattcttcctgattacatagagttcttcacaggatgagccatctggcaatttctccaaatgtctcattggaatgatggcagaaaataagaacagagccaattctcagagaaaacaaaggaagaatgtctagattgcaatggcagattttacatcaatgccaagaatctctgcatagatgccaggtagaatattaccactgaaatttgacttaactatcaagggatatcttactctgaacttactaattgaaatttgcaaatcaccatcatctgcaaaattaaaaaatatttcaactatatatatatttgcaaaagaattttgatataaattatgtaccattaaatttttagtaagctcattttatgaaataaaatcataggatgacaaattttaccagtcaaatgtgggtttaaaaaagcatatcattaggacaatgtaagaatagatatgaaatattggttttgttgcaaataggaaagctcctacttcgtttatagataaattatctttaaaaatttttggtaatgaaattaaaatatggctttaaaaaagaagctcaaaagagtataatgtatatttcatcctgatcacataaactccttgttaata

SEQ ID NO: 41651 - DNA, 2806 bp, Bovine  19866880629761
ctgcaaattgagggaatgaaatatgtcaatatgactatagcttttagtccaagatcccatgttcacatctgtgttaagagacacagattcagctaaaaacataccataaactcagtctcctttaaatgttatgtttttttcttatagttccattacactctttgttaactactactattttctatttgaaacgttttccaagtctgcacattttaaaaagatttttaaaaattagtttgggttgtgaaggaaggatactgaatccagaaattcttaataagattacattcaacaatttttaaagtgtatgattacagctgtgtaatgacacaaagccaaaacagcaaggcactactgctacacacacacacacacacacacacacacttatgcatactttaatagtgttattgatagtctcacaattgtaaagttgattgaaatatagagatcaactatgtttatagtataattcttttgaacaagatgtcaaagcatcactattgcctacaggacttaaagattagccccaataaaaaggtgaaatgttatataattttcatcaaataaacacagaaaggtcagatcactattttaatccaagagcacaaaagaattctaccctattctataccctaataatttgtagatttcaccatagtcagttctcatcatctcagtaagtgcatcaacttaaaaataccaaaagtggaagaacttacaatattttattcctacatatcatttattattctatataatatagtagattaaattttctgaccttggtggcatataattgtaatggaaaatgaataaactttcctttactatggtagcactgaaggtagaaaatgttaaccattaaataaaatgacctcaataaaatggtgacatgttccagataacccacttaaaggaatttctaagatactagaggaattatgttgacacatttacctgaagactgaaccctgctccccacacacacaaagttgctatatcttagggttacaggtaaaatttaccaaaaaatactacttaaaggagtgaaacaaacttactcagaagaagtaatggtgagtataaatcaaagatgaaatgacagttaagagtatcacagtatcttaatgagttgctatgaggaagatctatataagaaaatctaggatctgatacactgtgtaatgggaagacatgataccatcttaaagagaaaggcaaacgccaatctcataatcaagaaagaaagtataattagagaaactaagggtcacttgggcacctggtaaaaatatattttgaccttagattgaaccttagattggtgttttagtacttcaaggagaacaaggcaatcatggaataaagcgagataggaaggaagaaaataatgaagtaaaattatctgttttgcatgcaagttcataatgaatgagaatagtcactgaaaattacatttcagctacctgattggaatgagattaatgatgtatatttatatcatctgccaatttgaagacaaggatatttacaaaaatacaacacagaaaagttgagcaattatattttgatgtttatgattagaattgtgggttgcatattgaatttcagctgtccagcagagagagtcactttagcttgaaattgttttaataggctatttcattaaaagtctatagagaattttatattcttggctttcttttaataactagtctataattaaatatggggctttaatgatgaagaacaaagattcaagttgataaatagaacaagattatttatgtgctaaccaagtgtgtcagagcaatgaattgaaaacaatcagaattgctctgatcttatgggaataaaaacactgagttatactggcctgtagaggtacacagatcacattataattgcaattcttgattagacttgggcaatgtgtcccagtatgcttgcttatccctctatgaaatatatcaaagagttcgctttctttctttagttgtgaacaaatccatgttgatatattgaaaaccctcaacgggctttctttaaaatggaatttaatcattgaatgtgcaaatgagaattttttttttttcactaagaaaaggcaacaggaagagaatgtctggagaatttaaggaaatattttgatatttaaacttaggtaaaacaaatgtaaaatgaactatgtcttatacataattggctcattaaaaatgtatgcattgaaggaagagctgaaatacatgagaaaatatatggggaaaatatagcgtgataccatgagtatatgaaatttgacaggtaaaatgaaaataggtaaaaagttagaaagcagataaaattcacaggggaaacaagatgagttgtttcacatatgtttggtgaagaaaagaaaatgaaaaatcaatactgggtactcaagcaaagcagaacaaaatggaaatcaacatattagttggagataaatggggcatggccttaatgattggagtaaacctacccttttacctattgtgttatatttgttgttcatattcagtgaagcaacctagacagcatattaaaaagcaaagacattactttaccaacaaagtccgtctagtcaaagctatgatttttccagtagtcatgttggatgtgagagttggactataaagaaagctgagtgctcaagaattgatgcttttgaactgtggtgttggagaagactgttgagagtcccttgaactgcaaggagatccaaccaggccatcctaaaggaaatcagtcctgatattcattggaaggactgatgctgaaa

SEQ ID NO: 41652 - DNA, 1493 bp, Bovine  19866880629762
aaaatgaaaaatcatactgggtgctcagcaagcagaacaaaatggaaatcaacatattagttggagataaatggggcatggccttaatgattggagtaaacctacccttttacctattgtgttatattgttgttcatattcagtgaagcaacctagacagcatattaaaaagcaaagacattactttaccaacaaagtccgtctagtcaaagctatgatttttccagtagtcatgtatggatgtgagagttggactataaagaaagctgagtgctcaagaattgatgcttttgaactgtggtgttggagaagactgttgagagtcccttgaactgcaaggagatccaaccaggccatcctaaaggaaatcagtcctgaatattcattggaaggactgatgctgaaactgaagttgaaatactttggctacctaattcgaagaactaactcatgggaaagaacctgatgctgggaaagattgaaggcaggagaaggggacgacagaagatgagatggttgtatagcatcacttacatgatggacgagtctgagtagactctgagagttgttgatggacagggaagcctgatgtgtttcagtccacggggtcgcaaaggggggtcagacatgactgagcaactgaacagactgactgaagcaagatgtctatatttttatattcttgtgaattctctttcccagaagttaactttatagttttgtaaacattcaaataactctcatctcaatttcctttcaattgccaatccttctgcaatgccattaaatgatttgcaatttaaaatttgccattcattctctctagaattattcaattatctcagaatgacttgccaatggttgaagagcattcattctcttaattgagttccttttatcattcccttttatgtttattaaattatataaaatttcttgtgttttaaattgatagacaaggagatttacacaatacttgctctctattttaattgcaccaaatcaattttgacaacaaggttattcaaaaaaaaattttgtcaaagtaaattcccaaaacccacaggctccaatttcctttctggcctacatcttttcagtttagacagacagtttcttccttttctcttgatgtgaggaacccatgccagctccaactaattaaacactgtccctcatattctgtatgcttgtgcctacacacacacacacacaatttgttaagtaattataactttgagtttcaatatatatatatatttaacattaaactgtaatgtgatatgtcagttatatcacaaagctgaaaaattaaacattatgtttttcatttttttgtagctactgaaaaaacatgtgtgtgtatacatataatttggggctccctggtgactcagtggtaaagaatccacatgcaatgcaggagctacagggtttgacccttgggttggtaagatctcctgggggaggacatagcaacctactccactagt

SEQ ID NO: 41653 - DNA, 1552 bp, Bovine  19866880664289
tgttgaaatataggtactcacccaattattagggtaagtttgagaatatttctgcaataaatattgaccaatatagggtacttccctgctggtccagtggttaagactttgccttccagtgcagggggtgcaagttcaatccttggttagggagctaaaatctcacataacttagggccaaaaacaaaaacataaagcaaaagcaataaagtaacaaaattcaatacaggttttaaaaaatggtccacataaaaaaaaaaaaaaaaaacttaagaaaactgagctatataatcaactcacttctcaaagaaaaatgcccagtcctccaatgtattacaatactaatataaaaataatcttagtactactctgagggccaaataatcaaatccttattaagtgaaaccctgaattaaatcagatgaatgccactaattagtaaaacctaccaggtaggaattttattaaattgaatatattttcatagatccttcaagttcataaagctttaacacttagattctatctgtaagtacagtcactccaattcactatttagaaaatcagcttggaagtttgttaaaattcccatccaatcccatccccaggaattctaatattgtaggataggatgcctgagaggggtccaggaatctgtacagtcaacaagcatctcagatcagtctggtccgtggtgttcttaaaaaacaatccacaaatgcaacagcaaagaacatggagaaggaaataaagccagaaaacttaagctaggtacaagctgcaaagtgaaatatttgctaaaggtaaatttctgagttttcccaatgtattaatgaaagaacatcatattgctactaagacaacactgattatttatccattccatataagaaatctagactcgaaagcatatagtgataaaaaaagctatttataaatagaatatcattagttaaaaacagcacattcttatccatctctctttctcttaaaagtattagttgttaaaaccaactccctacagaatctatttcaaatatcttttagtgttaagaaaaaaatagattcattcccagcttatattccaaaaatagttgtcattttagttcaaatctgaacaaaaaatataacttcctgaaaatatcatctctctgatatcttatttcacttgaaaatgtttgtcttcatttaagtaattcctggcattgctaaaaagaaaattggatttgtgcattaaaagaaaactatgatggggtatattacaaaaggaattaactgaaagatataacagccctgtattgggagctgacgttatcaactagaattgaaaaccaatcttttgaacattgctaaaaagccacttcttcttgataatacttcaaactttcttgttaagagtcagaaagaaacaaagtaatgaagatgtaataaaaagaaggtcacgggcttttcagcatctattcatttgctttacaaatttagaacaaaatagtccatttttaattaaaggattacctgattctggaatcaacacttttctatgtttcagacg

SEQ ID NO: 41654 - DNA, 1217 bp, Bovine  19866880876295
aactctctgtcttccccttcttcacctttaacctgtattctctaagttttgtaatcggataagctctccagtgttttcagacccagttactgcttctgtcttttagaactgttcacaataggcaatactgtattccttttttgcttaccttattattttttactcccttactgaattataatttccatgagtgcttaatacagtctgatatattatgtgttcccagtaaatatatttttttaaaaataacaaatgaactttaacaagaagcaaacacaccaattaaattaagactagatgttaattaggagggtaatggaattacctagaacatgtgtgcaatactgaataatttaagacttataaagttattttacatatgattttctagtttaaaatattattatatttggtgaatttccttaaagtatgctaaagccaatagaattaaatataatagattttgctataaaagtggtctgttctgtttagtgaagtgcaatttctctgacttaaaatgatggctgatggcctctgtgtacaaattcaatatttaatctaattgtataaatagaagcataccattaattcatccatgtgggatttaaattagttactctgaaatttatcccacatacatactcactttttaaactgtcactgtgaaaataaaaactaaaaaaaaaaaaaaaaaattggaagatagtagtttcaaccactatgatcttcttcaaaaactgtacatgttctttttcttttgtttcaactcataacatttagcttgatagcgtaagcctcttcatattagagaaaatataagataattataatgtaactatatggtgccagaaatgtcatttttacattagtgtaacatattttaagagttgtttttaaatatttctaaaactaccagttttcatatatttactaaataagcacaggattattaagaggtctcagtatgctataaaatgtatagttcaatttaagattcatttgattatttgcatgtgtattcagttagcataaatttttaattagactttaaatcttcaaattttcttttaaaagtttgactaacagcaagttgaaaaaaaatggatgattttgcttaataaaaaataactgtaacatacatgtagataatcaggaattataaaatcttcagatacatcttcctattttgattttggaagttaaataaatttgcataa

SEQ ID NO: 41655 - DNA, 1184 bp, Bovine  19866880896285
gacttgaaattcaagttagatctctaaggtctattatctgtatccaggacacttaggatagaaaacaaaaggaactggtgggaaagtttcaaatgtaatatcgagacaacattcaatgcaaaggcatcagactgtggtggagagcacatagaatacttatttccacactgtgcaaagcccaaccaactgacatggagaaaaaaaaaaacagcacattcacttaagatatttcacctcccttcaatccctgtatgtcatgctctgaatttgttagctctgacaggtctcaaatgtacaactgtgccaacctcacttgtcagcatttttgaactacctgtaaccataaccctttcaaaagcccttttaataagaaactcacaactattcactgtgtttaaaaatttgctattaatcctggctaaagtaggtcttgcattgtaacattaaattttacaccccctcatgactttataattttaaacacttgacagatatttaatgaggattttgcctccctctccctgtaaagctcttctcagtaatatgtggttatcttattcaccaggtgtctgcccacgcaataaaaaggaatacaaatgatttttcattatgctagtaatttgaatcataattctgtttcccttccatttacagagcagcatggtgaaacaaaatcagtgtcctctagacaaaatatcattacaattggaacttaaaacatactctcatttttgctatgttaataaattgctttatggttaccattgcctgattcttttaaaggaattattaagtgatgggaactagttttggtgatgtcatcaataccttacctgtcactgatacagtattgtataaacactgtgcaaagatcaataaggaccaaaaagtgcacgtgcatttacaaggaacattccgcaagaagggatatgtgtatgtgtgtaactggcacaggatatttcactgcaaatactgttgagatcctagtgcaactcacttcagtcagttcagagggtagtgaattttttttataaataaagaaagccttctaagctgaatcagactgtggacctaaatggaaagatgtaaagacagctttatgttcctcagggagtctttccagctctcatcctcccgaccctgaattgttagtttggtgactatacagcattgcactagcccag

SEQ ID NO: 41656 - DNA, 1844 bp, Bovine  19866880984706
actcacaaaaataacttctgatactacatgaagattgaagcttctgaaactgtttgtgggggcacacgtcaaaggaataagagatgattgctagcttggcctcattttaactccaagattatgtgatttgaggcataaagtttacaaagattcaaagaaattgtagagattcataatgtttgaaggaaaccctatcatcatgctcattatcaccataactagtgacagaaagactcgtatctgagagggtcataaatatttttataatttaatactttaactgttaaattaaagaagaaaagtaaagtatatgtttagggcagttagagtttatcacccttaattttcttttctttttgtgcctgttcacctctaccctaaatcccctcagcacagagcattctcacatgacaaaggtcttagatgcttgctgaatatgagtctttgtagttttgctcttgctgtaacctccacaaattgataaactcaaagcacagttcgggagaatcatgcctatgttgttggaaagcaaaaactttcccttgaacagacttcaaagggaaacttcagtacactcacagcatactaagtgatcttccttcatgcggattagtctgcagatccacttccacacaatattctgacttgtaattcagtcagaaataagagaatcaaaggcacactcctccaagtgtaagtgtgcctgactgcatccctgaataatggaggtgggaataaagtgctcacttatataaacatccaggaggataactctcctcgtgtaattaatgagagtctctgtagagcatgaatggatttgctttcatgctgatagccacagtttattagagaagaattcttagttgctctgtgatctttttttcagtgatttccatagtttcaccgtaggtttaccacaaatttccataggttaccaggggctaagatataacattctatattacttgcttttaacagacacaatatattggggataaagtcttgttgatgatgaaaatatagttttgttacttatctaaatttccaggttaatttttttcagcttccattgcaacaggagcaaaatatggaacaatatttatatcactaactgaccaaatgtagcagccatagaagtatttgcatcaaaaaaataaataaagcatgtttaaccactaacaaggcattaaaggttattacagaaaatgtgagaatatataaatgaagaatgagctttataatcatctgtagtctcagtatctagataatgactcttttggtacatttcttcatagatttcttactcatatggtttttcacatagctgcaatcttgtcaaaaattacaatagttaggtgcctacctggaggacctggagtagttgatacatggtaaaaaggactcagaaaagtaacacagagaaatgggattagcatagttactgcattttaatcaattaataagattaaatgaagaaaacattctaagtgttatgaattgattatttcagtaaatatttactgtgtctactacatcccctggtatggtactggatgtgcatgcatgctgagccgtgtccaaatccttgcaacccaatggactgtagcctgccaggctccattgtccatggaattttccaagcaaggatactggaatggattgccatttcctattccaggaggtactgggtgtatttaatatttaattgaatgttttatgattcataaaagtgttgattcttatgagcactacatctggagctttctgataacattactctttatcacataataataatacttacattgattgtactaatcctcttgtttgggaaggggttgagt

SEQ ID NO: 41657 - DNA, 1327 bp, Bovine  19866881076933
ttgacctgtccctctgattactttaagctcttagaccttggattaagaaccttagaaccactctacttttctgggcctcagtttctgctgagagagtgcatataaagatggacaatggctacactctgtataaaagtagaactctgatccatagtctgcagcacccagcccaggaaaccaacccattatctgcagtaagcagcccacagagctggtctgctatctgtaagttagattggtatgaaatcagaccagagtctctagcaaccagcccatgaaggcaaaccataactcttgtagccattggattcaaatggccaggacttgattaaaaactggcaacttcctcaatttttgtccctgtttctaaccaagcatgaaccggaaaaagccaaataatgtgtccttaaccaatcacataggatgttctgcctctagttagcctactgatggcccctcgtgtcaacaacctccagttaaggcatatctgacaagttccttgttttctcctgtaacgatttcccacttctgcaggcttttgtcgttcagttgctcagttgtgtccaactcttagagtctctgcagaaatgtgtcgtggtggctgactctctttctataacaagctctgaataaatagctttgcttgatctcttttggttggtcttcatttactccacactgcaaaattaaatgaaagagttaggacagatgattctgaattctagaaactggatgtgctaaagctatctcagaagatccgatctagctgctgctgccttcatgactggaaggggtttgtatggttcctgtgtcaccagctttggattcagaatttgaggtgagcatatcaattggaaatacccaggtgatgtcagtgaaactggacaaggcttccctctgatggaggggtgggctcagaaggcagaggatctcctaaagctacgaatgagatccagctgcagggtggctcaaagaataaaaaagtctgctgaacctttcatttctaccatgccctaggattgccccaacttcttattttcaaggactcaggtcttctccaacatagtccagtgtaactttgtctacctgtttctcttccatacagatggagaatgaatggaccatttccctgcaggactcttaagttcctgcaggacaggactgtgttaaaaaagcctactttatttcagcacagtataaaattacattattgatgaggactaaattcaaaagcaggcgaatggaatgtgtctttaaaagttaaaaaaaaaaaagaaactactgttctatgtttgaggccctcagccaattttttcataattaacag

SEQ ID NO: 41658 - DNA, 1379 bp, Bovine  19866881231387
ttgattccgcatcccctccattggaagatggatttttaatcactggaccatcggggaagtccctctggattattttctgactggtattcattgcaggttaaaaattaaaactttaaagtaacgaaggagccaactagaggcatataagttagtttgaagtttatataaggtagttgtcactatgtacagcccagaaatttatagtagtctacgttctgtcttccagtgtccttagttcctatttcatgaggttctttttgctaaaactcatttatttcatctacaaaagcaaaaatctgcacaaagtcctgtagaaaatctaaacgttttcatattatgtattttggactcattatcacttcatagagtcacatgtaatgtaaacaacatttattttatactcagcttttgtttcaaatgtttcatttttctattttgatctcagacaccatagaaaatgtctcacagcaatttaaagtctagagatcaacaaataagaaatttctatcttttgtagaaatggaaatccatgaaaagtgttttattgagttaatttcacaacataataaatatcttctgtcacaaactattttacaaatgagaaaaaaaaaacacacaaatgtgtgtaggtttttttccctctagttgagcattttcctcgcttataatttttctccttttctctttattcaatatttattttgcaggcaggttttgtctattatttatcatgatatgctaatcatattttctttaataatgtcttagagtattgatttttctctctgctttttgtgtatgtgtactcaggaaataactattccttagttttcctaagaataccttctggggaaagcagcccaggagaagattactatggcatgtcaaacaatggaagttattatggtttatcaatgcaaaactgctttttataatttcattcagattgaaatgttcttatttatattggcataattctctaattttccacatagacctaattgcaaccccagatacactttgttcaaatatcaatttttatttagcctgaggaaataaaatattcaaactctataaatcacaggagtgctagtatgccatgttttaggaagggtattggtaaatggcaattataaattcaaatctccattagaaaacttcaatatcagtttatgcatgatgcaaaatcatacgtccatcctaaataatgttgtttccttctagaacatccatttattaaaagattctattatatcccaattttagacttttttcccctaagagagtcataccataaatttttaaaacttcaatggaatagacagttttctagaaaaaaatatagagaaagagaattgtaacatcacttactcattaaa

SEQ ID NO: 41659 - DNA, 1124 bp, Bovine  19866881267977
gggcaaaagaagcttagcatttgctttgggatttcttgagaaatatgttttgtctgtacataattctatctcaaaataatatatttatattttcacaaatgtttctcatatgtctatttttgtataaagacacacctgttttttttttaataatattactatccatcttttaaattctgttgtagtaatcataacatttgttcctttagcatttttctggaatcaatactgattttgctgcgatgcaatagtttcttgttgatttttactggaaaagttgtcctcctgtggattgaaatatcttacatctctatcttttcacttgctgctttcctttgccacttatgcttcttggcttcacagcgagtgtttcctgattcacagtttagtaaattgctgctcacaaaaatgaaactgtcaaagtaaaaaatgcttttcacgaaagaatctaaaactgtggtggaatagcagcagacaaaatggttcaacaaatactgctataatctttctttcattttaccttttactttaaaaatggtttgcagaacctcgctttccttgattcattcgtatttactcttagtacctatgtttccagttacccatttagtaaattactagaaattaactaatattagaaaatgtttattctttttctgctctttgttcccccttcatctttgtaatttgattattaataggcatagtacattttgaggagatattggtaatatataacaaatacttcagaagaaagcatatgtatatattaataatctgatttcttaaaatatgttctaagaaaataatcaagcaaatttcagcttattcattagtaagcggtttataattagctccttccacctccacctcctccatcatgaagaaaacaatccaaatgttgatgaatataaaataaagtttaactttaaaagttatggtgcatgcaaataatatgcgaatcatttgctataaatttgtgatatggatatataaatacacacatacacatatgcacaaagatgtttgatctgtagagttggtggtggtgctttagaagctaagtcatgaccaactcacagcaacctcatggactgtagcccaccaggctcctcagtccatag

SEQ ID NO: 41660 - DNA, 1847 bp, Bovine  19866880479249
attcatggcttgaagtttctcagagcagagaacaaagttttctcaaatggatcatcttgaaagaaagcaacatttaagaggagaggttaagaggagaggtgagtgattttattttaagagcatcagtttgggaaacagttcagctttaaattgatataactttgacaaagtataagcaaagtataacactggcagcagatggtgctaccttttacctcctaccttacacctcacgggaccaatgcagaacagggtgagctttattagttacggagaccatgagctgactgtaagcttcacatcccaccacccttctttggatgcaacatcaagtggtacagatgctactctagggggcacagcagcatctgtgaacaaggacctcttctgactgtttaagggaccatgtcaggcttctgttgtggatgcaaagctctgagctgcatcattttggatcagtgagattgaggtatgattgggaagttttcaagtaaaagggggtaggtgaggcccaggtcaagcattaagttcttagaaggacatgagaaaggacagtgtgaacctggagggtttctatgaccttgactttgggggagcatgttaagaagttacaggatgggagagccaaccccctgtcaaattgctctttcctgtaatgccatgagggctctattgtttattaactggggagcgtgttgtttgtatctcaaggttttagaggaacactttgattagagaacaattattttatttaattttcaaaacagcttcattatgtagaaattattatccttattctataccatgaggaaacaaaatttggagttgttacccttacctaagcccatgtgggcagcatcaagtacaaagcctggatttaaaacaaggtttatctgactcaaaagtcccttttcccagaacttcgttgtaaagaaggtcaattttattaaacattcttctaacattgaagtgtaaactttgatcagtagagtgacttgcttcatagtccataccttaataagcagtgaggccaaagcaagaacacacaggtcttcccaaagataacattacataccattggttctttaagtcagttgtttcctgtttactcaaagaaaaaggacctcaggaatatactgcatacttcatttaagattatttgcctcctaaccttaatattcttgaaatccaaaggtttcctgagaatgaatgctgagacctatttttactgtcaaaaatttatcaacaagtttatcttttagactaatggaaaaagaaaaatcttttggccaacaataaacatccatatttgacccaaagttcagttctacaggatgctgaaggtataactttttcacatactcatcaatattttcttatattcttgaagcatagaaagggaatcattaatcttgttgggcttgtgacaatttttcttcaaatcctttagatagtgtagagtttatcaaaagattgtagttgaattagcaaaacactcatattaactgatttggcttaatactaacctttatttatgaaaatcaaaattttataaaaaatagatcaggaacctggcaaaaatttttagactttgaaatgtttacaggtttacatttttgaaatgtaagattaatacctatgggtaaaatgcttttaatcctaatgctttgaaggactttttaaaaagacttaattgagtttcaagctatgagctgtatttatacttgatatggtatcagtgcatgtgttttctttaattttcttgaatgaccagtattaccaatagaaagtcttttaaataattttttatcagaggaatgaaatcaaatatgaagaaatttcttagg

SEQ ID NO: 41661 - DNA, 1545 bp, Bovine  19866880654568
actgaagaattgtaagggaatgagtttgcaatgttccttgaggtgctaagacttaacatccccctcttttttccctaatatatacaggacagaaatatatgtttaagatgaacaatattaatgtgttagtaaaactgctgagggcttcccaggtggctcggtggtaaataatccacctgcaacataggagatttgggttcgatccctgggtcagaaagatcccctggagaagggaatgtccacctgctctggtattcttacctgggaaatcccatggagagagaggcctggcaggccacagtccatgggatcacaaaaagagtcagacacgacttagtgactgagcatgcatgagcacacatgcattctactgaatgaggacttaacttatcctttcctctcttataaaattgtgaaagggtgcgctcttgttagaaccatgggacacctccttcatacacagctttcttctgttaatctcacttctactcttcatgattaaactgtattgaaagacttcttccatgattcaagaagattgttttttaatatttattttaatatgaaagaaggatatgctcattcatcatcagaaatgttgttaaagccacacttcttatcaaccattgatgatgaatgggaagatctttccttagtacaggagaaaatattgcacacatcttcttgagtctaaccacaaatctctcttaataaaattcagctcatctgtttgcagaatatgtcttcagtcataaaaggtatagtgacagcagaagacgtttcggagaagatcttttatctaatttttttttattgtgattgagcttataagtagataacaggcacaactgaaaccacattagtttttaacagagaaaaatttaggccgaaaatatttgttttgagtggacagcttgtcatcttgtcatataatctctgatatttattagctatcagttgagtgtataaatagttctagatattgggagaagttgcaacagaaaagaagccagcaaacaacgttcttttaggagctagagtacacatatattaaataaaagataatgctgtgtttgctgaagttactacgatatgcagcccttcatatttttaccaagtacttgctattcatggggtcctaatagtcccagagctacagctatgcacagagcagtgctcctgttgtcatggaactaatatttaacttgtcccaggggtcttccatgtgtcccttgagaatctagccagcatattttctagcatctaaaaattctttgtaggctggcaaaaaaaacatgctctttaaaaatttaatgtgctgtttctttatcttcaggaaaaaatgatgaggaacaaatttgaatcagatattgcagtccaaatattttcactagctgctggatcaccctaaaataaggctctagaacaccgatcttgaaccttggaagtattagaacttaaagaatcaattttgtgtcagaatctttgaacatatcaggaggtcagtcctgcatcgttcattcctctgatcttccattgctgtca

SEQ ID NO: 41662 - DNA, 891 bp, Bovine  19866880720827
aggagtgtacattgctgtttgatccaactgaataaatgtgcaagtaaagaaatgtaaacacacatgtatgtgtacattccatctgaaatgctctccttttctctccccacatctcacatctcactgtataagtaaccagtggtcttcaacatatgatgctcaagtcaagtctttattttctcataaagatctgagactttttttctgctaagttgagagtgatcttcccaaacaagatgtagtatatgtttattacttatagtatctacacagtatgaagaattgaataggcggttgtatgatgtagaaaaaccagtgacaaatggcaattagtcattttatatacatcaggatgtaaaattgatatgtcaaatgacattaagtatgaatatgaaaaggaaaattagtatatattgtatttaattgtagttgtaatttcattttatctattttttaatctttcttgaaattctaaaaatattctatgaggtccctttacttttttttgctctctttgcttggactgcttttttccccctatttgatggtggtgggaggcattctctaaaagttttattatattcttgggtgtctccagggtgtatgtgccctccaatgcatgattcttctgccaaaaaatgactaaatgaattgagcctggaaatgatctgctgccacatttgacacacttctctttcagataacaataaaatatactttgcaaaattccacagtatgtcatgtttaaaaacaaacaaacaaacaaaaagcttatagaataaaagagccccttataccttgagaagtatttaaaatattatttacttctctagttgccttaatcaaatattatatatgtcttgaattttcaaactctgaaatatttggaat

SEQ ID NO: 41663 - DNA, 2398 bp, Bovine  19866880787985
tagtagatataatgtcatctgagttaaattcaccccttccgggtccaacttagttcactgattgctaaaatgtctgtgttcactctatgactatgtctgttggttccaatttctaccgatacataaaaccaattttaccagtgtgttaaatgtgtggttttaccaaaaaagtaaaaacatatgtacaggtgtataaaatagatatatgaagagtcataaagaccaggaaataagagattagatgtagttttgcctgtgcctgtgaaaatacagtggtagtagaaaatagaaaaattcaatcttgtatgcttgtatcaataataaacaaaggaagaacacatggcaaaagtaaataaaatggttaataggaagaatgagataatataagaagaactgtgtaaaatgatcaattgattgtggaaatacatttaactcttttttcattattttatatctcaagtttcctgttcaattaagtcagtaatgagactctttctcattttcttattcccttgtcttcaattaattaatgcagtgaatgaatgtgaagccaaatttaagagaaatttcttatatagaacaaataggtccaaaggaaaagtttatgagtagaatttaaaggagtaaattaaagtaataaaaatgacagccaaaattatcatattatattttgtgtaacttctttcaaaattttgggtgaatattatccacttaccgtttttaatgggcacagagtttttagttttgcaagatgtaaagagtttaaaaaaggagagtggtgatagttgcacaagaatatgactatgcttagtcctgctgagctgtgcatttagaaatgattaatatagtaaattttatgttacgtacattttaccataaaaaggagggggggaaagaatcaaaaaataacatgctgaacccagctgaagaattttttgaaatcacaaaaaggaaagtacagtctcatcatttttgcttaaaataatagaagcaaagacaaaagagtatgagtaattgaaatccaagggtttcctgacaaagattaattgaggaaatggaggggaaagaatttgatagtgcaaggtgtgtacagatgaatgcaacatcctttgtactcacagatgctggctggtatcactgtatatagtcgctgagggtgactctcatgaagttttagaaatagtcatcttcaatctttccattcgcttttatgaaagttataaatattttaaaaacagtgtctctgaatcagtttttttttttttgtcttgctgatacaacttttactgcactatttcttgatttactcttttatctctgacaacttgtagtcctcacttctaattagaagatgtccttttccatcaaaatataattggatcttcatcaaaataggttcattagagaaagagagaaagaagaaatgagaaaaggagaaagaggaaattcagacaggtagactctgagagtttagggcaatccagaaataaagagcttttaaaaaagaaaatgataggatgcacctattctgtttcaatcagagtttcttaacagctatgctattgacagttaggagcagatatatctttatgttggggctgagatatacattgatgttaatctgattttttgatttgtgatttaagacttcatctcttgacagctgaaaaataatattgatttggctgtctaagcctgcctaatattaatgcttctcactttaaatcttttaactcttttggaagccctacttggttcatcccaattacactgataccctgtttaagcagccattgtttcactcgcagaactgggtccttcatctagtgtttgtggttaggaagtatgcaccatgctctcctttttcatctctcaaggtatcaagtccatcattgggcacattttcgtagagctgtaaaaattattaaacacaaacctcaattgaaatagaatcaggaggagagaaggggacactctcagagtctacaatagcagagcccagcaggaagaagaaaactttcttcttacttaggaagagttcagtcaatgagagattgtcacaattcagccaatgaaaagcacctatattttgaactctaatttactccagtgcactcttcttccccatcacttcatggaaataaggatggggaaacagtggaaacagtcagactttattttttggggctcaaaaatcactgcagatggtgactgcagttatgaaattaaaagatgtttactccttggaaggaaagttatgaccaacctagatagcacattcaaaagcagagacattaccttgccaataaaggttcatctggtcaaggctatggtttttcctgtggtcatgtatgaatgtgagagttggactgtgaagaaggctgagcagtcccttgga

SEQ ID NO: 41664 - DNA, 1513 bp, Bovine  19866880803599
agcctgagtgttcctgtcttttcccatgtgactaggtagttcgcatctttacctctatacagtaatgccattttctcctttaaactgttgaatgtgaaaatattgcttagttgctaagtcacatccaattcttttgtgatcccatggactgtagctagctaggctcttctgtccgtgggatttcccagggaagaatactgaagtgggttgccatttcctcctctagggaatcttctagcccagggatggaacccaggtctcttgcatctcctgcactgagccaccagagaagcccgtgaaaagcttaccacaggcaaaactatatattctaaatttctctatgtaatttctctctataagaatgtatatgttcagtatattatctatttagatttagaagtacaaatatttaaaagtataagtgaatagacagaaatatggtttgtaaagaaagttttaacaaggttttatcctatttactttttcagtgccaactactttaatactggtttactgcaaagttaattacagatgaactacaaaatatagccttcactttgctattaaaagagagttaaatgcctactttgactggatatcattgcagaagcgaattttcacctacaatgtgagttttagagtcagtttgagcactgtgtaatctattgctgttaatggactcatctacaatggcatcctctaaatcatatttaatgggatatagtctacgtttttcaacatgtggtttttttattcatagagaggctgtattatgaaaaatattatcttagagtagtagtttggttgttaggctgacacacatgtgacagtcctgaggtttcaattatccacttgcatcaatcaatctttttgttttcgacactgttgcctgcagtaatgtcacagcttttctgtcagacagaagaactttgcgggaaatgttattcattacagctgcaaatctgtcaccgtgcctggcatggcttgttaatgacaacatttatttcaaagagccatgtttcgctttgttgcaggagagttgactttgtgatcgtaaagtctaatgaaatgccaagaagatgaagtgaacaaagttttccaaaaatatgctaaagtgatccaaatctgtttttttaaaaaggagaatacatttacattcatattttcatgctcttacttgtgtttgcaaacgagtacccttagaattaggagggctgtatttgggtggctgtagaaaagttgttcttcccctgtgttgcaataacatttccggtggatacaagttaattgtccaggcttggatgaaacatagaaaatgcttagtaatgttgcatttctttctgaaaaccctttgtgaaaactgcataatgactagtagcagtgcataatgattcatgaaaactaatatattcttactaatttatgtgttatttaaaaaattgtgtgctaaaagcgatatgtgttactgagatgagcgctagaagaaaagggagggatattcctcagtttaacg

SEQ ID NO: 41665 - DNA, 1642 bp, Bovine  19866880829778
cctatatgttcaatttcccagcccagcatggtgtttaatgaagctgtttaaagttatggtcataaaaagtcttatttttattgaaaggaaagaaatgcttttgaggaaatgctatagtagaaaagagggatagaaaattaaaatgcagtttgatcctatctatataagataatatgcccatatggaagatgtatactaatatagattccttctcatgaaggagaatcttgctctgaggattaaaatatttggggacatttttaaactatataagccaccactgcttacaaatgtaagatttatagcaattactattaaagactccatttctcccagcctcttcttccacacatacacacacacacacacatgcacaagcatatgctttgaaacccactagataactgaaattattgatggaagtgtctttaaacatgtaaactgttagaagcaaacagcataatagagaataattgctcagaaatcttgagtggttaatgttgggtagtgagatatgagtaattttgtaactgttattgttcatgttttctgtaataagtgtgtaattttagaatcagaaaaaaacaaatatttatgtattatttttttctaaatttaagcagagcacttgtgtgtcaaaacaaactgcagaatctgatatctgctctcaatttctcccttttaaaaatctcatcaatattgaaatacaaaagaactaatctttgtaatattctgcattgacaatatctaacctttctgtcctcttggaagtcatgaaagctggtcactgagttagtcatgacctgtcacagagcatgaacacacatcaccagggaaaaacatagtggcagtagggtcacaaagagtcagaaacgcctgaagtgacttagcatcacagtagacgtagcagtaacctgtgtgcatgctaaatcaattcagtcatgtctgactctttgccactctatgaaatgcagcccgtcaggttcctctgtccatgaaattttctaggcaagaaaatggagtggctgccatgctctcctccagggggatccttcccactcagggatcaaacccacatcttttgtctggcaggcaggttctttaccagcaggtacacctggtaagcccagcagtaacttactgacttacctctttgaggcactgttctcattgttttatgtacattaatgcatggaatcctcacatccctatgaggtatctagtccttttgtttcttggtgaggaaacaaactgagacacagagaaatttaaaaatctgctcaaggtcacctattaaaagggtagaactcagagttaaggccatatggaccaattccagaattcactcttaattcagtgcttaagtaaataataagtaattcaattggcatcaaaactctatgatccattttcatttgatttctaattatatctaaaacttctttctaagcatgatttctggcatatcacaagctctcattaaagaaatacagactattttaaatattattatgttactactattattatgtctcttttcattatttcacttcccaatattatttatttatttcatctgtaaagaattatcagatgtcagtctttcactctacacacctggtgaggttctttttttaatttt

SEQ ID NO: 41666 - DNA, 919 bp, Bovine  19866880877383
ttctatctataaatgtaaagataagattgcttcttggcaactaactacagggcttagaggaaaggactaatgagttgacatttgtatagacatttgaaaacatcaaacaagcatttctttgtgctgttagtagaattcagtgttattactgagctcatgtaagaacagttattaaatgaatgagaaatgaactagtggtatagagatgtataaattgttaaaataaagatgactgattaaaaaccaaaaggcagaagagatcataaggatttatataaagtcatttttgtaatattaccacatttgaattaagcacatgtaatgagttcataaaagacaggaaaaaaaatcagtgagacaaacatggaaggatgaaaactcatgcacctgttctctttcaaaaacctcacacgcataaagaaaaggataaaagatcgtataattccacacgaacaaatataacagtatgagctgactggcaaaatttgagaagctggaaagcacatctacaagtgatagctgattaagcaaactgaagaaagctgaaacttaggtgcgtagaggctgaatcagacagtcaagctgactgccaccagaaaaccccagaaggctcaagaattactccactgcagtcaaactagtcaatcctaaaggaaatcaaccctgaatattcactgggaagactgatgctgaagcttcaatactgaccacttgaagccaagagccaactcattggaaaagaccctggtgctaggaaagattgatggcagaaggggatgacagaggattatatggttagatggcatcatcgactcaatagacatgagtttgagcaaactccaggagatagtgaaggacagggaggcctggcgtgctgtgttcatgggttcgcagagtcaaacatgacttagtgattgaa

SEQ ID NO: 41667 - DNA, 1017 bp, Bovine  19866880969206
taaaagctgtaaaaataattccctttctacacatttcctgctaaaccctttcaaaatctctagcatacacgattcttccctccataacagtgccttttctcattttcctgcagaaggccacatagagcatttttgtctttgtttttgccagctgaatggaataaaatattaggatgcaatgattacaggggcagatcaaatgtgctttagttactggacttctgctcagaaggaaatatagattagagcaaatgtaggtaagaaaaaattttataggtgattgatatactgaaaatacaaattataccctagtaatagctgatatgtacagtaattagaagattctttctaccactaaacagagaatatttgcagactcaaatattgcctcatgacattctccagatcattgacaactctatgcctctgtacctgggccatgacatagtcatacagcagtatggattaaacctccagtccctctgaatggtatctatcttgattgaatttgaaacacataataattttattaaaaactagaaatatctaaagtattctcagctctatttcatttttttcttgaattaaaagtgaagtatatggtacatactctcttattcaaatggattacaagcattatttttttaagtatgaatatacaatattcaatatctacatattttatgttatgaattttacctattgagacttagaaaaaatgtgttattccatttctctcctaaacaggtccttactgttgcagactcagtgaatagtgaaaaaactaaaaaaatgttatttttaaatagaaaataaggtacatatgtaggaataagataaattaaaaaataatttgatcttaaaaattgtaaaatctgtgtggacaataaaaagtggactagggaaagattttttttaatgctatgaatgtaaataaactatctacaaaggaacaaataacaatgcatataaaacaataaatagtttttcatggggattgcagcaattcatatttag

SEQ ID NO: 41668 - DNA, 1571 bp, Bovine  19866881149753
tagtaattcagtaattgattttgtaagggcagtgtatccttcagagtcgtcttgtacaaagaactagaggggaagaaaagcaaaatgacggtcaagagtccattttctaaatgtatatctcctctattctttaaattatttagcaccagcatcctcctatatttttatttcagtcattgtatcatggatttttctcaaatccaatagaaaagcagtctataatttttagcttatgccactttgttctcagtaagctattttcttcatatatatatatttcttccttctttaataattgagccttccttgaaatgaacatttgttcaaacctatttttgtaaaatatatgactcaagactttttctctccaaacattctttgttcaaagatgtcatttgtcacactatttcacctttctgccacttgggaacagaattttaataccactaacaaacaatattctttacttataatttaggataattaacacaacataacaattgaccttggttattatggccttccaagagaacaatagaaaataaagaaattcatttgcctttctttctgctgacactccgcactgtggctggttgctcctgagacaggagacatcctgcatatcactttagattcgtgaaccttgtctaataagctgctctcctgccgcaggctccagggctgtgtgctgtcccatactgctgggtcagcaccacaatcgaatccactcttctttatctcactcttgagacctgtgagctaagcctcactaaccgagagccctggataactcaggaaaccaggtgtgacagagctgcacacctgggctatgtctcttttcaaggtggtgctagtggtaaagaactcacccaccaatgcaagaggcatagaagatgagggtttgatccctgggttgggaagatcccctggaagagggcataacaacccactccagtattcttgcctgaagaatcccaagaacagaggaccctgggcagtccacggtccatacggacacaaagagtgggacatgactgaagcgacttagcacagcacagcttacccatggggcttcccagatggcgctagtagtaaagaaccacccccctgccaatgcaggagacatgagatgtgggttagatccctgggtctggaagatcccctggaggagggcatggcaactcactccaatattcttgcctagagaagcccatcgacagaggagcctggcaggctacagtccatagagctgcatagagtcagacatgactgaagcagcttagcacacatgcatgcttacccatttctgatctgtggcagaatagccttactaacacttgctgtcttgcccttgagagaatctgcttggttcttattccccacttttcacacttaattccctgaatggatgcttaagcatttacaccagttattggagactttataggacacaaagagtgtatcactgaatacctattttaaagtttcaagctctattctaacacagtcaaatcaatcaaatctcagcatataaaggccttgagatttcactgttgtgcttttctgcaata

SEQ ID NO: 41669 - DNA, 1228 bp, Bovine  19866881178689
ctgacactgtttcacaaagtcatcataagatgacactaatctctctgtaattactcagactggctctactactactaaatttcctctacttcacttactgcagaatcagcagtaggagaaactactgtctatgaaaggtataccatgcctggagagacgagcaacctattctaagaataacagactaagaaagaaactttaacacatgcatcaaacttgatggagtacaaatgtaatatacacagtttataactacacatatagagccttcatttttttgtgagctagtttttaagaacaatatgatggaagaatgagaccttttcattggctcaaccatgcaaattagcattatttttaggttcaaagactaaagcaaactatacaatgaaagaaatccagaggcaaccaattaatttccaggaagagatgagtcagtgacattggtattcaaaatggcaatagctggactctttcagatatttatagctgtgtttggataatgtggtacttttgctcctttctctcagtaatgttcatttagggaagggagggactcagctttgaaatgtgtttgaactctgaaaattgctgcctcattaacccttcacagcaaataggatggtttgtactgattatatttattttctcaacagatcagtgctatggcacttaatcccactgagagctcagtcatcagaattcttagaatttgcttcaatatttcaaatattctccaaattgaacctcttattttctctttttgcctagatgatgctggatcaaaaatccatctgacgcagcaggtagacatggcagcccaggttgcctctggaatggcctatttggaatcccagaactatattcatagagatttggctgccagaaatgtccttgttggggaacataatatctacaaagtggcagattttggacttgccagagtttttaaggtggatttggctttgttttaattagttggtgatgagtcaaaaggcgcacaggccaggagactagtagtattcctgctggttttcttccacaatatttctgagagtcctgtggtccatagatcctgtcaggataccaaggccctacagacaaaactaccttctatttctgtttcttcatcaatttgaaagaaacagagaaaacaatgaccaaccacatgggaaagtatgtaattaagtttgtggttgaattaatgatcagttattttcatatcagt

SEQ ID NO: 41670 - DNA, 854 bp, Bovine  19866881242870
atatctgtatccccaaatgatctttaccctcttggtgcagtcatcaaagctctgatagggaggagttagaattagtatctgagccatcagagattctgagatgtctcaaagaagaaaaaggaggggaaacgtgttaactttttgtgttatgttaatgagatccttcatccctgtcaccttaaaagaagcctaagacacatttctctctctgattcctttttcttctccctctcctcctccttcaccaacctcccccatatctaaaaatgaaggttaatattaagcatcacattaatagttgtcaaatcaatcatgatttcctctgagttatgttacacagagcaacatgctttatcagaaatcaaagaaaggacagtgccaaaagtggatgagctaatgtaaaatcacttacagggcactctggagacagaaactcgtttaatatttaatatagtcattaacctaagaaagagaaggagatggtaatggatggtctactccttttgcctacaggacagggtactgaagtgagctgtcccttctgggatcacagtcacacaagtctaaaatctataaagtgggtcacaggtgaagggaactggaaaagtctcaagtctcccagatgtattgtttaagagcacagtcctgctcggcagtcatgcctgaagttggccacactggaggaaccaggaatcgtgtcaactgaattgctcaattagtttgttatggcaacagacatacggttcccaatacacacagtcaaaccacagcaagtaatcaattattgaaggaaaccatctccaagaagcattaatccattgggatatgaaaggttgtttctgtctctatttaga

SEQ ID NO: 41671 - DNA, 1172 bp, Bovine  19866881467377
taataatttattttaataagtcatgtcagaacaagaatattctaatgttaattgacaaaaattgacactttcattgttttattaagttgaacttgcaattgccatgtatgttcataaaaagctacttaaactttttttttaaacaaatatcatcaaaaagcaatattttaaaacctccactaggttggagcatggtattttgctcaatttggaaaaaatatggtacctacagttttgaagattagcaaaatctctctcctaacaaacatggctctgaaaacctccaacatgggaaaatgtccaaaatgtcatttttctaatcttttccaatactgtttgcttcctagatgaagccaagtgattggggacaggattgaatagatgattttgattaaatattcttatatagcttttgaaacttaaattacgtgaaaatatagtactgattcaaaaggacaaattaaaatttcagagaaatgaaagcactgtctctatttcagttgttggttgttttcatagttgttcctttattatgtgaagaagctactatactatcacttcaaattaacagaaataattaaacgtcagctggaatactctaggaacatttctctgtatgtgggcatagggaaccacaaaattcttagtaccgtgtcagttggataaaagatgactgttttcccttcttcctgaggaggacaaatactaacacaaatcacaaatccttagactcagccaatactattggaaggaaatgaactatcttttagttcaaaggatagtaaagtctgagtctctttactgttaattccagatttatttctttacattaatcaagcccattaactaccctcttgcttgtatgttttgagtctctactatatgaactcagaacacaacatcatttgcatattagaagacccttcctttagtgcatagcgatgccagatcaagactgaactgacaaacattagcaaggtgtctgaatttgagtttaatatcagacaacaatagaatgatgggtactaaagtaatgctttttctgctgctgctgctaagtcgcttcagtcgtgtccgactctgtgcgaccccatagacggcagccccctaggctcccctgtccctgggattctccaggcaagaacacggaggggtgccatttccttctccaa

SEQ ID NO: 41672 - DNA, 994 bp, Bovine  19866881638941
atattattatgatgatgactatactatgtgcatgtatgtgtttgtgtgttgtgtgtgaatatgtatctccaagtatgtataagaattatgtatttatattgcatatatttttaaagcaaaactaaaagttaaagtaaaatttaatattaatgtttcaatatctgctatattgtcaacaatttcctgtgttattgtattgaatagacaattctgagagaggaggaaatcaatctttctttgtatttatgacagacaacaaataataacttttcattgaatttttaaactaaccttgttagggccaatcagtcttgctcagttcatttcaaagggaaaaggtctataaagaaaacaaaaagttataatgagtaaataaatttatatctttgcccacaaagaaataaagacttattttctccaattttatactctttactaaatttctgatatgctgttttaagaaaactgctactaacagctaaaagattctattttgataaaaatagagccataactgtaaatgaatatttcaaagaaataatttcatgatttgctaaatggggacccctttcttcctttatcttattaagcatgagaaccagtgagttggaactggggcaaagttttaattattgtgtgtatatttagaactaagtatgaatccatgtatatttcacagcacttgaattcacagctccacgtgttttactcagctataaatgaatgagttttactcagtatgtccaataaaactcgtgtaaaattctatttctaaacagatttgataagatttttatttttataatttcactgtatagctgagaaagcagatccaaagaaacaagtaacttgacctagtaatctaagaagttagcaagatttggggtctcagaactcatcacctgacatagtgcttagtcactgagtcaccatgttccctgaggttcatatttcctggcttcagatcagatcagtcgctcagtcgtgtctgact

SEQ ID NO: 41673 - DNA, 2591 bp, Bovine  19866881709511
cgagatagtgatcatttactatttttcatcaaacttttgttctaaagtgtttttgtattctaactatattgtgttttgttagaaatgaaggaaagaatatatataataatggcagtcaagatttccaagaaaaagacagtcttagaaaaaaaaattaatgaaattgctcagtgatgctctcaaaatagcagtcatatcatcaaaaacgcagtctaacaatatctgttgataaatgtattgacttcaagaaggttcatatcatctttaaagttcaagtgtgtgaaatactaataaatatgtgaggttttgttctatgagcatctatgtctacattttttaagtagatgtaggagatgatacattgtaactagagaataatacaaaaagtaatttatgtagagtgtccatgtttatatatcccatatacttaagaaaaaactaaaaactatctcatcccatctttctcctttgttgtaggtaaataaatagcaataatgaattatagatttttataacacttttattccaaagatataacaaagggacctgtgccttgaatgtggtaaagaatcacaaaatgaaagtacaagtgaggaaacttctagaaaataggattgccagataaaatggaagaggcccagttaaatctgaatttcagataaacaacaaattgtttttcaatataagtatgttcaaagtattatatgggactttcatactaaaaaatatattcatataaaatttaaatttaactgggagtatagttttttgtttttgtttcgaaattggacagtgctactaaatatattaatgggtaccacattgttgtattcagagggccaccaagtcattgccacatttatcatttgcacaggaccctgtactgcgtcatgctatgtgtctgaacacagagtttttatccccactatcatttgaaaatcaagctcatttccctttgagcatagtttgaagtcaactcctaccaccacatttgctgttgtatgattagatccagttccttaagatttctcttctttaataaaattaattaaatttaatcaatttttattgcaatgtagttgatttaccttaatgtttcttttcttcagtctttctacttgtgaaaattaggatattgatatacacctcataagtgtagtgaaataattgaaatattgtccatgacttgtgcagtgcaatacttgacaaatagtaatagatttagtaaagcaaagaatctgcctgcaatgcaggagacatgggttcaatccctgggtcaagaagatcccctggagaagagaatggcaactcactccagtattcttgcctggagaattccatggacaggggagcctggtgagttacagtccatggggctgcaaagagtcatacatgacagcgactaatacacacacacagggattaatagagaggactctggaattgaatatcctggatccaaagtttgccacttcctaatcatgtggctttggagaaggcaatggcatcccactccagtactcttgcctggaaaatcccatggatggaggagcctggtaggctgcaatccatgatgtcgctaagagttggacacgactgagcgacttcactttcactttccactttcatgcattggagaaggaaatggcaacctactccagtgttcttgcctggagaaccccagggatgggagagcctggtgggcagccatctatggggtcgcacagagtcggacacgactgaagcgacttagcagcagcagcagcagcagtcatgtggccttaagcaacttactacctactgttgcttcaagttcttcatttaagccttaaggataatgatgatgtttttcataccgttgttgtagagtttaaagaactgctgctgcacataaagtctggactctgggcttcatgataattttataatgatggattcaaacaattaatattttaaggatgtaaataagcacttgctaataaatgtacaatttgcaacctaacattaccaaattcaagtatgttgcatccacatttgaaactattgcatcaaaattttgccttttacattgaattttgtgttaaaaatcacctcctaaattttaatctctgtcactattaggataaaaatgcatatctaaccaataggtatgtttactagaacagctgaaataaaaatttagcaagactatatattctctcacctggcttgaagttaacaacccagtatctatttataaactgtcagagctttctaaaaaattgttccaatttcttccacaaatttaatatcaaacctggagcatatggactgattgaaagatgacttgattgaaagatgtttctactgaaagaaataaaatgctaaactgatgaaattactggaaccctgtgaacccagcgttcacatttttacctgtatctagtggtactgagaaggcaatggcaccccactccagtactcttgcctggaaaatctcatggacagaggagcctggtaaggtgaagtccatggggtcacgaagagttggacatgactgagcgacttcactttcacttttcactttcatgcattagagaaggaaatggcaa

SEQ ID NO: 41674 - DNA, 1451 bp, Bovine  19866881711572
ctttttctataatgtgaaatttgattttggaagatgatttaaagatgagaaaatgctctcagtattgttaagtacagaatacaaaactatacatagatgataaaacacacacacacacagaaataaaagtaagtaaaccaaaatattagctgtgattattacctggcttaagaaatttattccagaatcctccttcacaggtttattgaaaaaaatattgtatacaattcaccatttttaatgtatagttctaggagttttgatgaaggcagagagttctatgaattttttttctggacatgtgcccacaacaatcaagtaaaaaacacttccatgatcctgaaaagcttctaaatgttccattacagtcattcctcccagttcccaatacataacccatggcatccactgatttcttttggttttgccttactctgaaatatcatattctgaaatcataaaatatgtagtttatgaatttggcttctttcagttagcataatgcttttgatatacatctatattgttacatgtaccagtcttcatttttttccagttctatagtatatggaaaatctcctgctctattcctaatccctttgttgagtactcattagaggtttgtggataggagtcagagagtggatgcaaactcctctcatatctgagctcccgtgggttctgtatttttacataatttggcttttataagcctgttaacattttaaatgattctttgtgtgatctacttctgtgatgccttgtgtcttgtactcctgcactctgccacaagtgagccagtgctcacatcctgctgttctttcctgaggtatcaagccacttagtttctctggtcttcagttctctgaagggttgaaaaaaggactctctgttagattttaagtaccaagaaggaaaggctagaatcttggagcatgtgaaatgcttactttttgttacataaaccagtgagcaagtagataaatgaatgacttttgcttgagcaattccatgtaaatttcattacttctttactgactattagctagcttttgggaaaactattagaaacttctctgagcatttatgctccaatagattggtttctggacccatagacatactggagagaggcttcatccagcccctactgaggaaattataatctgagtacagtataccaaggtaactggtagaaacaatgaaaaattcaatcaacaggttaatttgaataattgatgtcagatagccagttggtttgatttttacccctcactgaattgacttataattgacagtttgttttctgactgtgtagctgtctttatgcctattgacacataagattctcattcacagtaagcaaagatctcccctgagaaccagattttgactactctattactctgattatagtttctacatttttttttaatatggcacaatttaat

SEQ ID NO: 41675 - DNA, 1113 bp, Bovine  19866882071211
ttactttgaaatacaaacataatcagatcattaaaatacgggaggaagagagtcttagaacatgcaaaataatggttcttaagcttttatgaaagtttgatgaaagctgtaaatctcccccttagaaaaatatagatatgcacatttttacatccaaggttaaaaacaaaaacaaaaaatgctcattcatggaaaaactcctcaaaacccctgcttgaagggtacaaataaccatgtgccaagactggaggttacaaactcaactgctgaggagattagcatacaacagagcgaagtgggctgacaggactatggtgtgagaccatgaggcttggggagaaccagaccagaggctcagctcctcagcacctgccaggtggcaaggctgcttcattgctactgccagagcttccaacttttcaagacaaaaaccaagtttaaatttctgtgtaaaatttctcaatgcctaagtttcagcaactaattcatatttgtttaaaattctgtgcagatttaaaaaaaaggaagaaaacaagcaaacaaaaattaaaaggacatcacagctgtggcggaaaagcaaatgcctgaagcatatacattctgtatcatttaaaatgagacatgtattgttcagataagttctcagtagaaaaacaggcattttctcacagaaagttaactacttcacatgttcttgccacttcacctttccagagtgaaaactataggaatagcagaagataaggaccagatttccctaaggaagcagctttagatctgcttaaacctatgaaaacctacatcatgaaagccacagttttccagaaggcagaaatttttgtcctaaaaattcctgagggtaggagctacaaatcagtggtttcaatctttaaaggccttagtatggccaccgcagcacattcagtcttgaacagactttatgctgattggtcaaccaagatcagctagctgctaaatgtcctcccagatgactctgtgaattgatccatgaaatggagttatttggaattgtccatgcaagtgatcaacagcatctgcatggaacagtcatcttggctctatcactaaagacaatactaaagatttcagtct

SEQ ID NO: 41676 - DNA, 3010 bp, Bovine  19866880385831
accagggtgtctactgacatgcaatcatgttaggtccttccccagactgtgattaagagtgtctgcagcagggctcaggtaactgcatttttagcaggctccccatgtgggtctcatgcaggaattcacagactcctatgagaaactccagggaggaaaccggcagggagaagtaccctggtagccagtcctgctctcgatcaagggctctgatgaggggagagggcacaggctgagtgaactccttgtgggatggccctctagcccttcctcccccctcaacttctgaaacagctgtccccctccacctcctccacaagccacatgctaaactaggaggaaagggtagctgtatgtggagatgaatgtggcatttggatcagattccaagcttctcttgtagctcagttggtaaagaatctgcctgcaatgcaggagacctgggttggattcctgggttgggaagactccctggagaaagaaaaggcaacccactccagtattcctgcctcgagaatcccatgaacagaggagcctgggaggctacagtccatggggtcccaagagtcggacacgactgagcaattaaaccaccaccaccaagtctttaaagaacccctgcagaggcaggcctagggacacaggcccatccattcctccccgtgaggggcaccataccttgaccttcttctctggagatgaatcctgacagcactgtgtggagaaaaagcagaggaagtcactgtcctcaggtgggcatgcccacagagagctctacctctgcaaaggtaactatccccgtcctccatggaacagagaccaggcggagggggcagggtcacactcaccctcggggctgaggcagaagtcggtggaggctgagccgtgctcgttgtggatggtgcatcgatacacgccacagtccacgggggacgcctgcacgatggccagggctgcgggcccctcatccccggcactgcagagaggagaccctccccctgaggccatcaccatggcacagcccaggccagactgtgtcctgagggtcctcagaccccactgtcagaggcttctgtgggcacaggctccaggagctctgggcagagccaggcctgcatcacacaggccaggttttcgatcctgactctggctgtgggactctgggcaaatgacttagtatctctgagcctcaatgttctcctttttacggtgggagtactagagtctcccttacagggttactatgaggattaactgaaggtggatccaaagttgggacaatgcccccacgtgatcactgctgccatgtcttagggggccaggtgggggtggcacccagctggcttacctcctgcccacctcgcccactgggcgctgatccttggcccacgtcaggaccgagtcactgagaatgttgaagaattggcaccagagcttcaggctgcccgaggcgtcaggaaactgctccacccgaatcttccgaatcacctgtggggctgggagcaagggcacagtggaaaggagtaagccctctccctgccgtcctacgccctctctggccttgcccccgcttccctgggtgtcattggtgcacaggctgagagaaaacaggattcaagtctcctcacacacccatcacttcacccacccccgccacatctgtgtctctgaggcctttgctctgacttcagagcacacagctttgctagaaaaaacccggccgtgcgcccccactccaggccaggcagagcctcacagctgaggccaaagacagcagtcaagagaggacattcagcttgtagcctgggctcctaaccctaggaccctgcatttgagtcctgtctgtaccactctgtactcgtgggacgagtctgcaaagaggggatgatggtggtgacaacgaatgatgatgatgctagagctaggatgctattgaagccaggccccaggccgagcccttgatttattctatcccatttaacctcataatgttatgaagttggtcctattatcagctccaagccacagagccagggcaaaaactaagcctttctgattctacagcctgtgggattattacatgggaatacctttacagaggtgcaccaggtctccagcaggcaggtgacccagcagcatcctctcctgggaggccatatctagtactcacctttcagcaggtctttggccttcctggacttggccagagcatcctgattgccttcctccagggccagctcagcatctagactgccagctttggggctgggggctgggtctcctgctgccaactcctcctctgcccgcggcacctccagcatgcctgcctttctgccttgagtcggggagcgtctctcgcgcccaggagtccctggggacccaggtgcaagggccttcctgggccccctgggggagactgaggggctctctctttcttcaggcttggtgccctctccatctcccacagcttttacctttgggagaaatctcttcctccgggccccaagagccagctcctcgggcgtcgccgcggggagcgcctcccccggggcctcctcctctggggagggctcctgggctctgctctcggttgacagcaggccctgcccaggggctgcctgcccaccaccctcctccctaagcagcccacccatgctgctttcccgagagacctccaggaggccaggcccctcaaggggaagctgtccctcaccctcactggatcctcctgaggccagcccagggccctccgcctcaccaaccacgatagcggggaccgagagggggctggggcctgggcgccgggcagcagccaaggcctgccggccagcctccacctcgcggtccaggaggccggtgagacggcgggaggtgccggggctcagcaggagggtctgtgcgctctgcaccaagtggttgttctccacgcgctccaggatgcgccgcgaggttcgcggactcagtccagccacttctatggtgggggccagggtgggcaggggcgccggaa

SEQ ID NO: 41677 - DNA, 3217 bp, Bovine  19866880386510
cgccccagacagtaggccttccacagacattggttgaattggagaattgtgtgaactaggctgttagaagtggaaaatccagccagtcctagtaaaggagaaatagaagccagttttaactagagtgaaggctgtagaatttagacttgagtttttgcaagtgtctggtattcctctttcagcgcttttgtacccaggaaataatccgtctttgctctggtgagcccagatttccccgtgaagacttaaggattagtgcagccgggtgggcagtacacagaggtgaccggtaacagcgcggccaacgctgacctctgaccaggggttactgccgtcagctctcaggctgactcgccgtttgtccttctctagtatttgctgtgtcattttctttccctccacctagttttctctaatttttcaccaccttctccttcttcccagtgttttctccctccttttccccgccagcccaccatcctccataaaattggtgacatgaatcatcctaggccatcaaaatttgctggtttcttagtgtttcctagctctggagtaaaatttgttgtctgctgttaatatatagagtggattaatccaactcttatatttccctaaaagaaagtgaagtcttctttttgtgtgacctgagtgaccactctccctgcaccgcccccccccaccccaagttagggtcattgacccttgaattatagattatataaagtactgaaagtttccctgtaaaagcatagttgagaaaatgggacccaactttctgttcctgaagtaagtgactagaattttatcttgagctcatgggctctgagttctctaatcccttgtgttcttatgccttttggtatatagaatctcattatcttgctaagcctagctataaagataactgctttttaaattttcttgaatgcctattatatacataaaatattttgtattatacacttttttttttagtgcttaatgtcattaccaccataactgtaaaagcgtgatgtgatgaaggtcacagctctgtcagctcagacctacccttggccggccttgactgtctccttgctgaagtgagtgttcggtcccttctggcacaaacgttccctgtcaagtgtcttgtgatgctggtgaccccttggactgcttgcctgtttggattgggttcttccgtaggggatggttcgggatgtgaggccatggggtgaggcagtcatctcagaattacctaaaatgccttaaaggacagagtatttttaaaaattaaaaagaaatcagagaacagagggagaagttgactggcacatgggtgagcccttgggtgtgtccaccgttggtggctcccgcctggtttctccgtgcacaggggtcggtggtaggaggcctcggactctgaggttctggagtgcaagctcttcgtccgagttgcacctggctttcctcgatgcctcctgtattgtaggcactttgctggatgccttgcggaccttatctctcttcagccctctgaggtggctggtgtcatttcctttctgcagataaggtgccagaggttagaaactcaccctgggcaaacagttaagcagggatgcaaatccgttgttcctggtgcttatctcctggctggttgctctgataaccaaccacctgtcccagtgttacatccaccattctctggcctcccactcagctatgagcatcgtgggtccacctgggctttaagcaggcatcctgaatctgttattaaaatttcaagtcttgatttactgtggagatccagtcctagcttaggttctcatgtctgtggatgttgcagctgtatttggccctgtcccaggtaatgcctctaatctcccctcttaactctctataatcagtcggcaggcatcccttggggctgctttctcctccctttcctgctcaggctgcaggtagccttccttagctaggacctccgtaggagccagcctggagggcaacccctcaccccttcttctgcccccagttccacacatacatgtcctgtcttgagccctcggttgcacttgcactctcctctgctcttgccacctctcctatagctctcgtgggctcagatttctctcccaagcctgctgcttgatgataggcctctggagggcaggggctatgcactggtttcagtacagttcccaaagcgtttggtgcactgagtaggtgtttggataaatacacccatctctaaggctgaaagggcttttatttctattccatggatctatctcacctgtttaaatttaacagaaattattggggtgtgttatgctttaacaaaaagccaaaataccctgaagccagtgattaatctgcagggtgatcagtaaagcttttgcctctcatgttggccgtgtcagggttgagcaaacgtgcctgggtcccgtccctctgctctgcttctgttctgctctataagatgagtgctggactatcttgggagagagctgttttgacaagtcttgtgctggagtttctttgctacaggcctcatccgcgtagacggaaaggcaagctcagctttccccacactttctggatgggctcaaagaacaccaggacttccctggtggctaagacagtaaagagtctgcctgcaatgcaggagacccgggttcagtctctgggtcgggaagatcccttggagaagggcatggcaacccactccagtattcttgcctggagaaccccatggacagagcgggaacggtccgcttttattctgtgtgggttgaaaattcaccttcagttaagatggtgctcgttgcctgtcagcatgcatctccctttcgtgtcctgcacgtcagtgcagcactgcttcagccttgtcctttgctcctgggacgagcgaagggctggaggcccatggacggtttccacacggtcttcacatgtttgaggtttatagcggctcccaagtgaggtgtgttggaaagaagagaagtggaggagccacaggtgtgtgtttttaaagccagcaccatgaggtaccagctgtgtgatatttagcaagttctgacccacattttctcaagcataaaatgagactagaatacctggattttggtgaagatcatttaaaatagtctgtgtgcatatgttttgttaattccaaagcaccagtacatgtaaggatgatctttttctttcaggtacctttttcaaggacaaa

SEQ ID NO: 41678 - DNA, 1624 bp, Bovine  19866880603994
tgggatgtagcaaaaagaaaaaaaaaaaaaacaactcacaagtcagatcatgccactccttactgaggtccactgcttaccctggcttgtccacctgccctcctcctcccctcatctctctccctcttccatagcacagtctggaacacagtgtgtgctggaattatttattgaatgagtaaatgaatggctctgagcttccccatgtgctctttctttctggcaaccccctcatctttattggaagttcaggcttggagttaaatctgcttctggtcttttgcatgaacagaggcaattctttgaacctctctgatcttctgctctcctggaacatggggatgaccacttccttcccagaagtgtggaagtgatgagtgtcaggtgcttagctgagtgcctgtacgtgggaggcactggacgcaggggagcattatcaggtcagaaggaaggtctgggggtcctttgacagagcttggcttttgccaaggttctgagaacttcagccaagtacagatgctggtccttacccctccctgctgtctcttcccctggggtcccccagtcatcactgtgacccactcactcccaggggtgaggacatctctactgccccccgtgctagcctggccagctctgcttgtctgacgtctttcccttttgcagaccgaggctcctctactcatccgaccctacttggcagacatgacactctctgaaatccacgttgtcatgaccggaggctacgccaccattgccggcagcctgctgggtgcttatatctcctttggggtacgtacagcccccttctgcttgctgaaaaccaagaacctgaaacctacctttgtgggagccccacacagctcctggccagatcgttctggggtcttctctcatgggctgcatcctgaaccagggctcctgtgatggtgggggtagaggcttcacctgagtaaggcgggccaggtgggctgggccatttgggctcctcacgtggccaaagcatcccagtgttctgtttactgagcaccaactgcatgctaggcaaagtgcgaggtgtttagtatcccgattttacagatgaggaaattgagactcggagaataagtgaggtgtccaaggccagaatttgagcccagatctgtctgactccaaaacacagacacactgtcctccacctaggccatccctggagatttgtcctacttttcttccacccctgcctcctctccaccacattctctcttggcacatgtccttcctctactcctaaattattacttgtgcagctttctgagcataatgcatttctaggtcaaattccaatggtatgaatctggcctttaaacccatcccaacactactgcatggcaacctgagatgaatcttgtgtgtcccaacaaagtgcctggtaataatgtgtcatgtgtgcgtgcgcgtgctgagccacttcagttgcgtctggctctttgtgactgtagcccaccaggctcctctgtccatgggatttcccaggcaagaatactggagtgggttgccatttccttctcaaggattgtatttggataaaacactatacttgtctttgcttttacatgcaagtctttaaaaatctcattttccc

SEQ ID NO: 41679 - DNA, 1215 bp, Bovine  19866880625360
atgtgctcatttgctaacatggagtactactttaggttaatgagatagatttcaggtcacagctcttttttcctttgcatcctttttgtactgtctggattttggagtgaccatgtattactttagattcaaagaaactataaaagcgttttctttttggaggaaaaaaaggaaaacttaagatttgaacgtggtaaagttagcctttcttcatacttcccttgaaaattatcccaagcaactagggagggggttgaaaaaaatcctggaaatgaaaactctgtctttggagaaattaggagatgtctgcaaccccaaaccagaaaacaagtggaaaaagttcttgaaagattggaccagggatagagaggaagtagaaaacactcgtagctgcagacctctggaaaagaaaactcaactagcaaatagcactttccaaggtgagggatacaccctggggtttagaaccaaaacgtctggtttgaaagagtggaagcgaccgcacaggctggtggcgggagctttaccggatccagtttgattccaggacgcagaggagggtgcactgaacgaggacttacacaagtagtgtttgtgggggcaggagggacaggactctgctgtgaacagcgcccacaaccacctgggtgggggacgagaagctcaagaatatctccccccaccctgagtgcccacgtacaccagaaaaggaaagagtacttccacccccctggacgtggctctggctcctctcccaagtgaaccttcttcaaatagctaaaccaagatagataaaaaaaatggaccaggtcaggatcttaccaaacataattatttttttttaatgatgaagaaacatgaaaataaagagctgacgatgaacagtactcactagagaaacactggcacagaacaagtgaaaatttgaccaaatattttacaagttaaagaaaaaagtcagctcactgctgtgaagagttggagcacaaatcagaaatacaggaactttgggaagaggtggcaggtcggcaggcaaagaaatctaaattcaggaatgtgaagctaaaaatgaaagccatctaagaagtgaaggcagagttagcagtgacataagacaatgtatagaaaatagtgaagtaaataagtgaagtgaaaatagtttataaatctgatagttagaatgaaaagtacagaaattgctaaggaggaaaaaaa

SEQ ID NO: 41680 - DNA, 2709 bp, Bovine  19866880879337
ctaatgcgtagaattgactcatttgaaaagaccctgatgctgggaaagattgaaagcggaaggagaaggggacgacagaggatgggatggttggatggcatcactgactcaatggacatgagtttgagtaagctccaggagttggtgatgaacagggaggcctggcatgctgcagtccatggggtcgcaaagagtcagacaccatttgagcgactgaactgaactgaactaaagtcaccttcagcatcggtccttccaatgaatattcagggttgatttcctttaagattgactggtttgataataaataattatcattgttaggatgtacttccacgtggaggcctgaaaagctcctccttcttccagaccttgtttaagtgtcatctgctctgtgaagcctgcttagacctccccggggcagaattaacatgccttcattagttccactgccgtattttatatgtccttttatctatcctttggtacactgaacttcaatcatgcccagttatctgaatcaaacgtatggtttcaaggcctgatataatccagaaaaagaatagtcactgtgggagaaattcttgcttttttaaagaagagattgttaacccacgtgagtctgtaactaggaaagttgaactgaacgggtggaggaatacttttggggtagagtacttcctgggctgggcctgccctattccagatttgtcaacatccttccttccaactccttccagctgctaactagactgcccagagaaaaatgcaccataccagccttacctctcaccctggaggccccagctgtgcccagcttctttcagttccacaaaaggatgccaggcctcccctacctctgctgtttctgcctcgagcattttcgagccctctcttctcccttttcctagctgttctttaggcaatctttgtcccctcctccaccccaaaggctttctcttatctctccaagatggctcaaattatttctaccaagtaaagatcccttggagtcagaaatggcaacccactccagcattcatgcctgcagaatcccatggacagaggagcctggtgggctacagtccataggggtgcaaaagagacacaactgagccattgagagagagaggaaagcagccactcagaccttcatatttcccctatcacaacatttactacattttattaatatgttaattgtttgcctggcttttctgcacagttgtaggtttcacaagctaggaaatatgcctgtaaaagtagccctgggcacaaccgacccatagttgatgtttagtaactgttgttaagagtaaaaagaaagaaacgaacaagtgaacagaaggaatgaacatctggcagctggcgcctgcatgcattccctgcctcgttagcttcccaagggattctgtgcagcttggggctaagcaaacaacaaacaaacactaaagccatctctcggggatagaaagagagctgtatgtgtgtaagtcactctgtcgtgtccaactcttggcaaccccatgaactgtagcctgccaggctccccgtccatggaattctccaggccagaatactggagtgggtagccattcccttctccaggggatctttccaactcaagggtggaacccaggtctcccgctttgcaggcggattctttattgtctgagccaccggggaagccaccaggaaagctgaacctaaaacatttaaaatttcaaactggagagtctcagaatatgaattttcacccacttccttcgtaattcagacctacctaatttaacatgttttcaaggaaagaaagaaaagaaaggaagaaaagaaaaatatatagacaaaatacttcaatgtcataatgctgagtatgattttctctaagccagggctaaggatacaaggtccacggagcacctgaaacggggtcagtctaaactgagatatactgcaagtaaaaaatacgtgctagatctggaagactcaggatgaaaaaaagaaatgtaagctattggttctcttcgttataagttgaaatgataacacttttaatatattgaattaaataaaatgcattaattttaatttcacttatttctttttactttttaagatggctcagtcgtgcccaactttttgaaaccctttggactgtagtccaccaggctcctttgtccaatggatttttcaggcaagaatactggagtgggttgccatgctcttctccagacccagggatcgaacccgcatgtcctgtatctcctgcattgcaggcggattctttatcagctgagccatcggggaagacccaagatggctaccagataatttaaaattgcatttgtgtgcatggagaggttaattctcaaactaggtcaggtggctacctgttttctgctcagatctgcttttccagtcctttcctggtctatgaaatgcccttgaaccctggcattttctctccactgcctttggtgtgacctgtggggccgcgactttggtgtggcaacaggttctgtgccctgtgtcctgaccttggggcctatgcgcccagtttgctcaccaaagccctcaccctggctggagcctgtgacctgaccgggcaactacgtagttacctctggcgtaaggcttggttttagtttaatttgtttttgttgcatgtgggagtttggcaaaaagaaataaatctgttttttctttttc

SEQ ID NO: 41681 - DNA, 1680 bp, Bovine  19866880976029
actcttcgcttccactgaagggggctcaggttctatccacggacagggaactaagattccaagtgccacacattgtggccaaaaaaaggcccccctgagacgggtacttagaccaagacttggaaggaggagcagaggccagaagaaatggggaaagcattccaggcaaagaaagaggtacatgcaaaggctctggggttgcccaaagcactggcttggagaagtgagagacgtctacttagaacaagtggtaattgtgacagagtgacccaggccaaagagcagttggaagctactgaagatttgacttctgacattttagcattacttgggctgctgtttgcagggtgattgtaggtgagtaagcagaatgcaagtaccttaatatttttaaatcaatttataaaaactctgtatgttataaagatattaattcttttccattttctattaaaaaaaattttttttggccatgtcacgcatcatgtaggatcttagccccccaatcaggaatcagacttggactgcttgcattggaagcatggagtcttaaccactggaccaccagggaagtcccacagtttctacatatatttttcctggtctttttattttcctttcccttcattccgtattcaggaattttttaaaatacaaatttataccaaatctttgcatttcttatattatttctaaatttaagagacttacctccattccagaaacctggtaagggttaaattcctaaaacagtatgatgaagtagttgaaatggtgcgctcttgggagtcagacaaaactgagttcaaattgtgacacagctgcctttttgctgtatgaacttcagtcacttctaggagcctcagtttgctcctctccaggatgagagcaagaaggctattctgtaacaataatactattatcctatattttctaatatttaatgtttaaaatgttaatatttatctgctttaatgatctagaattaaattttttatatggtgtgaggtatgggtctaagcctatcttttttttccccccaaattgttccattttggcccttagtacttctaggaaattacacaactgttcagagcaaaagggaaagagagttatattgcttaaatacctactctagggacttccctggtgatgcagcagttaagactccgtatttccaatgcaggggcacgggttcaatccccggttggggaactaagatcacacaagctgtgtggcctggccaaaaagttaaaaattaaataaaatctgaaattaatatagaaaaagaaataaatacctactctatgcctatttcttcctatacatgatatgatctctatgacagtcctcccagtcagatagtgttattcccacattcctgatggagaagctaaaatttaggttcccccctggggtcaggaagatcccctgtaggagggcatggcaacccactcaaatattcttgcctggaagattccatgaacagaggagcctggggggccacagtccataggtcacaaagagtcagatatgactgaatcgacttagcgtgcctgggggtggtttgagcacatccctgtgggaagcccatcacctctcatcttctgctttctcaggtcagagcagaaatcctcacaacgtttgccctctgtggattcgccaacttcagctccattg

SEQ ID NO: 41682 - DNA, 1151 bp, Bovine  19866881014554
atttgaggagggaggaaatgcgagagcagaaagggggtgaagggtgggggcacccatcaatccacccactccctgatcgcctttcccgatttgtgcctggggtgatctaagccctgtggcttcccccaggataggggaccctggagagagaagggtggtggctctgcttcttgggagagaataacgcctggaagacacagagacgttctgtccccgctacgcacagatggtgtgattatagaaccgacagcagttgtccagggcctctaggctgaactccgggccggtgctgaaaagaagcagaatctgtagtctgcgctccaggcctgggctctgctgaccactaaaggctgagcaacttcaaggaagttgctccatgtctctggtccaaacttctaagtttggtcctcaagccccgcttcctcttcccttggttacatcagccacagccataacgtttctacccccttgctctggtaccacaggcctcccccaccccaggtactcgggcctctgcgccccatcactgtcagcaccccggcccccggcccctagtcccccggcccaggcactcacctctggaaggcctggtggcagcactggtacacctcaaagctgctgctgttgagggtggtgttcaggagggacacacagtccaccgcagggcccctgggcatgtagaggatccctgtgcagagcaagcagctagtcggcagggtccagccccttactatcccccgcaacgccacccaaggactgtcagagagcccggggccccagtgcctggccctggactgagtcctgagcccaccaggcctgcactcaccggccacacaggcgttcaccagagacacacaggcccccgtgcagagcgcccggagcacgatctgggagaagtcgctcttccgctggggagccatggaggctgcaggaggataggagggctcagggccaggactctgcaggcccctctgcctcctctctgcgcttctggctgtgtctgctgaccaacccccttcctcttctggggggccagaggaacaggcgctgtccttctgatgcttgttgagtctgagagtcctccttggcctgactaaatagcattccacacctccccacatgccatcagcggcaggtgtagggaaagaaca

SEQ ID NO: 41683 - DNA, 1681 bp, Bovine  19866881053512
tgtccagtgtgcgcttggctcgtgcgccagccgttcctcccgccggtcacatcgcgccctctcttcttcccgtgtcccctcgccggccccgccatgctgtctctagattttttggacgatgtgcggcggatgaacaagcggcaggtgagcttggccgcccaccgttccccttgtaccttccactgttgccccgcggacctctggggccccagtgtgagggcctgagcgggtctgacgcctggactcttccatctctttgtggattctgtgttcagagatagctttatccactcgctgttttagcccttggctgagactgggccttctccgggcggagcgggaagcctgatcgtcacgttccattgcccataatgagacagggaagcaagtgcaaaccgtagggctctttgtaagtgggagttggggttgcttattgtgttagactggataaggcggcaaacttcaatcgcagtgacttccgatggattccggcaactgggtttagtagtgcactgcttctctggcttctgggatgctcggggagacggttataggcctcacaaaagccattctacgttgagcccgttgtacagctgggccccagcggtctgtactgacttcctggaaccaccttcgaggtcagagttgaaacagttactctgcttgccctcgagtccactttagcgttaaggtgtacctcagaatattagtggtacagggatcttgaaacttacatttcctgatttttgtccttaaaccttattccatcctgaacttagacatcatattccggatactactgttgcaattatttgttgttgttgtttagtcgtttctgtcgtgtccgactcttttgcgaccccatggacagtagcccgccaggctcctctgtccatggggtttcccaggcaagaatactggagtgggttgccatttccttctccaggatatcttctcggatcagagatggaacccgtgtctcctgcagtggcaggcagattctttaccactgagacacctgggaagccctgtaattatttagtcattggaaaaagttgcttttttttgtcttcgaggtcagtagtgtctgcagagcctagttttgcttgcctcggacctttttacagtagtttgctgttaagaaggatcctgatgtcactattaaaggtttttctcttggacttctattttgcagtttataattaccatttagggaagaaaatatgcaccctccccttattccccttcagacctcagctacctcagtgttacctcctcttagacatgtttcctgcttccttcagtcataattggtctttccttttcaaattgcacgacgtttatgactttataacatttaaaattctcacttgaatagtgttttttcatccatatctgaatttctaggtgccacagacatttctctggagaaattcttatttggggcctctattgttccctatgctaggttcagtgagaaaaatgcaaagataagtaagacagactctgaccttcaaggagcatcaatatgtagaaaatgactaaggcagaacagtaactattttgagctcttgctatatgtggagtgcattatatacctgtgaggtaggtcattttatgcccattatacaggtgaagaaaatgagcagcctaccagagattgttaggaggggagggaagg

SEQ ID NO: 41684 - DNA, 1422 bp, Bovine  19866881145734
gatcttgttctcctaattgctctagtggcccctgggagtgaacaggagcctggggtggaggatgttcttaggttcatgtttggaacacagtgtataatgatgctcacattccatttataggaatggcaaggaatttactctgtcaggaagaaaaatggagataacgtacaacaaaatgtgaagataatacctgtcattggacagggagggtaagtagaaaaaacaagtacttcagtcagtataccatgtttggcttattgcagcatatgctttaaatacttaagtaagttaagaactgcacatggaaacttctaagaaggactggtaaccaggtcagttaccaccaaagtgtgaccttccagggtggcttccccatggtcacagcccgaccctcctgctggcagcccagagccaccagactccaacagtcctgcttaagctgtgtgagcacatacataaaagatgaaagcatttaaatccgatgccacctcactgagttttgtgccaagaacactcactgggactctatatttaaaagttttctgtctggcttagcaggtaaagaatctgcctgcagtgtaggaggctcagattcgatccctaggttgggaagatcccttggaggaggaaatggcaacccactccagtattcttgcctggaaaatcccatgcacagaggagcctggcaaactacacagttcatggggtctcaaaagagtcatacatgactgagcacatgcacacatctggttttggtagcctctgtatcatttctgcacagaactatcaaattagataaagtatttccaatactgtcatttatagaaactcatatgaaacaggtgtgaccacaggttggaaaaggcagtatatatcaggagcctaaaagtgtcatagtttgtctcggaatctatgttaaataatacaaacagtggaaaattgagtgtgaattgcagaacactcaacaataaaatataccacaattaggaatgatgatcatagagaattaaatcacaggagaaaatgtttatgataaatacaaaagtcaaaatgtaaaatcatacctagtgtatgttcttggtcatgaagacaaggaggaggtgtggagacagtgttgtaaccacgctgctgtctgggagcccttccctccctgggcaggtgctcagggcctgctgggcgtcccttctcctcctcctcaccacggccctgcagtggtggcactgtgaccgtctctggttgacagatgaggaagctgaggctgagagaggtgggctcagcccagggcctggtcacagagcttggtgggagccgtgctacagacccccacactgcccatgaggctcacgtgttggtcagcagacctggtttccagctggcgactgcctcaaggaaatggctctgtgtgcgctctctgttctgact

SEQ ID NO: 41685 - DNA, 1477 bp, Bovine  19866881337743
atctatagttcctgtacaaaaaatggtatcactttcccccatttcggtagtgagggggtattccgatggcttgtgctcatcctatcctaccgtagtcactctcgtcccagtcgtcagggccattgtgggggttatacctgtttcagagtatatccatttcaactgtacgctcaaaataaccccttcattggctttgagtttccactgagtctactatggcacaaaatttagtctattgaatatctccttggatggccagaccacatgcttttctgttgtccccagacattggacttagcttgaagccagtgtcctacagaaccccctccccaggtctgagtattttcttttcctttccattcccaaataattgaacatagatccctttgggggaagactgcaaggaaggttcacaatatgcaaaataaggcttttattcaaagacatttgacatttggaaattaagtgggagattttgactctaccttggcagtttgagacaggcctctttgcccgaccagaagtctttagttatggtcatgactgggtgatatcttaggcactgtctggtctttttcattcctgggaccccatgatcgattaaccatagctaggggtctggtttctatgcccatgtctatcatgctgactcctctactgtgttccttctatttatctatctctgctgctgagatcagggagttcattttcacaggacctcttccaaccagcattccaggcccagagaggaatgccagcagagcctccctcgccaatttctcaagacagagtgagaccatcttgtgggtcctgtcagagaacagtgagagcatagttgggctggatgcttgccagggacccaataaagccctcttgtttcctgaaatctgtgagttcctgcctttcttggcttttgatcttctgttacaatttatcatgggtcagcatatccaccccacatggtaagaactgtggctgtttgaactccagaatctctggtgagtgagaacacatcagtaaacaaaacttgaatcaacaaactatgttatactatcttggtcaaacagccttaaagtttccataaatttcccctctattttttgacaaggtatattagctaactcacagggctttcctggtgactcagtggtaaagaacctgcctgcaatgcaggagacgtgtgttcaatccctggatctggaagattacctggaggagggcatggcaacccattccagtattcttgccaggagcatcccatggacagaggagcctagtgggctacagtcgaaaagagtatgacacaattgaagcaactcaggatgcacattagccagctcatacagtttcttctgagagtaactcttctgtttcctgatctgattctgtctctcgtcccttggattatgttgaaagtggattctggttactggcagatcaacagtgttgcatggggcagagtctgggtcccaatttt

SEQ ID NO: 41686 - DNA, 1278 bp, Bovine  19866881478058
gcaaggtttaaagtgataaaggcaaagcccagttgtgttttctttttttttaatactgagacagtaaaggaaatagggagtatgtggtaactggtgtgttttaagcacaaaagacttaatcctttctgttctctctgtattagtgtgaaatctcagtactttgcaaaatagtggggtaaatgaatggtttttgtgattcgttcaactgaggtggaaatcagcccatactttaattctaatggaatgagaacagggacattaatcttctgaaaccctcccctgtagagatcagccatcctaaatccattctctaggatttagccttcaaactttgcatacagactcttaaagatatcagcagagtatgaaacttggcaaattactgctaacagagcttctttgaacctgtctttgaggcttacatagtatttctattttctcatgagccaaggagagtgctgaaatgccccccgcccccaccccacctccacgtgtggtagaagattgctgcctgctccatttttccttcctgataacctaaagatggtgggctaactgttgagccagtagtaactggctgttttcgtaccagcctttctgagactcctctggggagaagtcgtgtgttctgctggcaaaggttgggatctcaaagttctttgtgatcctagctcgccagagtataaacatgcttgtacttgtatcctccgtgatccaggttcctcctccttttacacttactgggagggaagtctttatattttcttcacttgcttattttcataccagtcttataaaattactgtttctcctctttaactggatgtcatagtttgaagcaacagctaaatttctctgaaaagtaatcagatcatttaaaaatatttgactcactctagtaggcaaaaacaaacaaacaaacattatttgtggaatgaggtaccgtgttcccacgttttatattttactgctaaaacataagacttaaaactgggagattttattagtaaatagaatgtggtttttttggtcacaccacaaggaatgtgggatcctaggtccttgaacagggatcacacccatgccccgtgcattggaagtgcagagtcttaaccactggtcctccagggaaatctcagtagatgtatttttaaaagctctttggaaatgtaagaaatgccagaggtgcttgattcgttattttaagggaagtataaactctgtgagatttcacagggctagtgggaagttaggtggatttaaccattgtgagtgaag

SEQ ID NO: 41687 - DNA, 1487 bp, Bovine  19866881704199
aaaaacaagtgggaattgaggagcaagagtttgctagtatgtccgagtcctgcccagaagttaggggctgggggtggggagggccatgaccagaggacagagatatctgtcattctgcagtttcagttctcaaggctagttaataccctgattttttgcatcagtctcttccaagtttggttagtcactctccctggatctgaaccagctccacgtggcctacacaactgaatttcaaggcttccctggtggctcagtagtgaagaacccacctgccaatgcaggagacaacaggtttgatccctggtcccgtaagagcccacatgctgtggatgcggtgtaactaaagtccgtgcgccacaactattgaacctgtgctctcaaggccaggagccacatttactgagcccatgtgctgcaattactgaagcccgcacaccctagagcccaagctcagcaacaagagaagccactgccatgagaagcccgcacaccacaactagagagttagcccccactcgccacgagataaaagcctgagcagcaacaaagatgcaacacagccaataactaaataaaaattatattaaaaacaaacaaacaaaaccacctgagtttcaggtttctgaaacttcatacactgaagccctgagatcccaccaaaataaagtcacctcccaggatgacaactgtatcctctctatcagcagcacccatcacggtatggatctgatgtatccagtagtctctgataggtccctgtgccttacggaattaaatccaaacctgacctgcctttcacaagcccagctcagcttaccagcctcatccctggacaaaccaagcctctcacagctctgtgctttcacgtataactccctctacatagaatgtcctttgcccagtcttacatggtggtaacactgttcttcctccaaagcccagttcagaagtcaccctggccccaaagccttccctatttccccaggcatttagttcttaccctcttaactgtagctctctaaatacagggggttttgagaatttgttaagtacattgtagctcattttaattatctgacctcccctagatacactgagcttgagggaaggaactcacattgtatctagaagtcccagtacagtgtcaagactgaaacaagaaatcagtgttgaaggactgagcacatggaacattggcattaagttatttaaaggaaaacagagtctcacaatattcaagaactgaattgtccctacagttaatctcatccaaaatgacaacagggctgggaggcagtgtggatgttttaaaattttaataaaagaaactaacatgttgtactaaaagttaatttaatcagtacaaaaaccctaggaagtagggacttttacctgcattgaagctaagaaaagcttgaggcttttccagataggaaactgaggcaccagaagggttaaataactcaaaatcattcagttagtaa

SEQ ID NO: 41688 - DNA, 948 bp, Bovine  19866882102306
acggagatgggaagcaggtactggagggccactgcaaggactgatgttcactttcagatggaaggctggcggggacatgggggaggggagcaacctgcattggcaggcaaattccttaccagcgagcaaccgaggaaaccctattttatatatggtaatgtgtatacatcaatcccaatttcccaaattatccctcccccgtaaccctctggtaaccataacatattttttaaatgaaggaaaaccttctaatcctttaagctgcttgctgcttagtcactcaagtcatgcccgactctttgtgacccactggactgtagcccgccaggctcctctgtccatgggatttcccaggcaagaatactggagtgggttgccattttcttctccaggggatcgtctcaacccagggatggaaccagtgtctcctgtgtctcctgcatttcctgcactgcaggtggatccttaacctgctgagccatccatcagcgaaatcctttaagactgagcccaaattccacctccacctcaaagtcccctgtaccagtgcaaggccgtgctacaccctacgcccagggcggcaggaccactagggtggcccagcattagcagcacatgcccacagcaactaatgttcatggaagtttcttgtgctgcccacatgcctctcctgtcgtgcggaacatgtccctttggacactcttgcccccaagtccctgcctgggtcccagtctctctccccattgacttaattaactcctggtaattaaagctactgtttagtgatgaactgccaagagactgacctctctcacagggtgtaaatattttaaaaggggactctaaggggaaatgcaaacgtcttcagactcaggggaatggtggaacgttaagcactggggctcactggggatatgggtaggtggctgccttctaagggtataggtg

SEQ ID NO: 41689 - DNA, 1765 bp, Bovine  19866880556106
ctaatagtgtttgaacaaaggaggcccacatttcgattacgcagctgatcccatcaatattcatcattaactacatcttaaatatacaaaattaaatgtgactggattctgcctttcagatggaatacattttgctctttaaaagccacttaatagacaacctcatgcaaatcattctcaagttttacactatctacaatttaagtttatgaccttcatttttttttccttggcagttcttaaaatgaaagcactctattaatacttttaagatttaggaagaactcagaataaacgcatcttcactatacattaagtaggtattagagaaagatgacattcatttttactgtttaaaaattcactttcaatctaaagacacttctaagtgttttatactataattgaagactaggtatatcatgaatagtttaaagaataaatcaaaggaccaaactaatttactttaacagtactttctgggcaatcaaatccaggcaatgaaaaggtaacgaagaaacctcgttttctaaacgagtcacagtttaagaattctagttgttccttagacatccttagaatttcataaagcccagccttagctatctactctgcttgtgacggggtgtcccccatcactgggttggcagcactgtattgtactagctcacttctcagatcacaggcagaaagggcaggtggggggtggggcacagcttgggaagctggggtgtggatactaggttacatttgctctcagtctgggtgtctgcagaggcttcaaggactggtgagattctgtcctaaggagagttgatttaagtaccaaacaatgctttgaagaaaacgggtgctttgtgagccagtgagtgcctaggctggatgatcaattttcagggacgtgtaaagaatcatctgtcttatagagacggctacttgagtttctgcatgctggtagctcagatggtaaacaatctgcctgcaatgcaggagacctgggttcgatccctgggaccgtgaagatcccctggagaaggaaatgggtgcctactccagtattcctgcctggagaatccatggacagagaagcctggcagactacagtccatgggttcgcaaagagtcggagaagactgagcaaccgacactttcactttttttctccttgagggcagaggaccagaatgatatgggagatggaaggagagaaggagcaagctggttggatgaaatgccaatttatcctgagtggagcaaaaaaactcagcaacttaaaactatcataagaaaaccctgagacaattgtgagatatttatctccttagaaagacactcctgggagtgattacaggggtcaggactcaatgtagaatggtgtggcaactctggaaaacagtttggtagttcctcaaaatgctaaacacagagttaaaaaactcagtaattccactccagttatatacccaagagaactaaaaatatatgtccactcaaaaacctgtatgttcatagcagcattattcatagtagctacaatgtggaaaataatgcaatgtccatcaactgaggaatggatatacaaaatgtagtctgtccatacagcatggaatactgtcttagtctatctgggccctataacaaaatatcatagactgggtggcctataatcaacagaaatttatttattacagtcctggagactgggaaacccaagatcaaggtgccagcagattcagggtctggtgagtgcccacctcctggttca

SEQ ID NO: 41690 - DNA, 2614 bp, Bovine  19866880593167
gtgggggaggacgctgccggcagcctgagagaggggtctgtggctctaacacaaactttcaactaatattcctgcttccacctgccccccgcaccccatcatcaggaacactctgtacccctcattctttagcctttagtgggtcctgtgtacatgtcagctccccttcctcgcagctgggatattcaaccttctaagctttgcttctctctcactcctctgctccccgtctttcaaaagttttgctcacatccctccttctctatcacctacttttctgtttttcttaaggatttatacctttactctcatttttgcattcagttctttttgtggaggttcatgatcatatctaacagtaaatcaaaatcaagcttccaaagatacacgcaaagaagtctctccaggggtggggtcgggggaggatactccaataaggaaacatggttctttcaggttggggtagaattatagccaagagatgtttgcaatttctttctgttttgtacactttcaacagtaaataggtatcctttatgaatcaaaaagtcagagggttaaaaatcattattaaaagtcattttctgaaatacagatcaagatagtgtaaacaggtgtgtagaagaaactccaactcctcaacacagtctacacaacccatggtttttgcctctgtgccagggagtcctgtggctccacagaaacaccctgagcttttcagagggtggcaagtgtgggacagggtgctgagtggaaggggttctgggcaggtctctagttgtaccacagtggcactctttcattctgctttataggtaaaaattctgcttaataatttgatctttttagagagagccacactaataaagatgcttggaaattcccgatgaagatcgaaatgaagtgagggtgagggggaaagcccccaaggatgacatcatgctattaccctgtgccctacctgaaccatcagaaatgacagtggctgcttgaacatccgtataaggagcttggtgcttatagtgtacaaacttggtgtacaagaatacacaagtacacacacagctggcaaatgggaccaatctgcgagcttgttaaccacacacagccactctcagacaccaaaggcaggtgctcagccaaggtttggccagtgtcagtctttggcttcagtttcttcattcgcacaatgaaaggactaacgtcccggaagttccaaggagcatcctcttattgtacagtgactgcggactccctagagaaacagaatgtccccacctaaggactccttgagaagcggtatcaagttatgaaaattcaatccatttcctccggaagaaggttttaattcttctctggccaaataggcctgcctggctctaccatgaacaagcaagtcaaataccaaatgctgcagcctaaaaatgagctctagggctcctcagagcaaagccatccctttcttcctggtcagcagcagacctttgctgggaaactggcaaggatctaagttcacatccccctttgttggctctgagcacaaatttgggtcactctcttcctgttagcattctagtcctacagagaagctctcctttggctagatagtcagggagggtggattccattcaaattcttaacctatctacaaaataacatctcttcttccctcacacacttgtttccttttcgtgatctacctttctggaatggtccaaaaaaccagcagcaaaggtccctctgcctgacaggttaaagatgctttggaatcaatgagcatcaatgcactcttgcctgactctgagctccttatctgtctggaaaaagaaagagagcaagaaagacagaaagaaagagaggaaggaaggaagaaagaaagagagaggggagagaaagaaggaaggaaggaaggaaagtagagaaagaaaaaaggtaagaaatctttaaaaagagaaagtctcagaaaccttcagcacattcccttagaggacttcagctcaaaagcaactctttcaccaaggttccctttttgcaaaccagtcacattgtgcttgacgggcctttttcaccatctgtgtcaatgccacccccagctctctttggtggtactgaagcaaaccacaggaacatttccagtgaccgaagcaggaatttatatacatacagatgattcagatcatttctagagttgtttgttggttttgtttggtatttgaaagcaaagtaagtgatctgagtcaagcctgggttcgagttccattcaatggctgcaaaaaacatgtctgtgaacttgaggtctctattcaacacccagatcacatcataaaggaggatttatccttgctttgtggagatgaaagggaatggtgtgtggggaggggttcgcccactcactgcatctgtggtacttctttacccactgtgggcggctcctggaaataatctgaccccagagagcaaaagatacctgagttccgaaagcccatgcatctggattccagcagcaggacatgaggcttccccctcactccccacgctggtttctcctgcctggaacccactgagttcctgaagagcaagaaacctaacccattggcttcttctctatgagaca

SEQ ID NO: 41691 - DNA, 2227 bp, Bovine  19866880663806
cagtggtgagggctgcaaccaggtccacaccccactgcccacggcccccagctcacctcctcctccgtgaagcgtccatgctctccaagccgccccagctccaggatctgcaagagtgaccctgatatcagcagtgcccctgggacctgggagagcctgggtggggggccctgggagtcggtgtcaatcccttggcactgctgacttcgtggcgagtgaccctcagtggtggggatcgtcccacccactacagggtgtttagcaacatccctggcctcctcccatgacatgccaggagcatctccccagctaggtttaacaaccaaaattgtctctggacattgccggaagtcccctgaaaagacaagtggccccagttgagaaccaccactctaggacacatgaggacttcagacagtcaaggaagccctcaaatgtgtgtggggacccagcccccagccctgggcaattcacagggtgcagggaccatgacctgggcgccccagaggcagggtggggacggctcatctttagccttgaggtttctgggcagggtgggccctggaccccaaatggcgaggaccccctcactgaccttgtccaggaaagggtagtatacagggtgaggggccacctcagggagaaagatgaccagggcggctgcactctcagtgttggggttactccgcacggtcccacaggggttcagtagttcccctttctcgtctggacacagggacagatggagttgcaaggggaatgtcgccacgtccggatgcaccccacactcccacctctccctcctggcctgggcccacctgggacagagggccacatatagagacagtgctcgcccgtcttgagctggtccttgtagtcaaacagcatgaggttggcccaggcaatggggcagtcctgggaaagaagccaggtgggtcagggccagccgccccaaaggcctctgtttgctcaactgcaggatggttccagtcaggccacgctgccctgccctcacccacactccctatgaggcagccgggaaggtcagccacactggtttcctactgctcccagacacatcccaccctcggcttcttgagaaagcctctcacagaacatagcagccccagagagctggccccagtcaaccagtgagtcagtgcagttcggtggccagtcacagcctggtcctggtgactcagtgctcgaccaccaactccatccccagctggctgttgacttaggctccctgctccctgggaggacactgcgtttttccttccacccgagggagaggcctccaggttccctcaaggaccaaaggcccaggtctagatatcccgagcatccctgctcataagcccaggattccagcaccatcacacaccagcagggcagggggtggccagtggggtgatggggaggaggccggggtctgcaggcccacccagaccccattcccaggatgtgtgcgtgccagctgggatgcttgggagggatgaacagcagccccagggggctgcaggacaggaccggaccagcagggagtgactcccacaagctccacccaccgccttcttggacttcttcttggtggagcgggccttcttggccttctcgatcacagcgtaaagcgcgaagcagagccgggccatgcggggcaggtcacagatgttgatgtcaaactccagccgctgcttccacacgggctccgagcacacgctcacctccgagctggacaccgtcttgcatagcgtctcattgccatggaagagcccggcctgcaccaccagctggggaaggtgcacgcaagtgactggtggcagaggccgggccccttctccccctgcatgctcccttcccgctagggctcgaatatcctcctgaaacatccttatttcaagtgggcctgaacctccccaaccaggtgcttgaaggtggtccaataagggatgactggctgcctgagggggaaagagtgatggggaggggagggtggcgtgggcggctccccactgactgtgggaccccggggcaggttgctgctctgctttgggcctccgtttccctatcggggctcaggaattccaggggcccctcttggtcaagcacacaagaattgcatgagtccctctagacagggaaggatttaataccccagataacacccttaccctgtgtcctccatctctgctctcacccccccagtcagaaagctgcctccatg

SEQ ID NO: 41692 - DNA, 670 bp, Bovine  19866880794645
ttgtgaatcgggcccttttctgagcctggaggtggcagggggccacacaatggaagaggaatgtggattttggtggtggaaggaaggtcccgtaaggcactgcatcgagtgcaaggctgccgcgaacacattttgcattttgccctgttgtacgggcttcagggcaggagcccctgttagctttgacaggcgcctccagggaggctactgcccagggctctggtgcatttctgagcccgcctttcacccgggagaaccagcctttcctgggctcgctggcccctgagggatggacggtgtgaggagtgtccttggccccaacccggctcccttggtcctgtgagcgcagctccttggcaccagggccgccgaggctccacccccaccagctgctgcgttatttctgactcatccaggagttacaagtgtgtaacccaaacccctccacgcccggcttcctccccactggctcctcctggagggaggaaaccccaggacttctctcccgggacctcgccgctgcaggtcgggtctccaccgcacctggacgtactgccacccgcaggagccaccctgtgacaggtgggtgggctggcgagagcagcagctgcaagccccgggcgggtgtctgtgcctgcagccccaagctcgccgtccctatcgagggatt

SEQ ID NO: 41693 - DNA, 4499 bp, Bovine  19866880803698
ggacagtctattatcctcaggttcatctggggaccatcagtggagctggggtggtgagacaaacgtcagtgacgcctggactcttacaggttctgaagtaagttcagtccggttctggcctcatgccacccgcacccccgccccccaacactgtcagtgcaggatgtttatccggcccatcggatgggatgctctgtttgtagaggctgtgaccaaatttaagaactaggtatctgtaccagtatcttaactctgactttgctctcttggcctcagggcttccagcatgcatgtgatcaccatccagggacagttaaagtaaacctaacaaagcaaactcaaaacaatccatgtttaaattgttacatcagagtgttgctcttgccccaagtcttttgagtgctagtgagaagctctgaggcttgtagaatgaattttaaaattgcacaagagaagtattgtgaatattttaagaggaagtaatatggaaacaaaatgttgtaattttttactttttatttgaaaataattttacatttatagaaaaactacaatatatgtttagtaagctggtctttacaatttttgtttcatacctagcctacccacctagtttatctgtttttactgtagtaaaatatttcatttgcttaccaagtcgctgaatattcttaagttgaatttggcttatcagtctctatgcttaaggcaaaatcagaaattcagaagagcactgggcaatgtctgcattttagctcggggaccctgtgcttttaaaagagaactttaaaatgatgactgactgtgaactccacgtgttactcagagctctaaagctgacctctgggagagcgcaggttcaagagagacacagctgtgtaccagcgtgggtgtttagtggggaagcgttagaaaaagatgcaataaaatggagatgctctgtcttcataacgacaacactttgaatttggggcagagttcagtcacagtttagataaggtagaatggatttgaaagtgcttaatttatttttaggtacgttttgtttgtaaagccgacttctgggtaattcaggcaccagctgctgagggcaaggtcccaactagagaaagaggtcgctgatagccaagactcgaggcaaatcttttttttttaattgaatgctgagaaggattgtggagacacaaaatgcagaaggtcaggggcaggccaggaaaggtggggcactgagatgggaggcgtgctttgctgtcagtaaggagagagaccagctctgaagacaccctccccgttcgcctttagtaagtctagtcactggcagtgtctccagtgatgcctcgcttctgaggaacttgaagggctttggacatagtgaaacagaggtaatttgccagctttgctaacatccaaggtgaacttcctcttacatacttgccaatctcgcatgactagtagatttatttatttactgtaactggggacctcttacccggaagtcgcgggtgtcactggggccaagcccctaaggtaaataggaatgtttctctagttcaagtgtgttaggacacatcttctactaaaatgtaaaccgaaaaaaaaaccaacctctccgtcttttaaaacacacgaacagcgcccacaccgcatgcaagacagccaccttcctaactggcctggcggaagaccttgtaccctgctccatccccaagctgttctcagcaaagcagaggagatccttttgccctcactccgagtaaaagctgaggctgcccatggggcctcctggacccctcccattacctccttgactttgcccccttgaatttctccctcctgaaccgttttggctctactggcctcctttctggctctttaaaagaccagaacattggaacattccacagtagggcctctctgctggacattatctgcatggctgcctctcagctgtcccctttgcaggaaggccttgcagtgaccacgctattgaaaaccaggcccttccttcacattctctccatcctgctctatttctaatccacagcatttacctctgtccatcgtgcagtataatgtactgacttatattggttattttctctccctggcgggggcccccctgcaaacagaaattccccagaggtaggggcttcaatttgttctgacgactggaggtgtccccaatctctgagaatgccgcctgccacatggcaagaatgcaggacagagagaacgtgacgcatcagtaggatgttgactatgaagagcgtgacacccgctcctccccctgccggtgaaataaccagtattagctgctgtcataatacctgcttcctgtgctttttaaacataagatttatagctgagtttcctggtaatgaaggcaaaaaggcgggctgtcaccctgtataactctcatctggagaaagcacatgtgctccttggggtacatgtatgttgcttcttgtcacaagttctgaaagcagaatgttacccagtacttacatcagatagtgcaccagtgtaagcagcactgtcttctagggtagtttaacagaagatgactgctttttgcttcctcccccgcccctcacccgcctggattactggactgtgctttctgattcctccactaatcacccctagactagagcagtggtgaggggctactgagcaggctctttttctaggagtggtgaactgagagcagggatccaggccttttctccgccacaaagcccaccaaggtcatctgctcacaattagaagccattgggtttatcaggtggtttccctggtggcccagacagtgaagaatccgcctcgggtagaagacccaggttcgatccctgggttgggaagatcccctggagaagggaatggcagcccactccagtattctttgctggagaattccatggacagaggagcctggcctatagtcagatggttattcatttaaaactaagctgcttatttttagtcttactcttccaggaagtgctacatttaaagacttaacagaaaacagaatttgtttacaggaattttatttttcaaaatacaaatcagtgtttgcttatgtctcaggttaatctattagagaaaaggtattctccattggagcactgattacctttatattttgaatatagttatttgaagacaagatgttaacacaattaggctctctctgttaaagttgccaaagggtcataatccatttattgaagtatctgccttaaaaagttttaggacataatcttttaaaaaaatttttttccattcaaaacttttattctttaaactatttcaggtactttgttttttcaagtacctttttaatgtgaaaagtaatatgttagtgaggtagtttttcttttaaaagctgatggcttcagctcagaactttgtcttggagcttgatctgtggtatgcatagtctgatctaaaagaaggaagagaacaaaacactccagacaagacccgagtttccttctgcatttctttcctaaatgaaagcttataggactgtgggaaacttagtctgggccctaaacatgctttattttgaagctgaggagtaccatttatagtaggcacttgattgttccagaaaagttttgtaaacatccagataggttggaagtttgaattatgtaacagatttgactttttgcccactgttaatgtgcatcactatggagacagcctttttgcagctcttaaaaggactgagtcactcgaggacacaagttccccactgcattatagatgcgtggctcccagcttcctggagccagagacgcccttaattgtgtttaagtgattcctagggctggcggtacagtgaacagtcgtggggaccacagacagagcctaaacttgaagaaattctaaatgtattgaccatttgaaagctttcacatactatactatgagatgtaggtcacttcaagatgtggttatttgagagaagttttttttccagagagcgtgttttttttttgtttttttttttttttaagctaaatcctgtttggagaaagagttaacagtaaagaatttaaagttgaaaacaccaaattctgttaaggaccaagtgccttggtcctggccagtgtgaaaatgcagtgaaacatgtagttcctttagagtgttaggatgagctcagtatttttataacctatgacctatagctttttcatttttaagttttttattgtgaaatgatttccaacttaaagaaaagtgacaggaacagggcacacaccttgcttatactctacccagggctcttgtgtttgacattttgccacatttgtttatctgtttttgctctatatacatactttttttttcctgaaccatctgaaaatgtacagttttcaaatttaggaaatttagtattgatataactaatctgcagtctgtattccagttatatcatttatcttttgttaagtgatgatttagcacaagagcaaaaacataaaact

SEQ ID NO: 41694 - DNA, 740 bp, Bovine  19866880837649
caggttgctgggactgcagcagactgcaatggagtaatttttttttttttaaatcaccaaaccccccaccaaaaatttccccacaaacttatatttattgtagctgaattaaaacgcaaggtgcaaacatgaaaccaaattaagaaagaaatccgatttttttttaaaacaagaattcgcacctcatttaacaattgttttggaaaaatctactcttgtgagcaactgactcagctttccttacacagaaagccatgcggcgaaagacctggatgaacttcatggagccagagtttcctcaaagtgcagggagagggtttcagctttttagaaaagaaagtttttttaaacccccaaggaaaggggattgttctgcctggccatctagggagtggggtgaaatgaactgatctagcatccagaaacccacacacccctcccagaaagttacctctctctcctctgctcagcggctgccggctgctgtcctgccaggatgccggcaagttgcagactgctgctggggaggcaggacccaaaataagaagtgtcagctgggtccctgcaccgaaatgatgccaggagtcaacgctgcaggcgcggggatggtctctccccttttccctccccgacccggctttaatttaaacccctgacactgcaagatgcctgcttctacagagtcacatctccaaaaagcctcctcatcacaaggtccaaggcttttgctccaccttctg

SEQ ID NO: 41695 - DNA, 1234 bp, Bovine  19866880880153
cggggtttgaaccttggacctgctggctaaaaccatcgttagtttttgtcactgctcagatgctggagtgtcctgccataaaaaaatgtgatataggagcaggtggatttagaagtaaaaaccatcctccccaaagaaattctcccctcgccctgggtccccagaggtacctagctggtggtggccgtctggccaaccagctggtgtgagatttccagtctgcagccaggcccctgaccactggcccgcacgcctgtttgcacagagagctgcgctgacccttgctttccccccctccactgtctttcagactgaacaacttattgttttttctttctttttatctttgtatttaatgttggagcatggccaattaacaacattgtgatagtttcagagggacagctatgggcctaagttaacaaagttagtaaccggtactttttaactttgaccagagttgtgtgtacgttcattaaaattctagttaaaaccacacagtaggagtttcctacaataacttgaaaatgattggaaactgtgtttgaaagaaaggtcaccatcagatcagaggattactgtagagaatgtggcagcacagtccccccgcccacagtagctcacagtggagtgaaggcccagaaatgagacaggttaatgggacccacgggtgaaccagaaacgaagccaagagtgcgtgagaatttagggcacctctgatcactgggagctggtggttcttctgtgagtgctgggggcccctggccagacccccatgcacagagtgggcacccggagggctgtcggtgggctctggccctgtcgctgacctgcctctccctccctcagagcttcttgcgcgtctgcggtgaaggccccagcacaggtcatcgtgctccgggccctcgccttcctggcctgtgccttcctgctgaccacagcgctttacggcaccagcaacccctttgccccgggagccccgctgcccccgaccctgccaactggtagcaatggctcggccccaccagacaacggaacagccaccggggctgagggctggcggcagctgctgggcctgctgcccgagcatgcggccgagaagctgcgcgaggcctgggccttcgggcagagccaccagatgggtgtcgtggcgctgggcctgctcacctgcctgctggccatgctgctggccggccgcatcaggtgcgtgcggggcagggacgcagtgggagga

SEQ ID NO: 41696 - DNA, 1069 bp, Bovine  19866880910187
gcatgctgcagagtatgccccccccaaaaaaaacccaatatctgagaagtacaataaaataaggtaagcctgtattaatattttatgtataaaatacacacatgtaaaaaaaacaaagtctttcaatgtgaaggagttccatggatttaatgtgctatcctattacccacagacacagaaatcgtaaaagcttcaatacaccttgcccgtaaatagttggtcctgtgcagtttcagtgcccatttactctctctgaaaaaaaatcctatcagtgagttttccattccctcacctgactcagcttccagtggaactctgcaggtttgtatttcttctcttctgaaggatcctgacggaggaggaaaaccagccggcagccgtggacatagagtgagtaatggtgtcggttcatctctgcagagagaaattctactggtaaaccgccagcttaactcactactcaccagacagcttttgcagaaactaacacctgtgcccagccatttttattctggctggccaaaaattaattctgttatttcacgaacactttgtgggttattacattcaatagttacacctgacacatctgtaaatcttctccagcaccgttgaatttcattttcactttctacatgagaattaatcactaaggttttttgtctgttagttgaatattcacatcatctgaagtataactatattctgaagaactaccatcttatgagactccagtatacatgtcactcagacaattagagaaagtatctgcattaaaattcaccgaagaattcttcttcactcaaaatttcattatgcatcattgtaaaaaaaatttagggtaataaacttgtatttacaatatacacaaggttggaacaaaaatctaagagcgaaatgtgaataacaacaatcgttaagttgtgcagtgaatccttgatcaattttaagttctaacaacttaacacagtgatgttaatcatatcactctctaaaaatgtgcatctccagtcaataatgtgttaagacccaaaggagaaataaaagctgttatttcttcatggatttt

SEQ ID NO: 41697 - DNA, 1364 bp, Bovine  19866880996527
ccgccggggctgcagcagcgggcggcgcagaggccctgcaccactgctccgggctggcgggcggcgcgcctctgccgcgctctcgtcccgacggccacctcccggcggctgcgcgcagccagcgccgagacagcacccggcctctgattggtgcagtgagtgagtctcgggctttatttatacaaccttttctgcacgactcgacttcctcggagttgagggctggagccggaggcagccttcctccccggctgggaaggatgacaagccggggtctggtaccagcgactgtcttcgtgaatccttggatggatcattttcacctgcttctgtacggagcagccaccaagtgtggggcgcgatttgcggaaacctccatagaagaacaagactgtgtggcacctcggtagggctgggagggtgaaggctttcagacgagcccagggatgctgtgtttgggccctggctttggacctcctgctctgaatcgtggacaccggtctggaaagtgaggctgcctttccagctggggggtaagaagggattctcaactccggcatcctcttgggtgatggcagaggaaccttctcggaccatatccttgaatgctccactcaggatgtctgggaaagcccatggagacggactgaggcacaaaggtgatgggagaaaggttttttattcccagtgtcatggagttagttgaagaaggttaaagttggatgaggagggagtccagctcccctgcagagggaagctgaaccagcaggtatgggtggtgtctgaccgctgtggaccctcctggatgaagtgagggttgagggggcaggagtcagggacccggggacagagaagttccccagggggtctgggcagcactttctgctcagaatagaagcctcccgtgcaggtctttgtttataccaggggcatgaaaatgctgcccaactcgtcccctgggacctgtctcctggcaagatgggaagtgatgtcacgctgcctgctcttctggggctgagacagttcggagactgatgcctctgactgtcctgggccctggacttctgcagggagagcctgggtgctgggggccgctccctcccatggctcacttgagcgtctccaccttggagactgcccttgaagcctgcattgcgctgggaggaggaggagatggcagaagaggaagaggagggggagatgtcaggggtcgagggggagatggccagggtcgaggggcctgcagaccctgctccctgctgatgtcatcagtctgagggcctgcaccagctggaggctgccccagaactgacaccagaagccttcctgctcagtctgggacaggcgcagtgctgcggctgcca

SEQ ID NO: 41698 - DNA, 1943 bp, Bovine  19866880998866
aagagatacagaagccaagcagacattaattcactgctctgggcagtaaattaatggaggaacctacttccttgccccccacccccgcgcccaaagagaaggctcaggatcgaggttgtttatgaggccgggcaggagaactcagtgaaccaacatggtcagacagctcacccaccacaccacctgtgtttgctcagtgtgtctgactctttgcaaccccatggacaggctcctctgtccacaggatgtcccagacaggaatactggagtgggtttccatttcctactccaggggatcttcccaacccagggttagctctgtgctgtgctgtacttagccactcagttgtgtctgactctttgtgacccaatggactgtagcctgccaggctcctctgtccatggggattctccaggcaagaatactggagtgggttgccatgtcctcctcccaacccaggatcaaatccaggtctcccacattacaggcagattctttactctttgagccactagggaagacaaggattagctcaaggctggccaaataggaattataaaggagggatgtttgtggaccccagtccatccactttgctcttgtccccacatattaatggctcacttttcacctatgcccccaaaccatgcctgatccctgattcctgagttaataaccctgtcgttagaagaatcagacatgctgacaggcaaactggctggctgggcaggaaactcagcccattcaggggatttcgcatctgagtatagaataaatttgctgtttggcttaagccaaaagaatgaagctctaatttgtaaatttcagccacaaaccagctctctcaaggagactgggtcttggtggcaggcaggggggagagttccctgagattacacaccagaaccttctgctcacccttctgcaggctctcctgcctccgtgccttactggccagcctctctatcttgggcaccctctttccagcttcagcaaacgactttacatgtccttcaagtctcagtcagccctcctctcctgggggaggcatggtacctgccctggctgtaggctcccgcacccaccccaagcatcgtccatcagcaccctcagcctgctctcagagtcagagtttgcatgctccacttgttaacgaccaggctgggctgcaggtgcattggctgtacatgaggaggcacgacacaggtgacgcaggagatgggaaagtggttcaagaactttaagtgtaaggaattgtttacacgttagatcctctgagcgcacctaatcagcaagttaacggtgatttgggctcttcacaagtttgttagtttggtgcctgaaaccaggaatgctgcagcccaaaggaaccactcagtcagcccaggcaggtgcactgacccagacgggtcagaggtagcgggtgggaggctggggtggtccacttagctgagtgctcagaccagacctcaggcatccagaaacgcccccgggactgtgagagaatatattgctgttgttttaagccatccagtttgtggtcattcgttacagcagccacaggacactcatatgtccctggggtcatcagtgaactcactgcaacaggaagagggagggggccagggcttgtggtcgagaagaggcccccgagcagcctgaactcctgcccttcctcaggatgtactgtcacccccaatactgtgcactttctgttaatcaatactttctttggataaacctagttaccccaactttacagctagctgaaattcaaaatcaagtaagtgatatgactaatattaaatgaaagcagtgaatcaaagttttgttttcaaatgacacccacgcccttattctgattttggggtgggggcaggattgtccttgagatccacttattagctcattctttatcgcctacaatgcgggagactcgggt

SEQ ID NO: 41699 - DNA, 1282 bp, Bovine  19866881049528
tcccatgatggttcgagtgtcttgcccctttcttccctcctgggcccacaacgtgcagcacttctagggcagtatacttgctgattgcttcctgcattattactcacaacaaccagctaagacactgccaaagaaacactcacagctggccccgccgatgacagagggcaggcctgtcctgcttctgcttgaaacctgcggagaaagaaatggggaggggaggaaagaggatggaggagaaagctgagatcgcaaagatcccagcagggctggcccacgacccacactgatcagaaggaaaaacaagccagcgcttccctggatgagaagttagaaaatgacagtagtttaaaattcatggggactttcctggtggcccagtggttgagactccaccttgcatcccaggggatgtgggtttgattcgcgggggcagggaactaagatcccacatgacttggggggcagctaagcccaaacgctccaataagagaagtccttgtcctgcaacaaagacccagggcagccaaaaaaaaaaaaaaaagcaagcaacaaaataaagcagcagtgactgctcccagatcccaggcacagtctagagtggatccatcagagttctgacaaaggagatacagatgaagatttatgtcaaggagtgggctcatgtgctcacaggggctgttaggccaggctgaagtctgcagggcagcctagcaagctggaaactcctgggccagagcagacactgccatccaaccacagaatttcttcctcttgggtcccagctggactcttaaggccttcaactgactagatgaggcccaccaactctcctggatgatcttcactcagagtcaactgatggtggatgacgacccacctgcaaaacgtcacagcagcacctagggtctggctgggttcctgggtcccacagcctgctcacgcagacgcctcaaactgaccatcacagagaggcagcctgaagatcgcgtgactcacggctttggatgcagaccacccaaggtgcgtgtggggggacaagcagcgggtgttctctaccccagcaagggaagtcccagaaacctgtgttccaggcaagggggtacagaggaaggcagctccccagccagaggaatctctctgcccgagaggagaaagcccctgggagggtgtcctacacacacgctgcaggaggagggcacacaggcttatcctttcttggctacaaaatgtccagtggggctgagggaatgactgcttacctcagtcttctgcccccaaa

SEQ ID NO: 41700 - DNA, 1059 bp, Bovine  19866881098301
atgaaatgaaaagataaaagtgttggcagccaccccagacatctttgcagcagcaaaagccgcatgagatccttcgagccaagtggagctgcagcctggggacagccaagcctctggagcgggcgacagatgaacctggggtctgcggaaggacaaggcacccttgctggggaaatgtgatggtcagcagaacctcacgagacagaggccagcttccggttggcttctccaggaagcagatgctgtctgcctttcccagccctgactctgcagtggcctggtctggagccaggagctgggagcctctgatgaaccagcagctcccaagtggctgcagggtcatatcaggggacaatcgctcacccctcagccccttccactcccctctccagtcctggacacacaggtaaggtaccccttgttcattcatgcatccaatacaacatgccaggctgtctaggctcggggaacctagccatgaacaaggctcctgttctcaaggagcttgtattctactccaagtcggggtgtgtggtggggagacagaagattaaccagtgaaagaataattgtgtgcattctcagtcacttcagtcatgtctgactctgtgtgacccctgggactgtagcctgccaagctcctctgtccatgggattctctaggcaagaatactggggtgggttgccatatgcttctccaaaggatcttcccaaccctgggatagaacctgtgtctcttgtgtcccctgcattggcaggcaggctctctaccactagcgctgcctaggaatcccaaaagaataattgtgctatgttgagcttagtctctcagtagtgtcggactctgtgcgactccatggactgtagcccgccaggcttctccgtccatgggattctccaagcaagaatactggagtgaattaccatacccttctccaggggatcttcccaacccagggattgaacctgcatctcttacatctcctgcatcagcaggcaggctcttcaccactagctccacctgggaagcccaaaagaataattacagaatcacaattg

SEQ ID NO: 41701 - DNA, 887 bp, Bovine  19866881113768
tctgtccttactatgggctgaaagcctgaagtccaggtggaagcccacacatctcagtgaagagggcacaggcgggcaagacttgggtgcccctgccgacttcaccctgtgcctctgcccgctgtccgcagccttgctcctgcccggttaacctgcaaaggacccaggaccatgaggttgtatgtgggaggcagaagaagaaaagagagtgttctctgattcctggaaaaggtgtgtttagggccagcagacgtgaggccaggctaacaggctgtaaattatctgtagctgtagagtatgcgtgtgcatatctgtttccctgtgtgtgagagaaggggagagagaacttatttttccatatacaactgtaagtattccccaagcacagaaaccccatgtatgtctgagcacaaaatgggtggggcgccaaggtacctgagcctggctggtcgtgttgtcggatgggtgggacaccttcttgggcaggtacttgcccctcagctggcaggagtgattcactcaggtcctcgccgtctcccagcacggctcccagtcggccagtgactaaccccaggggagaagggtgtgtggtgacctgctttggccggaaatgacaggagtgcatagctgcagtcagcaccttgtcccaggggtgctggtgcaagttcctgggctggccagacacacaggtatttctggaccgccgcatagggcccattgccatgagcttcccgccagccagcctggatccctcagcacggggtgtggactccttcagcccctcccatgacccgttttctgtgtttccacagggcggcatcttcctatttctccccggccacagcccacctgtcacagttgagcatctggttgcctcaagttgattt

SEQ ID NO: 41702 - DNA, 1125 bp, Bovine  19866881162129
gtaagtgtagaagcttgggggaatccaacaaggcctgtctgcttggcattcctttgtcttcatagataaggatgctccatttctctgagtttagggagggcatctgtcgtgtgaatgttttacggtctgcttcataggcttccctcgtggctcagctggtaaagaacccgcttacaatgcgggatacttgggtttgatccctgggttgggaagatcccttggagaaggcaaaggctacccactccagtatcctggtctggaaaattccatggactttcactttcagggaagaggggtggagggaggagggcagagtgaccttcttgcttctgctgtttcatcaaaatcctccagcttaaaatgtccaacaggccaaggtgccacattttatggcagtgtatcctgaaccccatcgttgctgctggttactgttcctacctgttccattcatgtagtccttggccagctcaaacagccggaggtgcatgttggtgataggattaaaggacccacaagcaaggagaactacttctgtcttctctgagttctccatgctgagaatttgaagttgttgatataaatggaaaactctgacacttctcttattgcctacaaaggaaaaagaaagtaagttcagttcaagtcttttgatgtccttccacatactcatttcaagcaaatggagggactctcctggcggtccagtgatggactctgcacttcagtgcagcgcgctcggattcaatctctggttggggagccaaaatcccacatactgcagtcaaaaagtaaaaacaaacaaaaaacatcactaacaaaaaatccacaaaccaaacagatggaaaaaatgtttggcttcagtgactacgctgggtgaattgcaaaaatggctccatttccccacccttcctttaaaatgtgaatttatagctcttttcataaaggaatggaatcttccaccccctgtgactcgctttggcccaaataacgtggcacatgggaaaacatgcccattctgatcctatgcctctgaggcattgtgcacacccattctcttttggactcctgcccttccatgaagacaagcccaggccagcacgctggaggatgacagaacctgcagga

SEQ ID NO: 41703 - DNA, 770 bp, Bovine  19866881262444
ggtgtagaatttagtacccagcaaggattaactcctcaccatcaacaaaaatgtgtctttggaatttagtggggaggatggggaaagttgggcttctcaggtcgttctagtgataaatgatatgcctgtcaatgcaggagatgcaggagacatgggctagatccctgaattgggaagatcccctgaagaagggagtggcaacccactccaggtattcttgcctggagaatcccacggacagaggagcctgacaggctacagtccttggggctgcaaaaagtcggacatgactgagtgactgaacacgtggggtaagtagatcagagataaatacaggatgcctagttgagtttgaatttcagataaacaataagtaagtttttaatgtaaatatgtcctgtgtaatatttgggacatacttatacaaatagttatactaaaaattactttaaaaaattcaaatgtagctgggcatcctgcttttctatttgctaaatctggctgccctagcggcgggtactgtcaatcagccaagtcacccctcccttcttgccctcttgggatcatctttaagaagtaaatttagggtaaattaagtccacctaatctatcagagtcttgatttcctcactcataaaataaagttgttgagaggattaaatgatgcgttgacagatgcacccagaccagcgccgcccgaaagagacaaaccagaacatgtatttatagcctgcttgcgtttgcattttaggagatgtgcacacatgttt

SEQ ID NO: 41704 - DNA, 2840 bp, Bovine  19866881346129
gagcggagcactggccggcggcctggggcagagccatgctccctcctgtcgctgtgtgcggcttgctttgccagcagtgagcatcgagtgcttgcgtgccctgtcgcttcaggagtgtccgactctttgcgaccctatggactgtggcccaccaggttccttctgtccatggggttctccaggcacgaatcctggagtgggctattgtaccttcattaatcaagcgtctctaggggcggccatgctgagttttctcccagtttcctctctctcgggtcctggggtcgccatccccaggacaggtttggtggatgcttgtagaactgtgctctacaactctatccaggatgcttgtcctgtgtctccccgttgggctctcccaggacacaaccccagaggtggaggagccaaccccttcctctctggaaagcatgtaccagccccaggcagcccaccctactaagctggactggtagggatggatgtacctacaggcctctccggggactgtctgtcaaggagcaggaaatccagggaagggccctgctccctggtttttaagggacactgactgagtgccacccacttggagggcctttagccactcctgtctccccagtgcgtgcctgctgcgtgtgtgctcagtcgctcagttatgtctgactctttgtgaccttgtggactgtagcctgccaggctcctctgtccatgggatttcccaggcaagaatactggagtgggctaccattccctttctccaggacgtcttcctgacccagggatgaaacccgtgtctcccaagtctcctgcattggcaggcggattctttaccactgagccatctgggaagcccatctcccccagcaaccacaaataaggaaaaaaaaaaaaattggcaaagtatgtgtttcaaatttccaagttgatgggactactgtttaattcatcaaacaaagaaattaagaaaaaaaaataatgtactggtgaggtaattgattggtcattagggggaattctagattccacttaaaaaaactctattaggtaacttgtttgtaaggataaagtttttttcttttaaggtgtacctaattttatttattttttgactgcaccatgtggagtgcagggatcttatttcctcgggattgaacctgtgccccctgacttgggagttcgggatcttaaccaccagggaagactcagggataaaatatttattaataacacatttctggatgattttctggtgctgtcctcagttggcaccatgtcagtgtgccctctgtcccaggctagagcccttgaagagccaccctcgagccctctgatgagagtggacccccacccgcctgactgttggtatctaggtgcccatcctaggacagcctgagtattaatagattctagaggaaactggcaaagggcacagttctgcaggccagaagctgaatggagcccctgcaccgcgcccctgcccggctgggatagcagagtaggaaccgttggggagggagtagagaacactgtgtccgtgagtccgtgtttggggttttagtctggacctgagcaggttgtgaaataagggcatttgagccatgtttatcgaaatttcaaaggaccgtttggcccaaagtgacatatttagtttaatatcactgatgttgccttggatgtcagagtgctgccagaaaaaggctctgtgatcaggctgcccagggctggaggatggctgatggttctgcaaggagaacaggagggcctctgagctcagggaagaaggaggggtgtggggcttccgtgtagactgtgaccaagctaggaactaggcgggggcctcgcctgtccccacccgcactcagggtttcacagatccccgtgtttcttacacctctttcacaggctcagaaatctcaaaaggacgtggacaaatttgaggttcaaaaaaaaatttgacgtggaaaaaaattgatgtcatttgaaagacatcaattgtgcagtatttttcatttttctctgacagagtttcatgtgcattttctgttttaagcttcatttttctacgataaaactagtagagccacagagagctggggaacctggggatgaaaagcaagtaaaacccctgtggctcggatcataaaacacggttggcatgtggctccattccctctgttcgtgaacatggctacaatcccaggtcacttgcaaatccaagttatgtgttaagatagcaaaacatggagagagtaggtcttaagtgttcttaatacacacatacacacatacagacaggcaactatgtgaagatatggatgtgttaattagcttgattatggcaatcatttcacagtgtatacctgtatcaaatcttttctttgtatacttaatgtatataattgttgtcaattaaatataaagttggaaaaaattaaaagcagatttcttcaacaaataaattgcaagatgaacagggaacccatagataaaaagaaatttaaatgtcaggtcaaccagtcagtggatcctgattcaaacagactgctttttaaaaaaagaatatttttggcatcaaggagactattcataatacagcattaatgatttaattatgttgaagtttatttttaggtgtggtgagattaaaaagattctgtactttttgtgcatttagaaatatttacagatggaataatatactctcttggatttgctttaaaacaataacagttggagggagagggtagaggtcaagatgaaatgaggataaatgtgacaacgtgttggtggcatgtgggatcttagtgcccctactagtgactgaacctgtgccccctgca

SEQ ID NO: 41705 - DNA, 3127 bp, Bovine  19866880209237
cgaagcttgcaaacgttatgctgggtgaaagaagttagtcctaaaaggtcacatatttatgatcccacttatatgaaacatccagaataggcaaatccacagggacagaaatagattagtgattgtctaagctggaatgggggctggggggcggcaggctggaggaaaatgggtggtaactgctgatgggtacaggggttcttttggggatgacaaaaatgttcggagattggccattgcacaacgttgagaacgtggtggggaaaaacactagtttgtaaactttacatggtaaatcaaacagtatatgaattatatctcaataagttcagttcagttcagtcgctcagtcgtgtccaactctttgcgatcccatgaatcacagcacaccaggcctccctgtccatcaccaactcccggagtttactcaaactcatgtccatcaagttggtgatgccatccagccatctcatcctctgtcgtccccttctcctcctgcccccaatccctcccagcatcagggtcttttccaatgagtcaactcttctcgtgaggcggccaaagtattggggtttcagctttagcatcagtccttccaatgaacatgcaggactgatctcctttaggatggattggttggctctccttgcagtccaaggggctctcaagagtcttctccaacaccacatttcaaaagcatcaattcttcggtgctcagctttcttcacagtccaactctcacatccatacatgaccactggaaaaaccatagccttgactagacggacctttgttggcaaatgcctctgctttttaataagctgtctaggtttgtcataactttccttccaaggagtaagcgtcttttcatttcatggctgcaatcaccatcttcggtgattttggagcccaaaaaagctgttcaaaaaaaagttgcacaaattctactgtcaaggatattcaaaaattaagtcagctcaagaaaggtacatggtatcatcaggaggaaccatggaaatccttagaatgcatataatttttttaaatagtgagtgtgcttagtcactcaatagatatagattttatttagtatcctataactagaacttaagagaatgttggaaagcatctgactttccttttgtattaatttttgttgaagcatagttgcctcacaatgttgcattggtttcctgctgcagagcacagtgaatcagccatacgaatacacgtgcccttctttctcagggtcaccacagcactgagcagagctccctgtgctctgcagtgggttctcatcagttacatattttatacagtatcaatctcccaactcaccccactccccttcctgccttggtattctcacatttattctctgcatctgcgtctctatttctggaaagcatctgaattccttacttttaaagcactggaaaatgagatgcagaagttcactgatttgtctcagatctcgcctccagcttgtagtaactgaaggtccacactcaatcacagcagcatcatttataacaatccaaagatggaagcaacccaaggatccacagacggatgactggttaaacatgtgatacatacatacaaaaggatatcattcagccttcaaaaggaaagaaccatgccacgtgctacagcaggaatggacttggagacatgacgctaggacaaagaagtcagacacaaaagaacaaatactgtgattctgcttatgtgaggaacctaggataattaaatctacagaaatagaaagtagaatggtggttattgggagctgggggaggaaaaaatgcagaactgttgtttgatgggtacagattcagttttgcaagatagaaagggttctataaactgattacacacaatacgaatgtactagggcttctccggtggctcagtggtaaagaatccgcctgcaatgaaggagctgcaggagacgtggcttccatccttgggtcgggaagatcccctggaggagggcatggcaatccactccgtgttcttgcctggagaatcccatggacagaggagtctggcgggcaacagcccatggggtcacaaagagtcggacatgactgaagccatagcaggcacgcacatattttatcacaaatttacaataaatttttataaaaagagagagatcaaacctcaagtctcccaacacttatcctaaccacaccctgcagcatggcgctctcagacccagcaaaatgaccagatgaaaagcagaaaaagcccattctgctccatcagacttcacgacggagaaatgaagtcaatctctccaagggactgcttccaaagaatttcaggaactttaacaaacctcagcaacaccaatcaatacacagatcaataaaatagagtccactccacaggtctgagtgttccccagaacaaagccctgccagaaggtgatggtgatggtggcagagcagctcaaacagctttctccaggacagggcttctcagaccaaactgagcatagaatcaaccagagaccttgtgaaaatgcaggctcaccagggtgaggcctgagaatctgcacttgtaataggtgcccagatgacgggggtatgatgctggtcccagggaccactctttcccactccaagtggccagaatggagatgaaactccacaccacatccctctccccagacgagaagctatcttcatgggctgaaggctccatggcaacattccactttcagcggaagtacgtacccccatcacaagccagtatatttcagttcatttcagtctgaattagaaaacccacatattttgtggtttctgaaaatgcaggtttgatttacactaaaactgagtcagtgggttgactgcttgattgttggcggcatgggtaagaaaccaactgtggtccactctttaaagggaatattaaatatgacttaaaattccaaagtcgatggaatgtggtctaatatctgattcataaacgtgcccttggtaaaccatactggaaaaagccacaacacacagagagctgaaacattctgttctacacagggtcatagacaatagggagtttgggtttgtttttggttttcttaagttttttaaatttttattcatttatttat

SEQ ID NO: 41706 - DNA, 1110 bp, Bovine  19866880436783
tgtctgaaatctttgtgaccccatggactgcagcacaccaggcctccctgtccttcaccatctcccagagtttgctcaaactcaagtccattgagttgatgatgccatccacccgtctcctcctctgtcgcccccttctcctcctgccctcagtctttcccagcatgacacaggatggaggttgagttttctggtatggttgctttgtcaccaaattatcttcttgccttccgacatgctagagtaaataaacgtttgttgggggtttacgaaggcaatgacaggtccttacttaagcaaagatgctgaccagtaaatgatgatgggggtgtgtgaaactgccgggccgcagagggtccaatctgccctctgagagcatcttgccctggctctcatgggtgctccctggagaaggaaggggcttgaaagaggctttccatggaattgcaggaggaaaggttggaggctacaggcgtagagtttataaacacgtccgcagagcggttttgcaatgcctgttattctgtccttttgaagaggaactcttccggggagaggagcattgttggatgggtgacctaatttgtttcctctgtttccttctggcctgaactgggcaggtggccctgacccacaaggtcttagaccggctgaaaggaaatccatttgctgatagagaagatacactgtgagataaagaagggaatgttttgctgacagcttcctcctctgcctgactctggctatagtctaagtactaatgaactggtgactgaaccacactccttcagtttctgaaatcttacccttggaactccagctagcccataatcgttttctaattgttttatgtgcatttgttttctctccctaattctaatcctgaggacccttcgagaacagagttcaagactgttttccaccatgattggactcaataaatacctggctgaagagttaaagaggggtttagttttcatagtttatgtttttcctgtttcccaaaatgacatgataaatataaccttttctgtgtgtctgtgtgtgtgtgtgtgtagttgtggggcttatggggttctagttccccgaccagagatggaaccaatgctc

SEQ ID NO: 41707 - DNA, 1525 bp, Bovine  19866880465258
gggatgatctgctctgctggtgcgtacattttatttcttaatgggagaaactgtatgtgattttgctgccagtttagtgaccttcacagaataaatgtattcatatacaaacttctgtggatcccaatcatttgaaaagctggtaaaaaagccattgttattcagtcgctcagtcgtgtctgactttttgcgaccccagggactgcagcacgccaggcttccctgtccttcaccaggctcaccatgagtttgctcaaactcatgtccattgagtcagcgataccatccaaccatctcatcctctgtcatccccttctcctcccgccttcaatctttcctagtgtcagggtcttttccagtgagccagttctttgcatcaggtggccaaagtattggagcttcagctttagcatcacaccttccaatgaatattcaggactgatttcctttaggattgactggttggatctccttgcagttcaaggggctctcaaatcttctccagcaccacagttcaaaagcatcagttctttggcgctcagctttttttatggtccaactcttacgtccatgcataactactggaaaaagccatagaactgctttttacacaaatgcagatgtgcttatgcacgcaattttgtctctaattccagaaggttcaaagacctttgaaagttctccagggaccctatgctgagcacctttgtattgggtcaattcctagggcctatgtgaaattgctaaagtgagcaagactgtatgacccttgccctctacaagcataaatgtttaaaaaatatacaaataacttcatgtggaaacttataatttccatctgggcagtgatttttaactgagggttgagacccttttgggatttatgaaataatgttagtattttggggccagcattatcaaaccaatggaatggaaaagaaaccaggctatatgtccgtatactgagttgaaatgagaaatatgggtccccgtttgagaaaactgatgtctgctctgcttgttttactttatatttagggcagtgggagcaatttaaagaaatgcatgctttcttttcgtggtctgttttgactgtattggccctttttcttattaaaaaacggtccaagagtccactggttccactaacattttatgtcttaacagcctatcccaagtcatcacttactcacagttgtgaaaataaacttaaatctggctcttgaaggctctcatgatttttctttatatttaattttcctcctttccagataagtaaaaatcagtgtgatccccaccaggccaccacgtctccacttttattttttatttttttttacgtctccacttttagacaacattccttaaacttggttttctcatctgtgaaatgatcctgataatgataatttccttcttctaggattgttgggaagattatgagtttacatagataggatgcatagcttaaattgttcagttcatttcagttcagttgctcagtcgtgtctgactctttgtgatg

SEQ ID NO: 41708 - DNA, 3811 bp, Bovine  19866880634057
agcttagatatacatctaagtgattatatatatatagagagagagagagagagagaggattatatatacacacacacattcttttccagattcttttccattacaggttattacaagatactgaggatagttccctgtgtcatgcagtaggtccttgttgtttatctgttttacatacagtagtatctgttaactccaaactcctgatttatctccccccaccccctgctattccctttggtaacaacaagtttgttctctatgtctgtgagtctatttctgttttgtaaataagttcattgatgtcatatttttcaggttccacatgtaagtgatatcatatgttatttgtctctctctgtctgacttattcatttaataagataatctctaggtccagtcatgttactacaaacgacattatttctttttttttttttttttttgatgagtagtattctattgtggcggagaaggcaatggcaccccactccagtactcttgcctggaaaatccatggattgggaggagcctgaaaggctgcagtccatggggtcgctgagggttggacacgactgagcgacttcactttcacttttcactttaatgctttggagaaggaaatggcaacccactccagtgttcttgcctggggaatcccagggatgggggagcctggtgggctgccgtctatggggttgcacagagtcggacacgactcaagtgactcagcagcagcagcagtgtggagaaaagggaaccttcctacactgttggtgggaatataaattggtacagccactgtgaaaacagtatgaaggttcctcaaaaaaactggagttgccatatgatctagccttcccacccctgacaaaactctaattctaaaaagatacacgcactcttatgttcacagcagcactatttacaatagccaagacatggaaaaaacctaaatgtccatcaagagatgaatggataaagagatgtggtatatgtattcaatggagtactactcagccatcaaaaggaatgaaataatgccatttgcagcaacatggatggacctagagattaccgtatatttaaccttttcactttttaaaaatgtagctactagaaaatttaaaatcatgtgttttattgaggagccctggtggagggaacgggttctcctttatcttcccaggaccacctgctggaataggtggtggtagtggtgggtttagttgctaagtcgtgtccgactcttggaagcccgtggacctgccaggttcctctgtccacaggattttccaggcaagaataccagagtgggttgccatttccttctccaggggatcttcctgacccagggatcaaacccaggttttctgcattgcaggcagattctttaccgactgagttaccagggaagcccagagtaagtggagtctctcttatttaaggaatctcttagttctgatgggctgtctgaagtgtgttttgaagccaaggtgtggggaaaatgacagtttgaagggagagtgacttacaaacagtgcgttttcataaccagctccctggaaggacagaggaattttctctgcagcagaattcgttaaggcaaatatagatgatcaggtagacacgataccagcacctattatgaataataatagctctgcacatttaattgcctgacttccttgtaaaagcttaagagtaaagaagagtagtcacaggaaccctaaaatagtttcagaaaaactaatcaagagcctggaagcagtagaaaaggagggggtggtacagcatggggagatgagatctcatccgtcgctttgtcgtatctgtaatggtccgtcagcatcaggctgtttgtgtgggggcctcctggattgtgccttggtggtagctggtccagagagatgtttctctcatctccgctcctgctccatcgccagaataattcgttcgtccttgcatcattaaatcgcatgtagaaaatgaacttcatgcctatttacatggcttgctgttggtttcatgtttgtttcccttgctgcccgttgctgatttgtttgctctgatggatgccaaaatccttgcaagagagacctcgttttacatgtttaaatcctgtgttgttgaacagaaaaatacatattcagtttgttaatggctatagttagtggttcattaggaaaaaaaaagcagatcattcatttggcttctcgtctgtgtttccccttcttgccctgctctctccatttctttcacccttcgctccttgcttttttttttccttctaaggtataggtcacatggagaagtcctaaaaaaatgtgttcagatggcctgtctgcacctttttaaaaaaacacagaacaataaagccttgccttcactgagtatcacttcatttattttttatttgaccacctctgcccttccttctgcatagcctcctggcgctaaggcacccccagggctggaaggcactcacgtggtacccagtggctggctcacagcacagactcgccttggacaagggccagacccaggcttggagctgggcaagcagtaatgcaccagggagcagactggaaggaggcccggggtggagtccccacgggctcaatggaggcctggttttacttaagatattccaaacagtgaagggggagtaaacagtccgctaattaaatctggaggtggcagcaaacctggaggtgttgcaaagccctccgcacacagaggacgttgggaaaacacacggagccgtggaaaggggaggccaggctcggggagatgagattctgcctggaaaagtacaagccgccatctggagagaaattagccattggaagtgcactctgtggggcgtaagtcagtggcgctgtaattgactcggagccagaactgtgaagttctgtttcttgttcttgatagtcagtagtaatcgtttatttttttaacccctgaatttatgactcaggagtcaggccagtcctgctctgtttataaggctcagcgttaaaggtaaactgataagaagggtattcctccaaaatcatttgcccatctgcttccattttatttcgccctggaccccgaagggtggccaggggtccaagatcttggaggctgggtctgggaactggagtgtgtctgaccagccggtgggggcagctgcctgctcagtgtggatcaagacgtgccccgcttctgggtgtgtgtccgccaggagggagcctgcgatcggtctctgggtacccgacggttaataggttcatggttctccagccttcatggccctgccgcttcttaggagccctttaatcacacacagatgctttagtgctttgagccggcatccatttgccagtttgaaaacctgcactcattttttaaaaattgtgggatcttagttttccgaccagggattgaacccaagcccgctgcagtggaagcgcagattatattaactgccagggaagcccccccaaactacactcttatggtggaaaacaggattgcgtcgagggtaaagagcagtgatctgggaagtgagatgtctgttcgcgtctctgtgcgattttggccaagttgtttcatttctcagcctcagatttcttatctgtaaaatggccccagaaggttaaagagatgtagatggagacctttgcttgggagtggacttcagctgcgaaagtctttagcgtccctgagctaagtatagatcattttcagaacctcttcactaggagttcagaggagaccctagcagctgagggtgccctgggagatggcacgaccctagacaaga

SEQ ID NO: 41709 - DNA, 1465 bp, Bovine  19866880690939
aacagacatttatttctcatggttttggagctgggaagtccaaggccaggcttgttgttgagggctcccttcctggcttgcaggtggctgttttcagtgacctcacaggagaggaggggagttctggtttctcttccagtgacactaatgacactaatcccatcatggaggtccactctcaagacctccttctaagcctccttagctcccaaatgcctcatctctaataccccactggtggttagggctttacatatgaatttggcgggggtgggggggagcggtaaacattcagttcagttcaattcagtcgctcagtcatgtctgactctttgtgaccccatgaactgcagcacgccaggcctccctgtccatcaccaactcccagagtttacccaaactcatgtgcgttgagtcgatgatggcatccagccatctcatcctttgtcatccccttctctttccgccttcaatttttcccagcatcaggatcttttctaatgagtcagttccttgcattaggtggccaaagtactggagtttcagcttcagcattagtccttccaatgaatattcagggctgataaacattcagtccatagcaaatattgtgtattataaaatatatattataaatagtaaaaacgtattataaagtaataataatagtggtaatgataaaggcagctaaactagcatgtattgaaccagggtcgtggcgcccatacttggagggtttaacaatatatggacacatcataggcttgaggctatccagttggcttggtgccagggagatgcgggttccatccatgggtccagaagatcccctggagcagcaaatggcaacctgctcccatagtcttgcctgggaaatcccatggacagaggagcctggcgagctgcagtccgtggggtcgcaaagagtgggacatgactgagtgcacgtgagcttgacgccatgctccctcgcccttgtggcggtggctgtatgtgctgacccgtgtgtgatttcatcttgcaggccacagcctctgcagcgagcagggcagcagtgctgaggctgctccggaggaggtggaagggccggacttggaatcctcagatgatactgatcacagcagcaaggtgagagatttccattttcacatcccatgtctcaaaccaccaaagaatcacagctgacacgtcacctctgcagctgtgtgtggtgggaaggcccctccacgggacggaagtgtttctacttctgagaggtcactaaataggatatggcatcctaatgatagccgtgagaacaaacccagatgtgacaatataagccagagctcactcttaatgaactaaagtctgtgtccatcctgtttccttcttatgtcctccctttctgtatgaggaagaggcatcatgagtgtaactgggtcaggtatactttcctgctactcacggtttctataaggaaccg

SEQ ID NO: 41710 - DNA, 563 bp, Bovine  19866880749548
tatttgaagattgaacagtacaagtacagcagcgacccccccacccaacattagtcctcccccacccctcacacatacacacaaataacgcatcctaggtacacaagcttccctggggcgacatttctgctctagccctgggtctgaaattaccaccctctcccacctctgagccaagatttcaagcacacagcagggtgggggtggggggatgtccccagcaagtcctcaattccgacgcagctgggcttaaaattgagcttgcaagcccagggacagagcggggaggcagagtgattgttcaacaccctcctacactcagctcatgactaatgcatcacattggcagagcaattcctcccagctagctggaaccgacaagtccacatttaaaccaaaccacccctcggaaggctcggcgcagccctcccaagcccgaagtgtacccctttctgaaaatattcactttgacagaaaacaaacagagagattaggcatggagttctaattctgaatgcttcccttcagcacttgttgctgttcagtcgctaagtcatgtccga

SEQ ID NO: 41711 - DNA, 1419 bp, Bovine  19866880881576
ttctgccgccgggcccttttcttcagaatagataatccccatgtgctatcagggggtctgagatcctcagagactgacttgctgctctgctaactttatttcttttcctagagggagaaagaaatggtcttacccgccgtccaccagcacaatcctgactgtgacatttgggtccatgagtatttcaccccgtcctggttctgtctaccgaacaatcagccagccctgacggtcgtccggccgggggacacggcccgggataccctggagctgatctgcaaggtatgaggccacttggggttgtttgtgttggaggactctacggacactcagatgcgggtggcagaggaggattcttgaaagaacacctttatttcataacagagcagtgttggatcctcttgtgatatatgcataatggatggatgtgatttcttccacactaggaggagagggaatctcttagtagcttcttgcaacatgtgttcttgatagatttgtgcaaagcctcttatgtgctcattgcacaagttgtagagaatttaggtaaagaacaaagccgaaaattaaggcacccttgctcacaaaattcagaagtcacctcggtgaacattttggtgtttgtccctggtctctgtttgccacaagcacacatacgtgtattcagtggcatcatattatgtgcacggagcttcccaggtgtctcagatggtaaacaatctgcctgcaacgtggagacccaggttcaatccctgggtcaggaagatcccctgggggagagaatggctaccctctccagtattcttgcctggagaatcccatggacagaggagcctggcgggctacagtccatgaggttgcaaagagttggacacgactgagcgatcaacacaacactttatcacttgcactatttgtaacctgctctttgacagtttctaatataccgttatgaccaatgtagatagcatattcaaaagcagagacattactttgccaacaaaggtccgtctagtcaaggctatggtttttcctgtggtcatgtatggatgtgagagttggactgtcaagaaagctgagcaccaaagaattgatgcttttgaactgtggtgttggagaagactctttagagtcccttggactgcaaggagatacaatcagcccattctaaaggagatcagccctgggtgttcattggaaggactgatgctaaagctgaaactccagtactttggccacctcatgcgaaaagttctcattggaaaagactctgatgctgggagggattgggggcaggaggagaaggggacgacagaggatgagatggctggatggcatcaccgacttgatggacatgagtttgggtaactctgggagttggtgaggacagggaggccggcgtgctgtattcaggggtcg

SEQ ID NO: 41712 - DNA, 1025 bp, Bovine  19866880893720
caggtggtgctagtggtaaagaagctgtctgccagtgctggagacataacacatgaagcttcgatccctgggtccggaagatccccaggaggaggccacggcaacccactccagtattcttgcttggagaatcccgtggacagaggagcctggcgggctacagtccatggggtcgtctgaagtacgtctgtatctagctatcccctgttggtttgcttctttggagaaccctggctaatgcccatcccagtagagtcccttacaaccatttggtgttcctctaaagcctgtctactcagagtgtggccagccaaccagcagcaacatcagaaatgcaggggctcggggggccccccaatcccacacacactgaacccgaaaatacagcccagtaaaagcttcaggtgagtcgtgtgcccacagcgtctaggaaacatcagccctgtgggaaaacgcatcccccgggaggaatgacggtatgtaaagtaacttcttagtaaaagaatttgtttaaccaagtctctcttccctgaggacagatgtagggagtggggcgaaaaggggttcagaagaggtcttaggaagccaggacattttcccagtcatgacaagccatcagttacagaaaaaacaaaaacaaggaagtctcaatgtgcaaactaaccagcccacccaacacaaagaaactcaaggtcagagaggcagggccaggcaaatctggcctcaccacagcctcccctttgtaatgtgcttgattgcattttattttctgtgttttcactgaaatggcagttcgcggagaaaccctcgcatttggctgcgaacaggctctgagcagcaagagcgcttctgcagaattggcaggagggaagggaccgtggagcgtttcagaaactccaaggcaaggggacaaccgacgggggaaaaaaagacctcctccaaatgagggcaagagctgagaattaaaaacaatgagcaggagagaagcagaatcgtgaacctagagaacgtcttactggttgcca

SEQ ID NO: 41713 - DNA, 1116 bp, Bovine  19866880897464
tgataaggtagatggaatacgcagagtgtgagtgatggcctctggtggtggaggggaggaaggggcaaggaagacttgagagaagttgaactctgagccaggcttttattctcttttccttgcacatttattacagaaaaatagtaatatatagacagtcaaaaagagaacaatcaaaacctaccccttgacctgctttcagaggtacccacgattagcatgtagcttatttcctttgagacttcttttttcctcttctgctgagtggattttttgaaggatgtcagggagggttaatgttttcctacacttaattccatcaatttggttacatcagtgtgttatataaggagcaatttttacttgcttttaagattctgtcatgaaatatttaaaagacacagaacagcacagagaataacatggagagggcagtgtctggattgggctcgagtcacgtggagaagactgcagtcttaggaggggggcggggtgcaggcctgctgcacttacggagtgttcccgaggtctgtccctgcatcgggcccttcaggcagatagtttcctgggtgtttgtcgctaagtcgtgtccgactcttttgggaccccgtggactgtagccctccaggatcctctgtccatgggattctccaggcaagtatactggagtgggttgccattccttctccaggggatcttcctgacccagggatggaacccgtgtctcttgcatctcctgcactggcaaatggattcttcaccactagcgccacctcttcctgtatccctacagtaaccatctgaggttaattcccgccactgcctcgcctttgattgtttaactaaggaggctctgagaggctgaaggattcgcacaccataacacatggatcagggtagagctgtaagtgttacaagcttgataccacctaatctgaatgctgtttcctcttcccaagtgcctcaggaccccctggctccaccatcctcatctaaaaccacccttcttttatgtcttgactttttcttttttttccaaattattttggacacatgagatgaacaaaattgagcgattttttgtgtgtgtggtaaaatatatataacaaaatagtt

SEQ ID NO: 41714 - DNA, 1397 bp, Bovine  19866881024872
cagaaaattggtttaagacttctttaaaaaaatgtaaatctcccctaattatctgaatgatgatgctaatctatttataaagaacacaaaggcctctgagtgaattacagctctgaatcaattgaagcgtgcagctgacacagcgcccagagccccacaggaaaggttctccaaggcggcttctggaatctgggacttgacattcagtctcacagcaagtgtgctaaggtgcagcacattttcagtgggtgttcatttggagaggcgaagaccgtgttgctcgcatagcgatgtttgagaagaaaggaacccaaagtacataaagctgtttgcaatatagcaagtacatgaaattacagattgcaaacatacaactacccaatctgccgctctggagatcagatgaaaattctcttccccaagcaactacttatgtcgggctgagaaacacagaaaggtcttgaccttcttcaaatgaatcaggtatttatggtcacccaaaactatgatgggggcttccctggtggctcagacagtagagaatctgcctgcaatgtagaagaccggggttcaatccctgggttgggaagatcccctggaggagggcatggcaacccactccagtattcttgcctggagaattccatggacagagggagtctggtgagcccatggggtcgaaaagagtcagacatgactggcgactaacactttcactttcaaaactatgatgaaaaagtgaaaaggaagatttttaaagaaatctgttcaatatatggtgtatgtgtcttcatgtgagaaactgagagagaaacacatttgtgtgtgagagaacaagctctccacttatcatatccacaagaataacagaaaaaatatatattggggttgaaagcatgacaccacccaaaaatgacatgagttacccaccagtaccccatgtgaagagctcttgaggtaatacctttcatattttcttgcacagtaatttagggcccatcaagaccagctgaagtaacaaatgtcaaaagagattcaaatgaagatttgcatccacggctgagagaggacgtatcaaagccacacagagcagtaaaactggaaaaccacttcagagatccttgtcaagtcgtgctcaggattaatagtcaagatggatatttatcaaaaacacattagcttctactcaccagggcatgaaaagatgacacggaaaaaattccaaggcggcccattgccactttggttggtcggcttgcaaaggcaagtagccttttagggttgggcagctccccgccttggaggctggctaggtaacagcggtaccgaaacaggtccatttggaactgctcaagattctgctcccagacaaagatctagagtggtgaaaacacgga

SEQ ID NO: 41715 - DNA, 720 bp, Bovine  19866881210518
taaggccagtctgactcatcatggccccaaattacacaataatctatcaaggatttagccttatgggtttcaaatgtacatacatgcaaacagatggatgcctggataaagaagtgagactagaatgaggaatagtctggaagctgctagaggcacagggatacagatcccccgtgctctaagcattttgcttgatctggggagaaaaagtcaaaaaatgtgtgcagtgcttacccagtttgtgacctcttggactgtagcctgctaggctcctctgtccctgggagtctccaggcaagaatattagagtgaggggccctttcctcctccaggggatcttcccgacccagggatcaaacccacacctcttgcgtctcttgcattggcaggcggattctttacctctggcgtcacccaggaagcccccatattagacagtccctgcccgcaaagaattcctagtctagttgagaagacaggcatctccaacgaacagctcagatccaggcagatagtgtcagaggctaattggattctcaacaaagtgtgatcacagaggcagaagcacttaatcacagccagccggacagttgacatttagccccagcctcatctggggctgtcatctgaaaagtaaatccactctaacagttatcatgaaattgcatccatgatctttgagttcccaccagtccatacatttttatctgattaaccaat

SEQ ID NO: 41716 - DNA, 1213 bp, Bovine  19866881217491
accatcacacttggagaaggaagtggcaatccactccagtattcttgcctggaaaattccatgataggcttcagtccatggggtcgcaaggagtcagataagactgagcacacagtaccatcacactgggggttaggttttcaatgtttgaatctggggcagggggttggatacaaccattcaatctgttgcaacaactgagctcaagaagtacgtgagtgagctgacatggcggcctcattcccgacagcccctgggagcgagggctgggtggagtggtgtctgactgagacgccctcgttttatctgctctctgaacaaggcggtcagaaaggttagccttccccacggggtgtgtagacccttctgcttgacccccagccagggcttgcctggaaatgcacactggttcttctctgctgacctctgtggtgcccgtttcttctcgggccccaccctgcccctcacagaccaccagccagacggagctggagaactggatcaccgccatccactctgcttgcgcggctgctgtggcaagacaccaccacaaagaggacacgctccggctgctgaagtcggagatcaaaaaactggaacagaagattgacatggacgagaagatgaagaaaatgggcgagatgcagctgtcttccgtcacggattcaaagaagaagaaaactatattagatcaggtaattgttctcccgtgtacagacgtgggccaatcctcaggtcttgaaaggggtgtttctgctgccttggaaccgagaaatatccttggttatctcctccttgtcagcctgtcacccaggctgctagattctttattttgactgtcagttcttctcaccagttgttcacagttgattgttatgagctgaagggaacagtattacattggaggaaaaacagaaatctaatagaggagccctcctgctcccaccagtggcaagctgttcttggggatctgggtaattggcatgtctgtgatttcattccccgtggtatcaggttgacttggtgcccagctgtgatgggtctaacttcatccctgactcctcaataaagttaaatttctatatttagtaaaggtagagtgtgctttaaaaatatgtgtataattgctgtatatgcaggtaagtgtatttcatgctaaaaaggaaagatttagtgagataacagaggacattttgccttctattcagttgtt

SEQ ID NO: 41717 - DNA, 1552 bp, Bovine  19866880361213
tcagctcaaccgggccctgttattccctttgacctcttgattcatgcagagtggatgggaggtgagcatgagggtctccaatttataggaaataaaccacagcatttcccaaaggacactgctcctatgaaaaaggacatgtggggtcaaatacatttgggaaaagatccgctgccccctgaattagtcacaatgcactttggcacatcaaattaatgtctaccacaggcaaaccttgttcagccaacttatttgagtcgtagcaccctcccttaccccattcccccaccaccgccacccacataacagctatctacactctacagaacacacttgggaagctgctactagtggcaaaggttcttcatgcatttattcactcagtgtttactgaacacatactttgcacccagcattgtgctagcctgtgaacaagccaggcgtgcacgtgtgcatgcccagttgctcagtcatgtctgactctttgtaaccccatggactgtagccctcccaggctcctgtgtccgtgggatttcccaggcaagaatgctggggtgggttgctgtttcgtcctctaaagccaggcatagccatgttttaattttaaggacaactgggaagggacatttgcattcctctggcatcgcccactgttctctatacagagcacgtggtcaacccccggtactgacacactaactcacccactccagtgatgagtgctgactaatactgggttctaccatcgacgtggtatcagggcagggaacagctatcacttccgcccccactgccaacaaacatctgttgcatatcttctctgtgcagcaaggacacagcatgagattccaacagggacgccaatggtgtggtactcttatataatcccaatttattgttcctaactggggacacatgcacaccctagaacgaaacagagtcgtggtgttttatatcagtttctgactctcactggctctgctcatcttggaaggtctctggaggaatgcttaggcctgactacatgctggcaaaagaggggaagaaagaattttatttatctgccactaatcctcatgtgtcaaacacacaaatctgggattttccagttcctgcctggagtctgcaagggtgcatggtttatccacaattaaaacaggctgcagtttgctcccctcaccagaaagttgcttccttaagcagccatagattacaagccccggctcctgctgccagagaaagccgggggatttggttttgttagcaaaagctgacagggacctcagcagccgctctgctttacatactgaagagttgaaatacaaataggaaagtcctgctgatgctgcaggaagaggggggtgggaaggccaagagaagggtggaaaggcagggttttacttgtggaaatccagtgcctacattctgtcctcaaatgctttatctctcaagagtgctgacatggaggaggaacagatttgttccagctctggaaccataggcaggcatatcatgcactctttaagccttaccttacttacactcttgtgaa

SEQ ID NO: 41718 - DNA, 1900 bp, Bovine  19866880367807
cagcagtgagaactcaccctggcccaggaacgagtcctggcggccccagtgaggcctaagcaactcccttggtgacatgtcctggggctccagtgttttgcccatgctctccactgtccctggccctgatttggagagtgatggactgtgctgggcaaacaagacatgccctgggagacaataaagacctgctcccattcagacatccttttcccttcactatccagaatcccacggtgacagatggcaggaggccccagcctcgggctgatggctcacagagagggctgacagccaaagaccggccaatgacaaagggccttttgactttccaatcccaatgagaagcttggatgactccagcaagtttgtttccctaaaactcactctccttgggaacaatttaaaaatcccagaacagccaaagggaggcatggtcttggggcaattaatgacccccacaacaagctaaggccatttctattatatgtaggcttgttagtgagaaagaaaccaccagttgttgctggctcctgccagtgctcagttactgtggtgggaaggggctttggaccattgctcacaaggctgggatcaaagcagacctctgctatcatttcaggcaagtggctagagcaggcaaggccataggaagctcctctaactatggggcagaactgaggtgctaagagctgaaccctaatttctcttccagttgagttgcactgacctgggtattctgcaatctgacaatgtttaactggcttaagtaggagcagttggcacagccctaaataatagcaacaaaaacacccagacaaacaaaaccccaaattaaaaacttattgaaaacagcctcaggaacgtaagcacaggtcaacttgttgaatcaacacactgttttgatggcttgtagctcagtaaatcattagagacccaggggtcaggccaggcccactgggaaccacgttgtctccacagtcagtttccaggccctggtgacctgctgcggtcattctcggctggggaggaaatgtgatcagggtactccttgttacagagcagcacttaccttacggagaagctcacctcagagagtatacaaccaccatttgggtgtgtgtgtcatgcactacacatgtcctcaacagagattctcccagtgactacaggaggtggacacagacaagtcaggccacagtcaggatgctcggagaggctaagaaactgtctagtggtgcagggctggtcagtagtggtcttggaactgaaacccaggtctgctggctccaccatctcagagactgtcacacaccgcatggcatgcacttaagtcactcaaagagcttataagacagattctagagccaacccatagatcggggtagtcctgggtatctgcatttctccaagagctctgtgacttctgactttttgatgtcagctcaccataagaatcgcattttcattaccacccaggacacaatgacgtctatccacatatgtatctataactactgagctgatacaactgaaaaagagatgtctgtgcttagaacatgtaaagtgccctgaaattttgggagacattctactctatttaaaaagcttgttgtagccccaaaattgatttcatgacccatcaatgagtgcccactgcagtttgcaaaccctgccttggaccgttctaaggccctcaggggggagtctcttggcctcccctgagtgctgagtgactcaactgttcagtctcttgctgctttctactgggctcagaaatgggcaattggtagcttagtgatcatggaaatgtggccacatgccctgagaataatggcaaatcactttgtatttgtgttttacacataatcttgcacagtgagtcgcagcacctctggag

SEQ ID NO: 41719 - DNA, 1582 bp, Bovine  19866880498890
caagaataaatacatgaaaattaagcccactctgcctgcaaaagagaagagaaggcaagctggccgtaggctgtcacctggaatcacctactgggaggtgctgagtcacctctagatgaaggatggagaggaggcttgagtgacaggctcactggcagcaccttgtacaagggagctgcagttcaaggtgaaaacagattctctgccttggagccaacctatcagtgtaaaatattttactcttaatacagggatatttgtgataagtagatcaacacaggaatgcctggtttcatttttcatttacatgtgctccttggaatacctctcactttcctatcttaatggcctttccagaacttttcagagcacatccagctgactcctagtgtgtctggggataatttctggtggtggtgcactgagaaagttactcttgtttcatctgccctgctgcttttctggttgagtggagaagaggcttcactctggtgcttacgacttccttcgcctgattctttcttgtttgttttctgtttttaaagataccagggccagtccactaagcattttagcaggtaaatatctagctagacttagtaaaccctcttttgtttctaagattttatttgttttaagattttatggaaggtagtactggttttccatttacattagaggcatttatttagcaaacactcatatagcatttattctatggaaggcctgtttcaaacactttgtaaagagacagccctttgtttctcacaacctgattgtaagcctttgtgataagaattataatcaccctcatcatgcttgtgtccatgctaagtcacttcagtcatgtctgactctttgagaccttgtgtatcacagcccaccaggctcctctgcccgtgggattctccaggcaagagtactgggttgccatgccctcctccaggggatcttcccgacccaaggatcaaacccaggtctcttatgtcttctgtattgacgagcaggttctctaccactagcgccacctgggaagcccaccctcatcacatagatggggaaactgaggcacaagggagttaaatcaggttaggaagtggcagaagcagtgttgaaaccagggcagcttgactccagactgtgttcttcacctctgtgcactgctgcctctccagaaggaatgctttaaaaattgatatagtcaaggggaaaaaaaaaaatgagccgattcaaaaaacatgatatgaagaaaatgaggttcatgtactatttgtaaatggcagaaatggtgatggtgaactaaaatgagcgtcgctggtcgctcccctggcctgcaggagaaggaagtgactggccgactaagcactctacctcagacacaatgcactgcacctggaggatccctggggctgcagataaaacttcttgcaggttgactgtgttgtagagacctcctgctgcagtagacgatgtatttgtaatagtatgtacatgaattcacaggtacacgcatgtgcacagtgctgcttgcactgctgtcatggaccaggaatggagccgcacagcttgatcagcaccattc

SEQ ID NO: 41720 - DNA, 1151 bp, Bovine  19866880508753
agactatgttaaagcaggagaagggtcagtctagggtgctggtgagaatggcttcgctgtcccaaggcctgggttccaatgctgggtctgctgctgggggtcagtcatgagatccaggcagtcgatttccagagtaccagcacctctctctgttattgcaaagactaaatggatgatgtttgtgaagtgagaagtgactggcacatagtagatgattaatataataaatggctggtgctgttggtcttaatggcagctggaaagttagactagtctttccccaagctttacccaggcttcttgtaagagatgcctggtgttagcttcatggtggccaagttaacagtcactcagtgaatatgcactgggactctgtgttaggaaccatggacctcaaggggtggaagacccatccagtctggaaatctaggctgggcagacatgtagatgagtgattatacagtgatgcaaaagaaatatcatagaaatatggaccaaacacaacagaaaacagaggtaggaatggggaacgggagagtggctggagaggcttaatagaggttgggttttgaaggaggaataggagtttgtcagactgccaagctgtcccaggttggggtgtccaagctagaggaatgagctctgcccattctgaggacagtatgggacctgagtgtgatgtgtcaaagaagcactggggagatgaggctggggatagagcccagatgcattgtgaagggtctgtccttatcctgagtcaccaaatgcttttcagtagtgacatggtcagacgtgagatctagatggttctctctgacagcttagactagatttggggtgagaggaaggagaagagagtgtgtgcataaaacattgtctttgatattaattttgatcttaaaatgtatttctaaggcaccattgaagtaaatcagaaagcactagtaaataaaatatgatttaccatagatgtaaatcagaaagtagtagttaccattggtaatactattaataatatcaataaacatagtcttagaggtcttctctgcagcctggtgtacagctgcgtctccaattctgtggactttcgggttaaaggaaaccctgtgtttcctgtgcccaggctagcgtgctcccttccctccagtcag

SEQ ID NO: 41721 - DNA, 3103 bp, Bovine  19866880679552
ttcttttttgtttgtttgtttgtattttttaaattaatttatttactttaattggaggctaattactttacaatactgtagtggtttttgccatacatcgacatgaatcagccatgggtatacatgtgttccccatcctgaacccccctcccacctccctccccatcccatccctcagggtcatcccagcgtaccagccctgagcaccctgtctcatgcatcgagcctggactggcgatctatttcacatatgataatatacatgtttcaatgctattctctcaaatcatcccaccctcgccttctcccacagagtccagaagtctgttctttacatctgtgtctcttttgctgtctcgcatatagggtcatcgttaccatctttctaaatttgactgttatgtgggttggttcatgcattcaacaaagcttgcctttctggaagactctagctgggttaaaaacttggggaaatgtaggctcagagagaggaaagacaaacagctcaaggttaaacagaaccaaaagtatggacacagtgtccatattactgtaggactccaaattctacatgaactggtgcttgttctttaaagagtcctcatctcttgtactcgagagtttatttgtagatcaatacccattaacgttgagggaggacagccaagtccccagcaaaagccaggtcttccttgatgtgtccagaataactgggaatcaccctcccaagtggtgtggtaagtcagcagaggtgctccaagcccgccctgcccacccccttaccccagccagtcctctaggacttcctggtgaatcacccaaaacaccgactgccttctgaagacaagtaacttctctctcattttactataataaaatgggcatagttgttgaacaaatgaatacatgaacctcaatttttctctaagtgagaaggttggactggaattaacaagagactccttgaagcttctagctctgacattgtcatctgttgttcagtgggtgtgcagctgggttatgtaaggtcctggcctcaccaactgtttgaaagaatcctgtcttttttccccagccagacaatgatggcctgaaggcaggggttttgccaatcctcactgctgctgctgctgctaagtcgcttcagtcgtgtccgactctgtgcaacccatagacggcagcccaccaggctcccccatccctgggattctccaggcaagaacactggagtgggttgccatttcctcctccaatgcatgaaagtgaaaaatgcaagtgaagtcgctcagtcgtgtctgacgctttgcagccccatggactgcagcctaccaggctcctccgtccatgggatgttccaggcgagagtactggagtgggttgccatttcctcctccaatgcatgaaagtgaaaagtgcaagtgaagttgctcagtagtgtctgactctttgcgactccatggactgcagcctaccaggcttctctgtccatgggatgttccaggcaagagtactggaatgggttgccattgccttctccacagtcctcaccgggtatgtgtcaatgtctgttgatggtgtggtgggggtttcagcactggcccactgggtctgtcccttgctctagtgccccatctcatactcccttcaccttcccctctgactacagcagggcctagtctgctcccagctcagaagcacaggaccgctaaggagccttggagcagtcctccatggccataaggctggaggatctgcagaatcacataaactccccagaagcttctagcaggatggacatcatgtcaagcaatgtacccttgatttggctcccccctctccatttcactcccccagccccacactcagctccctgagctctccctgcaaatacaacacatgcacactggcctgaggctctgcccaaaaatatctccagatgttgtcgtgtcccctgctggggtggtggagccgggggatgggtataattggcacagatgagaaccactgggttaatcagaaatcattcaagaaacatactgcagtttgagagctattcacaggagagaggttatgcctatgggagctctgagtgcctcagttccctcatctataaaatgggggtggtagtcacagagcccacctcatgggctgaccataagacagtgaaatcatgtatgtcagaccacatataggacagagtctggcactgtaagggccgtgtgagtgtgacgtctcattacttgtctcttaagatgaaaggacgctagagctagagtaagtgcttcttttaggggatcttggtttttccttactgatttcctatcctaaaggaaaataatgtaggcagaagttaacacacattcaacaaaggacaagaaggggttggcaaaaggcatgaccattctgcacagatggctagagagatggccttgaaacccaatggagggccacccaaaagttctggaatccaagcttcttgaatgtgcaggggctcatgttttcctagccagtccacacagtggtctgctcccagccaacagtgaagcaaacacagctccagttccacgtcctaggtgcccgacatggattcaggctgctccccttcccacaggccccagagcatgctaaccacaagcaggtgttcaagacagtcgctcatggaagtctgagaacccagggcacataactgacgtggggttgggaaactcccagcggatgtcccacagcacacttcctaacaagaagctcctagattccaccctgtttcaggaacccttatctctttagatcttccttttgcctgactcagctctggctcctcaccctctctcccaagtggcaagtggcctgaaatgcaaaattcctgttatttaaaatacaagaaaatttggacttccctggtggtgcagtggttaaaaatctgcctgccaatgcaggggatatgggttcaatccctgatcaggacgattccatgtgctgcaaggcaactaagcccatgcttcacaactactgagcccatgctccgcaacaagagaagccacagcaacgagaagcgcatgcaccacagcaaggagtaacccccactcgccacagctggagaaag

SEQ ID NO: 41722 - DNA, 1291 bp, Bovine  19866880686622
ttcaattgcagcatgaaacagagtaggctggccactgggggtctgggctctcattcagttctgccaacagggaaattcatagagatgccacatccagtacctgggtttccctggtgcatggggtagggggtgggggtgctgagctgaaccctccggctctgccacctatggccctgcattctctttctccaggaggctccactgcacccgcaactacatccacatgcacctctttgtgtccttcatcctgcgcgccctgtccaacttcatcaaggatgctgtgctcttctcttctgacgatgccacccactgcgatgcccacagggtaacatgcccacatggcccatggtgtggccaggcctgcctgcttccccccagccccattcattgaggctggatttaatgcctagaatcaaaggggccagcactggggctggaataggaggttcaaggagtcccatgtccccacatgtgcagccggggactcctatgaaggcagtttgctgagaagccaatggggctactgttcaacttccagtgtcccggagtggatcagcctctctgggtattagacacatagcaaggctcctccttcctctactcctgccaagtcccaaatgtagacagatgacagaagtctagagatggttgggattgtagaaagaaaaaggtggacaggtctgcatctgcatgcccagatgtgcagcagaacataatctcaccctcttcctcctcctgaacacgcagaggagtcttcattcattgcaatatcactctgtgtatcagttgagaatctcttctgctgtacgtaacataaaactatacatcagtggcttaaacagctgggggttgtgccccacagaagcagtccacagatgggcaacccagagctggcacagtggctccttgccacaatgaacacagtccttttccctgtctgctctgccagttttgatcccatgctttatactgtgtgttagcaatatgactgctgcaaccccacacgtcacatctatgtttcaggctaaaaggagggaagtcaaggttaaacatttttctgtttgggaggctttggcttttcatttggaaaagaatgtgcttcccaagactgtgttcacatctcactggctagaactgtgtcatgtgactatatctaactgcagaagaagctgggaagttcagttttttactatcatagtctccatagtggaggcaagcaagggtaaaggggactggaaattgagattggtttaatcagcccgcctgtcgcttcccaccattcacatcgaat

SEQ ID NO: 41723 - DNA, 1638 bp, Bovine  19866880909301
tctctaattgctgtgcacagacttccattgtggtggcttctcttgttaaggagcaccaggctctagagcgtgggttcagtagttgtggcgcataggcttggttgctctgtggcatgtgggatcttctggaccagggattgaacccatgttctctgcgctggcaggcagattcttaaccacctggactatcaggaaaatctgcgttctttactcttgacatatcttgaagatcttacaatgttagtaaagagcttccttctccttcttttttggttgttttactggttgttgaaaaatatgtttagttgtttggacatattatagtttatttaggaagtcccctcattgaaagatacttggattttcccaggcatttgctattgcgaacagtgctacagttagtacctttgtttaagtcatttcatacacacacacacacacacacacacacacacacacgagtgtgcaaagtatatttctatggtaaattctccaagtggaattgttaggtcaaaggatatatgcatatgtaatttagatatatgttacttaattccctctgtaagggttgtagtttaattaattataaatgaacactaatactagtgtttgaaaacactgttttaagaaaaatttacagtttctttgctgagttagagtagttacattataggttgtatgaattttggtaagagtgataagattgttccagatctttggtttctactactgaccccaagggattctcagattcatgtgctaaatgaacatcaactatataataatgtttcacacatacttactatatatttcaagtgtatgtagatgctattgtataataaaatgccaattctcttaatactatgactatttgaatattttataataaaaatactctttatcttacagatatccctttgagggccagcctcccaccaccattcagaaattataaatatggtaaccaatttttcttattcttttaaaacatataatttcacattagttttattttgaagtgaatttaaatttggttttcaaaaatgagtttgcaatctgtatatacaaaccaatatggaagttatttaaaatataggaattctagtatattgttaaagtaaatactacttgtgtcatcaagtggcgtatttatgaggaatagcatgtttagaaaatgatttgaaatgaatttctttgtcaggtaatcagaaaaggagaagtgattaaagactgggaattaaaagaagagatttaacattttagatgtcaataacttgagtatgttggcttccctggtgcctcagtggtaaagaattcatctgccaacgtaggagctgctgctgctgctgctaagtcgtttcagtcatgtcggactctgtgcaaccccagagacggcacccacccaggcttcctctgtccctgggattctccaggcaagaacactggagtgggttgccatttccttctccaatgcatgaaagtgaaaagtgaaagtgaagtcactcagtcgtgtccaactctttgagactccatggactgcagcctaccagactcctttgtccatggaattttccaggcaagagtctgaagtgggttgccattgccttctccagccacacaggagaggcaggttcaatc

SEQ ID NO: 41724 - DNA, 2075 bp, Bovine  19866881153193
ctgagtctttgtcgtaggcaggcttttctcttgttgtggctagcaggtgctactctctagttgtggagtaagagcttctcattgcagtggcttcccttgtggagcacatgctccagggcacgtgcaggcttcagtcgttttggtacatgggctcagtagtttcagctcccaggctctagagcatgggctcaatagttgtggtgcacgggcttagttggctctgtggcatcttcctgcaccaggggaccatgtctcctgcattggtaggtggattctttaccactgacccaccagggaagccccgaattttttgattctacatttgacactactggaagggtcttcatatcccaagaaagaacaaggttgttagctctgttcatattcttgttagcagctatcacagttagtaattattttttgtaattattttatttacaattacttttattttaatttactcctctactgtctgaacccctgccctacctaagtcagggaggatagggattactgagtatcagttagtgctctgtctccaagtatctggcacttaaatggtgggtgaatgaacagagtgcttttctctctatgaaacattttccttctgattagccatgaacttagaaaccaaccaagtttattagaactaaatgtgaaactatgagctagagtaaagtagatgaactctggtggaagggctatgtcatctctatgttctgccctcagtcttggaaatagaacacttgaaatgttaagggaagatgagaacctgatgacgtgtcagcctacttgaccctcctagttagtggaggggccattaccattactgcagtttccccccacatccttgtctttccagttttggctgctcacaggcttcacttgctgggtgtcggtgtaaagccagccaggcaagttatattaagaggtgaaagcagttcttgcccagtgggtgtgaatagtagtttaatattatgtttcttggtataaactaaatctctaatttctaagagtaacctagtcattaaaatgtgaaaatcattaccaaaagcgttacggtaaagctttactagaaggcaagagttagtgtattcacaaatgatgaattatattcattttgtattttctggtttcttggcataagagactggggttaatcatttctgtgacattttaaaattgtagtttctattttcaggagtcagggtgctctggtttaccgttctctggccaggtagtccatggcatgggggtctattagctcatgttgtcctggagaaacaacctgagtttcttcattaatgatgatacctataatagtaattttagaaagatgttatcagtaacagtgattgtagccatctgactctggtttcttagtgctcagcacccaattgagctcagaggggataaaacagggaataaaattttagatagagagattaaccataaacttggtaagggaacttgattttagggaggcttgggttcagaggcatttgggaactgctgctgggataggagtggggagagctggatagagttgtggcttttattttgtgaaggtgaggggaactgacagctgaggtgaaaatgtaccatagctttttcttctcctgcccgccccccacccccctgccatttctcctcctttgtctcttttccttttctgatgaaaaaactggtaagaggaggcctggttaccagagatcttaaccagcccttcccctttgccattcttttcttcctttggctatttatatttggagaaattgggtgagagaagaatgggcatgggtgtaagacacatgagtgtgtgagtctcacctttcccctgtcctgtttttgcccagccaacatggagtgggggcgtggtttgggcttagctgagacatgaagaccagggtttgggtagaggtggaggtattcctggcaggaagtgaccttcactggctgggagttaagaagtaaggaaagttacttataagttggtcatgcactggtgagctgcaacctgtgttctgtttagaaatacttacgaatgtgggcaggcataatgaagtgctctacaa

SEQ ID NO: 41725 - DNA, 1464 bp, Bovine  19866881289948
cctggagtttctggagaaggaaagggaagaggaggcatttatgcaaaatgagagggatgaaggaggtatttgccatcagatgatctccgagatctcccaaaagtcaatagagaaatccctgaggaaacacccactcgggcatgtaatgaactcagcacatcagcttacactagctgggtccataatctccaagtcagttgcctggtacactgaggcaattgtgtggaccatccaactccctgaattcacccagagctgtgtggtaaatgagatagactctcccctttgtggtgggacaccccccttagggggtcttcctgtgtgcgtggtggtatggggcacctgctctgaacctgactgcatttgtttggcccttccctttcctttccttcactgttacacacacacacacacacacacacaggttaagaaaacactccacatggtgtttttgttttttcactttttttgttctgtttttagattattgcgttccaatgaacagtacgttatctacaaaataactagttagcaacctgttagtattcatggagctccttttgaccagctgtttgcagagaaatgtgaatatgtacacagaggcaaccctggagtgtgctacctatgtcgaactggatatgcacacacacaccccacgtggatataatggtggttgttgtctctaatccatgttacacaggtgcacacacacacaaattcatagactcgtgtcagtgtggtgtgtgacatattcgtggctatatgtctgctcccaaattgcaatgtgctcaactttagttcctggaagatgctgaaatttgtgattctgatttaaaagacaattataccccctgccttgagtcttgtctctgtcgctattcctctttatgctcttattttatttgaataatgttttattgtcattcacttggaatattagcaatgattgcatctgcttcaagtctaggcataaactgctcaaagatatcgaggaggaaaacaatatccatatgcaaaccatcaccctcccagttccagcccacatgaaccggcagttccccacccaccccaccccagtgattgtggaacccaaagccagctgagcccaggaactggggagggcagagtcgatcccgtctacagtcgcgtatgtatcaatttctgatgccttgtcgattgtatcatccagaaatgcgattaaaaccaaatatatgagactcaaatgaagtctaattgctatggatctgcaatccccagtgggcccctaatcctttttgacttattcctccccttcctccgatgagatggagcttagacacaaagccctcggtttaaatttcaaaaattaaaattgacatgcagcggtggctttcctgggagcaggaggaatttctaaggaggtgccggagcccagctttatcctctgcattaagaagcaatttgtacttctaacaaaacccccac

SEQ ID NO: 41726 - DNA, 1053 bp, Bovine  19866881369105
aaactttgtccttttggtgtcaaattgctgcagaaatcacaccttgcccttcctggattttttttttttttgccaataatctggagttattattcacattacagcctgctctgatcattaattgtctgtactgcagtcaggacacttttctcagcctctttctcggatgacagttgctgtgctgcacacagctttgatatgaggctcgggatttagaagccatacagtaaatccttgttgatagacgggtttattgaaataagttagttgaggagtttaagtatattatactcaactttcctgagatttttgcatttaaaattggtttttcttcttttttaaaaaaatttgaagttattattttcccattcaaggtgtatatatgtgcattttataatggaaacattataaaattcttaataattaatttcatatccaacatttgaatgtcctggcttgtgttcatttcattaaacttgaaagtcaatattaaaatgatccacaaatgtatttggagagttcttacttggtttcacttgctagtaagacaaagggatgagctggtggtatatttattggatttgagaatgcacattcatttcccattcacatgccagggcactatgcacctgcgtgcatggccgcctgcagcacatttaatttaaaatcaggtgccctaggggaccagcatgtggtagacttcctgagggttcttctggagccattttaaatagaatttgggataatggaggaaagggtgattatgtagaggtcttgaaaatcttttgtaatttgttttcactgtaattggcaagtaaattttcagtctaaatacgtgaaatcattgtctcagacattttcaatagggttatgtagatttaataaaaaacataatattctgtttctgcttaagaaatgttactaaaatttaaaatccaccttatgtctttcttttgaatgttcaaagcagctaactcctaatttgtgtgttattctccaatttgttaaggggtgaacatttttatcaacctggaccatttgaatttaacccat

SEQ ID NO: 41727 - DNA, 687 bp, Bovine  19866881520229
ctgagtaaggagctctacttggtacactgaagctgctcccagcagacaaggccaaggcaagcttttgctctggactcgctctcctcccctctggcagtctctgggggcagggctcctagactctcctgctgctgcccagactctggaaactctggtttattcctccatacacctggaggcagcaatgctggctttgccaaggccctccaccctgcaagcctgtcactgttctggtctctcccattagagccagattatgggggctagctacttaccaggatggagaggatcacaggccctcggatgacccaccagatagacgcgttggcattgatgtcccagcacctagggagggacagccaggtatgactaggagtggggagctgggctgactagaagagacctgttctcagaggtgccctttgcaggaaggaggacgttgtggtcctgccccctgtagacagtgggcttaacacccttaggactgaccatcttctgctgccaagagcaccgccagggctggggagcgtccaggctccaggcaagcccagtgagtgtctagggagcaaaagcacacagatctgagatggaagattctggaccccagagccaagtgcatggtcaagatcactgggggagcgtggtggccaacagcagccaaggcaggtgaagtgtcaggaagtgaaa

SEQ ID NO: 41728 - DNA, 1775 bp, Bovine  19866880621784
ttcagtgacatttttaccttcaaacgtctttacatttaaaaaaagtaaaaaaatttacaaaactaaattttacagaaggtaaaaaatataaaatacatcatactgacgtgaagtaacaccacgtatcgtatatggtcccacagcaaagtattttaaaactgaaaattttagctaggtttgaagcagcgacccaactgcaaatctgttttgaagagctaaattcaattcaaatgaagactacagctatgatctttaagttcttcccagacagcaggcattctaaggagtataagaagattgcagtgctctgttgtgatctttagcattatctttggaaacaactaagataaccttctggaatacactgtaatattgcttacacactttgagaagacctaatccatttcatcaattctctacttttaactttcttaagggagacagaaccaacactccagtgtcttgcatacactcatacactcatttcctacataatactttttatggctattagtttaaatttatacttttgtttaaaagaaagaatcttttgatccaaatcatgtggagattttcgtatcccaacaatccctgctatcaaatgacaaaggctggatttagttatgttccttaactccatacagcaacagcagaatggcacaaagtcagctgtgcaatagaaaggagccaggaattcttttgcactacagcgtaaccaagaatagggaaaattcctattcacaggtttaaatatagtgctggttcctaagccaatatcccaagttattcagcaaagaatgttttcagctatatgctggttcatgctgttttctttaaaaattattcttcctaagaaaaatacttaagatattatagaacaagcattagcccattaggaaacgtttgaccttaaacttctgagaatcttaaatggctattttacaacactgaagaatcttgagctatctggcatttaagacataaatgatggtatggtatagaatgatgaaaacgagtatgtctatacgactaaattcttcatgaaaacttagccctgtatttgaaacaatgcctaaagcaacttgcataaatactgtaacaaatacaacatacaagagaaaacaataccctctaattccacctgtgaaatcaaatatttccaaactaaaaacagtagtaaaaagaaatacaaaggtctgacagaaaacaaaattctgtaaagcaattatccttcaattaaaaaataaatttaaaaaaaaacacacacaagaacacttactttgatgtttctataggtctcattcagaaccatcttattaaactcaggattcttcagcgtgtcaaggaagttagaatacaggctgtgaaagtttggctcaatactgactctcttcataaccaggtactgtgaaacccaaggcataaattcttccttcacagtttcctttagttcttcaacctagccaaccattacaacatgggaagtattcaattaaaagatgataaaatacagttttatgtttcgtttctgtgaacatgactacagtgtatgctgctgctgctgctaagtcgcttcagttgtgtccgactctgtgcgaccccacagacggcagcccaccaggctcccccgtccctgggattctccaggcaagaacactggagtgggttgccatttccttctccaatgcatgaaagtgaaaagtgaaagtgaagtcactcagtcgtgtccgacccctcagtgaccccacggactgcagccttccaggctcctcctt

SEQ ID NO: 41729 - DNA, 1612 bp, Bovine  19866880713112
cttgttaactggttctcttataaatacttaagcatagtaacattttagttttatttcttcagaagttcgtggtatccacttacatattacacatatgggaatattcaccagaatggggcaagatataagggagatagatgaaccaaaagagtgctctgatatgatttccagtctctcagaagtgaggggagtttaattcaagtatttcagtttctgttaagaattcttatttaatgtgtttttctctttctctacccctttagtatattgagtatggacagcaatctagagatcctcctgtgaaaatgcagggctctatcacaacccctggaagtattgcactggctcaagcccaggcccaggcccaggttccagcaaaagctccccttgctggccaggttagcactatggtaaccacctcaacaaccaccactgttgctaaaacggttacagtcaccaggccaactggagtcagctttaagaaagatgtgccagtaagtaggtctatcttctttctttgttgtatttgttgttacattgcaatatatccaatagtgagcatgtactttattataaataacacatgcctattaataaagcatgaaagatcagcatttctccctttaccaccctgatttcccacatgtagcccctatgaatagttcagtacatgttcttgccagcacttcaagtgcacagttgtacataccatatgtattttatatactaaaggaatctgtgtacataccccacccctaggatttgtgtagtaaggatttcagtttgttaattttatgtattttatttctttagccttctattaatacaacaaatatagatacattgcttgtggccacagatcaaactgagagaatcgtagagcccccagaaaatatccaggagaaaattgcttttatcttcaacaacctttcccagtcaaatatgacacaaaaggtgagtctgaagtaatagtttatgtatcactacaaatgttctctgttgtttttcttgatggattgggggatttacatttgatattctctaccctttttaatctttaaaggtgaagataatagaatcaaaatgaagggaacttggatatacaactagtggttgtagattctgtagatgttaaatagcactgattttatttatttatttattaattttggccacatggcatgacatgtgggatcttagtttcctgaccagggatcgaaccaaactcacactccctgcagtggaagtgcagcctcttaaccactgaacttccagggaagtcccaaatagtattgttttgcagtgagttacaggctttttgaagtaaacttgaaaatgatttcatgatgggaatttcatttgtatttgtagtaacaattcacatcctcccagagatcattaacagcttgtgaaaagaattgatgcttgccttacaagattatgtgctaagatgatacttggaaatgtctgttttcgtcaatactaattagcctaaacaaaagggtttgaaatgtaatttataatgcaagtactgtctttgagactctcaccataattgattgggggaaaattttgaagcattttgcatgctttttggaagaagagtttcaaa

SEQ ID NO: 41730 - DNA, 1784 bp, Bovine  19866880845771
ccaagttaacgaggttcgtgaggggaatgaggtggggaggagtgagcccctcaaaccatctggagactgttctgctgcagcatctagacagatcccctcttcttttttaaacaaaagagaagtaaccccatttcctccccttcgccctcacaaaaataaactaaaggggaaatgagccgcaagagggtggccgtgggacatcaatgcgggtgagggggcgagtgggcgtcttcgtgggaccggggcttcaacaggacacctccatggtgtggttgacctggcccagcccctcgctgctctccgagtgggtgcaggcctgcgggcggctgccgtccaccgagttggcactggtgagggatgctgtgcgagagcgggcaagacgagtcatgctggctgagggcactgtggacagagagggtaccgggggtgaggaccggccagcagggcgggcacgggcacgtgggagaagggagaaggatttacgcaagcaaagcggccagcaagacccattcttccgacgaaggctcggaggcccatccgcagccagggctctacggtcatgcaacgccagtgacagggagtgcgcccaagggctgggggccacaggggccagcaggaccctcctcacaagagcgggccagagctgtggccccaacggggcagcagctgacgaccaaccaggagtccttaagcccggggaacgatggggcattctttctaattctgcttccctcaagaagacagtggggccgggagggggggagatcagttctgtaaagaagggcaaggtgtggtagcctcagacggccctcagtccattattcagagagtcacacaagtgagataaactctcagggagcaaatgcttcctttctgacctccaccggccacctgtccagctcaggcgtggcttgcccctgacacctctgagaggttctggccccaactgccagggctctggaagccacggggccccagggaacctagaagcatgactggtctgaagcccggccactccagagccctaaccgggatagagcccacggaaaagcggcacaagaagtttccacagcaagatgcggcttggctgcagcactgcacagagggaggagcagggggcccagggcgccggaggcgggcggggggatccatgcatcaggggaggggctgcggggctacctgctcctccactcagccttcggtccttcaagtatgcaactaagagagaagacagagccagggggcggggtaggggagacacagaacacgggtgaagaggaggttgggcgaggcccgggcgttgagatgggccggagaggagaggagggtacagagaggctgggggcagggccggagcctcaggggccccctcctgcacccccagaaggagccactgatgtcagtctgccccgaggagcccagagagcagggtggggcactcatccgcctctgcttctccagccctggctgcagtcctgggggctctgccgacaaggcctttgaggactataacgtgtccccgcaccctcaccactccagtgggctcagtatcctcgtggatagaagcccatgcatgcgtgctcagtcgtgtccgattcttttgtgatcctgtggaccgtagcccgccaggctccccgtccatggcattctccaggcaagaatactggagcgagttgccatatcctcctccaggggatcttcccgacccagggatcggacccaggtctcctgcattggcagcggattttttccccactgagctgctgggaagccctggatagagg

SEQ ID NO: 41731 - DNA, 1607 bp, Bovine  19866880991714
cgtattaaacacacttcaagcaaaggcagataaatgacacaggtaaagcaatctttagcaatagctcttcaaatgcttaataaactgcaaaacatgatgatgcttaatccccaaaccaagtgtaccagtcatttttcttaatatatcacaactatatcacaggatctgtgatacagcaggtttaaagagcccctgccaaagaaccagagccacaatataagggctataaaacttcaagaataacatttcagatgaagttctctgaagctgtactactaaacatttagtagtgacatggggcgatccttataatttccaataggcccctttaatataaacaaatctcaattaaattaacttttaatacaataaaagcattagaaattagaaatctagtcaaaacaaatcttgtcaaactttgagaatcttggggttggaggagatcagctctaatttaaaaaacaaaaaacaaggtatactattcataccaaaagattttataaaatatctaataactacacttctaaacttcttagtttgtgacattatttcagacttctgtgactatagaaaataatatatgatatgccttttataaagtggtcactgaagtggttccctaagtgctctttcttaaaataaaccccaacctgccattcaatgcagctgaaaatagaagcggaatatgttgctcccagagagaagggggtggttggtgtcagggagtaacttaaatgtaccttgtttttaaaagagcagttcagttgagagctgaagagccccagttataacaagtccttatgctctagcactgttgcttggcccgtgaagctacaaacaagacacatcaggttcaaaggcagtgcttatttctcaagtctgttattcttattttaaaaagaagcccttaccatatacctaagttgttttgtatctttcctctcatagtctgtttaatgattcaaatctattctcaaccacaatgcctatttacagatctcctttaagtggatactagacatgcagttatctaaaatgtaataaattcagacaaaaatctcctttgagtagactattaatgatgatgcagaagtttattctatttcaaatctatgaccaaatggagatgtaccaaatgtagtgttcatttacctgaacgggagaaatggcgtccaagctgctagcactaggagggcgtccttttggcataactcccggtggtggctgcctggccttgttcataacgttactgcaattggccaccatggtgaggatggtttctgataactcctgagaaacactcctggagagacacgaaaagagaaaaatatcattaattattccctagaacacctaaacaaacaaatctggatttctaataaatagaaaacttgctggaacctatggctcaatttccaccatatcccatgtctctctatctgttattaatcaccaggattttctgagcactgcctttcttgtgaaaatattttttaataactctgaaattaacaagccttgggtacactgctgcccatatattttgaaataccgctctaagaaacattccatatcctcaactacttcatcaaaaattatgcacaaaa

SEQ ID NO: 41732 - DNA, 1332 bp, Bovine  19866881050161
atctacctgccttggtgcactcatttgctttcaggctacctctgggacttgcgggaggaagccgctggtggctgggctgccgacacacgggagcaggtgctgagtcccggggtgatgagcagagcctctactcaggacaggcttctctggggaggaggggacctctcggtgcacactctttctccagaggcaagtcaggctgagttctttctttggagacctaccaacactctttacccatggcgtccaggcatggagaagtcgagaagtggaggagggaaaggaggttctcctgtggcatgagacttcctcctaccatccacggcactgccaggatgggggagcaggaagggagctgagttggaactgtccacgggggtggggtctgatttcaccccagaactgtttctggaaaaggatgtgcggatgtcatcccaccagtggaggggaatgatgccgggcccagggtggtcctgaagctctatgagatgggttcctgggtctaacaacaaaggccaagaattctctgggaggcagtggttacgccaaaagatccacaaaaatggcgttggctgtggtctggccaaagatgaaggctcccagtgtgaccaagaggactccgtaactgaccatcgcccaccagctgtagagcagagggtgagagagggggcctggtcagtcaaccactcatgacgttgcagactctcatatatatataaatgtatgtactaagtcacttcagtcgtgtctgaagtcatgactctttgtgaccctaaggactgtagccaaccatgctcctttgtccctgggattctccaggcaagaatattggagtgggttgccatgtatcagttaattactgtaattacttataccacttctcttgtgggtagagcacttcctacttctcaacagctttcacacaaaggtttctggggctgggtgtatgactcctagaccatgggtaaggagaccaagacctaatgcgattagctgactggtcacaggagaccaagggcaggaccagaattagaatgtatgtctcctggtgggaaagatggtcaggaaaaagcaagtcacatgaagtgatccattttattaaaaaataagtcaaaagcatctgcaaacttatgtgtatcaaaaacagctgcaggcttataacctggattttttttttttttttttttttttaggccttaccaaatggcatatgggatcttagttccccgattccccattccccctgtattggaagaacagagtcttaaccagtggactgccagggaagtccccacaataattttctgtttgtttgtttttaaagcatgcaac

SEQ ID NO: 41733 - DNA, 850 bp, Bovine  19866881223138
acttgatgtggcccaagacttgaaggtgagtttgaagggacagagaacgctttatttattgatgataaaaattccaagtgtcttaggaataagtcacatgtaactctaagctagaatggatgagatttagtttttccttataggtagaaagaggttggaagaagagtggttctttagaagtgtaaaaatgttttcatttacatttcactgagttttgtttggtcttctatgatatttaaagggctgttttaaaataagtgatactgacatcttcttagatgtaatctgtgagatacaatttttggagaaactgattggctatcgacttttctacagatttcattagcattaacggattcttttgacaaatagtctgattcttgatgtctttgatttgatgtacacagtactggtggtgtagttgtacttagaggaagcctgagtttagatttttttttttttaacagataaagataatttttcatgctttgtgttttgctttgctttaggtttatttgaaaaaacacagggtaaagtttattgtgaaggtaaagtcatgtgtttgtctttgaaatgtgatcgtatagttagggacaagtgttaccattgatatacactaagctgttttgtttaaaaaattatgattaagaaaatattagcaatattttatttagacttgtttgtgaaaataaaaactggaaacagaaaataggacagaaaagtcactcaattgcttgactcgtagtttctaatattctttttctttaggctttgtcaatgctgctaaatggtactccatttgcctttgttattgaccttgctgcacttgcttcacgtcgtgaatacctca

SEQ ID NO: 41734 - DNA, 1467 bp, Bovine  19866881285937
tctgagaccccaaatgagtgagtgagttatctgaagagactatgtgcttatgtatatgtgcacgcatgcgtagtcactttaaactgttttgtactgtcctactccaaagtgctttaaatctaaattcttcatggtaaacagaatcaagagtgttaacttaggcagttttcaaaaaatccttcatttctttaaaccagtaagtatctactacttgccaaatactactgaggataaaataaacaaaaataaacaccacctcatagaattgacaaatccaagaggaagacatcaaacacatatggtgactattaagagtacgtggaatgctcactgctacaagcaaagaacaatggctttgtaagcagtaatgagttttatactacaagaaaatagtaaacttacacgaagggctgaggcaaaactgtttttcaggttggttgatatgctcatgagtaaaggttccctgcaagtaatcatagccattccagctgtcaagttccgcatcatgtgatgagctgctattcgcattcgagattcctcagaatccagggcaaaatctttcctgactatttgctcacaagtagtcatggcaatcttaattgatcgatccaccacaggatggaccagctcctggacagcccgttcgattgcttggcgcacacactgcttcagctgtggatgggcctgaaacaagggaatctagggaggaaaaaagaagtcaacaatttgtttaaataaaacaaccaaatttctatcagtaatcacgcccttgtctttgaattacttccaaattaaccatgaactacccatttctactttaaataatgaaaagctcagaaattggaaagctgggctccaaggagggcacagtaatcactgtatcttgtgatacatgattacacatcaagtttaatgggcaaactgttcattactagatgcttaaagacactaccctggttagtcaaaatttgtggcttgagtactcctaaagaaagtaacttctttagtaccatggggaaatgcaaaaataatcaagataatagaaaaaaaggctttctacaaaaactattattttcaaaatagcaagcattttattaaaaaaaaattacattgaaatctttttctttacttgaaagactatttatgggtatttactgaatttttaagaaacttaaaaaatattcatgatgaacttatactacacatagcaattcctcctctctgcaacaaaagcctacaacttaggaatccacataggaagtaaaaaagggaagggaaatttaaccagttgacctcgtcacaaagtaacagtttacttactgttgggtttagagtaatgtgtggtgccaggcctgcgagggaatagacattgatgtcatggtaactgtactgtggctgtggtggaacagtggctgtacaggtggtgctggtagctggtgttgtagaagttgctaaatgtagagaaaa

SEQ ID NO: 41735 - DNA, 1796 bp, Bovine  19866881303750
tgacaggaaaccaacccgggcccctgcagtggtagtgaggcgtcctaccctatccgctggaccactagggaattctctgaagtgtgtgattctgatttagattcttttactataaaaagaccatattaggacactttgtaaacttgaatgaggtctgaggattagatgacattgatgtatcagtgttgactctgatttcagtggttttactatggtcacgtagaatgtctctgtaaggaaacacagactaaaggatacaagagtgactgggacatcaaggtcagcacctatgttcaaatggttcagaagaaaatgtttccccctcacattttcaacttttataacatttcaaatttttagaaaatctttttacaaagaacagggcaaaccatgaggtcaccaagtaaattcctttagtatgtcaaacatgaaggttaaagcaacctcgtgaattaaaaaaattcccaaatgccatgctgatgtgatacaaagggtagctacactccacaatgcaacagctgtgggtaattttttttccttgtaacttaagctcctgggcacaagtgacagattaactgacagaaacattcaaaattaaactgtaaattcctcaatttaatccaagacaagtacttaccttcatgggctgggctaaaaatcctgtgggctgacttaaatcatttgtaggcaagaagccaggcacattgcgtgcaaactcttcataaacagccagctgctttgggtccacaccaccaaccttggaagaagaaaacctgttttaacaggatcctcttcacaatcaagggaaacctttttatcaaagtggaaactctgcatgggagtaagcaccagggttttgagaagggacacaggagtctttacaacatttaacacacgactgaataggcatgcatgtatgcacacacagttcagggtttcctattttccctgagacctgtcagagtcaccctcatttatactttttccactggcaaatgcctcaagtaggaccatgcagccagtgcaattccccaatggagctgtaaaattgctaagatttctcaacattgtcttctcaccaacaagcaactagcaataaaaactcaagtatcagaagggaagaccaagctcagaaacaaaaactagaaggcatatgaacgtgtaacagcagcacttcaacaacagggggaggggatacatctaagctatttctgtgtcttccccacaggcagcctttaagagaaatcacatttaatcacagaaacagaatttaacccctatcttagtcctcagaaagaaaacaaagacagggcagagagagagagacagccccaagtctcactttcagcctgatttgctctggcatccgctcagcttggtatgttaacacaacaggatcacaataccttcgcccttcttgcctagcatgttttctcagctcaaattcctgcaaacaaacaaaaaaatcactgaggttcttgttatgaggcactttcttaaatggaaaaacaaatacttaaaaggcaaatgctaaacacttacagttgctaatctcttgtccatctcagggcctgctttttctactgcagtcttctgaataaaacagcaagctaattcacaattgtcctgagctaattgagcagctgcctgatccatcatttccctttgttgtgggcttgcagtctattgggaggagaagagacagaaaaaaatttaaagttttctgtgggtagacaaaacagatagatgggatactagaaaatgcaatgttgggcaaattattttagaagttccaa

SEQ ID NO: 41736 - DNA, 855 bp, Bovine  19866881368852
agaggaaaaagtattttagaggatttacagaaaataatcgatgtagcagacctgatttctatcctgaaaggcccgcttacaaggctggccatggctgggatctggaaacctacatttcagtagagtttccacaaccactaattgatagtaatggctcaccttgtcttctctgtttgtacaaacaatgtagcttttgcttccctttgggaagtctggaattttgtgacatgccaaccagatgctacctatgggattaaccccctaataaatactcggaacattgattctctaatgagtttccctggttgtcaacatttgacacattgtcatgatgtattgctgggggaattcctgggacctgtgtgactctactgggagaggactctaggaaggttgagcctggtctcccccacacttcacttcatgcaccttttccctttgctgattatgtttgttatccttccattgtcataaatctcagctacaagtacaactctatagggtcctgtgagttctcctagtgaatcattaaacctaggcatatctttggggacttacagtgcaggtaaaaaatttacatacaggtattattaaaattaaccttaaatattaggtacaaactttcagttcagactacattaccctcattcatacaatcagatacagaaatgcttatcaatattaaatctgtgctattattaagatagaactctttttttttcacttgatgacttgtagtagattcccttgatgtgtgcatgctaagtcacttcagtcgtgttggactctttgagaccctatggactgtagcccatcaagctcctctgtccatgagattctccagggaagatactg

SEQ ID NO: 41737 - DNA, 1831 bp, Bovine  19866881439644
atgatttttgaatttgagatttgagcgatgtttgaaattttcctcaaaactttttgtctttaaggaaaatgccgattccagtaatctattaaaattaccctgcaggataaggctcatttgccaaatggactttgggcaccaggccagtaaacgctgagcaaaaccaggctgctctttgctgccaggcctttcccatacactcttgctccaccctgcctgcaggccatgctggttttcatcatcagtggcctcgtcatcctggcctactgctcccaggccagcaatgagaggacctaccaggaggtggtgtgggctgtgtgtggcaagctgacaggcgtgctgtgtgaggtcgccattgccacctacactttcgggacctgcatcgccttcctcatcatcatcggggaccagcaggacaagagtgaggtccccccctcagtatctacctcatccctcccgcctggccctggggatcctgcagtgggcggggaagagcctggaatacccacccaaggcccgggcccggcattcatctgggaatcctccctgctggctgctgggcccatgagacagttggagatcccagcagaggtggaggaccataccctgcaggagcctggcatcaccttccctccttcctccctctgcagttatagctgtgatggcaaaggagcctgaggggcccggcggcagcccctggtacacagaccgcaagttcaccatcagcctcactgccttcctcttcatcctgcccctctccatccccagggagatcggcttccagaaatatgccaggtttggaggccccaccccagcctgcgctggacagcagttctggtcacaggcagtcagagacccaagggcagcaggggaacccctctcctccatgccaccttgcctccggggcagaaagagggggcaaggcagagacagaacagggcttgcagaggttctagcagaagacgttccttctgtgtcagcagctagggagacagtggctctttgcatcagtgggagcatcagttccaaatgtccttgtccaagaagggacggatagtaatcctgaatgtgaaggcctctcctggcctgggccttgtctttctcacaaagcatgagattttttgatcatttggaattgttagcttcacagcattttccatgcagctcagtgtgaagggaagggactagcttcttggctcagagtctgaaaaacagggattctaacctgtttgctgtgatccttaattgaaggggtcatgctcagtgtctccaaggttctctttaatgttgactttctggtattagtgccttggagccttctccctccagcctttcctgcttctcaaaggccctgcttgcagctctggccatacctgggctgctctgattgaagtagcagatgtgctttgaagcccagtgccccctgctgcagtctctgagctatggagctgaaccaccttatttcccagtggccacacatgtcagtctggtcccctcttggcttcctaactgtggcttgtttctttgaaatttatttctcatgcatttcttaagtctttgtttggaatgatctcccagttggttccttagacacttttggtcactaaggtgaaggatggatgtccctggggatagaatcgaagaagaggcagctgggactagggaggaggaggcttaattcatcctttctggcagcttcctgagcgtcgtgggtacctggtatgtcactgccatcatcatcatcaaatacatctggcctgataaagagatgaccccagcagacatcctgaacaggtgagtgagggcccccaggaggcacatagggtagaag

SEQ ID NO: 41738 - DNA, 1322 bp, Bovine  19866881588950
ggcatagcatcaccatactcaaatttttcttattactttattagtttttcagcacagttcactctttctacgttgacaaggggttttgttttacattttgtcatctcaaagtctcacgacatcagccaccagaatacacaagagtaggctcttcactttgtacagagaggaaaataataaattccattaaaagttcacgttgaccaaagaagacacaacctccggtggaaagccacacgtgggggtacccaatatacatatatatatataatgtatagatatttatagatatctcatctgaaagaacacagaaaagaaatccaagtttcacagcgctatctacaataagggattaattctaccagcttttcaaacagtcacattcgatattccgaggaagcacgtgagtgaacagaactgggggcagactaacactccactgggctctagagcagtctagagtcatggcttaagagtataaaaggggagacgtgtgcagaggaaatgtgggtgcaggagtcccctcagccccacacgcacccacccccctccacagtcctgcatttttcattgccctcttctctttgctcatttgggggcttatggcaattgatttaggctcagagacgaatggcttctggtttctgggcccggagattctacctggtaaggtgggtggatagggagtatatggcacagtgctgcgcttcaggtgacaggaaggggctggggtgtgtggggagctttgctcttctgcctggcccttgttcacttcaggaaacattacctcccacccctggacccagcaagccccagcttaggcctcctccacctggctaggatggtgatgtgggacacctcggaccagttttctccacatgagcttgctcagtgatgcctacatgaaacgctggcatagcttgacgagaactctgtctagaaacatttctaatgaccttggccacgctgctgctgactgagttgtcttccatggaacctagaggcaaaaaggggggtctctgagggaactctataggaactctgagctgccactgtctgcaggcttccaaaagcagtcaccacgaagttctcagaagtgcacccaacactcaaaggctgtcccagcctttaacctcagcccgtcagctccctatggaggcagaggaccaggtgacgttctgcctcagggccttggctcagcaatgggccagggccaggaggtggccgagggtggggctggaagggacagtctgtggggttcctgccctccaggtcctaccgtgttctgtcttctcaggcaaagcagccccgttcagcccctg

SEQ ID NO: 41739 - DNA, 729 bp, Bovine  19866882008327
cctggggtcgggggtcctgtggatgaggagggacctctgagctgagacctgaatgatgaggagatgggcagacagaagttaatgcagaagctctgagacaggaactgctgggggagttcaagattaaagaggttaacagtgtgggtgtggggaatgtgagaagtcagggaagagggcttctgagcccagccccgacacccttctaagcctcagttttagcctccagggctggtctgtcacctccccatctgctgctggactgagcaagggattgtccctctccctaaccctcccagggtcgctctgacccagccctctcgtccccgccctcaggtatctgcggcttcctgacctttggagacgccgtggaccctgacgtgctcctgtcctacccgtcagaagacatggctgtggctgtggcccgtgccttcatcatcctgagtgtgctcacctcctaccccatcctgcacttctgcggacggtgagccctccgccccaccccttgaaggtggtgcttctcaccagggcccctggatgccctttgaacacggccttgggccttgtgaaacatccattttatagagagagacattgaagcccataggaaacagtcaatgcctaggatggccctgcaagcacccccagcctggtcttggggggcagagtcaccaggacaacctgtgagtgctctgagaacctctaatccaggtcccttcctgaacaccctgt

SEQ ID NO: 41740 - DNA, 1785 bp, Bovine  19866880213914
ctaagagtcttctccacaccacagtccaaagcatcaattcttcagcgctcagctttctttatagtccaactctcacaaccacacatgactactggaaaaaccatagccttgactagacggacctttgttggcaaagtaatgtctctactttttaatatgctatctactttccttccaaggagtacgcgtcttttaatttcatggcagcaatcaccatctgcagtgattttggagcccaaaaagataaagtcagccactgtttccactgtttccccatctatttcccatgaagtgatgggactggatgccatggtcttagttttctgaatgttgaattttaagccaactttttcactctcctctttcactttcatcaagagtttagttcttaaaaaaacataaaaaaatttaaaaaagagtttagttcttcttcactttctgccataagggtgatgtcatctgcatatctgaggttattgatatttctcccggcaatcttgattccagcttgtgcttcctccagcccagcatttctcaggatgtactctgcatagaagttaaataagcagggtgacaatatacagccttgacgtactccttttctgatttggaaccagtctgttgttccaagtccagttctaactgttgcttcctgatctgcatacaggtttctaaaaaggcaggtcaggtggtctggtatttccatctccttcagaattttccacagtttattgtgaaccacacagtcaaaggctttggcatagtcaataaagcagaaacagatgtttttctgaaactctctttcttttttgatgatccagcagatgttggcaatttgatctctggttcctctgccttttctaaaaccagctgaacatctgaaatttcacggttcatgtattgctgaggcctggcttggagaattagaagttagaagtacagacaccgaaagcaatgacaatgaaatgctgctgtagtctcacatctgctgccacagtttagtacacataaggtcctggatggagagctttcaaggtcaaggctaagtccagatactggcattttcagtgtgtgcaggtcacatggcttgatttcctgggtggttcccagacaactttgagagctggtacctatcatcaaccttcgaaccatggttctttccaggagacgggaaatgaaagtctaggtccatgaatgtggttccagttgcccagggcctgtcatatccaatcgcttttgtctttagagatggcctgttttcctgatgttcctttatattttcaagttattcatgcactagaagtcctctccaagctactcctcacaataaacttactgatatttatgtaacatttgcattttccccttcaaagcttgggcaaatcatggacattctgccccagcagaagtcccatgaatcttgttctgaaaatgactggtatccatgatattttgaccatatactttttttctttgaccatgccagttgacatgtaggatcttagttcctcatcccgggatcaaacctgtgccctctgcggtgcaatcatggagtctcaatcactggatggccagggaagtccttgaccatatacttttgaaaagccaacaaattatgtgtgccatggctgattttcctctacctcaaaaaagtactgttttccatgaaaagatgctaaacatcattattcattattagagaaattcaaatcaaaactgcaatgaagtatcacctcacaccttcagaaaggccatcatcaaaaaatctacaagcaataaatgctg

SEQ ID NO: 41741 - DNA, 984 bp, Bovine  19866880759905
ataacaacatcttttaagtgctcagggaggggggaacccgaaagtcctgtcaaatcagaattatatatccagtttctgcaagtgaagatgaaataaagacatcctcagataaatgaaaactaagagaatttgcagccagcaacctgcagctagctataaaaaaatgttaaagagaagctgttcaggctgaaaattccaggctgaaatgaccctccatgaaaacttgaatcaccaggcacgaatgaaagaaagcactagagatgataatgacgggtgaccacacggcttgtactgttaacaaatctaatcacaggaccttaggcaaaaccaagctgatggacattctacaagataaatttatctttttcttaaaaataaggtaagacagacatttaaggctaaagatctaacttaaagaactaaagagacaagagaactgaatacaacatatggtcttggactaggtgctacccagggaaaaacttccacaaactttattatgctataaaataatgtattcttaaatttcccgattttagtaattgtccttgattatgtaagtagaccgccctgttgttaggaaatacatagcaggatgttcagggggtaaaggagcagctcactttccaagaggaaactgcaaatgaggcaaaatctaggtaaagggtctatggaagttctttgtactattcttataacttttagcttttctcttgagtttgaagttatctcagagttaaaaattgcagtctgttttcttttgtgaccaccaccactctatgctctgtcttacccatttggcactggtacatatttctcggactctggttgtgatctgagaaagggatgaagttggcgatcacactcagcaggctgtgagggaagagctcctggtgcgtggtgaccccagccagaacctcatcctcgaagatggcaacattcatgaagatcggaaagaggaaggaccaggaagttcaaggcaca

SEQ ID NO: 41742 - DNA, 3380 bp, Bovine  19866880791469
tcacctacgggaggggcaggctgacccaaagggaaaagggggtgcttcctggggtgagagcaatgttctatatattgactgaagtggtggttacatgagtgtctgtacttatcatgactcattgattgtgtgcttaagttctatgcatttaattatatgtcaatttaacctacatatttcattgtatgccccacaaatcttctttacaggacttcaaaacaatcatccagagaaggtggaatgtatttttttaaagttgattttgaacaaataagtcacttgatgatcaattcctcagagaaactcaaagaaaactcagatgaaggcagagaaaatgataacattcctcgtggagtctggagtaacaaaagtgatttggagacaatacctccagctggcaatcacttgctggtccattctcaccataaacattcagtgagtattaccatgagtcaggctgtgtcttgggagagacaaagcccttgtccttactaagcatacattctctaagaagacagacaaggagactaaacaaataaacagggtaatgacagactctgaccagtgcaacgaaggaagtccacacgaatatgtgccatgcctgagagtcgataaaggagtgaggaggacccagaagaatgcccaggaaagacctctgtgcagaagtgttagctgacacgcgtcacgggaggaagggcacatggaacgacattgtaggcagacagagacgaggtgcaaaggccctgaggcagggcgaaggggggggtgtttctaagaaaacaaaagacaatccgtgtgactggcgcataattagcagggtggaaagagtgggtggagctgggattggaaagtagagtggggaccagggcacgcagatcctaagaggaggagcagaaaggcctcttgagagaaagtcaaagataacgggcagccactgaagaggtacagcaggcaggggacatgatctaccatggagaacaatagtggggataaagctagaagctaagagaccagttaggatgctactgcagagatgctggcaagaggtggcggtgacctggaccagggccctgcagcagacaggcagaaaagagatttgagatgtactgtgggaagacaactggcagtctcctgatgtagtcagtctaaacaatgagcagcaggaaggatgggcagagagtgacatgctttagtaggatggggaactctgtggcagaacaagtccgagtaccgggggacattaagagtttcattttaacacactttcatatccagtgagtggacatgccaggaaaggagcatgaagctcaggagggtagtatgagccagagatacaaagttcaaagtcatcacatggatggtcgtgaagccaggatccaaaggagatctcccaggcaggagtgcctcagagggatcagaattcagtccaggactgagccctgtggcacccagcatgttcagaactcctgttgtgggcagaggaagagcactgaggcaggaaggaagccaggaagacagtggtttcggaaggtcacctttggcgtgcagcatcctcgcagaatactccctgagtacatgcagactgggaaggctagggggtggtaaccttaccagacacccccgggagatgcaaggagaggagccaaagaggagcccatcggatttagcagcacagaaccatccatggcgctgaccctcggagcactgtgggaggaggtctgggactgaagccaggtcacacccacttagatggaaatcagatgactgctgaccttcacggcagtcacagccccacaatgactcaatcctcccacaactgcctccatgaccaaggcattttcctcgccgccacctcactgaggtcttcacatcagtggttcctgaaaggcaaggcctgccaggccagctgggccacagctgccacgggaaatgtgagcagggcttcccggctgccctggctcgaagactccggccacttgattgatataaccacagacacccgtcctgtactgtgacctctgaccccaagatttccgcctgcctccccatccatctggtccccatcctgggctgccccacctgcgtttttatcttcctctagtgcccgctgctgcacactacagcattcacccaacttctgctcccttccactgtcagaaagcaagcattaaacaaatgccacagctgagactcaccaggaacagtcagaacagagggggatctttctggaagttcattaacacggcggctgttttgaacccagtaaatgttgacgggctcgggtggacccacagcctgacaggtgaggttgaaggctgtgtttctggtgacattcatgctctcgggctgcctcgtaaagtaaggaagtcctgcagagaaagtggtaagtggaagaaggttttagattcacaggtcaaggtgcacccccccggtgagtggaaaccacaccagaactcagcaatagttctctctgtccaccaccctgcagtgcaggagacttggatttgatctctgggttgggaagatctcctggagaaggaactggcaacccactccagtagtcttgcctgggaaatcccatggacagaggtgcctggtaggctacagtccatgaggtcacagagtcagacacgactgagtgactaaacttttactttctgtccaccacccaggtctgaaatgctcagttttcaccttgatgcagttgagtaagaaagcacacagaagctaattcttaccagtccagctcgagctggctttctaggacactttcccaaaggagcaatggtgattcagaactggtttttccagaagggaggcctggcagttgtgaaactaggtgttgcttaagctcctgggaaaggctggcaggattccttaccaataaacacagagtgaaaacaaagccatgtgcgaggtctgcccctccttttttctttttaaagtttaagtagacttgatttatggcttcccagctggtgcagtggtaaagaatccacctgccaatgcaggagacgcaggggccatgggttccatctctgggctggggagatctcttggaggaggaaatgggcagcccactccagtattcttacctggagaattccatgaacagaggagcccggtgagctacatacagtccacggggttgcaaagagttggacatgacggagcaactaagcatgcacacttgacttataatgctgtattagttccaggtgtatggtgaagtgattcagttatacatgtgcaaaaatagatattctttcagattcgtttccattataggttgttacaggatatggaatagagttccctgtgctatgcttgtttattttgtacatggtgctgtgtgtctattcatccaaaacttctactcc

SEQ ID NO: 41743 - DNA, 911 bp, Bovine  19866880844939
accaaggaagaagaagaacttttagaaagcaaaatcaaaataccagagggggtggggggtctggtgtctggaagggggtgtctcaaaaatattgatttttaattttcagagggagtcaaaaaccaatagaccaatggccgctggcatgccctcacagctatctagggactttcctggcagtccagtggcttgggcttcccaagtggcgtggtggtaaagaatccacctgtcagtgtaggagacacagagatgtgggttcaatccctgggtcgggaagatcccctggaggaggaaatggcacccactccagtatttctgcctgggaaatcccatggacagaggagcctggcgggctacagtccatggggttgcaaagagctggacgtgactgagcacacatgcacgtatggctgtcttctcttttccttgcttcccacatctgtttttccacagtcatcgacagcacagcactcagaaatcagggggcttgtgcgtatgtattcaggggcagcaggtacgacactaaggtttgagcgtgaggaagggagccctaacggtgagaaggaagcatgtggggagcccgctgagggtaaaggaggccccactgaagtgtgagatgcagtgccttccgacacatgtggattctcatacctggtcctgtgagccactgctcctcagggaagcatttcctttgtctcctgggccaggacactttcgcttcattttcttctttttaccattcttgtgaacagctttaaggtttatatttttttgcttaatagctaaaaacaacaacaacaacaacaaaaatttgacttaaagacaatataaaacaataacagcagtttactcttaagagggatattctttaataatgtaagaaaagttctccactattcaaaaagcaaaaa

SEQ ID NO: 41744 - DNA, 1785 bp, Bovine  19866880861477
ccttaaaacagactaggacattcccaggtggccctagtggtaaaagaacccacctgctaatacaggagacataagaggcgtgggttcaatccctgggtcaggaagatcccctggaggagggcatgacagcccactccagtattcttgcctggaggatcccatggacacaggagtctggcgggctgcagtccatgggttcaagagcggaacatgacagcatgcatcaccatctctgcctggtcttgagactgcatactggatttcagttgttattttgggagctctcgatcttcaaggctgctggggagagaagagtgagattagggcgagtcattgccacaagacattttacccagattcagctattttttctttttttggctgtgccacatggcatgtgggatcttggttccccaaccagcgattgaacctatatcccctgcattggaagcatggagtctcaaccactggactccagggaagtcctttcagctgtttttcttaagtaagattctctttgaattgttgtaagcctttaatttccagaattctgaaaaaaaatttaattttcactgttttggtcattgtcctctcgtactttttattaagcagtagattacagagatcttttgtctgtcctttcaggagtgatgacaacagttcactattaagtattttttgacatcttttttcccccatgtctgcactttagaaatgcttatctttgcctggtatgaagactgcaggtgtcccatcttctagtcttttatttcagaatcgccctttcctgcctggtggtccaggaactcacctttccagcctgatgttcctcatttctgagtgggtaaggtcttcactcctgctccagatatttaaactgcctttttcaggggttccacagaagtggccttatttaccattcacacaagtcttaagtaaatacaagttttgaatcccagctgtattcctgcacaaaaatattttaaatttatttgcctggatgtgttgcttggcaggtaagcttgttacataataatataaactggacttaatcttggacttcctgaacaaattcgtgattcagtccgtatctgctgacacaccagcctttctgtgtacccgaggaccgtaagccagtttcaacttcctcatgtcgcggagctcagtttggtgaatccagattcaacagaaacgctcctttttcagccaaagacatataaaacggtcactttggtgtgaaaagaaggaaaacctagtcccagtgaattcctgattgtctcgggggctgaatggctgtccttgtgtggcagtgaagggttctatgttctccccaagctgcggaggtgatgtgagctgcccctcaggaaacagaaagctgcccggcctcctgcaagactgccatcagctctgccgggctgaattcttggggatgcaccctccagctaaatctgcaccaaaaaaaaaaaaaggtagaagtgaccttgacttttgaatgggatatgcaggcccctccaggtgggggactagagggcaagatggggaagggagcaccctggaacagatgggggaggtggctgctccccatggccttggttctggcagatctcagcaagagggcttccctggtggctcagtggtaaggactctgcttgccagtgcaggagacgtgggttcaatccctgatccaggaagatcccacatgcgctggaacaacgaagcccgttcaccaccgctactgagcctgggaaccacaactactgaagcccaagtgccctacagcctgtg

SEQ ID NO: 41745 - DNA, 1319 bp, Bovine  19866880883232
gagaattttttctgacttaatataacagaaagaaagaggagggagagggcaacgcttggattgcaaagtcatcagccggagccaaaggtgaaggcatactcatcttctcagaagctacagaactgttggatttcatagacaaccaaggccagatgcacgtgatccagaaatacctggagctcccgttgttcctggaagcctggtcatcgcaagtttgacatccgaggctgggtcttggtggactgtcagtttaatatctacctctatagtgagggtgtcctgcagactgcttcagaaccgtatcaggtggattatttccaagataaaaccagccacttgactaatcactgcattcaaaaggagtactcagagaactatgggaagtatgaagaaggggaacgcaatgttctttgaggaattcaatcagtacctaacaagtgctttgaacatcaccctggaaagtagtatcttactacaaatcaaaggtatcatagagttacccagtcctttctctttctgttaaatgtgtcttgatggagctttgggagtttatgcctttcaaggaattgttccatttcagttgtcgagtttaaggacaaaaattatttgttatatccctgtattatccttttaatatctatataatctgtaatgatgaaactttttaaaatccttatgcttaatccttctgttaccttatattggtaatttatatcttctctctttcacttgggcagattggttagaggcttatcagttttattaatctcttctaaaggtcagcttttggctttatagattttctctgtcattattgttttcaatttcttcatgttctttattatttttattcttctccttttgaggggcttgcttttcttttctttttctagtttccttaaagtataaggtcaggtcactgatttgagatatttagtttttgaaaaaaatacaagcatttaaggccttcagcttttctataagaacttcttagctgcatcccacagattttgcttttgtgtttttgttttcattttattaaaatactttctagtttcccttgtggaaaaaaaaagtttatatgtagcttaaattgttagagaaatgtaaatcagaaccatgatgaggtattacttcataccggtcagaatgactagcgaaaagtctacatataacaaatgctggagagggtgtggaggaaagggaacccttctactctgtcagtgggagtgtaaattggtgcagccactatggaaaacagtaggaagttccttaaataaaagtaggcctgccatagatccagtaaccccactcttagg

SEQ ID NO: 41746 - DNA, 1135 bp, Bovine  19866881097605
cagagtcatcctgtcactgcaagaccaatctagaggcttatatgatcaccctcacccagagggtggctcctctttaaactcgtgcttaattttcccagtctcaagaagcagacatgggcttggtattaatgcacctgtttggtagctgtgacctcctgtggtttataattatgtgtgtggtgtgtcttttgtcttttacgtagcaattccctccccacctaccgaagtcagggtgcacaacagctccgcacacagcatcctcatctcctgggtcccgggttttgatggctactccccgctcagcgattgcagaattcaggtaacctttcttgatgaaaagaaatagctatttggggctcagtgactctgcctgacttattttccacctgaagagtggcacagacgtcaagttgacacccctgttcagaagcccttggcctcctgcctgccccgtgtccaccaggcacacgctgttttgtgatgttctgaccgcatggggcgctgtgcccttctctgtgcgtggtccagggcccaactggaggagaaacatgtttctaagatagaacatcatgagaccagggagaatgaatttttaaggtacaaaaacacatctagcttgtgaccaggagttcagaagccaggcatgctccagcctggctcctcctgggttggtggccataaaggacaacaagagacaagtcactactgaatgtgccaactcagcctgttggaaaaattgagggtaccaggaaaaactggggatgacagaccttgcagagtcatctctcactatctaaaattgatataaaatagagctatgagaaatataggttagtcatcctaaaatgcaggcttcccagatggtgcagtggtaaagaatccgcctgtcacagcagaagatgcacgagatgcaggttcatttcctggctcgggaagatcccctgacccaggagtaggaaatggcaacccactccagtattcttgcctggaaaattccatggacagaggagcctggcactcacagagtcagacacgactgagcacacatacatgtcgtgaaatgatacctcgccatgaaatagactctgctgtgagcactcactgcatgaaaaaggaagggcggcggtaacgctgt

SEQ ID NO: 41747 - DNA, 797 bp, Bovine  19866881286161
aaaacatgttgtaccgataaaagtcagaaaagactaaatagtattggacaaaacagaagtcaccaagaacagtttgggaaaaaaatcttaaccccacaaaatgtattcctgataataatgggcttgaaattatagggtgtggatatacaatcttgttatttcaggagatatatgtttgaaatttaggtcacggagccacaagctgacatttcggaattctaaatcccccagtggatatgatgaggggggtcactgggctcgagtctcacgtctgactcagacccacaggctccaccgggtaacaagatggaaacccattggcctgaggaaaacaccagaggagaacccaggagctgggtgcttatcttggtggtggctgttggcagaaattaattttttttccttctctttaaagtctgcacctacttcctggtgaccaagcactggaactaaggtggaagaaaccctggctcccacccctgctgtttccggagcagtgcaccggcctgctgccgctcacagggacactctttacagcatgctcctggacgaagccgcggtttccgtaaccgtgctgctgggtcctggggcatgaaacagtaagactacgtgggagaggtaaaaatagaaatggagtccagagcccaaaaatgggtgaagaatgaaaccaacgccaggaccaacggaagtgagaggggtgtgtcctgctagtgcctggatctgaatcttgtccaaaacattcattcgttactaagtcagagtttaaaattgcaatgaactgggaatctgctacaaaa

SEQ ID NO: 41748 - DNA, 3650 bp, Bovine  19866881386600
acaaagggaaaaaaaaaagttaaaaatgtgttaaaatagtagactagggcctcaatgaaacaaaccaaaaaaaaaaaaaaagcatgtagctcaaatacctgtcactgaccctaaccaatgaggtcagtgtaaggcaagatgctgccaccagaaggaccatatgggcaattccagaattagcttctgacctccaaccccttcacactcaataataccctagggctacctcaacaattagaaaagacatgaaaacctaagatggagggacaaaacaattcacagagactcaagatcaccttaaaatgtcggagagaatcggcaatgccaggggcaatctccttatcggcccagccaatcatgacaccgtccagcaggacagggtagcactcactgtacggccgatgtggagttccgtcaactggagtgacccctggtgaagtgaacaaatggaatgatctcatcaggatgctttcccaacatttaaatttccctccagactcaacaacggctttacctttccagacatctaatcaccttgtctctagaccagaatgtttttatatggcttgaggaaacatttaagtctttcagcaaggacccccaggtctagggtctctggctttgagcagagtagcaggtggacaggggtataaaggaggctttttttttgtataccttttatatttttgtttctgagccaggtaaacatattttccccctccgaaatctaattacatttgctcattattcacacattacaaatttgccaacttgctaaaatgtatctgtaaccccagcatcaatactagtggctcctctcgcgtcatttgaggacatctagtgaaaattttgagtcaccagaagcatgtttccggctgaggtcacacaaggggatgcagtttcagctcatactgcaaataagggtcctttctgcactgttcagtgctgtatgtgcttttgctgtttaaaatggccttcaagcacagtgccaaagtgctggcccctaagcacagggctctgatgagcttatagttacagtgtagttagctgaaagctcagtattaatgaatcaacaatatatattaaataaggcatctttaaacagaagcatgcataaagcaaggccatggacccagcagccgatgaaaatgctgttacgagaggtatgcaggaacctaaccttttcttccctaggaccaatgactcagtgtctgctaattcagtgccagtggtgacttagagaagtactgcaaataacaagaatctactctagctaagtaaagaacactcatccatgagctgtcaacaacctctgtaaaggtgctttacaaaatggcacaggttatccacagtgtgacaccatcacccttatatgaattctctgctcaaaccccagagaagcacaactgaatagctttgcacctgtaaaacccacacaagcaaacaagacagactgctgactgctgcgaaccacctacccaagttgcagagtagagccggaatagatgctgtgtacacagactgtgtgacgacctcacagatggcggttaagtggttcatcagtccacagggctccccatcaggggtgtgcacgggacaaaggaagccccaggactccggcagcagcctgcgcacagtggtggtccgcattttagcaaaatcagcccctctgtgcacacagcggaaatgggagagatagcgtatgaagttcagcttgtcagccacgacacaaagtccagaatcttgcaggaagccaagaccttaataaaacagacatcattgacaaatagaataaactgaaaaaaaaaaaaaaaagaaaaagcctctttttatttgaggctctgaaaagataataaaaccttagaacacatttgagatcatgcatgctcagttgctaaattgtgtctaactctttgggaccctgtggacagtagcctgccaagctcctctgtccataggatttcccaggtaagaatactggagtaggttgccatttctttgtcaggggatcttcccgactcaggcatcagcaggcaggttcttcatcactgagccacctgggaagcccacactagcgatcacagagtgggttatcacaaagtttattcagctgtggggaggggaagagtttacaaaggaaaaaaatacagtaaaaatccccagatttcacaaactattagccttaattgtttccccatctcttccacatgatctctatggagaaacataagtgagttacaaaacagcaaataattaaacgggattcacccgagagagagttgtataacacacaagcacttgttagcccttaaggaatttgcatcagtatcatctcctttaaaaaaaaaaagacttctggcccttcaataaccacttagtaaagttttccaggtgttctgatatgactggtttagggatgggtatgtctaaaaaccctctcagactaccacctagttaacctatcctcagaaatctaagcagtttctggttttctagaaggaggtacgggaaatgcatttgttcattaaaatcagatttaaactatacagacaacctgtctaaagcccttcagcccaatatacacctgtcaaaattcacaacctgaaatcggtctttaatgagtgagcagctcacttttaaaaagaacctctcccgggacttccctggcagtccaggggttaagactccaagcttccactgcagagggcacaggtttgacccctggtcagggaactaagaactgatgtgtcatgtggtgtggccaaaaaaccaaaccaaaacaaaacaaaaaaacatctctcatagcaatatgcaaactgacattaagcaaataatctgaaaattgtaacaaaatgaagcccatttatttaatttcacctgttttagaacgtagatatccagtagcaagaaggtattcaaatggttttgtaaggtctattcccagactaaaaatcttcatcaaattttcactgtttaaggacacattggtcttctgagacttcttgtctatagctattttaatagacactaaccaagcttccaatttttcctgcagtaagaaaaacagtttaatttttaggtgttttaattaaccacaaatttcatatttactcagtctatggaattttccaggcaagaatactagagtgggttgccacttccttctccaggggatcttccctacccagagattgaacctctgtctcgtgtacctcctgcattggcaggcgcattctttaccactgcatcacctgggaagccctaattattgataatgaatttggagatttttacttcagtcctctccatctttcctgtcattatgttatctcttaaattctttttttttttttttaaacaatcatcattttatttagcccttgatcctgtgggtcagttggggaaattttctggtctgggtcaacctaactgaactctgcattttcagtcagctggagggtcaactgatggctgggcaatctaggatagccaccctcacctgtctgcagttagcaagctattgagggagtttctgcagttctcttcctctgcactttttcccactactcctccctctcagaatttgattttgtgcaggtatctttcccccaccatcccaactccctatatgtagcatgagcctcagggaa

SEQ ID NO: 41749 - DNA, 1554 bp, Bovine  19866881543860
atgagaggataagaattttacttacattgtcccttattgtctatctatggcttaatcttagtaatctaaaagaacatattcctgggggactcccctggtggtccagtggttaacagcctgccttgcaatgtggggaacacgggtttgacccttggtcatggaactaagaccccacatgccacgaagcaactgacacttgatgcagccaaacaaatacttataaaaaggaatatactcctgagttcagtctcatacactattatcccagtctattcttcttcaaaggaaagcaaccagaaaaggtatttcccgtccttcacatacgctgaagccagggatttagcattctcccttgcaaagttgtcatgtcctttaaatttatttatttatttatatggccttactaggccttagctgtgtacacaggagttttagatgccgcgtataggatctagttccctgaccagggatcgaacctgggcaccctgtattgggagttcagagtcttagctactggaccaccaggggagtcccaaagtagccatcctttgaaaactctgctgcactctccactcctcctgcaaactgagcatttgtacaccaagtggccagctcacatttgatgtcaagatccaagaaaatctgatcttatcatgagataaaatgcagaccccaccccccaactccatccatggacaatggtgactactcctccaggtaactttaaatgatctaacaacttgactcttacctttcttggtcccctttgctgtctctttcttcacagattcttcaggacacagtaaggactgagtaacacttgccatctctttagcttgtatgtactgctgaagctccttagcgaaattatcctctggctcctgattgcagatgtcatcatcagtatatgcatcatagtccttacttcttgatttcctatgttgcaaattcttcggagatatagagcttctagagtgcctaaactaagtaaaaattaaattttcaaatttaaaaacctagcatgatttgaaacaatctggtcatgaaggagaaataaagactggctgtgaactgatcattgttggaagttgactgatgagaacacaagggtttcatatgctgttctttccacttgtatgtatatgaaattttccggaattaaaaaacaaaaacacatgcatccatacttaaaagatgctttgagggaagactcaatctgttcactgtgtgtactttactagattgaaagactaaagccccacaactgaattatttgctataaaagaactacagtaatatagtccacattttatttctccctttgcatggaccatcctttcacatggtttaattcactaacttgtcatcgagagcaagtaaactaaaatggcccaactggaaatccacctcaccagctaccaaagtctacttcctccctttaactcgaagcattgctggtggggggatgtagcagcaatgatgacaagaaactgccaagcagtccaagcagcagacaccttccagcacttggtgcagaaacattcccaagtatgg

SEQ ID NO: 41750 - DNA, 698 bp, Bovine  19866881612215
gagggtgggcttcatcccaaagactgaggtcctgggagaaggagggcgttctgccttcagacagcctttggatatgcaacaccagctcttcccaggtctccagcccccaacactgcaggagccaattccttaaatctctctctttctcactctctcactacaggagatgtgcatatattgagttggctcaaaaaattcattagggtttttccgtaagatgttatggaaaaatctgaatgaactttggggccaacccaatacaactggttctccttgattctgtttttcctggagaaccctaagataatggccttgggcaactgccccctaaaattcccccacttcccccagaagtgtcctttctttcctcttcagtgtggttgctgggtcaaggtcacagggatgagaaaagtcagggagttataacctgcttctgatttggtctaaagttaaaaaaaaaatctttcagagaaaaaaaacatgtgtgaattctacatgactcacatgcagagggcctcaagccttggctagcaggcacacgcttggcaagtgtgctctatcctttcatagacctaaagtcatcaaaacatctgtgttcccattaacaacatgctgacgtgacgcatagctgtggcttagaggaaaccaatgcaagacagcccatccgaggtccaagggggtcatctgcagctgcctga

SEQ ID NO: 41751 - DNA, 2194 bp, Bovine  19866880639464
gatctcacttcactcattttccattttccatcctcaccatgcattcctataagctgggactgccaagctgtttcatgccagggactttgccaccttgacttttacaagagactccaatcataaggcactgccctccagggtctccagagctccagcggccccatacagcagacccagcctgggcttcaaggttctgcccactcctgaaaccaagtgaaagagcctttcctcaatgctggacccagaggcccttcaaaagtgcccccagccaagctgggatagcacaggcgaaccctccagccttggcagagccagacccagtggaagacaggcaggtgggtccagcctagaaggacccagcagtgattcatgaaacctggaccccagccttcccagctcccaggccatctttacgggcattgaccacaaatgtaaaaacctcaaactaagccatttggcctccagcaaaggtcgctgtcttgggcttgtgtagttttgtctgagacaggaacaggctggaattcggaacccccaattcccaaccttctcacactacagtgtgcacaggaggcactagaactatctatgctgaaatgcagatccccagacctttccccaagagactcagtggggctggtgggagcaggaagctgggcagaagtccagtcttggtgattccgatataggtggccctaggaccactcataagaaaacacatctaaatctcctgagaactgagtccctgcccctcacctccatgcaaaaagcagacccctgccttccaccagcccatactaggccctttcttagggcctccaggctcagcccatgtgagcatagctgcccctctgttctgactgcctcattccctgattctaaacactgggcgtgcagctcactgctaggaccagacactgccttgtccccgcagtgctcagccccctgaacccagaaccttccccacccatgcctgcatactcctgcctgcttaggccgacccacccacaaggccctcctcccacccccacatccacagaacaaaacagactccacggaggagagaaacagtgggtggctgctctttgggcctgtgaatttctgcaagtattatgaatgacccaaggagaaagcacttgtaaaaatgatgacaaatagcttgacagtgttttcaattacccacaattacatctcaccttctgaaaatggattctccacattgctgtttttctcaggagcacccacctggcattctcacaggctgcctctgctggaatggcaaggggaggcgggcagctgcatgcagcaggcacccagtgcctagggagctctgccagtgccccggctgggccacagaggcaagtgggtcctcttgtctgactctgatttaaggagcaggaggccaaagaacaccaaaccacacggtgtcagtttgactcatacagtctgcaagcccagcctgggcttcccaagtggaaagaaaaggctctgggtgtttggggcacctcaccccaccattggcctgcatttcagaggcataaaaagggccatggcccacctcagcacaggcaagtaccagcaatgactcagtacttgagtgctggtgccaagtgtgaccactgtgcccccagtgctgtgggccttagtgcccactaggcaagggtgaagaacccaggggcaagagagccctgaacggacacccaccggatgcttctggtggtcttagcctccttccagcctccccagcagcaaggtgcccaggcccctctcagaccatgagggacacagccttttactattcctttcatagattctgactcctcttttccagctgctcccattgttattgagtaagtgtagtgggctggttctctccaaagtgccaggacccctgttaagagtcagcccagtcaagcatccgtaggactctcagggtgagagaggcaggtgtaggggcttcaggcccaaggaatgcacatgagttaggcagtcagccccccatagtcttctcagtaacaaaacaaggctgaccccagagaccaagtctcactctggcttttattccacatattgcattgaactcagacatgctcatggccacagctgctacgcaaaagctgtgctggggctggaaaatgcccctgccatccccagtcaatctctactctgctccagtccctactcccagccccaggcc

SEQ ID NO: 41752 - DNA, 1559 bp, Bovine  19866880660371
cacccagctctatggccacagcagacaggacgggcagcctgccaggactgtcgagagaaagagcagtcttgggtgggctgaaaaccaaaccccatcaaccctgcccagcctcatgccccacacagagactcacattgcctcctcgaccctcaccaccagctttctccagccaaagttaataattttaaagtaattaagtccagcaaaccgtaacagattaagtaaggactgctggtggctggcagagctaagcagcctcacctcagcctgagcccatgtgtggagggcagctgggtggggactggatcccaggtccagcctccagtggcctaaccatcggggggcagagataaacctctctgagcagccagctgcctaatgagactgtcaggggacttcttaacaagattaggcagaacccgggctctgccctacggtgtgtggaggatttctattcaattactggttcgggggcaagaggcagatactgcctgggaggagtggggagcctctgccgataaggtagcacccccctggcactcctagttctggcatggccagcccagactcccaggatccacagtggcctgggacagtgttcccaccggtcagaaggatgagcagagatggcccggagtgcagggcaaagccaggtctctggctgccaacccccggacacctgctcctcccttggaacctaggtgagctcccaggagtggccacaaatgggccacctggaggaaggggacagagatgcctgcacccctgcccacaacaggtgtgtggggataggaaagacccccctccttcctggggtgggaaacactgattctggggccaagaactctgcagacacccctgcacttgcagggggccacagagcagtgagttccacctcctggggatcaagccctgctccccttcaggacgtgggcgtaccaaggagttccgggtcacaccacacccccaggagccctcaggacccccagggagggctcagaccccaggacccctccctctcttcctatccccaagttcctgccctgccaggctggcccccactgttccctcactgccccaaatgccaccgcagctcagctcattctgccccatgcctgaaacacaaccttccctaactcaaagccttcctgcacggccaggcccacagcccatctccttcactgatgcccaccggtggacacaccacagagctcaaagcctggcttcttccttcctaaccctgcctgccccacagagctttcaaatcagccaagtctgaggtctcctggagctcagtgtgtagaaacagtggccccagggtgaccccagggcttccggtccaaccccagtcccgagtgccctgtgggcagagaagccccacactgagaggctgctccctcttctggagggcagctcagagaaggcacagggcacgtggtgttctgtgggcccagcctcctccctcttcctcaggtgacacccatgctctgcccctcaccctcagcttggggctgcaacagccccaggcctggctaatcagggcatcccctccactggca

SEQ ID NO: 41753 - DNA, 2555 bp, Bovine  19866881023198
gagggcctgacaaggacatgattaagaggagggaggcgtcggcagaaaggatttctccgaataaatgctccatgtgtctcatcctcagcggccacatttggctccttgtgaagtctggcccttccctactcccagctctgcagctggggtctcaaagggggtcccagctgctcatggacccctgatgtggaccccaaaagcatctactgagccccactgaactctgcctctgtctgcttctcccagcccagaaggcacggcaggtgccaggactgcagacagaggctcccaaaggcaggaggagaaatggacaggaaactaaccctgtgcttggctctgccctgtctacgatctccactaatctccagcgatcctgcaggctacatgaactatgggctcccttttacagatgagaaaactaaggctaagaggacaaaacgtcctgtcactgccaagagcgtgagaagcagagatcagaatccagcctggtacactcaaaagtcacactttgtcaacgatcagggtgagggtgttctcagccctgaaactcacaaatttaaatatggggtgcaggagcattttaaagtcactgaatggcattgtccccatttgtgatgattgattttatgtaccaacatgtctaggctatggcagccagtgtctacatgttgctgtaattgtatttttaaaaatgattaacatttaaatcagtagactttgaataaagccagttatccgctataatgctggtgggcctcatctaatcagttgaagatctaagagagaagatcaaggtcccccagagaagaaggaattttgcctacagactgccttcagatccaagactgcaacattaattctcccctgggtctccagcctgctgtcctgctctggagatctggacttgtcagcacccacaatcatgtgagtcaatctttaaacgaataaataactatctgttgctcttgcttttgacagacggatggattggatggaggaagggagagagccagagagagagaaataagcatgcctattggttctgtttatcaggacaactccgatgaataaaatattccctggagcaagcccttgtcaagatcctgttgctggtcaggagtatgggggtgctgagaggcaagcagagaagcaggacctatgcccgccctgagatatgtcccataaaacttcctttatttctcttaaagtgactggaagcaacattgttaaggattgatcttggctttatgaggtataaaactcaaaagaaagagctattagtttataaccatgtgattccaagacctcatccctgcccctcattccttcttgcccgaggaagcaacagaatatctaacatccacagcggaggtcccaaatgctgcaggagcagaagcggaagtgccaccagagctgggagcacttctgcacagagaaactcttcagttcagcctctctgtgcagacagaagggagtggagtctttattagtcccagtatcagctcccagaaatagtgggaattgggaattccagtgaggtcctcccccaaggccagaccactaagactctcccaggacttcagaaagaaggatcacacaatatcttggatcctttgagaaggaagacctgacactcccagtgagcactttctacactttgtctctaatcttcccaacaatccaataaagtaacactgtctgcatttacagtcgaggagcctgaggctcaagagttgtcacagccctctttccaaaggccttgcaacaagatggttgggagccaggattacaaatgagtgttttgacttcaaaaatgcaagttcctggttgcagcccaaatcctcccactgaccttgagaaggtgatcagtgctccaatttacctgactacacttagaaatgcccctttctacagatgtcttctggccatggaaaatgctgactctatctgacatgtgaaagcagagaagagaaactgccttcagggatcatccccaccaagactctttaagcaaatcttcagataaactgggctccctgccttttctccaaaataagaatggatgagtcctccaccccagttggtccggctgaggtctccctcctgcttggagtcccaggccccgggtggccccagctttggccttggctcccataagagctatggtgttaatggcacaatggcttgtctagggctgtcttgagcccagccaatgtagaagtctctttccaagggtatccttccccaatcactttctctcactaatttaaaattgttcctaatcacatttggctctctcttatctgtttcaaggagacatccaaatcccagggagaaacagagatgctatgtggaaactcccaaataaagagtcgtggtgacctgggatcagaaaccacaggatctctaagatggttaaaccccccatgtttggggtcaatttcctcagttctctccctcctgcccttgccacaagtctggcttccagaagccaactgtcaaagaagaagaaaaaaagccaccttctttgcaggtcagggtaggagagttttcat

SEQ ID NO: 41754 - DNA, 1676 bp, Bovine  19866881139915
tttgggctgggttttctgtagacatttatttacttttttctaatataacagaatctcgcagtactcccccgaagctaccttatatctaattttctgaatttctagatataaaataaatcattatacaaaaaaaatctgtatctacagtgtacggaacaaaaggagatttcaaagcccattaactcacagagatagtatgttactgggagaatatgggctgtataattaaaacaatttaaatccgattataagaagacagtgggctttactgcctgccaccatctcactaacggaaagaaaaacaatatcttgaggttttttttaagttactgtaaacttgtgaattaggacacgcatgtaccaccactccacggccttatgttactgatgagatgaaacactccttgcagagaaatattccttacagagaaggtaagccatcttcagctgagagatgctggctgagtataccgtctggtagcggaggcccccaagtcaggaaaggaagtggtccccgtgtcagccagcgtgagagtgggttctctctggagacgccaacctcacggttagtgatgcctggctctccctgcccactctctactgaactccggagtccagagtctgaggagggaaaataccagagggcctgggacagggagatggaccacatgactgttcacagcccagccaggaacagctcctactgtggaagtgtacgtttctttttgttggtcttggctgttctgggtctcattgtggccagtgggatctctgatctctgttgcggtgcgcagttcttcagctgcagtgtgcttgatcttcagctgtgggacctgagagcttttcgttgcagcatgtgggatctggttccctgaccaggggttgaacccgggcctcctgcactgagagctcagaatcttagcaactggaccaccagggaagtcccagaagtgaacatttctaaacacaatctgaactggagaagcagcccagggctgtaatgaagtaaatctatgatgatgagtgcccccacgtgctcatccactgggaagcaggatggagtcaacttccacattcctctccatcgctaggggctggagttgatgggctggttccattgcacatcagtgccatcaggaaactcttaaagaacacccatgcctcggccctaccctgacacgtgaaatcaaaatctctgggtggagcctaggccctgacccttgcctgaggtccctgaggatgcagacgggtctgcggtgttcacatacactttgcacaatggctggcacagggtcaaccatggcagagctggagatggggaacagagagtggtggcccctttgggttttcccactcctgtgagtctctcctctctcagctcaaggccccgattaggtgtatggctctgggccctgatttctcctctaagctctacagcctgcaccccatgctcacctcaggggttcaaatcccagagctggagtcacttctgccagaaccacagaaacgaagttctaagagccctgcagaccttgtcagacggtcagcaccctcctcctacatccagcaaccctggacaagtatcctgccttttcacatccctaagctttcactcaagctgttccaccaccttggagtgcctgcttccctttcaccacctaagtagccctcatccc

SEQ ID NO: 41755 - DNA, 959 bp, Bovine  19866881493771
acccgtgctgccctctgtctcctccttgccctgcatggcccccaggcctgacctgattgtgtggacaggcttcctgttttgctgatctgtttggcagggactcaggacctggatatttaagcagcttgtttattagaagcggctccctttctttctgtgtctgacgtctccctggctgcatctcttttgcgggtcattaagaatgtcacatttggtttaggcgagcgtgtcaccacggggtttctctgagagcatcacgtacagggcggtcctgaaggcgcctcccaggaactccctcgccggctgcctgagaccgactgagagatggcgtctggcccacgaggcgtcctgatggcgccagtgccctggctctgggggtgcagagcttcaccaggccactgagtctgacgatgctggtgctgggaatggtgcttgcaggagtgccctgggccctcacctggcctgagaggggcagaggtcaaggtctctgaccgccaggagagcccccttctcatctgtcctgatgcggcctcaccaaggagggaaaactgttgacagacggagtgttggggtggacagagcccatgtggggctggctgcaggcatgggcatggccgcaccgcacctccagccacccctctgctgtgtccctcttgtgtgtcaggacactggggcctgaggatgacagggctgtcccaagccagcctacagcttggggcagagccagacccgagtgaccacagtccccttccttctgctgagccacagtgcccaccagctccattctgccacctacctgcaggcccctcactgagactctgccctttcctcagagtctgagctgggattccaggacccccagtgtattttgctctgatatttgctatgggaatctggttgagctcctggaagcaaatctcacagatcccttctattactggatccccctggagttttaa

SEQ ID NO: 41756 - DNA, 1775 bp, Bovine  19866880995094
ataaaaaatgttagaaaattcccaataaatcagacctcccaagaatgagtatgactggagattccatgcttctaagccacttccagtatgtcacaggtaatatagaacatcgtttgctgtgaaatgtggccaaattgatggtttcatagaacattacttgttcagcaagttctgtggaggcatgcaggcattccaaatattccaataaaccacaatgaggaaacaccaaagagctgagagtgttgaataaaaggaaatagcctggggtagaatagacaggtggagcgtgtgcatacttttactttgatgcaaatttccaagtccacacaccatggctgtgggtaaagttttaatgcccacagcttggacaagttgcaaatgagtcatcataaattcagtaactagatcaccataaaccaagccagaccataaaatcactctgcagacagaatactgaagcccactcccctatcccaagcactcagaaagtcataaaggagataagcagacagtacagggaatctgagcactcacctggaaaagactgagtcatcaaaagcagacaatttaaagcaactcagaaaagaactacgaatctgaattgactgtaaatttaagtgactgctcaaactggagcacatggtgagatctttattgtcaacttacttttctcagctccccaggtaagagaggacagtggaagtgaccatccacttacaggacataaaaatgttgtattttgaatagcatgagtagtttgagtgaatttgttattcaaaagtacagtaagctgacttaaatccaggagtctctttgaaaatcctgctgttctttcatttactcctggtagctagcatataatgaccatcaaaattttaaaaaaaaaagcacatcagctgagagccatactaatcagaatccacaactatctatctgttttaaagtgagtaagagaaggatcttctggaacttaataaatgtaaagcaaaattgcagaaaggtaaaaatgaatgtaaaagaaagtcatgcaatattgcaaatatctttgaagaattaatgtgtcaggaaggtgagctatttggaatcctgaatagaagaacctaaaatcaaaaactgatcttgttgatacttcattatctagcagatatgagaattcctgtcacaagaaaagagttatctactttagattaaaaggtatatttattcttttattcaatacttgaatgcttacaataattgagcccctgtgctatgcatgaggcattcaaagatgaatagggcatgagccctgtctgtaaacagttcacaatcttctgggaataaaagatagtaaaacaaagtatcccataaaggatatgaaatgccatgatagagggtatagagagagacaggaaacatctggcttggaatggtcaaggaaggcttctctgaagaggtggcgacagtgacagtgttagtcatccagtcatgtctgactctttgtgatcctacggactgcagcctgctaggcttctctgccaatggaattacaaagaaagaatactggagtgggtagccattccctttctaggggatcttcccaactctgggcttgaacccaagtctcctgcattgcaggcagattctttactatctgagccaccaagaaagcccactctaaaggtgggtaaagtcataagcaattgaacagttattggcaataataactcttagcaagaagaatagcatgtatatatcaaaggacagaattgttggtttattaataatacatttaa

SEQ ID NO: 41757 - DNA, 1208 bp, Bovine  19866881375684
cagttaagaactattacatgagcctgttttaacaatttaaccctctatgtcaacataaaacaaatgcaacatctttgtattttagcatcacccatttccaccaactatccagtttcctgtgaacaacatgagatgctctttcaatgcctccagtaaaaatggaatcagattctctagatttagattatttctgtatatgtgtgaggtctcatactattgttaagcttcataaaatgttaaaagtgctatcaaagtctgcatttttattgacttcaattagatagtaatagttccacctaagacagtttttatcagaaactttctctttcagacactgcagagagggaaattcacatatctctataccccaggaggtgactgacagtaaatgatttaacacaagatagtcacatctaggatttaactgattttgcatgaagaagaatctaaccacaccaccaatgttttaaactttaaaacacgttctatgttgaaaactgactcttgttatttatagagaacataatgcagataaaaaatcttgaataaagggattatacatgtttgagtttgctactatgggaaataatttttcactccttggcttcttctcaaataatcgtgatgttggcagtatttatcaaccttataaaaatcacatactttaaaaatgtagtgcagtatcttacttgaatagtccctatttaaatgcaaatgttaggttccttctgtcataaaatgaatttttcaataaaaagaggtatgtattttttaatgctaacggcctgtttatctcattccatgacttggcattaatatccaagcacaggaggtttgtctttgggaggggataaaaaagatagatgtacaggaaaaaaatgcataaatctttgatggaggaatttactaacacaataccgaaaagtttttaaagagtaattttgaaaatggtctctcttagcaaacctaattctattttacaacaaaatataaaataaaatcttagtgactgcagatttctgtaggggaaaaatttgaagttctatgaatcttattacagtgtaaagaaatacagctggatttgtgagtgaaaattttaaattgtgtatttcttttatttttcttaatggcttacattttaaaaattactatttagtgttgaaaatgtattgaagaaatgttattgaatgcttcatattcacaaggca

SEQ ID NO: 41758 - DNA, 2536 bp, Bovine  19866881507939
aagaaaatgggagagtattcaagagccattctggaggtgtgatatcactagaaaactaaataatatttgaataggcagatggctattcattagtttcttgaaatgtgaatcaaattctccatcttgcatcaagggaaattcacatgacacttcccttggtttctgacttaactctttttaaaaataactattaattagctgtagccatcatggaattgtgcaaaaatagctttaataaaataaaaattgtgccttcattttaaacatcaaaattgtgggatgtttttgttcccctgactgaaaacaaagataattctctcataagtggagaacttgtattatattctgaaacatggaataacttttttttaatagcttagctataaaccattcaacattaggggtccatgatatgaaggccgacagtttgtaatgtagggtttaattaaattgggcactgctataattaaagggtttgagttgttaatgcatcactctggcaaacatttaatttttaacttgctgttgaaaccctcattaaaacaggatattagggcagctaaatagaatttgccagaggaaacatttggatttttagatgtaattcagcacgatacactgttgtgattgttttctttttaaataaaaaaatgaggattttggaagtcaagaatatgagagcagtttgagataagagagcaatttcatttaaaaaaaaaatgaaactaactttgagaagaataattgtacctgccagtgttggaaaccagtctatggtcatcccaaaccacactggcattttgggttctcacattgagtctgaagtttcagattatttcagtatcactttttctattttgacaaatatttatttcacttattccttttgcaactacaaaaggcaaaggggcagatgcaccattaatctgttgattcctgaagctaacattaatgaaaaatatctatattggtctatcgtaggctccagatgattctctcaagtagaagtggctttgctaaccagcattccagtgcagattcagtgattctttccctgattcttagatctgaatatggaatgcagaaactcagagaaaattctaagcaaccctagcttcagagttcagtctgtcatagagcaaaacaaaggttaaatgaagttgataaatgttacattctctgtctcatttgtaagattcaaatgatgcaatagtgtatttaaaaatatgaggaaacttgtacttaagaaatataggacactttgtttatttcaacgtttattaaacttaatttactacaaggcctctctcccttcccacagaccacgcactggcaaatgtcataatgaaaagaaggctgatttagcattaagggaccccaaattaattctgcttccattgtttgctaactgtgtgagcttagagaaattaattaaaatgcctggaagattcagtttctcatctctaaaataaagttgataattaccatagaaacttattgtagggattaaaagaatatatagattcagaaacacagtaaactttaaagtgtatttttaaaagttattttaatttctttgctcttacttactcagaaatttgtcaccatttccctgacactttattttctatcattctacgtattctactggacatcatttactatgcagaaggttattaggggataggaggagtgcccagagtatattaagatagagtgggtccacttcactaaatatttattccctggatatattcaggcagaacttgaagaatattgtacagaaaatactgttcaaggttaattaatctcaggttccttcttattcaaagacattgtgacttgaaaaaaagtattagagctcataatgtaaataagctattgacattatcatccaatgaataaatattggcaaagcatggaaagtgtattcaggtataatgaaaggggtacaaattcatattcttgtaagtttctactagctactaaatttaaaggaaagaatatctatctatagacagatgatagatgatggatagataaataaataagcagaaaaaagcaaagtctatgtcagacatgttacatgaattactgtttcaagaatttattcatggaataaatatggagttagtatgatatctacaaagatagaagagtataaagttttcttttgctttctttctttttgttttttaactaaaatgagggttttctatgatcaggttaaagacagaggtgggaagtaaagatttaacattaatatttaaagaacatgcatatctggagaatgggaggtaatagagactttacatgtaaagtacacttttcatgtaactgaaagaatacaaaactggaaataccccaaattcaaacaatttcttttgggaaccatgatttttgcatatattattcagaatttatctgttaatacaataccaaatatggttttaatgcaaaagaaagaaatttctttggaattgtaattgatttttacctactctttcagaatgaaatcctatatatgtgcttgatt

SEQ ID NO: 41759 - DNA, 2505 bp, Bovine  19866880368071
tttcactttcatgcactggagaaggcaatggcaacccactccagtacttttgcctggaaaatcccatggacggaggagcctggtgggctgcagtccatggggtcgctaggggtcagacacgacttgaaggtcttcactttcacttttcactttcatgctttggagaaggaaatggcaacctactccagtgtccttgcctggagaatcccagggacggtggagcctggtgggctgccatctctggggtcacacagagtctgacatgactgaagcgacttagcagcagcagcagcaggctgataggaaaataattttaattagtatgaggcatcaagaggcaacttgatgcatcgaaaagttgaattgactttttagccaggtttttatacagtagaaaaggacttcaccccaggtggagaatgagtgagcgagactattccagtggaaggtgtaacaggtagaaaaacataaaatgaaagagtattcacagactgtgcagggcagactgatgaaaggttagttggctggataataaatatctttccatacgttgctaagaaatttgaatctgatctaaattcaccaagacatgttctacatgctagtggaaaccagacacatgagttctcggattggctttactgtcaagtatacaaattctgacctatcctttaattctgcacatcctctaaattctgggatgtcaagatgacatgaggataaatatcaattaggagtaaaggttctcatataaaaggcaaagattacactagccagtaacaactgtttctaaatatttaaaaatatgtgtttttataaagatcacatttgcttttcctatgagaaaaacatttgttttccatctattatgagagtatagttttactctgacttattttcagtctatgatagacagcaaatgtttcttttaatgtgttatatccaaggagaaacatactacagaaaaaaattaatgatggatacaagttgaagatattttagataaagtcttctattatatgctgacttttccccaacatttgttcacatttatctttaaactgacaatcctgggtctcttcttaggagccatagtaaacgtaacagcatttgtgattgagaatggattataatgtaatgcaaatatatgtgcatttctgtgcacattcatttataggatattcattttctgtggattttgttatttatacaaacagcagctcctgttttatgtaggatcatgtcaatattttgacttttttagcagtaagaaagtgattgacaagataagcaggggactggagagtaatagctgaagtgtataatgttatgatattaatacagatgtgcaaagttatacatgaagtagaacaaaggtgtgtgtgtgtgtgcgtgtgtttgtgtctatgtaggcacagacattaatctcaggacaatagaaaaagtttcaggaacattaccatttagctggtatatatttatatctcttaatgttgagattctttaataaggcttagttaaatggttacacccatcagtttatgacagaaaagtatctgttattccagagtttgacacagaatctctcagagatttgtaagagctttcattaatcagtcagccttccacccaataaaggaagccctacacattaactctgacagatgttagagtcaaagcttcttcctgtgtttataaatcagtacatcatctaaaaatgtttacattacaaatgtgatttttcccccaaatgataactattatgtaggctctcttttaccaaaaattattttcattgacagaatagaacttgacctaaataattctcaacgctcaaagtttttaagctcaaaagtatttttagataaaagaggagggttggctagtttaaagccatttagtttaattcatgtatctcagttacagccatcaagtttaaagtaggttcacaggtctttccttgttaatgactagaaaactcacttttgcaggaaacattctaagtaaaaaactcacacttagttcctgaccctgctgccctctaatatagtattttatattggggttgtacataacacctatatctaataatctctttgctttaaagttcctactttgagatcatgtgtacaaggattttggcatttctttattttcacataagagcaaagctaacttcctctcagacataacagtttagagtatctttggcactgtctcagatcctctatagcaggggttggcaaactaggaccagcgaggttcaattccagcctgattgatatttttataaattaagttttattggaacacagccacacctattcgtttgtgaattgtctgtgattactttgcactacagtagcagaattgagtagtaacaatacaccatacagcgtgcatagccccaaatatttacattctgggccttcacagaaaaagtttgcaaactactattatgtagagtataaataatagaaaacaaaaccctacaaccttattacc

SEQ ID NO: 41760 - DNA, 2083 bp, Bovine  19866880518118
catacagctgggcagatgttaggaccagaagcaacccaccagacaacatggtaggacttgcaaatgtaatttcaaaacagcattgttgtggagtcaataaggtgttagttgctaagttgtgtccgactcttgtgaccccacggactgcagcccaccaggctcttcggtcactgggaatctcctgacaagaataatggagtgggttgccatttccttcgccaggggatcttccctgatccagggatcgaacccaagtctcctgcattgcagtcaataatagacacaattaaatgctcactgtaattggagattagctaaacaaattatgacaaatccattaaatagaaaactaggcataattaatagacgctagagtctatgtctgatagaaacattttccaaaacatattgaaaagttaaaaaaggtaaggaatattatgtacacctatttgtgtaaaagatatttggtatacttgcttgcatgtcaaatgttttgaagcattataaatatgctcttaataatgactgtcccccccaaagcagtgcaaggggatgtgggactgtggaagatttttccctttctatatttctgtactgtgttgtttttaaatgatgagcatgcactattttactttgtaaaagcttgagtcattttacaactttgctttattgcactagcccttaatttccattttactcatttttctgtatttgactaatttgcccatcaaaaatccccatatgaattctgtggcagcaaagatgaaaacaaattacttaggcataatcttattttacctctaaggtgcttgtaataatggaaataaaaggtgtgaaacatgttaatactgtatgtttaagattaaaatcttttagacagaaatctttatgattcctttaaataggtcccttctaagtcatgtgaaagtctttgttttgacagataattttctgttcatgtttaaaatctactccatttctaaggtttttttttctctccatctgtggaaaatgagtcactaaaaaagttaacctaacattttcttcttgaacacattgaaagattaataatctttacttttgttaagtaagaaagtcaatctaatttagataacctaggatcatatttctttctatagaattaacagaccaagtgatattctataattatgtctagaatgtcctctatgtttactaatacatgtctatatggttaaaactaaatttccaggaaaaaaatatgtatgttactctagaattttatctgagcccagtggtgattttcttaggatgccatttggaggggggaaaaaagagtttatctttcattatggtatttatgcatcttatagcttttatgcttactttgctctccctgatactgctagtagtaaaaccagattttattaataatagcattaagtgattacaacatgaacagtgttagcagtaatacttagtagtagaaactggtaaacaatgcagagtatataccactaagcactaaatgttttctatctaaatgattttaaaagtgagagagtgaaaagaaagtaacaggttctgagtatctacatgtactagacattctgtctggctcttttaaaaaatctaaggtctctcttttattttattgaaatataattgctttacaatgttgctatttctgctctacaacaacatgaatcagccatacatatattccctcccttttgggcctccctctcagtcccccatgccaccccacccctctaggggatcacagagcatcaagctgagctccctgtgctggcaacttcccactagctatctgttttatgcatggtaatatatacgggcttcccaggtgactcagtgataaagaatctgccttccaatgtaggagacacaggttagatccatgggtcaggaagatcttctggagaaggaaatggcaacccactgcagtagtcttgcttgggaaatcccatggacagggggaagcctggcagactgcagtccatggggttacaaaagtatcagacacaactgaggaaatgaacaactccagcgagtgtatatacgtcagcgcgactctctcaat

SEQ ID NO: 41761 - DNA, 2211 bp, Bovine  19866880621233
aaatggaaattcaggtctgagagtctgcaagcccagttacgagctctgtttttcctttgtggctttcagctttcagtacttaaataagtcagatagaatatacatttcctgtctaaatgcctaatttacagggttgctgtgaagaaaaaaataccctaacaaatgggaaggtgctttgtaagctaaaatacaatatacaaacataataatggttactctcctatatttgcttttcaagaaagtttcactaagtccctcactcatattaggataactactctctatcagggcttaccaggtggccctagaggtaaagaaactgcttgccagtgcaggagatgtaaaagatgggggtcaatccctgggtcaggaagaatctcttggacgagggaatggcaacctgctccagtattcctgcttggagaatcccagggacaaaggagcctggtgggctacagtccatggggtcacaaagagtcggacatgactgaagcgacttagcacacatgcacacagtctctgttcaggtctgggaataagcttttgatgactagcctcttccacatgacacaaggggataatatccccgtgggtgagttctgtggttgcaggtctggattctcgggtcacacttctgagttggggaagaattcgttcctagttctggtgtgctgctcccgttgcctgtgccctgagcatgctgattcagtcgtgtttgctgtagatttctatcctgggaaggacctccgttccctagggcaggcatccatgtactgtgtgtccagctcccggccccatctccttcatctagttatgattaataagaacaaaacgctatttgtaaccatacacatcctttatactgagactgaggaaagtataatttttcagtacatgacatattttcatgcatacacctatctctgtacaatcccaagaactgctgaggatacatttcatagtttctcctttactaacattatagttttctttgctaatgagtgaatagcttaaaagcatgaattcataattacattgttgtttatttcaatctatagcatacacagactataatttgctggaaaaactcttcactgttgcccttgtttattccatgttaaagttaaccatccatgtctataaattaagtttactacaaaaactcacatttaaaaaaaaaattatacaagaaacagctggattatcacaatcagcaaggaaatggactcaacagttggaactagtatgtctgggacactttgtcttcatggtaaacagtcactttatgcaaatcccacttggcttcacttaattaaaaagctgaaaaagaaagaaaattctttgctgaaaaaaaaaacacagtgtgctttttattctatattaacttagtacaggtaaatataaaataaaaatgtaacgtcatacacagttcattaattcacttcattgtaattttatatcagggcaatttctatgaactagatcctgtaatgggatcaggtgagactaggtcaggggtgaaagcagatgctgataagaacttgaagttgtgttggttaagtttggttaacttctgtgagtcattctcaacgttagcaagactcctagttaaattggcatttaaactgacaacacaggggaagaaagggaatgagctgaaacatacacttggattgggtcatttcaatattttagacaatatattttttctggttatttaatcaatatgcatttacttaaatacttttaagaattttataatttcactatattgaagtcaaaaataattataaatcataataaaagtatcatcaggttctgatgaaatgatacaaatagacgtttatacatatagggaaaaaaagcaaaataactctttttgcctttcttgatttccctaggcaacacttttatctatgaaaagaaatgtaagttagtaatatcatggcaatttgaataacatcattaagcttttgttggctatttgtacctttctgctaacgtgcagcaactttgctttttatagtcttggcaacgtaactttaggacaaccagaaatgaaccaattgttaactaatattaaaacattaatattaaaaatattaatggttactatagttgaaaaaccatgtagttggggaaattgttcaaactgataagtttaatacttggacactcaaattacaatatcctaggcatatgttacttcgt

SEQ ID NO: 41762 - DNA, 1525 bp, Bovine  19866880891993
ttagttgaaagggtactaacttcttttatttgcttcaggtatgtatgggttactcctgtacataattgtatagttgatactttgtgactaactcaaacatttgtctgctttctgcttttccattacattgaacagaaggtttgtttgggtttatggagaaacccaaatgaaccttttggccaaccgtgtacttagactgtaaaaggaagcctttaaatatcaattgatgtttatggtagcagaatgaaagctcaattaacatgggtaagactgtgttcctctgcagtaacttaatagccctaaatttgtcaatttctggcatgtttatcaccagaaaagcttaaaagtgtatattactagactcaggaaaatggttttatttgttgggtttatatttggtttcttgtatctcttctttctaatggttcactaaattagatctgaaatatctgggattgctttcttcagtttcttagtaaagagatacataaaatcttggttattgaagaacttttgatacttactcctggtcatttctactgaaatgatctgagttgtttatcaataaaaatgaatgtagtggtaactgttcaagttggaatatattgaaatgtcttcactttctcagttacctgcctagaaagtaaagattaaattgaagtgaaatgaacaaaacttcaaagagagcagagtcagtccacagataggaaggttgtataggaacagcaaagtattatataggaacaggttagtatttcaaataacacagaaatttataaagtagaatacatatacccctataatcttctcctccagaaataaagcactatcaatttgctatatatcctttaagatatttagcatgtgcagtgtgtcagcagtaaagaatctacctgcaatgtaggagacctgggtttgatccctgggtggggaaaaattccctggagaagggagtggcaacccgctccagtattcttgcctgaagaatcccatggacagaggagccaggtggcctacagaccgtggggttgcaaagagtcggacacaactgagagtcatgactaacacctcactttacttcacagtgtataaaataagttaatgagtaagtaggcacacatgtttatttttaaaatatgaaatggttctgtacatagtgttgtgataagtaatccttttggatttacttaaaggtaagttgtgactgtccttttaggtaagtgtctcatcttgttaatgactgtgatagtgtttcatttcatactgttttatgatctaactaataccctttttatggacacacatcttatctccaagtataacatgcatatgtgaaatggaaaaaatgttttgttttcataatatttttaccaaatgaatattaccactaaacatatgggaccttatgtacacactccttccaagttttaatgatcaactttcatcttgggctgctgtctcttatcataataacaaatgtttttgaaagattaattctcctgccacaaggggatggagaaaggtg

SEQ ID NO: 41763 - DNA, 3486 bp, Bovine  19866881287845
tacacattttaataagatactgaatcttgttggcaaggtgactttgtttccttgttatgctgggaaaacgtgaatggaagaattacagaatgtcattttttatttagcatccttctatagctcttttcttttttcaagagaaaagctagattaaaatacaaaatcagttaaaatgatgcaatttaagcaactctgtttttcctgacttgcttatttatctgaatgtgttcagcaatattttagatggaaaatattatcagaaatagaatatctgcctttagggaaatacattgatctacttagcacgaaaaataaatggtaaattgaatgctcagaaccataatttatctacagtttgcaaaggatcaaaaatcaagacgtgaagttgtacctaatttgttctcaacttgctggctgtggggaactggatgagggacagcatcttgggtattggtggtggtggtgtttagttaagcagggtccaactctcttgaggtcccatggactgtagtccaccaggctcctctgtccatgggatttcccaggcaagaatactggagtaggttgccatttccttcttggtgatcatcccaacccagagattgaacttgtgtctcctgtgttggcaggcagattctttactgctgagccaccagggaagcatcttggatattaaaatgcctcaatggaccaaagtcgctctaaaaaattagctatttaagggcaaaaaggcaagccaaccagtaacaaactctaataaaaactcttgtctttcaacaggaaagaagatgttcaggacaaacagtttcaaatctgttttggaaacacagaatgctatattcctgttttagagattcagaaagtatactcacagattaaaagctataatttatctgtttttgtttttctgtgggacagttttccagatttgctcattatatcctttttggaatatcatctatagttttgtcaaacatgaatgtttcaaaagaacttgcaaactctgtattggactttttggtgactttacgtgcattatgtagaaccagctatatgtgcttaaatcacacacatttatacaaagaatacctgctacacttggaagttctccaaagcttggtttcagctgtttctttaagtcatatcttaaaattgaaaggatttattcatacaaaaggaaaacaccctacttttcaatacagttactgagacctccttactgcttagttagggaagaccttctgcttgggtttgtgattattcgtgaacgtgccttaaggtatattgcttaaattagattttctggtggtttcttgaccatgtaatttagtttgcgtttgaagatttaaaatcaacaaatgattggaagttaaaaaaatagacctcaatattcatactgcacagctatctttaaatacaatagacatgcttatgagttgatatcacccatggaagtgaagcttctccaactgataccagaaagctgttttttattttcttactataaagggtaaggcagtgtaaacacagataataaagcttgattaaaaaaggatgcttaaatatgtatggaatagtcttgcaaaaacaaaatatattaattggtctcaggcatatgccttaatcaaggatattatagatattaataagcatgcacttaaaaaataatactgacaaatctggtattgttaatattaattttgtagaatgctttaattttcattggtaatgctaagtaacagaaaatttgaacagatgcctcattgtattcttactaggagaaaattcaactttcctggagaattagaaaaggagaattattaagtgttttctacactatgagatttcatgaatctggttaagaatctagtaagttcttttcctgcccagagcaaatgtatacttcaaccactaatctctttggatatggtctgattttatctttgttgttcaggctggtgtgttttgctgtggctgttgttaaaacaaatggacatttactcataattaaagacaaaagagtgaaaaaccattctgctgtgattatgttgcagattttttttccgtctacaagtgagactctgcaaatggttctgattgcagcatttgggaaaggactgcactggaattggtccagaaaagagtgcctaaaaagagctgatgggaagagcagcaatataaggagagtctaaaataaataggctttttcagcctgaaataaacaaagctgagaagggatttcattaatggctataaaatcaggacgtgtatagattagagaggacatggcttttgaccaaattcattgacattttaaaagaataattttttgacttattaaaagaagtacttatttatgaaatggctaatattcatattacattaataatcccaggaaattgacttgatagaaacatgtacgcaaaaagaattttggaaagaaaacgtgaatggcacatcgtgagctgattattaggaatttggaatattgtgaattctctctctctctctttttttttggtcacaggtttataaaggactttgcaatagatccgggttcaatccctggattgggaagatcccctagagaagggaacaactccccataggtaatttggcaaacactctcaaaaaaagaaagaaagaaagaaatccgtgattgttaccttttgctgatttccatagtgtaaacacttaccatgattgatttcaagctaccaagaatttagcaaccagtgtcccagatttgtgaatatttaatagttgactcccacagatcatcaaatataccactcacatcatatcatatttacaatctataaacaaagtcactctcagagagaggactattatgtttatactgttagcctgagagaccaatggggaagaaacctacaatactcccataaattaatgtaactggattaaattgataatttaaaaatataatttcacatgtcttctctccagtttatatgcattcttcctttggtttccgtttattcattcatacattcactcggtctcatttctttactacctggcatgtgatgtgagctctaagaaaaggaagacttggctagagaggagactggggtgcagacctccatagtctgatggtacatgtctacttgggtaatgcagagcagtgtgctgggtagatagatgttccatacacggtatctccaggcaagtgaaagaggagggctctgtgggtatgaggaccacagggactctggtgtctcctttcccaaatataattgctcttgagtctctttctttctttaactgcacccagtgtgcatggttcttcctaaataaatggctgtgttgaaagaaactgtatgaaaaaaaataatatcaagacaatggcttgtaattaactgagttaacagcttcatgtaagcaaaatgaacaatttccaggggcttttatgtacttcccccaatgtgcgaaagaattagattatacattcattccagaaag

SEQ ID NO: 41764 - DNA, 1652 bp, Bovine  19866881327581
gaagcagcaagagtctgggctcactgagatcattcctttcacgtgcatctcagcaattctggaccagtatcgtgttttctcacatcttcagctcccttgggactcatggtagggagtggctggtctaatagctgttgggtggttggtattcttctccttcctgagtgctcttcgggctcaccagctcacattggagggctagagttgctgatgactgtgacatccttgtttattgatatggcaggaaatactccatttctccacaccttaactattttcctggagaaggcagtggcaccccactccagtactcttgcctggaaaatcccatgggtggagaagcctggtaggctgcagtccatggggtcgagaacagtcggacatgactgagcagcttcgctttcacttttcactttcatgcactggagaaggaaatggcaacccactccagtgttcttgcctggagaatcccagggatgggggagccggtggacggcagtctatggggtctcacggagtcagacataactgaagtgacttagcagcagtagcagaactgctttcccagatgttccaagaaattagaaaataacactgaacatttcttctatggcaatactcaaccatcagccaagagattgaagaaatcttatttgaagacctacccctaagagacctctttagtggtccaagcctaaaaatactgtgtaggagttcaccaagaaaatgaacgtgacttgctttagaaattatgtaagaggatgcaaatgtttactagaccaagacatccgagagacagatttttttcagtgactttagcccctttgctaatattgaactgcacttgctaagtgggcagtccatttcactctgaaggaagacagcccaccagaaaaaatccctcctggctattttgtacgcctaatacaatgctctctgttttcttgacatttgcttttgacacctcaaccagtttcttgtcttgtttaggatccctgtggagtcaatctgaaggagagaaggacgcttccagtggttaggtggtggccaataaggatgacctacattcctgtttacgatggttgggcttatcaacctggagcgagtctgcgtaggtcattgcaaagagtgtaagacacaggacttgtctacaagaaaggaattttcaagaggctttgggaatagtttctcctactgaaatgaaggagctctctctgaaggaaagaaaagaaaaagctttagaaataaagcctaaaactccctcctgtgtgtttagattcttaagtctgcaggtaaacaagccagcggggagtgtctacacacgaggtgaggagggaggcaagcaggggaagattactactcattatgccacttgacattaattaaagatcttttaaaataaagaaggtatcagattacttttccactgaagtaatatttacattaattatgccaaatgctgaaactgtttgctatatccaaatcatccacactggtaatcacttcatgtgttttggagaccaacaggctaggtgagtggaggatgctagcctgctttactctgcgcatgtcaaattcaaaagcccttcttgagagagctagtcttttcgtttccacatccgctacggctcctgttcctttctcccctgtgg

SEQ ID NO: 41765 - DNA, 787 bp, Bovine  19866881493981
cacagggatttggggaaaataatgagattatataactgttttaaaaaaaaaaaaaaaaggagagttgaacctctcaagagaaagacagccagaccacattaaatctgacattccagcaaatggtaggtaggaacctccagacccttctgacatagtactttgccacattcttgactgaaaaaggaggattgtatgttgggagggggtgtttagaagcccttctaaattcctcctacaaacactttttggatagttatttctcactcatagaataaaatcattgaaaacaatgacaggaaactctgctcttgccatttttataaacaaaagaatcttacaagaaatgacaactgatgtgaaaagagctttaggtcatctagtttatccactaacagcatgcaagtctgatgcaattatattctattcttaggttcttttcccaaaatacctgacttttttgtagggataaatatttccaactgatcctgtagactcctgtcctccagcatatttttctactctgttttaaacaatacaaaacattttcccttatctaatgctttcaatgctctttgtgaagagcgtctttctgaggagggcaccgttctgatatttacggaagagtgtttatttacatatgagttggattcccagtcttcagaccaccctaagtctcaatttggaagttaatgctgttctgtatcagatacagtaaaataaacaaacctttttaaaggcttcagttttagacttttccaccttcttagtatcaccatggtagctcagt

SEQ ID NO: 41766 - DNA, 1274 bp, Bovine  19866881557832
tttctctagtgatatgtatttccacatattagactttgatgctttcgccttgtaagagctgtttcctgatattggatcttaatacacaacaacagaaacaaaatcaatctgaccagaagaagtcgattgctactgctgattcccctttattccagattgagagtgtctgaaaatagaacccacttcccaggcttaagacggaaaacatagttcaaataataccttctcattctcccaagaattaatgcttgctaggttcaactttacccttaagccctagtatttgttaaggaaggtcactatttaccatttagagagatgaatagaattacatcgtcacaaaagatagattgctgttgctcaaatgttccttttgttttataaagagttaggaggggtgtgtaccttcagggagaacaggtccaagctccccggaactgtttggccagtccccttctgcctcccctacctgccttcacagtgatcaggacatgaacagacgatggctgcagggacctttgaaaaccagccaagagtgtgtgggagaaaattctggtttcaaagaacttagtctaaactaactccacaaaatctaaataaatcagacactaaactcgatggtaacttttacattagaatacaaacattctttcattcttgtgagagaggcaaatgcttacctaggaattaaattttaaagctggttaaaagaaaatccagtcttacccaggctgccaattcaagaactggtagtaattttcactgacgtttctactgggtgaaaggtttatttctctcagaagcctgttatttaattagtctgatttctgagagtgccgagaatgctgcaggtactcaggagatgctcagagaccaacatcctcatcattttaaagcaaacaggtaagctggaaagtcagtctcctactaaagagcgtgaggggcttgagagaagttattattggtgtttctacaattttcagccatttggggagacaagatgactctcactggcaggtgttggattattaggaaaattaagcagatggcattggcaaaccatgcctccccttttcctcagctgccaggaatgcctaccctcaggcttagctccacatatgtttgtttaataaagctcctgccattgcaaggaaacagaacctgcatcattcaagctcactcagaactatgaataggtagcatcatccacattgtcccagagtgttaggcaaacacctctctgtttcctatgtcactcgtacccaccaccacag

SEQ ID NO: 41767 - DNA, 805 bp, Bovine  19866881627231
gaatgacagctcaaggctgcagaatctgtacaattaatgtctttgtgaaaatgttcaagagtacagtttagaaggaaaaggaaaaatttctgcaggtatcttggtactcaatacaaatactgtctatattcacagatttcttgctaaaatggttgccattctcaagacaaggattagcatcaatgctaatagaaaacagtcaaaaatagagttggttctgtaactacataatatggaaatttggagtgaagatggcatacatttcaaatttgagagatatccaagtgtaaatgcctcttatttatgctatatgaaaataccctttcaaggggaattctatgcaactggactgatcagcagtgtatgcatttaaaactgatgcacttataattattataagtgtttcatatacaaaatcaatgtctttgattatggtatcaaattcttaatgatttcaaatctgctttctcatcttgttctgtatacttctaaagatttatttgcttgaagcttggaaaaagaaggcagaaacttttacttaccaggttatactgactagaaatgctgaggcagtgaaaacagcccttaaatatcatgaccagttcgttgtccagtgagcttcatgacagcatagttttgggactatcagggtaagaaaagttcatacaaataaaattaaaaatatattgctatgttttaatattttggaaaacaatgctagttttctgccaaaagttatgtctagcactgtctaaatattctaggtaataagttgaatatttttgggtgtctcattagaataatt

SEQ ID NO: 41768 - DNA, 616 bp, Bovine  19866881855740
tattaaagccataaatggctcaggttgagatattctccaagggtctttagacaggaatggaccagatctgcttattacttgactttccaaatgtcgccaaaaatatcctttggtaatcaatgcatgactagcattctagaacctattaagaacaaagaatttggaatctgctctgctctaggcttcattcctagtggaaactctgttaattaatttgctaagaaaccttttatataagggacctatttaacatattcatttctccttgaaattcagctcaagtaagaagtttgcccttctagataaaccaaatttctctgattagtcatgaaagtgaaagaaagtgaagtcgctcagtcgtgtccgactctttgcaaccccatggacagtagcctgcaccaagctcctccatccatgggattttctaggcaagagtactggagtgggttgccatttctttttccagggaatcttcctgacccagggatggaacccaggtctcccgcattgtagacagacgctttaccatctgagccaccagggaagtcctttagattagtcatgagttctgtacaattcaacatactttcactagttctttttcttttgatgcaat

SEQ ID NO: 41769 - DNA, 2412 bp, Bovine  19866880379248
ttttcttgtggatattatactaaaaggtaaaatctagcttccttcaatgtactcttgtccttaacatcttacgaggtaaactcacgccttttactgtttgacattttactatcattctgtccacccaggtgaaatgtccatgtccataaactgtgtaccgagaatatgtagatgtatcagttgaatgagcttttctgtgttagtgctggatggttcttcatttcacagtgaatattgaaagaactgtgttctctaaggcatattggttttagtttataatttcgtttttaacactaatgcttaggaaggactatttcccaattttcctcgattatcaatgaagatctttttctttaaattaggaaaggattcagctccttgacaatagactacagatggcatcttcattgttaataggaagtgtggtattcactatagttaacagtttcaaaaattcattcaattattttatgtaaatacatttgcttgaaaatacagctgttaccttgggatctgtgtctcatatggttacacagatgctgagcactcataggcagcaaaagataagtgtgtccttggggtgattgcttagtcctttgtcttattttccatcatagaaggagggagccgctttgcccagactctgcaaagccctctaacaatttgcaaggggagaatctcaatataatttaaaattccagatttcttccataattatagtggctgccttctgtttaattttatgtgaaggtctgtcagctgactaggttttgcagtttcagttgttcacgaaactataattttctctgagagtaggttcacctcctaatcaaatgggtgatatcctctgagtgttggctttaactcctaatacattttgattagcctccatttgacaaggagaaaagtggcccaggagataaactgccctgtcggttcatcggtttcattagtctgtcagcatgtgctgattatcctatcaagtttatcaacagccttgaatatgtttcctaattctcatatttgcatattattggtgccctttagggatcagtgatggattttaatgtctggctagatttagcctgcaagtactcatttttctcatggctcattcatttaccccttgaagatcattagcgccaagcacttgtatgtgtatacgcaagtattttttttcttttatttttagaggttaggagaaataaaggaatatgtgtgaaaaaatacagttatattttaattatattatttgtttaataacgcgattcattgcagctgcttaaagaaaacacacactctggtccttcgcatttccccttcccttgaacattttatgaaaaacatcactccctgctgcatgctagtagctgacttaccctgaacatcaaaatgagcctagtttttgaatttgtatattaatagaaaataacaagattgattagcttgctatcccaacttaaaatgttccatgttttatcataagacttttaatttttattgtggtagtttataagtaaaattaaaaatctacttgcatagacattttcattattctctttgatttcatagcatcaagatgattaagtcacaataattgaggattgtgtcccatctaaaattgagtaaatttataagcatgtaaaaatcatgttttaaaagatactgtacatcatttttataaacaaaaattaaacttttacttagacagcagttataattagtaagtatgaaaatacatgaattataaagaggccaaatcataaaaaattgctcctagccagttgtgcaacttcatttctgtatttcttcttcagaggataagggttggattcagagaccccaaggttcaacttacggctttagcactttgtagctgagtgaagttggacattacttaactgaagtctcagtttccccatccataaggtgcctgtaatggtagtgtctgtttgaggactgattgagataatgaaggtaaagaatattggaccaaatgcccaacttagtcagtggtttgtaatattatcttcctttgtaatcattatcatttctgtgggctttaatctccagaagtcactaattgtattctctggcggttctttctgtgttaacaatgtaaatctgatttctatatagatacaattttgagatagtgatggctctggagtcaccaacatggattctatttagttctgtcctatctataagtgctgtattttctctggaagtccatttttccttgtctttcaacaaccacagtcaaaatcctactgaaacagcctacttagtgtccaattagtttaattccattaatacactattccctctaaattgaaatcatcatatttagagttttttctccttttcccgtcattacatattttccccctagacttagtcaaaattatt

SEQ ID NO: 41770 - DNA, 735 bp, Bovine  19866880452511
aaaaattgaagaataaacttaaggattccctattagtcaatgatccatcatagttgatttttcttctattaccaagatataattagcccattttctcaagttcttatttccctggagaattagcatacacaacttgtaaatatttccctttgtaatgcattattcaggtatcatgttcataatgattatggttcattcaaatcttgatttaagaacacaataggtaggctggaaatgacttgagatggaaatatggggctgcccaaaagagaaagaaggatccttgcaaaagcaagaatccaagccaaaaaaaaaagaacccaagctgtaacagctggaacaaaagaggagcagctaaaagggagactataacgtattgaatactttgaacttcgtgggagagaacagggcacccatgttggaagtcacgctccccttgacgatagctcaaagtgatcaatgtgattagagcacagccaataagatgttaggttcagacgtgaacccctgccagaggggaactatgtctcaattgatcacacagcatcaagccaaaccctgaaatctgaaatgtgaattgggagggtaacttcaatataaacattgattttatagatatgatttcaacagtacacattttcctgttacttctataaagtatttcgccgatatcaaaatacctcccagccttacataatgtaagcactgcttggacacgttcacaaatcaccagat

SEQ ID NO: 41771 - DNA, 4191 bp, Bovine  19866880484397
caggcagatttgagcattttttccgggtatttttactttacattaaaaactggaagatatttatattcaatgattataaaaacagttgtttttattatgattgtggcatgcattgctctttgaaaaattagctaataagatgaaataatctcttaatattcaaattttaactacttaacattcacacaagcaatcatacttcagggttagcataccactatttctgttacactgatcctctgaacagtcaccaaaatcaacaagggctctcactttttacttctacctttagttgtaatttaccttagaactttaatacatgtctttagtcttatcaacaccaagttctatgtaaagatcttgcaaaaccaaaacattgaaaaatgctttaactatcatgataaattctaaattttgcttcctccaattctcagtaacttgtttgaaatcagaatgctatcacaaaaaggggttacatgttgaaatcttgccagttatataagccagatcggctgcaaaagaaaataaatacaggagtccctagtgtagctgataattgttttccttcagattacagccctatttttaggcttctatatatatgaactctttcagtcctcctaacaaagattatcatcccgttagtacttgacaaggaaactgtgccttagagaaagggatacttaaaagctaacagagataaaaattgtgtctgttggttctgaagtccttgttttaaccactatgaaacacctggacttcagatatgttccaaaaacagtgttcacatagatgtaagttaaataagtgtcattttaaaatatgaggaactgttatgttaaaatttctaatctcaatgaagaccgtaaaaaagaagcaagcaagcagaaggagaaggaaaaaagggccatgtaagtgcatgaaacttaagataaatgtgaatgtgttttgttttgttaatgctttctcgctctatccattaacaaacattgtaaggggttcaactcttgtagcctgggtttatactgatttcatgtcacttcacatgatccagggaaatcacagcacttataagcctacaaggatttatatttcctaaggtaattataccttggattattacagaaagaaacataatgttgagtgggtaaaaaaggtctggttaaaatgttaagtggaaaaaatagaaataatttaaagattatgattcatatgataccagaatacatatactacatacttttatgtaattctaattatagcaactttataatatgcaattatctctcttattcctctatctttggttacttcagatacacctgaaaatcagtatatttctaataagggaaaaagtattaaaaatgaaaaaataaaatttagtactccaatgatttgtttacattgtcttcatagcactgttaattagtataacatatatgtgcatattgtaatatccatatatacagttcagggcaggttttttggttttaacaaatctaggattattccttcgcattttaccatgtgcagtctctattctgactttgactacaagccacccccacatccacagttcagtgtctgctataagaactctcaaggatcacagctgtgtgctggcaaaagggcttgcataactcaatgaagctaagagccatgctgtgcagagccccccaaaactgatgggtcgcagtgaaaagttctgaaaaaacatggtccactgagggaggaaatgggaacccctctagtattcttgccttgggaccccgtaaacagtgaggaaaggcaaaaagatacaacactggaagataagccccttcccagatcagaatttgagcaaactccaggagacagtgaaggacagagaagcctggcatgctacagtctgtggggttccaaaaagttggacaggactgagctattgaacaacaggtcagaaggtgttctatatgctactggggaagagctggaacaatgacaaatagctccaggaagaacaaagcagtggagtcaaagcagaaataatgctcagttgtgggtgtgtctggtggtgaaagtaaagtccagtgctgtaaagaataatattgcatagaaacctggaatgttaggtccatgaatcaaggtaaattggatatggtcaagcaggagatggcaagagtgaatatcaacatgttaggaatcagtgaactacaatggacaggaatgggtgaattaaatggacaggaatgggtgaatttaatttagctgactattatatttactacggtggataagactccctcagaataaatggagtagctcttacactctacaaaagggtccagaatgcagtactggggtgcagcctcaaaaacaacagaatgatcctgattcgtttccaaggcaaaccattcaacctcagtaatctgagtctatgccccagccactgatgctgaggaaggtgaaattgaccagttctacgaagacacataacatctttttagaattaacaccaaatagagatgtccttttcatcataggggcttgggatgcaaaagtaggaagtctagagatacccagaatggcaggcaagtttgaccctggagcacaaaatgaagcagagcaaaggctaatagagttttatcaagagaatgtgttggtcaaagcaaacaaccttttccaagaacccaagagacaactatacaaaaggacatcaccagattgtcaatacagaaatcagattattttttgcagccgaagatagagaagctctatacagtcagcaaaaacaaatcctggaggtgactgtggctcagatcatgagttccttactgcaaaattcaggctaaaattgaagaaagtaggaaaaaccactaccctcgtggatcagctggtaaagaatccaccttcaatgtgggagacctgggtttgatccctggcttgggacgatccccctggagaaaggaatggctaccccacaccagtattctggcctggagaattccatgaactatatagtccaggagatcacaaagagttggacacaactgagtgactttcacttctttcaggaaaaaccactaggccactgaagtatgatctaaatcaaatcccttgtgatcatacagtagagatgacaaatagattcaagggattagatctggtagatcgagtgactgaagaactatggacagaggtttgtaactacaggaggcagtgatcaaaaccatccccaagaaaataaatgcaagaagacaaagtggttgtttgaggaggctttatgaatagctgaggaaggaagagaaggaacaaagggaaagacatacccaactgaatgcagagttccaagaatagcaagaaaagataagaaggccttcttaaatgaacaatgcaaagaaatagaggaaaacaatagaatatgaaagactagcgatctctcaaataaaactggagtgatcaagagaacattttatacaaggatgggcatgataaaagaaacaataagaaacaaagagaagcagaagagattaagaagaagcggcaaggaaaaacagaagaactatataaaaaaggtcctaaagacccagataataatgatggtgtgatcactcacctcgagtcagacatcccggagtgtgaagtcaagtgggccttaggaagcattattatgaacaaagctagtggagaagatggaattccagctgagctatttgaaatcctaacagatgatgctgttaaagtgctgcactcactgtctagaaatttggaaaactcagtagtggccacaggactggaaaaggtccattttcactccaataccaaaggacaataccaaagaatattcaaactaccatccatacaactgtgctcatttcatgtgctagcaaggttatgctcaaaattcttcaaactggtttagctgtacatgaaccaagaacttctagatgtacaagctgggttttgaagaagcagaggaaccagagatcagattcactggatcatggataaagcaagggaattccagaaaaacagctacctctgctttattgactatgctaaagcctttgactgtttggatcacaacaaattgtggaaaatttttaaagagatgggaataccagaccaccttacctgtctcctgagatacctctatgtggttcaagaagcaatagttagaaccagacatggaataactgactggttccaagt

SEQ ID NO: 41772 - DNA, 1010 bp, Bovine  19866880514974
agcctcttgatgaaagtgaaagaggagagtgaaaaagttagcttaaagctcaacattcagaaaacgaagatcatggcatctggtcccatcacttcatggcaaatagatgggtaaacaatggaaacagtgacagacttcattaatttgggctccaaaatcactgcagatggtgactgcaaccatgaaattaaaagatgcttactccttggaagaaaagttatgaccaatttagacagtatattcaaaagcagagacattactttgccaacaaaggtccatcttgtcaaagctatgatttttccagtagtcatgtatgtacatgtgagttggactataaagaaagctgagggccaaataattgatgcttttgaactgtggtgttggagaagactcctgagagttccttggactgcaagatatccaaccagtccatcctaaaggaaatcagtcctgaatattcattggaaggactgatgttgaagttgaaactccaatactttggccacctgatacaaagaactgaaaagaccctgatactgggaaagattgaaggtgggaagagaagggaacgacagaggatgagatagttggatggcatcatcaacccaatgaacatgagtttgagtaaactctgggagttggtgatggacagggaggcccagcatgctgcagtccatggggtcgcaaagagtcagatacgactctgcaactgaactgaactgactgaagagtaacaattttttatttctataattctatctctacccactctagataaattgataccttctgtgataaattgataccttctcacaagggcttgtaaatgtagagcttcagactaagacatgtcattctgccattctggtcacttctctgattctctcaatgatgtctcctgtccctcagaagccctagtgtttgattctatctgaggagtttgtaatttcttcaattctgtctcctcacaacaaaaacatgaagcgagggaccagtgttacagcccttgg

SEQ ID NO: 41773 - DNA, 2525 bp, Bovine  19866880526502
atttaattgttattctgcctttcaaataacataaaactgtggcagtttgtgacctttgagtagctttccttgtgaattaaggtcatttcttagtaagtggataccttttgggtgtagttaaatgccagtatgaagggcccttgagatataataagagttgttcttgattctttgcttcctgatttcgttcaaaagaaaaattttgttttccttttgaaaataaaataacttcaccagatgagattccctgaaacttaccgtgataccttgaagcttcagttcacctttccttaatataatcatatatgcttagtcctaataaataaaggcttctctggtagctcagctggtaaagaatttgcctgttatgcaggagagcctggttcaattcctgggtcaggaagatacgccttttccagcctatccctggaaaagggataggctaccccactccagtattcttgaatttccctggtggcttaagaatctgcctgcaatgcaggagacctggatttgatccctgtattgggaagatcccttggagaagggaacggctacccagtccagtattctggcctggagaatgccatggactgtagaagtccatggggtcgcaaagagtcagacatgactgagcgactttcacttttcactttcctaagaaataagtcatgtgcttgttaaacaatgctttttaaatctccatcatatataaggcacctttagggtacttaggagtccttgataaatgtacttaatctccagtatctttgagcaacgaacatttatttacatagatataactatgttctctttccattgcattttctagaaaatgtaacatttaaaatgtgacattctgtggtgtggaaaatacattacgaaagatgggtaccatgtagctaaagtttgttggtaccatgggtactaaagtttgttgtttctggagtattttatcccagttctgagggaatgactcatttggataattaatcttggctccattttatactttagtccctcaattaaatatgtgtaaatattgagtactatgatatgtgatttgactttgtagttagactcagtattgagatggtgagattttgacatctggaaacagatctggttttctcttgtcattaactttgcaatttaaggagttaactttagtttatacatcaatgaaatggatatagtgatggacctcaaagtttattattatattatataaattctggacactgtcaagcatatagtaaactttaaataaatgaaagcactattatttttatcccagcatacatatatttttatttcttttccacctctccttctccctttacattttcctcctctttttctccacctaggtttgcagttgttcaagctaagcccatgagatgagcagtagtccctcaacaagaacagcttcttccaatattcattttgtcaaacaacaggaataaaattagtactctaaatatcttgaaacgctgttgggaaaaactttcaaaaattacatgaagtttttagaataaactaaatacagttttttaaaatttcaaataagtactttatcatctccagtgttttaatgtgagaattgaattcatctggacactgtctattaaaatacagactttaaaaaactggatactttttttttttagactttaatcacaatttcttgtaagaattccagggattttattccaataaaactgaatggttttaaagattagtgcatgaaatgaatgaatcaataacatatatgagcttaaaaatgtaaaatgacattaaatattcataaaaatgcaagatctttaagttctgttggtccaaagtaaactttaccatgtgcaaatttgaaggtaacctcaaacatccattttgaattgtcttaacatcaacacaagaaaaggtttagtgaatgttaaaaccctttattccttaagtaggatataggataattccatctctattttaaaagaatgtgtggcatgaccttaattttccatttcccctttctttttatcctcacctcccttctgtcccccttttcttctcccagctgcagaagttagatcaattatattccttagttcctggccagttttcaggatgatccctacaaatgtcctcttttattcatatattattcccttttacctctgttcctagcttaaatgtccctttgcatcataggcaactatcctaatgtaattgatttctgtccttagatttataatgtatccttgtaaagtatataatggtacttcgggtaggaatgagtttttaatatttttaagtaatgtgacagaatgcattaggtattttgaatatttttcggctttttcaaggtctattcctgttaaaatatttacacggaacttgttgattctcactgctgtatagtaatccataaagtttctcatgatatttccatgatggataagttgattattttctactatcagccaacactaagagacttgtattaaacatcctcttaaatgtctcccctg

SEQ ID NO: 41774 - DNA, 3368 bp, Bovine  19866880530149
aaaaaaacttatcataccatgcaccctttaccctattatcaatgatcaatgaatttaacattcagttttatccaccccacctcccacctgggtcacaccttttaagaactctctaatgcactccagaaatctggctttctatagcttatatttcacttgagaaatataagaaatcctaaattagcatttccatcgttgcaggcctttaagacaggaatctgacttctagggtttcaatgacaatgggtttcaaaatgtgcaaagcacgtcattttccgtgaaattgacagaacccagttgaatatgagtaacctgacaatcacgagatccccgtcagtcaatctgattcctctgaggcagcaggttatcaaaaagtgaaccgagtgatgtaatacgcatcccagacagtgttatgagaacagcagagatgatttcaatgagactcattatttattcatcacaaggtccaatttgcgtgttattttcactgacggtgtacgcagttaactggttgaaattcagtgctgatagagtgttttattccatactgtaaaaaggacccttttaattttttttttctgttttcctgtataagagtacaaaacagagagattttgtgtttgtggccattcatggtgatatctgaacaccatttagcaaagccggaagagcagacattggagaaagcccttaaggactccctgtttttttcattaggagtgtataataacatgtcaaatattacagagtaaaaagtaaaacaagattattattcagaaaataactacttttcctttaaatgctatagaacgagataaacactgataggaaacacagaatgagatataacctccacttctgagtcggatccttagtctcatcacccaagggaccttctctaaggttcagggaaagaacaggaaagaaagctctcccaacaggcaagaaagagctggcctgtacattcttggactcttcacatggaccagtccaagggctagcacatttgaaaaccatgcatcatctctcatcaatgttggggtcacatcatatcttaaaaggccctgacatcattagacacagtagctatctcagttcgcctttcctaattcattttactaagttcatgtgctttatgtatccgctgaaaggagtgctcagtgctcctcagtaacttcctctgagtttccctcaagaaaatgctcacccaccagtttccacgtttccccacctctctaattataaatacctacatccaaacaatccttcagggccctgctgacgtaccctgccccagaaggtgcttcccatcccctcagctgaaagtcacctccccgtcctctcagctgccctccggctccaagtgcctgacagccctcaccactcttcagcttgaattacatgtactattctcaacttcctactactctcaaatgtccttaagatcataattttattgattcatcttagattcctcacatcacctaccacagtgccttgcacaaagatgaaccttttaaaaaataatcataatttgtgataagatcgctgtcccaggtattaacactctaacgctagcatcacagaaacttgcaagaatagtcagtttcccaattttaaatgacttgacttgaatctaaacagcaagcagaatacagaatcatctcaaatcagctgagtgaagaaggcaacctgcaggaataaaataccctattaatctttgacttttagaattgaaaaatatttctgaaccttgactttatttgtagtattatctggttagcggtcttggcagctgttcaaagttttaaagtactacaggtcatgaatattaaacgctacaagtttactgggaggaaatccaaattcatttgtaagtgcatgacaaatagtcaccccctccagtttcaataatgcaaggaaatactgtgatcagaaccagagttccttgctatatctagattctcacaaagtcaagtgtaagacaaatgaagggaaagacaattttcagaaagcaagaacactccttgaagcagagtggcacagatggtgcttaaagacaatcagaatcagcaaatatatcctatttcattcaaggcaatggatatgagggtcacatcttgagtaaaaccacaatctggtctagaaagaaaagggacgaagccataaataataacagattctgctaatgccatccaagcagctaatcaagttaaaaaagcacatgtggatccaatgtgcaaatacctgcaggctatacactggtttttctgtacgtggggagccacacaacatagtctgatgtacaaaagcaccacatttaacgtcttcactgttcagacagtgatgagcccaaaaccttcaacagaatataagccccagccctgggaaaccattttcaaaatatgcccagtaaatggtttggaactatgcaactatttgctagtgtgggtcagatggctgcatcccattatagagccaagcatacttaatacccaagataaaggtaaacttgctcaccacaggcaatttccctccatcacatctggctttgcattaaaataaagttttgctagacagagacaacttgtttttcaaaagtggcaatgactccctatccctctctagtaatattgtgtctttatcttgtttacatgaaatagagccacgagatttcatttgaaaaaaaggtggctatccagataatacatcttggaaacaactacggtaaaataaatactgtcatctgtagagaaagtcttaaaataccaaacccaaagggcttcattttccaaattattttgggctataattacaattgttacactcgctttcaggtttcctttcctttttaatttttttccacctgtaactgaataagtgattatgaggctaataaagggggaaaaaaagatatttccacattaaaacagttaacagatgttaaataagcacagaaaatggccactaggcaagcaatgactgatgttgggtaagtaagaaaaatgttgcctttactgattttattacccatgtacctcctgggatcataggagacttataaagtattttgtgggcagataaaagtctagcatttatttgcaaggctagtttaagtgtctttcaagggttccccatcccccttacattttgacaacataaagccaagtaagtgaaaaccatctaagaaaggctaaaataggcatttgttgagaggtcaagaaaacttatttttcaacatttttctgacatgcatctcttccagtcccaccttccagacctccctaatcaggaatgaaatcctcattgtagaaaggagaaggtataagatttcactttagcactgcaggcacatctgtttcaaaagt

SEQ ID NO: 41775 - DNA, 2436 bp, Bovine  19866880678622
atgaacatttattgtacaccaagtactaggctaggctttaaataaagacagtaaagatgctctcgtacccttgtttccacagtctaacagatgaaatggaggtgtagatacataattacaaggtgttagagttaattttatgtgttgatttggctgggtcacagtgcctggatagttggtcaaacatgactctggatgtttctggaaaggtgtgtttttgtgggcgagattcacatttaaatttatggactttgaatggcacagattgccgtccacgatgtgggttgttgtttagtcacctaatcatgtctgactctttggcaactccaactccatggactgtagcccaccaggctcctccgtccatgggattttccaggcaagaatagtggagagggtcaccatttccttctccagggcatcttcccaccccagggatcaagcccacatctcctgtatcagcaggctcattctttaccaccgagcccccagaaaagcccccataatgtaggtgggtctcatctgtgtagtggacagtcaacagaagaatgagctcctgagcaagaaggaattcagccagtggacagccttcagcacttgctcctctcccagtcccctgcctgctggctcaccttgtagattttagacttgcagccttcatgagttgtgtaaaccggttgttcaaagtaaatctctcgctccacacacagatacacatactttctattggttctctttatctgacagtccctaactgatacaccagataatctttgtaagcagagtgttctttagtccttcagtcacctgctctcccctctatggacttcacctattcagagtgtgtctactgtggggtgctggcacacaggcaaagagctagaaatgtccgtttaattgaactgctttcaagcggctagccagaaggagcccatgtggcctggttttcatactatatggtctgattttatggtcaggaatttacaactttataaaaagtagagtacagagatgatcaaactattcctctttctgctccaattgttctggatggagggcagaggattctctgtgtgaggggatgaagagaattgtgcacgtggacacggtcagcaccactgggagggggcatgaatgttgtatagggcagggctgggccaggggtgcacactaggttctgtgtaatattatttctgaaagtattaggaggctgtgtatctccagagcaccttatttggtaactcactgatttatagtcttttctcattagcctcctaaccttgcctgaggggatcagtgataagcattattaacaccttagtggcatctgggaacactaaaatgcaaggaagagggtgacttgccatatatcacactgcagacctgggaagggatgctgctgcagagaactgtcttctcctgtgtttattctttgaagacactgctggggtctgaaaggtttttcttttgttctgtgggaaatctcattgttgtcatttgtggtatgtaagtagagggcagaaatcttcttaatgagtgtataaatggatgttctatttttcattcctgtaatggcaagtcaaccagtggagaactcttgacttgaaataaaattaaaaagggagtttgacagctcctattattgtcttatttattgttctacttagatcatcacatgcagtactgcaggttccaaggaagctgaagaaattttaagcctcagctacagatgtttattggagacaagatgcaaaaacaaaaacagaaaacacacatttgattcctttaaatgaagtgtatcatgaagtatataattgctcttcaaaatgttctctgttgcctcaccaaaagcatgagaaacatactcccttttagtattttagctttttatcacctaatcaggagggtcaccttcaaaaaaacttgaaaatgttcttttcctttttctcttttatccctgaactccagctcttgagaccatcctaccaaaccatcattaagcttatgaggaaactgattcagggagatggagtgacttgttatttatcatttttattttatgtacatgtgtatttatgactaagataaggctgttttccagcacgaagaaaagattccaaatgcaaaagcataattgtgttagccacgctttctacaactttcactcaaactttgcctgctacaaatctgctaaagtaaataaaaattaaattggtagagactagttttggacttgactactgttctgactgaactgatggtgcagttgaatcaaagccagtggtcggaatgggcattagggaatacaaagcctggagtgtgtttttcctttagtacggttctttcagtattgagggagtaaaaatggctccatagcttccatctgtcttttcaaactatgtctaggagtaagaacaaggatttgggtcaaagaaa

SEQ ID NO: 41776 - DNA, 930 bp, Bovine  19866880699152
atgatagatgtctaaggcttgtaatttttaaaaaaacctacctaatcgtactactactacttttctgtgggtgcacactactgggtgtaaactgcacaaaaatacaagcgtactcttactgtaaaaatgactggttacactctgaggagtgggattgacaatgatgtgagaggaattttaggtttttttgtaatgtttttaatgagaattttattcatgtataactgaaagaataatgatatggaaggaaaactggccactggaacagtaaaaaaaaaaaaaatgttaatctagtatggcccttataaaagaggggaaaaaaacctgattttaaatatcccaggcaattgttagaatctctgttatcactttgtattgagtgttgttttaaaaaatgccatgtggaaggacaattgtgaaatcagaatcaaagaaatgaaagcaaatttcaagtaacagaaagggttggaaggaaaggagtgataagttattggcaaatgcaaatgttaatttctaaattcttactgtacagagtaattggctagttcagttgttatcaaggggtttggaaagagaaataatattttagagtattcatgctacatcacaaaactacagatgcccttttttggtatgtataaatgaaaaatcgcaccaaaatttaattatgaaatgaaaaagagctatttgttccattttctgccagttttgacctgccatgactcatggaactatttcaacctttgaggatatattaactgcaatggcttaaaaacatagaacattattctttaaacataacctaggatagtagtagtataatcaacgctactagataagaaaacacatatagtaaaatctagtttcctagaaaagagtcaagcctttattacatgatgtatatgacaaagtaaaataccatagtccccc

SEQ ID NO: 41777 - DNA, 1176 bp, Bovine  19866880719870
ttttatggctgaaaagggatgcagacagcacaatttctgccgaatatgttttctattatattttgtaatatgaaattataggttagtttttggtttgcataaagctgcctttttcacccgtcactgggagacaagtaacaccttcctttgactcacgttttccaagagtccttagtgttaaaagaagactttctttctggaatgtagaaattaaaagaatatggcacaaaggcatttttatagccttattgagtcttgagggcagatatatggattccagacaaaatgcaataatagactaggattttactttcagatcgtcttaacaaacacttcttgtgggagatttattgtccatgtggaggaacagagctgctttgaaggttaaatggagtagtttagagaacagtgttcaaggtctttctctgcctcttattaagtatatgctctgctttaactaacttaacccatccggcttagttttctgttttatagcagtattgtgagaataaaaggagataatgtgtgtgtgctttgtaagctttgtgatctcagtgtaaatatgaagtagcacttgttttattatgtgtgtttagttagagttaatgcttcgttggcatgaacaggacatttccccctctctgataaagcatgtagacaaatcctggcagaactaagactaagatacctctgaaagtcctatttaagcttataaagcagttcaacccctgtcatcaaaaacagagcaccagacatagtgttggacagatacagcttttgtgtgaagtctagttgctctgaaactctgaaggataaacaggagagtgtatgtaattatgtatgaccgtctctatgtcatagtagggtgtatgtggacagcaataccaaaatcccacagaatacattgcttaaacaacagaaatttattttctcacagttctggaggtttgaagccagagaacaaggtgtaggaaggtttggtttcccctgaggcctcttcttggcttgcagatgtccaccttcttgttgatctgcacatgtttaattttttttttttttctgtgatcatgtgcctctcctgattctctgtgtgtccaaattttgttgatgacaccagttattagattgcattagggcccagcctaatggcctcattttaacttcgttacctcttta

SEQ ID NO: 41778 - DNA, 958 bp, Bovine  19866880733993
atttgaaatagcttaactggaattccatcacctccactagctttggtcatagtgattcttcctagggcccacttgatttcacattctaggatgtctggctctacgtgagtgatcacaccattgtgattatctgggttgtgaagatcttttttgtacagttcttctgtgtattcttgccacttcttcttaatatcttctgcttctgttaggtccataccatttctgtcctttatcaagcccgtctttgcatgaaagttcccttggtatctctaattttcttgaagagatctctagtcttttccattctattgtttttctctatttctttgcattgatcgctgaggaaagctttcttatctcttcttgctattctttggaactctgcattcaaatgggtatatctttccttttctcctttgtttttcacttcctgtcttctcacaactattagtaaggcggcctcagacagctgtgtcgcttttttgcatttctttttctttgggatgatcttgattcctgtctcctgtacaatgtcaggaacctccatccatagttcatcaggcactctgtctatcagaactagtcccttaaattgtggatagtattatatttggagggagagggtcacacacacacacacacacatacagagtctcattttctcttttttgggaaattctgagcattttatggggttgtctcccacatttgttgattgattgtttttagtgatttatttccttgaaagcataaaggaaattgataaacctagagaatttcaggatacccagttgcaaaaagagctatattgacataggcttctggctgtttttcaagttaaattttgatggcacatcaaatgttttttcagtatttaacactaggtattaggaaccttttaaactttcactgaagtttaacctctttcctcaagattagcgtttcaatttaataaaca

SEQ ID NO: 41779 - DNA, 1965 bp, Bovine  19866880768520
gccaatgtctatttgagtggatttcctgaatttaaaataaaccacattcaaatctttctcacaatctttgaatagaattatcattttttatactataatttgcacaagtcaggctacttaaatggtagacatacctatacgttttctttatttccatcgcttctagtaacaacagttgtttgcagcctctgagataagtgaccagaaaacacaatacaatttacaatgttataagtaaatatctttaaatcttttgatacacatataatgaaatatgggtataaggaaattatctccttattagttctgttgcttgcttactttctattcatctctttcttttttctaagaccaatacagatagaagtcagcagcaactgatgtgattttcttgggaaaacatgcttaaaatataaataatctcctgtaagtgaaggtaaagtgataatatttcacaaatgaaatcactctttagcttccatttactcaagattaagacagagaataccattccagttttcaataaaattatagctataaagtgcttctttgacctctttcaccaatttcagtcgattctggtaaattctttctgaacacacaaatagcttgcagacatatacaaaagattttttccaaatgcagtaggtaagcagcatacaaagcatttactctattttgatatagcatcccagtgatgctcaaaggaaaaacatttgggctaagttctggtttgtgtttaggtttttattcagatttagagaaaacttttaaagtaaataatgttcttttcataacttaggttttacagaaaatttttaagcttctttgttaaccagttttcacaaataatgatgacacaaaacgaaagtcaaaatttcaactctagattattcttagcatttataacaattttaactttaaaatatcatctatggtctaccttaaatcttaaagttgagtatatgaataaagtgtccaatttaacattaaatttgctaattatttcaggctttagttagaaaaataaacccaaccctgtccaaaaataataaatcctcagaattcaaattccgagtacacaaagataaacatctgagtacttatgataactgcctttaaaaaaaaaaaaaacacaccccccaaattcagcatgcaatcaaaatctgtcatagaatttaagataccaaagaaccactttccaacaaatggagttgaattcagaggattccattctaacaacctgtcttgatttaacctcaagaagctgacaatcatttgctgctctggttctaatctacagaggtactcaatcaaaatgacccgttttccattgcagtgcctctgtctcccatcctgatttctccataatgatccctcctctaaatcataagaggaaagcattgtatcataaacaagaaaggggcagaatcctcttcaagtcaactcctcccaatttcaccaaaattcatttataggaatatcaaacctaagcttctccttcatagtaagataaccccttcttcccatccaatccctcaccctggagaaatccagctattggacttttctttagtcttagaaatcaactgctgaaggcatgtttaataaggccctgaattattggtttcttgtactcatttaaattactcccagagagttgagagccttcgtgcagaaaccatttgtcgtttccctttaataaattaaaacagtatgacaaaaatggttttaacccgtcagtaacagaatctggtttattaaaatactgggtgaattttcacctgaatattctaaaaatgttccaaggaacagatgtgcattagagaaaactaggctgctatccaacaagaaccaaaagtgctctcctttttaagagtttgccacttgctgttagaatttagttatcaataggaacagagtaaacattccaacgagaagaaggcaacacataagaaagaaaat

SEQ ID NO: 41780 - DNA, 1852 bp, Bovine  19866880769201
ttgctttgaggcgtagcatttccttggtgttaaccagcaaagccccgaacagcctctgggaactacacagaatatggaacactttatgaatgtatgtcactcttgtgtgagggccatgataatcctctctgcatcatctcaattttagtgtatgtgctgctgaagcaagccctggaatttctcttaactagaacagaacaccatggaggattttagatagaagcacaacatgatctcacatatttttaaaaaaaaaaaaaaaacaaaaaactgagatcttgaccggaaaactgactgcatcaggcatagaaaaaagggggaccacttagaaggttgttaatactccatggcaaagactagggtaaaagcagtggagccagtgagatgtggttagatgtggagtatcttgtagatatatgactgataagattggatataggtataacataaaaacaggagtcaaagatgactccatagctttggcttgtggcacctaggtgaatgcaggtatcatttatacacatgaaaaagatttcttgagagcaagtgttggtaggaaggtacatgtgtcatggagcaaccaattcctatttttgagatgctacagcaggagagtgtggaggactaattcagaaagcctgaccagaaaggaagtcacagatcaagccttggcaaaaacaccagctatctggtagcttccctgagaagaagttaaaagaaaacttgcaagaatgccaagaggaaagcaaaaacagaaaaaaggggaaaaaaacaaaatcaaacaaaaacaaaacaagccttctatttaaagcatggtttcagtaaaagagaagaaaaatatattaaattactgtttaaaataagtagcttgactttcacaaatattttaaatattttattagtaaaaatatatatgttgctttctatacatctttgacatttatgagtaaaaaaaagttaagattttagcatattaatacaaatagccaatttccaaaatattacataatgaaagatgtttagctttattcagatatcctgttatataacaaatttttacttcctttctacctctgttcacttgcatattttcccttcaagcttaaagaggtcatccacacgtactacaataacatttcaatacgagataattaatttgatagaatacaaccacatcttaagctctatctggggaaattgctttggctgttacattgcattgctaccctaaactcagttaagttaaaactcttctccatctataatataaatttatgagaatatttcattattaaaatgtctgaggatgctgtggtgaagtagaaattttctttaaacacatttataactaaattgcagatatatatatcctaaaattttactttagaattatgaaatcatttttaaatatcaaaatcagctatctttagacttcagaatagtacacagaatttctctttgactcataaattaaatagaaaaatatgtgtttgtagttaaaacaatgaactttcagcaatccattaagtttattcattgatttccttaatccaactactatttactgggagtcagacatgcctgaagcaacttagcagcagtagcagaagcagagttaagcactgggatgagaatggtgaattaggaacaacctttgccttcaagcctttaagccacttaaaattggcttccctggtggctcagacggtaaagcctcaaatgccggagacccgggttcaattcctggttcgggaagatctcctggagaaggaaatgacaatctactccagcactcttgccggaaaatcccatggagggaggagccgataggccacagtccatggggtcacaa

SEQ ID NO: 41781 - DNA, 1000 bp, Bovine  19866880876120
ctgatgtgaagaactgactcattggaaaagaccctgatgctgggaaagactgaaggcaggagaagaaggggatgacagaggatgagatggttggatggcatcgccgactcaatgggcatgagtttgagtaagctctaggaattggtgatggacagggaggcctggcatgctgcagtccacggggttgcaaagagtcagacacgactgagcgactgaattgaactgagcttcactgaagtatctgtaggagatagcccagagttcttgtgcaaagtggaattcattacataattcagcccatcatgtgcttagggaagttttgagtacattcttttacatgatgctaggggtataaagatgaggttggtgtagcatagttcctatcatcaaggaacgaaaaaatgaggtggctatcattgcccctctggtagtacgccattgatgccactgcttaagccaagcttctaagaatgtaggcacttggtcaatagttgtccagtaggtgactattatgcagaagctatggtagccccctctcctagggatggttaaaaaagattaatgggaattcatgacttctacccattagcatttaagccctcaagtccttttgctcttcagtcatatttgggcattctctctttctctcaggtgcagactttgtttttcttccaatggtcaatcacatttggcataaacctctctttcctcttcccttcccctctaatgctgatttggtggttgaaactcttagtcccccaaataaggtgtgcaaggaccatcaccttctttaattcctttgaataaaaaagaaacccaactggagccctcctgtgcggggttgtttgagattacaacacagccatttgtggacaactgctttcttttcctgggcaatctgaggagtcccatggctcatgtgtttgactgaaatagaaggagaacccttcatgttcaaccctcatggttattgcaggtattctcactgtctaagcccagg

SEQ ID NO: 41782 - DNA, 3049 bp, Bovine  19866880911317
aaacacacatcagtgcccttggaatagcagctgtgtggtaggtgttgaggccaaataaagtatttctttccctttgtctttgatgattgccctttatttctgtggaatttattatgatacatgtgtgattattcctcaggagcatcgagtttaaaaaaaagttcacaataggcttatgattatggtttaactaggaaacaatgtgtaaaaatattgccggtgtggggtaaagaaaaattcacaacttttgatgatgaaagtgctgttttcctacttgtcattccaaggattattgatttctttaaaagtagaaaaattcgactgttctagcctagaaattctcacttggcatcatttaggagtattttgacttcaaaggatgtgttatttgctgaaaagtggccactggggcaaaatatggctcttgacattttgaacggtgttaaatgatggcaccgaagtatttcaaacagtcatgattcaacattgtttaaaaatccagtggggaaaatggcagcccatagaaccctgcatatttggaattctttgggtattcattttaaatgcagttcacaagtttgctttttacaaaatgctgtgttttttttttttttaaagaaagatgaataaggctagtgaaatttttacagctgggtcttttggaattttgtgttctttttttcagttgcttataagtattctataaagagactgaaaagatgcaggccatagccttgatttttgtttttgctttgctttctcggctgggttatatgcctatactcagaatattattataatgcatattgctattcagcatctattataaatccaagatcacaaaagtagtctttgagcaaggcagataagtgaaaacacttggggaataagtaaacaccttgtttttgttaatttccgactagtctcatgtctaccatgctttcttttctctttgggatatcttttggattaaaaagtcagtagtctgactccacagtattcagtgcatgctgcagtgacattcctgcgaattgtggcctccacaggggtgccttggctggtgactgtagattgcaccttaggcttgactgcttttcgcagtttggagaggacacttgtcattacagagccatttgggaaaggagggtaaaggtgacagctgtgttgttccccttggggacctttctcattgttttctatactatcttttgtccatctcagccctcctatcttcaggtttttaaaggtgttataaatacggagcctcctgctttggattgtaaaagatgtcttaaggtagaatacttgggtccaaatattttgtcaagtgtacttttagaatagggtgtttctctcctcctccaagtaattaactgcaggactgctttcccaaaacaattgaaaagagctcattttgacaaagcaagcttctaatgacaaatttcccaactacaaatttgcagaggaaaagttctccgatgatgaagaagtttaatcaggcaaaaagacgtttttatttgcagaaataggccctttagagggaggtaattacttatagctgatgtgaaaaactggtatacctgaattcatttggtaaacctcatttaaaataggaaggttattcttgttattctattgaaaggaaaaaaatggtgctgttgtatcactgaatttatattaaagaaataaggttttacacttaaacccactcctatagggatatgtattgacttaaccaaagaaaatgaatttgagatttgagaagaaatctgttataaagacactagtgtccagcctgaaattaccaactgtagtttgccataggtatcttctatttaaaatatcccactgaaatgatgtcttttaggttgcttcctccacctctatatttttaaaagtctttgcatttttcttttaaaaacaatagtattttttgctaatagtattccatgttgaacagaaaatgaaatttcactgttactgatgaataagtcatcaacataaagtaaaccatttctatgagagactagtacctacttaaaaaaacaattgggatatagttgctttacaatattttattagtttctgctgtacaagtgcatcagctgctgcttactgctaagtcgccgtcagtcgcgtctgactctgtgcgaccccatagaaggcagctgggtatccatatatcccctccctgtggacctccttgctcccatccgcccctctcggtcatcacagtgcactgagctgagctccctaagctatacagcaacctcccactagctgtctgctttacacatggtgacgtatgtacgtcaatcccaatcttcacacttcctcctaccccagtgtttctgttctttaggtctgtgcagctgcttttaagttcagacctgatacgatgttaaggatgcctgtggcaggcaagggggcttagacccggtcctctctcataactacctccctctccacaccccaccttcatcatttgatatggatgattatcttttaaaaattcttctaaaatgcttttagaattttctcagtttctttgaaccacatgaaggtctttgtacctctcctaaaagcacattttcaagctgggcttcttattggatctctttccatctatgtatgtgtatatgtatatatttctagatcattgctttccaaacgtcagtctacctgcttatcacttgggcttgttaaaatgcagattctgcctggctctggtctaagagtctgcatttctgtcatcttaggtgtgatcaatgctgctgattaatgtaatgtacacgttagctttgtgtgttttacagacatttggaaaagactgcctaaattcctggattaaaaaagatttagcataatcttttatatctcaaaagcatatgagttttgcctttttatttaatctctttgttttgtctcatatttgcttaatcatgacatctttaaattgatcataagcgtttgagatattgtatatattttgaaaatgtagagagcctgctaaaatctatttgatctcaattgaaatatctgtcactat

SEQ ID NO: 41783 - DNA, 2150 bp, Bovine  19866880912556
ttaagtagggaatttggcctggcttaggatcttaagactttgctatagttcaccaatgaaacaagaccaaaactatgtcatcttttctgaacacagtatatctgatatcaacaatgcttttggcaactacaaattaatcattattattggttatacattaaccaccatgtgtctctatttgaacatcaatctacctttttgagaaagccaaagcctttctctttttggaaagagaaaggatgggcatgtggagaatgaacagttagttgccattagtaataattaagtttctgctgcagagggaagagaatttaagtggaagagtttgagactgtcctttttggtggcttaataagctgccaagattgagccactggattgtaggggagaaaaagttgaacaaagaagagcctggatagcacaaccagtgaagaggctggaaaaatgttcaacccatttgaagtttctgctggaactgtccatcaattctgatctaaaatatatttaatttctctcctatctcctttggatttgacaggtatatccctcattcaagacaaagctatcagctgttctctagtcggatggagaaaatagagttctatatttcagtaatagctcaaaactcctagaaaaacttttttcaaacaattttctatcatgtatctttttttctatcccagaagactcaaaatgaaataactcctctgagaacattctcttggcatcatctttgagcagctagagactataatgaaagcttttaagacattgagaagagaagtcaagcaatttaatttctttccaaaaatactaaaaatgtcataaaagaattaaaatgcctgttttttcagttggacactccccttgtcttgtgtgttagatcatcggttacaaagaatcagaatgtgtgaggattagaaacaagtgaatccctttgatttaatgtaggcccttttctgatctcacttaacaagtaaagaccatattgactctagcaataattagcttttaaattctttagacagcaacttatcaaattacattaagccaattaataatctcaataggctttcattttttatctttttgtgttattttaaatatgtaattatacttcacatctatatattttatgtttcctttgcagtagaatattattctgtaaatgtgcctttgcctgtactttctgatgatggctgttggggaactttcaatgaaattatgttttaaagtatctttttagaaatctgtcctatatcaccaaagatttaggtgtttctctgttgtatgctactaaacatcaattgaataatttttcattaaatgatatgaaagaatacatcagttttaggtttcatcatagcccctcagatctattttcctaattaccctgttgatgttagttttaaaatgtgcctgtactggcaaagtgttactgtttctgtaaaatgggtcaaggaatattatcttgtttttgtcacttcaatttatagcactaatttttgtttggacttgtattcattcaaaaatttttctctgtgagaaaagactagttagcctgctgctactactcagttcagttcagttcagtcgctcagtcgtgtctgactctttgtgaccccatggactgcagctgaagactagttagcctgctgctactactcagttcagttcagttcagtcgctcagtcgtgtctgactctttgtgaccccatggactgcagcacatcaggcctccctatccatcaccaactcccagagtttactcagactcatgccctttgagtcggtgataccatccaaccatctcatcctttgtcatccccttctcctcctaccgtcaatctttcccaacatcagggttttttcagttctttgcatcaggtggccaaattattggagtttcagcttcaacatgagtccttccaatgaacattcagaactgatctccttaaggatggactggttggatctccttgcagtccacgggactctcaagagtgttctccaacaccatagttcaaaaacatcaattcttcagtgttcagctatctttaaggtccaactctcacaaccatacataactcgtggaaaaaccatagctttgactagatggacctttgtgacaatgtaatgtctcttctttt

SEQ ID NO: 41784 - DNA, 1168 bp, Bovine  19866880949930
caatggcaatttaggaacacttgcctgattatcattttgacctggagtgtcagtgtaggaggtttcatattattcaaagtcaaatattataactcatgcagttgttttcacaaatgctataacatggactgtttcctcattttgtttccttgtgtagataactttttagccatttgcatacccataaaagcagttctctggtggcttagatggtaaagaatctgcctgcaatgtgggaaaccttggtttgatccctgggttggaaagatcccctggaggacagcatgacaacccactccagtattcttacctagagaatccatatggacagaggagcctgatgagctacagaccatgggatcgcaaagagtcagacatgactgagtgactaagcacagcacgtacacataaaaaacacaggttttcaaaatgtttatattttacagaatataaaaacaaggacagtgtcaagaactcttgtactgacatttactacttaattattaagtaggtctttttttcatatttgagcatttatgaaataagcaagctgatcttaaagttttttttaaagattccaatacatgtctacctttcatacaataaccttagcacaagctttgctaattcttaaaaaaaattgacaatataatttccattgtctccagattttataattaactatagaccttagtgattaactggagtatttttaaaggtccttctgattataagattatcttatattatttcttgtgaaataaactcaaaaatggttaaagctctccccaaaatgtttaatttttttctcatcttattatgagaatgcatttctgattaagttttgaaattctctttagttcattaactcctattaaactcctaccactgactttcagataaaatcttattttctaacacatctttctaacatataataatggtagaatatcaggcttttaaagtctgttttaagatcaaggatttattttacttggaaatcattttttagtccttgctgagaatgacttccgtacagttttaatcaagtctgacttatagaataggatctccctgatgattagctaatacagttaaggtgaatggagagtccagctgtaggaaatgtaatatgaatttcatttgcatttttcatccagccactcag

SEQ ID NO: 41785 - DNA, 1904 bp, Bovine  19866881002210
aaaaatctgccttggggaagcagagatgaatggaaacttaattacgcttgacaaagatcagatggccttgtgctgtgaaaggatatctttgttcatgtcttctttgttaggagtgtggcggaaataggaagctgaggtcaccgtaagacctcaccgacgctgctatcgggtctcctggttgcagctgatattgcagtgtgactgcaattgcaagccattgttgacttgtctgatttaagtgaatacttatgagagggaaacaagaattagggtaactatagaatatttgtccaaaccaggaagggttggctattatttttacactataacagtggacatagagtagttttaggcaaaccagaattacttctgagaatcacttacaaaatgagaagcacagtataccgtttcaatatgcatgtggtccggtttgtataagaacctttctaggacgttttggcttcccttatagctcagttggtaaagaatcctcctgcaatgcagaagaccctggtttgattcctgggtcaggaagatccactggagaagggataggctacccactccagttttctggcctggagaattccatggactgtatggtccatgggggtcctaaagagctggacactactgagccgctttcactttcaggacattttacctttgataggcatctttactttaaagtcctttcagaagaaaataagggggtcattcattccaattccatttaattttgtttgttagtaaattaaaatacagtggattttaggtcttggctactatccccagttctcagtgtcagctggctggatctaggagaaaaggaactggcattccttttctctgtcatggattgaaaaacaatggaagcaaaggagtatgatgtgaattaagagcttaactttctttaatctgaatttttaaccaatgatgacttccctgaattgaactccgttttttaagccagtagagtttaatcagtcctttgattgacaattgagaaaagcaaaacctattcaaattagtggctttccttggtgattcatcttcttggtatcagaaccagactagaattcaggttcctggtgtgctcagatggtagagaatttgcctgcaatacagaagacctgggtttgatccctgggttgggcagatgctctggagaaggagaaggctacccgttccagtattctttcctggagaattccatagacagaggagcctggtgggctacagtccatgggtcacaaagagtcagacacgactgagtgactaccactttctgtgactgaatccagtgcttttatgcagtacactgggttcagtcatcaaagagagttacatcttaataaattaaataaccctctctatccttactgctgaagatttcgaccaaaaataggtatgaaattagggaattatttacatctggctttatcttcttgtgagagcatttggattttagagtcgtggcagcctgccagggacaaatggaggtgcagagatcgcctgcccgtcatccactaccttttatggtgtcaggggattgcttgttctgctttgcgacccagctgcaatgcagctgttgttggcactcctgctctccactctcacagagcagctttcctaaccatccccatggggtttaactgctgagcacgagtgtcggttctgagctctgtgagccaaggctgcctcttggggaccaatcagcgtagcagctttccacatcatagctaaacagtttgggatggagcagtccagcaatttctcatgacaaacaagaagcacccatttgcacaaacagtgcagccggatggttgaagttgctgcaggagctaaatctgggggctttccgatgactgactcctgaaacggaggtcacgggaccgctttgt

SEQ ID NO: 41786 - DNA, 868 bp, Bovine  19866881004917
gaatagtcatcttataggatatcgcagaattaatacattggagcatcttaaatcaatgcctaatacatagtaagcactcagtaaatatagattatcattattgcattgtaactgggggacacgacaagggctgtgttacaggctggctgttcatcactctgtgttcttctccaaggaatatattttgattcagggcacagtttggtccagccaaagttccacattgtaataagaaactgcctcaccagtttaggaggctaagacttcacaaagactgattaccaagaaaaccataagttctggaaaatagagcaagaaaaaaacatttttttatacccatcccatttttaaaattagatccactgtctatctttttctgggaccactgtatttcggccagagactattttcatggctgggttaaatagcaagcagatcttactgactataaaggctggcagacctggtaatgatttacagaaggagactgtggtgcctacttgtctgaataattttaaggacttggcagataattctcgaggactttttaattgtagtcctcagaaagccagaggacaggctaatgacctttgaagcttgctttctttcattcttgactcagtaacagcaaattcttcgtttactatagtatgatatattttacatataacgtgaatatgattcattctaattggacagagcattactgccaaggatggccgtggatagaactccttcctgtctcctatataaggcaggggccctgcctgttgtttaaattagcctttcatgcaaccactaactcaaatctagtgatgattcaagccagaaacagtaattttatttatatgatgtcttacataaaatg

SEQ ID NO: 41787 - DNA, 1942 bp, Bovine  19866881015106
tgaagagttgactcactggaaaagaccctgatgctgggaaggactgggggcaggaggagaagggatgacagaggatgagatggctggacggcatcaccgactcagacatgagtttgggtaaactccgggagttgttgatggacagggaggcctggtatgctgcgattcatggggttgcaaagagtcggacacgactgagcgactgaactgaactgaataataagtacattttcaaagaaaaagagatcaaattcaggcatttaatacttcacagatagggctttaggcattaagcttgaaagcttcctacaggtttggtcaccaaaagagatattctaatatccagtaaacaagattgcatgttatatggccatgtaagagagaatttcaaatagctcagcaggaaggccacatatattcaaccagaggaaaaaaatcaatccatccagtaattaagaaatactttctattcccaccaaagatgtgcaatgatttgaagcaaatgttgctgtataattacatatgaacataattgaggctctccatctctgcaagtccttttatgtaagtaagtgatttgaaatggaatgcaaaatttaaaatatctttttatgctgaccattaaaattatacttcaggctctaaaacttagcagggaacaagaactctttagagatgtggaataaaaagataaaaagttagtataaacttaaaaagcagaatactacatatttagtaaagccattattgggacaacattagcatggttgtcaaggggtctaactatggaagcagaaagcatgtcagaaattcatactgacccttccttcataattacccttttagtctacaatcttcctaagaaggatggttacaccagtatatcttatgaatacaagatatacagcactgtaatcaaaattcaaaccacaatgaagcatatactcatttgccagtttctttcatgggatgcaatgatattcaaattatatttcaggatagattaatgaatttgcttaaacattttattcaaaatgaagtttggagatcaacttgatatgtataaaaccagaatcacttgctgcttcctctcaacttactatatataatacaaccatcaatctgaaataagttttttgaacccatggtaaaattttcaattacttttatgtgtactctctcactaatattgaagaaacttggttttctccagcaacctggtgagtgtttttgtttgttttttaattacagaatgaacaaactggaagacatattaaggaaagttaaatttaaagactcaggataaacaacatgtcttagtatagtaaaatttccatttcttaagtcttccccagagtatcccggtgatttgaataaactatgtttacacagcatatgcaaagatatacacctattcggtagagttctcttgtgacggtggttgtttttaaaatacataataggagtccttcatcctaaggatctccaggttggagagatagacacttggaagacaaagggttggaaaaagaagcaattaggtataaaatgcttgaaaagcagaaaaggaagcaccagtgagaagagaaacaaacagtgaagcactgaaaatgcttagttgaaatgaggaattcaaattattttaaaaacacagtattgttcccccatgtcttggttctccactgactgcaagtctctacttccatggcggacaaatctgggagtcctgcctgcccaccccattcaagttcagcaggaaaataagaaaagaggaccacgcacctcacgtatccagttgtttttgtctcattataaataccttccatttctagtgctattaataaacccaaaagtttttcaaataaactacttcagaagacaacttggaatcaatgtaatcatctgtttttgtagtttcctatctcttctgtcaaaggaaggg

SEQ ID NO: 41788 - DNA, 1225 bp, Bovine  19866881037229
tggaaaatttgacagtgtttaaaaatatgtgacattttttttcggaagcagttttattgaaatgcttgtggctttcctgctgtgatgtcactctgttgcccttagtgcagcagagtacattacggtgtggcgtggtttcattttccatgtggcgatctagcagtgaccaaacaaatcagcttcataatccttacacagcctgggagtgagccacagtgtggaggcaggtgtgggagaaaatgctagaaaaagagaaaaggcgaatggagagcgcatcctaaaaaccttctttggaatgatggtagaagaaagtctagagtattctgagcatttttaactcttcagtgttcttttatggaactgaaattaacctgtaagagtttatcttctcccacattgttgattttggaaaatgacatgttccataaattaattctcttattactgtaatatagtgttttatattctgaaacattagcaaattggtggaaaatctttataaaatatattctgtacttaccttcataattgaagtatattggattaatcctgccccatgactcaataccatactaagtcatgagtaatatcaccatcatgtaatcattgagtattgttttttgttgtattatgtagacacattcaggaattcattatatgtttaggaaaattttccactacacaaaatgaccccagacacttagtgtgatttcagtatttaaaaaagaaatctttagtattttttccttcataattacacatccagctgttacttcttgctcttcatatgagtactataccaggctttccacatttcctgatctgttaaaaccaatttgctgtggaatgaaaaataaaagtatttcatttttttaagagtgaatggatcatcattagcatagatattttccttggctcaaagagaaatggataaaaatctacagtgggagaatgtgcagttatttgaggatttggaccttcgatagttctcatgttgactccccttcattatttccacagagaagacccatgtagcccagctcctgagaagggggatgggcagccatttctttgctctgacgttctagtccgagtatcttcttgaaccaaagaagttgttgtttagtcaccgagtctaggtgtttgcctgtgttccagtcttgagtctcttcttgtagttcccttgccctcccctctggtttctgttttccctgtattatcccaa

SEQ ID NO: 41789 - DNA, 768 bp, Bovine  19866881041780
cactgttggtactcatcactttgttagagataataatttaacatatgctattaagttggactttataatagaagccaagatcttttagaaaaaaatcaatgcttaagttggtattttattttaaactgcctcttgtacgggtaaatgcatgaaaagggtttaataattcagcccagcaagcaactactatacaaccactgggtgccagcaagatttggggaagttgcctttaacacgataagagaagcaaatttctgtgatttctttcaatttacttggatctttccttgctatttgaattttttaaaatctttatgctcaatggaaaagtggaggaaaaggtctaacaatatgcatacttaactgtggtccaagcatggttcttatattttctctgcctggaaatggaaaaaatagacaaataattttattatttacagcaaaaaaacccctaaagattattttgtgatcaaaatacttatttgaaaacaaaatttggggtattgctaaagtcaggaaccatgtattaagtaaaacatcatgctaacaaaaaatgtttaatgtacggcttttgtggtgctatttttatttacccaacacagctgacaaaagcaatcagtcgatagtgtaatcactgagagcagtcagtctaactattctgattaaaatttctgagaaacctagaaagctcaaaataagtataagcaggatgtcttctaaaaatcaatacacaagctgtggtagcatgaagaaatatatttaaataaa

SEQ ID NO: 41790 - DNA, 1898 bp, Bovine  19866881047156
ggatgagtgagactggtgcccaggatcaacttggaatgagaagagaatgggtgttatccatatttagtagagccattcaacatgattaggcaattttctctgaagtgcgttttgaattagaagcagctgaaaacaaactatcatttgttcattatatactatatgctagccttttgttgactgatttataatatcttgacactagtgcacgaatgattaattttgcacatgaagtaacttagactcaaacaggataagctatctaatgtcaaaatgttaataaacatctgagccattattagaacacagtattgcttaggaaaagaaacaaacaacaaagcaaaaccagacaccctctggttggttttagccgaagtttttactttgtaaggtgaaaatgcctaaaagtcatgctgattaaagtgataaatctgataaagtgatcatttatacagacaaggcacagaggcaagtgtgtcaaaggtgatgggtcacccactaaaggacaatgaagaggctggagatcatggtgaaagcaagacaaagcaagttgcttattcacacaagagacttcagttgtttttcattaaaagtttcaaattttataatgctgaatatcaatatatactttgtgaattgaaatgaggtatttagaaacatgcagtcatttattttgtattgtagtatgacaaaattcatagttgtcatgaaatgtatttatgagtaattcttcctttttcactctttaccaatatattttctcactaaggtatggatatgtgaaaattcaagacattttgtgggattttttaaagacatattacagatggaaatgctttcaaaattatttacatcaaacattatctctgtgttactttctcaagcattatgttgaaaatgccattatggatctcttgtcatggctataaagcattttgaatggcactttaaaataacaccaaatgtaagtgatacaattagaaaaacaatattctgggagtttagtattttgcattcagaatgtgataaaatgtaatcattcactctttcgttggaagcaattttaattgcaatcaccaatcagatatcatttgatctataatattaatggctcagccttgaatttttatatcattatcaacatttacacatacaattcatgtggtgaagtgctgttcagttttcagagctaggtttttaatatttttatatcaacacagtggcatatcccatagagatgcttcaacaactctctagacacagtgtgaggttgataaatatgaattatcttaaatcatttgcaatgaaattgaacagctaacccaagggcttgggttaagagaggcaagtgaatatattgtacagtgtcattttttatttcttttccatttgatttttctctgtgatgtgtaatgaactagattaatgggcccaattccattactgattaaatggatttgatttggacctttaacagggaagtcacaatagcagtcagcttcagagcaaaagctttaaaataaaaatgaaagattgtttcaaagagaaagagaactactaggcagtaatatagaggcagacttgtttaaattcagagggattatttgattaatgcaaggatcaagctgctacacgttgctgatgagctggcacatataaagtaggtactgttaaattatgagaacatctcatgttaagaacaatttttttattcaaatatatttttttaagtatgttgctgttcagtcactcagtcatgtctgactctttgcaatgctatgcactgcagcatgccaggcttccttgtccatcaccaactcccagagcttgctcaaactcatgtccattgagtcattgatgccatccaaccatctcatcttctgttgtgcccttcttct

SEQ ID NO: 41791 - DNA, 994 bp, Bovine  19866881049175
ctttggtgggggaagggggtgttggcaagcattactctgcctatcaaagaaattgaggtttatgaatgacgagttagcactatcaaggtttagattaattttacaactgtagtcatatctttgctacctatcttttagctcttcattgctaattaaattcattcttgtatctcttttcactaagataaatcccttggttttggttttaaaagagtttgaatttttactgtagtcttcctatgtggctaacctgtctttgtgacccaaatttgatactatcaaccacatttctctaggcatctctttttgtggtttagtggctaagttgtgtctgtctcttgcaaccccatggactgtgtagcctgccaggctcctctgtccgtgggattcttgtagtaaattgaaactttccattcctaatagggatgcttttcacctcatataaatagaaaatatgtgcctaaatccatattcagccccagatccactctttcttttgtctgtcatgcattatttgcagaagaggctgccccccatggactacaaatcccaggcttgcttacatctggcttctagatggttcaatgaatgggagacaagggcagaaagagagagcatgtttttcccctgtaccatcccaaatttgccactaaatttacatagggctgattccacctgcctctcaactataacttgaggaggtccatatttcctcctcttttccctttggtacaaagggcaataatgttctcctgctcatactggtctctggagcatcaccatcccttgtttgtttccttcatttacccatatgtacttcaatgaagtttttcaacaaatttcttcctttgaaatgagtcctgtgttctgctgcaactctgacacaatatccccaggcaaattttttaaagtgaatttttgtcttttgttaatggtaaaacaaatagatcttcagctcaatggagctgaagttctgctttgatgatatataaaa

SEQ ID NO: 41792 - DNA, 711 bp, Bovine  19866881108531
atgagaagtttctctgggcagggccagtacctttataaaatatgagggtggaataaacagaaaagacaagagaataaaaagcaagtggtactgaaagtattcacccattttctcttcattgtgaacacctcaatccccagccttccatcattccaacaaatcttatgcttccccaccagttctttttccctgtcttcagccactaatttgcctctagctccgattgctagaacctgtaaacaatgacccctgccacaaacagatccttgctcttctgaccattgagttgagtgaaggaatatgtcttcttatcaccaaaagtaaacctgaaagattagttttaggaacattgttataaacggtgttttgttttaattcctcaagtacttcaggataagcccctgagtgaattgtttctaggttgtaaaatatattccaggccaaaagagataggctaaaactttaatttttggaactcctcttgcttattcctaagttagaaactactgctctaagtgctgctgacctaacaccaattcctgctggtctgtgagatacatgataccttttcccctttcataatttattgcttcaacatcagacttttgttagagctttgtccctgctgttaagggacaaagaaaacacccccttcgttgaacatttatatttaaagtgagtacattgtacaaaatctctgtgtgcctgtgg

SEQ ID NO: 41793 - DNA, 961 bp, Bovine  19866881158359
ctgtgaatacatgactcaatttaatgtaggaaatgaaaaatcctattaaacattaacatagagctttaaataaatttaacaaaacaaacaaacaaaaaaagacaaaacaaaactgtgttgcaatctccagttttttattaaacatgaaaaagaggttcaaggtagggattgaacccaggtctcctgtattgtaggtggattctttaccagctgagccacaagggaagcccaagaatattggagtgggtaacctatctttcccaagaatactggagtgggtaacctatccctttcagatctccctgacccaggaatcaaaccagggtctcgggcattgcagggggattctttaccaactgagctatcagggaagccaaaggttgaagcaggatattttaacaaccagatgcttctttgttcataataggtaacatttacaaaaccacagtaaaaagacttaggttctagtttgaactttttgactaactagctacatgacctgcaatctcatttactttcttgaaacctcacattccttaactttagtggtagtctattactgtcagcaatctctaaatactttaacaggttgaagattctttcattctagattaatcagagaagggtttctactgctagtttcattgtgcagtttataaaaaaaaaaaaaaatgccttctctggttagcaagcaaggaaaaaaaaaataacttccaagagactattcagaataacttcagaatcttacttcccaagccaagggactggaaatatgttgatttaattttgacaaaaacacattcttcagcatctaatggaaagaaaattttagctgattgaagagtattcaaagagctttaggacttcaaacagctcttacaaatcatctcactgattttaagtatttgatgccagcgtatggattaaattctataagagtataaacaggtcaaatattaag

SEQ ID NO: 41794 - DNA, 1707 bp, Bovine  19866881241259
actgcagccttccaggtgcctctgtccatggggttttccaggcaagagtactggagtgggttgccattgactcctcccatcttaacccacctaaaaagtaccacctaaaaagcccatactggtatgtgtataataatagttttctacacatttattaaaatataaaatttgattttaaaaatactttatatatgaaaattatatgaaacatatagaaaaattaatataaattttcactttagagaattctgcctcacaaattttaattttagtgttttaactaatcatttatttgtcagtattagaaaaataattgcagcaatatatgattcaattcaattcagttcagtcactgagtcatgtccaactctttgtgaccccatggactgcagcaggccaggactctctgtccatcaccaactactggagcttactcaaactcatgtccattgccttcgtgatgccatccaaccatctcatcctctgttgtccccttctcctcgtgccttcaatttttcccagtatcagcgtcttttccaaagagtcagttcttcgtatcacgtggccacagtattggagtttcagcttcaacaacagtctttccaatgaacactcaggactcatctcctttacaatggactggttggatctccttgcagtccaagagactctcaagagtcttctccaacaccacagttcaaaagcattaattctttggcgctcagctttctttaggtccaactctcacactcatgcatgactattggaaaaaccatagctttgactaacggacctttgttggcaaagtaatatctctgcttttgaatatgctatctaagttggctataactttccttccaaggagtaagcgtcttttaatttcatggatgcagtcaccatctgaagtgattttggagcccaaagaaatagtctgccactgtttccactgtttctccatctatttgccaggaagtgataggactggattccatgatcttagttttctgaatgttgagctttaggccaaattttcactctcctctttcactttcatcaagaaaatctttagttctttttcactttctgccataagagtggtgtcatctgcatatctgaggtaattaatatttctcccagcaatcttgattctagcttgtgcttcatccaggatctaggaatatactggtagaaaactggagtataatctctgcccttccagcctttttggtctagtggaagagagaatctctaagcaaataattatcattgtgctgggtgttataaaggtaaagcagagagacctcgtccactcagaaatgttgggaggctttctgtaattaactttgaagctgaactttgaagggtgagtggacgtttgcagggtaaaggtggatggggtgaaaatgggaggaaacactttagagagcctttagaaggatctgaaagtgttaagagctctgtaagagaagtgataaaagtctgatataatgaaagtttggtattaagggagaaatggcctcagatgtggctgaaaaggtgagcagaggctatgtaatcctgaactatgtatacactattaaaggttttcttttttatccctagagcaatgggatgcacttaaaaagcatggagttgcggatttacagaaagaggtttgcagatatgctgcaaaagcaatctgacagctttttttttttctccctgaag

SEQ ID NO: 41795 - DNA, 1359 bp, Bovine  19866881263533
ctctaactcctctggacagtatagtcaggaacttaggaaaacatttccctattccaaatatgggacaacggtagtctctaaaatggtcacattaattatctctcaaagaaaaaaaaaaaagaaaatgttcaagtaagtattacaagaacctcttctttcttaacactgttaaaaagcaagaaggaaagatataaaaaggcagaaagagtaaaccatccaggtaaaagcataaaataaaatattacctttagctgggtttacttttatccctgacctatacagcatttcctcattctgccagtctccgttcctgatcgccgtcttgagtccatagaaaacaattaatgcagctgtagcataaaaaatcaagctcttgagaaacctcttttggactttgacataaagggctctggcacccactgtaatgaggaggcaaaagcccatactaggaatatacaatactcgctctgcaattacaaagccgacatagaaaaacaggttcgtggcaggaacaaagggtattattaataaagataaagacagaacaactatgttctccgtagaaggaagctgtgttctctgcgatgcattgtttctaatgccattttctagtttggatgcaaagctgggtttaatctctgagttcccgtactccacctctgaatggcagctatgtccatttgcattctgcttgccatttgttacaaatttcccgttgcattctctttctatgcttgggctcttcaaaccaaagtaggcaaggaggaggagtccagtatagaaggccacagtgtgtaagtttctccaatcagaaattgttttgagcagaggcacggcgtccattgaccaatcaaaactgagggtatctgggcatagcaacagccaaaggttcttggttggcaagtagaagaaggtgagcgtgcgagccaggaggctgtccgaatcagcagctgggttgtcagagttggaaaagcttggtggtttgtttcccatccagtataaacgggcacccaaaagggaagttccccagaaagttaacaaactaatgctgagaaaaagagacaagttcttcctctgaaaccaaaagagagggggaaaaaattaagatcatcatcaatacggcacaggaacagatcatttaaaaatgaaaagtatctttaaatggacaactaaaaacagagtattaggtttcaaatacatgactttgtttctatctcctttaaacatgcttatggctcctgtaagctttaaaaaattgactatggaatccaattctgtatacaatttttcatgagtatcttttcctcttgtttctcgctaaataccagtaaccagagcctcaatttctgacctctataa

SEQ ID NO: 41796 - DNA, 1470 bp, Bovine  19866881288786
tttttctaagacaaaataagctttattttcttaaggcgattttctggtatgttttgcttttatgagatcagtaagatttctgtatatttttgcgtacattttgatatttttcttgccatttaggtttagtccatgcttggaaacttttgacctctgattctgttactttgtttaaagaattgtttaaattccccaactaccagacagagaatccaagaagaagagaatgtatacagctataagaaaaaataaattcccaatccacatttttttttttttgccacagttattaaaatgtctgtgaagctttatttatgtgaactctactgaagaagattatttcacataaaaatatttctttatgagggactttgagtggtgattgacttgattaaaatccattcaaaattgggaaggatcttatgttttaaaatcagtgtgtatgtctataggttactaaatattagagagaacacatttaaattgtatctgtaattatagacaagttttgttgttgctttttagtgggataatttagacattacatatgcaaacacagtttattaaatttattaattattaaatttattaaaaatttattaaatctgcattacttattagccaaggatttaaattacattaaatgatttttatgtaaaccaaactatttgtacacctctcttttgtgtatacacattaattttatcctcttccatcaccccattttttgtatagggtataggtacctttttttggtagaaagcaccattttatgttttaggctttgaaattctgaaaaataattttgaatataattttatgccaggaaccagcacatcaaatatgtgttttatatattccacaaagaaaatataacttttccctagtgtcttctcttttccttgctatttgtgtccccttttaattaatatacaacttaaaaatatttagctttcttattgatctgctttcaagcaggtatgtaatgagattttcatcttaaagtagaagagtctcaaaattttgatgaaaattagacttcaaggctgtttcattcttattactttctgtgctgtttgtaacagattaccacacatgtggtgacttaagacaatacgtttatcatctaacaatttctaagggtcagaagcttaggcatggcttagctggttctcatttggaaggcctactaagaaagaatcagcttctgagttttttttagttgttgtttgtagttgtaatcctttagttgtaatcatttccttgtgactataggatccatgttattaatagcttgtttttttgaaaccagtgacagagacagagagggagctgccgagatttgagcatgagttgaatagtaagactgagtcttatacagtcatggaagtgccactccatcccctttcccatacaagtgtgtgtgtgctcagacgtgtccgactttgcaaccccaggactgagcccacc

SEQ ID NO: 41797 - DNA, 970 bp, Bovine  19866881533398
gtagcacaatatatgtgatacatgccttctcttttacagaataagttttgtaacttcaatggtatgtatccataataatcattcagtgagtcacaggaaaattttttgttccctgctccctctaatctaaacatgactgcacggtgattataataaaacaatggaacctaaatgttagtcagtgcaaagtgggaagagttttgctttagagaagacgaaatggaaaaataatctcagctctaaacagtaatcatcattacaaaaggcccaggaagcacacagggctgcacacccagataaactgcactgacaccactctagcctggggtagggaacttttccatggaacttcaagtactttcacaactggagttttatgtagcccaattaactttggctagacatagaaatctggctcagtacttccatgcagtagccaaaataaaggtttgctgtatcaagaattactgtcagagtctcccatatccttccttctctcttactaacctaaatctggaaaataacctaacggccaagttccttttactacaatttagatcaatactaattttactggctcaaaaaaactataaaatatttggctgaaataaattgaacaaggacaaaaggaggaccaaaaacaagtaaggatgtacacacaactgaagtatatacatggttttagaaacaactataaaaccatacgaaacatggtgataatggaaacttattccttcctttctcaatgcttgtccaattttaaattcatggcattagtcctaggtaacaaagttcaaataaggaataaatcacaattttaaagagaacttgtgtttagtattttaactggacatgacattggtatgaaagctctatatattctatagttgggtcacgcaggcccagctatatttaaacatggaggctaccaatgaccctaaagcagaactattttctagggcaccctgga

SEQ ID NO: 41798 - DNA, 589 bp, Bovine  19866881556375
gatgaaatatacatccctttctctattaaggaagaaatggaccaaaagggatttaatagaatctaaacaatctgccagcaaaatgggaaccaaaggtagtcattcaacactaaacataataggctctcatctgtttgaattttcttacctgagtccaaaactgaaagagggaaacctcttctgctatttctcagctaatagaaaggcttaagtcaaaacaaaatttcatgctcttataatcctgaagttacttctgtgagtgggtactgccaattcagaaagacactaaggaattaggaaattttcactccaggaaagatgaagaatgttgaatgtagcagatgtggaaaagaaacaaatgtaggcagaattctccagagaacacaggactaggagattgtctttggaagcaaaaagatctattctctcaagtcttcaaggggggttttaacctgttttcagttttgttcatttgcggctcttggttttttgctgccttatgatttttcctttaaaaaatgttgacaaaggccagcactgttataaaactgatgaatgatgtgacaccaccagcccaactgtccttgtg

SEQ ID NO: 41799 - DNA, 1205 bp, Bovine  19866881911426
agactttggtcagtcagttgacttactagaaatgatgagaccatcataatccataaactgtctatttcccaccactatggcaatgaaatagagaagaaaaatatgcaaattgctcatttatggttttttttattttgctttcctaaattacttctaagcttgctgagtcggatttctataacatctttaattatgatgaagtcttggcttaaaaaagaaaagttgtttagttagagcttcataactggcaatgaaacatttaaccaaagtgcccgctctcaactttgttatatgttgctttttatttggactatgggaacagcatcatggagactcatggaatttgatactgggatcttaaaatgttagtatgaacatctgtaaaataattccaaacaaaactgagcattatgtataaattgcaaaacatggacaaaattctgaatgtatttaagtaatacaatacattgtaatataataaatcataaaatatcagaacaggtaatggattatacaggttctgctctcttttaatgggagagacaatgtgatttgtgatgcaaaatcagccatttgtgaagcaaaatcaaccatttgtgaagtttccagctgttcaattaagagctttcatttctgtaaagtaggaaaactaaaggaaattcttttgaaaaaactatgaattgactagcacaataacacatgtggctttaaaacattttcaataatgaattttttttcatagtagtcttacaaatattaatgaagaattatcatgccaatgttctcacactagggtttaaaaaaacagatttttattcattttaataaattattaaacattaaaaaacaaggacttaaattctgaaaagaaatgattctgttgataggtcctattgtttcagttgggattgtagtaaaattaaaggaagaattgttcttattcaaaatttgccttccaaagatatagtaaaactaaggtttcaaaggtgacaattatactttgatttttttaaattcagatttttgagatcaaagatactataaattctttataattcctcctattttagcagaatgctttttctcactccaagatgattcataccaagctgatttctgaaaccttaatcccatttccgaggacagtcacaagtcctggatgacttagtttaatttgctacagatgattaaggcacaattcaaag

SEQ ID NO: 41800 - DNA, 749 bp, Bovine  19866882161884
actcaatattatcacttcccatctaggtgaatgctctcttttatttacctcattaagtgtgtgagaaaaaggttcctaagttccaaacatggagacacagtttatacagatgtgaatgtaaacaatgggtttaaagcaatcatatggtactccagcacttatggaataatccatcatctgctcaccacacaagttcctcacaagaagaaaatgcctagaagttactgtgtcaatcagcataccggaaaataaaatgataatgatatattactcaatgaaaggaaaactgagcacatgtgcatgtatccagtaaagatttccaagactaatcaaagtacataatcttctctgggcagcaaaataattccctcttcaagacttgcggaatctagtgctctcagcatgagcctaagaaaactatagcaaaaagaagatattaaagtgaagaaaagtaaataaacataagtgaaaaattataactgctacatagaaatctctttctagacaagtaaattcataagcaagcacagttgcctgtgtatttgagatgtgttaagaacagcgacctacagaaatgcatttttaaagccctttgttctttcattattttcatattgacattttttcaaatatggtttttcacaatttctggtatcattttaataatgcatctaatcatggatatcaatgcatattaaagatatatttattatagtagcattgatttgctgactgttgttagtcacaaa

SEQ ID NO: 41801 - DNA, 847 bp, Bovine  19866880668127
cataaaaatgagtatgcttaatacatacagcaggaggaacaggcttccatgtctgtggctccatctccaaccatgacgatcttcttaaagtgaaatttttcctttaacaatttaataacttttccttttccaccagattcagctgttggctgcgtctcatcaaaacctgcatattcacctataaaacagatccacagaattagatcagtagggccacttttttgcatagatgatatcctcatttacatacgactggcaaagctaaaaatggccttccacacagcctggacttccacacttatttctcagaataaacaagctatgcttttaaattacaaacttcttgtcaaggttattcctttaggtgataaacatcttgcagttaattggttttatcttctaagcttccagtacagcaagtctcaaaacttattgaaatggcagaacaccatgaaacagtaatatattaatttaaaacatgttattatataatttcttctaagaggagattctaatttacatttgatggattatttccatcttacagtaattactacacttatactctactcttttttttaatgatttctatcttaaaaactcttcaaaagtgttctagtaacacatttaaatgtttttaattaatgccatttggttttaagaatgccagccaccccctgacataactggagacatcttaagatgacgagaagattacagttgtggctctgtgatggttcagaaaggggccaggaggcacctccaaaggcagctacagtgcagtgacttgctcacaaattaactctccttccgagtcaaacacacaagccaagttggctctaataca

SEQ ID NO: 41802 - DNA, 2075 bp, Bovine  19866880912621
gtgcggccctgaggagatacccttcctccaggtaaggagcagcggctgcgctttgctggagcagccgtgaagagataccccacgtccaaggtaagagaaacccaagtaagatggtaggtgttgcgagagggcatcagaaggcagacacactgaaaccttaatcacagaaaactagtcaatctaatcacacggaaacacctatagatgtagccagaacatcgctacgtactaaagttcatgctgaacttgctgatgtcttaacagagaccgtagtggactccattttggccattaaaaaacaagatgaacctattgacctcttcgtggttgaggtcatggagatgaaacataaatctgaaatggatacaagcttaatcagaggtcttgttctggaccatggagcacggcatcctgatatgaagaagagaatagaagatgcatacagcctcacgtgcaaagtgtcattagaatatgaaaaatcaggagtgaattctggcttttttttttttttacaagagtacaaaggagagagagaaattagtgaaagctgaaaggaaattcatcgaagacagagttaaaaaaataatcgacctgaaaaagaaagtctgtgttgattcagataaaggattttgttgttattagtcaaaagggaattgatcccttttccttagatgctcttgccaaagaaggcataatagctctgcgcagagctaaaaggagaaacatggaaaggctgactcttgcttgtggcgggatagccctaaattctcttaatgacctaaatcctgattgtttgggacatgcaggacttgtctatgaatatacattgggagaagagaagttcacctttattgagagatgtaacaatcctcgctctgtcacattattgatcaaaggaccaaatgagcacacgtttactcaaatcgaagatgtcataagagatggcttgagggctgtttaaaatgctactgatgatggctgttagtcccaggtgctggcgcagtggaagtgcaatggcagaagccctggttaaatacatgcccagtgtaaagggcagggcccagcttggagttcaagcatttgctgatgcattgctcattattcccaaggttctcgctcagaactctggttttgaccttcaggaaacactagttaaaattcaagcagaacattcagaatccagtcagcttgtgggtgtggacttgaacactgatgaaccaatggtagcagcagaagcaggcatatgggataagtactgtgtaaagaaacagcttcttcactcctgcactgtgattgccaccaacattctcctggttgatgagatcatgagagctggaatgtcttctctaaaaggttgaactggagcttcccttgtatctgaatcctgaagactacagagtgatcctaataatatagctatggaattttggtccaagcttcaaatgatcttcaaagaattttcttcacccatattaaaaaaggagagagcattggcacctattcagattctgaagtcctgaaattataattaacagtatttttaaaattgcactgcagtgtccacatacagcaggtcatgcttacccagtaaagaggacattttgttttaccctcagtgatataaaaatattagataagcatatgttatctaccttgttattaaatattccttgaaaaacaaaaaaaaataaaataaaatacaacaaaacaaagtggatgaaacaaaattgttcaaagatcttagaatagcaaccctttaccaacctagatgaaagtaatttactaaccaggacataccggttgaatataaacctggggtacatgaatataaattacattttcctctgcttctttgcatgagaagcagaaatacaattgggaaaatgtttttgactattgaatataatgtcttgagtacaggggggttcactatactgttcttatcttttgtgtatatataaaattcttttaaaaatacagtagtatcttcccatgctagctgacacacaaaaatatttttgtacactttcataaattaatcttataaatttaccatccatatttagatctccagt

SEQ ID NO: 41803 - DNA, 1194 bp, Bovine  19866881273860
tatgcagttttatgtcatttaaatctcaacatgcacacccccctccccccattcatgatcttggaagaatctgctgtgagcttactaaaatgcaggtcacagatgactgtttacaaaataaaacctcttttcctagtgctactcgttttgttgtagaaaaatattacaaataaaaattagtgctattcaaggtgttcatttcaaagtcacatatgatacacaggttcaagccgtcttttcctcgcgtataaagacaacacaatacacaaagtggagactgaattacccatcaaccacttccccctcagtaacgacacagtttactatgctgacattaaaaatgaaagtgaagcaaaacatttccaggtattgagtacacttataatttgttcctagtctgaaactcagaaaaaaaatgctacagaaacatgatgaaatttatatttcttcctgatacaagaaatttgtcttaaaaatctgtaattataaaacagatttgctctttataaagaaatagctaactttttttttttttcccatggttagattcttacttggagatgactccaattttcaactgggctctcttttcctggggggtagggagaggtggctttggtgttaatattatacggtacattcgacaaacttaggggatgtttccgaggactacaatcagccaagctgtaatagtttcctgtcttgtgattatgtaaattttaaagaaaagaggtctcttacaagctatatacagcagtttacacttcagtgtttctctctcacttgtaacacagttcaagttgattgatgacaagcacttgtcacataaacttctgtaggcacatctccattccgtcgcttcactggaggggcgaggtcttctgtgggatcatgattcgggattccatttcctgaataagtgggactgaaaacaagggccgtaatcactggggctcactgttttctaaacagatggcaataaatacatgctaacaagtaggctgctgaggatattcattcagaagacatgctgcctgaaatcagtactggagtactaaggactggtctcgggcagaaatatacaagctaatgacagatcagctgacaccctatcatgtgtcattaaaatattctgtcaggagatgtatttcatgtgctggaaaccagcaaagtctatattgtgagaaaaatggt

SEQ ID NO: 41804 - DNA, 1050 bp, Bovine  19866881329465
atgagacgagaagaataaagcgctttatgcctattaagatattacctgtataatacactagttcttcccagccatgtttatgccatgctgcgttccgtatatcctccctggtctgaagatccttgtaagcttaaaaatagccacacagaagaattagccaaacataacgccctacattccactagtacaggggggaatgactccaggacctgccatgaacaccaaaacctgcaggtgctcaagtcccactgctggccctatgtacccatggatctgcaccctcggattcaaccagctgtgggttggctgcatcgtactgtgtgtatcaactgaaaaagatccatgcggttcaaacctgtgttgttcaagggtcaactagatgtccagtaagtgctgactcagctgctcatcttgttttctcaaatagcctacgttatcttccttgacttacgatggggttacgtcccaataaacccatcataagctgaaaatattgtaaatcgaaaatgcattcaatacatctaatccacaagaacatcccagctgagtcttccttacctcatgtgtgttatgtgtattagtcgttcagtcatgtccaactctttgtgaccccatggactgtagcccaccaggcttctttgtccatgggattctccaggcaagaatactggagtgattgccattcccttttctagaggatgttcccgaccaagggatcaaaccctgatctcttgcattgcaggcagattctttaccgtttgagctacagggaagtcctttcctaccttaaacgtgctcagaacgctcatgttaccctacagctgggcaaaatcatctgatgccaagcctattcatatcaagagtttagtgtctcatgtaactgaatactgcacagaaagcgaaaaccacaatagttgtgagcgtactggctgttcacccttgtgactgcgcagctgaccactgccacagcccagcatcatgagagactgtaccaaaagcctgggggaagagcacaattcacacttcaaagtttctactgaaaagggatca

SEQ ID NO: 41805 - DNA, 924 bp, Bovine  19866880385336
tcatgatgtcatgttttaaaagtccttttctgctccacccttatataattattaatctgtactttccttgagtgctttttggattttgttctttacgtttaaaattttaacctattttgctgaaagtataagttaggaattcaagtgtgtagttttacaaatgaatagacagatgctccttttccagcccttctattattattatttttacaatacttgtgcatctatcttgggatacttatacgtaggatacatttctagaactagatttcagtcaaaggatatggacatttaaagttaataaatattgctgaattgcccactaaaacattgtaccaacttgtgttcctttatcattgtattttgatacctgatttttttctatgctattatccatatgagttattagtaatctttttaatttttgtcaatctcattttggtgttccattaactggttgacagttacttttgtgttttaataattgattgagaatcttttacgtttcaatgtcatttgaatttgttttgtgacttacttacttgatcgtgtttaagtatggtttgtatatgtatttcaagcccatgacaattactattgttagaagggactctttctcaacagtttgaatgattaatgttgatctctctcctttctgtttcaggataccatggccaagcgaaatacagtgataggaacacctttttggatggctccagaagtgatccaggaaattgggtacaactgtgtagcagacatctggtcattgggaataacagccatagaaatggctgaaggaaagcctccatatgctgatatccatccaatgagggtaaggaaatggacagaaaaccagtgggatggtcagttactggtataatgagaaacgagttaaatgggtgtctggttaggtaccaaacagta

SEQ ID NO: 41806 - DNA, 3427 bp, Bovine  19866880426417
cttgccctctttctttccgtgtgcaccagacactatgttctgtacttgacaggccctctaagcctcacagctgcccttggggagatcctgttgtcctcctttgaaaaagcagacaggtgaggcacgtagcagacttgtccagggccgtccagctcgcaagggcacagctcccgtgggaccagggccacctgcctcaaagcccctgctctccccctaaacctacccactcctccagcagcctttctggatgagatggtcagagaaggcttgctcgagttctctgaggagttcacccctgagcttaaaggagttcaccccttatccttccttaaaggataaggaagaactggggacaagctatccaggcagaaggatcgttagctgcatagcctttgaggccagacaagtatatctgacaatgtgaaataaagcttagctagagggtcctgagcagcagcaggtaaggaagttggaggggacgacaggccagaggtgtagggccattgtagaccctggtgaaattgttggatttttttcctaagtgcagtaggcaacataagggcagctcatttctgtatttttaattgtttgcggctaggagatgctggtggcctgaattgaagtgttgaaggcagagatgaaaaaaatggttggctttgactcgtacgagtatttcagagatcaaaggactgggtgtgcagacaggtggtgacagaaaggggagaatcggggatgattttgagcatctgggaggatgggcaccattcctgagacggggaagactggggaggaaggagaagaggttcggagatgagggaagggtgggtctcaagacttttggtctggatgtgttgaggggctgagatagctggcaggatctgattggggtgtgtgagtcgagttcagagaattctgatctaaaggtagaattgtggagggcgcagggtagagaggagatgctaaatggtgaccctccctttggctagtgaaaaccccgcaagctgcctgtgtggtcagtgtgagcatttactctctcaggatgctggctgccacagaacttttactgcaggaaatccatttgaaatttatttatgccaccaaggaccacgatgctgaaatgctatactcggagccataaagccattctcttgagctcattttcagaaaaatctgtatctggatggtgtgactggctgactgtgttctaataggtcaggtgtaaatttaagctccaagggccttagagcaatctgaaggtggctgagataaagtcagggtgtttcttattgcccaaagattagaatcaagggcaaaagatccccaaagacattggaaacctagaagaagcctcgaccagagacacccatcaatgactctgtgagaatttcactggcaggaaaacaagaaggaagatgtaggatcgggcttatcccacttgagggcttattagaaacacttgaagagcatctttagcgtctgaagccctgcccctcccttcccagggagcctgatgaagtagctctgactggggatgcaggagtctgtattttcaacaagtgattctgatgcaggtgacccatgggttgtactttgagaaacactgaatttcaaaagacctttaagatcatctaggcagccctttcttacaagtggggaaactgaggcctagagggaggagggacggcctaaagtggcaggacaagctggcgagccagtgcagttccatcactttctttttttcttttcatttctttttaaaagaatacttgcttgtttttatttatttatttggctgctctgggtcttagttaccatatgagaaatcttcagtcttcgtttcagcctgtgggatctagttccctgaccaggggtcgaattcgggcctcctgtgttgggagctcagtcttagcccctgggccaccagggaagtcctgccactgagtttttatccgaatggatggaccagaagtaagcctcccaccccaattcccaactcccctttcttcactgtatgtttttcttttctttcttgtattaccttctaatctgagtcatttactagtttactgtgttacttggcgtatgtctgtctcacttcactaaaatgtatgcttcacaagggcaacgatttggggagtttttgtttttcttttcactgaagtatcctctgtgccttggacagtgcctagcccatagtaggtattcagtgaatgtttgataaatgaatggatgaaaactattttgttaaactataaagacttgttttaacaggcattgtgggaaagtcccaccccttaggcactgttaacgcaaaatagagtaatatagtttgattttcactcgtttgactctggtttgagtcagagattctaggaacagcttgttgataggagatttgttgtttagtcaccaagtcgtgatgggaggttagagactttctaataatattgttaataataatgataatattaacagcaacaacgatcacagttattaataacattgatagctaccatttgtgagtgctaactatccaccagatacatgcgacgatgcagtcctgcactctggcgccacacctgttatgaactcatctaattctcacttcagcccaagggtggaggaactggtattgtctgttttccagaggagaaaagtgaggcccaaagaggtcgagttatttgtccaaggcgacacagccagtgcagttaggatctgtcctgagctattaacaacatccagttttaggtttgaggtgtcctctctttggagaagggctccaaaaaaaaagccaaagactaggcaagcatcgctttctggggtgtccttgggccaagaataccaacctccgagatggtataaagccacacaggctggaagcaagatggagtttttcagctcgactttccagcattcccccaccctctcgagtctttccattctcatctcacaaagaacctttcgtcttgaactatgaggcttttctcacgtctcagaccacctccctgaaacgggccaagggacattcctgtggtgactggtcattaagccatttctgccgagcccactggagcgcttcccactccaccctctaaagggagaggggacagaaagaggttccttcacccacctttcgacccccctccgctgctgaggcctcaggaaggggccggggcagccgatgagtctataaatctcctgtgacgcttgagtgaaccttttgagttcctgaaacacggcgcctgtcaaccggccgtgagctcagaatttcccaccacctgctgtggagaatgttggcactcattcccacccctgcacgcctggcctggcctcgctcggatgcagggaacactccacacagacggccatggccacgagggcacgtgcccagcagctgcagacacaggtgggagatggtgcccccctg

SEQ ID NO: 41807 - DNA, 1758 bp, Bovine  19866880448051
tgttcagacatttcccaaatgatcatagggtgtgtctggatgcaacatcgtacaacaggtactcttgcattgagaaagttctttttaatccttctgattacaccagcaagaatatcccagattagagatctcggtctttaacgtctctttaaccctcgttaatcttcctttatcacaacagaaacatagagcaggcttcatgctcacagttctggcaggtggcagtatctagccagaatctagtattattatttcatatcatttaattagacatgatttacttacatggaacttaattgctttcattgcatctgcttttacacttacattctgtttgtgacaagtgaccctgcttatcccatttaaagtagtgatatccagtttttcttctcaagtaaatttatttttacacaaaagtgagtcccttggaagaaaaacattaggtcaataggagtacaggcaatacacaaaatattatgatgctattttgcaggtatggcaaacactgtgaacagattgatgtttggaaaattcttctagaacagtgtttattaaaaggttggaatttccactggcagaggggcttctctctgggttgctgtgtcccagaccccacccatcttcatatcttcctgcagagaaccccatcccgaggttcagagttatggatcctaagccagaattagcctgaggagagagaaggaaaaggttaaccccctttccataataaagctctgggttctgggcccaattccctcatcgaggccccatcagcccagccacgaaggcaggatcccccgccctccttcacaagggcaaactgaagctccgagtgtttagggctgtggtccaggtgatacaagttcagcaagagaacagggacccccagttcctctgtcatcctagaggacccctcccaccccatccacttttccagtgctggccacaggaggcccaggcttctgggaaggttcctgttcagctggttgaactcgaggaatctcttagggctggggctcagagagggaaggagcttgcccgaggcacacacagccctacctcagacggggtttctgcagtcccggccgcaggcacccgggcagcaccgcttgcggccctggcagtccgagtccttggagcacaggtgctgcacggggctaacgcagcgcagacggtcgtcggggcatctgcccatcttaactgcaacacagggaccgggtgagccctgcctgtgccccggccctggggtctggggtctggctggcactcagcaaggtggagagggacccttacctgaaaccttccggacacactggaggaagcacccttggcgacagcacttcatccccgagggacactggctgtcgtgcagacactgatcaggcacggagaggaggcagggcccgtcatccggtgggcagcccccagacttctctgtaagagaactccccaaattttgctactggaggcagttcagaattcagtataagcgctgtcctggggatcgcgcgatctaaattctccattccgtacttctttgcccattgtttgcaacttttttttttttttggaatggacttgctttttttttttaattttttattgacatctaaagtgaaatgtaacattatgttagtttcaggtgtgcaatgtgatgatttatttttgtatgtcctgcaaaacgatcgccacagtgtctcattaacgtcggtcaccatacatagttaaattgtttttcttgtgataagaatgtttaaa

SEQ ID NO: 41808 - DNA, 1565 bp, Bovine  19866880462992
gctgggatcctggctgcaggggggctccccaagaccggcccccaacagagtcccctctccaattcacagctctccttgctcttccaggagctgacatggacccaaatcctcgggcagccttggagcgccagcagctccggcttcgggagcggcagaaattcttcgaggacattttacagcctgagacggagtttgtcttccccctgtcccacctgcatcctgagtcgcacagacgtgagttctgagtcctgggaagaggcactggggcagggcagggagggagtcccatagtcctggaccttggtccctccccgctggttttcttggccctttaaacatctatctccttacctgacagatgtctctgaccatccaatcagtgctggcctggctcctcccgacttgcccccttcttgatatgcagcccccataggtagtatctcatccatggaggtgaatgtggacacacttgagcaagtggagcttatcgacctgggggatcaagatggagcggatgtgttcttgccttgtgaagaccctccaccaactccccagacgtctggtatgtccctctgctttgggcccatgggcactggtcggtcagagctggatgtcaaagctgggctggggaagtctgcacggaggggctgggcatgagcttttccacccacgaagcacctgcttgtcctgattttagggaagttgaccttgggggaagctgggttacggattcctaatccaaacctctcagaaggcccaactgccttagtcttcttcaattttttatttttgaaatcaatgtaattagttaacataataaataatgtaaaaatatgatctttagattagacaactgaagcagttttagtcatttaatatttatttagcactttattaggtttctaataccatgcttaagaattctacatgtattatctcaatccttactatgtcctattagggcaggtggggttattcccaccttataaggaaagacattagagggacttccctggtgatccagtggttaagattctgtgtgttccactgcagggggaatgggtttgaaccctggttggggaactaagatctcgcatgtcatactatatatatacatatatatatatatagtcacagagacgaaaagtggaaaagctgaattcaaaccatggctgtcttgactccaaagtccacatgcttaacctataagatattaatggatactgctgctgctaagtcgcttcagtcgtgtctgactgtgtgcgaccccatagacggcagcccatcaggctcccccgtccctgggattctccaggcaagaacactggagtgggttgccatttccttctccaatgcatgaaagtgagaagtgaaagtgaagtcgctcagtcatgtccgactcctggtgaccccatggactgcagcccaccaggcttcctcggtccatgggattttccaggcaagagtactggagtggggtgccattgccttctccgattaatggatactatcttactttaaaagtgctgctattattgatggcatattatgtgccagacatttta

SEQ ID NO: 41809 - DNA, 979 bp, Bovine  19866880480269
ctcctataagtgccccctcctcagacaccggggctctggccgcctcacccgcggggctccgacgcgccccccgccattggaggtggcgcgcaaccttcctgctccatctttgtcttggctgcatcctgagactcccagtgccagacccctgccctgcgcccagggccttgagcgccccccgtttgtctctcgtctttccccaggggcgggggcttcgggctccagggctggggtggaccttgaggggaccggccgggggacggcctttcctctcggttcctcccggctggtcccggagggaggcgtagggcggcgccgactctacacctgcgcgcccttcggagtgtgcctctgatcccgggtgctcttgggcctggagtggcctttctgggtgggctggaccgggccaccattcatcggccggaacctcaggctcccaggcctgcgcgcaacctcggccagagcccaaggggcggggaaatgtggagaaaccggctcctggaggccctgggaccagacagaggaaacagaagggcttcggatacgcttttgcggtgaggaagcgaatccaccaacaggtggggtagctagagggctttgggtgagagttccccaaagagtgccagagagggagtcggaatcatgttccggtcttgggctcgcttatctccttattagccgtgaccttgggcgagtcgtgccgcctctagcctccatatactggtctgtaaaatgggatgatggtacctcagacacaagggttaagttacaagtgttttgtatgctgatctgagagtattttagttcagtgaggggatgaaaggggaggggagtgtgtggtggggaggagcaaaatggtttcctgacattttggggaacttgatgacaatacggatgagttctcccccaaatacatacacgcaccatccaaacatttttgtccacagttttagggagttcaagggcccgcttaagactc

SEQ ID NO: 41810 - DNA, 1876 bp, Bovine  19866880550145
cttggacacactccctcctctcaataatacaaaatgtattgcatctcgcgtatgtagtaggtgacactctatcttccctctcaagcattgccttttaatctttggacacgtccgttacaggtagagcccatttctcagctgcagaaactgaggcctagagaggggaaatggcctgccagcttgaagcagagaggattgggagaagcccaaataataggcatgataatagtccctcctttacagggctgttacagaggtgttgaaggtgttggcgcatatagcaagttctacaaaagggtcatctgttatctctctccataacccccatttcactcccagtcaagaggttttgtcttctgccttgggatgcatattagggtcagatggctccccagcccaaaggcagggggactcccaaagcactgaaaacaggaaattccctcgcagtccagtggtttggctccatgctttcaccaacatcctgcctggggacttccctgagggtccagtggttaagacaatgcgcttccactgcaggaggcatgggttccatccctggtcagggacctaagatccagcatgctgcgtgcacagccaaaaaaataagtttacaaaagcaggggggaagccttcaaaggaacaaaacactaatgatgggacatggggcatccaggtgagctgggaaggaggcatgcagatggcagatgttcagccccagtgcctgaaacatctggcagggagcagcagaagggtttgccctctggtgggggcatcagaagtggggaccaggccttacctcgtcagagtccccccaccccttctcccccacacccaggattctcacccatgctttagcagtacctgccatcatcactcacacctttctcagagaggcaagttgaggttgattgcagctcgctccttcctctgaccccacccaacccatcttaaaccctacgagctgattcactctgctggacagactcctgggctcctttccctggactctctcagtgctcccaagcctgccaagtgggcccagaccctccctgaccccaccattcccaagacaccacagctggtgggagaagggacaaggaatttatccctttgtggctagtgtccatgactcggcccagagtgaactctatgggggcccaaggcctaaggcccatccagcccctctaaagtggggagaggggttccctgctcccctccctaccctttatggcatggcccactgctctcacaggcacatccacaaaccagggttccttggtgctcacaaaatagtcacagtgttggagtataaagctgtttccattcaccctgcactcatgtgctgttcacactaggtgcctgtgggtgtagatacaggggcccatttgacagccaaggttcagagaggttaagccacctgcctaggctgctcagcacaggcattgctaggatgcccatttgacagacagtgaaactgagacccagatgggccaaatcagaggcagaagcagaacttggaggacagccaggggcgcctccagattcagaactcttcctgtctcactgcctctcattaaccggcctggaggcggccaaggacctgagctgagggaagaacgcgcctgcagctgccccatttgctcccggggcagtggatacccccaagctctccagccagacaaggagccggaccccggaacccgagcccccgcccgcgctcactttgggcttgttgaaagctggcgtctgggccatggtgccaagcgtgcgctccggcgctgctcgctctgccgaaagaagatcggtggtccccgatgggtcgatggcaggtccgcttctccgggggcccgcagtgaccgcggcccgccacgctcct

SEQ ID NO: 41811 - DNA, 1021 bp, Bovine  19866880677194
aggtgaggtaccagtaacctagctgtgcgtcaaacacccctggatggctcgttaaaaacagattccagggctgggcctctggaagctctgaattgataagtcccacaggaggccaagttttcctggcttatttgaggctcatctggaaacatattctagattgttccaaagatcaaaaacatccaatgatactgtttgatttattcagtcctcaggataaatatccacagtcctcctgctagaaaacgtatagtaccctgtcattttaatcctctgttctgttggttttgcctctgtaagttcccagaaggcagaggctaagcccgctattataattcacataccagtcatcatagctaaatgcatggagcatctcctgcatggcaggctgtgaactaaaagttttatatgcctcatttcatgtgctcctcaaaacaatcctctgagttatatattattgccccctcttcacagatgaggcagttgaggctcagagaacttaagtaacttgcccaaggctgctccgctaataagcgacagagttaagacaggaattctaatccagagcccttgctcatgaccacaatgccatgctatctcatacagagtgacgtgggggtgctaggggttcaaggccaggtctatgtcactccggggccaaggtgtgatgctacactgcacagcctggcagagaaggagtcagtcgtgagggtctcactgcccaccttgaatgaccttggctgaggggaggtctctgtctctgcaggtgtgtgcccagctgtgccccacaccatgtgcctgtccctggccaccaccccgatgcccacccgggggggtgcccctggtgctggacggctgcaactgctgccgggtatgtgcgcggcggctgggggagccctgcgaccatctccacgtctgtgaccccagccagggcctggtctgccagcccggggcgggccctggaggccggggggccgtgtgcctctgtaagcaggtttgcgggtctggtggagggggtgat

SEQ ID NO: 41812 - DNA, 2098 bp, Bovine  19866880729481
gaattcattgtctaatggctatttatccagcacctgctataatcctgcttctgtacctctgtctggtccttttcgctgtctgggcaggaaaaacaagtagttactaaatgccctatgctgtgtgccaggcaccaaagggtgaattagatctagttttgctctggaggagttcacagtctcagagtggggactgggaataaatagaaactttcagtaggatgtagtaagggctggctgggttccagaaggctgcctggaggaggttatactcttagctggggaggacgaggtaggtaggagttgctcaggagactgtataagcaaaaggcatgtggtgtgaaatagcagtatatttctacggtttaatattgatctctttcatcctttagcacaaattcagagccaccattctgctttctgattggattttgagcacccggggagaaagcactgggccatcatccactcttcccccacagtgccaggcatactgtgggtgctcaatgtatatttcacccaagttcccatccattatcataatgatgatagctaacgttcattgtttttcagatactgttttaaatgctgaacttgagttagctcttttgcttctcaacagccttctgcagtagataatattatctttactcaagagaacaactccctcaagaccacacagctagccagcggcagagccaggattcaaacccaggccacctcgctccagaatctgcacttaaaaccatctcactatacccactaagcattccctggccctgtcctcacaccagcggccagccagcgcactgcctgaatctgagacatccttcaacgtttttaacagaaagcaaacaaggtgcggggtgggagtgggcttgagtcacatcaactcaagttcaaatgctggctggaccacttttctaggtgggcaaacctaagcaagtcatttggaaggtgatgggccccaatatttctttttttcttttccttttttctggtcccactgagtggcatacaggatcttagggttcaccaaccagggatcaagcctgagtcccctacagtggaaccacagagtcttaaccactggactgccagggaagtccaaggccggaacatttcttaaacgaatggatggatgttccgcgtctcatttttcctcacctaccactcaccttacaaggatgagcatcaaacagggtgatgaatgtacatgcctgccaagaaaggccccctttccccagcttctcccttccattttccagggagggtgatggtgttattgtcattcaggcttttcccccctgtatttttaaacccattagccccggggtttatcacttggcatccagggcttatctccaactgtctctttgatcagctatgtgtgtctctcccctgttgggctaggctgttcctccagaacagacacttgcaatgcacatcaggcactgaataaatatttttaactgaatttcctctgcctttttattatattttgtcttcggttcagcacatgccagctattttggggacccccaacctcaaattgggtacctaagccacacccattcatccagacccggccccgctttcggctcagactcccaggcctctccccctcccccttcccaaatcaagcagcttgcagacccggggcacctccccaaggccgccccgcggccaggccccgcccccgctcacggtcggtgtttttcagcgactgtttcttctgcgagggcttggagatgaccttgatgaggcggctgtggaaggtgcccagctcccggccgcctcggagcatgagccgcaacaccagtcggaagtgcttcctcttgtctgcgtccgagatgtacagagtcttggcgcaactgaattcctaccgggttcgcgaggacaggggtcgtctcatcgcagccctaagtcccgggatgagcccacctcccccagttatctgacgcccgccccgtcggacgtaacatgacaggtccaagctcttggactcagcctcaaggcagaaacctggtctctccgcatccccacctatcttttggctcctgcagggggagtgaaggagccccctcccctctccggtccc

SEQ ID NO: 41813 - DNA, 2052 bp, Bovine  19866880736322
aaatgagtaactgactacgtcctgacagttcggaaagcttagtaaaagcccaaagcaatctctacttaacaatctgttttgaaggcctgatccaggaaagaacgcttaagatagtctcataaaatcagaggttttggtcaccctccagggaaaaaagtcagggctaaaatgtatccttcactaccacagaaagccatccaaatggtttataactctgcacagaatccagtcaatcttgctcaggttctgctgatcaaattaattttgaattagcagtctggtggttttgtatcctgctggacccattatcagacaacgccagagggctgttagctctttgtgctgcactggattctatttttaatttctctgatacatcaaggagaaaaatctaacaggctgctaagtatttccagaaaaacaaaaagggggcacactgggcactaatttactgaagggcacaccactgcccccctgcccccttcctcacacacccacacccacgttccaaacaccacgacttctgacttctgtccattccacatcccttctgcctccatacacacacacttccctccctctccaagtgtctcagcctgcagggccctctccctcctccagctgcagaattcttattcatctttcaaaatacacttcaaatgagatttcttgatgctgtccttgggttctttttcctgaggttcttgctccctcttctgggctcctacagcattttttttacaagtactgtatgaacagagtcccttggactgcaaggagatccaaccagtccatcctaaaggaaatcagtcctgggtgttcattggaatgactgatgttgaagttgaaactccaatattttggccacctgatgtgaagagctgactcatttgaaaagactctgatgttgggaaagattgaaggcaggaggagaaggggacaacagaggatgagatggttggctgtcatcaccaaatcaatgggcatgagtttaagtaaactctgggagttggtgatgcacagggaggcctggtgtgctgcagtccatgcaagtcgtaaagagtcggacactactgagtgattgaactgaactgaattgctttttagacaacttccagcaagcaacgtgaaaaatgcaattaaactgccatcatcctggaggcccgttatatttttatagtggttcatatattgtcttttgaagtaataattttagtgatatattttatgcaaaaatatagcataataatacatgaatacttaatatatgcttttcttagattgaaataatgacacaaagatgtatcacacatgtcttatctataagtataccctatttgctagaatctgtgaaaacaactatgaacaagttctatcttaaatgtaagaaacaatgtgagaaatgtataaatatgtaaatatttacattaagagtacacagtgtgacatatacagtacaggaggtggtggtttttcacagagatttgcttcagaaatatgtgattcaaatattgattatatcacattctagtgttataaatttgatctctttattcttcctaaattcaaatatcatcatgtaagtggaatttttgtaattaattgcaacaatgtacataaaattcttaccacaataaattcttatttttagatctcagcaatgtattttaccagcattattaccataaaatattcacgctgcaggagggtaactcaagtaattcttatggtatcggtaaaatgcatagaaagagtagggattgagctgaaatataaacattttgcaaatattctttaacctatgaaaataagtgttggaagaacaatctaagtagaagggagagaatatgccaatctcatgggcattatgcatgtggagaactgttgactatgactggcatggagacgctgttatgaaaatgacaggagttgagcttggacacgagatagaattagaacatgaagagcttcataagtcattttaatgcattcagattttatcctgttggttgatggtggggcatgaaaacattttagattaatcagattttc

SEQ ID NO: 41814 - DNA, 1351 bp, Bovine  19866880743600
tgtccacaaagtccgagggaagtccccgtctggacaagcttgatgaaatcacacacatggtcaggagagaggcatagggctcccagccaaggtttctggcctcagacaaaagcaaaggctacacacagggagtaagcaaggcgtgagggtaatggagatggaaggaaataaacagagataaatggaactgacagggcaggaggagagctagagcctgaggcaggaaaacagattaatggaaagaatcagcaagagtcagactgatgcctggagaaccagagactaggaaacaaggcagggagagagaggaacaagaacagcaatggactgagacctgggctgacagatggcagagtaaaagaagagttttcagatgctcagaagccctcacagagaccctggagcccaggtggacatgaacacactcctagggacatctcctgaagctaagctcagagttcacagtctagagaagggtacattcccacaccacctctgacgttgcagccaagatggtaccaaggtatctccaactcaccattttcagcaccttccacagcccaaagtgccaggcttcccagggcaagaagcatgaaggggaagaggccactgagcttcatggtgagggcaggggtgatgctgatggccagacctcccaatttataccttcactagtgggtgtggcctcaccagcatttctttggcccctcccagcttccatggcataaacaggaaggcagagaccaggaagcttgatactagagagacagtggctcattcctgtcccaggcaagatggcaaggccactgaaataactgccagggaaaaaatagaggagaggcgggcctgggagatgtcggcaggcttatgaggaaactatctcaggtgtccatctgaaccctgaacattgtgggggccccacgtcccttagccttgttagtggagatggggttaaaatagaaggtcaactgcaaagatgctatttagtcctggattcttaggtaagatgttgggaaatgcaccgctagttctcccactcttggactcccagggaattgtgaaactctctactgattgctcagtgcaatttctttctcaaatttcagataacattgagtcaagctgggatctgggaactgggacccgtttctaagtgcttgcacctggactaacggctcctagagcaacagaatacaacgtatctataagggactaaaaataactacccacatgcgtagttggggcaaattatgaacaaaaagatacaaaaagcccaaaaacccaactgccacttctgagatgtgaaatggagcaataacagggtactacacatgcactctgcacacagcac

SEQ ID NO: 41815 - DNA, 1844 bp, Bovine  19866880747421
ccctgtcctgggattcttagccagaatactggagtgggccactatgccctcctccaggggatcttcctgacccagggatggaacccaattctcttatgtctactgcattggcaaacaggttctttaccgttagcaccatctgggaagcctatgaagatatatatgaaacaataaactcattatcccaaagtgaaataaataaaccaatgaacgaagagctgtgttctctctcttgggatgttgagacactagctgggaggctctgaatgggaaccaataataatagaatggagaagagctgtgctgggctttcagggacaacgtggtccagcccacctgttttacagacagggaagctgaggtctccaaaggtccctttttagtgcaaggtcacagggactcaagtctgcagtagatgaggctggggaacaccttctagatgctacagaagcaccatcctagaggacttgcccaatgcccaggaagaatctatccaaggacattggtactgcctccaggtaagaagttcagttcttgcagccaacacctctggcccagggtgcttcttattccaagtaatgaaaagcacaatgcttcccttaaccctggggaacagggcgccttctctttcagctgcagctataaattccagcttcccagcctcaccccagaacatgaagctactcacaccatgaagctcagctgcctacttgccctttgcctcacgctctgcctggtgggcttggcgagctcaggagagacctcaggtgagctaaggtgctggacacagggtccctgatcatagcctggtgggggagtattgggtccaaccagccatctggtcacttccacctcaggagaaaacaaggacctagacatgggaagaggttccctgtggtcagcattcagactcagaaaaatctggggctagacctcccagatgtctctttgacatcagcagattttaatttttcttaaaaagcaagacatatgtttttttaaaaaagacaaaccatatgtaaatgtgtgaagtttaaaaagtgggttccttgttttacacagccccaacaatcctgctctccagaatcctactccctagaattcttaagcaagaaaagaatattgatgatgctttggacaggaggccagattctcaaacttggctgcacacgcaagtcctctgaggtctctctgggtcccacattcaaaaattctgatttaatgggtctgggacaaagcctgggcatcaggatttttttttaactccctcaagaggttctattctaaccaagattgagaatttgctgcctaaatagaaggtctcgagttcctttctacaatgcctcttccctattccaggttaaacttctaggaaatccagcatggtcaaagtcactctcattggggattcacaaaatggtttggtggagctgagttgacatttgtgcttataagtttgaggaatgctgtccttattagggaaagtgtcattctcaaagtgctgtgtgctatattcataaaaagatacactgaggtcctgagtgtccaaggcagatggtgtgggatgtgtgtgtgtgtgtgtgtgtgtgtgtgtgtgtgtgtgtgcatgtttgataaatcactgagtttgatacccagagctagatgtgaaaggagttaaaatcacaagtgattcagtaaaagaagcctgtttctttatttgctgattacccatgatattaaagattatttaatatgaatatcttttttctggcagtgaaaaatgaaacttgcccattgtcattcaactgacactaaaaataattttagaaaataaaaatcatttgaaattccaccacccagag

SEQ ID NO: 41816 - DNA, 3451 bp, Bovine  19866880792513
tgaccctctctctctcatctcagggacttttctcctcctctgcctccccctaatatctcttcccgggggccttaacaaccatcgcttcaacatttcttttaagagttgttggaaaggcaccagttttggagaatgtgctcagagggtgtagatgccccccccccccaatgtcatctgtgtacccccccttgacagtcaagcccactgtcttcctgtcaaagctcaaattcccaccctcacccccagtcccctggaatgactgactggaattccctcccgaccctccccatttactcgatggggcttggatttgactctactttggtgttagggcctcaggcaagtcccgggcctcagtttcctgctcttgaaaaaggggttaattatccttgtctgagcatgtctcagcattgtaaaaataaaactgcttgaaaggcttgttctcctgtgcacagtgtcgtagtcttcctgcatcttacagcagccggaagggatagctactgttgtcgatgtacccattttgcagatgaggaaaagccaggcagcgtggtgtagttttgtgactttcttgggttgcacagtagtgattcaaacccaggcgtgtttgactccagagaccaccctctgccccccggcctgaaatgagattccaggtgggaaagggcagtgtcaggcctggcggctgtgcttgggctggccaagcagccactgacaaaggcgagggtatgagggcctgttcagcttcagatgcgcccctctgggatctgccatcccactccattcaccccagctctctggagtgccttcctgcccatcggttcctggatgatccccgtcacagggctgcctggcctccttgaagaatccagttgtctgcctcagccctgggggccgatctatcacctgcctctccagaccgatgtaggccaatgctggattatatttaacgctgtgctatttccacttgacagctccggagcgccatcccccctccccttttctccttcctcccccctccccttctgattcactcggaaactgacaaggctgatgtcagcgccttattcttagcccccgtaattgtaactgcatttagcagtgcgcacttcattaacagtttctgcgacgggggagtgagatgactgcgtggctgggcagggatgcgggtgggggtgggggaagggggcagctgctgcagggaccctggccaggtgcctcttctggatggaccagctgggtggcttccaggtctggctttcctagactagcgatcttcgaaggccccttggagagcgtctagtccatgctgttctttaggcaaggagggaaactgaggctcagtgaggcagagcaccttgccaaggtcaccgttaaggatccaggcctctggcctttgagtctaggttttcttctttggtgttattatttcttcaactcatatttaattagctgctcagtgccaaacatctctttaggtgctggggctatatctggggaacaagtcagacagtttctgctctcgtggagctatgttctggagtggaagagacagataataaacagggaagcaattaagcaataaatttcagtctgtgttaagtgaaatgaaaagacaggttgatggagtaggacatgaaataaggtagtccggaaaggctcactgaagaggtgacagatgaggcctaaatgatgaagagccagccatgggagtatgaagggcgagagggatttaggcgtatggaacaggtggtgcaaaggccctgaggtcagcatgaatttgggtgtttagggaatagaaagcagaccagtgtgattaagctgcatgaggggaggtgaggtcagagaagcaagctgggggcacaagtgagccttgtagacactgataaggaatatgaatgcgggtaactgaggttcagagtgggaaggagaaagacccccagctgggtaaagtcagagagaagccaagagctaccgcctcctgaatcccagtcttttgagttccttagacacaggtgactttaaatgcgtcatgtggcttcctttgccattgtagctggaaggtagtgtggagtctgggcttcttctgcccaggcaggttctctctgcttgccccttctctcctcctcagctctcatctgacccagctgtattgcttctcggggtgatatagctgggaaactctggggagcttccagggtgggacagaaagaacgtggctttggaatccaacacacctgaatttttatctcacctctgccatttctgaattgtgcgaccttgggccagtggcttcagctctctgggactcagtttcttcatctgtaaaatgggggcataataatggtaagttcttggacttccctggctgtcccattagtgattaagtctctgtgcttccactgcagggggcatgggttcgctccctggttgaggagctacgatcccacatgctgtgtgatgcggccaaaaaaaaaaaaaaaaagtaagttcttcaaaaggttattgtagggagtaaatggacataatgcacaaaacacacctacctcagagctgggcatgtggtcctcagttataaggacaagtgagattatggtttaatcctgtgcacatagtagatgctcagttaggggttaccactgtcgttgtggttgttactgtcgggtcagaatcatcaagttgacttgttgaaacatagattgctgggcctctctccaagtttctccttcagtctgggttgggacctaaaaatctcatttactaaaaaaaattttttggccacaccatgtgggatttagttccctaactagggatcgaacccactccccttgtggtggaagctcagagtcttaaccacgggactgccaaggaagttcctgaaaaatctcattgctaacaagttcccaggtgatgctgatactggtccagaccctacttggagaatcactgggttagagaaaaaagctggagagaaatgaagggttcttctgaacctgggatgtctccttaggtgtcttagatgcttgggacattgggtaccagattcggtacccgggtgtggtcttcaggcacacctatttccatcacaaggtctcagatcagatgagtctcagctgctgccctgctttgcactgggtttaatgtgaaggaccccatcaatccttttggaaaccatctgtataaatgataaatgagtcgacatgaataacacatcaacccataatatccttttgtgacatattggcctcagacagctctgcagattctgaggggctcaggcctagcatcttttaccaaagggaataggatgccacccctttcttgcgttgaagaaaggcagaaatatgtattaaaaccaggaggttcatttgaggacaggtctccactgggaagaagtaaattaaaagaaccatcaatgtaaaagggtaaaaagtagggaaattctaccgaggga

SEQ ID NO: 41817 - DNA, 1453 bp, Bovine  19866880880110
tctgcactgttttgttttgtttcagtttagcccgtttcaaaactaggaagaagaggcaaaaggcagaaggtggtgctggctagccgttgttttttttttttttgataatgatctctcttacttccttctgagaaaacatttctacagacagctcagaagagatagttcaaatgcttttacttccagaaaccttaggtcttagcaaaaggtcctatgaaaagagaacacttgttcatatattactgttctgtcccttccttcacaagtttaagaaactattccagttgagagtagttaagtgttttaattttgaggaactaagatttgtcaaatgctgcaagcaggaagtcgggccagcaggcgaccgcagaaatgcacgtggtttgccccgaatttccatgacaacatggtggggtcactgcaggggagcaggcttcctcagttcagattgagaaacacaaactgaggggctggggtaggtcctgggagttgagaatgacaaagtcttgcagcccaagcctgtcttcatccttctgaagctctttgggtcaccagatcaactcagtctctcctgttggtaaagcttaagatagatggggctacctgctaggcattttgcccaggagcccttaagtcttgtagacttctgagtgcaatcacttctgttctccccacctttctttttttacttttcaggagtaaatttgttaaagatttttttatataggctatgtttttgaagtgttagttgctcggttgtgtttgactctctgcaaccccgtggacggtagcctgccaggcttctctgtccaaggaattctccaggcaagatactggagtgggttttcatttccttctccagggcatcttcctgatccagaaatcgaacccaggtctcacgcagtccagccagattctttaccatctcagccaccagggaagccctagaccatgtttataaaacctttattgaatttgttacaatactgcttctgttttatgttttggtgctttggccatgagacacgttccccatggatcttagttccccaactagagatcgaacctgcatcccctgctttggaagaaacagtcttaaccactggaccaccaataaagtcccccccttttttttttccatgatacttttgtggttactctcaactggctaaaaccctcctttttcttgtttggaaggaccagagtaaggtagcagtttttttttgttttgttttgttttcttttctttttggtagcagtttcttttgtcttgtgcataagatatatgacggcagctctttccagtgggcaagttggactttgccacttttgataggctgtgtaagagctgtgtttcaaacacagtgtacgcatgtctctaaagatgagggatttcaaagagcctacttctgtgctaaacatcataaggaatacagagaaatacagggcagca

SEQ ID NO: 41818 - DNA, 4030 bp, Bovine  19866880912893
atttctttgattatctcctgcaggtctgattccacaggaacttgcttaatagcaacaatctgaccggtctctttatgaatagctttgtacacgctgccataggacctgtaattggggcgacaaggatacttacaaagtcaaaacaagccaagagattaaaaagtgcttaaatacaaacaactcaccattctaatttacatccccaggtgcccaagacataagtacttagctacacttgcaaaactgagatagctaaagtattgatactttgggggaaaactgtcccttaagagaactaccatcttataaacttcccatttaaagtttactgaatgtatgagtatgaaataacagtcataaggacagtagctaccacatctgctgtctgctggaagcagcatcctctgaggttcacccttacagaaaagccatgaaagggtcattatctctattttacaggcaaatgagaaaaggttcagagaagttacacgacttgcccaaggttacattaagtgataaataagcagtcagtccaggatatgcatccaggagtgtcagaacacaaagcctatattcttaaaaaaaaaaaaaaaaaaaaaagcctatattctctctacattcgtatcggggcaaaaatccatgggaggggtcttctttttcttgcactcattctagcatcacaaggtcttttagtccttgctcctcttactcacaataatctttaaaatattgggaaatttttactcctctttaactctttttatctttcacttcatctgcccttaagagtttattgtcaagataaataaaaggttgggtagcctttcaatttgggggctataagagcaagacatttagaatctaaagacctagggctggagtcctaccaccacaacttatccacattattacagtactacatatcagacatattattaacctcgtacctcaattttctcacctgtaaaatgacaacaacattacaagagaattgcaatggttaaatgagatatcattatcattatcttacatagattgtattttcacttaaatcctggatggctgtcagtgaaataatgagcaaactgtctttcatagtttccaaacacacctgtttcttcatactcccttggtgaaaagaaagatcaaaataacagcacctaatacatcaaagtagctgagtgctctagctaacaaaatgctactcaaggattgtttcaatgtgaaagtcacacaaaagttttttttaatgtctatgcaaagcacataaaaaatttccattccatcagactttttcattggcaaaactaatataatgatatttaaatgttgcctaaaacttattttttgcaagggaaagacaaccactgaccatgtgtggaagatccaaccactgcctcttcttccttggccactggaaaaagctgccatcatgtatcttatgcataagacaaaagaaactgctaccaaaaaacaaaactgctaccttactctggtccctccaatcaagaaaaaggagggttttagccagttgcgaataaccacaaaagtataatgaaaaaaagaaagggggacttccttggtgggccagtggttatgactgtgtcttcccatgcaggggatgcaggttcgatccctagtcagggaactaagatccacgggaaacatgccttgccttatcttccttgataagataaccccaagatttgtaagcaaatctttgtgaccaaatgcttggtcccaggagataaaggctggtggtccaagccagtcccagaattctgatccctttctgccagtgactgaactagcagtaagtctaagacctagtacacagaccagtgaaatctgagaggaattctttagaagggtccctgggaaagaccttcttccctgataaaaaaaaagaagcaaacaaggtggcccattttctcctgccacttcctttcctgcttctaaagtggccatcttgagactgtgagacttacacaaatgctaaattgttatcaaacacttagccattctggaatctttcacccccagatttttctgctagttattaaatgcccttactggttagccactattggttgggtagtctgtaactttcatccaaatttattcttgataccctaggtcaggggtccccaactccctgataggaaccaggttgcacagcaggaggtgactggtggagggcaagtgagtgagtgaagctccatctgtatttgcagccgctccccaatgcgtgcatgaccacctgagctttgcttcctgtcagatcagcagtggcattagattcacaagggagcacaaatcctacctaaagtcaaggcagaatagcctgagattgccacagatgagaagtaaagtgaataataaattcaatatgcttgaatcattctaaaaccattcccctcattcccggtccctggaaaaaccgtcctatatgaaactggtccctggtgccaaaactgctggggaccactgccctaggtcccatatgtgtaaaaaagttctttatttcatcttcactttggaatgagttttgctggatatagaattcttctttgacaacagctttctctcagcacttgtactgtagtttatcagcttctattgttgtagagaagtcaattctcatcgggttatcatttttcatgggtaatcatgggcaatctctcccgtaattttaagactgcctctttatccttcacattctgtaattttactataactagaagccgatttattcggcacttcataaacttcttcagtctgcaggcgtatgtctttcttcaagtctggaaatttcttagtattatctctttatttcctgtctcttccaactttcttctagagctcctactggacctagagtggaccttgtcaatccatgctgtctccctagtttccaacactgcatttccgtcttgcattttgtgatcagtctcatttctagctttcaactcccaaattctcttttcagtttgtccagttgacagcttttgcaatttactgggcattagaacttcaattgttgtagttttcattgtcaggcccctcagctgtttctttctcatggggctgtttatgttaataattttgtgtttgtcttttaaggattattattccctccttttatctttttgaaaattgtaaacaaacatgaaattccagactgctccattatttctatttccttgggtgggaatttcctacttgttacgtctgttgattatttaatggcactggatttcctcatatgggtttcattttactttgaatgattcttttctatacagtgttcactgttcttgagcatttcatgacatcatgatggtttcatgattcccttagctcagttatcgattaaactaggtcttgcattaggatttagggttttcagccctcaagacaccatacctgaatacactccaggcccagttcctatagtcagaatagtccctctttttccccaggccacaggcaactgatacaaaaatttcctgcaggaagcccaatctcccgaaaacaacatggcatgctttactttcctattactatgataactatcttttctatccctggtctatagctggctatgtattcttatattttaaaaaagtaattttcattcattattcttatatatttgaaatggaaaggagaggttcctgcatgcactgagaaatcttgactagacaccctccacacctcactatgctatcttgacagccaagaaaactccaagagctcatatgaacaattaagattcacaattccagactgcacttagagtacaatttagaaggcttcagcaagaacccctggctgaaggtaagttcaagacctgactctctacaaaaaaacactacattttaactggcagagaacaaaacaagtaataccacaaaggaggtgcttcacacacgctctgcaaggcaagggtcaatgcagagaaacagaaattagacactatctgaggccaaattaaccaggtatcagtcttaaccatatcactcactag

SEQ ID NO: 41819 - DNA, 3331 bp, Bovine  19866880995190
tcccagggagaagccccaagctctttccactttccccacaagtgaaacactcggcttccttcctcttcaagctctttgacttgttttcctccttggataacgtgatccctgggatggctccggaggggaggttctgtgcgtccccctctgcacagagcacgggctgagaccctccccgtgccgggggcgaccccagagcatccctagggtgcctgcctgctcagagcgtttagccaccatctaaagcttgagagctcgttgcaggaaatcagcaccaaataatatgaaacgctagagtgctgtaggaataggaacagaaatacactattaatgctacaggagtattaacagtttagtgcagtaataaagtgctgtagtaataggaatggagtatactattaatactctaggaatggtaccagtatagtatagtgtagtcatactaaagtgctatcgtgataacaggaatgtgttgttttttactgaagcataattgaggtacagtgctgtgttagtatcaggtatacagcaaagtacaggaatgtattcgtgctgggaaaatggaaacagtgcactatattgcttctgtggtggctcagatgataaagaatctgcatgcaatgcaggagacctgggttcgatccctgggtcaggaagatcccctggacaaggaaatggcagcccaccccagtattcctgcctcgagaatcccatggacagaggagcctggcgggctgcagtccacggggttgcagagtcagacacgactgagcgactaggcagggcacagcacccacagtatagtgtggcgacactaaagtgctctggtaactggaacgggagtgattactttttattggcgtataattgatttacagtgttgtgttagtttcaggtgcacagcaaagagcagaaatgtgctgttggtgctacagtagaaggaaaacagtgctaaagagcaaaatcaggactgaatctcatggtggtgacaatatattttaagccttaataagatgtttttcctcgtccgggctactttctgcttcacatacaataactttctacagttcctatgctgttctattgaagtttttaaaagagagctatttttaaagtgttggtatagcaagaatataactgggattttgtagcttcaccttcaagatgcttaaaaggacacagaactcttctgacacatttgtattaaggctgtgttttgatatgggtgttatcagtagggatccctttggtggcacggggtggagatctacctggacccagcctgggtgatgtctgtcttgctcaggagggttgagggggtgggggacacagctgggcctccaggagatgtgcaggcaggggttccagaccagagggcttcctcgtccctgcggtattcagtgaatgtcatgcccgtactctctctcatgttcaggcttttgcctagcggccgagagacatggcctcaggcagtctgagagttttagcttctgataaattctgccaccgcagggacttgcctggtggtccagtggttaagaatctgcctgccaatacaggggacctgggtccgatccctggtccaggaatatcccacatgctgcagagcaactaagaccatgtgctacaccttctgagcctgcgtgctgcagttacggaagcccgcttgcctagagcctgggctctgcagcaacggaagccgccacaacgagaaacccgtgcaacgcagagtagccccagcttgctgcaaccagagaaagcctgtgcagagcagtgaagacccagtgcagccataaataaataaaatgcctctctgaccctctcctctattgccctctttttgatcataggctccagacttcaggcttttcctgaaacacaccaggggttctactgctttatatctgctgcccccactggtcataacaggctctctgaaagctcccagttccctccatcatctccaacaagtttgttcaaatgctgccttttgaaaggtcctgtgataaaactgcaacacaactccctgctgctccccatccctactccgaattctccttctgttttctttttctccaggtcacttatttcctgctaacattttacagggaatgaaggtgttgaatgaaggtgttagtcgcttagtcatgcctgactctttgcgaccccatgaactgcaaaccaccaggctcctctgtccatgggatttttccaggcaggtatacttgagtggtttgccatttccttctcaagaggatcttcccaaccagggattgaaccctggtctcctgcaggttctataccaactgagctaccagggaagcctttttacagggtatacttgcttttttatttgatttacattcactagcatctacaggtggcattagtggtaaagaactcccctgccatcacaggagacataagggatgcaggttcgacccctgggttgggaagatcctctggaggagggcacagctatccactccagtatgtgtgtctggagaatcccatggacagaggagcctggtgggctcaggtccatagagtcgcagagtcggacatgactgaaacaacttaggacgcatgaatgcacagtatataaaacccatcagagagaaatttttgttgggtttgtttactcatggagcatcccagcacctacagcagtgaaccgcctgtgatagatgctcagtgactatctgttgagcagatgagaacaaatcaaaggatggataagcgaatagcactgtgttagctcaggggctccttttcagcttcctgcagagcttgtcatatctgggtatcaatgtatccctccccccagcacagggcacctacctcagaagacaggggtgacacaggacaccctcccgcaaccattgacgcagcatttcaacgcgtcaggacactggctgtccacctggcactggtcccggcagaggccgagctgggggaaggcgatatccacattagggcatgagcccggcttgtctgggtaaaaaaaggagtaagaggtggtgagcagagccgaggcaggcggctgcacacgtctccacagcatgtctgcccacctggattcacaaagaagacagctgcttgcctgagcgaatctcagggggcttggaaggtcgtctgcaaactctcttcctcctgttctctcctcccaggggttttgagatcactgcactccagtttgagtcccagctctgccttctcctaactgtggcctcaggagggaaatcccccagagccctgtgtcttcaggtgtcagatgagatcagcgttgaccacaccacaaggttgttatggaagcaatggaggcaacaga

SEQ ID NO: 41820 - DNA, 1423 bp, Bovine  19866881002825
tcctaccttgggattgctttcccttattatgaacacatgccatctgaatctctgaaaagacaccagtacttttccaaacacaaataagggtgtcatgaagtcattactcactggtctggctagctcccaaacctctttctcccatcttgtaacttttgtaaggtccattttatttatatatacctatactctttccatgcagaattcgttatgggttacaacaaatatgtaagataaatggatggagcttttcaatgaaaataaaatatacatgcccaccccaacctcctcaaactcatgttaaagtcttaacgctcaagacctcagattgtgactgtatttagagatggggcctttaaagagctaattaaggtaaaaatgacatcatatgggtgggccctcatccaacatgactggtgtcttcgtaagaggagatgaggacatagatatagagggagggccatgtgaagacacaggaagggggcagccatctgcaagccaaggaccgaggcctcgaaagaaacaaccctgctgatgcctagacctcagacttctagcctccagaactgtgagaaaataaatttctgttaactcatgccatctgtgagatcaacaatggcagtcctaacaaactaatatcacaggtaataaagttaactggccgaaaggcagttcactagctatgatgagcaggaaagcacctgtcattcaaggattcaaccctgcagaggatgggatgatttcagagaacagcatcatcgaaacatacagtaccacatgtaaaacagataacggacgaagcagggcacccaaagctggtgctctgtgacaacgtgggcgggacagggtggagagggacatgggagaagggttcaggatggaggggacacatgtacacctgtggcaaattcatactgatgtatggcagaaaccatcacaatattgtaattatcctccaattaaaataaattcaaatattaaaaaagaattcaaccctgcaacacttttctcttgcacatttaataaaatttttaaaatccaaaaggcacaggagtgagtgtcaaaaaccaaaacggtttacttttttgcccaagactgtacagcataaagtaaaagcagaaacaaaactccgattcctaatcctctcttcaattaaaccagcacgtccaggaaagaacgaacatatttcagaaggaaatataaccagtgtccatttatagttggatctatggtgcaacagcaaatacctgctaacatacacaaggccctgtgaaacaagggtactcccagagaggcatcagagtgatacagctgagagcacagactttggaccagactgcctggattaaaatcccagctctgtcacttagtaactgtgcaacttctgcccaatcgctaacctctctgggcctcagtttcatca

SEQ ID NO: 41821 - DNA, 838 bp, Bovine  19866881075788
cacttctgccatagatcatccgcaaagtagccaaacagtgtgccctcctcgacgtggatgagcccatctcgcaactccacaagtgtgcattccagtttcccggtggtcctccaggaggaggcggcacctacttatgtctcgctacagagaaggtggtgcagtttcaggtgagaagcagagactctcagcaccaagcatcccagaaaatcagaaccgcaaagaacagtaggatgtaagatcaccattatcagcaccatcgtggttgctactcactgagcaacactgcctcctatggaatgttagacatgaagactatcaggatagaatcagagaatgtagaaaaaaatagtaatagtagcattgagcaatgctccttcccaaaggccattaatgtcagaatgttgtgatataaaattgtagggggattccctggtggtccagtggttatgactctgcacgtccaccgcagggggctggggttccatccctggtctgagaactaagatcccacaagcccagaggcacagggccaagaaaaaaaaaaattgtagaatgcaaataaaaatcagtaataaatagtacttttggctggtggctcagaggttaaagcatctgcctgcaatgcgggagacctgggttcgatgcctggatcggtaagatcccctggagaaggaaatggcaacccactccagtattcttgcctggagaatcccatggacggaggagcctgatgggctacagtccacacggggtcgcaaagagtcggacacgactgagcgacttaactaacttttgagtattactgagcaaagataattatggactgttaagacataag

SEQ ID NO: 41822 - DNA, 1560 bp, Bovine  19866881096768
atctttttgtctttgctagagcatctaagcagaggaggtattcctggatggtagggttgaagggtctttcaaatttacttgactgtgactcacaattagaaatacattttatatcataatctggtaaggccacctacacacacacacaagtaaaacaaaaatttcgtaaaataatacctatctttatcatgagaaaagcattctgatgtgttttattctagttaagtctattttattctattttgatcacaacctactaaacagattatttagcatattaatgggccatgactcacaatttgaaaaataatagattaaaatgtctttgctctcactacatgctttgaaattactcttcagaatagctatgctaatttacaaggcattaggtttttttctctacatcctactcagcacttggaattatctctttttttttcccccagtctgatgaatgtaaagcagtatgtcattgttgttttactttttctttctttagttactaagttgagtttctcttcatctgtttattcactacttgatttcctcggaaagtgcgtttgcctatttttctgctgggttgctagattttttttcttgctgaattactcctgagtttcttgagcagcttaggttttcattgtttaatgattgttgttgcaaataggctgcagataccttttcccaatttgttagtcatttgttaactctgtctgtgatgttatttattgaacagaatcagtcattttctttatgtgttttatttaagaaatactttcttcacttcatatcataatgatttgccttgaattttttatagctgcttaaaccatctgaggtttgtcccactgtggtatgagataggatataattctgtttattccatacagtggatccactttccccaataccatgaaaataatgtagcctttcccctactgacttctgttgccacctctattgcataccaaatatccatacatgtgagtctgcttctgggttcttccatcccattggtcaagcactaatagcacactttgaaaatgagaatttatgttttaatatctggtaggggaagtttccgccctttgagttaaatgttttaattttttattttatgttggagtatagctaacagtgttgtgatggtttcaggtgtgcagcagagacttagccattctccccccaaacccccccccgcccaggctgccgcagaacattgagcagagttccctgtgcttttatttttgagatgacttgtcttagctatttgtgaaaatttattcttccatgcacattttcaaattggcttatccagttcctctccctcaaatattagtgagaataccatgaattgataccattacaatgttatgcctttctttccacacacatagtatatttctctattgatccaggagataaaaatctccttttgtaggttttacctggcatgcttgactaaattaaattctagataataattttctgttttctaaaaaaatactctgcgatctaacaaatgggaatggtatcttctttcaggggagccaagttttt

SEQ ID NO: 41823 - DNA, 1003 bp, Bovine  19866881141395
gctgagggagatggccccaaggcctaggacacccccttcctcttccttgggtctgcctgggagctttcagacctggaagttctgtcccaactggggggtcgtcagacagccccctactcaagatgcagagctctgctaagctaaggtgttctgatccccatttgtccacaagtatcagagtcacagccagaagggggcaaggcggttgagaggtaccacgggggtcatccctggggtctaggcagaaggggcaagaatgggtcacatcgcttcagctactgggtgaggatgggacccctagatgtcattggataagtaggttcatgttgctagaccacaggcctgtgcccaggaccaaggatggcaagacacagccaaacgcttttgcccaaggtaagaacagaagcccaggtgatggatgggaaccacatccctcagggcagagacaggcccatcttgctgaggctgcggaccagctcaggatgcaagatccaagtcttgcttgggccagggctcccagggtgcccctcagtctcgggccaggccaccctgccacagcccccacacagccctccggggggtcactcactcagcctggttccaggggatcggctccaccttggagttggccagcaggtgtgggctgtagcgcacctccacatacaccacgccgtccttggccttcatctccacaaactcgtaggcaatccttttgacagcctcccggcagcccctgggaagggaagagagggattcgagagcactccccttgggtgctccaggagtgacaaaagctgtccccaacccatgacagaccaaacccacgtggggcccccaatctctcatcccccagtcacaagctctgggcctctactgcagaagatcccagaagcccagaacatcctgtcagctctacttcccaactcggtgccagtcctcgccccctccagcctggttcgaccacctcaccagcctctctgtctccacatttgtcccagtacag

SEQ ID NO: 41824 - DNA, 1593 bp, Bovine  19866881151238
tgtgacttgatgctgtccctagggccagaaagcttcctctaatctaaggttgtctacagtcttccaagccagccctgcgcggggaggggcagtcacaagactcagctgcgaacatggactgaagaagcagagagatggttccagtctgtccaatgctatccagctgctaaggagtggcccagagattcgaatctaggtttgcagtctttttctacacttcacaacagtgccagggagagagatttctgccgtagggctcagaggaccttctctgggggttcctgatcagctgccccaggatggagggagggaagccagccagcgagggctctgaaggggtctggcaagagataaatttctctgtctgaggcctgaggctgtctggaaagccagagttcctccctcccttccctgatgattgccagttctgactgttacaggtcacttcggccttccgaatctatggttctactatgcaccaggctctgctcaaagcacactgagggtaccgggtgagctagacagacagacgcggactccagcttcacggggcagctaacctattctggaggcctcatggagcaagagatgcttgaacgcagatggacaagataagaagctgtacgccacattcaacaggagtgggcagggcagaggctccatcctgggatgaggcagaaatgaatttaccaggcttaccttgaagctccgaagcttaaactctagagcccctcacttgccagatgccttccagtgatctgggaggggcccaagcaggacacattcagggtcacatgctgatgcagagtttgccaaagtaagctagtttaactgcggatgatgaagaatgttgcctctttactctttgacattccccttggtcatacttcccctcatttgggtgtcacgggcacggcggtgacatttttggggatctagctaaggggaagctgtcatggaatgccacatcgatgaaaaataaaactcaaagtatatcactgctaagaggacatttgcaacaaactgcttaataggcagcatcttagtcaaagggtttttaagatgcatgatcaaggaaataggaaaagtcctgaaaccttacagctcccctatgaaagaaacttatacatgtttttctaaatttgacaacagtcctaaaaatttatgacctcatttataatgagttgtgaagctgggaagaaacttctctaaactatcaacaattaaaaaaaaaaatcttttggtcaacatgtgctagagaaaagacaaaacgctcttattttctctaaagaaaatgacactaaaaaatcaatgtcatatgaagaggtgatcctaaaagcatacagccaaaacttaggaataaaaaaaaaattttatggatgtatatcaggcaataaatataaacattattatttttctagatattgtctagggtctatcagcttgtttaaaaatattcatctatttggttcactgggtcgtagttgcaggacacaggaactctttagttgtagcatatgaaccctttgggggcatggtggggatctagttccctgcctgggggatcaaacctggggctgtctgcattgggag

SEQ ID NO: 41825 - DNA, 1402 bp, Bovine  19866881164740
acatcaaaaagcagagaggggaaagaaccatggaaagggggagatgcaacagccatctgtctagatacattagtaggagagtgtgcatgaatacagggcaaagaaaagaagacagtgtgagaacccagcacggctgcatgattccagaaggtaaacttaccgttttatttcgtaatcgaataatatcagatacagaaccagccccacagtactccatcacgatccacaagtctgtgttcttaaagtaactgccgtaatatttgactacatgagggctagggagagagacaatactaatcagtggaacaaccttcaaacatccctatgaattcatgctgtaaaatacgtaaaaatccatttctcagctccaaagatcagttatttatgtttaaggttcaaacgggcaccctcttggtaagaaattaaagtagtattgatttctgaagggcagtaaataacagcggtgcaaaaactgtgtaggttccttaacccagcgtttctaagtctgcacctcaccctaagaaaagacacacagatttcaaaaagaaagagttaccatggtcacagaactgcttaaaaaactgaaaatttagatacgatccaaatgtctgacattagggagtttatttaagaaataatgatatatccgtataaaggaataaccacaagtccatggaaaatgtaatagaagaatacttgatgagaagattctgcttaccaaaaaacaaacaaaaaatgcaggttacataacagacagcacagtataactccaaaaagacatacggaaggacatgtatgccaaggagtatttaacaatgattatctctccaaaggaaaatgtggttttcctttcttatttgcattttcccaagaagtcacatatactttgtaataaggaaaaataaaactacactacaatctattgtaagggaaaaatattcagaatcagacctgaaatatagaatcttgaagaaagatttcaggaaaaagtcaaaatccctttaaaatgaaataattaaaaaaaaaaaaagaatgtgtcttctgaagctaccagctctacctagctagatcattatcagagctaagtaatattgcacaatgtagtaacggaagaggcaaaaaccaactcagctgatctaactctcaaaatttcaaatgccccttcatccttgggaaacatgccaaaatgacaggatatcaggaaaacacacacacacatgcaaaatgcatattaatgaagaaatggatgaataactctcttaagatacatatcaccacatctgtgctgccgtctctgaatttctatagtatttctatagtactggctccataaggcaattactgccaggtattcactgctggaatatatcctataccatcatgcatcatcaactatataagc

SEQ ID NO: 41826 - DNA, 1674 bp, Bovine  19866881172759
tgtcctccttccagcaagatcctcctggatcttctcctccggcaggactggggaatgtaaaatggtgcagctgtgaactctcagacctgagggggctgtgccatttttaaagtaagtaatcgattaatgtagttatttatggctgcactgggtcctctcttgtggaacacaggccctagagcatgcttagcgcacgcagttgtggcacacaggcctagatgtcccagggcatgtggaatcttcctggatccaggatcaaacccacagcccctgcattggcaggtagattcttaaccactgagcccaccaaggggtatccaagggctgtgcaatttgatgccacgctggcatctggggaagacaagaggtagcttagcattttaaaaggcaggttttgaacttagacatgagttcagtcccagtcccactgcttaccagcagggcctcagtttgcttctctgaacacagaaagaatgatctgactttctccactggggcacggaggaacaggaagggggccatgcccgtgatgctctggagtcagtgccaggtaccacggtcaggactcaaaaggcaccaggtatccacccactcattccacaccaggtttaagcacccacctggcaccgatctctgtgctgggtgctgggatggagctgtgaatggacttgtgtggccccagctcttagagactggaggggcagatttcaccaatttgttgccattgtgactgtgattagggaaatcaccccctttccaatctcttaaccttccgaccttcacccctcaccttgaccttgaagcaccctgagcaggatctaaatcagatgtatctccataatcttagctcctcaaccaaggcctggaggctcaacaagtatttaaactgaaaagatttctgtaacaaacacagcactgagtgtgtgcaagccacggttctgagcactttacaagtatgaaatcctgtcactatgcctggcaaggatgcactattatcaccacccccattttgcagataggcaaactgaggttcagaaaagttaagcaaactaacttaagttatatagccagagaagggcacaaccaggatttgaacgcaggccacctggccccaggggccactcgctccatgcctctcccgagttgatgccacttcccagcagggtccagaaagggcctgatctgaagacctcacctgtctctaccacttgctaaaccctaggctcctcactctccattccccaggtgggctctggaggaaaacagggcccccgctgcagccttttgatgtgccctgccaagttggcactgtgaggcctcagggtgcctcaggggatcccaggccagcagctgggccggcctcggggccagcgttttccgtaaacatccccgcgagccagccccgcgtggtcagaccttgggccgctggcttcgagggctgaggtttggcgggccctcctcggtttcctccaacacagccacttccaccccctctgcctggctgagcttccagtaatgaagtgttttgctctggggctggtggggtcgatggaatggggtatcggggccttgtcggtctcacttgccccacttgggctcctggaagctggttagatgcccctcactgcagcctgggcagcttattggcccccctgggggttggaggaggaattg

SEQ ID NO: 41827 - DNA, 1468 bp, Bovine  19866881199384
tgactgactggtcaggaatttagattcctctgaccccagagctggggtgtatttattgtttctttggggtggctgagagccctccctccaggatcatcactcacctgctgtctcttctccagtgtctcactataggctcttccccaaagccttggggcagttgatctccaagtattctctccgggaactacacctgtccttaacccaaggcttctggaggactcgatactgggggacacccttcttgcaggccccatcaggggcagagctgtgggcttggttccaagacactgtcaccgagtgagtgcccaccttgaggcctgtggcaggctgtggcgggaacgtggcatggcaagtgttgtcatcttaccactgccctttgggggaagcagttccatgggggtaaagctgcactggaagtaagaagtattatggcctagtggcattcttgactttgcttaatatgtttccttcccctgatacatccagacctgtggttgcatgtatctgccgagatagataacagttatctgcagcctacttggatgtaaggcactagaaagctgtggcaaaccagacaaccttttaaagacattcattcacataatgataaaatgccacaagagccaaataaaatatatgtgggctagaattggcctgtaagacatcatatctctgtattcgagaaattactgttttttaggagaaggcaatggcaccccactccagtactcttgcctggaaaatcccatggacggaggagcctggtaggctgcagtccatggggtctcgaagagttggacatgactgagcgacttcactttcacttttcactttcatgcattggagaaggaaatggcaacccactccagttttcttgccaggagaatcccagggacagaggagcctggtgggctgctgtctgtggggttgcacagagttggatacgactaaagcgacttagcagcagcagcagctaccacattgcaggcagattctttaccttctgagccaccagggaagttactttaactcaatagcctgtgttttgttgaagaggctcccaatgcacacggcgctggcaaggagaatccagccctgtcccccaacctccaccccttgcccagggatgcactgctgtccttcatattctgccagagtgacagctgctgctggcctgtccacactgtgaccactgatgcctgacccacacacagtccctgggagggaaggcgtgctcttctggtttgcagggtaactgtgtagctcttcatcacacaggctggacagcattttttgatgataggagccaaatgacttgattgcatgccagtatggcttgcactgcagagatccaggaccatgacagggttacacgtccgcctctacagcttgccaccttgtttacactcttgtgctggtacgctggcactcctggatatgcctttcattattgggatgtgctttg

SEQ ID NO: 41828 - DNA, 1619 bp, Bovine  19866881216338
catcatagctacttgcaggctaagcaaaagttgtgatgcactgagcactttgcatgcattatcttgtgtaattctgataacatcccattgcaggatacgatcatccccctttcatcaggtggcgcaagttcaaggaagtgaagtccttgcccaagaccacacagcttggtggaggaagtaagattcagttcaatccactgtctttctgtctccagaatctgcattcataatcacctatgaatcagtgctaggggcttagataggcaaaaagcacagacatggtgatgttacgagggagtaaaaactagagtaagtagaatggatttatcaggatgctttgttttcaagttatagaaaccaatcttgaactaaattcaatgaaagagttcttcactggttcaaattcatccctaagatgagtgctactgggcccttaaggctgactcaaagaaaagtctggaatccaaaatgaagcaatttctctctctctgtccctctctctcccctttctccccatatctttctttgtttctttctgcatgctagcatcctacaaggaggggctaagcgaacactgttccagccattccgggtccccagccccatctgattgcagatggcagttgttcaaggcatctagaaggtcacgggatccggaaccaggggatacatgcccaagtgattctctgatcaatgaggacacagctcattaagactatgagcaatcttatggataggggacagttgccaaatttcatcatctttccccacggttggaattttcacccacagttcttcctgggcagcatgtgctgtgaggtccgatgtcagagtcctaggttcagagtggcattcccatgcgcacccagtacgctatctgagtgatatgtgatggctaactgactttgggtaattcgcttctcttctctgagtctcagtctccccatctataaaacggaggtgaccactgtacatagctataagacttgtgaagattcagtgagagaggtgaagcaccaggaacacagatggggcttagtcaatgttgagtgcctcacttgcttttccagtggaatcagctctcttctgttctgccatttccagctgggctaaggaggtggcctctatccttacccaggactgtagggtaaagggaaatatatttaaaatatctagatgagaccctaattctttgctagcagttacataaattctaaagtcatctccatctttctctgccctggctagcctccagagcaattaaacattgatgttgtagctatacttatctcctcttccctcttccagcctaggacatcaattctccttatcaaatgaaaaatttaaccctcacatttgtggacatcttgggtttatgaagcactttcagattcacggttctcacatacttattataggaattaaagtaatatgaaaaagtacaaggaagaaagttgaaagaagtcaagtgatcaaggtcaacatcaccagtggtgcatcatattgtgatcatgtattgctgataggatgtcaggagaaaaacacataacttctggagtcttcttccctcaaacctacaactccagtctaatcttgagaaaacatcagacaagccaaaa

SEQ ID NO: 41829 - DNA, 1228 bp, Bovine  19866881262794
agcctcgtgcgcaccgacggccttttctaccccagcgccttctccttcacctacacgcccgagtacagcgcgcggccgggggccccgggcgccctggcggcgcccgccgctgacgccgacgcgctcctggagagcatccatcacgagttcacgcgcaccaacttccacctcttcatccagacgtaggaggagcggcctggacgctgagacctggccgggggagggttttctgggtcctgagccctgccttccgcctcggtgctgcgcaagtgaaagctgaagaccgacttgcagaaagctctcgccctagaaacctggccctgcgggtctttcaccggttactccctcgtcttttccttctaggaagaccccgcctgagtgatgctccctttgtatccggtcaggagtgtggttttctctatcattgtctttttcactctgacattctctctcccgaagtaactatagtttttttgttttttgtttttggccatgtcacgtggcctgtgggatcttaattcccagaccaggagtggaacccgtcccacatgcggtgaagtgcagtcttagtccctggaccaccagggagtttcctgtagatctctcttctttgtgcatccctgtccctgcatctttgtttctctccatctctctgggtctggcatacagtttcacacattgtaaaaagcctagagcagtgaccctccaggcagctgtatttcctgaaggaagaaacgggtgatatttcacacacatggggcatgggctcacgcttgccctgatggccccaaagcaccaggtcctgcctggaacattgggtcccactccaagcaccaagtcccttctggagcatggggaacctgtcctggagtgctggcttccaccctgcagtacaaagctcagtcctttccttagtctttttctggctggagccaggcacagtacccattcagatgtttgccctctggtccacaactttggtggctgggtaggtccctggtgtagtggtcaggtcttgccatcttaattgtctacccaggcatttctttcgcaggcctggtaagatgcaatcagtcctaagggtcggagattgctctgctgtgttagcatcaactcccagccagggcagggagtgtggtactccctgtatctgtatgacccacctcctcccagagggaggggcccagtgtgcttccccccacatacacacagagtagaggacaacatg

SEQ ID NO: 41830 - DNA, 955 bp, Bovine  19866881405446
tgtacttgattgtaccgaaggagataggaatttgctaccaaggtttttctttgaggtggagtgtcctctgtgggggggcttgcagttgcccttcctgtgtacataaatacagtattttccacggttctgcctgcgctttattttataatgccatgcttgggactgggaggggtcagcacagtcagacattcattagagccaggggctataaagaattattaggccacctttttttttttttttcccctttttgagcccaggtgttcctccagttggttaaaacatggagtgcagggaactcctgtgtcccaccccgaccctgcagccttctccgctttgccttgggcaaactaccatgactcaggatgcctttcccacttgccagtgatttctgactgtgcccagtgaaacacaccggtctagacccacttcctcatagaaaccactgctgttcccctcgggccctccgcagcctccctgagcgagttgacggagttcctctttcagagttagggctacgcagatgggaacttgtgccgtctcccccggaagcctttccagcctcctggctcccagcctcgcgggataggtagtggaggctgacaggatgaaagctgaagagtgaacgtgcccgggcagaagctgggaaaaggctcgggtgaggcgcctcagaaacagggcaccctggccaagcagggagggagcgggttgttaatgggccgctaatcctggctgcagagtccaggaggtgagaccgggctgagatggcttcccctgtgtcagtgggtttcctccagacaccagagacaccacaggcaggtgactccctttattttgaggaaagcctcagagccctcccgtcacgtggccagctgtggtggttgctccagctgtggtggcgcacctctttgggactttcccacaagggctcgtgacaccctgctgcatgtcttct

SEQ ID NO: 41831 - DNA, 1230 bp, Bovine  19866881468051
taggtgctccgggggaagcttcaggcgtagaactcattggtgggggcttttttgtagatgggtttcttgcccaggtcgtagctgccctcatccttcttcttcatgcggtacaccagcagcagcacgaggaagacggcgaacaggatgcccacgacaccgcccacgaccagagctggagaggagagagggggcagcgaggtgagggctggcggcccgtcgggacctcggggcgcacgggccgcttctgctcggttggttctctggcccccggacatcctcaccatcacgcccaggggcatactctgctaatgccttactgaatttgatcctcaccacctcattcatgagaagggagtcactctaaaggactaaaaaaaccacagaaccagagtgacaaaggcatccttccaacccacattgctggagtccaaagccaggttctttcccaacacgaggccaactccccagcaacagctcagccctgagccaggaagcagaaaaatcgcaggctgtggaaatcccccttagacctacttaccccacagtccttagcgcagggagctctctagttgaccttgcgtgcacacatccctatgcagacctacacttatacccgattgggtgtacacactctgtacacacgcaggtatatgctactatacacagttacaacatgtgcgtgtgtccacactcctatgttataaagaattacacatgtggtttgggactttctggtggtcctgtggttaagactccgtgcttccaatgcaaggggtacaggtttgatccctggtcagagaactaagatcccacatgccagctggtgtggcaaaaaaaaaaccaaattatatacgtgatatatgtccgcacatatgaagctcagtgcttaaggcttacattctattcctgtctctgccacttactggcaatggaatctaaataatcaagtttcttcatttctctcattataaaatggaaacaatagtacctttcttataggtttgtccctaggttgaaataaatcaatccccttaagagagctcagaataatgcatagcatatactcaatattcattaattgtgactttttgtggtttgtatctgtgtccctgccaccctgaattgttctggcacaacagtgggtgtttaataaattattccattgggctcagagaggagcaatggccaagagcagacgcgagtttctcacatcgggtaaacgtatattct

SEQ ID NO: 41832 - DNA, 2183 bp, Bovine  19866880412393
tgataaggaatcccccctgccagacaggagacacaggtaagatccctggatcaaggaagactccataggccttggagcaactaagcccatataccacaactattaagcctgtgctctagagccagggaatcgcaactactgagtccctgtgctgaaactactgaagctcacatgctctagagccatgttctgtagcagagaagccaccacaatagaatcctgtgcaccgcaaatgaagagtagcacctgctcaccaaaactagagaaaagtctgcacaacaaagacccagcacagccaaaagtaaataaataaataaaattgttttaaaaataaaaaaataaaaaggagtaaaatgtgttattagttatagtaatacagtttatttgctccaccataccaaatgtggttaatataaaaaattattaatgagatattttatgttttttaaaaactaattctttgaaattggtgggtattttacacttacagaacatctcatttctgactagtcatgtttcaagcgctccatagccacatgtggttggtggctgtggaatcaaacaacacagttttatattctcttcttttgttaatatttggaattttcataatgaaaagtattaaaaaaaaatctaggtctgaattcaaacctcattttcttgacacctactctctcccattcccggcagccttgccctgtaattcaggggtttcttgggccttgcctagtaaaaggtgacagacacagatcttggaggaagcatcgccaccctctggtttctttgctgctgctccttgcatgatccattatccagcgctgtccccgctgtgtttttgaaggtcagataaggcagatccaggtgctggttacccttcagcacctaatacaatactcaacacatagttcatgctccatagatatttgctaagtaaataagtgtcaagacgtgataagagatcctacatatcgtaaagtgggtgacagtagaaggatattgaacacttggaatgtgttaggcagagtcacaggtgttgttttattgaactcttgctaaaatatgtgcctcagtattaccattgtcaccctgaagataagataattcagtgcctgagtaactaatcagtaagtgttaaacccacacttctaattcagatctgcttgacaccaaagccacatcacaccatctcccaggaatttgcccaacagctagaatgaaatgcaggaactgaccaattttccataatgatgggcccttttatgccttacttgtccccaaggagacttctataggcttgtggtgggcagaatattgggtcccaaagatgtccatgtgctaatcccccagaacctgtgaatatgttaggttagatgacaaagcagaattaaggtgcagatggaattaaggttgctaatcaactgatcttaaaatagggagattgtgctgtgcttagtcactcagtcatgtccgactctttgcaacctcatggactgtagcccactaggcttctctgccagtggggattctccaggcaagaacgctggaatgggttgccatgccctcctccaggggatcttcccaattcagggattgaatccaggtctcccacgttgcaggcagatccttcaccatctaagcccccagggaagccctaaaatagagagattatcctgcattatccaaagtgttaatcattcagtagtgtccaactctttgggaccccatagactgtaacctgccaggttcctttttctgtgggattctccaggcaagaatactgaagtgggttgccatttccttctccagaggatcttccccacccagggattgaacctgggtctcctgcattgccagaagatactttaccatctgagccaccaagaaagtccttggcagtgtttgatttgaattcccgcaatgatctgacatgtataccaccattgtgtccacttggcacaacacagagctgtctgcctcctcttgggacagaatcattctttcccctgcagagctgtgtagggtgggagaaaggattttgtaaccagtgtcaggagacctggtctcatgttctagaatcacgtgacccaaccacctatccattatgctcccttgtggtaaaataggggatgattataatagcatccatctcacaggattccaagtttatttttaactcacaaaca

SEQ ID NO: 41833 - DNA, 1584 bp, Bovine  19866880421657
ccttcgcacagcatgcgcccgccgcgcccgcctcacccgccgggcccgcggcgccaggggagctgggctggctgtccatggccagccgcgaggacctgatgaagatggtgcggccgccctactcgtactcggcgctcatcgccatggccatccagagcgcgcccgaacgcaagctcacgctcagccacatctaccagttcgtggccgacagcttccccttctaccagcgcagcaaggccggctggcagaactccatccgccacaacttgtctctcaacgactgcttcaagaaggtgccccgcgacgaggacgacccaggtgagggcggacaggtgcttcccggccggtcccttacccacacccgccccccactacgcccaccctgcaactcacgcacacgcagaggcaggccagggtgggataaaggtaaaaagcctgaatctttaagcggaaagtcagtcctgagtggtgttccttaggcggttggaagggagggtcgagttaccggtaaacggattaggaataaaaacacgggtgggctctcagataacggatggctgtaaagagattcagatgagccgagaatcccatcacatttcaggagagtgaggtggggagagatggggaagttggtacccgctgtacgtagatgcgtttcgaaccttacctgtttagaaacgtaatagtgtaaatcccaaatgtgcttcgtgcggatctaagcccctgaggtgaggagggctgggtgatagtgtcttgttaatggtttccctcttagctgaggaatgaggtgaagaaaagctcaaaaatctcagaaacagattcttcttggaggttttctgaaggcgctcaggactaggggtgtggggtgagaatccggttagggaaaagaggaaactgtttccttgccttctgcagcaggaatccccaacctctgggatctaatgcctgatgatctgaggggggttcgatgtagcaataatagaaataaagtgcacaataaaagtaatgcactcagactcccccccatcccttatccccctgcgttggtggaaaatattgtcttgcaggagaccagcccctggtgcagaaatggctaaggatcagtgagggatacaggattctttgtaaattatgtaaatgctctgaagtagttgtgttattgttcagtcgctcagtcatgtccaactcttttcgaccccatggactgcagcactccaggcctgtctgtccttcaccatctcccagagcttgctcaaactcatgtccactgagtaggtggtgccatccaaccatctcgtcctctgtcgtccccttctcctcctgccttcaatctttcccagcatcagggtcttttctaatgagttggctcttcgcatcaggtgccaaagtatcagagcttcagcttcaacatcagtccttccaatgaagagcagtgctttccatttgaaatgctgtacaaactacacgtagttgaaaaattgtctagtagccatgtgaaaaaaagtaaaaagatggtgggaattttttttttttttaaagaaaaaagaaaaaattttaatagaggtgaccatatctgacttcagg

SEQ ID NO: 41834 - DNA, 1321 bp, Bovine  19866880484235
tgtggtgctctagttgtagcactcaggctctctagttttggcacctgggatccagagaacagacttagatgcccggcagcctacaggatcttaattccccaggccagggaccaaacctatatccactgtgttggaaggtggattcttaaccatttgaccaccagggaagtcctggaattactgtttttagcaaacatatcacccagacagctcaggttatacaaggaatgaggtgggaccctccatgtgttttccaatgaggtttgatattctccattaagttcttgtgcaactgacttctcaaacttaaagggaaaattttgtgcttgagtgtgtgactctgtatgtgtgtgtgtgtgtgtgtgtgagagagagagaggatgtaggtatccctggaaacctctggagctctgctcctgccaagcagacttgggattcagcccacacctgtgagatttggatgtcttttgtcccctgagagtctcactctgcctggctaatccaggcagagcttcctgctgcctcctttcaggacgcagttcagaccagaatattaatggagattacagcaaggagaagaagcaatctgagcgagggagggggctgccgggcaggaagcttggcatcctggcggaatctttccatacatgatctcgaaccacttgtttggaagcagtatgtgatgcaggggggccttccctggggtgtctggagctcgtctgtatcctctccccaggttgttccgaggacaaatcgtctcatacctttttcaggtaattgacatgcacgcatctttcatccccccatgcatatcaaactctgcttactatagagtgaccttacagcccagttggactgagacaggtttacatctactgtcctgacgttttactatctgtcaccatcaaaagtgaacatgaaagtcgctcagtcatgtctgactctttgcaaccccatggactgtacagtccatgaaattctctaggccagaatactggagtgggtagccattcccttctccagaggatctccccaacccagggatcgaacctagacctcccccaatgcaggtggattctttaccagctgagccatcagggaagccctggtcaccatcaaaaagtgtccctatttggattttcttccaagaataagcatcaaagaagacagggaacaagagctaccacatgtgggggttgccatgtagattactgggaagagcattagacttggaagcaaaggagggttagaccactttctacctaagtaggactcagatgtgtcatctgtaaaatgggcataattataccaacctcccagg

SEQ ID NO: 41835 - DNA, 1325 bp, Bovine  19866880912127
cccatggagagaccaaggaacagcaaagaaagtgaaagtgagtcactcagtcgcgtccaactctctgcgatcccatggactgtagcccaccaagatcccctgtccatgggattctccaggcaagaatactgcagtgagttgtcctttccttctccagggaatcttcccgacccagggatcgaactcaggtctcccatattgcaggcagactctttaccgactgagccaccagggaaatcaccaaagaacagcaaaagactgaggaacagcaaggaacaccgaggtacaccaaggaacagcaaaagaaaggctaatgcaagccagagaagaagagaactcgggaagtgacggactgagcgggtagggcaaccgggagggcgcggctttcgtggagccgggagactgcgcaagcgcagtagcgcgcctcgccgccatggtccccggttccgtccagtcagccgctggtggtggcggcgacttcccctcaggaagtccggtctccgcctcctcctcctcctcttaccccgcctgttcggcagcggcggaggcggcggcgcggcagcggttgtccctgcctctccgccacctccacctcggcctatccccgggctggcggcgctggcggggagggggacagtagttgtagacgctgcccctgcctcagagaaggtgagttcccgccccggcggcgggggcggcccgggcctttagcccctcccatcctgcgaccccggtaaaggcccggcgcgcccggagagtgcgaaatggcggaccggacaggacctgaggctctccgcttcccctccccacccgtcacccctgggaaacgggcgccgggctcccacgtggatcgcggagggagaagggacgtctcccgctgccgggggagctgaggttggagcgggagagaggcgacccggccgaggctgtagatagagagtgacagggcgagggaaggggaggatgtgatggggacagaggcaaggagagaaaaggccccagacgcggaagggcgtagacctgcgcggggtgaaattgaacatcccggaaagtggcgacctcactcacaagtagggagaagtggagtcggaacttggggagaataggaagtaaacacgcgagcccaaggttcctggggccctggaggaagagaagagggggttaagttttgagggatcacttcgcagagtttccccgggttttttgaggataacaccctttaaaacaagcctccaagatgtacaagctcatcttgatagtggtgtgagttttaatagatacctgccagtgtcaaagcaggacttcagttagggcggcgaaaacaa

SEQ ID NO: 41836 - DNA, 1327 bp, Bovine  19866880913559
tatagcagagactgtcacaatattggaaatcacttatacatcaataaaaacacatgtggttttgacatagactgagaatcataaactataatggactaagaaaatgtgtcctaaaacactgtgtaaatttgaggatctgggaatatatcgttaaaaagattgtttattcacttttggctgtgctgggtctttgttgctgtctagttgcagcgagcaggggctactattcgttgtggtgcttgggcttctcactgcagtggtttctcttgttgtggagcgagggctctcgggtgctcgagctttagtaatggaggcacttgggctcagtatttgcagctcccgggctctagagcacaggctcagtagttgtggtacacaggcttagttgctctgaggcatgtgagaccttcccagaccaggggttgaacccatatctcctgcattgacaggtggattctttaccactgagccaccagggaagccctggaaatatatcattaatgtctaaaatttgtcagtggttatcactaggttcagggattatagatgatttcagttttatttacttgtactttgtgttttttgccataaataacactacttgtataataaaaaaaagaaagtcaagtcattttaagaaagcagagagaacatcaggcaaacaaattattcataaaatctacaaaaacagaactggctagtccttgtattacgtgccaagaaagagataaaagagatcttcaaacatgttctcacacatacgcacgcacacacacacagacacgtgtgtgtgttttaatctcataggtggggtaaaagaacagagaaagattctacttattgtgataaagtctagacctgttcttctttttttttttaacaaatgagaaactgagttagagtttaaataacttacttaaagtcacacagccagaaagtggaagagccaaaaattgaaccaaggcagaggatccagagcctgctcacttaactactccaatattggtaccaaccttctaggtcctatgaggactagaagagtgatgtctgcagagacactggtcagtgcccatcagctattaatattctcattaggaagctggaatgatggctagcagcatttaatgtgttacctgcgtagtctattctgagaactttgtctcttttttatgttagtgttttgtttttctagttaattaaaataaacacctatttgtgctgaaagttaaaaaaaaaaaaaagtcacagcagcaatattcactgtaaaatcaaatagtggattttgggcttcctaggtgggttcagtggtaaagaatcgatccctggt

SEQ ID NO: 41837 - DNA, 1048 bp, Bovine  19866880927230
cgctcatgctgctgcagctgctctggatgctgtggtatgtgcgccgcagctccgcgcaccgccgcctcatccgcctcaaggacacgtacgccggcgcgcgctggctccgcggtgagtccccgacgcagcaaaccagcgggcgggcggccgagcgcacagcgaaaccagcctgctctcccgctagctgcagccccgcggtatctgcgccctcgctcccttccacctctctcctgtagtcttctctgcctccgtcttcctgtccatcttttctgtgcccccctccccacaccttcacttctcttctctctccctccgctttcaggctcttgccttatattccgacgttggagctacggttacagaaacctattcacatctttctttccttatttaaagccctgccatggttccactgaccccgtgacagaggccacactccctatcctggcgttcaaggctctctctgatcgggtcccaggtgactcttcagttttatcttctttgtcctcattctgtgctccaggctcaaaggctttaagttcccgtcacagtgtctcattcctccaaagatctggccccaacgccaccttctccacacacttggcaggaattactcctcactcccatgggccatggacggaggagcctggtaggctgcagtccacgcggtcgctaagagtcggacacgactgagcgacttcactttcacttttcactttcatgcactggagaaggaaatggcaacccactccagtgttcttgcctggagaatcccagggatgggggagccctggtgggctgccatctatggggtcgcacagagtcggacacgactgaagcgacttagcagcagcagcagcccatgggtcaccatggctctatgtagagcccttttggcctttgtgaatttctgccttgtcttatgactagttggatatgagcctggtcatccagatgagatttgaggtttcttaggctcagggactgtgtctagatcatcttgccttggaaaaactacatacaactccagggggcccaaattcctgct

SEQ ID NO: 41838 - DNA, 2418 bp, Bovine  19866881006627
tgtcagcactgtgtcccacagttaccctttacatcttagccaaatgggaaccatttttctcttcaaatcacaagctggtgctttcccatctctgttagcagtttcctcagtcttcgaagcatgagtgtccatgatggcatcatgatgctcccgtatgtgaattaagcttgtgctctggtgcagtgagtacaatcagggcttgtgtctcctaggttgtgaagttatgccgggagtgcctgcagaagcaggagccagtgtttgccgacaccaaacatctaacacgctgcgactgctgagcattgtttccgaggtcctctcctacctgcaggcctttgaggaggcctcacactacgccaggaggatggtggatggctacatgtaggtgacgatcctgggtctcaggtagtctccagaaatgtgtctatttcagggatggtaagaagatggcaggcatatcactatatccctccctctggcacccacagcaggcattagtaatctatcaccatcctctttatgactgaacctctttatcatggtgtgcccaccaataatgtccagataatcagatctgatacttgagatgaaatctgtgtgtcaacctttgtcttgcccacctccaggttgtctattatttgggtggcatcttctgtttttggtttccttaaggctaaatctggcttgcttttaagtgcctagaaaggttccccccacccccaaccaatcaaccaatcaacagaggcaatcttgcagctttagagtttatcaaaagaaaaaagaaagggacttcccctgatagtcagtggttaagactctgtgcttctactgcaggggataagagttcaatccctggtttgggaactaagatcctgcaagccgcacagtgtgataaaaaaacaacaaacaaaaaaacagagagaacgagaaggaaaaaaagaaagaaaataaaagaggcgtgggccatccttgcttataaactgtaaaaggcaacttccttgcctttcctctgctaatgtcttctcttgccatatgtgtccacattggtgtgtgaatttgtatttctggccaaatgaatacttttgcataagaaagttgtattttttgaatggagggtacccttttcaatccatggagggtacaaaaggagggtaccagggaggtaagaataccacttggtcccacgaagagcattcaaattatttttttcccctaaacttcttagctttttcccaaggagaggttgggtactcctgaaggctgtcagctcccagtactcaagttccaagtacaatcctgcccccgtttccctgtgaggacttggctcagtggcccaggtcagagtctccacctcacagtctcaccatgtggggtgtttggtatctgactgcagctctgtgtgcctcaatctatctttgatggcggatacctcccagggctgatgggaaagcaaatggacttaatcagtgaggtcacttttatttatttatttatttatttatttttgactgccctgggtcttcattgcagtgtgctgaggcttctctctagttgtggcacacaggctctctagttgccccacagcaagtgggatcttaattccccaatgagggattgaacctgtgtcccctgcattggacggaggattgttaaccactggaccaccaggaaagtcccatggttgctttataagctgtcaaatgctgtgcagatgcaaggcaggttgggaatatgggttatgattacttgctatgtccccacaggaagctgtaccatcacaacaatgcccagctgggcatggccatcatgcgggcagggctgaccaactggcatgctggcaacattgaagtggggcatggcatgatctgcaaagcttatgccatcctcctggtcacacatggaccctctcatcccatcaccaaggacttagaggcaagtggcatcttgtggctgggctgggctctctgaagatgaaagctgagtactagattctgcttttgcaaagaccctagttgcctgctagaccaggagggaattcagacatgcttagtccctcctctcattttacatctgaaaaaactgaggcccagggaaggagagtaacctgtccttagtcacaaagctagtggatggcaaagctcagacttgaaccctaggatgctccaagcctagactgagaaaacctaatggtatgcatgtgtgtgtaacacgtacattagaaaacctgctatgtggagtagagtcagagagcacaggctctagaatcagactgctgctgctgctgctttaccactttccagctgtgtggctgctaatactgaatgtatgggcctcagtctccttatcagtgaaatggaggaaaaagacagggttggcacaagggtttgatgaattggtgtgtgaatggaatgctcttcatag

SEQ ID NO: 41839 - DNA, 1307 bp, Bovine  19866881129411
catcagggaagcgcaagagcactggagtgggttgccattcccttctccaggggatcttcctgacctaggaatcaaccaggagtctcctgcattccaggattcttcaccagctgagctagacagaaacattactctgttaaaatacaaacaagatgctcatgtctagagatcctccagaactgtttcattccaatcccttaagatgtgggcaggtagaacaagcccaataaagaaactgggattgggggagaatatgtatatatataaccgagtcccttcgctgttcacttgaaattatcacaacattgttcatcggctataccccaatgcaaaatgcttttggtgttaagaataaaattttataaaagaaaaaaaaaatcaattgcttgctctctcaacacaaaaatccggtagcagtttctgtgccatgctgcttacagctctattcctttatagaaagaagttaaagatagggaaacaagatgcccaaaaaggaaccagaagtcatcccacttcaagtttattttatgtgatttccagcatgcagtgtgctttcttggggaaaaaaaaaaaatcatcccagttcacattataaattaatttacaaatatagaattgtgttagaaacaatatttataaaagtccatacaatttttcacatacaaaaatatccatagaaagtggggtttttgtacatacagtatgagggtaggtagtttctttggttgtcttcctgtatatttaaaaagtaatgttgacattatttatacctcaatagactatttaaaaaaaaaaataattttctatatgtattatttcaaacttccaatttaacgataatgctgtgaatctcaaataatatacagggaaaagttaacaattttttacaattaatttgtgttccttttcctaaaaaaattaaaaactagcaatgttcccatcaaagaccaaacatggtacaagggtaattcatagaacattaacttcatcttaatgcatcactattccaataaaatcacactttctgcactaacactttttggataagttcaaactgtggctgagtgtctgccacatacagacattctcttgggcaccaagatggtgaccataaaaagtattcaaatgatgacacctcctgagaagtaaaagggagtgttaaaatatattacattagaaaaatttttgaccacaaatgttttcttttaaaaataaaaattccatttaaaaactatttttaataaaatactaaaacttggtttcaaagatgaaaaacccaggacatatgctaaaaaaagacaggatac

SEQ ID NO: 41840 - DNA, 979 bp, Bovine  19866881252001
aattagtatttaaaatatgcaagttccatctgtccagtgctcctttcataatctttctcatgttttatttctatgaggagactcctactatcaagtatagattcaaataaccaccaggagaagtccttttttaattgaatgtctactgtctatactagatactattctatatggaatattgagtgtgaaatacattgaattgcatgaggaccaaaaagggcttggacacagtttgaatgatagctggggagatgctacatagtggcacatattttaataatacagtttgggaagtctgacatccctgttttgtcttcctgggtttattcctggatttgaaactgtctgggttgtattcagtggtacataaacatctgcttgaaggaagacctttgaagagatctctgcattagtgtcattcacatagaaaactgagcagtcacaaggggccagaagcactgttaggagaagaacaaataaagccgagaggtttatgagaagcactgccagtttgactgttgcctagtccacctgacattctggctgtgtctcctcttccatcactgcaagctgtcagggtgtttgtggataaacagagtcctcctctgggtgatctatcttcttgccctgcttggtttgtgcacggatcactgcctatccttggtgaagtggcctagaaacttcaacaagcattttttaaaaaatcaaatgctgacttaattgctctacaaatgcaagatactgtctctgtatctctgtatggctccctttagaccctgagtgaactgatgaggtctcatcaccaactggaagcatcctggcttcttacagattagaaaatttggacatcttaggctcttcttggcctggtcccaaccttgcctctccatttctccaatttcatctaccacttccattcattttccaagagattttttctccttaccatctgtcatcttccttttttaaaattctgtcc

SEQ ID NO: 41841 - DNA, 1549 bp, Bovine  19866881565501
ctctgtgctttaatgtgtaatagatacttgctgctgctgctgctaagtcacgtcagtcgtgtccaactctgtgcaaccccatagacggcagcccaccaggctccgccatccctgggattctccaggcaagaacactggagtgggttgccatttccttctccaatgcatgaaagtgaaaagtgaaagtgaagtcgctcagttgtgtccgactgttcgcgaccccatggactgtagcccaccaggctcctccgtcaatgggattttccaggcaagagtactggagtggggtgccattgccttctccgaatagatacttggtgagagtaaaatttctctgcttcaagcaaggcaatgcagtccagcaagggttaaagctggcttcttgtctccgctggggagccaggcaggatggggttcctcctgtaatgggcccagatgccgccatgctttgttgattacaatctcccacaccatggaagctttgactaggtttgacataatcagctcacagcctctgcctgcactctttcacaaacaggccattttcacatctttttcatggaatccgacaagcggaaaaataattaatgttacctcagcccaacaatgaccctggctctgattcaaaaaggaggcatgttgcataaactgccctttaattgagggttgggggcagaccccacatactcctatatcggttctgcctccctgaccaaggctgattaaggctttcctaagactgcagacccctggtcactgagtactactcagtttcaggttcaaagagtttccgtgaaagaattctgttcatggtatttagcaagcacaaaccagtttcttctgtcagagaatttcagatgatactgttggttgttcccattttatagatgaaaacaaatgacttgctccttgcaggagacataaaattagaactcacaactacttttcaatattatttctttcttttgaggaagagaattattgttgtttttcagttgctaaattgtgtccgaatctttgtgaccccaaggactgcagcatcccaagctttcttgtcctccactatctcctggagcttgctcaaactcatgtccattgagtcggtgatgccgtcctcgtctccttttgccttcaatcttcaagcatcagggtctttttccaatgagtcggctcttcgcatcaggtagccaaagtattggagctttggagaaagaaaatacaaatgttattttattatagaagtctacatggtcttttacacagtttttgtgaatgctgcggccattcaagtggcaaaaaaaccactttggaaaagaatctggcggttcattttttgttttatttatttatttatttggctgcgttgggtcttagctgcagcacatgggatctttgatgtggctcacggactctctagttgaggcatgcaggctttctagttgtggtacactgtagttgctccatctatgtgggatcctagttccccaaccagagatggaatccacgtcccttgcattgcaaagcagattctaaccactcgaccaccagg

SEQ ID NO: 41842 - DNA, 1136 bp, Bovine  19866880348953
tcagtgatgccatccagccatctcatcctctgttgtccccttctcctcttgcccccagtccctcccagcatcagagtcttttccaatgagtcaactcttctcatgaggtggccaaagtactggagtttcagcttgagcatcattccttccaaagaaatcccagggctgatctccttcagaatggactggttggatctccttgcagtccaagggactctcaagagtcttctccaacaccacagttcaaaagcatcaattcttcggtgctcagccttcttcacagtccaactctcacatgaccacaggaaaaaccatagccttgactagacgaacctttgttggcaaagtaatgtctctgcttttgaatatgctatctaggttggtcataactttccttccaaggagtaagtgtcttttaatttcatggctgcagtcaccatctgcagtgattttggagcccagaaaaataaagtctgacactgtttccactgtttccccatgtatttcccatgaaatggtgggaccggatgccatgatcttcgttttctgaatgttgagcatacagaatagcactgatcaaatttatattcgtgatttgactaaagacatcaattttgtaggagctggtggcaagaacatgtttaacatggcacttgatgcctagtagatccacaacacaagtccaatagacagaaaaggtagtaaattagtatgttccaatctgctatatctagaaaatctaaatttatttggaaccttcagaagtataatttaagattggtttgatgataattgaaacatacggaaacaatcaaaaccctagctttgactttacataaaaaatattccctaatcaaggactgtcaaactttgtaaactttcctattgctgtctcttaatttttacttctcaatccacatagctaaactgtcaaagtcaaatgtagactggggggaggagggggaagacaaaaaaagatgatattttcaggctaaaacttttaaattattgttttaaattacttcagaagaaaaccacattaacatcataaatcatcaggaacaacaacaaaaaaaatcccactatcctcatggggattaacaccctacttcaaatgaccacaatcaaaaccagca

SEQ ID NO: 41843 - DNA, 3009 bp, Bovine  19866880543701
tagatattctttagaggtagatatatctttagatattccttttcctctaccaaattgcaaacacttaaatcatttttattgttagagaaataggtcctttattgtttgtgaaaatataatttggaacatatttgtgaaagtcagtttggagatacatatacgtaagtacatgcacatgtgttatatatgtgtagatgtgtgtatatacacacacgcatatgctcatacatatttggagccaatttcctaagaattttcctgtagaaatatgagaaaatattattcctagttttttaaaaggctgtttactacattttataggtgtttataggtaaaaaagtgggagcaatttaagcacccaaatctaatgggaaagttgaataaattacattatattcatatcatggactatcatgtatccgttaagtcatttgcagaaaaacaccaaataacatggtaaagtgttgatatattgtaaaaacatgttacacaacactatataaagcataataatgctatgtatgtgtccagaaaaaaatgactagaaaactatctgcctaaatactaacaattactatacttgagtgatggggttatagatggattttttttcttataatttttttgcttctcgagttttctgtagtgaatgtctcattaatatattttatgaaataactaaccaaaataaatgttacaagtttcttgacatatttatactttgacccagcaattttatttttcagactacatcctaatataaggaaatacactgtaagtacacttacagatgtacttacagctttgttctttctgacttgtttatagtaataaaatactggaatctactcaaatgtctagcattagtgaattggttttaaaaaataacaatgcattcatgcaatggaatattgctcagtctttaaaatcagattcttgaaaatatttaataaatggaaatgcttacaatatattcagttaaaaggcatatggatagagagataagtagagataatttaattacaattttgattacctaaaaaaattagaatatccattagcatgttaacagggcttaccaatggatggtgaaattatttatacgttcttttgatttccctttttataatttctatgctttcaacatttgtaatttttataaacagaaaaatatgtaaacaataaagaaactttattctatagtgtatagaattgttttattgctagtaatattaatatatgctatctatataaacatgatccctccaaatattttttcaaactatcatttctagtctactcagtttaatactataccacacaataagaatgttgaaatattttattgtaatcccttggtctttctgataaacagcagatagcattttgacctaaagatttgctttgctctataaaatgcttcaaacaacatagggatattcagagggctggccttaaactttctctaaacagtgacataaggtttcttttttttttttttttagaatataaatactttttattgtatataccaagtttgattgagtgtcaaagatttgcttgtacgtttttagttgccaactttagtttgagttgccaaattttaagggtttctccattcttcacttgttcagaatctaagtagggtaaaagtcaaaacagtttcaagttcagtggtgcctcaggtgtaaccttcctcttctgatgcaagaaccatacccacagggtgaagtttttttaattcattgagagagtttatgtctttgacatagctctaagtaatggcctctgactaaatgaaagacaagtaactatttgtctcagggaatgcaaatatatatatacaggtgtacttggagggctctttgtgtggggatatttttatgtctttaattgcttgatatatcttttttgtcacaaaagactgagcataactactgcatactgcatgatagataataagcccaaagatttatccatgtgctgctactgatgcatggactcaatgagtatttattgagtaaaacatagttctggccatttgagataaaaaagacacagctgttcctttcttaagtgaaaacacaaagacagttacatgaattttatatactctttttcaatgtttagtctccaataaaacaaaaaattataattgatatttactgattttcacttaaatttagtatgatatcattttaaaagttcagcttaaaatcattgccatataacccacaaatatcaccagtgaaagttaccaaaaacatatttttaaaggttcaggtagtttatataaatattaaggataaaatgcagtatattatgatttttcctgatgaaaagaaggacttacactgattttttggactccgtgcagctcattcaatagtttcaaattttgtgataggctttgaaaatacaacagggcaagagtttttgcttcccagaggaacaggcagaaatgaagtcaggtttagataaagatcagaccatgaaaataattgaaaggtgaaaagagaaaaggaaaggaagagaaacggaaagcaaagataaaagctttggaagaacaaagcaaaaaaaattttgtttacttggtttgtcctttctccacgtatgtcgttctgtaaaatcccacgagcgagccgttcagccagccggcgaactccaggatcaggtggtagggaccctcgccagtgttgggctcaagctcttcttctgcttccaccaccacatactcctgcttcttgtattcgaagcactgcctgacttgaacctgctccccagacggcctcctcagcaccgggagcctggtgatcctcgtctcccggagatgtagccacaggtaccgggtggatgagctcacgttgatggagatgtccacgctgcccgtgtacgtgtcctgctccatcagcggcttcacctccaggtcgtagtgcactggtttgatgaagtccggcagcctgaagtctttccagcctccactttcatcctcacggcagggcagacccc

SEQ ID NO: 41844 - DNA, 1827 bp, Bovine  19866880586707
aaaaatataagttaacttcatggggtgatgtgttaataagcaaataaagtaagtatttggttggctaaactgaaccttacagagttaagataggagggagtgtagaattgttatctgaaggaaacaaacaaacaaaagtcttaaaacattcactagtgtgtatgtcttaagatattttaaaaagggaataagtggttcaacttctctgaatgttgtctcactatctgtaaaatgaggataaaatcaacttcacaagatttttatatgtgagattattttctaaaatacaaaaatgaatattagctattgttatggctttggtattgtatccatcttttactctgaaaacatgaatttgtcactttatagatttgtaagagccacatacgagtgagtgcaggcacatacacgaacactttttcagaggaatattctctcatttcaagagcaaattaacttctctctcatcattgatccatttgagaacgttttaaaaagagagaaattttgagcgaatatttctataaaggaatgtaaccagcagtcaaataaagcattgttgattgaggaagttatttcagtaaaatcaacccatcctattcaagcatctcaattatttgaaggatgaaactcaatgtcatataagcaacaagaactttgagagcttagaagttgatgaaaacgttcagttatcttgcaactctagttacatctgttttcttatgagactcaataaaaccaagataaacagtattcacaaatgacaggcactttcattttattatttatgtttatatatggagtatctttttatgcttatttattattttatgtttatttatctgttaaaactttatatatatatttttaagggagaaaagggttactaaaattcaaaagtttgcttttatagacacttaaaaggcatctgcttttctagaagataacgttgagtcaaaatttgggattggcaaagcaatattttgttctctgtggtagatctaataggtaaattattgcattaatacttaaagatacagaactgctgctgccaacgtaacttctgtttgataactgaaatttcttgggagaagtggaatttattctaggtgcaatttggcagtgtgaaaacttgctaataatggaccattcttaatctgctcccttaatcctacttaaagtgtttttatgatgagaagtgattaagtacagagcacttcctacattcacaacatagtaattatttgaattcaagtcactaaaactgaaatttatatgttggaggatggcatggagctgatcacccaagattacaacttaaaatgccacacatatttgctatggtatacacttagtaattcagcaaattgttgccttctcctttattttccaggctcagctcaaacatgaaaaggaaatttgacccacatttaatgaccagatctgttaacagttttgtcatggtacctacatcctagttcgacccaaatgtaatacttgaccagcaccagatgccacagccttagtttcattagcatgaaaaggcatgcatggcagttgttaacagagactgtttaaataactgtatttgtgtagttagaaaaaaaatgtgtcttactacggagatttgaggcagagctaatataaatcatatcaactgaaacattcaacatatgtgaaaagtactccattccctgatatggtcaatatggaacaatttatgtttgtcaacagcatttgccaagaaaaattgcaattagatgtcattggtagattctctttttacttggtttggtggggggatttgcccatttgctctcataaaag

SEQ ID NO: 41845 - DNA, 1421 bp, Bovine  19866880633913
gaaatatgaaatgatgagagaaaatggagttgtattttctagagacagtataaacatcttttctcagtttatttaatttaatggatcaagatttcaagggatagtacagggaagtaacagatacaaataaacatctagatttttccatgaaagacttgacctagtacaacactctgtatatgtgtgtttttcccctaaatactaaataacatatcttcaggaaaatactctacataaaacaagaatgataacacaaaactgcaaaagaaatttcccataattttatatatcaccaaagaaaatcactgtttttaacactttgatttatgctttccaatctttttctgtgtatatatattttacaacaggaatttcacattgtatatatcatttgttatcttgcttttatcatttcatgtaaggacacatatattacattttgtgcattttcttttttttctgtcacaaacctatgttagattatgactaaaacagttatatgttgtattccagcaaaattggttaatgttttagagagaaaatctgggaaaatgctgttttataaacagcttaattttaaatttatgactaaaagaggaaattagtttctctttcaacttaaattttatgtaattatcacttagccactcgttctacctgtgtaatatcttatatgaacttggcgctgtgtaatgctatgcgcatggtgggaaggggactctcccagtgtcctgacaggcctgaggaccagataagcaagcaggtctcatgtgttggttcctgtggaacattcgcacctaaaaacaatattataaataagatttgtcacttaggctagctgcaaagatagtccacgatgtacctaaaagacaaaattattcatggagaagtctggactagcccataaatagtactaaattccttcgactagatttggagacagcatgggttgttagtagcagctgggacccataataactaattcatagcatttctggatgcattaaaaagacagcaaataaaagacatatggcacgaagtatgtaccatgaatgctagttccttttcgttccatttccttcttctttccttccacctgaatgcaattacctttacttacacttgtttctatggtcttctgaagtgccaataaaatgacctttggaaaataggagctgctgtacctcagccatccctagaagcagagcaggatccagagtaaatcactcgagtgtgcgtcccgttcatagtacgcgtctgttcaggagaaatcaagttaaagtaaatatttagagcagcagtgatggaaataagcataaactatgagcatgtaggtgaataatttttatatgtggatgaagaaagaaggcacttttgccttggatatatcctgaggacttaataaaaataatagcaactgt

SEQ ID NO: 41846 - DNA, 2254 bp, Bovine  19866880656421
atgaaggcggtaggttaagataactaaaagtccagtatgagtttctcatgttttcttctcttcctacggccaccttggagtcacatattgaagacagaaacaaaacaagatggaaggaacctaaattcctgacttagtgcttaatggagtgccatccaggggagtcacgaacaaaaatatccaccttggatatagcctaagtgagaaataaacaacacagcagatagatgggtactgcttgtttgggtagttggactgcgtttactaatacacagcgtaagtggccatttggggattgtactaaaaataaatgacaaatgaatgacatcaagtgcgtttacaggaggtaaagaaggattgaccaatttggtccatttggatcagggaatgtttgtttacttgagaagagaggtaagctgggtcccgagaatgactcaaaggagaagaggcaggagcatcagcaccagcaaatgcatcatgacagccatggatactgtgtgttcgcaaaacaatcaattggccagtctggcttgggggtaaatttgaaaaaggattgtaagatgtcaggaaccttctggagttaagtgaactggggcttggaataccatgccatgaacttgatcctgtcagtgaatgggacacactgaagatttttgcatagtgcgatggcaacatgagatgactttagaaagttgtgaggagataggaaataggagagtctgctccaccttggcctacccaccccccacctcgccctgcactccccccagaaaaaacaccccaacaaaaacaaaccagaaaaccaataaagatgttgggaggataaaggcagcagatagaacatagtaagaagtacaaactctttgcccttctcagatttgtcctgatcctctccagaggacttccctggtggttcagatggtaaagcgtctgcttacaatgagggagacccgggtttaatccctaggtcgggaagatctcctggagaaggaaatggcaactcactccagtattcttgcctggaaaatcccacggacggaagagcccggtaggcaacagtccgtggggtcgaaaagagtcggacacgactgagcgactacacttcttctccagagataagatctattgaggctgtgcttgtgcctcgccaatggccgtttctcctcttatttgccaacaaatatcctgagtttgcaccagcaatgtgtgctgctgtagagataagttggtgttgattcgggtcagtaatttctaccacattcctctccggcaggtaaagctacagaagggccaagtgaatcaggactcctgcatgaaattttagatgcagactgctgaggacttctgggaaattactgtcttcactgataaaagaaaaagatactcttaaggggaaaaaaaagttactcttccttcctctgtccacttcttaaccttgaaaatgattttcatagccagaattgtgacaaccagcttgggaccacacaataaaggttatggaatgaatagataagcacatattagtttcctgaagacattattgagcttccaaatcatgatgctactctctaactccagacttcttgttactagagagcatcatggttcagttactaagtcgtatctgactctttgcgagcccatggactgcagcatgccaggcttctctgttcatgggattttcccagcaagaatactggaatagttgccatgccttcctccaggagatcttccccaaccagtgattgaacccatgtctcctgcactgcaggcaagttcttttctgctgattcacgtgcaaagtccaacccttacaacatatgcatataaaatatcttagccacaaatgcaaaagatagcagataaaccaagaataaaactcactagaacccctttaaaagctaatgaaaatcaagatatcaaaggaaagtatctaaatgcagaagctaaacaattcaccagattactatcaatgacaaaagcagaaataaatgaggcaaagcattcagaagatagaagggaatcactccatccacaagatatagtattattttgcctcggatttggaacatcactgaccaaaaaatggatttagaattaaagcttccaaatcaaaagcaaatataaattttcccaagatgtaatttaataaatgattcagataaattcagtgggagttataatgtttatacagaaacacatatattctattcactgaagaaactatttatcaatcctcttaacaaatgttcca

SEQ ID NO: 41847 - DNA, 1277 bp, Bovine  19866880657499
ctgctatatcttttatgccccagccttggaagccacacattatcatttccacaaatcctacatagattaactttatttaatgtgaaaggggactgcaagatgtgaattagaggagcctggaataattgggatcatcatgaaggctgtctgctttattcactaaaatccctgataacttagcttttaggagtttctattaagccaacttcatcactttgggtgtttattgattttttttactataataattacctatatcattaaattccagcagtagctttaattctatatttcgacctattcagatctttttgaatgttaattctgtcgtatcagcaagattcctcagctttgaatgattgataagtgggttatattgtggaattttaaaagtacaacttattgataaaagaacttgctaaatacttgtgcctctaggcctatttagacttttaaagttgataaagtaagtacatatatcttaacctgcaccattatagaaataacacatacattattaagttaattttctataaataggggtccagtcctcccatgcaccatgtcgatatagtatgctaaataatgggcagctccaacttcatcaggaaactctaacacattttgaaagactgatgaatcagatagacaaagccctcaagaaatacatactaaagattataatgttttaaattttctaatttggaaacccaaaacatgtaacctatttgctatggatgtacacaaaatattagcctttggcaaaattatgaggtgaaataaattcattatcctttgcccactaaactgttttgtcattgttttcttcccctgtatttagcaagatgccctatgcccaactgatccttaaaaatagcttttgattaataaattattaagaaatcatgaatttccctccctcaagtttcttggtacccagttcctcttgtctgtatcaacaccttacctaagtccaagataggagagcttttaaagctatcaaattttgactatttttgatttttaaaagaagttggacaatctaatgacatttaaggagcttttgttttcgaagtctgaatccatatcaagctatctaatggtatgaattttcttatacagttgacaaataaatgaaaagtttttgtcaagttttggctgccttaaaagtcagaataggttgccaccaacttgctgctgcttctgctgctaagtcgattcagttgtgtccgactctgtgtgaccccatagatggcagcccaccaggctcccccgtc

SEQ ID NO: 41848 - DNA, 2269 bp, Bovine  19866880866250
ctttcttataatgcaagctccttctttcagggatagtgtcaataattctgcttttccctagaaatgtagcaaggtaaaatcagttccaagtcttcaacttattattgatttttctttgttcaacatataaacttgcctgttaagagctttccagaatgtcaggtattgagtgaagggaacgacaatataatatatctattcataaaagctttcagttagaattctagacaaaaataccatttgagaacaatatatttaacttaaagaagtaaaagggatactattagtagataaaaggtagagtaggaatttaaactggagaaggcaatggcaccccactccagtactcttgcctggaaaatcccatggacggaggagcctggtgggctgcagtccatggggttgctaagagtcggacacaactgaacgacttcactttgactcttcactttcatgcattggaggaggaaatggcaacccactccagtgttcttgcctggagaatcccatggaccgaggagcctggtggactgcagtccatggggtcacacagaagtcagacacgactgaagcaacttagcagcatgggctctatggttttacaataggtacagcttttctagatgtacctgagatatttattttcaatggttattttgaaagatagagtgctttatttgatattatttacaaaaaaaggatgatctgacattttatgcataataacttccaactgagaacattttaatgtacctcctgcaaatacagtgtgattttctgaatctacactttgtaaaatgtgtgtagaagtcatggcccgtgtgagtgtctttgttccacctccttctgcaggcctcagcctggaacactgtacctatcatgtcatttctattctttcacaggcagaaagggaaatcaactcacaaatgcagtgcatttcatatattgggactgagtttctttgcagttatgtaagcatcaaaatacttaaggttttaagagttctaattttatacaaccaagaaaacaggtgagaggaatgtatttgccttctcataggtctcagagctgaaaatatgattaattacatacttaccttctcttttttttccttatgcaataaacatgatttgaatacttatttttaacacaattgtgtttgcagatactcaattttaatcaaaatactaaaatgaatatagttcaaggggtaagtaacagcaccacttgccttaactttgagattttaatttatgacttcttaaattttgcatctttcccaaatatctgtttgtattttcaataataccaattccttatagtattaatcctataaaaagacttcttaaaaatgcatatgtttaattatgtgtattattatatgtttattatagatagtgattctcctaaaataaatgtgattactttttgaggcatatgttcctgtcagtgtatacaacatggaataatggatgaaattctacaacaaaacatgtttcaggtacaaaatagtgaatggaaattactatcgtcgagaacaacaacaacaaaacgtgttctaaaaccttaagaccttgagtacgtttcctaatcccctggtgccttttaacaagtgaaactattttttttttataaaattgtcaatggcttttctttagatttattgggatcctgcttaaatggaatatctgtcttttgtgtttcaacaatatccaaagctttctcatgtattattttcccagtacacatgcacacacatgaaaacgcttacagagaagttcatcagtgtgaaagcctgatcaccttcatgtaaaatgtgatctgctatgtctggtgaaaatctaaaatgagtaaagcatacatacattttttttctttgctgatagcctcttagtaatgaatgctttcatattagaagtgaaatgtaattcatccttatcattctgtatattttactttatttgcaattaattctcttgctatattacatctacgttaatatatgttttcctagaaattctaaggagagtactgcctctaatttatttcccatcttgccgttgatttaagcaggatttaataccagtgatctcctttcttagttacaaatatacacagtgagtgttctgagacttaggaatgaacctagaattcagaaatgggtttttattgctccttttgatttaaaattaattaccaattattaatttaaaaattcacaatgagaattagtagtctcaggttgctatttagttcattcctcttattt

SEQ ID NO: 41849 - DNA, 1637 bp, Bovine  19866880887073
ttttaattttatggcaggcttcctttccataaattttttaatgtgtatgtgacaaactattagtttttatcttcatgatttctgctttttgtgtgatactttttaaatgtaaaatttctcctcctgtttaattctttatatgttgatatattgcctgtatcctttcccaacattccaaacattcaaggtttatagataattcttgtgattgtttttttacactgtgattaactgggatgaaattttacctgtatcactgtcatttgcattttggtttgtaaggatacttgtgattcttactttttaagagagaaaaatgcaaaaggtataggaatagaatataatcgctaaagtgctatctttgcacttagcttcaaatgtctttgcttagcaggctgatacagatcataatgccaaatatgcaagtagccaataaagctttatggaagcagaataaatagcctatattcaaatttctgtatctgtaggaagacacatcgattattagttaagataaaggtgacagagctattctgctgtaacagaaacacagaaatacagcagcttaaaagacataagaaattatttctcatttggatcggtctcctgaagtgagcattccaaggtgttaaggtggttgtgctccatgaagcctaaggccttatgctgtgtagttgaaatctggaagaaggggaaggaaaaaaagaagatcgaaggcaagcaatcttcctttacttccctaacaagaagatggaagttgcacctaccacttctgtttatgttccattgatgagaactggatcacctttttgcacctagctaggaggaaggctgagacaagtaatctgactacggttctcatgtgtgtaggaaaaaggagaacagatttggggaatataacaaccagcctaccatttctgggaaagtggtgtggatctgtctacaaaaaaaaaaaaaaaaaagtgaagaagttgctgcgaatttctcctgaatagaattattttaaattaaataagtttacttactgttttatacttactgtactttgaaaattactttaaaaaaactctcaaaataaaaaggacatgtctgcatctagaggaaagatttaaagttctgagaacttatgtagccttttccttccctaaatttctcttcaggtatacactcaataacagaaaccttggccggattgtcactatagcagagccattcaacactgaactacaactctggcaggtaggaagataaattcctctatacttgtcagagaagggacagaattaattttttttcaagtagaaatgatattttctctattcagatcccagaagactgggaaaaagtaataattcttatatataattaaatgtacatctatttttttctaaactaaaaaaatttcaaataaccaagagataaagtttaaaagttgagaaaggtgaagcctggggaggcttaggctcatagtccttgagaccatacagttcagcaagccatgagcagtccatctcccctttccaggtaagtgtaatcctgggataagctggtcaagatttgattcctttcagaactcatagttttggaatttcaaaactaagcccaaatctttcagatttcggatacctcaattcctg

SEQ ID NO: 41850 - DNA, 869 bp, Bovine  19866880914186
cctggagaagagaaaggctacccactccaatattctggagacccagtttgtagtactttgttacaatggtcccgacaaactaaaatggtgcatttgtctaaaacaaaggctttattaatcatttcttaattccctggtctatttctaacctaaaatgtggtgggaagacacactttattttgatgagaacatgttctgatggtaagtaaattgtttttaaatataagttaatgcaatttgtcaaaactaaaattgaaatgccttctaattaccaaataattccctgaagaagaaacttcaaagtaggggagaataagcaaatatttattaatgggtcttgtgtttcctctcggaaggtttgtctgcctgtagatgaactggatgcttgttagagtggaccagatacagaaagtggaaatgaacacaccagggaggtggaggcagctccaacacctcccaatccattcagctgacctatcctaaaacacaaaaacaagccaaggaaaacctctcttgactgcacttcccctcctctcagcttcattacataaataaatgtttaaaaagagcggtctatacactgtgttcccttcctcctcttctttttgttctttgtccttctccaatctgtctccacctcttgttgtttcgctgaaactgctcttgcccagggctcagagactgtttcagcaacatctccccctcatcttacttctcctttagagacgtttggtcctgctcaccatctcctcctattgaaactctcccggcttctatgatcctgagctctctggttttcaccacacctctctggttgcgcttctgtctttgctgcctatttctcctctatctggccttccctggtagct

SEQ ID NO: 41851 - DNA, 1429 bp, Bovine  19866880934096
tttttaaagaaactgcatttaattgcaatatatgttgaaaatgagtattctccattcttcttactgataattaatattacctcatttaccaccactacaaagagtggaaagcctatttggaaagccttggccctttgctttttgtgtatttgcagtttataaatgttaatcccagtggatcccaaggataagtgtagattcataggctagaaacattttgtaagaagtaagaaaaagcagacattccctctcagttatatagcaaagaacttaaaaactttgaactacaatctaaaaatcttgccatattaattaagattttgaaaggcaagtatccatgttcaaatgttgatatatttataaatactttgccttatatatttttcttcttaatctatactggtaatataaaataaaaataatgatgatagaaaaatagctcgggaggcttagcctggaggatcattgataagatgttaaacatcagctttttctaagacggcaacctaagaatgggcttttacattccctgggaagggctcaggacactgagcctgtgtaacataaaaaaaaaaaagtttactttagacttaaggttggcattttaatatgcgttattcaatgaacatatgatgcactgtcttaataaatttgggaaatgaaaatttttttaaaaagtatttcacagttatcagaaacatcttcaaagcacaataaaaaatcagtgtttgtgtaacattcgtgtatgttgtacataagtattaatcccaatttatagataataaaactgagaaaaggttctttaataacttcagagacaattggtgaagagtatagttttgtttcctatgtttctgtttaaagaaatattattacattagacaaaattatctaataaaatgttacaagcatattgtttttataattgcaaatattttgttagcaataattctgaagttatttaaggatgaggacatcagctcacccatcttctgtatattttttgtttttcttctttaattatagttgatttacaatgttatattggtttcagatgtacaacatagtgattcaatgttttttatagattatactccatttaaagttattacaaaatatttactatattttctgtgttgtacaatatatgcttgtaggttattactttttacatagtagtttgaaactcctgtgtagttttccttcttattactctagaaaaagtaatatagctcttaagaaacccccaaattgtgcatattacattaagatttaagaaacctcagctcttttcacaactctgttatcaacaattatatgactgtgcttagtttattgaaagcttaacagttacagatacatatagggcacatgatggatcccccagatgtccctcaaacagtagataatgaaatgattctcagtgcag

SEQ ID NO: 41852 - DNA, 1193 bp, Bovine  19866880977622
gtgacatcatgtgagcagagaagtaagtgcttctgaggaaaccacaccatggacttcctaccaccttagcaaagcctgaaacatcagctaccaacactgtcacttgactgatcaaccatcttcatctcgttacctccaggcatagcaaatgagtcctactaagattcttgcattatacctgcctccaagtctccctgaaatcttactctgtaagccatcctcagccaaaacatagtatagacagatgatggatagatagaactcacctgatgctcagtccctttcagagcacaatatgctctttttttgtgtcttaacttttaagagtaactgtactcttaaagatactgtcttcattcctcatttccaagtcaattgtcaacccatttagagctgttttctgtctccacttcaaccctactccaaaaatctccggtgacttcctttgttgctgaatcagtggatcctttttaatatcattgcttaattggcactgtcaactagcccctccttggaaaaacggcctgtgatttctaaaattttgagtaactgcttacttttctctgttcttcaatgtaccctctcctctgttcactactgaaacacttgtgattctcagagtcctgtcatcagctcattggtttattgattttaaatgctttctctgattgacttcattcattctgatggtttcaaaatgcaaatgactccccatctctctctttctctctctcacacacacacacacacacacacacaacacagatgtccctagccagcccagtcgtcttccccaagcttcaaaattacatatttaacaggctgctggagatctccacctatatatcttgtgtatgtgtgcacattcggtcatgtctgactctttgcagccccatagtctgtagcctgccagcttgggggggtgtggaattccccaggcaagaatactggagtgggttgcattttcctactccaagggatcttcccaacccagggatcattccttgtctcttgcatctcctgcactggtagacagattcgttaccacttacccaggaagtcctgctgctaaatcgattcagtcatgtccgactttgagtgaccccatagacggcagcccaccaggctcctccgtccatgggattttccaggcaagagtactggagtgggatgccatcaccttcttcacctgg

SEQ ID NO: 41853 - DNA, 3526 bp, Bovine  19866881033808
attcttgcctgggaaatacacggaacagaggagcctggtgggctacagtccatggggtagcaaagagtcggatgcaaatgaacacatatgcaaaaaaaacgcaaactgtgaggagataccaccgacgcaggggatgtggagccagcgatcccctcccagacagaactcccaataagggaactgccttcaccaagagatgagtacactgacatgctgatccagcacctggcctgtttatagcccctaaggagcctgtgttagtccagtaaatcaaagtggtatctccctgaagagctaactgaaagggaagcagtgcaaaccacgcattccaatccttactgggccacctggaatttaaaactaaagcactggcttttatttcaaatgcataaggagcctacctcctcagtgtgacctttccctcattttagagaattaaacagagcttaccaaagggtaaccttctctctttttcatgcacctgcacacatcccaaatcaggagtgccgaaactaaatgatccttgaaggctgggaaacagcaatgaccttttgtaagtaagtcttcctggaaaacatctgggaggaaaggtcttggtgatattagaatcaatgtcaaaagagctgataatttgagaaaacatttaaaggtgcagaatctatttcaatggaatctcaaacctccaggaagggacttgctgaaaatgaaatgaaaaatgaattatattcttgccttgatcttcatggcttgagtgaaaaacccaagctgggtaattattgggagcagtcctaagatgcatattctaatcatttcattataacctgctctcttcagtgagagagcctctggaagtatgctgctcacaattattcaagtcagaaatccagggtaaattgttttaatccgttcaagtcaaattaatatggtgtggatgtcctatggatacagattctcagttatctttcttgttgacacatatgagaaaattctggctgggcatacatgatttattctttatatctggagccgggctgtaatcattcaccccgtttcaagtcgagtttggcaactttatctcgcttgcagtttgcatttttgtgaaagtgaaaatatattctgcagcttttgatgtgttgatgggtaggaaggtaaagacagccacacgcagtctctggagacgggctcagtggctaaatgaagacctctagtgctttcttgttagccaagatagatctacatcctgatgaaccgcaactagtcaatagcagacgctctcaacgcatgtgctcagaagccacaaatcagttttccctgggacttagttatcggcatattgtgccgtaggccatgccctgctgctgcttgcccgactgtaatttttcccccagtgaagtttttaaagtcacaggctgagaccgtaaccgtactctcctggcaacaaggctgttgctagacttccagatatcaattgcttatcaaataaattgctactttaatgtccttagcctcttgctattaaaggaggttcagtgccagcaggatttcccactgttatgtttttctcttccaaaatttatttccaaatgtttccttacctatgtgtctgagttggcgcattacatttttaattctccatcacttctacctgaagtattgcaaaagcccccctattggtctcagcataattggcctcttggctatcttaaccaccttgcttccagaggtgtctttctaaaatacacatctagtcacattgttattcctctttttagaatttctccttgtctttctgcatttctcaccagggccttagggaagttccctgggttagagcctaggatacactaagaaaatacgacttgattaaggagaattgctttcctgggataccagcgtgtcctctgaaagtggcccagtgcctctttgtaaaattataatttgagtttaggccccaaagctatttttgaaatacctgtgctgtcggcttgtgctgcagctttcaaaaggattaatgggttctttctatgagggcagccctggctctgcccagcaggccacccctgaattgctctgggcagaccaacccctaaatgtcagttctccttcttgatgaatagacttctctccccgctgtcaatggggcctcttcgcaaagatcccaagtctacacggtgcccactaagaagcagccactattgttgtgcacctgattctggatgggggcagttctcaccctcctctgctccaatgcagttgccgagtgaggttctcagggcaacaccctcctcctactttgccagtgggagccgtcttcagcaccctatacagtagtcacgcaacaccagactcttgagagcagtattgatagcacatgtaacctgctctcagactgcccactttccctccctctccccaggacactgcagcaaccccaaacgactcacaggtccctgcctcttggagcctcaggacgtggcaggctacctgctgtggttgccttcacccgggttcatcttctttatctgcctgctaaactctaactcagtctctaagtctgaactcaaacatcacctcgtctctgacatttacaaaggctaaaggaaaaaaattgtctttttttcttccttttttttttttaaatgagagaggcttggacctgtttggaagagaaggcaatagagtgggagggattgataggctgggataattgacaaggcccagtccagacggagatgatagaagggaagatcaaagtgcagaagaaaagcatggtatgcctacccttagacaacccccccatggattgtaagcatttgtttgcttgtagctctccctgctgcaatgacatggtagcccagaccaccattgtctcttgctcaggtcacttgctcagcctccaaagtggtctccttgtttacatttagtctccactttagaatcatctcaataaggcagccagagtgagtctcaaaatgcaagtcagatcttgttactcctctgctcaaaatctctccatccctttccatgtaaacaccaaagggccaccagcccccagactatgtgctctgctctcttcccttggaggaccatttgatcttctaatacaatattttagttacttattagattgtttgtttaaactcctcactccaacaagcatgggagctgcttgaaggaagtttggtctgtttactttcctgctgtatcactcataactgggacacttagtaagtcctcaataaatatctactgaatgaatgaatgaactttcttatggatactcaaacatgcaagtaagtagagatcgaaaacctcatagaatttctgtcatccatgatgttgggaaaaatcttagatatctctaatataagtccctgtcaatactatttttgatttctgagtaaactttgtaaatttggattacttgcaaaggatgctatggcttatatgagaatattacataaaattatcatcctcacatatctcagttgattatctcttggtattttttttttttttttggatt

SEQ ID NO: 41854 - DNA, 2040 bp, Bovine  19866881042089
agattaagtccccctctgcagttaggctttctctctttcgatatccatttcagtttctgatagttttttctatatcgccagaaaatgcaaacatttcatactcataaaaaggaaatggtcttacatttctttatttgaagtctaagacattcagaagctgatcaaaagacttctatatatccactgttaaaaatgaaaataataatttgatggccaattaaatcaatctttaaaataagcaaaattaattttaaaacgtattcatataattcaaattttaaaataaagttttagcttgaaatatgtagtgaaattataacaacaccatctttttaactaacattaaggcaaaggctcaccacgttggaggacaaaggcctgatctggccttctcaactctgctaagccagcactgtcttcagaaatgatttgaatttgaatacgtttcagcaggacaggctactctgaaattcccacagtatttcctactctttgttttcaactggtaactttgttccttgctgataaatgatttttaattggtgacttctgttctatgtcattctctgttttgtatagaatcagtttcaactatattgttcttgctttcatttttaaaatactaagcgatcataggtttttaaatttaagctgcccgttttcatttgaaaagtgtctaaaacgcttcagtctctgctagcaagggtttaacctgaatgccttaagtaaaaatattattgccaagatttgagacgacaagataattcatgaatgtcttccagttccaaccacaaagcagttaacccatgttttcgaacatttgaaaatatatatatattattttcttagattccacttccttgaggcatcattcaaacttcacatgaggttcagaatgtagtaattagcagtaggctgcttacatttgccaatatatttgtacaaacatatgttggcactcggttccatatcagctacacatcaaagaagggtgctgaggaggaattattctacctcgggggctggattagtgtctctgcctgaaataggcctcatttaagggcatggtttgggggaaattaaagaacctgcatggcctgagtattggagtgaatccattaacaaaaagctgtgctgaatatttctgccattctttttccattcctgctactatgatcctggggcaagtcgtaacctctttcatcttcagtttgccactctgcaaaaggcagaccatataattctctcgcaagcacctcacagaagcgtgggcatggcaagcatccttctggtaggaaagccggtgcttccttctgctgatatcctttttcaggtatgcaccagccttctcagcgcctctccccacaccctccacacctcaccttaaaagatgaaagccctgagcccccaatatagccacaacaagcaccaaagacagaaaaatctccctaatttcacctcccaagagaggctggctttctttccattgctgtgaattttaatagcactattgccaaaatgagttcatctgttttacaggaaaactaaataactttaataaccttagggctgacaatgtacaaagttctgtccgtgtttccccaaattcagtcctccacagaaacacttgagggtacctacgatcgtcttcattttgcataggaggcaacagaattagattaagttgacttacccaaggtcacaccactaaggcacaaggccaaaattttagctcaagtctaactccagagccaggtgactcaattgttctaccagagctcaggattgaggaagaatcagcacaaactcatcaagaagagactgtcatcagtcagtaaggtgctggagccattactccaaaggtgggaaaaccaagtgatacattttcagaaatctcgtgagagtgatagtaattattcaaatttaaactatagggacttcctggtccaggagttaagactctgtgcttccaatgcaggtgtaggctccatccctggtcagggaactagaccacacatgctgtgcagcacagccaaaaag

SEQ ID NO: 41855 - DNA, 1371 bp, Bovine  19866881054196
aatttgagtcaaaaatcccagtaaatctgaggaaaacttttgtttaaatcattgagtacctttgatgtgcaactataaatttgcacaccagtacatgtataagcatccactttatctgtgtgcccaccaatacagtatacaattgtttcctcctaaaaaaatcaatatggctgtgatttcttgatggttcattcactgtttatggatagggattaatgtttgaccttcccttgccttcttgacttgaaccaattactttagaataatttttctggtttaactttttatcacatcttctgacattttagtgaataatatttgacagctatgaacatctgcaaaagttatcgttatcataagtggagctcagtggaacaaccgtcaccaatgctctgaagatcatattgtactacagaggagggacacgcttatattttttaaaaaattgtttgatttcttagcaggagtctttgcttagtttgctttaacaaatgcagattgtttcaaaaagtgacacctgggggtggaaagcacatttgcattccataccaaggaagcctcaaagtatttatttttcattttagaattttatgcattattgtcatgcctgaaacagcttttaatcttctctttacatatatctttttcttaaagaaataaaacaaaatctttggaaacatttagcactgcaaaccagttttatgcatcacaggcttgcaagtcctttctgatcaaagtatttcattttaacattctgatttcttattcagtgtgtacccagtgaaactggtgtattgcattctccttgacgaaagcaatagagacagaaagcgcagtcattttatgtgcatataacaatataaatcacaaagattaagggaaatcattttggggaacaccacaattttgcaagcaaaggcacttaaataattacctttttaagcaacttttattgactatgcagaaggataaaaagtaatcttacttgttttaaatggcataaaacaaccaaatgccattaacagagtgttacattccttattttactaagactgttgaagcttaccagaaagggataaaaaatgtataaattcaggaacactggctagtaatatcccaaaccattgtcagtggactcctactttcttctgccaaaatatgtggaagcatgcatggattgtactagattagtacgaggggctcgttttccgtggcattagccaggtatcttagcaacaagaccataccagattctagcagtgctctgtggtggtgcatgtaatatcctggacataatctgtcttttaattttctttggattgtcgtgatattacagatacatgtgttcagttatagatctttatttaataa

SEQ ID NO: 41856 - DNA, 854 bp, Bovine  19866881059784
ttaggaagagtttaggaaaggaaaaaaaaataaaaacaaaaactaattttcctatcaagcaaagggataacttgaagttgaattaatgtttttatgaaaaagatctttacatagatactactagaacatacaagctaactctgaccactaagtaagaagcaattcccttttaccataccatattccctactttcctttcacctgtgttcaatgcctcctgctccaagcaggcatttggtggtgcagggggaggaaactgagggaatataaaatttttataattaaggctggattagtcataagaatgcccagcaatccaaaggctgagcagcatttttgatgtttaaaagaagtgtgtaatgtcggattaagtgacaagaaaccaagcctttttttcctccaactaggctttgatgtcgggggtggagcaggccccttgccatttgcagtcgcctctgcgcattgctgacatggtgctccgtgttctgatcctctgtagcagagtccttgaccaagcaaaactgacactcggtcttattaatgtgttcctctggattgctttttttgttatttcttgctactctgatttttctcactttaacattttctagtgactttgattgatctaatgtaatctctttttttccactgattttcaaagcatgaaaatttccctgccaggtggatattccccaattctcacaactagacgtatatatatatattcttttttaaaattagattgattccgaacagtgagaactcataactcatttgaatggaaaacagttggggggttgccacacttcatttgtacttgattgttgacactggtggcagctgttactgccaat

SEQ ID NO: 41857 - DNA, 1091 bp, Bovine  19866881060380
gaatgtatataaactgtacatgtatacacacatacatacttctccagaacaatttactgggtgtgctggttccctccccaaaggagtaaacctgagagtcattccaagctaaggtactttctatatttctttctcctttcttctttctctcttatattatttgctagctagcaataatggaatcccttgggtttcagccaaagaaaaatctgggcgacaagaacagactgcagcttttttttttttttcctgagtgcctcttttttcttttgagtttctgatgaatgactataatttatttctaccaaatttaaataagtcctgctgccttgtgtatttaactaggcaggcagagggaactggtttgtttaggaagtagtgactgagaaaccctggccaggtgacagaggagggcagaaagaatccagaccaatttgtatgcagtatattttactcccatgaaataaaacacatttttttttcatatttgctgaaaagtaaaacaataatattgtacgaaatgttatacacagggtaggttgtacatagcagtttcagaaacatcattgcatccaccagagaaactattctaaaactgatattcacacatttttttataataataatatgttagaaacatacagtgtggcatttagtatatacattcctttgctcgcaagcgaaaaatcctaatcgcttctgtataacatgctttattttaaagcctaacctttaaaaacactgttgtgatattactaacaactgctttttataaaattaatttgacatttcgatatatatacatcctttcagtcattttaatgttaacaatgctaaacttaaaaaataacaagcttatagtaatgttaaaatgtcatatccagtcaaacatttgtgtgtcctcgaaactgttggaaatacttttagtgaaagatgtcagacgttgagaaaattcctttgaaatcaaaggagctctctttaattcagtggtttccttttctccctatatcttctctctctctccctttctttctttagtgcccacgaccttctagcataattcccagtcttttaagggcagagctgcccca

SEQ ID NO: 41858 - DNA, 438 bp, Bovine  19866881116464
tcatcagacagttcatactggagagaaaccttacaaatgtgatgactgtggcaaggcctttcgtttaaagtcattccttttaactcatcagacagttcatactggagagaaaccttacaaatgtgatgagtgtggcaaggcctttcgtgcaaagtcaacccttttatctcatcagacaatacatactggagagaaaccttacaaatgtaatgagtgtggcaaggtctttactcacagctcaaatctcaggagacatcagaaaattcatacaggacagaaattatttaaatgtcatatatgtggcaaagtcttcagctgaagtgaacaccttgctggtcatcagagcgttcattctggagagaaaccttacaaatgtaatgagtgtggcaagcactttaatcagccttcaaagttcataagtcataagagattacatag

SEQ ID NO: 41859 - DNA, 1395 bp, Bovine  19866881208326
tttattatttctttgatataatatgcccattaagtttctctgttttccttttttgagagacttctattagttggtgctagggtttttttcatatttatcttctctttcacatttgccagttctgtgtatgcttgtcctgtacttttagagaattctccaaatttatttcgaattggcctattaatttctttgacaactgaaattttaatctttcatagctcttttatatttttagtttgtcctttcaaaaacaatctgctcttagttaatgtgtataagagctttgatctcaatatatttcataaattttttatttcaattatgtctcttattgagatgggtttattgtttatccatgtgagattttaacttttatgttttttagatttttttcatgcatcttgttatctttgattgttcattcatgtttaagaaagaaggactaaattgattattcttggtgtcttgtatgtaacccctctactgttgagaagagaggtgtatttttgagacagacttttccgctgaacaggaagtctgactagaggctctgtgtatgtatgagtggagctggcagctccagcccattcatcctacaaatgccacaaggaggaaagctttactctgagtgtacccaccaaatggaaattcttagctttcctccactgttttagtcaatttgttcaggggaaaaaaaaagccctctgggttttgctgggtcattgccagacttttgagagctctgtgcagaggaaagaagggcagtcagtgaagggaaagtggagggagaggggtctggctaatgcaatggtcccgagtgcagacttcaagttaacttcccttctttcaacctcgctttcactcctgccgtccactcagtgctgacactgagcccaggcccatctagggtaggggaagtcagcttccacctctgctcaagcctcttttcatctggctgcaccttctcagtttgttttctgtctatattcctccctctacttttcttcatctaggaacttcagagttcctctctgttttctttacttctctatttcttttagtacttctatttcctttttcagtcatttccgggaagaataagacttgcatgcacatgctcagtccaccattttgaaccagagatgactgagctatttctaaatgtctatttccataaagacactgtgcttatgaatcaggtaccaaagaacaagttctaaatgaattgctggtatttccatcaaatttctgcttcccctgaagtgcattatagagtcttacccaaaagctgaatgtggctcagaagcattagctctcgggtccaatagaaagcgtttctgtgtgatgttcttcatattgtccacggttaagtacaggggtaacccatctggattg

SEQ ID NO: 41860 - DNA, 811 bp, Bovine  19866881257743
ttcgtatctgggaacaacacccatatcttgtcctcagctactgacatttgtcataaattccaattgactttttgccagaagagcttcaggatgattttttttttttcttaatctttccacaatcttcagcatgattcatttcggaagtattgaatatttggggcctggatattctaggaaatgatcaagaagcaagaaaatcagtcctaacttggtgaatccaaagatagttttgtgaatccagtagaccctctggaagactatgaaaacttgctggtaggaactgaatacatcagggctcaagaggcaaaagtaataatgataacaataaggcaaagatatctatgcagtttagccatcaaaggctttatgtagaacataaatctggaattgtgttttgaagaatatgtgggacttgaaccaaaaaataaaaagtattttagattttaaaaaaaaaagagagagagaaggaaaaaatgataaataagaaggccataagaagaaaaacaaaatgtgctgacaaagagtactcccagatcttttgtacaacagagaaggagtagaactgtggttatactggttcagttcagttcagttcagtcgcttttcatgtccaaccctttgcaaccccaccaactgcagcacgccaggcctccctgtgcatcaccaactcacggagtttactcaaacttttgtccattgagttggtgatgctatccaaccatctcatcctgtgacatccccttctcctccgaccttcattctttcccagcatcggggtcttttccaggagtcacttcttcgcatcagg

SEQ ID NO: 41861 - DNA, 1314 bp, Bovine  19866881284228
tcagacagatacccagtgtatatatgaaattgtgaagcatcccaaatgcattaccagtagaccttaatgtgctctatgctgtaaagaattactgatgatctttctgggagtaatttaaacattggacgagggcatcttctagatcctttctagttctttattcctttgaagcctaatttctcttccctgtttaggaagaaaatactgtgagacccacaggatagagatgaaaaataagagtgtgtgtcctcaaatttttctttcaaaaataccatggcatttactggagatagtctggattcctgtgacagaatgagttgagatcccccttgaaatgaactcacatgccactttcctttatatgaacttactcttcatgcttccttactctacacacatcccaaaggaatgggatgttcattgccagaaaataggaaactggatcgattcttccctttttttgtcttatataaaattgggactccatgcatacacttatatgaatctctcccttttggaaaaagccatgtggaatcaatggtggctcctttttgacaaagagacaaacttgaattgggaagaacctttggggtcagtaacgggcctgaggtgatgaaatggtcctggtggaaggttccttggcatcctctcctggcgaatgttctaccagcaactggtccacggatgttcccacagacagtgtccttgggattgttatttctccccttcatttgtctcctgacacccctccactcacggtttcttcttcagcataggaagtcatctcatttaaaatttcaagtgacttgactacagtaatagagctcttaggatacaaatcagacagaagtaggtaaagataggtaggaatccatctctcctttgagcctggcacagattagcacaacaaccagattcctaacaggtttttctagatttcactccccactccacctgcatgttgtccttattcttattacaacgttgggatgttcttattactcaatccttacattcatctctctttggttctgggataaaactactcaaaccttaatttagatattttatactcccttagaatctctgggaaaagagatcttataaactagattcccgggtcttattaggctcagaccaacctgaccattaattttcctactgttcacaaacatccctgaacttctttctctttcctgggatgactggcccatgacagaacttggagtttggcctttcttttattcagacaattctcttttcctcctctctcgcacttcagacatttctttctctatcccccaggtaatatat

SEQ ID NO: 41862 - DNA, 909 bp, Bovine  19866881304800
gtgcagacaggatgggcccgccgtcacggctcgggggctcctgattggtatggagccacgtcactccagccggcgaagggtctgggaggaggcggaggcggggagggtcggggaagggttggggaagggtttggggagggcaaacggcccgagtgacgtctcggcaccaggaagcccgcctctggttttaagatgttaggccaacagggaagcttagagccgcagaacgggtccgtcgctcgtctgggtgctgggagctgagctgcggcgaggccaggctcgagctctactgcccgagggggtgtgcgtgtgcgcaccgcggagggtgagcccagaggcccgcgccgctgccgccgccgccgccgccgccgccgccgccgccacgggagatctaatatcagctacctgtccctgtcactcttgacacttcgctgtcagggctgccgcgcggggggcgggcagagcgcgaacggcgttagctttccttattggaggggtacgagggggagggagggagggaagaaagggggtctttgcccactcttgtttcgctttggagcttggaagcctgctccccaaagacgccccgaaccattctctcctacccacatccccatgtctctccattgacccgctgactttcggccgctggatcctttcgcttgagccttcgcaaggagccggggggcggctcggctccaggactccgcgcgggttgtgttcccggctccgcccgcggcggccaccgcgaggaaactccgtgcctggagcgggaagcggagcaggcggctgcggcggccacggggcttcggcggggcagcaacccaggactcgtagggcggcgcgctccttcgtccatgaactgcatgaaaggcccgctgcactggagcaccgagcagcagggaccaa

SEQ ID NO: 41863 - DNA, 672 bp, Bovine  19866881600943
gtggattctattatccccttttagaggtgagaaatttatacttgggattacttgtatgaggtcctataacaagaagaaagtcaagacaagatttgaattctggaatcttgacttcagaagctgagttcataactacatgataccccttcaaagagtctgtgttttgattgaagaataaaaacattgacataaataaattctagctgcagtaatatttataaagtagaagatgcttaattgacagatgatcggcaaaagacaatgaagtagaaaggctttgttctagagaggagatagccccagttacttgtgtggcctgaagaaacctcatacaagaagagggctccaaacaaggatgggtaagaactggacaagtggtcattctagaaaacataagaaaaaccaaaaccctagtaactagatcaccaaaaaaaaaaaaaaaaaaaaaacccctactaactaatgagaagcagagccagtctttcatcccagcttcaaatactatttcactgctaacatccttcatatatttcttgattctaaagctgagagaaagaaaaacttcaaaagaccttttcgacatttatttctttgctctacacacagctgtaacattatcaagatttcattcgtaaagagattaatctctcatgtaagcagcactgcctcttg

SEQ ID NO: 41864 - DNA, 1405 bp, Bovine  19866881683292
tcctcttgcctggaaaatccatgggcggaggagcctggtaggctgcagtccatggggtcgctaagagtcggacacgactgagcgacttcactttcacttttcactttcatgcactggagaaggaaatggcaacccactccagtgttcttgcctggggagtcccagggacgggggactctggtgggctgccatctatggggtcgcacggagttggacacaactgaagggacttagcagcagcagcagcagcttcttctttttgtctagcctccttcttttatattgaacgagtagtgtttgttttaggatataccatggattatggataggtatggccttccctggtggctcagtgataaagaatccacctgccaatgcaagcaacactggttccatccctgagaccagaagatcccctggaggaagaaatggcaacccactccagtgtccttgcctggaaaatcccatggacaaaggaggctggcagggtagagtccacggggttgcaaagagtcagactgagcatgcacacatggaatatgaatagatatatagtccattcacctgctttgtttctttgtctgttctctgtgcccaccctaaggcccatgcaggaatttggttgccttacttctgaaaatctgcacacatctgagtctgcgtgtgttttgtaaatccccaaatcattgattctcaaatttggctgcacaatgaaatcacatgaggaaatttatcaccatgggtacctaaaatctcaccctagagattctgattttattagcaaaaagatttttaataactttcctcgtgattctaataagcagcaaagtttgagaaccattgttctacactactcaaaatttccaggatgtttatgttctatgactagtattaagaatgaattctgctatgattgcaacactgaacacatgtagaaatatatattcttagtctgaaaatgaaagacaagagcttcctggagcaacaacaatctttttcaacctgtgtgtctttgctagagggattgatacactttccatttcagaatgtttcttccttgaccttttgcagtcgaccagatgcttcattatttcttattatgagttttacagaatcagatgagtgctatttgcattggcctctatcacttcctggttaggggcagattaaaattactatattacctttagaagaatttctctgttagcactagttatattcaggagaccttttaaaagtaaacaagacaacccttcctaatataatctattttggaggatgagatttgtggttgattgcattcacattattgtttaaaatgactgcaaaagagagaagaggcacaaaatataaaaaactaagataaggcattataaaatactaatactaatgtaaaatactaaga

SEQ ID NO: 41865 - DNA, 1619 bp, Bovine  19866881890586
gccgtagctagaaacctaaaagttgtcctttacacacccatctttttaatcccaccccattcaatccatcacttggtcctgtggattttacccctgtaatatctcaaatctgccagtttatctccatctctgctgcctccaccctagtccgggatgccattgtctcttgcctggactcatgtcttctaattggcctgtgagtaatcactctgtgtgcacactgcagcaaagtgatgtgttcaaaatgtaaatctccctctacttccctgcatgaaactttttgctaatcttcagattaatggagggtgggggagggatcttaatcagacctggaagacaccacatgcagtctgctgctgaccccgtgaaaccccagtttcacgttgccggcacattctcctttctcagtggaggccaaatgagttcacctttcttttggtcgctcatacttgctgccacaggacttttgcaccggcttctcccctgcttctttctcttttttcgccttgtgaattctctctcagtttttaggtctcagcttgcatcagttcctcagggatatcatccctgacaccattaagttaaatttcctactttgaggctttcattgccctttatgaggcacttgttggtagcattctgaaatacgctggagtggttaattattagagtaatacctgttacttctcacttccttccctactagaggctactcattttatgagattggaaacagaatctatgtttctttatcagtatgtttttagtacttggtaatatactaggtatagagtatttgataaatatttattgaatgaatagatgatccatctatatctttggaaaagatattgactacatgtgccatggtattcttatctgtaaaatggaggaagatttaatctttttaatattttaaaaaaatctttcagagattttttttttctagttgtatctaaaatactgcttatttgaaactaagtatgtgaattagtttgcaaaaactgttagcactcactcattgtaccaatgcatgactattgggtagagaaagggtccagatagagagaaaaagagaaaggagacgagaagagagagaagatgaatacatgtacatatctggaaggaaagcaaagaagtcagagatgggtaaagtcgaaagtggatgaaaacaaggaatgatctttttctttactccacacattaaagagaaagaaaattttaactccatagatctaagtacttccaatcttgctcctcccccacaacacacacacacgtgcacacacgcacacacactcacatgaaggtagctctctgcttgactgaattggtgagctgagctaatgcaagatttgtgatctgaactcaggattcttgactcctggtcacttgcaccctggcctttcctttcatcaagttaaaatctctgcacatcttttgtgtttgggggtaatgagtttaacatatatttgagctgtcatttaaaaatttgtgatctataaggaaattaagggagaggaaaaaaaaagagagagagagaaatctggattgcatttccctgacccataagggattttactaagaaaacagactttaatgtaaacaacctctatatt

SEQ ID NO: 41866 - DNA, 941 bp, Bovine  19866881907888
catcatctcatcagaacagtgctcaggcattaggaagcagttagactcagatcagcaaatacaagtttttcaaaattcatattttcactggaaagcttgaaatttgtcactgggaacaaaagctgagaatcattttccttggagttacagggttcctttgtacactttcccccaagacagtgatagttgtagaaacaaattggaataaccatagcttgtcagttgttcattaaggaaaagtggtgcttcttgaataatgtggcaagttcagctcatgcattgcatcatccttgatacaatccttattatcatatttttagctttaagacccttgctggtgggtggggtcagtaagatcaacaatattttcgcaataatactgaattatttgtttactttttgttgtattgatagcttggcataagcagtagtgaggtgaatgagctgactggccccttagcaggagtcaaggcaaggtcttcatgctggatgggtagccccagtttatcaccaaagaaaaaaatacaattgaacttaggagtgtccttgatggaacagtagcaatcatatattttattaaatcttggccctagaatatgcatgttttcctattttaagtgaggaaatcgaaagcacacagaaaactttcttattttaaatatttatagctgaccatcttttgctttgtactcttatattgctttaatgttgagaaaactttaattcctcaacatacttgataaatattgtatgcattttattatgtgttttgaaaaaatacttaaattttcaatcacttaaagtttcatttgccttgttgtattaaggaaaatctaacatttcccctcaaattttaagttatctcaacatcactgtcttagaatgctttattttacatttcaacatataactgaagaaccacaaatcggaataaattcaga

SEQ ID NO: 41867 - DNA, 745 bp, Bovine  19866881926540
tccattagtatcttccttcataaacaaaatgggacaatttaaaagctttgcaagacatataaacacagtacttggtgaaagcagtatctatatataaaactccctccatagtgcttgtaaattaggccaccaaatatttaacagagaaacgatagagtcacaaaattaaaatatgatatttggacacattaaccattcaaatcaagaaaccagtttcttatggtgtccctgttttgttttagccactcgatattgtttttcactgtttccagtacttgctccctaggtttttgtcccgctccagcttcaggatatctttcgaaaaagctcttgatctataaaagagaaagcaataattaagaaagtaattttaagcccacgtattcttcggggattttatttacattctgggtttgtttccttctttgctggaaattcagtatcactgaacaacattaagatacatcttctgatgcatcattcagattgagcccatctctcagattggtagtcattacccatggctttggatgcctggcagcatgtgccgcaaaagaggccctgctgtactggggaaggagagcagcacagtggtggctggcatgctctctttgcttttgcaagtttctcagttttctgcacgttctcccaaggtgtttcctgggaagtctgtactgtggaatgatggctttattagccttttgttccaagagtctggagtgttttatatacttcagttcactca

SEQ ID NO: 41868 - DNA, 1680 bp, Bovine  19866881982649
caataaatagtgtggtgacaactgcctccatcattttgaaaagaaaattactccttgtgtcaaaataaattccagatggatcaaagattttgaattacaaaatgaaaccataaaagaattcagaaaaagcatggggaaatacttctttaattttgtaatgtgaaaggccttcctcaacatgacacaaaactaagaaactgtaaaggaaaatgccaaaaaatataaacagagctaaaagattaatggtaaagggaaagaaaaagagtttttactattttgataaagagttaattttctaatttacataatgtttgtacaggttggcaaggagaagtccaaaggaggtggtggggggcgggggggactaatagaagaatgatcaattaacatgaataggcagatcttcagatatagaaacaaaatggtcaacgtgcaaaaagattctcaatctgattgacaacttaagaaatgtaaaacatatgtaagttttcacctatcagactgacacactttttaaaggttgtaatatccattgttaatgccacagtgaggaattctgacccttttgataggaattttaacaggtgtaaattttttagtgctatttagtaataatgttcaaaatcagcaataaataaatatcttttttctaaacattcccattattaggagctgactctactgaaaaaattaagttcccattgattaagaagttcttttcaggcttatgtatagtaagactaagcaggaaaataactcaaaggcttattaatggtcaagcatattattatggtcaagcatattgtgaaagggagttcccttggtggtctaacaattgggactcagcgctttttctgccatgacacgggttcaatcctccatcaagaaatgagatcctataagcctctccatgtggccaaaaaaaaaaggaaagaaaaaaaagcttcaattaaaacatgtaaatatattgtgaaatcatcatgaaacattataagccatgtaaaaatgacattatgtagccatttaaaaatttcatttctatagccatttgattaaatgaaaaagtaacatatatatcaacttttatactatagttcaaccatatttgtaaaaactttaaattatatatatatatacacacacacacacacacacacacacgcatagatatagtatctgtgctgatagatgcaactatatttttctacaaaagaatacatatgaagcctcaatggttaccttctttgaagagattactgggaacagaagtgggggcctgaaaaagagagggtaagttttagttctcataactttctgtacatttcatgcacacattatttttattttcatttttaaaaaattaacttaaaaaaaaaaaacaaagacagtggaattgttttgtttttcttggtttaaaattaaaaagtcacacttcagtcagtatgatgcacctctagagacccagacagctgcagctgccagcaaggagagaattttgtcaggcttagcctagttctaaattactggttttgttattacacatccctgatttcattttcatgtcccagacgacatctttgaaccctaactcaaactaattcaaaacctaagtaaaagtcagtggtctagaggtcttctccacttgcggtggtccgaattaagtcaatcggtaaaaagcat

SEQ ID NO: 41869 - DNA, 3655 bp, Bovine  19866880407601
aacaaacatttgtctgtcaaaataaccaaaaactaacaaaatgagaacaggcaaaggctatttattcagagcttgctatatcacaggggagtcagtcactgtcagttggttttggcagagactcaaaggcgggcacagaaggtggaaaggctttatagtggaaaaaagggaaggtttcagatatgccctggttggaggctggtgacctagggacgttgaaggcaggctaactagaagcaggcatgttatatgatagttaggaggggatatttgatttttttctggttggtcctaagtggggagcagcaacaaaagttagaaaagctggaagttattaatcaagtcctggctgtttggggccaattgttgcacaggttattgtttggcttcttagaccagttgctagagatagtaatctgacttcctgcaagtcagacttgtagattgcaggctgacattctgggctggttacgggagataatgcggttggtttcctggtctggttgctgcaggtttttgtggttcagaattctatttttattacgcactggccattgtccatttgtatgttcaacgtttaagcgattaacattatacgaacaaaaagtacacagagtctaagtgtgcacctagctcaatgagttatccagtgtaacgaccacccagggcccccgtttattctaaaattctcctcaatcagaatttcagaaacctgtcatcaaggaacattgtgagcggcctagtagattttctttctctttgcttctttagtcctggtgtccagggtgggactcaccacttgcaaacttctcaggccttctcacgaagtcatgccttcccagacacaatagacatgggcagtcccgggtttcccacagtcaggcttggccccatgagtcaccgtcctccacattcctggacaggttcatagagcatgccttgaaatccaggcctcaccacttccttggcaagttaatctctcaaaacctgtttcttcatctacaaaatgggggtaataacagtgcctattctcaggacctccctggcagtccagtggttaagactctgagctcccactgcagggggtatgggttcaagtccgggtaggggaattaagatcccacatgccttgtgggtgcagccaaaaaaaaaagtgcctcttaattgctctaaggatcaattaaggcgatggacacgtcaacacaatctgtcacacagaataagcactcagattctggtttattggatgtttaaaatgtctaaaaatgacagctgaacattagtgagaacctccaatgcgccaggccctgagcttagtgcttaaatgtaggatatgaataaacgttcctacctgagtcattagaaaaggccgtgatgctgggaaagattgaaggaaaaagaaggggcagcttttcactctcatgcattggagaaggaaatggcaacccactccagtgttcttgcctggagaatcccagggatgagggagcctggtgggctgccgtctatggggtcgcacagagtcagacatgactgacgtgacttagcagcagcagcagaggatgcgatgtttagatagcatcaccaactcaaaggacatgaaaggagatagtggagggcagaggagcctggtgtgctgtagtccatgaggtcgcaaggagtcagacacgacttagtgactgaacaagaacaacaaaaattaatcatccttattttacagaggaaggaattgaggcttagagatgttaagaaacctctctgcacttacctgcatttgttgtgagaattaagagatgaaggaaagcatgtctttagtgcagccccagcgcatcatagtcactccatcaatggggctgttgtttaaaatgacccttggattatccactgtggcagaccctaggcagcaattgcttagcaacatctgctctccttttcacccttagcaacaaaaaactcacttttttgtatggggtggcatcaagaggaatacgtaaaagtactcctcttttcaggctctcttacttctttaggaggttgtgagacccaattctggccagtgagaggtgtttaagtttctgaggtgggtctttttggaaaacttattattgtctcaagaaaaaggaaatttcatctgacaaatacttcttcccttttgcccccatctttgccgcctagaatgcacatgcagttctgtgaggtacagctgccacgggctgttctggtagcccagctggtaaagaatccacctacagggcaggagaccccggttcgatccctgggttgggaagattccctggcggagaacgtggcaacccactccaatatccttgccaggagaatcccatgggcagagaagcctggcaggctacagtccaagatttggacatgactgagcgactaagcacagcacagcacagctgccagcctgtaagcgtaaggaccaaaggcccatgcctgggatgccgaggcagaagagccccctgggacctccctggtgatccagagcctgggactctgccctcccaatgcagggggcctggctttgattcctagacagggaagtagatcccagatgctgaaactaaagacccagaatgccgtaacaaaaggatcccacgtccgcaactgaggatcccacctgccacggttcgacttcgcacagccaaacaaaataaataattttttttttttttttttttttaaagaatcccagacccctgatggccttgtaggcagactgtccaagccctggattgccagcctccaaaagttttcacccctgtaatagccagatttcagttgatgttatacacatttgaaggcaatccagactaatgcagccaccattagggtgataaggatatctgaatgaaatgaaatttccaaatgaaatgaaaattaggaatctttagtatcttctttaatctgtttacacatccctactgatgatcaagaactcctgagaatgagaagtcggtccacatcatctacatgaactcttctccagccttctgaggactggcatcaaggcctcagcatctgagtcccacgtgtccactaactctcccttctcaccaagtcacatgatgtcatagatgacgtcaccagcagggcttccatgggtcacgagcactgtgtgccaagggaccggaggattctgcagtcacttgttctcaaggcttggctccggaccagcctcacccagcatgggcctgaatgacgcttctgtaaaacctgaggcatctgctctgacatcttggtccaagtccaagggcagtaattgcattctgcctacttgtgtctctcctagacttctaaggtagtatttatgtctatccaaaaaagatgatgcccagtgttgctctgcccattaaaacaacgaggggtccaccttaagggataaaggagcatctgcacgagacacgacatcctgaagtgggggcaagaggctttacgaggagccggctgggatggcagctttcaactggaaagaagctaagtcaagaggggttaaacttgtggtttttcgtgccacttcaaagaaataatatgcatacatttccacttactttaaataactctaaggcagtgtcagatgaaaacaggatttacctccagcctcttttctcacagctttcctaacaaaacatatccc

SEQ ID NO: 41870 - DNA, 923 bp, Bovine  19866880532147
atttcttctttttcctccctctcctttctggccaattattttgctgaaagcaaccatagactatcaaaattccccaaacagttcaacccagttctgtgtacaagcaaaatatagaatctgtcatattgttggccaccctgaaattatgtttttatacactgtgcttttcaaattggggccaatcaacttgtcattcattggaatgttttcagctgagattgtgctgacacacgcagatgcatatgtcacatttataggaaaagttttaaaatacgatcattctgctggcatcaattcattgttaaccaaagacaaggttattcagatgcactgagcgtggtgcttttggatcactcagctacttgtgattttccccaggcttttaagaaattctcctacaagaatataaaccacaaaattgcatccttctgatcaagtaggagaaatggctaaatacactacagatagtagagacatggcaccaagctcaatctactagaatgtcacttcataaaatttcacctcatactgtgtctaaagttctggaatagtgtttctgccatatgaagctgggcaacgagctccttgattgagggccccatgaggtaagatgagggtgactggttatttgtcttggaaataaggccagtgcagatttgagggtggcagaagggtgctgaggatttaacatcactgccgcatttctcattctggaggagaccaagccatggctgttggaagtccatcaggtgggaatgagcacaggccaggagtccctggagcagccgaaggatgtttgcggaggtccacacttgcacaccctccagccttctcgacatgtcctccttggcggatgtcttacactctgctcataactgacctccttgttaggtctagaactgacctcctgtgtcttctctcca

SEQ ID NO: 41871 - DNA, 663 bp, Bovine  19866880552264
ttttcttctcattgtgcgtcgagtagtcaaattgcacccagtattgtaaaatgagagtggtttgttgctaggcaattccatgaatcatctcaaaccaagttttaagcagaccaatgacagtgtgtccccttaatttgtttttctcagtagagcacagtttttgcttgagcaataaaatatatgaactgatcatatgggaaccaaattttgtgaaacaataaataaatcttatcccaacactgactaatatttaatgataagcataatttttgctataatgcatggaaatcaaatatcagtgatctaaaacataggcaatgattgcacttggcattatgtcaacactgcagataaaagtaactctgggatcagcctgggagaagaaagaataggaagaagttctgaactgtttccaaaaagacctactagattcatgggccaaatcatgggtctccatggctcgagaaattgcactggcctctgttttcaaggagaacattgaaggaggcaacattccatgggattgtaggttttaatatagctgctataggttaatcttataaatcactgcatatggtggccgtagccatgaaattaaaagacacttgctccttggaagaaaagctctgaccaacctagacagcatatcaaaaaacagacaca

SEQ ID NO: 41872 - DNA, 1853 bp, Bovine  19866880559734
tcacacggctatatatggctgaactgggttcaccctctatgtctaactcacttcaaagccagccccaactaaattgtcttcatcggcttccctgtcctcatgggaccagtgaggcaagcttgtcaaaacagtcattaaaaataaacaggaggtgcattcagttctgttaatgaattgttaaagtgttaagtacggtagaaacatcaaaagtatgatttaagaacagcctctgctactcatattgtttgtaggtgtgcagccaagaatcaaagctcttttgtggaagaagttcagtctggtacttactgaatgcaaataataataaatgatatttgttgtttaaacctatgatttaagttacctggtctttgttctttcagatctgaacatcaattcaaagaacagtcaagcattcattcctcataaacttgaagtttaagagaggttttttacagaggaacaaatttaatattttttataagggaacaaaaaactgagtgttctgaagtgaatgatttaactaggtaaaaagatctttcagagaatacattcctttttaataacctcattagctttctttatagatgcactgtctgtattataaagctctggacaatttttaactgcctgagtttattgtaacaagcaattctgtgctaacctctggaatcctggcattttttgagagtgaaaaaagagtctcatgtaacatttctgtgttttttttttttttgtacttatgtagaatagctccaagcgagctcttttagaatagaatctttttttttttttttaaagaagaaaaaagccttatagaaaaggataattattttaaggggaaaaggaaagaaaaacactaagtcagtggtgtgctggttattatttctgaacacccaaaatgaaaagtattattctaatgatgagacgtcctgtcaatatttctctctgttaaagcctagtacatattttggattggaaaaaggtaatctgtctgcgtgggcttcccaggtggcactagtggtaaggaatctgcctgcagatgcaggagatgcaggagatgtgggttcagtccctgggtggggaagatcccctggagggaaaaaatgggaacccactccagtatccttgcctggagaatcccatggtcagaggagcctggcaggcttcagtccatggggtcacgagtcagacaccaccgagcatgcacacatacataatctctctgcacaataaacttgatagaagagccaaaacaatgtcttttataaacgaataccttagaatattgtttcatgggaattgggatgacaaagagaaatttcattagtctcatttatatagtggggaggagagaaccttttcaagaggaaaggaaatgggtacatttctagaataaccgttttaaatcctaagctattatgaaacacaagatctcaagtctcagctgttctaagttcttcaaatttatttgctctagtcactctccctaccatagttcagggcttcccagatggctctgcaggttaagaaccagcctgccaatgcaggagacacaggagacgtgggctcgatgcctgggtcaggaagatcccctggaggaggaaatggccacccactccagtatccttgcctgaaaaaatccaatggacagaggagcctggcaggaatacagtccatggggtcgcaacgaaccgcacacgactcaacacaagacggtcgcaccatagttcaggcagctaaaacaggataactgttgactcttgggatctcatttcctgctcttttccactttgattcaagacacgtttgtctttggcttacacaaagttaagtcacacagcttaaaataaatg

SEQ ID NO: 41873 - DNA, 2192 bp, Bovine  19866880562795
ttgtgttgtcactcagttgtgctgactctttgtgaccctgtggactgcaggcctgctagggctcctctgtccataggattcttcaggcaagaatactggagtgggttactgtttccttcttaggagatcttcccaacccagggatcgaagctgcctctcctgtgtctcctgcattggcaggcatgttctttaccaccaagccacctggaaagccccacagacagccaagtaggctttaaactccagccaatcagtcatttccttgctttgctgctgccccagctcctgacaagaccattggaccctcctaaccaggttggtgctgcctgaaatgatttttgctcttataatctcttaaaaaatgttaatatacatcagtttatcttttaaccacagtcagggatgtgttgtagaacttaaggtcagggatcggctgggattcagagacgatcatagcaggaagcaggactcctgctttaatcccaggggatgttcttatccatctcttggtctctgttccgctgtggtttgtcttcattttttcctctgggttgatcggctctccctgctgctctgtctatggggcaaacagagccaaggccactgaaatctcccaagtacagatccagtctctattgttccttggccctctcgaattggaattctcagagaggggaccctggccctgcctacccgtagtccagccatctgtggcccaggttgaggggctgtgagaatgtatatgcgtgtgtgcccatgtgtacatggcagcaggccaggctgacaagtaccaccatgggccagtggggacagttgatgacccacaccaggtgcccttgtctctctgtttctggttctttttggggtgactccactagggattttcctaagcaggaagaggatcatgagaagcaggaccatgatggtgaggtctgggtgacacatatctttttaaagcaaagggaactcaaactattttttttccaaacgagtcacttaggagggtgttagtgtaactgatctggtacacagagttgacaagctagcagggagcagaaaaaagttgtgatctgtcagactgagcccaagatgcttccgagagctagactgaagtccgttcagcatttctgcatctatagaacagaaagatttggtcagagagccctctagaattagacccatcttagactgagtggtccgcataaggcagcctttattacagcaataatgaaaaatgtgaaggcagggccacgattctatctgtggctccttgcagtttcccaacgtttagcttctgctttgtcctgttatttcaaactctcttctccctctttttctcccagtttgttgcaatgaagttgcctgttttatgacttctgcaccatattttcttgtcgttctccaaagctgcaaacattttcttaaagctgtgtgatcaaaagccgaggaaggaaaaagctgcaactgagaagttataattattgctactatgacatgaattatcagaaaataatcaaaacataaatttctgtctcagccaagaaacaaggtgaaataagaaaccacaatggtgccagtgttcatttgggaacatggagttaatgtcattttcactgttctaaatcctgagtgccattgtcatggaagatgcctagaggttgccaaggaaatacaaacaaaaagggcctggctgtccatggaatttggtttctgtgtagatttcatgtctggctttctctctgatggtcctatagcactttgtctctttagtgccacggtgtattaagcattaaagccatgtgtcatcatgtcttattttccctgatagactgtaaggtccttgaaggcaggatatgtgccaaagtacacaatgtatgaccatataattaggagttggcttacttttttctctcctgtttcctctattcagatgctgtcagtatctttgagggaatctatcacacaacaccctcttctccatctgagttttggatccattggaacataagatacaaagagttccagtgggaaaatgcgagcaacaccttcatcaccaaaggaggctgggatgtggactggagggtgtaggttacctgtctgtgcccagatgggcaggcacctgcttttccctcagttgagcccttggacagccctcttggggggggaaagtcagagccttcagggtgtctaca

SEQ ID NO: 41874 - DNA, 1576 bp, Bovine  19866880632327
ctaagggtgtgcagacacccctgccgagttcatggttccatttgtttcttggtagatagagaatatatgtgtaaactgctgtccctagagattgagtaactcaccaaagaccatataaccagcaaatggtggaaactcattcccaagaagtttaatctcatagttcacattcttctattttaaagactttttttttctttgaagtggaccatttttaaagttattattgaattggttactatattgtttctgttttatggctgtggggctcatgggatctttgctccccgaccaaggatcaaacccacattggaagggaaattttaaccactggaacatcagagaactcccccccagtagttcatgttcttaaccacgcaatttttacagtcgtgccatggctgtgcatcagtcatgtccggctctgtacaaccacatgggctgtagccagccaggctgctgcattggcaggcggattctttgccacctgggaagcccaacttttacagtatctcactattaatcagcagagtgacttttagtgacagacttagaaatgtgaccaagaaaatatgctttaagaacaaccacagaatgtcctaccatgcttatctttgaatgtctggtgtactttattttgtatctgttttaatacagaatccaaaggctttattgggtagacagagtgaaaagcacacttatcctcaaataaacgaaaggcgtaattagagtcaccgataaggattctgccttgccacgatgcaggctcaccccctctgaaaacgctgatcaaatcaccagtgcgggaattgtgttaagttctatttcttccagctagtgaaatattaatttatcaaaatcgcacagatgtacataggctgttttcattagaatttgggacacgattcagaattgcttaggcagtcttttaaatgtgattttaattcaagtggagaaaacacagggtactgtgagcgatagatcagctaaattgttcctgtgaactttcctggactcagctgtttaacgattagatagtgaatcatttatgtctgagaataaataagtctgataaatatgtaaaatcttttcatattattattctggatgttaatatgagtgttactgttttaacagttcttatgataaagctgtttgttatttgcaaaaatgacccaagtgtaatatgctctggtttgaaagtccttgctaaaaattatagtgggaaaaattggtagcttaaacttgcctgtggtataaatgtttaatttgaacaatattatttctcacataaattttcttctttttgtgtgtattgtgtggtgggtggtgttcagtcgctcagtcaagtctgactctttgcgaccccacagactgtagcccgccaggctcctctgtccatgggacttcccaggcaagaatagtggagtgggttgccatttccttctccaggggaatcttcccaacctagggaccgaacccacttctcctgtgtcccctgcactggcaggagttagattctttaccaccaagccacctgggaagtatattaaataacagaataaatctacatttt

SEQ ID NO: 41875 - DNA, 3171 bp, Bovine  19866880702165
ccctgaagaaggaaggaacactgaggaggtgcggttaacgtcatgcccgggccagaatgtaaatggagcactactgaaaccggagctccctgtggtaccgatgacaggtgattattacatacaggtgtacatacacatacatgcatgtgccgtgtatatacccctgtagatgtatgtgcaaataagcacagcacatacatatctccgtctatatgtgtgtgtgtatatgtctgcttatcattatttgtttttctgtaatatttgtgtcaagtccttttattgaaaactaacttcaggaaactgcagccctacgcggcctgagccccaaacatcctgtctcctcccaaagtctggtctcaaagctggccctgcctcccagaccctgtccgtgaagggcggccgctggggagcggggccggctgcacccacccgtgacctgtccgccgtcctctctgcccgcagctctggccgcctggcccccgtgttcgtgtacgggacgctgaagacgggccagcccaaccaccgggtcctgctggacggtgcccatgggcgcgcggccttccggggccgggcccgcacgctggagccctacccgctggtgatcgcgggtgagcacaacatcccgcggctgctgaacctgccgggccgcggacaccgcgtgtttgggtgaggtctacgaggtggacgaacggttgctgcgcttcctggacgagttcgagagctgccccgacatgtaccagcgcacccgcctgcacgtggccctggagggcgtacgcgcgcccctggagtgcttcgtctacaccacggctacctacccgccagagtgggtccacctgccgtacctcgacgattacgactcgcaggggaagcacgggctccgctacaacccgcgggaaaacagatgagcccagcgggcgagggaggccagggaccagcccagaagggccacgctcgctgaacgagggcgcgataacacccctggaaaccggtacttgaaacaaacactcgatctgtcgggggtgggcgggggagaacacctctttttcagtggcagccgatttcccaaataatttggaggtactgataacaaggctgttcctgaaatctgtctcactatgctgctttcttgcttgctgcttaaagagcatcttgggtttgaatgtactggatgagaaaaactcaggactttaattcccctaaatgacatttgaaaactcatgttatcatgcttttctgattatgctgggtttttctttttccttgctctgctttgctttaatctgaagataacatttaaaatgatatcaagcctatgtgactgctagattttaacagccctgctgtattcatcctgacctgtagcaccgagaaaagaaaaaattttaagctgatttaagacatctcaatgtaataaaagaacctcaagaaacacatgctgtattttagagttcttttcaatatatatgacaccattctttataattttttagatcaagcttatacagagatgattaaagattgtatcaagtgagaaactgaatataaagtattggtgcgactgccggccctctctctgagtctgtctggtggtctagcagactacctcctggtctagcaaaataacaagcacgcacttgctggcagggcagctgaatagcccgatttcagagaggctcactggagccctgccccagaagggagagggggacgagcttttcagagaagaagcaacgcattagtaatttgttcttcaggcctgacaaaaagcttggcttccaaatacaaacagcacttaaaataattttagcacagcacgaagtaccaattactacccacctccatttgatactctgtcagggtggcctcaaggccgtgcacgactctgcctctgctcactcaccagcaagtaggagcatcctgagaattccagaccctgatgaaggtgcagctgctggtctgggtagcctcgttctccgtcgggagagcttgctcacgcgtcgacttaatagtagactgagatggcttactgcatctgcttcagaagcatgactgttatttttaacccttttttcgtaattggaaactcgcttcacaaaaacacaacaaaggcgaggatgggaatctgttgctgggttctgcagccccaccaccaccactgggccctgggaaccctgactggcgcccatgctggtgccctgggagggttggggggtcacacctgcaggctcaggggacccacactcactggcagaccaccatgaatggtgtctgggcttccggagatcatgaccagccaaccacaagcggggctcggagcctcaagatcatgaccagccaaccacaagcggggctcagggcctcaagatcatgaccagccaaccacaagcgggactcagggcctcaagcaggatgaagcaggtaatgagattacaaggtggcaaacgctcatttaatgaaactgaaggcaaagaactgggatttatatacatttttaaaaagcatcctgatgaaatgctggtatttcaaagcacactggcacagcccatagcctcttctgtacactgtcttcatgcaaaaaaagggcaaactagtattagacaggtgctgttttattgatttcatttgggcactaggaaatctcacagcagaagtacaaatcatatgtaccagtatttatatcaataaaaatttccattgctgatttttttggcagaacgttggttttgactatatgtagagtaaatatgaccatgtaaaatctgccgcacaggggtgttcctgctgaacgcctgaataaattgagtgtgaaagaataataatacaaatggctaattaaattgggtgatgactgaaaggctataaatacttcattccagttccacgagcaggtctccttctccaactgtgtctccagctttacaatgtaccgatttcaccttgaatttaagaaagaaaaaaaaagaagagggaagataaagaattactaagcaaaccaggaagaagcagtcttgtccggttctggaagggaaggtgcagccgggcaggcgctggagtgcaggcaggaggctggcggtgggggcccgtcgaggggaccttactgagggcgtcctcgtgtggtggggctggccctcgcccctccttatccttcggctcctagaagccactgctccc

SEQ ID NO: 41876 - DNA, 1701 bp, Bovine  19866880710493
cgcgccgcgagtgccagcctccccgcgctggctgcccggccgagcggcgtgccctgggccggggcgcccggggccgctaccgagctgccgcttccctgcgccgggcttggagtttggggaagccgaacgggtggcgcagccgccgcctcacctcctgcgaactccgcggggcttctcgtcttgttgatgttgtgtctgtaggctgtgcgtattttcttccttctttttttaaccgcacacaaaagaaaggaggagttagaggaaggagctagccagagccccgtgagtcatcccacgctgctctttctcttggagcgcagatggatggggagtgtttcttgagaaacagttaacagaggactcacggggtcccccctccctgtcccctcagccccgaccgcgcctggggcgccccagagggaggtggggtgcagtatcacccgctgacttcgatgggaaaatgactacaagctagcaagctggaaactttctgggacagtggaactgggaatgtcgaacctcccgcagtcattctggctgtcggcaggcatggctctcgcgcgttactgaatcaagaaaccgagaaggtgatccgaagaggaagctactcggagtagcattgtattcagcgctgcgtggggggagggcgggagagatgagtctccagtgccttgggggccccaagagaggagcagccagctcaggtctccaggtgctaggtcaggaacggttgtgttctttattctggtttccaaacgcactctcattttaggctggcagagggcaaccggtgtgtgaatggatcaatactgatgagctgaaaaggccagtctgaggccagaaggcccttcagtgcagctgaaagaatattttttagtaggtgttcactgctgatttttccagggatcgtgtaggtttgatctgcatctgtcagccccttactgcagtccaggctgctgtgtcaggcgtcaccgagtccccaggttcagagctcagtgactgctgtgtgttcatttttgagggatggtgtgccctctctaaggtctctttgaccttttcattgacgattgattgatgggttttaaccccctgaaaatagaagcttggtataaggagtttgagatattgaaaataaagaggcttgtgcttcagttcccaatctaactacatacaggcgccactgaattctcaacacaatgggggtaagcacaggaatgggacaggaatcccatcaacagtgtggtcactggtagagctaactggagccctgcatgggctgaacctgaggccatgatgttgctcctttcttctctgtccatgaggcaaacttccttggctcaggagccagggctcgcagcaggacatcccctggggaagacgaatggggtgatgccgcccagggcccatccagagagagaaacagaacgtgccccttttcctggttcatgctgctgtttagtcgctcagtcgtttctgactctttgagaccccatggactacaacccaccaggctcctctggtccatgggatttcccaggcaagaatactggattgccattttccgtctcctggtacaaaaagacggaagggccccgtctccctccaggtgccacttcatgctggcagggcttcttgtacctcagcttccagcctgtcttcgatccttgcagaaaaaaagtccatctactgtggaggaggagg

SEQ ID NO: 41877 - DNA, 1932 bp, Bovine  19866880800765
tacctgtagccctgcttactgtttgccttgaagctgtataatttgtggtcttctgtgactgtcttcttgcagttagcacgttttcaatgttcatctgtgttgtagcatgtattagtatttcatctgttttaattgccaagtatataatatgctgttgtgtggatatatcgtgttttattcagacagtcatacaatccatggggttgcaagaggcagacatgactgaagcgacttagcacgcacgcacaacagtggtttacttcagggcgtaataacccggctcctcctttaaggggatctgagtaggtgagatacttttctcagttccccttcatgtgccctaaagacagcgattgtggtttccttgtgagcccgtctgacttgaaattaatatcaactacaaattttaaatgcttatcattcaaaagctttctttacaacatctaactttctctttttaacaaacaaaacttctataattgattggtgagcttctctaaacttttaaatttagaattattttaaagcaatatttcagttttagaagacatttttagcatttactgtttgtaaaactcttacttttgagaacttcttttggaactcttttattgcataaggagatacttaatttgggggtgaaagctgaatagcatgatttaaaggatattagtgctgctttaatcaaaactgcagccttttctgcttcttacatctttatcatgtagtagtttaatagtaagtaatatatgagtaatatataagtaatatatgagatattattatctgaccttatttttaaaactattttaagggtaggacaataaaattattaagagataggggaagaaagaaaatatttatgacctaccctgacaagcatattggttgagactttcatatgttaacttatttagcaccctctcagatagccatttttactgtattatggtttggaactgaagctcagagaagttaaatacaccaacttagtatacaactttcatttggtaaaacagcaatgtcaagtgagtcccaagtcagtgattccaaagccgttgtttttttcttgcctgtaactgaattctactttgtgtgcagagaggccactaaacctggaaattcaagccagtgcctgatgtatgtcctactgatactttattacatagccagtaacctttgtttttagacttcatgaccacattagaggggaaatatatatacataaatggcttcccaggtggctcagtggtaaagaatccacctggcagtacaggagatgccagttcaatccctgggctgggaagatcccctggagaaggaagtgcagcccactctaagtatacttgcctggagagtcccatggacagagaagcccggcaggccaaagtccatgggttcacaaagagtccgacatgactgagcaactgagcacacactcaaataactatccaaatgtataggtaggcacatattcttctaaacagtacaagtctgtgtgtctttgattttagtgagtatcttttaataggattggtagtcaaagaattgttaaggatcatgtatattttcccttccctctcatattgaagaattagggaatgggtgaatgaaaaggaagaaatgaggaatgatactttcaagttagctttgagttgtttttcctttcaattgcttttatttacttggctattaaaatgtttctgctaagaatatctgttttagaagattgtgggctttgggggataactccatgaacaatgacttgatgaaattagtcatttatgatggacaataatatggcagaagtttgcaaagttcaaatagacttttaatattcaatgccaaagaattgtgcctaattaaagcttcggtttaattaagataacaatgcatagtccttcattaaaattaacacaggaaaagttcttt

SEQ ID NO: 41878 - DNA, 1789 bp, Bovine  19866880804740
ttagtataatgaatgttgtatgttgattaaacatattatatatgttagtatagtgaatgttgggcttcccaggtggtgctggtgttagagaaccctgcctaccaatgcaggcgacttgagagatgcaggttcaatccctgggttgggaagttcccctggaggagtgcatggcaacccattgaagtattcttgcctggagaattccatggacagaggagcctggcgggtggcagtccatagggtcacagagagttggacatgaccgaaatgacttagcacgcatgcacataatgaatattaatgtatatttctcttctcatggctaagttgcactgagatgtcattttactgggtgggggaggaaatgacttttcatcaaaaaatttaaaccagatatgaaaatcaaaataatgtaatttcattgaaaacagtccttggagaggcttgagatatatggtagatttttatcccaggtggaaaaatagttcaagtaagaattaatgagaattcatttaatcagcaaatacttactgcatgcctactgtgtactagataagtgtaaggctgttacactggagaaggtgacatttttatgtgatagtcacaagtaaatgagattaattcctgagttaaggttggtctccttggttgtctttctttttctttttttttaattggaatataattattttgcagtgttatgttagtattcttgcttatctttaaattttgtgattcatctatatgccagaattgctaaagcatttgttactaaaagatatttcactcaactgtcttaaaacaaaaactgtgatggaattaaaccatgttcttgtattttgtgatgaacttatatgattctttatatttctcctttctatatgatcatttgaaaaataactctgtaagtggacacttaactatgcatcaaattgagtagcaaattatatgtgttgaatattaaaagataatgtagtatagtattttcctaggggaaggttagctttgcaaaaatgtagaccttagcataattttcagttctgtactgagtcaccactgaagtgttactgttaatctgatacagtgtttttctaagcggtgccttgccttaataagaaaactgcccagcttatgtctatgagttgttatttctctatgcttgtttcagattccatgttggaaagctatagatcattggcacagttcaagtgatatctgtcgagttttcgttgtagaattatcccattttacttttcagctcatgatgtgtttaaaaaacccatcaaaattaatgcattaaaaatttccctggaaaacatccaccttgatatatagtacaaaaactacttcctgtatgtattggcttagctactatcagaagcatcaggcataataaaaattgagcattcctgatagtatatccctttttcctgaccatatttggattgagcttcatttagcgtcagtgttatgaaaggagacaagttgaatagtgtgcagtaagtaaaggctttcattggtattagattttaatagaggggaactcctgcttttagagtctcagaagggagagttgtgaccatttacttgtttttctagatcaccctctgccacatcagtaggaaattagccaagaggtgacagtctaggttaatgacccaagaggtaatacatatttgttttccttacagtaatgtgttcgtgttttctgaaagtcttttatttaattaaaaaatttttttaaataataagatattcaaatgaggaaaatatagcaaaatttacaaat

SEQ ID NO: 41879 - DNA, 1622 bp, Bovine  19866880884553
acagccttcaggaagagccttgtccctgtggggattgagaaaggatcagagttaagcactgaaacaagcaattaattcccattagaggattaaggcactcatgttcactttgaatcagaaaaatgaattgcgaataaaatcctgtacaaccaagaggttacttgtcaaagttaataaattagagcatcgaagggcaaagtggaggcacggaagttgagcggccacaggaggactggtgagcaactggtggggttgtgttttcactggacgaggccacggccgggatgctgtagcagtgtggggtggggggttgggtgctgtctttaatagatatattcctgaagagaagcctgaaggggtttctaccctgttgtgtcaccaccccccacgcatagatttccctctagtgttttaccgttaatataaagaatcaatgaaaagggacacaaaggagttaacatccaacttggtgtgtcttactttcgggttttagagcggattctaaatgaactcacgcagtgtttctgtagacaacgttactgatgtttaaagcctggaccgggaggccctgctgtgatcaggacttagtcaccctcccctcgggaatcctgaagcccaaaagccaaacccttgtctcaagtccaacaggtcaggaataatgtggacgtccaggggtcagcccagaggtggaacaggctcagagagagtctcaaaaagtttcacttcagcaaaatttggtgagtttaacattgtcaatctttaagaaaacaaaaacactcatggaaatgtccatctggtctggcactacttgaaatgcctgtcacttattcagcagttttcttactgaaacacagtccatctagagtttcctgtttcattgctgaagcagaaattgaaagtaattatgagtcctccgcataatcgttggttttttccctgcttaatattttttcttagccacctggtggcaagagtgtaaaaaggcaggatttcatttaagagtttaatctggtttacgaattagaactgttgtacacactgggaccacatttagaaacacacgccaggtgaaccaaatagaaaagggctaatatttaactctccttagactgcaaaagggtgtaagtgggcaccagcgtctaacatgaaaaccacctctacaaaagaggcgtctctacaaaatattcatgcaggattaatattttatgacacaaggcaatgctaaagagttagaaacgaggacacagagatcttactcttttctctaagtgataaatccttaagccatgaacagcgcccaactgcctgccgtcagggttagatcagaccgcgctagaaaaggcaggagcaacgaccggcttgggtcgcacagttaggcgaagcggctctgccatggccggccgggcgcaggaccagcctggggacggccactcgccgcggcctccctcgcggccgtgtcctcagctctcctcggtcgacctcgtgcgtcacacgcggctcccaccaggcccgtgacccaggacctgcttcagccacgcgaggcgacgcctgggccccgcgcggccgcgggcctgtcacacgcgtgtgtgacgtgtgctctctggagggctcgtctccttgta

SEQ ID NO: 41880 - DNA, 1280 bp, Bovine  19866880889883
aaacgtgacataggttacttccccaaaaaagtactggtaaaggagatgtgtgctgagttgctcagatgtgtccaactctttgggacccccatggactgtagcctgccaggttcctctgtccatgggattctccaggtgagaatactggagtgggtatagccatgtccttctccaggggatcttcccaacccaggtatcaaacccagatttcccgcattgcaagcagattcttcaccgtctgagctaccagggaagcccactggtaaaggaaaacaataataaacctagttcttttcatttgccagttatttggattttcaacaaatgggagtttactctattcaagttcaatatccataaggtagttttcagaaagagtgaaactttttgatgatgttcatatttatatctataaatacaaatgatgcagatttgggacttgtgctatcagatgacaagatacagcccaagcttcagctcttgctaattaaacgaatcaattaagagactccagttgccactgtgtagctgctgttctatagtagcaataacaaccccgcggggaggtcttttactacattaaaatgctgtcctccacaactccatctgatattattagaaacagttatttgtgtcttgctgtcatattagtagcaaaggcaaattatggaaatatgcagaccagaatggtcccagtatgagaccaggttgggttttcagcctccaagggaacaactgctgaaattccaaagttccccaaagttctttaatggaactgataaatctatcagcacagcatccatttagaaactaggtaagggtcacatatttacatactttcctgctaagctgatacaattcaactagatgaattatcatattaagtttaccctcctgagttaaactgatggagttcaaaattgttttcgatggttgtcattaatcgctgttacttcgtaaatgctaactttgaaatctaattgtgctagcgtaccaagggtcatattaataccattcttaatggtaaatctttgtaaaacatgtttattctactgatattattactcaagctttcaaggctaataagaaataaagtatatttattatcaataaaaacttaatttaaaatgtacactttgagatttaaattagctttaagaagttcagcgtgatttggtttcattaagatccctggctaagcttcaaagacatataatttgatagttcctcgagagtccttgggtgaatgccagcagcacagctatgaaaaagctgctcag

SEQ ID NO: 41881 - DNA, 726 bp, Bovine  19866880892619
tggaggaaaatcccatggaggctcacgttttggccatgcttataaagggagactgagtcggagaaaacggaggtcttggtgagagacctgggatggtgactgtcatgagggatgtgactgtaatcatgcagagaccgctgtcactgcttcccagcttgctgtaggtgatgctgggatttccgttggagacacatcagacttttgatacctgagctagttaaacagttaggatatacgtgtgtgtaattgtgtgtgtgtgcgcgtgtgtgcactcagtcagtcatgtccaactctttgcaaccccatgaacggtagcccaccaggctcctctgtccatgaaatttttcaggcaaaaatactggagtgggtttccatttccttctctaagggatcttcctgacccagggatcaaacctgcatctcttgcatcatctgcattggcaggttctttaccagtgcgccacctgggaagccccgaacagtcaggctacagggtatcatttgcacaagatgatactgttggaagctgtcaaagtttctttgagagccaagagatcaatttgtccactggtatttttaaaccttgattaatgtcgttctgtttattttggccacccctggtctttaattataaaatcatgcagtttggaatgagaatgttggtcccccattctgtgccgagtttaactgaacacatttctctctggtcttctgacatgctgcagg

SEQ ID NO: 41882 - DNA, 1655 bp, Bovine  19866880909391
aaaacactaaaaatgagtgagagaaggtgaaaagatctggcatgcatttattcactcagttatggattcagcaaatatttatcaagtacctactatcctttgccagcatgcctcaagttgggaatgtgtagctaaaacagttacagtttttttttttttaatagcttttcccctcaaaatgatttgttgttgtatgtgcagcaccttgcactgatacgtgtgttctgcaataaaaaacaaatctattcctaaaacaaaacaaaacgcattaggcattgtgttagcattgacaggcactaggagtgtgctaacacagaaccagagatggatagcattgtattttttgaaaattcacttttgcttataaattgatttccttaataagagctgacttgttttaggtgctagaactcccaattctgtacttaattatttttggttagcctatgcatatggtagtcctatatttcaagaaatagattgccaaacaggattttccattgagtttttaaaaaaggaaacgtgtagaccaaaattcagcataaactatgttaactcataagaaaaaatcatttaaacatcaacagattttgatcaaatgctcaaatttcaaagaagtttctaaaacaaaggtgtttacttctcttcatcagtttaatagcagggccttgcgctcgtttttgttggtggtgaactgaattttacaagctctgtaaaatgaagccagagtgaacagaagttgagtcaaaataatggataacacatctgacatcttcttaggctcttgttctgaccacacccccttttaacctaaggggagagtcctgaaggctcagggttcattagctcgcagctgtctgagattagtttgcaatggcttaaaagaaagtcagccccagaaagcagccggcagtggcctggaaaatggacaaaggagaggggcagctggtggggaaaagcatattccgctgagacatctacgcaggggtcaagggggtcctgggccactggaaacagaaccctggagaaagtcttgaaggcagacagcctggaatcaaaggcagcagatggcaaaacagctcaaaacagagcaaggtcatgattcaagaggacttatgaattgtgttgttgaacagggactgttaggcttgtgagtaaggaaagagaacttagcatttaggtagtacctgcattgggccaagcactgggagtggtacttttcacccaagtcagctagcctaacatccagggcacctctttcagtgtaacagttaccctacaggtcatgtgtagtttggcaagtgtaagcgccaatggtcatctctatttatacatatgtttatgagatttcctgaaatcaacctacttgttcatttcttatctgtagtctatactgtttcatgtggaagacgcatgcctttcgatcgtattccaaattgatcaatactgtatagatttcagtctctgtgaagctgtggacagacgggtgagatagtgatatcggcagggactggcttgtgcagaggtttaatcctttgaggaaaaggatagcaaacccaatggcagttgtccaaaacaaataaacaaaagaaccaaatcaaaagagaaaaatgctgctagagaacgaaatatattttaaatgtatttactgcata

SEQ ID NO: 41883 - DNA, 3254 bp, Bovine  19866880915278
acttcatgttacaggtaagtccatgagcaagtctcaaagttgctgtgagatgttcaaacttcttagctagttagtggcagggctgggaaagtactctgagtgtcttgacagattttcttcctgaacagttgccttgactgtgggtagggagaggatcagagccaacaatccctttgtgaacatctacgcttataaaaatccaaatttacattagctgactttcctccaacctttttaactttatttttttttacaagttttaaagtgtacgctccaatgacagttattataaaatattggatatattccccacatggtataatacatcctcgtagcctgtcgtaccctcgatagtttgtactgcccactctgccagccctaaactggcccctgtcccaccactggtaaccactagcttgttctctgtgagtctgcttcttgtttgtcatattcactagttcgttgtacttttcagattccacatgtaagtgacatcatacagatttcgtctttgacttatttcacttactctaatgacctccaagtcccttcaggttactgcaaacggcaacattttgttcatttcattggttgagtcgtgtcccattgtaaacatacaccacgtcttctttgcccattcatctgttgatggacactcaggttgccttcatttcttggctcttgtgaatagcgctgccatgaacatagggtactttcctctaacctttaaatgttctatgcaggtcatacatagacttctgacaaacttgggcatggttttatggcattgcctcacaactgtgtttcatagagaggtaagcttttaactgtactcacttcaccgaagacaaaattgagagccagaaaatataagtggctggtctcaaaaggcaaatccatttatggtaggcagagtgatgctcaggcctaggtcttcatactgtcaattcagtgctccttctactggtctacgcaggctccgtgccttactctaaaatctgtcttcctataagactgcaggcatttatttctcttattgtttctcctccttcccctaatctgtatgccctggcagaggctaacatgtgcttcatcttttaacatgaactgtgacttgacgctcatgtttaaaattgaggcgagaaccataatatcattcctggcgtctctgggcatggcaaaatattgtgctgatgactttcctcggtgtttgcaatctgtttcattacagctaatgtggacctgacatacaatatatgagtcatttattaatccctccaaatttacacttgctgaggcttctgcagcctgctcagtgaacacatccgctctcacctgtgataggaaccatgctaccttagagaccgatcctacccccaccccggccatcctccgtgaccagctttctttcccaatgagaatcgctccgttgacaagggcatccagtgtggaacttccctctgaagtgattgcagtttatctttccagtcaaaatgggaacaatttgtgctgtcttaggactccagagctgctgtaaattcacgtaatagatttttcagtgcctagtaagataattgcattggggagaggactgaagcgaacgctgggagctgtgaacgcggggcccctcattccatgcggcttccagggtgacctagaaaccggggctggaggaagacagctttgaattcctcatgctaaattagttctgagatgcttctgggcagagactgccagctgaactctgttttgacagtgggaatatttataatgaaatgtaatgaagtaaaacttaagtcctaaattgccccaacacggaagcactaaaattgcaattctgggtctagtgacacctccagttaccggaaatgtgaagttattctctttggaaaatgacttcactttgaagaaatgaatactggctaagggttatgacacacacacggggagcttcaaatccgctcccttgggttattgctgacctcagatgagcaaattagactcaccgcgtctctctctctctagaggtagtcacacttagcaacaagccttgttctggggcttatgcattggctgtgaaacatagtcaaacatttctaaaaatgtgaatacgaatatgtttaaattcaatgtaaaccactgaatgtggtttgggagtgtttgaagcagtggtaacaattgatgggttgcaattttaaaacctctgtgctatcacctttatgtaaggacgctcattgctgttgcttcagaactaattcccaagagcaaagaaaatttctaacacaagttattggttgctttgatctttagtgaatgaattaatttcttcctttattcaaagaatacttactgtgtactcactgccatatcaggtgtcactcttggtaagaaggcctcaactgtgagtgtgactaatgtggtcatttcccatccagatattaacaaaataagcagttctcaacattcagggcagttttgttttatggtcactgccaacagagagttagcgaatactgcgcccatagtgcctaggggaaatacagggctaggttcctatgacccacagataacaacacttttgttaactgatcggtccataatcttgttttgtgtgtatttctgtttaaagactgtaactctcacttgaatgaacattgcatgcgagcatggtaagtcgcttcagttctgtctgactgtatgtgactatgggctgcagccagccaggctcctctgtccatgagattctccaggcaagaatactgcagtgggttgccatgccctcctccagggggtcttcccgacccagagagtgaacccttgtctcttatgtctcctgcactggcaggtgggttctttaccactagtgccacctgggaagccccagttcagtcagttcgttgcatctgactctttgagacccaatggactgcagcatatcaggcttccctgtctatcaccaactcctggagcttgctcaaactcatgtcctttgggctggtgataacatccatcttatcctctgttatccccttctcctgccttcagtatttcccagcatcagggtcttttctaagactcaactgaacacatattttctctgtaggcagtaagtactttagggctggagttggggccattttaaaggtgaagccaccaagagataacacaagggatgtgaaaaacaaggctttgaatatacagggacaaggacacctgcttacagcctgacctgaaataagaaggcagagcatcac

SEQ ID NO: 41884 - DNA, 954 bp, Bovine  19866880924175
ctgcagtgatttggagcccagaaaaataagtctgacactgtttccctgtttccccatctatttcccatgaagtgatgggacactacaaattattattatttgttctgcagcacacatgcttattgatgcatgaaaacgtactttcactctcttcactttttttttgaaattttacaaatgaatgcagttatagtctaatataactttctttacaaaaataggcaggaagctggatatggcccatgggccatgatttatcagctcctggtcgaaaccaatattgtagccactaaccacaagtggacatttacatttaaattaatacaatttaaaattccttttttcaattccagccactcaagccacatttcgggtcctcagtgaccacatgcagccagtggctgccatatggagtaacacaaatacagaacatgttcatcatcacagaataaatgcatcgcccaagatcttcaaattacattagaattcgctgggtaagagtaggggggagcattttatttcttaagatactaaaccctagtcatttttgacatcctgaatatgaatgatttataatagcatcaagtagtgtgaaagcttcatattctgtacaaaagtgccatggtgtgattttaagcaacattttcattttcactagagacaaggtattaaaaagcatgctagaattttatttagaaaatttaagaatggaaaaccaaaaccatctatacagtgaagattttaaagttggcctccatttatcttttttttttttaataaaaacctggacttccctggtgatacagtagataagagtctgcctgccaatgcaggggacacaggtttgatcgctgatccaggaaaaaccccggaaacacatgcccggagcaactaagctggtgtgccacaactatagagcccaaactgtagagcccatgagcccacaactgctga

SEQ ID NO: 41885 - DNA, 1052 bp, Bovine  19866881031323
agtcctggtaactaatggccggatgggaagggttcacgtctaattgaactgttgaagcttaaaaagatgacttacaccagtgaagctggccataggatagctctcacactcctggtctctgttctttgcaccgtaccaccttgtttgctaaggtctgcagattcctagaccagtactataaaagctgtcatctctacccattatcagaaagttctagaaatgagcagttttgaaaatttttgagacaagtctcaagtctactcgtcaaaattaatgctgttgaagttaactgctgaaacaaaacttttttaagtagttcttttttttttttaagtttatttttgatgtggaccacttttaaaatctttattgactttgtttcaacattgcttttgtttgtttggccacgagtcatgtgggatcttagttccctgaccagggaagggtgaagtcttatccactggactgccagagaagtccctgaaactggttttaaatgataggtaaaactgaatttaaatctacagggaacgcattttctcaaacacttatcaccagtaggaagcagaaagctttattggcttcagaaaaatgccacatatttaaaaacaaaatgactggaaacgcaggacactcaagatggttttgataaaccgtgttaacaggtttcaagaactcacagaactaatcagacttagaacacaggcgataagactataaacctgagattgtttctgggtgacttaaggtcttgaggataaaaacctcaagtgagagttagctctccttcagttacttattgagtattattatgtgccaagcatgggtttagggctttatatatgttttcttatttaaactttccaataagtctgtgaaaaaggtagtattatccaccattttaagggcttccctggtggctcatttggtaaagaatccatctgcaatgcaggagacttgggctcgatccctgggtcagggaagatcccctggaaaagaaaatggcaacccactctagtactcttgtctgggaaatcccatggacagggaag

SEQ ID NO: 41886 - DNA, 1511 bp, Bovine  19866881260333
atcatatgtgataaagaaactatatttccttatacacctgataagtaatgaatgtgaacgtgcatgctcacaatctaactgaagggacagctcccaaatcccaaactaggaaacagatctgcaaatgttaagtgaggatgagaacatgccgaaagccattatatacctcatcagcccccaagcaacagacagatttctaaacaacatcaaacaaatgacagaaaaccataattctgaacagcagatgcagattctgttgatgctgtcattagatgagtggaagctgctgctgctaagtcacctcagtcgtgtccgactctgtgcgaccccatagacggcagcccaccaggctcccccgtccctgggattctccaggcaagaacactggagtgggttgccatttccttctccaatgcatgaaagtgaaaagcgaaagcgaagtcgctcagttgtccccgacccccagcgaccccatggactagagcttaccaggctcctccatccattagatttcccaggcaagagtactggagtggagtgccattgccttctccgtaagtggaagctagatgtaagtataagccatacagaggtagggaatgtctctttaaaccacagttcaacaccacagagaggtggaggcagacatgaagaatccttgttaccatgccaaacatactgttcacacgtaatttttcagctgaagtgactaagcagcagacacagaggctaaatggcatttatttcactagtgcaacactgagaacctggcataaagaaccaccctgttatctcagtgctgaaaactgaggggaaatgaaatcgagggcaaaggaagtaacaggtctgagacagagttagggtacccggcctgacaaggaaaagctgcaagcaacctatatgtacagccaaccacctacaccactgcaacataaataataatcagaaaacaatcaatattggatctctgcaaagaattttccccaaaattttgaggaaaaaaaaaaaaaaggtaaattaagagcattcaacacaagaactcctcaaagaaatacaggaagagttcagataaataattctccaaagtctcaaagacagtcataggaaacgtgacccttctttgaaaaaaaaaaaaaaatgagctcaaagaagaaaaacaaaggttcaaagaagagattaaacaacaacagaaggaaatgaaaatcaagctggtagaactcaggaaaaaaatgaagagaaaaataacattatagagataaaagcaacgttaagaagcaccaaaaatagaataaatgtgactaaaaagaaagacaaggactggaccaattctccttcaaaagtactacaagcaaagaagaatagggaattccctggcaaaccagtggttaaagctccacactttcactgccgagggcccaggttcaatccctggtaaggaaacgaggattccacaaatcatgtggtgcagcccagcccaagccactgaaagaaggaagaagtgtagattaaag

SEQ ID NO: 41887 - DNA, 2316 bp, Bovine  19866881300245
agggaagacctggggattttggtgggcaaagatgacccagtggaggatgggactcaccctgaccagcacgctgtcggcaaaggaggcagggttgtccacctcggtgaagacgggtgggccggtgcccatgatcttccagcgtacatacagcaccccggctccgcccaaagccaggagggtcattctgaagaggaggccccctgtccggagcatgccagggctctgaaaggacagcgcaaggcccccagtgttgaggatttttcaaataaaagtgtggccaagccaggtataaatgtgcagcagttctggctgaacctcgctgacactgggctttaaaaggctgcctgttttagaattcaaagttgcacgaagtactttgaaaatggtgttttaagccagcgggtacgtgacattttccacatctcagctggagacaaaagcagatactcacctctaacgatctgtccttacggaggagcttccggacaatttccaggacatttagtttgcctatcaccaagatgtcaaagatggcattcagaccctaagaaagcaaagcaaggaatcagccatgggacagcctaactgatcaggtagccaggatacgccacaattctattgcagaatctagacgagaagtgtcctgattagatcaccatagataatctcttcagctctaaaaacaaaacaaatcctatgattcctatgaaattagctcatgatatttgtatcaaatttacttatttatttatttaattcttggttacactgggtctttgatgctgtgcacagactttctctagttgtggtgagcagggctactctggagttgcggtgtgtgggctcctcattgcactggcttctctcgttgcggagcacaggctctgtagatgtgacgcgcaggcttagttgcctgtagcatgtggaatcttcccggaccagggatcaaacctgtgtcccttgcattggcaggccgattctttaccactggaccaccaagaaagtcccatcagatttgccatctggtaaatcccctgttagtcacagggtccatagcctgcatgcaagagtatgataagatgccagagagctagagctttggggctcccaggagaagttctgcagaggccccccttaccatttttttttccctaaaactgtcccagagttgtagcagagccagtacctgtgcagtggccatgcctaagatgataaggcagccagcaaccttgaaaacccagccatgtaagtaattacacttcaggaacctggggtgctgcctgatgagggcatatgccctggaagagagggaacagaacatacagactctggtggggctgcagagacatcccaggctcagactcctcgtcacccaccagctctcccttcctgcctggcacacagccagccccacaggggagcgtggtcatgtgactgagttctagccaatgggatgttggcagaagtgattaggcacctcttggaggtttgggcacagaccagagcacaccccacccttggtttcccatccagttggctgtggaggagatgatggaggtgtctggagtagtactggaaaccaccctgaggatggcagagccccactgtgtggaggatggccacctctgcccatgacttttagggggatgaccaataactccaattatgaccacctctatccatgacctttagggagaaaggccagtaactccaatcaagaccaaccgtacccatgacttttagggggatgaccaataactccaattatgaccacctctacccatgacctttagggaaaaggccagtaactccaatcaagaccaactctacccatgacttttaggggaatgaccaataactccaagtatgcaaaacccctggccctaggaagtgtgatattgtagctgcactgatgctaacagcttccagcagcaccaccgcagctcctttctagtaggtatggctgctcttaaagctctgacacctgtggttacaagctgagggctcatctggcctggactctaccctttaccctgcagtggactttccataaatgtggctgctgtagacaacaccatgtagctgaactccctgttggaaccaggcagagcggtcagaatatacactgtatggatggttcaagctgcccttctatgacatggggccttcgaacacagagcttcatggcaaagaggatcaatcataagtcgtcagaagccagtggtaatttgtggttctcagcacaagggtgacatctctcctcagcaacccccatacatgctgggagccattattatccagtacacaggccagcgc

SEQ ID NO: 41888 - DNA, 1162 bp, Bovine  19866881562372
tgtcgtgtgcaaaatgaacccccatgacggacccccgctttcctgtggctctgaggttaagaagtggtggacccggcagctgaccgtggagagtgatgaaagcggagatgaccttctggacatttaggtggaagccagcgtggatgaaagtccactggccaaaactgactttctgatgtgtgctttcattgtccagtgagcgatctgtaattcatgtataatttaaggctaacttgtaacaagattttttagaactaatttctggatcctgccatgggaaagcataaaattgggtccatcaaagctgtatttgtgatgagttattgccacaaattcaggagaatcagcacgatgacagtatccattatattagacactatactaatgccagatgtagatcattcaaaattccacactatctatgtaaactaaggtatatattcatgtatactcctatgcattatcaccaccccctcaaagagtgcttagcccaaaacagctgatattcatggtacaggaggcataggttttagtttgtgtttttcccacttcttctagaaatactttcctgggagaatttattatttatgattgatctgcaaaggtcagcaccgagctcatgctaaaatgatagtagttttacaaactacagattctgaattttaaaaagtctgttctttttctcatgttattttttaaaatctgcacaagctatttagagatcagaacaagtcagtgtctgtccccggtcactcagtggaactgtggcctgctcccaagagaactctgtgtacaggtatcaagcaaagaattggcctgaagagctgactgatttaaaacaaagctgtacatagatcactcagggggagcatggttacatgaggatgttgagtttctttaaaagccctttaatcacagtttagccacaaaaaaaaaaaaaagtaaaactacatgattccgcttaatttaaaaatcttcacatgtgtgatgttatccttggcttcatctgttacccaaggttggtccctttggccataaatcagcaaagacattataagttggccgcaacacaccattgccgtgttcaattcaaaatgatggccttgctgaaacttccttggtggtccgatggttaagaatccggcttgcaatgcaggggacg

SEQ ID NO: 41889 - DNA, 754 bp, Bovine  19866881963997
gggatgcgtccaggctcacttggccctttggggattttaaggttgaaggtgactagcacacctcaaggtcaatgctgctccttgccagacatgtacaccagttgctgactggagggttttggcccttcggttggcatacactggccctggcgctgaagagaagttgcatttacagctcctgggaaatagaggctgcgttcaacagctgccgtcactttatataaaccaggcccgagatgttgccgcacgtacctacaatgggcagcctcctctctcgacagaggagggcctggagcttgtggacattacagactaagcgaggaggattaattagaccatgtccacaaagcacattgagctccttggagggaggccttttaattacagtactggccaggagcaagtgggaaaatagggaaataatatcagttttatcaggagtacaaaggaacactccatttggattcctttcttgcctcaagtaatccatctgtattttcccaccttcttattctagaacctagatatgttttgaataagacacagtaatcttatatcttcatttccttgtaggatgtgctgtactattctttttactgtcgttattcagacatattattattctgctcaattcatttttgaaaattgccttttaaaggcagagagatgtttcttttctctgcctattttgaactgtgtatgaaatggagaatgaaagaatacttaccctaacttggttgcaggatttggttag

SEQ ID NO: 41890 - DNA, 876 bp, Bovine  19866882155714
aagccttccactttccaggctaacccgcttaattggtttggtctaaagggagggaaagatagagacagaggctttgaaccatcatccctgtgtcttattctctctgcttgatgatgtgtaacacttacttcccacctgtctttcatgtctccagtcaaattttctttcttaaatatcatgccctttgagctgataacattttccaatgaaaaaatgcaccctgggcacctgctcagggtagaggtctctagggctgtgggcacagagtgccgagtgatggagtcttccctgcacacgggcatcactgcctctgtacgacccacagaagagccacagtaggtcggagtcaacccagccttcccatggaagcagctgacccagatcctagacccaaagtgaaaagagtccgttgtcagatcacaccacagtcagagagtttattttaacagatggccgagtctcatgaggttttctgtttctaaggatgcttttgtgtttccaaagtttcatgtacatgttttttaacataaatctttttcctctgcctctttgaaggttgctggtgtcgtcggccgtgcagacctcctgggcgccctgttttttctgctgtctttccttggctactgtaaagcgttcagagaaagtaagcaggatgttttgccctcttaattttgcatcttcttcgtgtttctgttctgtcgagcgtgttttaacaggtgggaaggtgtccgttgctataagtttatcactttgaaggaatgtaggccaaaggtgtcaactgtttttagtgatgtctgttactcggttgctttttcacgacacaaaggttgtgcttcaacattcacaatgttcaggaagcatcttgctgagtagtga

SEQ ID NO: 41891 - DNA, 960 bp, Bovine  19866880344258
atggactggttggatctccttgcagtccaagggactctcaagagtcttctccaacaccacagttcaaaagcatcagttcttcggtgctcagctttcttcacagtccaactctcgcatccataaataaccactggaaaaaccatacccttgactagacggacctttgttggcaaagtaatgtctctgcttttcaatatgctatctaggttggtcataacttttcttccaaggagtaagcgtcttttaatttcatggcttcagtcaccatctgcagtgattttggagccccccaaaatgaagtctgacactgtttccactatttccccatcccatgcttattttttaaaagtaacaaattacagaaaatgtattcattgacaataagactggagaaacagatagctttctctctggctaaaatgcttctagcaaccaaattgcttatctgtttttgcctcagctggttgctgaataattggtggaaacctgtcctttctctacttctctaagttaaactttaaaaaatcccagcaatcttcccaggaatgttctgtgcatcctgaaaagttattgatcttcctgtttaattctcctctgttctaagaaataagtgagatttaaaacttagtgataaagagacgtgacaggcatctgaagaggtgacagaagctcagtttccaaagagcagtctgtaagacttttgttactttcatttcaaatgtgagacaacagtgctctctgcccatgtgaatatccaagaccaacaaatgacagcccaagagaacagagtctgataaaaatgaagttgattgcctggagccacctgccagctgaaatctgttgataagcgctccataaattgtaatatgaacagctcatcctccagtttcagaggggagccggctacacccaccacacagataacagtctcaggttctccagtcggagggaaaaggttat

SEQ ID NO: 41892 - DNA, 3278 bp, Bovine  19866880347917
gcagtgtctgacatatagtaggcatttgacaggtataaactgaactaaagagaattttgtggatgagggtaggtgctggggctggatgagacaggcatagccgcacttagcttccatgggccccagagacagtgggaaccatggtgaggcaggtcccgtggtgcagaggtgagcatgaatactggccttgcaccaggcactgtgtcaggtgctacgcatttattgagcaccgaccatgttttagaccctgtaagtgagtgcacctacgttaaatactttttactcagaactgctctacaaggtggtatcaggtccattttgcagagactggcatcaaagctggaggggctcaagcatagatttggagccagaacccaggtcatctggtttccaaagtccatcctccccccattaccctggcaacaaatgtgctggcagataatgtggtccaggcactagatggagtctgaagtaaagggacagagggggcaccatctgtgctcccacctaccccatccccagctgaactcacctcaggctccatccttgcccctggtggtacgccaactgctttgcaggggtgaaaggtcatgcaatattgtgatttataatacgtaatatatatttggtctgggtctcatttctggctcacagctcctaaaacccttggaatttcctaagtgatatgggcaataaaggaatcttctgttattcgtatcaaatgaatgggactttcaatgggagtttcagttaatataatgacttttaggaaagcttcacgataacctaagaaggggaactggttgccaggggaaaccgtgtgactagaggctggaatctctcagtctcaccgtcctctccccctgacctccagggaggagagagtggctggaggttgaatcaatcactaatggctaatgctttaatcagttatgcccacatgatgaagtttccataaaacccaagaggatggggtcgggtgagcctcttggttggtgagcaccagaggtgctaggaggtggtacagctggccagggacggaggctccacgcctcttcccacagaacttggcctacacatgtcttcatctggctggtcctttaataacctttacaataaactggtaagctagcaagtaccagctggggttgcagactcggtgacacattgctggatgtgtggaaacaccatgacacatttggtgattagacgcgctagaagtggaatggagtactgagagtggaggagcaccaggagggccttctcctgagcaggtaagaaggtggggcagagaaagacagtctggccatcaggcccaccttttggcagccttgctctcagatgctaaagtgagatgaggaagccccatttcagagcactgtcccaatgccactggctggttatgacccatcgtgtacagaatggaacagtggagaaatgagtagaaaaggctttggttccattgtacaaatagcattgtggagcccagccagcttcacaccagattccaccttccctgcacataagaggcaccaaaaactagggcagagaatgcacatgtattttcctaattgtctgacttaacgcttacaaagtcatttctgtgtctgactccacccctagcctgatcatatgccctgttttagagaaaggtaaagaccaccttaccaggtaaccggatgggcttccagggggcagagtttggcacgtaggcatgctttgtggccgtgacaatcagctgactgcccagcttatactggaatttgatgaaggcgacgccatctgtccccgaggtaccagaggcaatggagacctggttggtgaaaatctcaatgagcgcgtcagggacaggctgatgggtgctggcatcactgatgtggaccttcagggtgacctctggaagaaggacagagcaacagagaacggttattaactggggaactccaacagcgattctgtaataacagcgaaagggaggtagcaagtattcatgggatatgcttagaaaatctagactggggacttttctggtggtccaatggttaagacttcgtgcatccaatggttaagacttcctgtatccaatgaagagtgcacaagtttgatccctggtcggggaactaagatcccatattctataaggtgcagccaaaacaatgtttttaattagaaaaaaaaattctagatctacatctaaaatataaatcgttttaaccagaaacattctcttcttagcaattcttttttactttacatgattccttatcttcctcaaaaccactgcctataacaaactcctttcctcctggctcctcctggcggccccccgcccccaacaataataattaagagaaatatctctattcctttaagacactgtgcaacaaataccacgctttctgatcctgcccagtgttgctggtaaacacagcctaagcaaagctcaggctgctacacaaggaccctgcaggcactaaggtttgcagcaaaattgtgacctgcagcaaaattgttcaacaatctgtgatgaacatggatgtgtacagctcagggtcgctgtgctggtaatcatgaagacatgactgaaaagtagtccctgcacacagtaccacccaagggggtgggcagactatctaagcaatgtgtcctgcccagaccatggacccgccccagttgttactccatttaaggaacctcctcccttgggagggaggaaaagcacctattacttggttttgttggatccctcgtgctgcagccttcccaaaaaatcttgactgaatttctcttcctgattcctactgattaaagtgttcaagggctcggttggtatcacacagttaatgcgttttttggctagatgaccataaggaatagctaaagaaccctagacccaggagttacatgaggtctgcaccaaataaatctctcaaaaaccttgcagagaaaaaagtgctacaaaaactgaacctggttactccctactataggaggagaaaactactgccaaaagagggataaaatcaacatcaagaaaatcaggcatatggcattacaaagcatatctagtcgattcctgccaatcttatcagtgttatcttaatgcagattcgcagcacacatttgctttcttatggagctggtcttacttgcccccagttataaatgaattaatactctcatagcagaaaccctctacaacaggacaagtgggaaggtgctttgtggtgttgcacacggacgatttacataatcttgtaatgcaacattcacagcaa

SEQ ID NO: 41893 - DNA, 1722 bp, Bovine  19866880487221
ctgatgccataaagaagatgctttcctctaaaacttgttttgtggcttttcttttatgtctttattctccctgggattcgcatttgtgtagtttccgatagagatctaaaattgaacttttcccaaggtatatggtctgagtatcatttattgacttgtgcatttcttcccccactgatttttaacattgcttccatcctacaccaagctcctctagatttctggatttgtttctagtctcacttttgttccagcggcttttttttctgcgccagtcccaccatgttttaaatgctatagctttagaattgtcttgatatcagtaagatctactcctcaagttccttcttcagaaatttcttggctttcatttgctcttgttttttcatacgtatttttggatcagttcgtcaaatctgatttgacaaaatcttttggaatttttaatgagccctgatggctccgcagtaaagcatctgcctgcaatgtaagagacgcaggagacacgggtttgatcgctgggttgggaagatcccttagagaaggaaatggcaacccactccagtattcttgcctgggaaatcccatggaaagaggagcctggtggactacagttcatagggttgcaaagagttggacacgactcagtgactaaataacaaccatagaatttgctgctcttccttatcatattcccctaccattctctttctaatattagggctgctttgttccagcataagctctggtctccatctccttctcagcttgcttggaccacacacctgcccctttgagccagcaacatgggaaagcagctcctcctgttgcagagtaacctagtggatgaggctgtggaccagagtgagacctcctgggatcaaattgcctccaccatttactgggcaagttcactggcctctctctgactcagcctcttcatctgtaaaataggggtaggaatgtatctacatcagagctctgttctgagactggaatgagttcatccacataaaggactcagaatggtgccaaaagctagtaactaggttgttcttattgcctgtgcttcttctgatcgtcatctcttcactgactttggaccctgggactgaatatgattgttcagataggggttcaaactggaacaaagacacagatgcagactaccaaggagcttcattcaagacacatactttggttcttctctgtgctttaccaaagctgtccctagcatcatatcccagaggaggctggctatatgttcctatagggttagtgacattctcatattaggtgggaaatgctcatatttgagagtggaacttggtttcacagactggattgattcaaaaagcttatgttattcaaggcccaatactaagctaataggtacagcataagctctggtctccatctccttctcagcttgcttggaccacacacctgccccaaaccattcttacttataatatgaatttgttgtcacaatgcattgaatcatacttttttatttggtgggagggacatgtgcataggtgtggtagtggtgatattgtacataaatacacaaatacataatttctttgttccttatagtatgtcaagaattcttgagtcgattctacaattccttgatagcaagaggagtcaacttttctctggacaccatagaaaaagaattgatcaacttttgctggatgtcaaaggaaaagaaaaccg

SEQ ID NO: 41894 - DNA, 1290 bp, Bovine  19866880534467
taaatgtttgcttattcatatcagttattaagaaggaaatagaatttgtcattttatttgctagcattcaggcttctcaaggggtgcaaaataacccaaacttaaatgcagcagaggctcagaccataaagaaaagtagtgagaaacagtttttaaaactttaaaacataaaaatagcaaaaatttccaaattatggtttgatttgaatcaatagatttattggtagaaatgccatacactgagaatttatttttaggttttttgacagcttataagcaggctatgggtatgataatttttctatgtgaatttaatattatatacatttgtatgtagatgaataacctagactttttcctcccatgatattgctctgctgagtgcttaatatcctgttctgatcataaacctactcttaaaagatctattacagtaggttttgacattaccctttacaagaaaaagatatcttgtttaacttatttctgctgtctcttttgtgtttatgtgtttttacagagcaagatttgaacttctgtgttctccactttttaataaatgtatagaagcaatcagagaagtcttagaacaaagtggatttacagcagatgatatcaacaaggtaataacttttgtatttttcttatttatgttaggaatagttttcgactgggaatttaggatatggccccttggtaccgaaagagtatttttatacatgtaaatattttcttaccttacattaggaaataaggaaattttgattaatggctctaatgaactcacagttctgtgtgtttattagcaaaaaagattaaaattctttttcagtgtattttttgtatataagcaaaaactgacaaatattagagtgtttcttaggtgtcaggcactgtttctgagtgttttacatgaattaacttgctgtatcttaaccaggaactctatgaagtaggtgatattatttatctccattttataattggaggcacagaggtacagagatataagtagcttcatggttatcatgtggctagtggtagaaccaggatttaactcagtgtggttcccagttctgcttttaaccagtacaacggtctcctctctgcttgctgagaaatattgcatatttgcttgcataagaagatttagagactttgaagaatattctactggtttgtagtttttttcccaagattatttctactctttcacgatatatatacattttttcattgttgttgataaaggaattttcatataagaaaactcagaaaatagtccagtgt

SEQ ID NO: 41895 - DNA, 3005 bp, Bovine  19866880622931
aattttatggagtatagttgatttacagtattgtgttaatttctgctgtacagcaaagggcgtcagatatacataaatacacattctttttcatattttttctcattatagtttagcaccgtatattgaatgcagttccctgtgctatacactgggaccttgtggtttattcattctatatataatagtttgcatcactgattccaaactcccaatccatctctcccccaaccccctcccccttggcaaccataagtctgttctctatgtctgtgagagactcttgttacttttattaaattgatcaatttgtgctccagatgtcaataaactactaaggatacagagtaattgaggatggtgatagagaacatgggtttaactttggaaaacagcatgaagtttcctcaaaaagttaaaaatagcactactatatgatccagcaagcccactcctggtattcgtccaaaggaaatgaaatcaggagtctgaagagatatctgcacccccatttcactgcagcatttttcagaatagctaagatatgaaaacaacccaaatgtccatcaatggatgaacggataaagaagatgttatatagacagacagacagatattctgtagccatgagaaagaagtaagtgctgccatttgtgacaacatggatggaacttgagggcattgtgttaactgagacaagtcaggcgggaaaagacatactgtatatcacttacatgtgaaatctaaaaaacctgaattcatagaagcaggaaaaaaccctcaaaagctgaaactcatagaagcagagatcccctggagaaggaaatggcaacccactccagcattcttgcctggaaaatcccatggtcagaggagcctggcaggctacagtccacggggttgcagaagagttggacacgacttagcaattaaataacagcaataccatagaagcagaatggtggctaccatggggtagggatgcgggggaagaagagagatgttggtaaaccttaaaactggtagataaatcagtcctggagagctaatgcacagggtagagatgatagtcaacaatgctgtactataaacttccaaagttgttaagaaagcaaatcttaattgttcccaccacaaaaaagaaatgataattatgttacatgctagaggtattagctagaactaaggtggtaatcatattgcaatatacaaatgtatcaaatcaacacaccttaaactacattttttgcacctaaatgcacattattatatataattatatctcagttaaaaaataaagatgaacataggttttggagtcaggcagacctgaacttcaagttgctcatctataaaactggattaatgatatttccctcttagggtattatgaggactaacatgacaaatgccaaaccgttaataacctttaagaacgatttgttattatcttttacaagttgatggaaattcaggaatccttgaagacaatgcaagtttttggggtcaaggtggcagctagagcaagattatcatcaccttaattatatgtcccttttgtcactgcttatcttgaccatttgttttgaacttagcatttacactgctttttctgatttggtttatgtcgtctcctaatactaaaacttgtaaagtttggactgtatattgatgcacataattcattccttattagtattattcaattggtcttttgcgtttctgctgaccccagaatatctattttagatttgaaatttttactggacagaggtaagacatgcaagcttagtctgcgtattgtcatcccatcaccttttttggattttatttttcagtgtccctgagtcacaatttctttaaccagattctctgcagggggatagtgttgtaatttctaataaaagggaatctaaagaactatttattgaccattcattcatttaaaaagtagttattgaactcttattatgctacactgagaggaggaagacaagtaaggcaggttccttttcctcaagatgtttgctgtcaagtagagcaaaggaataaagggacaggcaaaagaagcttctcagttggatcaaagaaaaagtacaaggaaggaagtgaagtcgctcagtcgtgtccaactctttgagaccccatggactgtagcctaccaggctcctccgtccatgggattctccaggcaagagtactattagtttctgttctttcctaatgaaactgtagctttcaaaataccatttgacttaatgtaatttaattaaacaaatacatctcgatgacctactaagctgagtccttgtgaatgaataagacaacaccctgattctcaaggagtctggaggactggtgctatagatttagatttccttgtatacccacctgggcccctgcccctcgttaagtgacagacaaaattgaaggaatttatcatggcacacacaggatcattaagttctccagaaattccccttgtgctattctctataaaacagaacacttaaaagagttgcttcacttcacatgtcttgataaataattattgaggtaagatgtgtttctctaaaatggaaaacactgtaagtttcctgctggaattgactgagagtagtttcggcagctgctcaaattcttgccgatttctcctgaatggatccttttgttttgatggctttccttatgtaaaccacctttattttctttggagaagactcgacaaagcaaaatcacttgttaatattaggataattgctgattcccttcctttctggcactgaagatgtaagaaagatcttacatctttcttacatgtaagaacagagcctgccctggcactgtagagttcatctgtggaaaactacacaacacaaaatgtttctattgcctcaggggaattcagtgtgtcctttaaaacacattttttttttttttaattacagggaatttcctgttttttttcccctaaattaaagcacgggttttccttttaatcaaca

SEQ ID NO: 41896 - DNA, 2035 bp, Bovine  19866880636375
agcctaattaaaaaatggttttagtcctgccctgtgatttttttttagtggggtggaatagaaatttacattgaagttttaaaaatctgatcgaatgacactgaagaatttccagactgaaataagaaaacagtaatcttaagagggaaacttttctcaagtcaatgtaataggcacttaaacctaacacaagcaaaacaaggctttaaaaaataatttacatgaaattatttgtacctatatattttaagatacttactgctatgttgccttctgggagttttgctggctgatctttataaggcatcttcttaacttcaaaggacaccagggatgcaagagaatagggatcatttttcctctgaaattaaaaatatttatttaaaatatattccatgtaaaactttaaagttatattggcagtcatccagttgttttcaatgttttccatttccaaagaaatattccctccttctttcttccttttctctcttttttactttttttttttgctatccatctatccattcatgatccattcgcttattcatccatccatccatctgttcatcatccattcatctttcatccatccatccagttatctatccattatccactatgtatccatcattcattcaaccatccataaatcatccatccatccatcatcatccatctatcatccatcatccattcatcaatcacccatccattatctgtctagacatccatccaaccatccatccgatcattcatcttcttacttctaaagataatctatcttattaccaaaagacttggcacaataagggtaaaataaaaacagaaaatcagacatccttaaaggagtaagcacaagtgctcttactgaagaacatagttggggatgacatcgtgagtacaaattcttgttgtctgatggaacgaaatattttaggagagagactgctgctaagttacaaagaaattagtcatatttccttttatagacaacaaaggtccatcaagtcaaagctatggttcttccagtagtcatgtatggatgagagagttggactataaagaaagctgagcgctgaagaactgatgcttgtgaactgtggtgctggagaagactcttaagagtcccttggactgcaaggagatccaaccagtccatcctaaaggaaatcagtcctgaatattcattggaaggactgatgctgaaattctaatactttgaccacctgatgtgaagaactgactcattggaaaagaccctgatgctgggaaagattgagggcaggaggagaagaggacacaagtttttggtggcttccattctcacattccaaactcatctggagcaggaaccagaactaagactcccatgaacacagtactgagtagtgcaggaagaaattctgccaccctgtggacattccccccaaagcgccatataatctattgctcatggtcagctcatattcacaagaactgctgggctcttgatgatgcctccacttgaaaaaaagtaaaggaaacaaatggaaaataataaaaaaggacaatctaggctttcttgatggctcagctggtaaagaaccctcctgcaacgcaggagacacaggtgacgcagatttgatccctgagtcaggaagatcccctggaagatgaaatggcaacgcactccagtattcctgcctgaaaaatcccttggacagaggagcctggcaggctacagttcacagggtcacaaagagcaggacaggactgagcaactaagcgtgcacgacactcaagaagaaaatatctgaagtacatcaactcacatcatttaaaaatattcatgaaaagctgttgaacgtcacgaattatgacagacatgcaaaccataactccagcgaggcatcactcagcgccactgggaaaggccatcgtgaaaaatccgcaaagaataagtagcacataaatggtaaagatcactacagagagaagcatggacctgcctccaagagataaaaatagacctgctataaaatcctgcagaaat

SEQ ID NO: 41897 - DNA, 1728 bp, Bovine  19866880667695
tctgctggatgtgagatcttcctgaatagggctcaaacccctttcccctgcattggaagacagatttttacctactgtaccactagggaagtccaacaagtcattcttgattgttttcgtctgctatgtacactgcaataaacccaatacttagaataaagcatgatgtaaaacaggtgtacaagaaatatgaattgaacgacttgatggacggatccaatgaaatccaccagccaagtcaccacacttttcactgccacccacagtgggcagtaacgctgattgcagggcatgggatcttgatgtcctggcagatactaaaaggcattgaaagagttgaaaactaggctttgaggaagaagaaagttattttctaactggatgatttacccctgcccgatttacccttgaatactttatttacaggaaatacaattccaataacgtgcttatttgtgttgttttcctcaggttcatgtggataaactagacatgtttcgaaacatgcctgacattctccatcatctgacaacagaccgtgacactcagatccatgcgtgtcgacatccaaaggtacatggtgaactctttttcttactgtttgtatgattcacagaaaccaaaattttagattcagaaggaacctcagaaatcccattttgtaggctcttcaatttccaaatgtgaaaagtgaggctgagatcccggcattagatcagggtcatgcagcgttacatcactatatttccgttatcataaacctaactagtaaacagacacagatacttgtaatttctaatgaaatatatttatacaattgatatatgtttatttgtaatgaattatgtaacgaacaatttatttgtaaggaaagtagtaacattagagcttataattgaaaatttaacaaaaggtaatcaccatccattgtggtttacttttgaaactcatgacacatgcatatttataaactttattttttttctcattggaggtaaatatctaaatataactttgctttgatttttttaaaaattttttggccacaccacacggtattcaggatattagttccccaacctgggatcaaacccaaccccctggattgcaagtgtggtgtcttaatcactggagcatcagggaagtcccttaaatttggaagtagttacgtgtattggtgatccagtttcaaatgaatatttttagtgtctttgaaactcactggtaattgactttctgatgccatcatagaacttccttctcttattaactgccagggattcaattttgaatttggctttaacagttccattttaatttatatagtcattcagtgtaactcaactactaattagtgaccgtcaaatgcagagggtttgtgtgatcataatttttctctaaatttttaatcttggcattcaaatgctgagtaatttttattttagtaaatagcacatttatacatttggataatcactgtagtagtaatactatgtaactccatcagccaaaatcctaaagtttctttgtcctaaagtaaagcaaaatttaaaaaaaagattgttattcttaccatggagtattctatttcaaaccaccacaggagagatacaagctaagaaattcttttgatgattgttcagcttcacattataatttacgtcatgaatttacttcatcattttggttatgtatatatacacacaaacacagacacacaccatgcag

SEQ ID NO: 41898 - DNA, 2086 bp, Bovine  19866880728418
agggttcagtaatgttagtgattattgttattccatactacattgatttgggttttttcttcaattcatgttctacccagaagcatgtaggtttttctccctggccacaccctgaagcatgcaggatcttaattcctcaaccagggatagaatccagaccctggcagtgaaagcactgagtcctaactactgttcagccagggaattcccaagaaacatgtaggctttgtgaatttttaggttggaagtcgaggtctacttaaaattaaacaagaattttaagtagcacaaattctgtcatcttgtgttcagctgcttcagtcttgtccgactctttgtgatcccatggactgtagctcgccaggctcctctctccatggaattttccaggcaagaatactggagtgggttgccaattcctactccaagggatctttcccacccagggattgaaccggcatctgttacatctcctgcattggcaggtggattctttaccattagtgccacctggaaagtgtcatcttattagttcccaaaatacagaggaaaaaaaaattttatcatgaggtacccattaacctaagcacacttgtgagtcttttttaatgttaatatccaatattttacatacatacactgtgtgcattgtagctttattagattcctaatgtgaagaggttcagatactttactaagaacttctaaagaatagaaaatatgtagttaactgttgtaggctaagcagttgttatatgggagactgcaggactcatggagttttgaaagacttttgctaacaatacttaaaggacaaactgtttcctttctctctgtttatgataattctgacacctagtaagtgggtgggggttctcaaaccaaccagttctcctcctctctggataccaaatggatgtcttacaattcacttccattctgacagttgttcagtcactcagttgtgtccaactctttgagaccccctagcacgccaggcttccctgtctttcaccatctcctggagcttgcttaaactcatgtccattgagtggtgatgccgtccaaccatctcgccctctgtcatacccttgtcctcttgccttcaatctttcccaacatcagggtctgacaatagctgtccaaaattagcccaaatgctaccgattaagggctcagtcccatgagactgtcctctaattcagacacaagccctaagtggtcatctgtacttctgaccaatcagctatatatcagaggttcccatgcatccctccctttctttcactataatgactcccagaactcagaaaaacaatgacttacatttgctggtttataacaagtatcataatggatgcagatgaacagccacatgaagaggtgcaacagggtgagatccagaagggtcctcgccatgggagcttctatccctgtggagctgaggtgcaccaccctcctagcacataaatgtactcaccagcttgaagttccccaaagcctgtacctttgggactctcatggcagcttcatcaattatggcaggtgtgatcaatcatgaactgagctttccaccccatctattctctctgaatgatgggaagtgagcctgaaagttccaagattcttatcatggtttgatctttttggtgaccagtccgcatacaggaggccaccctgagtctcctcatcagatcagaaagatactctggtgactcaggaatttgagccaggaaccagaggtagagaaaagatatatatttattattatgtcacattactaaaaaatcaatgttgttgattgatttgaacccagagaatccaaagaatgcagagtacttaaaaaattggcatgggcactttgatttagaaatcagaatttcctcatatccatctttgtttccgcagtattttcttcactaagcctgggcctgcttccagaacgatccgctaccctgatggtgtatgaagatgttgtccagatagtctcaggattccaaggtatgtctgatacttaaaaagaggagcgatggtaactttggggccaactgttaaaatatgaggaatgggtagtcaggtagtgatg

SEQ ID NO: 41899 - DNA, 1369 bp, Bovine  19866880748148
aggtacctctacgtttctctatgagtaaactttcgttatccagcagttaggaatggaagtaattgaattagcattaaaatgtatattgccctataaccaaggtgttatcactaagcatcggctgtcattcagggtaaagtgctggaaggctgcctggataacaggaagtacacactgactgaatcaggcaccctgtttggccctgcagatggagaatacacttgcattttaataataagtggtcagagctcccctatggaatgcatcttagatcaggtgtcacaaactttttctgtaacagtccagatagcaaatatttttcactttgtgggaacagctctgttggtgcaggaaaagctctcacagacctaacatgaacaaagatggcatggttgtgttctaatgtcttactccacttgggctgctgtaacaaaattaactggatggcttataaacaacagtaatgcacttcttcattctagaggaagccaagtccaagatcaaggtgctggctgattcagctctggtgagagctggtttcattggttcacagaggtgccttttcattgtgtcctcacatgccatgtcctcacatgtggaaaggccaagggagccctctggggcccctttcataaggtgactaatcccattcatgggggctgcgccctcatgacctccaaaggctaataccatcatcactttgggcattaggattctaacatatgaatttggggagaacacaaaccattcagtccatagcactcaatagaatttcattcagggatgcttagatttcatataattttcatgtgtcattagatgctcccttctgattctttcttcaaacatttaaaagtgtaaaaaccattctaagctttcaggccatagtttgttgacccttatttaaatgagaaattcttaatggattcacaagttactagttctggctgttaaacactttgaaattcaagtactttgatttacctgaaaagtatatcaattaaagtgttaaactggtttgaaatgctaattgcatttgaatcaatcataaatagtagataattagtaaatagtgctacatgcttaatacgtgttcctatttttttcccctgatcttataatattcttggaacttttcatttaactgcaataatttaatttctacttaaataatgacattatggattatatataatagtagaaacacccttatgaaatatgtaggcttctgttgagcttagtaagttaaagaacatatgatttctttgaaatgtccatccaaaactttaaagacaaagttttcagaaaacttgttctgattcatttgatcacttttgaatgactttccaaatgttgccttttcaaacaa

SEQ ID NO: 41900 - DNA, 1485 bp, Bovine  19866880781614
tgacctgttagccttctcatactgctctaatactgcctgttcacctgcctgtttacccaactgtatctcctcccactagaatgtaagcagcttcacagactgtatcttaacctctcttggtttctaccactagggctgtcctggcacagagtaaaaacgcagtacttcttggcggaaaaagtcaacatcctactcttccattgactctacaatccaacccatttacaagacttttctacttcaagaccactacgaaagaaaaaaattataatcagaagatagcagcaattataaggcacattccaagtttgggattgttgtcaccatcctggatgagggaagagactaccacgaaaggttgaggactaactggtaccacttaataaatacagatgtgcacacatctatttacacaaacgaaaacctttcctttttaattagttcacttggcctccctatcttgagctgtcctgctcagaccagatgttgtttcaaatttaaatgactcaccctcctgtctaaaccccaggaaactaaagacaaataaagggactcatttctcagctatgattatgttctaaagctgagctctttttttttttttttttaaaagagtattatttgttgcctctaccaagacagcttaagtgatggggatcagtgcatccaaaaaggaaatatttttgcctccaggcaaggctgtaataaaagaagctcattcatcatctgctgaggagaaacatgtcacaacaaaattactaggtaatgaaaaatctgggcaatcctgtggcacttctaatcgtaagatctcaaagcaatcccacactgttgttcacaaagccttgtcatcagctggacgcaaagtaggaagcatctctttccatagtgttgtacactatgaaactaagagaaaacaatgttaagcaaattaataaaaataactattattatatacacagacacatttatatataattatgtacacatacatgcacacataaaattttaattaactgcaaatcaagtgagatcacataagaatacttacttgtaaatcctcaaacaccacacaaataataataataataagcagtggaagcatgttataattcagaggatagactttggaatcaaacagaactgggctttaatcctgggtcacttcctccctctgtgaactagggcaagcatcttaccctctctgagcatcaatgttctcctctgtaaaatgggaatcataagaataatcccctcattgtaaccaggtaacgatggaatattctgtgtaaagcacttagaagaatggctggcatgcagcaagtactctgtaaatgttagctccccaaatctaaaccaaagagaagccattccccatgcccatggaatccccttcttctcgtacatcctgacaactgaattttgcagtattccatttcatcactcccagtttgatcttgccttcctccctactcagtttggaactca

SEQ ID NO: 41901 - DNA, 1455 bp, Bovine  19866880810011
ctggagtaactctgtcgcctgcatcatttgcgaccacatcagcccggccatcctggaggtaaatacacaactgtattagttcttttgaaatgaaatatatagtctccttacatacattcagacatatgtggggccctgtgactgacatatatgtggaaacaaaaactgctttactgtatttctagatcttaataaccagaattctacaaccagctgcctcttttcaatctgttctgcataggtgataacagaagagacatgataataacctctctatataaaataacgtgttaatacattaacctttctatctcttttccttttccctgtaaacgctaatctttcttccctctttttacatatgatgaattagcaacaatccttcggcttttccctacaaatcatttgacatttaaccgtgagacgagtatcagggctgtcccttatggttccttccgcctccccacagacgagaagaagccctaaactcccagtcacacactcatttccagaaaggacaagtgactggagcacacaccatcaactggcttcctacgcttctcgggattaacaggtccagttccagatcgccgccaccttgctctttcttggcaaacgtccagaaacctccgggtaccagacgctcgggtccccctcccggcatcctgcgtccatgaggtccccaggtccgccttcctcctctaggcctccagcacccaggacgtggccgggtccgtccccaccctcaggggggacctccagctcccagcgtgtccctgggtccgccccccaaactcccggggcctccagcgcccagaacgttcccgggcccgcccccgcccctggggcctccggcgcccagaaagtccctgggtccgcccctgggctcggggccttcggaacacaggatgtccccgggtcctcctgcaccctggatgtgctgggtccgcagctgcctttcctgaggggccgcaggggaagaggccgagtccgcccagtccttagccccgagacttcctcgcagaatcgcctctccgtgcgacgtccctaggcccgcgacacgctgttcacaaccccgcagaccaaaggacttggcctcgtacccaaaggacgctgcacccgcaacccagctccccgagtccctcaccttatagacggccacacaagctgatgtgcagcccaggtgaaccccgatggccgccatgaggcggcagagacgccggcagcactaacgggtggtttcccaacagcaacagcgccgggccgcggcacagccccatcaagcaccgcggagacttcacgttccagtccacccactacgcctccgcccttgccgaggccgcccgcgtcgccgccaatcagcgtgaaggtcccgccttttctgtcgcgcagtcggcgattagctattgtgagtctcgccccgctggggcagcacagcttgagcaatattgcgca

SEQ ID NO: 41902 - DNA, 3119 bp, Bovine  19866880878835
gagtttactcaaactcatgtccattgagctggtgatgccatccaaccatcccattctctgttgtccccttctcatccagttttcaatctttcccagcatcagggtcttttccaatgagctttgcatcaggtggccaaagtattggagtttcagttcagcatcagtccttctaatgaatattcaggactgatttcctttaggattgactggttggatctactttcagtcaagggactctcaagagtcttctccaataccacagctcaaaagcatcaattcttcagtgctcagctttctttacagtccaactctcacatctatacataactactggaaaaaccatagccttgactagacagacctttgctggcaaagtaatgcctctgctttttaataggctgtctaggttggtcacaacttttcttccaaggagtaagcatcttttaatttcatggctgcattttttctcaccaaaagcctagaactgagtaaagtctggcacaaagatgttcactatctatttgctgtaatgagtgaattgttcatttttttaaaaagagaagccaagaacagaattccccaggaaatctttcaatatttaaatgttggcagcaaattaaaacaaaacaaacaaataaatgcccccaaatcaactgtatgggccaaacaaaatatctgggaatggatagttgctctgcatccccagatccagtccattattctgttaagccacattaagtcttggcatagaaggaggaatgcaccaaaatctgatattctagaacaggaagaggatttaaagcctgaaggaaattgtgttttgaatctccccttctccattcctaggataacatacatgtgtaccaggtacttccccgtgctggatttcagcttctttctgattaagaaagaatgtagggttgctatgaaaacagtgatgaaaaatgttgatttatggtcctacctgttttactaatgaatgagctcagctgagaatgagtagacaatgaaagaaaaaccaaacaactttccccaaatggtcctatatttcttcccctccaatttaggtatatttcaaactgcttatatgaaatggcaagttgtaatgcagggatcgaacccatgtctcctgcactggcaggtggattcttaaccactggaccaccagggaagtcctgggtattcaatttaaagatactaaggcttcactgtacttgtacatcttgtctgtctcccttatatcatgctttacacaaaacacacaaactaaatatgggctgaattagaacaatgatgattataataattattagtacttacagaacactttacccagtactacgcaccactgtaagggttctccattctcaacaattttatgagatgggaaatgataactattattcccattttacagatgagaaaactgaggccctgagagattaatggacttgctcaagatccagaggagccagtgtttacatccaagctgtctcaattgctgggctacagcctgcctgtattcgatacactcttgccaaatgctgtacaaccagtgcaacatcctgacctatgaaaatgaattttacctcttaatttctcatttcagtggagaccactgaaaactgaaactatttttaaaaaaatacttggttttaaaataaatgatggcagctttgccttcctaattatttttcacccaggccaatctcagaacgagtatattaataatagatgcagtgcttcaaatccaggccaaaggacagcaaagcaagaaggttctgaggatctcaggtagtagggagaatacacacctgccatagataatccacaaagtaattattttataagtggtaattaagagttgactacaacttaagacattttctttcaggaggaacatactgatctatatacactctgaggccacaaagtgggcagccatcatttgtaaaacttgccaaaaattgtttccattcaacaccagcatgaaaagttctcctatataaatggaccctttaggaaaattaagtctctaaggataggattttgaaacaaagtggacctgagctatatatggctataatttagctaaagtgatggtattgttttctaaactgtctcattttcttgttgttgttgggggggctggctacaaacacaaaaggcttaacaatttttaggaatggactgatagtacaagagtgttttttgagttgctaggcaacatcaggaaacaaatgtccatgttctgagatcactcagcattcggtctccctgtgggcagtgcatgtgttccacggccagactccgttccactcgggcaacaggagtagaacaccccaactgtgatgctgatgatctgcagcagccaaaagacaccaatctgtgtctcaaaagcaggtcacattttgctggccacctggcagctgaggtctctggcccaagtttttgctggactggcataatttatccagattaagtcctacacttttaacggttcttttctgttatttcacttcaattagctttctctgcaggtaaattatctcccccccaccacactatatatctaagggaagcctgattcactggtatggacaattttttaaaaactgaagtacagtggatctacaatgttgtgccaatctctgctgcacagcaaagtaactcagttttacacatgtgcacattatatctgagaatacagagactcttttcctgagaattatttctttgtttctaagagatcaccttcattgtgagaagacccatttcaggtgatctttctcaaggatatactgacattgtacttcagcagggtaagtttgcttctttctttgtttaattcccttaactattgagtctggtcattttggaaaaaaaaattataaagatgatatgcatggttctaaagttagcatcacagatgtaaatacatacttaacttttagaaacatgaattcctttcttttgttctaacttttgcccacacaatgccctatggctcattcttgtcattcagtcactacaccctgtctggcaatttgtcacctgctatgtaagaggcatggctcacggtatatacagaaaaagacacaccagtaatattttcattt

SEQ ID NO: 41903 - DNA, 930 bp, Bovine  19866880893668
aaaaagacacaccagtaatattttcattttctttaagtgacaaatagaatatagtgttttaagaactcccatccttttctccccttgagaaacaatgaaatgtaacaaaatcctagatctgtactttaaatcaagctccattgtcagggataggctggccatgacttacctaaaagggctagttcgatgagcgacagcatcaacagtaaagctcaccatctatgcagagacgaacccactaccggccaattatgagcgagtatcgctgaatgcctgatacgtatgcgccatacatgataagaagctggttcagtaaccagcatttctatagcaacgcacaccgctctgcaggctgcgttctgggaaggcagttaaaactggattctgcaatgtagcttcacttggaatctgctttgatttttgtcacctcattagaatgaaagtattcaaaccaagtaacccaagttattatgaaacagcagcaacttatcatagagaggatcttaaatcatgatttctcggccacgcaaggtcagtcggtcactttcaattcaaaccactgacctggtttgcttattcataagtgaccgttccccagggcatcgaatcagattgcagtctgaccacctgggacatggggcagccatctgctgtcccagttacgagctaaagagaggaaatgctataaaaacaagccagcacaccatcttttactgtcccgaaagtcttggctaagatgcattcaccatgaccgacaaaactgcatttgtcctactgggggaagaaaagcagcttctttcaaaggtcaaactggcccctgcacattcctgatgaggtcactgtatcccatcccctcagacacacttgcatactcaggccccaggtcctggcactatactgcttgcaaaagagacagcatcatcagaagat

SEQ ID NO: 41904 - DNA, 2197 bp, Bovine  19866881007471
aacctgatacaagtgagttcagtcctccaaacagcaatatcattatagaaaccacagcagcaataccaggacctactttatctggattttgagaattaaaggagataataaagcaaagggactggaacagaatacagaagtaaatcataacaacggtggacagtaacagtgacagtagaaataataataggaatcctacacatgaaaagatgctcaagattgctaattattagaaaagtgcaaatcaaaactacaaatgaggtaccacctcacaccaatcagaaggccatcaccaaaaggtctaaaataataaatgctggagagggtgtggagaaaagggaaccctcctatactgttagtgggaatataattgatacagccactatggaaaactatggagcttctttacaaaactgaaaaatagagttaccatatgactctgcaatcccactcctggcatatatccagagaaactctgatttgaaaagatacctgaaccccaatgttcatagtggcactgtttacaatagccaagagatggaagcaacctggatgtccatcaaccaatgaatggataatgaagatatggtataaggcttctgtggtgatctggtggttgagaatctgcctgccaatgcaggggacatgggttctattcctgctctgggaaggtcaaacatgccatggagcaactaagcccctggaccataactaccgagcccatgtgccacagctactgaaacctgagcacctagaacccatgctctgcaactagagagtggcccccactctccacaactagagaaagcccacacatggcagcaaagacccagcacagccaaaaataaatacaattttaaaaaaggaagatgtgggacatatatactgtggaatactactcaaccattaaaaagaaggaaataatgtcatttgcagcaacacggatggacacagagattgtcatactgagtgaagcaagtcagagaaagacaaatatataatattacttatatgtggaatctaaaaaatgatacaaatgaacttatttataaaacagaaatagattcacagacataggaaaaatgtttatggttaccaaaggagaaacgattagggagggataaattaggagcttgggattaatagatacacacaactacatataaaatagataatcaacaaggacttactgtatagcaaggggtactatattcaatatcttataataaactaaaatgaaaaagaatctgaaaagaaaaaaatatatatatgtatctgaatcactttgctgtacatctgaaactaatgcagcattgtaaatcggctatacttcaacaaaaaataataagagtgctacaggtattctttcaaagtaacagcatgcggcggctgttcacagggttgttaactcatattgtgcagatgctgtttcctgagggcagccccctgggaggtctccctccctcgcctccatcccccatccctcgtctattgcacaggattgacactgccccagtagcagggagtccctggagctaaaggacccctcactaaagcagaagaagtggaatgcggagggcaggaggggaaagaggaaaggacagaagggtctgggtgggtaagaatagtctggaaatctaaggagaaagaggcttttcttctgacaggcagggattagccatgcactgccccctccccccaacacatagcatgcatgtttgcttgcatatatgtgcatgtccacacacacacacacacacacagtgaaaaagcatggggtggggaagcttgcgggagtggtagaaagatatttattctcagacttccccttgtggactacataataggataaatggctttaaattgggctaaaaagacaacttacagtgttttcctgtcccccgtgtgagtgtgacaatctgggctagagtcacgcctccctccctctcatcagcacccctggggtgttgagctcaggtatgttattattaccactgctgtaattatttcaacgtgaatccaagaatttcctccattgaagtccatgggagatctggatttccttgggtgatcaaagtgtagactcaaggtgtgaaaaatggaggtcaatttagggttaatcttccctggaaatgtgcttctatgtctgaaattaaccttatctaaataatgattagaaaggcaatcgttcttgggt

SEQ ID NO: 41905 - DNA, 2023 bp, Bovine  19866881073859
tgatgatttacaactattcctcatttaaaaaaataagtaaaaatataaatacacgtataaatacaaaaacaagcagacagacaaattccgttagatgaatatgaactctttctccaaactcactactgcaaaatacgaaagccaagccctgaatccattgtttcattgtggccaccacatgcgagttcagacacttcctgtggagactcaacagaaaaggtgaaaatattctcacccagcagtgaattcccaatgaaaaacaaggcaaaaacagaaatgttatcaagtcacagaaagactgtatagaggctcctatgctcttcagtgaatcaggaaaggaggtccagatttttctcattaaagagagagaaaaaaaaaaggagctaagagctggaaagcagaggcatttccccaaagcagaaatttcatcaatttacactaccttaaagtgactgactccacacacaagacaacggctggtctgcacaccaaccgcacgacgagggccaagttttggtatttgcagtttactttaatatcacacggtgtggtttgtacataaataagtatctgagtcactcctcaaaataggggttggggatcctacttaagctactctggaagtccacactcaagaggcagcttccagattgctccagttaagcttcatctctggtcaatgcccaaggctgtgctaattagcacaatgaatatggagcctgttttcataggtaaagttagtgacctatcagtcagtatgtcagatggttgtgaaatcagcaggtacctcagccctggagactggctaaaacgctttagagatgctccagccttgcctggagcagttagccttgggaccctatggttagagggtgatgccaggcttaattcctaacagcttccagctgtgaaacattcgtattctagttgcctgacctggccctctagaaaagaaacctgcatcccacctctagacagaacatctataagggaggggagcttgcacttcgtcgagcttacagacaggacttttcagtgcctgcatgcttgcttatctgtgtgtaggagtatggcacaagacgcttctcctcggaagaaaagctatgacaaacctagacagcatgttaaaaagcagagacattactttgccgagaaaggtctgtccagtcaaagctatggtttttccagtagtcatgtatggatgtgagagttggactataaagaaagctgagcaccgaaaaatcgatgcttctgaactgtggtgctggagaagactcttgagagtcccttggactgcaaggagatccaatcagtccattctaaaggaaatcagtcctgaatattcattggaaggactgttgctgaagttgaagcaccaatactttggccacctgatgcttagaactgactcattggaaaagaccctgatgatgggaaagactgaaggcaagagaagaggacgacagcggatgagatggttggatggcatcaccgactcgatggacatgagtttgaacaagctccaggagttggtgatggacagggaagcttggcgtgctgcagtccatgggatcgcaaagagtcggtcacgactgagcgactaaactgaactgtatggcataatcccgagaatgtgggggaagaactaagtaatacccgtcaacctctgattactgggcactgggagagctttcaaaagaacagaacagttgtggcagatcaaagtggcgtgggtcagtggcaactggtagttgctgttctatcccgcagtatgagggatgagaagataaagcctcggatagactgaagagctcggctgggcaaggtccaagctagtttctcgcatagcctcccaaagcctgcacttcctcctgcaagaccctcgccttccttctctccagacatgggtgacctcttcgaggggcccgatcccgcgcagcccgggtccccgggaggaggcgacgcgctgcgctcactcacctttgtggcagtgggacaggaagtaggcacgggccctcaggtt

SEQ ID NO: 41906 - DNA, 999 bp, Bovine  19866881144378
tgggagtgaagctgccacacgccaagggaaggcagagccacctgaagctggacgaggcgggaagagtcctcccccgtgtgtgtggaaaggagcacgacctggccgtcacaacttgacttcagatttccagcctcctgaactgggagagaacaaatttatgttctcagccacccaatttggggtcatttcttatgacagcccttgaaaactaatacactagtcacataacaatcgaccttgttgtgtttactgtgtgaggcatattaaaatgctgatcatgtcaacaatgggatcctcggcaattactcccaaattatgcacaggacggggctaacttcatgggtatgtgacctgtgcagtcaggcagggccctacactcagacaagccctatcctttggatagcccagctgtcactgtcctgaaatccttaagaatttcaaacaaggggccaggcattttcacttcacactgggtcccacaaatgatggagttgatcctatacatggatcagaaaagaatctagcctccctttgcataagcaaacaagtgtggatctttaagggcactttaaaagatttcaaagatttaaatctttaaaatgatttaaaaaaaatgattctttgcacatatgcaaaataccctataaacattcttagtactcacatatccaaaattctgtgcgcctcttggaactccagcaaccaattctgtgatgaaaagtcatttagaaggtaaattacacagtctactttaaagctattcaacaaatcagctaaagatggtactttttgaataagtaactatcatggatcacgtagacagccggaagtttgaagttacagttttgcattggcttttgcctctgctacagaaaaagaaaacaggggactcaaaagttgtacttctagaatcacctgcctccaccagagcctccatgcgtttcagcttctagaacataagcctgccttctcagatgtgtgtgtgatttgtcagttaaa

SEQ ID NO: 41907 - DNA, 764 bp, Bovine  19866881194883
aatgattttgtagctcaatccaataagaagatttaacagttaaaattcagtaatgccagaaacaggaaagtagatacgtaaataactcaagaggctgccgtaaaaagcagcagcagcatttcgttttccccccaaataactcccttctctcgcctgtaagtctcagagaatgatcactgcctctcactagtaagagttcccctgatgttttactcactaataatgctaaacaggttcattttcatttgtttggccaccaaacatgaaattctctcccaacttcatttcttctacaatagcattgggaacactcaccactggcatttcaataattgatggtctgggaatagaaggctgaaaagtaactgctttacgaactgatcctacatccggagacccaggcagatcctcaggggtgtgagcagtctggacggcagagtggttgcttgaattccggtttgtgttgccatttgtctctgaatgggcacctgaatctcgccttttctctgaggtgccttcttcacctcgcgggtgacttgggtgtcggcctgctttggccttgggctgaacatggatggtggaacaggtatcagctgcgctggcctgatctaagggagcagtctccctggtgttcccaaaacaagcaagcagagctgagcatgggaatggatgcatccttgcagacggagacttcagtctttcagccagccttgccttccacgtggacatgatctgcagcagaacattgcagagttcacagcggg

SEQ ID NO: 41908 - DNA, 941 bp, Bovine  19866881218596
atagaattgattttacaaccaaagctaaaccatgatggcagaagtcagaagacaggttatctgtgagtgggaaagaccgagttggggagggacagagttctgtaccaggtgagtgctgttgtttctcaggctgggcagaagctgcacatgtgtatacttgtgaaagtccatcagactgtttccttatgatgtaagtactttcctacgtagaggttacagctcaattaaaagttttacttaaaaaagcccacacaaataaacagcaagaaaaaattacctgcattccaaccttcttttcaagctaggggctcttaatcctttcatatgatctgaaaacataaaagaatcagatatcataaatacattattttttcagaggattccttgacccagggaaactgagttgtctgttgtttatagatttccttttaagagaaaataaatgagagtttcacttttataggagcatagatttgtatgagctcttgcttctgcaagtgaagaatccaccgaaaacaggacaagaaccaccaaagttgaccatctctgagccaacagaagccatttaaaaggagaatgagcctctgtatcttagggcagagtctaaatcacttggagtagccacagaagaatgcatgaccagagtctcatttggaactgcttccatcattttcctctactctcttttatttcaatccaaccatcttcggaccatgctctctctaaccccttcaattccagtcactaagttagtccatctggaaattcaagtttgcttccatggaatccttgaggaaaccatacaggcttaggccagaataagaagagtttcattaacttctcagccaactgtgactgctgggttgaaaatcatttaagagacactggacttaaacaaacattagagtagataacttcacagatatatacagaacgttcca

SEQ ID NO: 41909 - DNA, 1852 bp, Bovine  19866881261061
tttattcatcaaatgcatattgaggccatgccagactttgtgctggatgctgaggatacagtaatgagtaggaacttgccagaggttaccatcctggaactttttggccagcctaatacttgagaaactccaggcacgagactagcaaggaaaggtatgtcaagacagggctgtgagagcataggaggcttctctggggtggtcccatgcaggggtgtcttctaaatgctggctgacagatgaaatataacctgtgctctgcagtgaaagcaccaagtcctaaccactggacgaccagagaagtcccatgaatatgtttctgtcttttgtaactgaataggtgtaggtggatcccagtccctgagatggagaacactggaagacggaagacgatgggttgggagggagctggggaaggcagatgatgagtttgcttttggttatgttgaatatgaacatgtttgagatgtccaagacttttcatgtaagtatttagatgtgtgagcttaaactcagagaagatagctaggctaaaataagaactagcatgctggtgatagctgaagccaggaatgtgaatgggatgcctaaagagagattacagagaatacagacaatttggctgtcaagtttagaataaagatagagtagaatatgagagagatgaatagttgagtgaagtgttttgttgttttttaatggaagacacctgatagtgtttaaaaagccaatgtgaaagatacaggtgagatcaatttacggtaaaattttacatgaaattactgtactgtttagcttaattcgtaagtatacagacatgaacatcaaagaattaacctttgaagtctttaaacattattttgtaaactggaaagtaatatactttgtgcagtggttgaataaaatgtgtgtatttgaaaagattttgttcttaatcacttgattaatttcacataattctttctttacattgaaaaaaggatatgatcccaatgataggctgaaaatcagccataccaagggcacggggatttgtctgagacagatactttaaatttttactcagtcttaagattatagaagcaactaaaggaaataaacagtgtgttcatggaaagagggagagggtattcaacttttacccacagaaaattggcacattctacagacattgttcagaaacgcatgtgtaaatacaatcatcttaatataagagcagtcatttcagtcacggccacttggagatagtcatggcctggtttaacagttttattcttttggaacttcaaacagaaagactgtgggaatgggtgaattcccaaggaataatttggctttaaatttaatattcagtgttagtctcttgaaagcagtcctccagttttctcccaaagaacatgagatcacactttttccgtagatgtccataataaatatgggaatgcataaaagttttagtggaacattgctggccgtctttttgattcatgtctatctcaatacaatcgtgtttcgagacttcttatagtgaatttatttggggagattagccagtgttcttatcatatcagtgttggtggccatggattctctttttgctaaaactctgtatctcactgggcctccctgctttccattgtcttacttttatgttttgtgcttatattttagcataaagtgtgaatgacttagagattatggaatttcttcctttagcttaagctgatatgttttacaatctattaacttagtaagtgatttacagctaatacatctgtactctgagagaacacaaaaagtattactagaaggccaaaaaggaccttgtttgtaacgcagaatattccaacag

SEQ ID NO: 41910 - DNA, 1481 bp, Bovine  19866881315738
aatgggtgaacaaaaccggtttaagaatgaatttttttcttctcttgaattccttcctgtcacctcgggccctcaataaagtcttgttaaccaccagcctccctttgttgtgagccatttgggggaagggtcctgaggagggggagcacaggagggagggtcaccgggtcaccccgcctgagggcatggtagcaaacactgcagaagagacagaagatgcaggtcccgaggcggctcaggaatacctgatgggggagcctgctaaaagcctggacttcctgctcccatgaaaagggatttgtactgcttgtacttgggcattaaaaggtgaatgatctcttcagactgggaagtctgatatacctgggttagtacagagactgttccacagtaacctttaagtaaatggtagctttttagattttatttacaaaatttgaccaagactaaaattaaagtccacatttgatgttgcatgtactccccctcccaccatatctgacctctgtgttatgaatatggctgcctgcttgggacaatattcccaacgcatgctcagttgtgtccaactctattgcaacatcatggactgcagcccaccaggctcctctgtccatgggacttttccaggcaagaataatggaatgggttgctgtttcctcctcaaggggatcttcccaacccagggatcaaacccatgccttctgtgtctcctatattgacaggcggattctttaccactgggccacctgggaagcctgttatttcagtgagaggcttgtcaggtcccgtggggctcagagaccagatagaatagcaggggtcttgagctttcaactggcctttctcaacagcctaatctcctgttagaatcttgaatttcaatgaatcagtttctgtctccacaaaatgggaattcatgatataagatctaccacctgtttgagcttaaaagcacatcttgacattatattaaaagagagagcaaaataataaattagaattgccaatataccctgaaatcttgacctgaaagtcactattaatgggaaaaccattacagtattatatttctctaacattcttagcagatgcttggctaaggaaaaaaaaaaatctcaatttttttgagcattgtcttggaatgtggttataatttattattttttaccactcacatattaatgtgctgaaaaatagaagatctatgctcaaaagggcattattttccaaaattaagtaatatacatagtagatggacagaacacacattcacacattcataatatttgtcttaactgctcacactatcacaaacattattattattttttggtgttgttgaaaattaatcagggacttagcatggattgtaaaaaaagcaaattgtgtgtgtgtgtgtgcttattcacgtcatagtctttgtgaccccatgcactgtagcctgccaggctcctcggccatgggatttcccaggccag

SEQ ID NO: 41911 - DNA, 2400 bp, Bovine  19866881336383
tttaggtgtgtagcaaagtggttcagttatacatgtgtgtattctttctcaaattcttttcccatttagattgttgcataatattgagcagagttccctgtgctacacaataagtcctcattggttatctgatttaaatatagcagggtgtataggtccatctcaaatatccaactattcctcccccacccttctcctctgatagccgttaagttcattctctaagtctgtgagtctgttttctgttttgtaaataagttcatttgtactgtgttgttgttttttttttaaggttctgtatttaagtgatagcataagattatttgtctttgtctgacttatgtcactcagtgagtgcttgttaagagccaggtgctgtgataactttgttgcgggggagggacggaatatagagttaaaagaaaatgaccttctcagtagttacccatctagttgggaaggcagacaaagcagaataagaaaggtgtagtgggtgctttgacagaaactctggggtccctaatcagaggaggtgacccacaaattagatctagaggaataagtgggaattgccaaggcaaaggtaggtgagggtgtttcaggaagaggaacttcactgcagctgtgggtggttgcaaggagggaccaggtgagggctgagggtggagtgacagagagaaatcacaaaagctttgtgattactgagcagtctggatcttatactgaagattatggagaatcacctggggattttaacgaaaatcattttagaaacacccactttatcctgaaaattgcagggaataagactaaagggaatgactttcactttaggaagttgcaagagtctagggaagaaagagtgacagagagagccaaaaaaaaaaatagtttaggagatctttggagataaaattgacaggacttggtaactgattaaatatggggtttataagaggaggagaagttacagatgacttttagttgatgggctgggcaatctggggatagtgatgtcatatatctgggggagagaggatgtgtttgattttggaaatgctgagtttgacagtgaagtagagggagctgggaggcagagggacaggcagatctgaacttcaggaaagtaggctaagctggagatggaggttggagactgtcatcattgtggtcattgttgctgatgtcatagtgatgctgtatcactcagcgagaatctagagcaagcagatgagggaaggaggtccatagataccaggtgggtggggattgtccgaatttcaagaagagagttgaaagagtctgtgaagccactgagaagggtgaaacaaacagaggcagcaagaaaacctgaagagtgtgaaagctgaaggaaggaagatttttaagaaggactaaattgtgcatgtggttttcgtgggaagactccattaatgacctttatgataacattttcaatacagtggtggtttttaagtattacagcgagtctagaagagaaggcaggtgagacccaggagtgcagagtattttccaggcagtttgcttatgaaagagaaggaattagatagggtaggagctaaggggtgatagagaatcattcagagaggaatggctaaaatctggccattactccctttccagaattttattaccagaccagatattgatctttgaatgcatgcaaccaactgtacctcttccctttcccttcagaattcacaaatatttggtgaacgtctctcataggccaggtactgctttcaattcactggccaaaaaaacagacagcgactgctgccgctcattaagcccaggcttcctcaagggagagtgtaatgaaataaattatacagtatgtaaatgatgaaatgctagcaaataagaaaaaagtgggcaaggtaaggggaacttcttgggtgacatgcaattgacacgttcagtatctggtcagaggaggggccactgctcttggtgcatggcttgtgccttactcccccgcctgactgtcttgataacctgctcagcacttcagctcccacctggctcctgctgtcccccatctcctggtctggagccctgtccctgagccgtcacccgccatcctgattttggctggtgtactgcctgccgctgctcggatccccaacgccacagcagctccaacctggcaccgccggcttgttgaaacccgtcttggatggctgctgggcctcggtctgtcatcatctctgcatgttgttacctgaccgctatgctggatttcctctccaaaccttcttttgattacaagtgacagaaaatgaacccaagcttgcttaagctaaaaggagaatgcattgacttgtagctgcatagtccacagactaggctaattttaggcatagcaatgacaaatga

SEQ ID NO: 41912 - DNA, 764 bp, Bovine  19866881353362
atgctactgaattgtgaacttagaacagttaagatggtaaattttatgttgcatgtattatagcacagttttttaaagcaaaaagttacagcagtttaaataaaacaagactaattatacaactatgatcttacatctataataagagatgagtcaagtaggataggaaatttccaagagcctcttttaacacactagtaaccactgtgcagtagtctcttcccccagtgaaatcttggatctgaggttctaaggataccatctggttccaatcccccaaactctgcgattaaaatagggaaaagaagacataatttttagaaatatagtgagtttctatgcattgttgttgttcagtcactcagttggtccgactcttcgagactccatggacagcagtatgccagacatactgttaaatcctactgtttctatgcataacaatagcgtttaagaacaccagggtcatctgcaaactctatcctgcttcacataattaatgatgacacacattcgtattatgtaatacctccatccactgctgaaaagtcacctgtgccaacttctttgcattctggggaacacatattccctatttatcattgctttccagtgttcaactggtttttgatactctcattttatttctccagaattatttgttttcttactcttttttgagaggttcttaggagacatttcttgagaattcagataaatatgtgtctgctgagtttcccttggtctttttttaattggagtat

SEQ ID NO: 41913 - DNA, 1142 bp, Bovine  19866881387677
ccatgagctggaaagaggaaggctcatacagatcagtcctgctgctggctcctctaatgtctccgagactctttgggcagccaagaatctccatggagataaattacgaaaaggtcacccaggaattctgctgcctcagcagtgactgaacccaacttctgtgcagggacaatgaagaacatgcagccggggcagctggctgctgtggcactgtgttatctaggagtggtgcaaaacccatgtcttttgcataaaacaactcaaagatctagtcagtctttactctttaaaaaaaattatggaaacgaaatcgggcactctacatctctgcctaacaacagtcaactattatttctttaaatgagccccaaacagctggcaataaatgacttattcaagatgccatttgcacaagcctaaaaaccgcacgaacataacatggattaaaaacttctaagcttcacggtttgtaagagtctcactccgctgaaaaagaaacagtataaaaaggcagttcagtatcaagtgcaaactggaaccagaccaaccaccaacttctgttcctccttgaaattgtttttgtcaggtgataaacacacacagtccggctggagatggtctaaagacagaataaagataatggaacttgaagtccacaatcagggtcaccaggggctatggagagttttttttattatgcacataacaagtacataataagcattttaactgtatggatgtataagggagtgactacttacacagaaaacgtagtgcagtcccttccaagacatctgtgtccatcccaacaaccgaacagatgacaccgactacctacattgaaactatgctttgaataaggtgagaataaattttctaggtagctttactttatcatcctttcattatcatcttttatcatcccttcaattgagatgttgaaaatctaaggaaaaagaagtagctcatatacctggtggcagacacagtggctgaagaacaggccatatgagagcagccagacccaatggactgcgtccggttctgcctctgtctgtctctaaacattaggatctgaagggcagggcagaattactatctcaagtggatccctggccagcagcacggtaaagccacagcat

SEQ ID NO: 41914 - DNA, 743 bp, Bovine  19866881409448
taggaaaagtaaatggtgtggcttggtgaatgctccacttaccgcgaaacacagagtgttgatgggagctatctgcctggttattcaatttattataaaaatgatctcataactgaggaatctcaaagtcataataattattaaatcttcatcccaaatgactggcatatttggtttttttttaactttttattttatattggagtatagtcaattaataatgttgtgatagtttcaggggacagcagagtgactcagtcactcgtatacatgtgtccattctcccccaaactcccctctcatccacgctgccacataacattgagcagacttccctgtacaatatgggtccttgttatccattttaaatttagcaggctttacacatccatcccaaactccataactatcctttctccccatccttcccccaccctggcaaccataagttcattctccaagtctgtgagtctcaagtgactgagaggagactgaaaaggcattcactgtcttgggaaattcaatcggagttaaaaattaagcccagaagaggctttcagcaacaaaggtaatgatgtctctaaattttatttagtattgagaatactactttgggttaaatgccagttaggctgctgtccaagtgatacatgaactattcaggtgatctagacatagctttggtttcttgtcaagtcatggaaaatctatgatgtagttcttcttcctttaataaaatgtga

SEQ ID NO: 41915 - DNA, 864 bp, Bovine  19866881593756
atggagacctgctccgtgcctctaggtcacatgctaactaacaccattcctgcaattagcaagtggacagttagtatttttcaaatgcagagtgagttttgaataaagacggagagcttaaggcctaaaataaggagccaatcaatttgactgcagaataattagaaacagaaattttctaaaatacagaagaggatcagcaggattccatgttctggttcccatgtcgcagcaaggcctcctgtaagactgtcagtcttttatgccaatgcttttttcccttggcagtggtgtttagggatcacctgcattggttactgcagaaaaactagtgagctaagttcagtttcaagaataaaaataacttactgttccgacaaggagagtactcagcatatgcactgaaattctgaatggctacatagcaagtgccaactgggtccttttctggtgctggtttaagagttctccagtgatataatggagcacaagcctgtgaaacatcaaagacaataaatatttttttaatgtagattccacatactatggacctaaatttgtaacaaacaatgctaaattattagatgacttaactggcctccagtatgctaatgagtaccttggtagtcagaattaattaaacttcctaagtcaatttctcaactaatactccatagaattggaacaaattaaacatatacaaaagaatgagatttttgtcccacaggattttaaatcaaataaaagtagcctgacaaaagtaaatatttatgaaaggtaaaggactcatatgttcttttttttaaaattggatctgcataaaagcaaatgaccatttaaacagtgaatgaattagtgcaatgt

SEQ ID NO: 41916 - DNA, 731 bp, Bovine  19866881615442
atgaatttaaatgcaaaagatgtgctgcaatgtggccaatctttcagggaaaattgagacatgactttttgaacacaaaatgtgttatttatggttttcctttgcagatggcatcttattttggatatacagttgcagtatcagatgttaacaatgatgggtaagtttataagaacttcctcactcactgaatattatagtcatccttaaagatgttatatttttttcttcatgaaatacatccttctatatttcctcaacaagatagaggctctcttgtttttttttttttacttcagcgcaagaggatataactactgaaaaactctctatcatcctttttaatgtctttaccacatctgcacttctaagaaaacactattatacttagttttatctttaatttcatgaattgaatagtacttggccatttgaaatccatagccattgaggaatttgctcatctctctttttagcacatgattcattcataaaatatttgcacataaatattgtttctcctgttattgcatactagaaacatccatgcagaagataaaataataatgctattttttcagattatggcagtaaattacagttgaacttggatcaaacagcatgataagttatggttgtgtttaagtcattacttcaaagaaacattattaagcatctctcaatccactaaaagcaccgacagattaaacaaagattaataagaaaaccaa

SEQ ID NO: 41917 - DNA, 1692 bp, Bovine  19866881626326
tgtgtgcatctgtggcaggccagaacattgcaaacacaataggtgagcatattttcattttctattcctctaccatattaagaaaattcactagtaagtggacttcccccgatggctcagtgggtaaagaattcacctgcaatgcaggaggtacaggtttgattcctgggtcaggaagatcccctggaggaggaaattgcaacccactccagtattcttgcctggaaaatcccatggacaaaggagcctggcaggctacagtccatagggtcacaaagagttggatatgatgagcaattaaacacaagcacttcactgcatagaccacgtgaaactctcaaagagctctttattcacacaaaaatttctgttatatatatgggaacttctaacctaaatactccttgaataattggtattgtctataaaaacagatacaattatggggggaaatgactgtgtaaaaccatcataaaacaagtttttaagtttggggagtattttatcaaatctacacagctcatgtattgtttgtgatcccaactatggcaaaaatgtttcctaaataagcaaggtgaaacgggaattctctctgataaagcactgcattcactgaatacttttcctttctggattatatttgctttacgtctttctgtcctttaggcctgaccgctgaggtgcagttagacaccctgaaacaaaaaggagccattaaacgtacactcttccttgataaccatcagtcacatctcatcttccctctcgtgataaaagggcagaaatccctccagtgccaggattttatcgtttaccttcgagtaagtgtttcagaatcaaacctttttggcctctcacattcaaatcaaaactctaatcatttttgtccatttaaaccatcacagtggttctcacgggcttccctggtggctcaatggtaaagaatctgcctgcaatgcaggagacctgggttcagttcctgggtagagaagatcccctggaggagggcatggcaacccactctagtactcttgcctagagaatcccatggacagaggaaccgggcaggctgcagtccatagggtcacacggagttggacacagctgaaatgattaagcagcagcagcagtggttctcatagacccacacctattttcacttgattggaggaaacttgaggaccacacactcctatgttgagcctgacttcagtcaacctgataatatattgccgttacttcctaagttgcttctttttctttttccttttaattttttattgtagttgatttataatgttgcattaatttctgctaagctgcttcttgttttgaatatactcttagtcttaatactaactcaggtggttttcatttcttcctccccttccctaaaacacgaaagtcagacacaatttatttgaacttttatcctgcatgaggatgtttggccagattttatcaaggtgaatctctgagccaactcaggaaaagggtgaggcagtcacaggctttattgaatgtaagttataattatatttttaaagcaatgcattctttttaaaaaaactttttagtttatattggagtgtaacaatgttgtgatggtctcaggtgaacaccaaagggactcaggcatatctatacatgtagccattctcccccaaactctcctcccatccaggcttccac

SEQ ID NO: 41918 - DNA, 658 bp, Bovine  19866881666845
tatgtgtgtatgtatgttctgtatgtgtatgtatatataagtgtacaagtagtaaaacactaactctggcaattattaattctcaaaggtgcagattatcactgagctttcaccttttttttccactttcaattgaattcaccagagtccagatttctgctgtctgagttctatcacatttctgttatttcctctgtcatttactggaggtagctgtgccctccatttgcctctgctttgatattgaacaaaaactgatttctttctgaggaagttagaaaagcaaggcttatgtgaccaatatgtttcccaaccctcacatgagaaaaaaagggcacacccaacactatcaaaatacaaccctgtacccatcacagcaccagatgctttaagctgcttcttattgtgtctccctcagcacaaaataaaacagactcctgcctgccccctccaacaaaggcttccggtctccaagctacaacacaattctgacaaaaatcttagcttcctagagctttgaaatatcctaacaaaattgtcttccattttaagctttaaatatatatatataagatgctaaattaaggtcaggcaaattctggtagtctttctcagatgactcccaaatctcaatggtacctcccacttcctcttgttt

SEQ ID NO: 41919 - DNA, 916 bp, Bovine  19866881950944
tttttgtgggatttttttaaaagaaaataaaccctcagtaaattagaatgttgcaacctaataccacagtccagctcataaatgttttccttcagagttcatttggaagcatttcagacagattgttaggattattacttactgggataaaattatgctttttttttttttttcaaacatttcttcctctacttgtaagcctcctctcagtaatactttgcatgttgcaataaaaaagcaagaaaaaaaatctgtctatttttaaatgaacacatttgccaaactcaaggagacttatctaaatgcctgcttcccacagacatgggctgtttttccagtgccaaactcataagccaatttttaacccgcttaagagtcaacatggccatgtttccacccatcattttacacattatctttaatcccatcatttctcttaaaatcatcctggtatgaaagtgagcagatctcaggtgggtccaggtagacatctgtacttgacaaccctcattcatctttaaaatgctgcgggaaggggcttaacagagatggagccaaggtggtgatgaggagtgtctggaggagatgctgtgggctgtgagcatcggcaatgccaagacaggagccagaagtctatggatgaggagctcagggagctgagtcttagaggtgggccagtgagatgtccaagtctggttgaaccagggagaaacccaaaccctgttccataaaggaagcgagatgagacacaaaccatgcagaagcctagctgactcaagagacaaaagaacagtcctggattgtatatcagagccgagaaagtggtcatgtgacccccaacaaattgtactgagctcttggctgccttgtctggagaatcttgaagacttcgccagacttttagcaatcaagagca

SEQ ID NO: 41920 - DNA, 825 bp, Bovine  19866882165656
tgggaagattcaaggcagaaggagaagaagccaatagaggatgagatggttggatggcatcaccaactcaatggacatgagtttgagtaaactccaggagttggtgatggacagggaagcctggagtgttgcagttaatggggtcaccaagagtcgaacaagactgagcgactgaactgaactgcctttgaatctggagctgcactgaagcatggtgcggcagaagtcttcctgctacatccgcttggacacggcctgatagacatctgcgttgtgattcatggtctgcaggcactgaatgtactctgccttgcctagtggggagagaagcctgcatatctcctgtctgtaccaccggaatcctgcacgtctattggaagttgccatggcagactgggaagaaaggctagctggaggaggctcccgggcaggagagtgctgacctgaaggtgtgaggaatttctgggtgctccagtctatctccaagagccagccgcttcttccctctctagagctaattgctgagaagccaggtctgaggactgcatttctggctggaaggccacagaggaatgcaagttacaggagcagtgtaaggataattgtggcattaagttaggcagagctacctgtaagtaggttgcaaagaggcaggatgccagggctgagagaagcccaactttgggaggtcacttaggatggggaccggaccaagggctacaaagggccttactggcttggtaacaaggggaccagcttcttcacaaaaagtaggatgcttccaaggctgagacctggaaccactgtgtgtcttctgccaaggat

SEQ ID NO: 41921 - DNA, 3607 bp, Bovine  19866880422344
ttgcctccctgcccccgctccaccgccccaggtcttggcttcccctcctcaccccagctgactcatccatctccttgtttggcatttccagttttcaaatagttgggaactgggatcatatctcttcttggatccctcgctgggctagatgctctgaaattctggccccataaatcacagccccagtggcctctgtcacttaacagctcttcttcccctgctgccgtttgccatgctgtgacccttcggccagaggaacagggactgatgatttcctgaggacagaccagtctctgtgccccgggacgtccagggtgccctccccagggacctcagtcacccaggtcatcagccagtgcaccttctaattaaagttgccaccctctcttagccaagcccgggctgtctccaacattatcttatataatccaatcctcacagcagtttttaatctttttctaaagtttatttggctgcgctgtgtctcagttgcagcgtgcaggctctagttccccagccagggatcaaaccccggccccctgcattgggagcgtggagtcttacccgctggactgccaggggtgtcccctcgaagcagtctttttggatgttaccattattatctccattttgcagaaggaaaagttgaggcaccaagagggggcatggctggcccaaatcattcattcagtacatggcccagctgggaacagagcccatgttgtgtgactccagacttgttaccccttccagagtgggtctggcctgttctggggagagagaggacgatctgggagggctggcatagtcacggcaggctgcctggaggaggtggaccagaccagccttggcagagggtacagcaagcagcgtatctaccatgtgggcttatccagctccttcccattctcagacttcagtgccttttgcccctgggcctccagctcagtttagtgacaacattccccaaggaggtgggtttgactttcctggggactaagaccctttggaacctggatccttctcgattgggtctcaagctccttttgaggtctgtaggtttccctgtgtttggagtgcagtggatttttgctgagtggggcctgctctgagccaaccctgtgcccacgtctctagggacgcagctgggagcagaatctatagacaagtcccaaactctgtcgtctgaccatctttgcacagcagagaaatcaagaattcatccatgcattcactgattcacccattcaagaccgaccgtgcgccagacattgtgctagtgtcctgtctgcattatcagctttcctgtgtagctgggattatgcctccatttcccagatgagaaaaagctcagaggagagcagtgacttgcccaagatcacacagccaggcgcagaggaaggtgggcattgaagccagctctgtcggtcctgctggaagagcttagcatcgtggtccctactctccagcagctccgggtcctgttggagaggtagggctcacgagtcataattacctagcacaactccagtctagacaatagcagattgtcagggaagaaatcaatttggcatgagttctctggaaagactttctggaggaagtggggctttaagagcaaggaggatttggccagtggaggaggaaagcattcggggcagggggccagaagttgtccccatcgtccctgggttcgcattgttgtccagcgtgtgagcaggaaggccccggcctgctgttggaatcattaacgctgggaaagaatgcgaggaagtcaccaacatagctgaggtgacatgccttccagtccattgcctgtgactggtcagatcaggacgcaagaggccaaggcctggtcttcagcttggttgccagccaactactgaccctcttccctggatctcactcttccgacctatgaaatgggctcctttcttgcttttgggccacttgccaactcagaggaaggggaagttgagttcttggagaaaacggttagcttgtcctcaagcctttgtggtaaagcctggcatcttaccaatctcgtgtctcccttcactgactccctgcccacacgtgctgggccctgggctaggagatggagaaggctccctgctcccctagactttcctgagcctctcctgtcctcccttgtggatctggggtccctcctgcagtgctcagcccacatcagttcagctgcggctgagctaaaatctagggaccctgtcaatgtctgtttaggggtcataggattcctatactcctggccctgttgctgtgatccagggtgagtcgtgtaacttctctgagcctgatttccccagatgcaagctgggacttttcattcattcattcattcagcaaacatttatggagtgccagctctattgccaacctcgtgttaggtatgaacagcaagcgtggttggaaggagcttctagtttgatcagggagattagtcaataaagggagagtcagccaataaagagggctgcttttcaaggcagagtcttctacgagctcaggagcagctgtttagggccacacgacctctaggagacgtcgggggtctttgtgactttgtctctgtccccatttgttattctagttattgtctgtttccctccaggtagcttgtgggaagaggggtcttggggagacagccccaccccccaccccccacctccggactagggcaggggagaagatgcagagaggagagcaggttgcttttgccctgagtctcagctgagctcatggatgtggggaacagccaggcttatttatactgagcctggttatattgtttcatttatttttgtctatttgtctggctctgccaggtcttggttgggacacgcaggatcttttagttgcagtgtgcgaactcttacttgcagcatgtgggatctagtttcctgaccagggatcgaacccaggccccctgcaccagcagcatggcatcttagccactggaccaccggggaagtgcctggttattttgcttccggagagatggaagctgccactggggttcagctttgcggtcctgccgggctgcgtgagaggagtagggctgaccctcctgtttccgctttccatcctcttttctccctccccaactcttctggggaacccgaaggaggcagagatcagctcaggcctggatttgatttgaagcagtgggaggaaaagggcttccctggtggctcaggtggtaaagaatccgcctgcaatgcaagaggcctgggttcgatccccaggtcgggaagatcccctggagaagggcatggcaacccactccagtattcttgcctggagaatcccatgcacagaggagcctggcgggctacacagtccatggggtcgcaagagtcggacacaactgagtgactaagtaccagcacacagtgggaggaaagggttaagttggcctggtttctcacctgggtgggaggaggtggagaggggacaaggactgggatggctggggcaggaatgtgtgataagatcaaagcttccagcctgccggggcctcaactaggggcctcacctgggtttcacctgagtagtcaaaggggattctctgagtgacctcctggag

SEQ ID NO: 41922 - DNA, 3146 bp, Bovine  19866880490199
tctgctttattgacttgccaagcctttgtgtggatcacaataaactgtggaaaattctgaaagagatgggaataccagacccacctgacctgcctcttgagaaacctgtatgcaggtcaggaagcaacagtttcaactggaatgggacaacagactggttccaaataggaaaaggagttcgtcaaggctgtatatcgtcaccctgcttatttaacttatatgcagagtacatcatgagaaacgctgggctgaaagaagcacaagctggaatcaagattgccgggagaaatatcaatcacctccgatatgcagatgacaccacccttatggcagaaaataaagaactcaaaagcctcttgatgaatgtgaaagaggagagtgaaaaagttggcctaaagctcaacattcagaagactaagatcatggcatctggtcccatcacttcatggcaaatagatggggaaacagtggaaacagtggctgaatttatttttctgggctcaaagattgctccagatggtgattgcagccatgaaattaaaagacagttcctccttggaaagaacgttatgaccaatcgagatagcatattaaaaagcagagacattactttgtcaacaaatgtcggtctagtcaaggctatggtttttccagttgtcatgtatggatgagaaagttggactctaaagaaagctgagtgctgaggaattgatgcttttgaactgtggtgttggagaagactcttgagagtcccttcgactgcaaggagatccagccagttcatcttaaaggagatcagtcctgggtgttcattggagggacggatgttgaagatgaaactccaatcctttggccactcattgaaaaagatgctgatgctgggaaagattgagggcaggaggagatggggacgacagaggatgagatggttgtattgcatcaccaactcaatggacatgggtttgggtagactccgggagttggtgatggacggggaggcctggcgtgctgtggttcatgggatcgcaaagagttggacatgacctagtgactcaatggaatacagcaaaagatagaataaagaattatttccttttaatttataattttcatatgaaggtgtttgtgtcctagtagtttccaaattccttaattgtgattatttttgcttgcatttctctattaaaaaatgagtacctgcacaaattaatgttttttaaaaaatatgtttagtgaatatctgtgaagtacatttattattttgttgatgctcaagctatcctatctttggaacagaagaatccttcacactggttcctctgtgttcacaactttgtcaagtgaatggcaattattatcccgtcctgggaaggacttccattccaccagaagcagcagtcccagaagtcaaccccactctatgcttaagggtcaccactgaaaaccataactcacacacttttagtgaaacaatgctttactcacccagagaagaggcagagcaaggtgagtttcaagagtggacattggtttcccatggccagcaggtcacctcccacatctgacgcaaggtgatgatctgcagggaccgcgcctgtgtgctgggtgaaggaccctgttccttccccttcactccacaacgccagtgaaaggatgcagtaggtggttggcaagggaccacatgacgcacatgctcaaacaggatgaaggaacacgtattgagtctaaaacagagaaagatgttcccacacaggctgggagggctccttataacttggtagtaaggaggtgttccaggcccaaggtccatttttatgtggctgagtgaggagtcaaaaaactgcacacatttttgcctttcctagcaaactttattttctggcacaacaaaatagactgggtcatcttgatgcttcctgctccaggcttggaatcagatgttcttcaaaggtgtcctgtttttagttttattttttttttaagggaagttatttaggttgccttttcaataacataatttgaaggggaaagtaaactctttttaatatatccaactcaacagtccataacatcattttattttgtgcttttatctttttttttcttatgctgaatatcttggctcctaacagcattaacaaacttccttatattgtattacatttcattatagtcaaactattttcaaagttataaaatgttatagtgaaaagttagaacatttgatgaagtttaagatttctttgcaattctgttttcctttaaaatatgtttcctaaggctgtgttactgaagccacttagaaaatccttttgtactgtggtattatgtcatcaacttaatattcagttagattcccttgtttctgttgggtttcaatttttttttaagtgactttaaaaaaaagattttatgaccaaaaacatacactaagtttatccagaaagtctcacttttaccaccatcttcttcattcatttgttcctctcctccataggtattgatttttattagtcttcagtttatccttccaatgtttctttttataaatataataaatttatgcttatagtcatatggagtgataacatatgatatgacagataaaattctgcctcttgccactttcagttaacttcaatacatcttgaacatctctgcatactactgtatagtttctttatactttatttatgtctgcatagcattccattatctgtatggtttataatttaattgtttagagttgtgttgttagatatttgttttggttacaatcattgactataaatgccagtatcagtcttgctttcatagcttttcaacttacagacttagaaaaaatatatttacaaaacatcacatttccttttttataaaatctctttcatgcattttaaaatcaatattgtattggaatatttgtaacaaatatacatctgaagtgctacaatgagcagaacccgtggcatgcttataaatgtttaagggaaaaaataaatatgcttaatttgtgatatctgcagattcccatggtgtaaatattcccaccatggccaatttcaagccagcaatgtgaggtcactgaaagtgaagttgggaagagatgtacacaattcaagcccggccagaggcagttccagcac

SEQ ID NO: 41923 - DNA, 1178 bp, Bovine  19866880491264
cagaaggctggaaatgcattataaatcaggatgtcattaagtgtgggacccttggactcaaaccccagctccacggcttgggggaccttgggccctcatgtcacttgctgcaccctggtttcatcgtctataaatgtggatggaccaagggggcctgcttcttaagatgaaatgaatccacataagcatcacgctcagagaccggcagacagtaaataatcatcattatcatcatgactgagtctttcgttccaggaaggcaagaggagcaaacttggggtcctctcccccaatatcaggtgtaaccctgagtgtgtacccagccttgacaatcaggagtggacagatcaccatccctgtctaggctgaggctctgtgaggtcaacccctaacctctcaggctggtatggtgcctggcgcatgctcaatactcgctgaatgaacggatgagggagcgggtacgatgggccacggcgggcagctgtttgagggcaccacgcagcaagggcgtcccggggcacttgaaagccttcctgctgtgggctgtgggctcagaggcaccgttctttaatcctcatggtagtcctgcagtgggctgcctcccacgttacagataagaaaacagagaggcagagacgcaaaggactctgtccacagtcacccgggtaatgcgtggcgaagccctcaggtcagcgggagaccccttctcctccccatccaaccccacctgcgtgcgcttctgggccccgagtcctgctctccccagagaaatgagcttatttcagtctcttcctcactgaccacaaagactcagtcctgtcctcagaaatatttggaaagttttatttaaatgttttgtgttcccttttaaccaacaccaaaaagagaaaattttttggctgtttcgaacaggagcgtcccttcagagaggctggcatgtatgtttagagccgggaagcgtccactttgccaggctcctcttcccagcctgggtcacccggggctggatggccagtcctcggaaccgacttcctgggagccccggggcgaccttggaatgagggagtgagcaaacctccctcccgaggaggacctggtctcccctgcagttatggacagacttggggaacgggccatgagcctggtgggttccagagggacggggaagggggtggggg

SEQ ID NO: 41924 - DNA, 1282 bp, Bovine  19866880506013
ctccaggagatcttcctaaccgtgggattgaacctgggtctcccgcattgtaggcagacgctttaccatctgagccaccagggaagtctgaataagggggtccgcatttcctcctcccagatcctgcctccccctcactttccctctccttccccagcctccctccctccctcaagaaccctctcccttctccacactcacctgccttttccaccccttgctggctcccggagccccagacccagggagagctgacccaggtctcaccctctgcccaatgagtctccatgtgctagaacactgcgttcctgccccttcctgttaccctggcttccagggcatgggggtgggcaggaggcaggcagctaggggatctggtggctctaggtgtgggaggacctcggtgggcagcagggctcagctatgaccgcaggaggcctctgtctcccttgtgtccaggccccatgctgtgagtggggttgggggcagcagggtggaccgaggccaggccatctcctgaccatccttttccacctgcagacgtacaacaccaacgcccaggtccctgatagcgcaggcaccgccaccgcctacttgtgtggggtgaaggccaatgagggcacggtgggggtgagcgcagcaacccagcgctcccagtgcaacaccactcagggcaacgaggtcacctccatcctgcgctgggccaaggacgcaggtgagtggggcgagccgtgcggaacggggcccggctctgtgacctgtctgggcctcagtcttcccaactgtacaatggggagagagcagaaaaagaggctcgccagggcccttccagctcccatgttctgggactccgcaaactcttccgggactctcttgcatgacagcaaagtctcgcggtttaggggattgctcagtgtgggtttgctcccaactcatttccctgagtctatttgtttgtgcttgaaaacgtagcccctcgtaggttcagcttgaggaaggtgagggatctagcccagctctggtctatgggagtccagtagctgtctttccccattcctttcctccttggaactgggaggcaccatgatgtccccctggcacctctggagtcacggtgtgagtctggctgatgtaggtgacagagccacactccatctgagagctcttcggaggggcccctgagttcttgcagggcagccgtggggcttcctgcaggggtgggattcggggggtcctcggtggagaaggagggctcccgcctaggtgctcacgcttcaagggc

SEQ ID NO: 41925 - DNA, 2151 bp, Bovine  19866880548904
tctcagactctgggtctctttctggaagcttctttccggtctggcggcatctccctttccagatgtgaaatacagctgctaaaacctcttgatcttcagctttttgcaagtgaagtctctgctcttgctggcttgtcccttgctgcaggcccttatctgaccccaaagccttagactgtggggtaggggctgcaagcggggcaagctggcatgcgacaagcccattccccaggttccctggggtggagggggctccagtccatggcccgacatgctctggattctcccctctcactgcagatgtgtgttcccaacattttttccaagatgaatctcgtgttgctatttcctgtccagtcccaagccccagtggcctctccctccctgcaaaaaagccctggaccttgcttaccaccagagttttcttttccagacagtggcctggtatctatggggtgccaggaatctctgtgccatccatggccttgtttgcatgtgggagggggagggctggcagtgacacaaggagagtcctccccagctggggaggatcctacccgctagccttctctgcccagtcagtgcccctgccccagccctagcctcactctccccttagaccaatcagggcctgcgtaggacccacccaaggggtagggaacattgttctctacccctagccaggagagaagggagaacctctgatgttggactggtcttgtggttcttaaccagtgagtgtcagaatgcctgagcaggcatgacattaaccctcctacctggggtggggagatgactcagtgtctctgaggaagagcccaggaatctatttctcaccagctcctgaaggttctaaagcttagtcctggatgcagacctcatgggcacggcccagaagtccactggccacccagggcgggaatgggcatttgaccaaagggagagggaggggagagaaggaacaggaggaggaatttgcccatggattgtgagggaaaggggcttaagactatagcaggggatagacatgggcagtgcagaccttccacaaggcttggtagcactgccaaaacaaagatgacccaaggagggagatacatacagactgcccgtgctgagtggtgccttcagagcaaagtcatgctcaggaagcagctggaatgagtaggtgatgacactgttgtccattcgttcaagcccttattgaccatgcagtgctgagaaggcagagatgagctcatcacagtccctgctctcagggtgccgtcattccagtgtaggcacagccattccacggggagccccagacggtccagaacccagcctgggggcagaggagtcataactactcctcccagaagagggtttctttgagtcatctttattggggtataaagtacatgcaataaaacatacgcattttaagtgtacaggtcagtaatgggaatgagatgtattgattatatactcaggggactgttactccaaaaggtttcctgtgtcccttcccggccggccccaccccacccctggtcccaggcaaccccgatcttcctgtcatcataggttagacttatctcccctgagtttcgtggaagtggaatcatacaggatggcgttttctctgtctgccttctttcactcagcacaaagtgtttgagattcatccctcattccaggcctatcggaacgtgttctggtttgcgactgagtagttagaggaggtggtggtgttcagctgagtttcggaggatggatgggagttagccagataaaaggagaaagggcactccagcagagggaccagcgtgagaaaaggccagaggctccagggacgtggtcggtgtgaaggagagggactgactgtctggttttttccttctccttgggtgcctctccttgtctagccagtgagggctgggtttggtttttacaagggagcctatttccttctggccgggctgggctccccagatagggctgaggccaagacactcgtgccaggccatctagaactggacgtgtggacccgtgcactcttgtgcttggagacactgcggttcatgttttcctctctgttatcttgaaaactcctttggaaacgcctcagtctgttctaggggcttaccaggtggcgcagtggtaaagaat

SEQ ID NO: 41926 - DNA, 1217 bp, Bovine  19866880656980
cagccaggggccccacggaaggacaggaggtgtggaaacaaactgagtgaggagccgcagctgtgatctggaccagcaaactccaagctctcaaagggcccgtggtcccatggtccatgagggattgaacagtacccgaccctggctgagtagctcctaaaacgaaggcacttttgtgccaggcctccctttcttctttataaccaaggagctcttcaattacagcactttcctctttacagaaaaacctcagtgcaagaggcctgtgatctctcctgtgtcctgggggccgtgtgcagagactgttgggggccctggggagcaggcagcaggcatgtgcggtagggggctgggcacggagcctgggtactgaagactggatgaaggccccagagctctgctttctctgccctatttcaatccaaaccactcaagactgaccactcacgcatggctgcctctgggcacaagccttctcttttccaaacacttaatacactgcgacccagccaccaagcctgccctccctcccaactgctgaaaaatgagagctggcttcaagaaaaaacaatctgatgtctaagaaggctggagagtgaaaatgtggggttggtacgacagtacacttggaataatgcacaagggagtcaaaaaagggaatggaaacaactctcctctctgccccccgcccctccctggccagaccagaaagaggaggacggggacagagggagaaaattcgagggttggctccctgaagtgtgctgtcccaagagcagcaagtcaggttgaggaggggctggtgaagaggatgggctgcaagggtggctggaacaaagtcctgctccagtgagagcaagaccggatgagggctgggagtcagctccagggcacgtcagtcaaggaatgttctgaggcctgtgtttcttgggggactgccctgctaatgccggacgcatggcagacaggacgccacccggggaggatccactcttggatgacaatcgtgatcacagttaggaagtcctcattgtgaggacgaaagagtcaagcctaaacgtggggacagcactggccacattcaagtaatggaaagcgccccaccagggaccctgctgcggctggacaagagcttccccggggggtccgttcttccttgctgggaacctatgtgccacgctgtagggtacaggatgaggaaaatgactggacccctg

SEQ ID NO: 41927 - DNA, 1681 bp, Bovine  19866880662729
tcctggcaaccctagaacaaccctgatctgaagaagagtctggaaccgggagcgcaaacatctctggagagaccagaggagctggtgcacttgcctcctcttgctccctgcatcctgccaacccctccactgcagtcttcccaaagaccccaaactgcggattctgttggtctgccccactgctgggcacaggatggctgggatggaggtccgtcctccgcagctgccccagaggctgctcctgctgggggcagccacgctgactgcatcagctctgcacactggtgagtctgtgggggcttggctgggcaggcaggagactcaggcccaccacccttagagcctgtttccccagtcagcattcaccctgatgggctgggatcccttgggttgggggacactgggaaactctgagtctgctcttgcctggcacccccaaatccatcccagtccctctgggtggctggagctccaagtcacccagaagcaacggcctggaggcaggtggggcagccctcaggtctggcactgggaaacgctgtggactttggagtcagatgaccctgcattcacacactcactctacccttgacatcacttttttttttttttttttgtggcctcactgcagggcatgtgggatcttagttccccaaccagggatcaaacctgtggccccctgcactggaggcacagagtcttaaccactagatcaccaggggagtcctgacttcacagtttctaagtcttcatttcctcagcagtaaaatgggaagaacaatagagccttgctccttaagggactgttaatattatccatgtgagatcaaccatgcaggacacacagacagcaccctgcgcataggaggtgctcgtgcactcactctctgaaacaccccctgtcccatgtgcctccaggacaggttctgcctttagtagatctgcacagatatgagaagatgctcctacatcccgagccctaaaggagaatttctcccccaaagacccagatcctggcttgtcctcaagtactactagtgcccttaccatcaccagaaaagccacctcctgttctctctctctccttacaaaaatcagagatggcttgaatacttacacattatctcattaaccttcataacaattctgtaccaatgaggaagtttggggctggaacagataccaaactaaagggaacgtttaacataaggacatttattatttcacttaagaagagaggccttaggtgagaccagaatggttttcagcagctcaactgtgcgaagatcagatcagatcagatcagttgcttagtcatgtccgactctttgcaaccccatgaatcgcagcacgccaggcctccttatccatcaccaactcccggagttcactgagactcacgtccatcaagtcagtgatgccatccagccatctcatcctctgtcgtccccttctcctcctgcccccaatccctcccagcatctgtgccaaggctcctccataatgctcatgacctcatccttgcaagatggctgctgcagctccggacatcacatcctcagtcaatgactttcaaaagcaggaagaaaggggggctactcatcccacaggtttccttcctttttttttttttttttgttaaggaggaaaatctttctcaggaaccctcagcaagcctctc

SEQ ID NO: 41928 - DNA, 826 bp, Bovine  19866880665254
cacccagaggagcagggccccagcctgccccgaggccggccttcaggacttaccgacgtagatgctgcccttggtgttgaccgccacgttcgggcctggggactggccgctcaccagctcctctccatccacctggatggagcctctctggccctctctgcatcggaacgggagtccggccctcacccgctattcctcgtcctccccagccccatgagggtcccctccctttatgacagagaggtccgcctcctgctccccaagctttttcctgttccccaacccccggctgggtgagagatctggcgccacacacacagcttccgagcaccccacccggatttcccccatcccctggggtgctcgtgtgcccatccccgcccgctgtcctggaagtctgtgctctgggtggtgatcgccccgctgaccccgccctcaaattctgtctccccagagctcaatgcctgccccctccatgtgatgggggaactctggcccctcaccccagtgcccgggcgggggggctcccttaccgcagcgccgtcacacgatgccactcgccatcgttaatggggtcttcggagaccaggcgggcctccccgctgcccagctggtagctgcaggcacacaggccccagagggcgtgagcagggcttgggactggagtgggggagttgggggtgtggctggggaggggaccggagggaaagccagtgaaggaaaggggggtgagggaagggagaggaggggccgggacccacctgaagacgaggtgcccgtcctgaagcccaagactgatgaagtccttgcctcggccggacttccc

SEQ ID NO: 41929 - DNA, 1540 bp, Bovine  19866880702365
tgcctgcccttccccaggtcggagtcccgctgctgaacttgcacgcaaacagggaagttcaggcctgggaggcccttgagccccttcccatctgcaagggaagaacactggacttgaagctggacagccctgggttccaggccctgtggccatatctcaaatgaaggtccttgggcgggtccctttacctccctgaaccttcttttcctactttgtgaaatgaggaacagccctgcctaactccccgagctctcagaagtatggaaatgtttctttcatcgtgacatgtcacacagatgtgtacaaggcattgctttcaccctcgccctctccccaaatggcccgtcattcctggacccccagctgtcagcacaagtcctgcccagaatagtgttcaggcaaagtttgcgtgaactgaattgattcgttcttggttcgtttcagcaggtacctgccgactccagggccagcactctgggtgactggatgacaaagcccctcggtcctgggaggagtccaaacacacccgctaaagatgcaggagaacaggaggtcccaagtcatctcagatgctggagacttatctgtgcgtcacttattcactgattcatagcccctctccccctccaggctctgagctccatggacacgcagaccctctacatctctagcaccttgcatgtggtttatcttcactgcgaccaaatagagaggaccttatggatcccagatctgttcctcctggcagtcccttctcttgcgccccaggttcctcatctgtaagatgggagtttggggaaacaaactcaggaaacatagaccttagtctgcaaagttcctgcatatcacaagcctgcagtgggcacggctgttggcatcaccgctatgatttttaccaagggctttcctatggtagagatgagagcgatcgccccggggcttggagggcgggggggtgctccagccccgcccacggttggccctgagagaccagagggcagtctgctgctgcactcacaagtccatttccacctcccagaccgtggttcttctcatcttttcagtgagacgactgagggtcagctcagtgagagaattctcctaggtcacgtagtgcctaaagagatctggccctgggagagggcatttctgagggtctgcaggatcgccaccaggagcaacacttgcctttgccacattttctcaccccgtcttaacagggaggaaacacagaggcccacagccagtgagcagcgcctcccgccccggcggagggcctcagcctcagccctccacccgccccctagggcactcggatccgagccgggccctggccaccctctgctgctcccggaagtgccctgtgtctgcaccttgatctccgcacccacgatgccaggaaaccccagtggggcggccgagctgccgggtatttatagcggacatgcagcaaagctgccacccccatctgtttacccaacaacgctctgctagctggacactttcagccccgccggccacagacagaccctcaccgccg

SEQ ID NO: 41930 - DNA, 1373 bp, Bovine  19866880742916
ttgtgccctacctaccctgcttagcctgggtaccgggcctcttagggcgaatggaatctgttgtctaaacagggagactgagaagccgcctgcctcactagggttggggcagagccatagaccaggtccacgccacccctacccccaccgggctcttcactggtttaggagcaccaggtgtgctcccacatagatggtcacatttgggtgccgggagggcgcccttcaccccatggcgtgccctgggctcagcgcggaggaggggctcagtaaacatttggcgttgagagtgggcaggaggtggcagggatttgcggggcccagggagagtgcagatggaggctcacataccatatgtctaaatatttgcaagttataaatcaagctaacaaaatgtgaactaaaatatgttctattctcctaccttgacaagcacactttcatagcaacctggaaggccagctctgaatgcagactcctcggactcctcagagcccgcactggagcttggtggggcaggggcccctgtgtacacgtgtgtggacacctcagcccgcacacgccagctaggcgcacactgccctgctcccgagagagccgcccccggccacccctccgccgccgagctgggcatgtcagtggcgccatctgacctccaagcttggatctgcagaagagaccctcccaggtcctcctggtattgggcttggggccacctgggcatccagagtgatctagagggggcacagacttcaggtggcacatcaccttggccccagggtctcgtctccctgtggtgagagcttagctggaggactagagtttgaggtccccagggcagggctcacgttcacccaagggaggtactgaattactaaactgttctgagtcaacgtatatgattcttacagtctcagtgtggtaggctggaaaacaataatagtaataataataataatttaaacagctacaggcaattattttagagtgtccatataatgtttttccaaaccgagacatttttgagagtgaccagggtctccaactggaagatttgccaggagtcaggcataaagcaggactctgccaggcaaagtagcatctctccttttgctaaagtattgagcccgcacgtgctaggtgttgttctcaggattgtcacgcattcagtcctcacaagagacctgctgctgctgctgctaagtcgcttcagtcgtgtccgactctgtgcgaccccatggactgcagccttccaggctcctccatccatgggattttccaggcaagagtactggagtggggtgccattgccttctctgcacaagagacctgggaaggtcttttctctcctttgacagatgaggccatgaggg

SEQ ID NO: 41931 - DNA, 1709 bp, Bovine  19866880776716
ataaggagttagaggacgtgctctcccacctcgggtgaaactgagagtacttcctggagaacgcatcacctccccctatcgtcacatgacttctagaaggaagacgatctttgctggggaggaaaccaaggacacccagctaggtgagcagcccagctgaggtttgggataggaacccgacagtgattcagatctcaaaggcccttcccgttctgagatcctcgctgtgtaataaacaaagcacagactgctcccctgctgcgggaacccaccctgtgcgacgtcttacctgcagtgacgtcaccgtggacaggtccttaagcttcccctcctcgtctttcaggttataaccctcgggcctcttatcacgttcggtaatcttcccatagtttgatagttttatctttaaagccagaacaaagtgaaacaggacacatgatgagcaccggcatggaaaatgaaggacctgctgagcccactagataaggatgcatctacccacaagtggcttaaccttatcctgttcttggatgtaccgttgtttttgtttagtggctaagttcagtttgactctttggtgaccccatggattgcagctcaccaggcttctctgtccatgggactgtcctggctagaacactggaatgggttgtcattttcttctccaggggatcttcctgactcaggggtcaaacttgagtctcctgcattagcagatggattctttactgctgagccacctgggaagccctcttgtatgtgtaggttctttctaatttaattccttctctaaactgatgtgcccatctttgctaagggaacatctgtaaccatgctctgctgctgctgctgctaagtcacttcagtcgtgtccgactctgtgcgaccccagagacggcagcccatcaggctcgcctgtctctgggattctccaggcaagaacactggagtgggtagttcctcacaactgatcacaaaggtgatactgctgcgtcaaagggcatggccctttcaagggcagttatcagtctctcaactgatttccacaaagaccatcctaacgaagcttcctgctcttcacccttcatgggcagaccaaagagggtaagtgaagtgaagtgaagtcgctcagtcgtgtccgactctttgcgacccaatggtctgtagcctaccaggctcctcagtccatgggattttccaggcaaaaatactggagtgggctgccatttccttctccaggggatcttcctgacccagtgatcgaacccgggtctccctcattgcaggcagacgctttaccctctgagccaccagggaaaccaaccccccaaccagggatcaaatccacaccccctgcactggaaggccgaggtctagacaaccagggaagtccccacgcgtcatttttaaaggctgcatttcattattcaggcatttctatatttatccaatcaatcgcctactgttggaatttaggttatttttggttactgtaaatttttgactgttggaaaaatgcatgagcttagtttcttaaactggaaggaaaactggttgttttctccctccgccaagaccagttggcagtgacttttcctccatcccgtctcacagttcccatcagtgtccccagacaatgtctgccctttccatcagcagcaaaatcctgatggggtgtcacccagcccactcaatttttccgcctttat

SEQ ID NO: 41932 - DNA, 954 bp, Bovine  19866880783679
ctatggagcaggtgagctaggcagtgtgagcccatttgacagatgaggacactgagtcttagggaagtcaaaggactggccaggcaagatggcagagcaatatccgaactcaaagctcctcactccgcagtctcgagggtccttcaggccccctccccacttagctccctgcctcctacctggtgccgggcgggcaggctgcccccacgcttgtgccacgtgacctgggcgtggggctgcccagaaaccaggcagttcagatccagcgtctgtccttcagccacgtgtgaggaggatgactcgatccggaccgggggggtgacccccagcgctggggacagagggcagagagtgaatccccagctgggaggaggcggggaggggagggtgtgagtggaggtagggtctgctggtttctggggtcctgcctttgctggagtggggagcctccccccccgaacccccatcactcaccaggcacagagtctacaggctcaatgctgaccaggacagaggactccaggggcactgaaccgcccaccactcggcacacgtactcgcccgagtcggccggagacacctggtacagtctcagcagggagccgtgggtctggccagaatggaggtggggtcagagggggccctctcaggatcctcgcactgatcacctgccgccctgcctcactctgagcctgagaactgacttttaactccattctgctcagaggtggagaagtggctgtctcatcccaggaccaggggtggtcaggagaagccatggggaactgagcaaacactaacaccacactccatcaacttctggacacatttaaaataaaaaaaaaataggatggagctggtaacatgcatattacttttgctttattattatttttgggtgtcaccgtgggcctatggaatcccagctctccaaccagggactgaaaccaggcc

SEQ ID NO: 41933 - DNA, 824 bp, Bovine  19866880893732
gtggggcgtggggaagcaagatctcataggagctgtggtgagacccccgggcgctgctggagctgcgcaggggcccgagggaaaccggtagaggcgtccggggcccaggcccacttcccactcagagaaggcggcggggattccaagtgcgggaagaaggactgatccctggggtctctcctgatggttgggcccacaggagcggacacgggccgcccttctggagacgctctatgaggagctgcacatccacagtcagtccatgatgggcctgggcggcgacgaggacaagatggaaaacggcggcgggggtggtggcttctttgagtccttcaaggtgaagggcgggggtccacctgcgcgcggagggacgcggcggggatggggcggggacgcggtggggatgaggtgcaggggtgcggggcaggaccaggtagggggtgtggctacaggcggactcgcccgggaggtggggttgcgtgggggcgtggctcggggtggagctaataggcgcgagctcgggccaggtgggcgcacacctggggtagagtccggaggacggtgagcctcagggtgacccaggttttagcgtgggcctaaagactcgtggccgtgcgcgcgcgctctgccggggcagagccacggttgggagctgtaaggtgcgctctggctggaggaggagctgatggttggaggcggggcttaagcttgggggcggagtctgcctggacggtagaaggaaggagcgctctggtgccaatggtggtggctgccaggtcagggcagagaagagaggacccccgtgtcctaccgagggaaagaaa

SEQ ID NO: 41934 - DNA, 1907 bp, Bovine  19866880894781
cctcgtcccggcttccttcccgtgcggttgtgaattgtcttctttgttttctaggctgatgaaccaattgcagattatgctgcaatggacgatgtcatgcaaggtaaaagaccagtttgtttgggggattgttgaggaccttgttcaacgatggtggggttgtagttattgaatctttagtctacagtgtttctacttttaagcttgaataaagcttctacgtgctaaggtagaatcttaccgttattgctctttttaaagaatgatatctatgaaaattgagaaaatggaggaaagtgtagtatttagtttactgtaggaaactgaaacagatggaagcctgcggatagacgagcttagcaaaaagcagcgctaattcaggttgcagagcctccggcaggtatacaggaatcagatgccccaggtgcctctgaacataaggagtgaggttgcaacctaaaggcaggttggaaactgtgtaagaagcagttattcgactcaccaccggcacacgtcctcacagcccttccctttacatccattcagtgcctcttcttgacctgtagagtttcttcgaagaaattaaactagaaaggtgagagacgtgttacctaccaaatagggagaccagccctttgttcaaacaccgggcagcccatctcttacctcccacagtggagggaagagattctcttctagggaaagcagagaagttcaaggaaagagcctacagatatttttttaaaagtagttcatctcccagctacctttgggtgaagccaaaccagacagttttcaaccatctttttagtccctcacgcttcttagaggggagtggacgaccagagagctccggacagtgaggcagagggcagcatgggaccaaaagacatcagtcagcaggtggacaggaagttgatgatgcgggaagcacaagaaagctttaaaagtagctgaacaataccagagaaagagcaaatagtctgtatgtaagcagcgttcagagaacagaagacaattcatgaacataaaaatgggtgcgccaaggcccgggtacagttaagtgcaaatctagagattaagatcctaaacacacctagaggtctggaagggaaaaccagtcttattcctgagatgaagagtcaaggacaaaccaacgggctagtacccacaagagaatgaggaagtgtgagcttcaggctagagttcttgactagactattctgttacacgcgtttggtgactctgtgaatataaggcctcagaaaatttctttctcacctaccgtttactctgggagggtgtactctgttaaacaagagtaagaagaaagatgtcaacagtggaacctgaaaacagggatccaacgcaggagtagatgccctagaagacagttcgggggcagttccgagcttccagcacgaggcactgcagcaggtgttgagcacgcccgctccagattggagcacgctccctgggaagagtgcaagtgacagatgactgtcctgaggagcttacccttgaatcagagatggtacagagaaaatgaagcacagaaataatgcagttaccaaccccagagagacagagtcataccagacaagaacgatcaccagggtaccccagagggttcaaccgtggacactgttaaggagtaaaaagatagtgtaagcactggagattggcttaacgacaaaaaatatccgtgtgtcaggaggatggttaggggccatgtgttatgttagaggtgggttgtttctttgaggaaactattaggtattaccaaaaattgtgaattagcaacatctagaaatgcagaggttaaacaccagaagacgtggccgcaagggccaaaagctgttccctgtaaagtgtgggcacaggaaggcggggccccacggatttct

SEQ ID NO: 41935 - DNA, 1081 bp, Bovine  19866880896740
cgggattcttttgtttagacaagtatcttccaaagagacataaagagctttgaaaattcttgggcatcctacaatacaggtttgagttaattaaaaaaaaaaaaaaatccataccttgcttttcaatttctgttacaaacagtagtaagtaaaataacccagaagctgtctgtacttagaacttaaaatttctgaaaaaggactacagcaatgttgaatccattttgtgcccacatacgaattttcagagatggaatcaaggaaaatgtgtaatatgctaagcagtaaataaacgctttaattcaaaacagaggaaatttatttttaaaaattccttcatttctttctataatgattaaaaggaatgctttttatattaaaagataaataattaaaagaaaggttcttacctgctgttgccctgtgtctaagcccaaggctttcacaaatcctgatggatcgatgtatcgcctattactgttttgtaacaaggcaaataagtactggagatgctcacaaatcgtttgaggctcataatctattaaagaaatgtttgtttttaaaaaactgctattttaaaaaaatatatacaccttgtcacatgaggacataattaaaaaaccttacgtccaaactaaattagttttattacatttttttttaaactttgaaagaaactagtaaccacatcttttggaagtaatgaggtaacctgggctgtccatatacattccctaaagccaagggcctacccacgtcacaatgacaataatgatcatgactacagtttctagagtatcaaatcccaccaaaacttccaatccaataaaagccatatactatatttactatgggcttccctggtggctcaaaggttaaagcgtctgcctgcaatgtgggagacctcggttagatccctgggtcgggaagataccctggagaaggaaatagcaacccactccagtactcttgcctggagaatcccatgggtggaggagcctggtgggctagagtccacggggtcgcaaagagtcagacacgactgagcgacttcacttcacctcttcacttcaccatattt

SEQ ID NO: 41936 - DNA, 1927 bp, Bovine  19866880921748
ctgccacctcctggacagacagtgtcaactaaccccctctgacttgtgttttccagacgtgtcttcccccgctggaagttttgtgtgagtgatacagagaacacctttgggcttcgccctgggccccatgttcgtcaaagcgaccttcgctgaggacagcaagaacatagtaagtgcccccccacacacggaggccgtgacatcacacccgcctcccccgtgagcctgccaggccgcgctctcatccactctggactggctctaccccgggccagggctccggccctaactccaaggttccattttctaaagccttgcgtaatctgagttacctacaacagagaatatgatcatagtggcaggcactttgtctgtaggatttcacgtagccctccccgcttcccagggaggttagtctggccgtctccacctccaagggtaggcagggcccagagaggtcatgttgacagaacagcttgacatgaagtggtggtggccacaggatgcctgtggctgagcgcctggagacagctgggccccagcctggatgccggctttgtctcttcctggtggggggtcttgggacaatactctgagcccaaggacatggaggtgggtgcgtccatccctcaggcggagactgaacggcattgtgcacacgacagcaaccggagcagaatgcgggctcagggaggggtagccgctgtggcattactgttggggttcagtcgctgactcgtgtccaactctttgagaccccacggactgcagcaccccaggcctccctgtccttcaccacctcccagagtttactcaaactcgtgtccatcacgtcagtgatgccatccagccatctcatcctctgtcacccccttctcctcctgccctcagtctttcccagcatcagggtcttttccaacgagttggctctttgcatgaggtggccaaagtattggagcctcagcttcagcatctgtccttccaataaatattcaggcttgatttcctttagtaccatttttattcctaactttaactgcacagattttttatttgcagtcagaggttagcaaactgactcaaacctcgtacgtgacctgcctgttagtggctgatgcagattctgagtcacgttctgtccgtcgtcagtctgtctgctcctcctgctgcccgactcccccttcccctgctccggagtctttttcagcctctggatctgcttttgacattcatctccagcctgaacagtctttctggaaccacccctcagaactcggcttctctagatgttaaagcccagtccatccagaaggaattccgtgagccactacctctgagaacagatacacgtcctaggatttctgaaaagaatcacagcgcacggcacaggcacccctaagtcccgccgtaagagtcttttccagtgttcccagagcttgccctgagtgtatttgaccagggagccctgtttatagaaatccgtctcttctcacaggatgctagcgtttagaggaaggaggttggggaaccatggctgtggacccccttcctcagcccagcacctcggagcacaaggcctggagccaggatctgagtttagtctctggccccacagcatccttctccatgggatgcccgctgcccatggacaagttcagtgcccacacgtgactgtctcctcaggccagcgagatcatcctggagatcaagaaggcgtttgaagagagcctgagcaccctgaagtggatggatgaagatactcggaaatcggccaaggaaaaggtgaggctggccaggagctgggaggggccctgcacagagggccgcgacctccgaggaggaggtgggcgaaggagggactggctctagccggtgagcccaacacgggatgctgtgggtagtccagcacgatggcgggagagccgtg

SEQ ID NO: 41937 - DNA, 1807 bp, Bovine  19866880963688
cacatatacacatacacacacactacaatacaaagatggagacttgaaggaaatggtgagtggaacacaagatggtatggtacatccctgaggaccttcaacatttaaaagttaaataggaaaagccagtaaagacaacatgggggagagagagtgaggtacagaagaaactgagagtgtgtagtgttacaaaggctaagggaaagagtagctcaagaaggacagagtggccacctgtgtaaagcactccaagaagtcaaggggataatgaaaaaaattgtcagttgaattccacttcctgtctattagggcaggtgggaagggatgagacccagaggacatggaaaaggattagctttggtcaggagaaaagattcctcctcctttgcaacagaagaatgggtacagacataggtaggtttgtaaattcattgcaaatacattgtgaatttctcacatcagaggcaaaataatctgctaaaactgagaagagaagccaaggagtctagaagctttgaagtggtaaccatggagagcaggtggatcagtcaagggaaacttggcaggatgtatgagcagtgttgagctcccagttgaggctggcgatcatgaaactgtagtgataatcatcagcatgttatgtgatatttcccctgcacttctcagctgcctgatgcaatcacagaaaagacagatcgctagatgagccagcatgaggttttggtaggagcagaggttcttcatcagagtttgtgtcagaatcgcactgagattttttagaagcactcatatccatgcatagactgtatcccagggttctggcttggtaatcctgatggttggtctgtatatccctcagtttataggaagttcttccatggtgtgtggcctccagttagtaggcattcattcacttggtgcaactacagacagactggccagcgaattagcaagggagagcttaaaatgatggacagtaaagtctcaaccagattagagaaagaagtaaagacacagaatctcacacattgggttaatatggatctttctcaaactacaatgaggttatatcccaataagtccattttaagttgaaaaatcttaagtcgaaaatgcctttatattaatacatctaacctactgaatatcatagcacaaatttgcttaccttaaacatgctcagaacaattagcctatagttgagcaaaatcatctgacaaaaagcttattttagattaaagtgttgaatacctcatgcaatttattgaatactgtactgaaagtgaaatacagaatggttgtaggttatttaccctcaggttggcacagctttcctgggagctgccactgcccagcatcaggagacagaattgtactgaatatcactagcccgggaaaagatcaaaattgaaaattcgaagggcactttctcctgaatgcatattgcttttgcaccatcataaaattgaaagatcataagttgaaccatcataagttgagtactgtctatacagagatcaatatttaggaggtcccccaaaagtcaaataacatgtcctgtgtagaaagagtgctgatagcaggtttaaattaagcaaatttagagtatattttattctcatcataactttttatagagggcaaaaaataacctgtaatctcccagaaagctgcatttttttggtatgtgatggcccagaaatgctcatcatttctttgaagctaattaaacacttaagtttccaaacacatattatgtctcatgatgctgcctataggggtagagcatctccccccattcctcaga

SEQ ID NO: 41938 - DNA, 1103 bp, Bovine  19866880995852
ggccgcccgtttgttagcctcggggcggtggccctcatttctgtggagccgacattggcttccagcccggcaccttgccagccaccttggagcctcaccagatacccggagcggagggcatcaattggccttggccatcctcctctgggttgggaaggctctttagtgccaactgtggagcaaaaggcagctcacccctgggcaggcagcccccaatcccccccaccagcccacgtcccagccccgttccacccctatcagaccagctgggcccccggcccctggcagcctccccttcccaccaagccctcctggcctgcatcgccccctccccaccaaccccacacctagcccagggcccccttgccctcaaggggctgcaagggaaactccagcccactcgtaccaggagctgctacaggcagagccccacactgaaaggggcttcctgcccgcaccaggccacgtccccccccacggatctggaagtgaaggcccaggggacatggggggaagaggccttggtggtcagaaagagtaagtgccttgggtgcggggagctgggacacatgactgggaggggcagggaggggatgtgcctgtcctgccccgtctgtgggcgcccgagggcccgcctggaggcacgcgcccgccccgccagcagcccccagacgtggggccgggacgcctggcccctgtgtcctagaaggggccctcctgtggtctttgtcttgatctttcttaataaacggtgctatccccgccagggctgttgtctcctgtgtctttgattcaagcgggactcgtggtccctgagggtgggccggggtgggcccaagcaggatggaccagcgaggtccagggttgcagtgagacagcttcaggcgcacgaggcccctgctccctgcccctcgtggatccagcagagtgccagctgccaaaacaagctgcagggccaactgtccaagtggccttcagcatgaccctccgaggcagaaatcgtcccatcttccagaggggcagactgagtctcgagggctcagaggtagacagccctgttgggggtgggggcgggggcagaacccggggaccgtccgatccca

SEQ ID NO: 41939 - DNA, 1123 bp, Bovine  19866881001890
cctctacagctctttgtgtggttaagcttcctgatggagggaccacttcgatttggcatcctaatgcctagcctcctgtaataagtgggaaatgaatgaatcaccaaacaaataagtgaatgaacaaatgacctctggagctgtgactttcatgtcttttttttttttttaatttataggattggaacgtcaattaacttctgaccactggcagcccacctttcccacgcacatccatcgcacctctgggctccagagagaaagcaggtcttggagggcgccatgatttcaccattcttactgctggctatcggtacctgtcttgccagctccttagtgccaggtaggattgggggcaagggtggagggagggggagagctggtacagctgggataggatgagggcagtgtccgtggtcggtcgtagagtcacccacagtatttaagagctggaaacaaatgttcagagcaggacatcccagctactacatgtgcttgtgctggaaaagccagtctttttccttctatattattctttaattgcagtttctagtctcgcttagctctaggaatctgaaatagaacttacccctataaactcttctataaacccctgatagaacatttctttatattttgtaattcttgctttaaaactcaccttcaaggagttgtatttatttttttgtttttgtagtttatgtttcctattggaaactcacatgaaagtgtttctatagtgtggtattctgtttgattcttcgatcaattctgtcagagtgtttatgttaatttctcagtttggggctcttgcactttaaattcaggctcagatatggagtgttttataatttgatttatttttgactgctgggtcttcgttgctttgcatgggaattctctagttatagagtgtgggctcggagtcgtgacacacgggcttagttgcctcacagcatgtggagtcttcctggaccagggatcgaacccgtgtcctctgcactggcagacggattcttatccactgtggcaccaggagagtccttcagatttggaattgagttcacatttcatcgcggctttctctctccaacccttccatatctcccaggcaaaacacgta

SEQ ID NO: 41940 - DNA, 1327 bp, Bovine  19866881022472
cgagtggaggactctgcccccgccagcccctggagttggcctcctttccgcaaccagggcctggcacccactcactgctcagggtgtagttgcccaacagatgacacatttttccatggctccagccagttgctaggaatctcatattactttgtggtccgtacactgcttttcaccagcagccatctggcaggagcacttttcagtgactagatgaaactgtggaactggagtcaaaataatcacagagggcaagtcagacacgagacatgttagaaacgctcccctccagctccgctacactgtccctcctcttgccccatcattcgcagaagtcaaagcattcttggacgtccctgctggtctggcggttaagaatccgcctacctatgcagggaacgctggtttgatccctgatccaggaagattccaccttgccttggagcaactaagcccatgcgccgtaactactgagcctgtgcactgagggcctgtgctctgcaaagcgaagccacggcgaatgaaaagtcggcacctcaaacgaagagcaacccctgcttgctacaactagagcaaggccacaggcagcaacgaagacccagagcagccaacagataaacgttagaaatgaacagggttctttagaattggcatctagatcgactgcagaaatgacagtgactggcagtggtgagaactactctacggggtggagaaagcatgggaaccacctctggaggagtggcactagagacggggagtgactgtcttcccaaatctccacagggcccgtgaaatccttggtttattttttagtaaccaggcagcgtgacctcttggcaagggcatgggactagggccagacggaatggagatcaactcgagcttctcctcttactggatttgtttggggtaaggatttgcatctacaagttcacgtccgtgaaaaagtgttggtactaacaggttgctgggagatactgctgggcattttaccagtttcggtttgagttctggctaacttacctctgtaagcctcacttgtgctttggaggttcacctccgtatctaaaccccctaccttgcattttttattgaaagtgtaaggctaggtattagccatacagaatactatgcaactgctaaaaaaaatttttttaataaacctttttatgttgataccaaaagactgctaaggcttactgtgcaagaaaaatatattaaacattcataatgtattttgtgtaaataaaaaaggatttctctggcaattcggcagtccagtgtctaagattctgtacctccactgcaggagccagggttcaat

SEQ ID NO: 41941 - DNA, 1675 bp, Bovine  19866881031609
tgaggaccccaacgcagagatggtgggccagccttttcagctaaagatttgatctcagtaaaggagcttgtgtttagcccacctttggctcgggaaaaggtgggacccctgccgtaattccaggaaaggaaaccagagtcctggcctgcaggggaggagatgctgacagccagaagcgaggaacactcccccagggacgacacacccttcaggtggtgtggactgggatacgccctcctcagccaggagtgtggcagtcaattattttgctattagagttgccaccacttttttttttctttttggttattctggaagcattcatttggatttttccctgctctggttttctttatgtttccataatctttcggctcctgggtggtctggtttccgacaggcagcagcgtcagctggttctcacagagtccatgtgctcatggaggaaatgtggcctgagccgatgtcaccacacccacagaaaggaagtgacagctgcacaaggtggagaaatgtatgtgctgtatccgtatgggtgactttggttaccaggaacagaaaactcaattcaaacagctataaataataaaggcaatttattggctcacattttttgaaaagtccttcaggaaaggcttgatccagcagcttaacagtgctaacaaggacccagttacttgcctttttcaagattagcttcccttacagtcccaagacacctcccagcagttcccaagaaaaagattgcctcatttcgtgatcaggagggtatcagagaagcatctttgttccagaattcccaggaaaagtcctaagattcactctgaagtgacaggtctagatcacatgcccaacactacacaagtcactgagccaggtgtttgaaattcacttactgacttagccctgctccagcctggcaccagaagtggaaccagtctgtgcaatcacacggctcccgaaaccaaaatcaaggccatctgagagggcagaggagctctgggaaagccatgcaagtgggcccactgcagtgagcagccacatgcatgaaagcgagtcgattaatcaccataattgcagctcctgtcgggaactgcattaagcacttcacacgcatgagttatgcgatgtaacagatcatcactgacccctgggaggtgaccttttcattctattttgcagagaaggaagcaggttaaatgaagtgacttgaagcatcatagctgttttgagtcagagacaagattgttgttgtcgttgttcttgctgttgtttagtcactgagtcccgtctgactttttgcgaccccatgaactgcagcacaccaggcttccttgtccttcactatctcccagagtttgctcaaattcatgtccactgagtcagcgatgccatcctaccatctcatcctccgtcatccccttctcctcctgtcctcaatctttctcagcatcagggttttttgtaatgagtcggttcttcccatcaaatagccaaagtattggaatttcagcttcagcatcagtctttccaatgaatactcagggttgattttctttagggttgactgatttgatctccttgcagtcccagggactctcaagagtcttctccagcaccacagttcaaaagcatcaattcttcggcgcttagccttctttaggtccaactcttc

SEQ ID NO: 41942 - DNA, 920 bp, Bovine  19866881069385
cacgggcgttggaacacttgtgcatggtagatctttactttcattgctgaatgagaggcaccaccactaggccatatggtgcctttggtcatgctctcaaaaggtatcccctccgggcagatgtagcaccaggcctcccttggctgcacacacttgttcagtgaacaacccgccccaccgtccatggcacccctgaatgaataaagaaatacaggaggaatgagaagctctgaggcagagaaaagatttggagtgggagaggaagccaggggaagctgagttctattggttttgtagtggcagacggatgacccacgaagtctgtactcccccatcagactagagatcctagatcagactcctgtttttcagaagccaaattgtttggctgctctcgcctctccagattctggtagtctttccttatctaaggaactttctgtgagacttgacttgtttccgtcccagagagtgtggccagtgcccagagctatgagtacatacacggtgtgattatagatgcctccctggctcaactagcgtctgcaaggccttgcctttgttcttcttcaaagccatatgaggagatagccagactgtagacaaagcaacttgagaacatttactaaagataccaaggacagcaaaaataaaacagagccagccaaatcccttagtgggaaggagaggatgcagaataaatagggggatgaccaatcctccggtaggtggagttaccctggaactttctcgacaggccacgtttcctgccctctacgtcagcccccttcctgccagtctagtcagctttaccatctctttccccagcctcttttaggaagcaagacttatagctgagatttagtcttgactgcacatctaccaagagttacttgttctccttttcctttgcttatgag

SEQ ID NO: 41943 - DNA, 1000 bp, Bovine  19866881084011
agcctggatgggtctcttgcacggctggcagcctttgaggacagtcttcccagccgtttccgggggttctaggggggcccctgctgcccccaggctgaggccccagctcccattggatgctgcctgacacctcgaggccccaagcagtggggcagggacggaccccgtgaggcaggcgggcaggccacagggacagccctggaggctgggcggcacggaaggcccggtgaccggtttggccgtggttcggggcctcgtggagggcaggggttgggactgaccttgcactggcactggccagcagggtcacactggttgctgacactgccctgggggtcacagccacaaccgatctgctccggcaactggccaccgctccctaaggtggagggaagccgctacagctggaaccccaaacccaccatgaagcatccccattcccaccaccctctggccatcacgctccacccgagggaacgagtgtttgcttctgaacacccgccacgtgcaggcattggccacattcacagacgccctccggggtgggtgggccttttacgacccccattttacaggcaaagaagccgaggttcggagaggcaaagtcacatttcctatgttgaaggagaacgaaggctctgtcctagctccatccccagggtggccagatccccaaagcctccccaagcctactcacttcgacagggctggccctggctggggttgccgtagtaacctggcgcacacctgcggtgagagaaggtgctgggtgaagggagggaagaatcactgggctgtgctgggggccctgtactggactccgtgacctgagtgctggacgaacacccattgcacagatggagaagtagaggggagaagaggggcagggacaggccacaggccatggaaccagtgagatcagcagggtcaggcctcgaacccaggactttcagcaagaatgaagggtttctgggaagactttggcctcactggggatggg

SEQ ID NO: 41944 - DNA, 1678 bp, Bovine  19866881164501
tgatgctatagactgtagcctgccggctcctctgtccctgggattctccaggcaagaacactggagtgggttgccacgccctcctcaggggaccttcccaacccagagactgaacctgcatctctcattctcctgcatcggcaggcgggttcttcacctgggaagccggcaggtctcaatggaaggtcagccagagccaggtccagctccgagctcggtaactgtgtgacctgaaccgatccactgtgcctctgagcctcttgtttcctcttctggaaaaatcaggacagtcctgctgtcccagagttaattacgaaggggtaataacagctaacatttcactgagcacctactaggggccaagcgtggttctcagtgcttcacatgtacttctatcatcctcatttttatagatgagaaaacaggctcaggaaggttagacacctgcccaaggtcacgccacgaagcaacagaggagtcaagaagcgccctcagggcacgagaccccagagccggcgcaacattctgccactgcactcgtaactgatggcacctggagtgtggtcccggcgtgtgacctcctccccagctcccgctgcctcgtccagcagcttctgcccaggagctgggcgatgccagcacacgctgtatggggcaggggcctggatctggggcaggtggtggcgtaggggctgcccccgtccgggtcgccccatcgcccacctcaagctgcctgagcacacggcctgggtctgttttgttcgctgctgtatcactggcgcccagaaccggaccaggcacccagctggcgctcatcactcgctcaccctgattgagcacttgcctggcgccagaggcctttctatacgcctcacaaatagcatcgcgttgaaggcatgaggtgggaatcaccaccctctccgtttgtacaggtaaagaaaccaaggcacagagtgggaaagccacttgcccggggtcccacgcagtcagaggcagactctgctaaccactacgccatcatgccgccttggtgccatccgtgtttgctgattgaatgagcggatccacgacacatgctccctggactcccgggatggctggccagcccagcctccacccccagggctgcgcggtgaccccctccgcacccagcccggcactcccagcccagagggccaccccaccttgccgagaaagtgcttccggtagaggcgggcagtgtggttgcactccagcttcaccttggtcgtgggcgactgcagcagctctgtctctgggatgctggtgatttcgtgattggtgccttcaatccagtagcccccaaactggggcagcaggatcagggggaagggcccttctcggcccaggacctgaaggagcactcagctgagggtcactcaccctgcacctcggtgggggccttgggacaccccccccaacttggacccggagccacttctgtcatggctgaggggtaccagggcatagcctggagctccccaagggtcccctggctcacacccagggccccctcccaccttattttggttggccagaaagtttgttcgggtttttacagacgatgggatggaaaaaacccaaaggaacttttttgccaaaccaatactagctcgaacccttctcctccccctgcaggcccagacccagacacacacag

SEQ ID NO: 41945 - DNA, 1348 bp, Bovine  19866881184415
gtattccaaggacacttggggacatatgggcccagactatgacaagcccattctgatatgtgttcctcctatggcatccaccctacacacacctctcagaatagtctccctagttcaaagttgtgtgtacatcattacctgcttataaacctcaaatagctcgaattcatttagggtaaagtccaaagccttgaaattcaaattccccatcacccaaactttctttccaacttgagtcactacctctgtgggcaccctagttgctcaaatcaaagtgaagtaacccatggttcctctgatttcttatttttatttccctacttatgctagttcctctgttcagaacacatacgaggattcaccgaagctctctctgttgcaggctccagctgcagcaattggaactctgaaccctggtttcctttgagcttgcttttgagtggttataataagaatccatcaaaacccatgtctggatctctctttggccaacacagccttatttcctgggactatgaactccagaaggagttttcctgccctctgtatagacaggcaacccactgcttgtttttgttctgatgtatgcctctggttttatactttgtgatatgccttaacatagaaaagaaaagtgaaaggcaaaggagaaaaggaaagatatccatctgaatgcagagttctagagaatatcaaggagggataagaaagccttcctaagtgagcaatgcaaagaaatagaggaaaacaatagaatgagaaagactagagatctcttcaagaaaattagagaaaccaagggaacatttcatgcaaagatgagcacaatgaaggacacaaattgtatagacctaacagaagcagaagatattaagatgaggtggcaagaatacacagaagagctatacaaaaaaagatcttcatgacccaggtaactttgatggtgtgaaaactcacctagagccagacatcctggaatgtgaaatcaagtgggccttaggaagcatcactacaaacaaagctagtggaggtgatggaattccagctgagctatttcaaatcctataagatgatgttgtgaaagtgctgcattcaatatgccagccaatttggaaaactcagcagtggccacaggactggaaaaggtgttttcattccaatcccaaagaaagacaatgccaaagaatgtgcgaactaccacacaattacactcatctcacattctagcaaagtaatgctcaaaattctacaagctaggcttcaacagtatatgaactgagaactttcagatgttcaagtggatttagaaaagggagaggaaccagagatcaaattgccaatatccatt

SEQ ID NO: 41946 - DNA, 905 bp, Bovine  19866881238517
atgacccttaaatacacagccccattataggcaatgatttccatgcaattatgacaggtctgacttgttattgttttttgtccagtataccaccatcgatataaaaggtgtttatcagggtaccacttaaaatcaccctctctgaccccagaggtgcaagttgcattcttttaaggaacctgtgtcatggttgcaagggctctaccagccccactagaccagatgcagaaagggacacacaggagtggctcgtgtaacatttcagagtgtggacagagtgctgggggctcaagccccacaagccagactcttgggtccgtgttctcgggcccctggggacaaaacccgttcgctctggctcccgaccttggtcccctcctcacctccctcctccagcctcccagccccactgcagggatcctcaccggggacgacaacactgccagagccggaagcttcaatggtgaccaggacggaggcctccaggggcccagagccgagggccacgcggcacacgtactcgcccgagtcggccggggacacccggtgcagccgcagccgtgagccgtgggtctgaggggcacggcgcgggagagaagcagaagtgaggcggcgtggaggatcagcccttggaggccggggcccggggctcagcctctgacccaggcaggccccgtgtcccacggggggctcccaggtctccctcccgggcagggcgtgagggacaggccccaagccggggcgcccacatccagcagccctcctactaggtcctgccccgcgctcacgcccccacctggtggtgagccgggaggctgcctccacgcctgtgccacgtgacctgtgcgtgggcctggccggggaccactcagttcagatccagggtctgcccttctgccacgtgg

SEQ ID NO: 41947 - DNA, 728 bp, Bovine  19866881247234
tgagtgtccagggtcgccgcagacgggctgggaggggcccctccaccctcgctggcccccacaccctgacccccctctctccccgctcccagaccaaaacgtggtgtaccctgtccgcatcgagtcctcctctgactccctggccaacgggcgcaccctggaccttaactgcctggtggccagccaagccccccataccatcacctggtacaagcgtggaggcagcctccccagccggcaccaggtatggagccagcgagcagagagggtgcacgccagggggcgtggctggcccccatgggaaccgggaggagctcctcacagccctcctctgtgctcattcagtcattcaacacacaaagagcgttcttgccagaggggtcctggccagtgctggggacaccgagaggagtcccactggcccgcgtgggtccagcacagaacattctgtgattcgctcactcctggcccttccccgagaacctgctccaggccacgtcccactcccgccactgagaattctaaggggatgagaccaggcatgcccgcgggtagctcaaagactaatgggcaaggcaggtgtgccgtgtgacagccctgtagaaagagtccccacggagggcctcggcgggcttgctggaggggtgacagctgagaaagagtgcaaaggctggaggcaccctgcacccagcccagaagctcagaaaggccattgacggagttcagga

SEQ ID NO: 41948 - DNA, 1310 bp, Bovine  19866881262684
ctgctggcctcggagccgctcggggtccgagagcacttgaggttgcttgccccggtcatgctggggccgtggggccagcctggagtctgggccatgaaggacacattgcggttgccggtgctgggacggcccgcttggtgtccagacattgtcgagggcaggcggacgaagcttcgtggtacagaactgctgaaatctcacctagaggctggttccctgggcctgacggggagagagctgggtcagctctcctcggctcaggtgttcctctccccatcttcctcccaggcccagggatttttcaaacgagaaagcaggccccatgttcttcagaaagcacaaagggcaagagatggggaggaaggcaagacactgagaacaatggaaatcagaggaccccctagaaaaagtggggcagtctgctttttcctttctctgtagcccacattctgaaattcccattcaccttttaagcagggactccagaagaccacagagtcaaaggactaagtctctaatggtgaaattcgaggcaccaagacacacattctttggagtaacatcagttaatcacccactacaccgcacaccctgctactgaacaatatgtcttagaagcaatacggtatatgtgctttttctttgccagccctttgcttgttccttacttgtgagtcttaactacaaacccagaaggcagtcattattctattcctatctgacagatgggggaaactgaggctcagagggttgacgtggcttgcctcagatcacatagcttgtgagtggtgggggccaaggtactatcttgagtgtatctgatgacccctaaaagatgatgccgtgttgttgggggtgactttgtcctcaccagcagtctactgaggaagagttctcatctcacctgttggataggggcaccgatcgggaaaaccagatggggaggggtgcttgctaaccctgtaactaagttgatcttgacttcacgaaccccaaggggagaggcaaggagatgctgtaagtctacagtgggacttgtgagacagaagtttccagagtacagtgtttggtcttcatcttctctgatgaagggagatggtctcatccaccccacaaaagaagggttcttggggttcctcccggtctgaaagtggacacttcacagggactagggcctgaccaggctctggcccaggtcaccctgcttcctgtcctggggcctgcccaggtggcaggagccccagccccattccgtttgtcccccaggtccccagtaccgcccgtttccagaaggaaggctctgatttctg

SEQ ID NO: 41949 - DNA, 1560 bp, Bovine  19866881306763
agtgggtcatctgaattcaagcccagcagatctcaccttggacacgtcacttcctcactctcagcctcagctgttccatctgtaaactgggctgattgtgcccatctctaccccagttgtcaggaatggggaacaagacgtcagcttgttctgtctggcacctagtaggtattcaggcatgttgggtcctttccctaactctctgagatcttcagggactctgagcagctaaggaaacagctcaggaagcagtgtcggatggtggatctgctttaagcctgactttgcagtgtccacacgtgggcctgtggtccagcgactcaccgtctgagctgctgggaaggttgaacagctgtattaaatgcccagcatggtgcctggcccaggggagctcccatcaaagaggttaacctggcggttaacccagggggatgggaatcggggataacacctccttccccgccccctgaccagaggcctttgccttggcatcccaagggggcaggattgaccacgggcaccacgagggcaaagccaagcaggcactgcacgaggcggtggagatggaccaggccatcgggcaggcaggtgctatgacctccgtagaagacacactgaccgttgtcaccgctgaccactcccacgtctttacctttggcgggtacaccccccgtggcaactcgatctttggtaggtaggcctccattggggtaggtactgggcattcccagggtctgccatccgggagtgggggtagaggaggagagctggcaagcccagggcctggcacatgtgggacatggaactggggagggaagagacgtcactggcaggtgggggaatagagggtggggggcatggagggaagtgatgcctgggtgcatgggtggccaccgggatgatggataggtagaagaatgagaggcaggatggattaatggacaggggagaggagaggatggagggatggatggacggatgaggggtggatggaccaacagatgggaggacatgggcacaataaaaactgagggatgtttggttggaaataaattgggcttggaaggtggcttccttgggaggggacccaggggtcctagccgggggttagggcctgtacccctggtgctccaacaggacccctggaccaatgccttcttgtgcaggtctggcccccatggtgagtgacacagacaagaagccgttcaccgccatcctgtacggcaacgggcctggctacaaggtggtgggtggtgagcgagagaatgtctccatggtggactacggtgagaaccaaggcccagggctgggaggggacagagaaccccctcagggatgagctcagaaacagtacagtcctctggttaaggctgggagcgaggtgtcccaggatagacaggagttgagtcattgagtcagaacaatgtcaacttgaatcccctccgaaaatccagcaactctgtgaccttgggcacttaacttcaccttcctcattttcagtttccctctgaagaatggtctgcctcccggggttgtctgaagggctagctggacctgatg

SEQ ID NO: 41950 - DNA, 1009 bp, Bovine  19866881375780
tgcctgcctgctccaagcgagcaaggacacaggcagcgcatgttgtttcagagcctggctcgtggggccaccgagcagagtgtgtccgtggcggagcaagttacacaatctctctctctgcctcaatcttctctgcttggaaaatgggggctgtactagtggctccagcttaactcatccaacagatgtatttactgcgtatttacctccggccaggcgttaaggatacagcagcagtgaacaagagcacagaaggctctgctcctttgaagattaacccagggggagcggggaaggtaaacgggtaaacaaatacatatcggagagcgacaaggagaaacagagctgaggaagtgggcagggtagtcggggactggagagacgcgaggcacagggtcacacagatatccacaggacaagcattctaggcagaaggaacggcagatgcaaacgccctaaggtgggagtgtgtttggaacggtccagaaacagagactggtgcggttggagggagcgagcaagggcgaagcgggcagaaggagagagtcgagaggcagtggcgaggggtgcaggtgggggctagatctgaagggctgtgggggccagattaagtcaggggctgggttctgacgtgagcaatgtggggagtgtagggaggtcctgattgaggggacaacatgcgatgatctgttgaggaacttcatgcctggcggatgacagagggcatggacaaacgtgaacaatatctgcgtgatttcatctggcctggtaataacccccagaccaccctccccactgctgcaaaccctaaacccagttacctcctgccaccttctttccatccatctcccgggccggcctcaggcccgcagatcccaacttgcctgcgctcagcctgcgaacaggcccaggctgagccagctgggggccaggacgccccagacaccaggagctcggcctgggacgtgtgaggtgggggggggggggcatacatctctgccacaccagc

SEQ ID NO: 41951 - DNA, 634 bp, Bovine  19866881390619
ccatggcagctgtgtgaggttgggttatcatcagccttcttcagataagaaaactgaggctcggagaggttaagggacaagcccaaggtcattccaggcaaagggtggtgccaaggtttccctctagttcagggctctactaccacacccaccaccactgctctcaaggcaggctgaccccactgtcgcccagcccccagcggcctccccatagcagcccctggttctggccgccaccaagcatcttcccgaggtcccgctccagtcctgccctgtctggcctggacattcctggacacagtaataggcagcagccagaagggaggtgacttccccaaggtcacacagagagctggagccagcctggagtcccggccaggtacactccagggtcaccttcaggccctacaggtgtgtggcctgcagccagctggctgtggctcccctccccgctggagtgtccgtctccccctgcgaaagggtggggcaggctcccaggcgggatgggccaggccggaagcctgccgacagctcccgggtttcttggcaactgtcactgcaccgcctccccctcccttatcttcacgtcgaggtaacaataataattgctgtgtcgtgagtgcagctctctgta

SEQ ID NO: 41952 - DNA, 777 bp, Bovine  19866881725438
catgtttatatgctattctatgatgtggaccagggtttggcaaactgatctgcctgtttttgtatggtctgtgaactaaagttatgcatttttaaatggctgaaaaaatcaaatgtttttgacatttaataaattcaagtttacctaccaaaaaaaaaataataaataaaacatgaatttaaaagagaggttgaaagccattagaaggagatagggagagatctttttgggcttctggactgaattagtaagtgaagtggaatatataacttacccaagagtgttctagcagccaaagcaaaaggggaaatggcagtgtggttctggggtgacttggttccttgaaaaaccacacccttaccccctcaactgataagggctgtagataaaaaaaactaccggcagggaagacctttgaggaagtgggtttccaggctccgcatgcctgtccctcctggcagtctctgtgctcatcccagctaatgctcaggaatttcttctgcttcactgctccaacctggcctactttccccagctctgggctccgcaaaagtagtgggtctcccatctgagaaacgtcaaacttgggccaggtgaccactgtgggggaagcagcaaagacttaaaaactgaaacagggactagaatagatgaccgattcaggtccagccctcagagtctgtgagtttatgctgggtaaccgaggtgcagcccagattcccagccagctccggttcctgtatgctccttcagagaaaacaaattcacacatcacaa

SEQ ID NO: 41953 - DNA, 943 bp, Bovine  19866881808595
acccagaagaatgtgtggaactcacttcgcggggagccgccagctttgctgcccagcctggtggcgtcaggtccatgtcaatagtggccttgagcagggagtggctcatggctgctaggggtggctgggccaggggcaccgtcatgaaagtcctgggaacaaggcagctctttgaggccaggccgtgtggggccttcaagtcgcagccgcccctaggacccaccctcccctcctttccctgatgcccacctgtgccagagctgcagggatccctagatcaccccgggttgggggacccgtgacatcatgagaggtcttgaggaccagctcctggccatctgctggagccctgtccctcagccacaggggagggcaccccgtttctctgttgcactggattttcgggggtatctggcacacagagtctggcagtctatgttgatgaatgaatggacactgatgtatgcaattcagtattctgtaacctgacatccctaagtgttagactcaaaattcatcgcacaaatacctattgagcatcttctaagtacctgaccagggtacctgctgaggttgcagcaaagaacaagagtccggttctctccccttgagtaacttgcattgtagcgaatgcagggagacagacaataactatatatggcaggtggagatgtgtttggaagagagaatacagtagggaagaggacagagagtgatctgcagatgaggctgtgattccgaagggatctagaggaaggtgggggagtggtggtcacagaggcccgggggtgtgctggatgtatctgcacaaaacgctgaggaacttcccaggtgacgcctgccagctcaggagatacaagaaacacaggttcgatccctgggtcaggaagagtccttggaggcaggcatggcaacccactccagtattcttgcctggagaatg

SEQ ID NO: 41954 - DNA, 1151 bp, Bovine  19866881827957
tctcctgcctcccctctccccccccccccaaaccttgtgatcccttcagagtccccctccccaacatgggtatttttacttaggggaccacatgctgtgtgacatccgggcctggaaagcagctattattaactcaggacattgggacagggagaaggctcagtgctaccagctcagccccctgtcctgatgtcctgttgagttggcatgaggcaagtttgggacaggacagaggaagtccccttcccaccaccaggagctcagctgtgaacatcgttgcatggacaggacacaggcagcagctttggaagtgagctggggaggtggcgtaagagccactggtggcttcttggggaaagaagccaagatctccctgggtctggaggacagggtctggacgctcggtgcgggtgccacgcttggggccgcctgatctccccgtccccgcacctgtctgctccgcagagcaggaggcaggagccaccactgagtgaacgctaactctgaaccaggtcctgtggcaaacggcggttgcatgtcatcagagtcagtctaaagagatgagttctgagacctgccttgtggtccagcagtcaagattctgcacttccgctgcaggggacatgggttccatccctggttggggaactaaaatcccacatgttgcaccgccaccctccctccctgccataaaaaagagagagagaggtcctagggtgtccccatttaacagatgaggaaactgaggcttggtgaggcaaggtgactcggccaaagccacgcagcttagagccgtgactccagagccaggagtgtttgcaggctcctctggagcaccttaacttctgggctgggacggggtgggcttgtggctcagaaaagccatcaaatggtggagagagagccaaggagcatgagaggaagccggctctggaaccctgacccgggatctctggagggaagtgggtggtcccctcagggagggaccaggcagctggaagcaagtttcgagctggatgaggagctggcactgttctgtcctctgggcacttaacgcactttagttatacctgtggctcctctgccctggagtggaagccctggagggcagagaccctgcctctcagcgcacctgctcgggcagacgaaag

SEQ ID NO: 41955 - DNA, 1092 bp, Bovine  19866880051982
ctccaaaatcactacagatggtgactgcagccatgaaattaaaagacgcttattccttggacggaaagttatgaccaacctagatagcatattcaaaagcagagacattactttgccaacaaagtttcgtctagacaaggctatggtttttcctgtggtcatgtatggatgtgagagttgaactgtgaagaaggctgagtgccgaagaatcgatgcttttgaacgtggtgttggagaagactcttgagagtcccttggactgcaaggagatccaaccagtccattctgaaggagatcagccctgggatttctttggaaggaatgatgctaaagctgaaactccagtactttggccacctcattcgaagagttgactcattggaaaagactctgatgctgggagggattgagggcaggaggagaaggggacgacagaggatgagatggctggatggcatcactgactggatggatgtgagtctgagtgaactctgggagttggtgatggacagggaggcctggcatgctgcgattcatggggtcgcagagagttggacacgactgagcgactgatctgatctgatctgatcggaatggctattgcagtttatgatgatagtccacacatagaaaacacaagcaatgattgttggattgactgaaacagagttgaatcatataagttatcttttggtttactgtgaacttaaaagtctttacacaattcagcataatcgtacttcaaagtcattttttgaacatgagcatataaaatggacaattcttatgctaaataataattaaagaaaacaactacttttaagaatgagaaagtatttcattgttaaatagttcatgttttaatgtttagatctgcaaatagtaaagtgttacataaatgtttgattttatttaactcagatactaatttggcctttttgccaagcctgcttttaattgctttagaattaccaaatgcctgccatcaaagagaaaatgcaagtaatcagaccctctgtgagcacagcaggtgcaggagacagaaagcagaggatgaagcccgtccacaaattcctctcctagaaagaaatt

SEQ ID NO: 41956 - DNA, 1956 bp, Bovine  19866880275892
cagtgttcttgcctggagaatcccagggatgggggagcctggtgggctgcccatctatggggttgcacagagtcggacacaactgaagcgacttagcagcagcagcagcagagttaacttcctgatttacaaatagtcaaggtaagaaagtcagtgaggtatcagtcacattaaaacattacatgagaaaatgtgtgattgcttcaaaagattcaatagaaaaatatgacaaaattctgtccccattcatggctaaagaataaaaatcatcttaaaaacaaagtttaacaatctggatgtagtatgaagaaaacctaaagcaaatatatttaaagatgcataattattcttttcaaggaaaagaaaagagtaaccattctcatcatttgttaaaaattcaaaatcttattgagaattctaataaatataatgaaacaagtaaacataaagggagtaagaatttcaaggggaagaaaaatatttcattcacagaagacaaaatgtagaaaagccaaagaatctattgataagccattgcaactaataaaggagttcactaaactgttgatacaaaaaagtcagtagtattcctgtaaagcaggaacaactaataagtgtaataaaataggctagagatttgtttattctcaccagaaggacatatacaagtgaatggtattggctatttgtcttagaaagttattaaaccttttggttttttatttacatatttctttcaatttgttataatgaccattgtattttaaaccaaaagaaattgttaaccagaaacaaatagactgtgggtttatttgggatcagtagagacttgcaaaacagagtctgcaaccctggggagccaagtgcaagttcccacatggggaggaggatgcttttaatggaagataaaggaaggtgggagggcttaataaacagaatccttggcttttcattggctgagtctttgccagaaaaaaggaggggtctttctgtgcttcaggctgtggtctctgggtgtgaaagctccccctgctggcctcccagctctatttatttggggtttctgtttattattattattattattttttacaaaaacaaagcctctaaaaataacgtcatgactaagttccttatacaagacagtagaagatagttaaattgccttaggagaaaatacaactctttgcttatccattcgtggacattcagtgataacatgaagacatggtcaatagaagccagagaaagggacctattagttatttcatattcattctgggtttaaccaaagtctgggattctgttcccacatttatccaatatagcatcaagtcatcagatttaatttagacagactattttagcccagtaactaaaggagaacgtttcaactggtaaaaatttttaattaaagtaaattagacaaatgtgtaggttgatggcattcattaatatttttacactgaaagtaatgtcttgccaatggctttatttccaaccatatttaaaatatatgcttaggcatgcactgaattcatacatttttttcttagagtcaggcaacattttttcagaattttgggtgccaaaaaataattttatctatatgtgtattctgaaaaagaaaacaaatcattgtttagttatagatatagctatctgtaggtcaactttctcaggttagaagttaacactacctttgttctgcctgtgaacaaaatttcaaaagacataagaatgggtgcacaattaattgctaaagaatgtagtcactagtgacttgaaactttagtctttgaagtctcagttacttggtttctatgacattaaaaattggctttatagatgaaaatatgtggaagctattgaagtgagtggagaaccttaaaaaaaatgacccagtcttttcgaatatattttaaacatattccatagagatgtgaggactttaag

SEQ ID NO: 41957 - DNA, 3058 bp, Bovine  19866880551104
aaaaggaaagataaagcatctgaatgcagagttccaaagaatggcaaggagagataagaaagccttcctcagtgatcaatacaaagaaatagaggaaaacaacagaatgggaaagactagagatctcttcaagaaaattagagataccaagggaagatttcatgcaaagatgggctcgataaaggacagaaatggtatggaccttaatgaagcagaagatattaagaagaggtggcaagaatacacacaagaactgtacaaaaagatcttcatgacccagataatcatgatggtgtgatcactgacctagagccagccatcctggaatgtgaagtcaagtgggccttagaaagcatcactacaaacaaagccagtagaggtgatggaattccagttgagctattccaaatcctgaaagatgatgctgtgaaaatgctgcactcaatacgccagcaaatttggaaaactcagcagtggccccaggactggaaaaggtcagttttcattccaatcccaaagaaaggcaatgccaaagaatgctcaaattcagttcagttcagtcgctcagtcgtgtccgactctttgtgaccccgtgaattgcagcacgccaggccgccctgtccatcaccaactcctggagttcactcagactcacgtccatcgagtcagtgatgccatccagccatctcgtcctctgtcgtccccttctcctcctgtccccaatccctcccagcatcatggtcttttccaatgagtcaactctttgcatgaggtggccaaagtactggagtttcagctttagcatcattccttccaaagaaatcccagggctgatctttagaatggactggttggatatccttgcagtccaagggactctcaagagtcttctccaacaccacagttcaaaagcatcaattcttcggcgctcagccttcttaacaatccaactctcacatccatacatgaccacacaattcagttggtttttttaaatacatttttcctgggttgctgcaagtctttgattaatttctagagttctaaaaatgttgattctaaaaatatgtgccacattgttatttttcatattacatttatgaagggggtgattttggggttccttactctgccattttcactgatactacaacttttattgcagcttttgttttaaagctatagtttttaaacctgagttataaaacagtcatatgtaactaccttccctttttattactttcttttgtaggatatgcttacatgcatccttaaaatgaattaatatttcagttaagaaaaacaattgagtctcagtatggcgggctaaattatgcttctctgtaaagtcatatgtttaagtcctaatcctcagtttcctagaaaatgaacttatttggagacaaaatttttatagaagtaatcaagttaaaatgaagtcatcagggtaagcccaaatcccactcaaatagtgtccttacaaaagggccagtaacttgtgctgaggagtgacactttaatactagaagcatttattaaaagtagaaaaaagaagaaacatttgaactgaggtaagtagaaaataagaggaaaaattaagaccagagaagaagtggaatgaaactaaaagctgccttgtatcatgaaagaataactcatgtataaaaatattatgaataaattaagatatggtgaaatttaaatatcatagcttaatatactgaataattttatataataatcttgtaatgaataactatcaaaatgtaagattctaaaacagacttgattaaagtatttagtaaactaataattaaattttcctgattggtaataaaaagtttgttttgctgtttccttccttgccaaaagtaagtaccagactatacagtttccagggacaaaaacactttacatattctttcagggaacattaataggaaaaatctgcctaattctttgtatgtgtctattataatcttagatggctaacttaataatgctaaataataacaataatgctaaatactaaatcacaaattttgtacaaattggaaaagacaaaggataatataagaaaattatgcacattacacttatgaatataggtgtaagtgtcccaggaaaacatagtacgaagaatagaggggaactttcttaaccttagcaagagtagctatctaaaagcggcattcaatacacacgatgctgtatggtaaaagtttagagagagtctctgtacaaagtcaaggagaattttaattctcataaacaatttttatcttactagatcacagaaatcttagtatatggttgatcagtgaagtattgctatgaaattactgaggagttgctagaagcttttctaaaatcttccttatgagtaaattcagaataactgagtcttcactgtgttccttttgtatctcctagacaatactatttttgcttgtttaatgaacagtattgtttaaattttaaagcaaattgagaaaatgcttggtaattaaaatcaaagcacatatttgtcaattttttaatcacattacaattctaaaattcagtatgttgtgttagatcactgtggataatgtatcattcctatgatctaaacaaatttatcatgtcagtttctttcaggtttggtatcttggcaaaataagttgtgatatagaattatcttaatactttgtaattaaaatagttttctgagagtgcaataagtatacatgaactctgaataaaaaggccaataatttatgctaagattaagaaatacccatacacacaaataaaataagtgtatatttttgaaagctagttactggaatgcagttaaatttaattcttaccaagtaatagcaataatccaaagaaaacttctgaacacaagttgcccagactacaaaaatgtaagccattatagaacatgaatgaacataagatattattgggacattttaatattgtattttcagtgaaagtatatgttatgctccatcaaaagagtccacatgtgttatgtgtaacccagcggctgcgggaattctgaactggt

SEQ ID NO: 41958 - DNA, 1301 bp, Bovine  19866880835329
aattcagttcacagctgtcaggattacccaaattgtaactgctcttaagtgaaggcatttgtctgagaaagatgagatgcaattttcagaaccagtggtttatgggtacctcccagggtaatgggctcttttatacctggagtttatcttcctgaaagacaaataagagctttgggttttgctgttagtgtaagagcagaatgtgtctgctgatcatcaaagaggatatttgacatctcatggacgtaccccattgaaggcctttgaggagaatattcattggcttgttctcttcgagatggagacagattgggtgagctgtccatggggctatttgtctaaaactgtcggccactgacagctcatttctaccagaacacatcccatggaagggttctgaaagcaattcaacttacctctgggaatggcactattgatcaagctgtggatggggtgaaggtacctgcccgccttggatgaatggctttattgtatcttgtgacaattgatttcccttttgctgaggacacaggctggagataatgtgagacaactgtattaatgaccaagtggcttttaacagatgaatgatggtgagggagtatgtatggataatcttacagagaacaaataatcttgcttgtgaaatacagctggaaacgtgacctcttttacagctgaggtcctcactcctggctgaggctggacaagctgccacagcatttgtggtacaaatttagggtttccttgaaaaaaaaaactggtgaaagaaaaacatgtggaatttttaggaagcacagcatttttttaaaagtatttttaaaactattttttaattggaatgtagttgatttacagtgttgtgttagtttcagggatagaagagcaaagtgatttagttctatgtacatatatacatttctagttttctcagattctttccccatataggttattacagagtattgagtagaattccctgtgttttacaggaggtccttgttgactatctatttgataagaagcactattttaaatggagcccctaggaagccaaggacgggagaaaacggccctgaggcttgactgggcagcaggcactttgcatttaatcctcatgacaagtctgggataagcatgatgacctagggataagcatccttcatcctaagtatgtgaagacaataagcaagtccaatcgggggacagggggttcatctggagactcgtgtccagctccaaagccaggggttttccatgatgcttctccagggtttagtctaagccgacagctgcacatg

SEQ ID NO: 41959 - DNA, 1533 bp, Bovine  19866880893099
cctctccccacagactgcagacccacagcccagttgatatatccactaggatgcctaatgagcaactctgatattcagcatgtctaaaagtgacttctcttctttcactccaaaccttctctacctgccttcactgtgacaagcaatagcttcagtccatgcggctgcagaacctaaaaccttggaatcattctccatgcctccttctttcagactcatactctccagcctggaaattgtgttggctctgctttaaaaatgtatccagaggccaataactgttaaaacttcctactgaactcctcctacctgctattacctctgacctagatgacagtggcagccttctaactggtctgccagcttattctctcactcagtccactctgaatccaacagccaccatgactgttgatatacacacccgatctggccacttcactgccagtgccctactatttacagtttcttaatgtgcccgatgagatctgggttctggcccttcctgacttcttctactaccgcccccttactctgctgcagaccctggcctttgttcttccttgatagacacctcagtcacatgtctgacatggagctgttactctgtaatccctttgactggaaaacagtccctccagacatctgcacatcccctcatctcctccaagtttctgctcaaatctcactgtgcaaggaggcccacccagagctccaggcactcctgatcttaccatgttttacttttttttctcatttttgcattgacttattaccttctaagatatgatctgtctacctattaggcttgtggtttagcgtccatctccctttagagtgagtactcactggagaatctcagcctggggcgtagacatataacagatactttgattctctccttcaaacttctctgctctccttttctatgatgctgtacccttatctcatcctctctctctgaccatttcctttctgttctggttttatttttctattaaatgtaggtttttctccgttgaactgtttattttagcaatcaatttaagtaagtaaagaattgtgtctgaagttctttgaagtcctcgcaggaccctgaatattgtgcacaggaaggagatgtgttattaaagaaaaaataaatagaaatatatttttaaatcaaattctattggggaaaaaatgcttacttttgtgtagaggacttgtaaaatgagtcttttgcactatatttcttgtttgattgtaaaactggttctccattatcctagaaggggtgaataatgttaaaaagataagatataaatgagaattgctaacgttttctattcatcattctttcttttctcatctttctgcatttttcttctttcaaagcatctcttggatcaaccagatttaatgctttcctactgtcctctattatcttgaaaatttacattgtttacacacacacacacacacacactgctactgattacattaaaatttacaaatatatattattctactcatctttttaatctccctgat

SEQ ID NO: 41960 - DNA, 2028 bp, Bovine  19866880895318
ttttaatgttaatggtgccagtcagaatttgatatttctgatatgcaaaggaactactctgagagggaggttcatgggtcatgtttattttcttctttatgcttctctgcttttactaaattcacctatttagtattggcacaggctctgggatgaagaaaacactgtgcaatttaagtgtacatgaatattggccaacattccactattaaagaaacattattgtgaatgaaagttattgctttaaggaatgtggccatgagagctgcaatgatcagagcatggggaggtgggaaaataattgaaaggacctagcaaaccatggctgcataatacaagcaagtgccagtggtgggaaataagagctccaagccctgctcttgtcacctgaaaagccctgtgagctgcagccctggcctggcaggaagtagaaaactgacactaaggtggatgtcagggtaatagggaaagatggcctcatcagaggtcatgatgtttctatttcaaacacagcagaggtgctctctgtatagctggtacagaggataatggaaactagaaatacttaagagcattgccttgtcttgctttcctctcttttattgtgtgggccaggggcacttgctgctgctaagtcgcttcagtcatgtccgactctgcgcgaccccatagacggcagcccaccgggctcccccgtccctgggattctccaggcaagaacactagagtggggttgccatttccttctccaatgcatgaaagtgaaaatgaagtcgctcagtcgtgtctgactcttagcgaccccatggactgcagcccaccaggctcctccgtccatgggattttctaggcaagagtacttggggacatagaaatagaagtagacacagatatagatgcacaaggagatgctgatgtagacacagagctgggggcacaggtggggaaggagatgtagatgaagatgtgaaaacagacacagatgtggatgtacatgcaggtgcagatgtactgtaagtaggtacagagatggatgcctcaggacctgcttgtacgtgcctgtccagcctactctccctcctcattgtagatatctatatatatatatattttctgatttgtatatacatttatgctgcttcatgctcccttgccttttcttacactgtttccttcacctggaaagctcttctctccctctccaggcaacttcttcaagagatagcccagaaggacacttcagaaaacctttcatatactcttacagcagatgggttggcgttctgtaccatttcctgatccctgcattttgctttgtcttggtatttattacacagtggggattagtgcctttttgcttaggattagaattggtggcaggcgggtgagcataataaaacggttttcaaattgggtccagatttctccaggagattgctagctgacacctgatcaagccaggagcatttagtgcccacatatgggcttgtgctcataattgcattggtgccaaggaatgtttctttcactgtcaccggctaatgggaaagtactagggtgaattaacttataagagacgtgcttgcatctagagcaggctggatggcaccgcggcacactcactaatgaagtttcacagtcgttccaatacagggaagtgaggggagacgtgaatcattgcggacacagggccgtagacacagcgatgcaattcaagacgacattctctgccgcatccaagtacaattcaacttaaattatatcggttttgtgtttggtatgttatttgtaggtgttttccatgtcacatttgcatgagaactaaaggaatttatacttggccttaatatcttgtgagaaggctgtgtgagcccttcccctccccataaaagaagtttgagaaacacaacccaaatgcctccttttctaactgctgtacaggtgactttgagaaaatcccttaaacattttaaaccttagtgttcttcttggaaaacagggataatattggttcccactttatatagt

SEQ ID NO: 41961 - DNA, 1654 bp, Bovine  19866881079303
aaatgtatgaaatagcagcctggcagtgaagaatgcagttgatccgggacaggcagctggagagaggtaaagacagtggtttcccgacgctgctgcgcctgacaactcggggatttttcaaaggtaccaacgcctgattcccacccaccagacatgctaatttaattggtaagtgctgtgagctggaaattgttttttttttttttttttttaatctctccagataactctcatgggcagtcaagtttggaagtctctgtttcaggtttcaggtttgttggagggacctgggtgagtgaactaccgctgccaaattctaggcaggacccttcaggatttcttggaatcttctcctagaattgcagctgtatgtcagagtgggagcaaaaagtggggcaaagtcattcatatgttatatctctccctgaattcatcaaaggttccatgcatgttatgaaggaaacccccttcctctgcgtgagagtttttttccactgcctctaaaacacctgcagaatgaaaatgcctctaaggtcacagccttccatcagagcagtaagaagccgagatggaagctcggcaagggctggatctaaaacaccattcgactatcggtgctttacctgtggcgtacaggttactgatgttgaatagtattctacgtcatgttctaataatgagatttattacatcatgtctaaaaataacaaacatgaaccagaggactgaactaatgataagctgcttgggcttgagaaacgaatgcagttgcataataaactgccacctatttgaaaatgaaagtcctcacccacgctgcttctagaatctattccatttaaccctttttcagggacaacaaaggggaacttttttccatcttaagtgcaacaagactagaggagagcagattctgggggatgctctatagacccatggctgatgggtgataagctttttcagatgaaagacactgaaaagtacaggctctgagagaatttccaagtcagctgcatgatcagacccattccctcatttaaggaaagctaagggaagcaggaacccatttaaaaagaagtcgtcttcatgtctgtctttgctccatagttgctagtcttctgaacaccttctgtggcacccgattcccaaaataagcctagggttgtccactatgggtaactgaataaattactgcctaagtttataactaactggcttttctcaacaaagcataataaaatagaaattaaataacttgaaaaatataaggaagtttagtaaatcagttagagaaaaaggggctcagatggcatataattaaaagataaatagaaaaataaaggaaacatggagaaaaccatgttatatgtagattataagtcatgcatacgtggatgagaatgccaacaggaacaggctctctgtctgtaacacaggcccgaataatcctcaggagcccgtaccctttgtgacacttacgtgggctgctttatttaatctcccaacactccaggtccttggtcctgagaccatgccatggtagagatgtgggcactgaggcttgagcacaagtctaagccatgtgcccagagacaacaaggctggcgggtggggaacctaggggccccggaaggccctaaacccaggctcccag

SEQ ID NO: 41962 - DNA, 743 bp, Bovine  19866881157138
caccataattttgtagcctttttcctaattaaccctttcaaagctctgaagaaactgactaagcatttgggaggcagagtttatttttatgttttaatctacactggatgattcagctggaaatcaactaattcaatcactgtactttaaatgaatataggctctgatttctggatgatgttattataaataccaaccaaatacagagtgaatcataatatttccaaggtatttaagcaatcaagtcccagaggcaacaggaaggaaagctatgtgatataacacatccaggacacagttgttattagaaatgtgatttctgcttcagtggtgcattttgaggatgctaaaaaattacagtgaaagtttgagaaaataatcacatattcttaaggtcaacagtagatggaacagattttaaataaatgcaaggatgtaaattaatccccagcatagcataagtgtcatgtcagtatgttcgcactgaaagcgtgctgggtgcttgtgatgtgtctgcatctacatgttggctggtgtgaatgattggctgatagaaggccactcccaagttcaaagaagggctgaacaaacactaagttcctttcagatattcttacttccgactgaaactgccaaaaagcaatcctgctttaactgagtaactctaacaaggcagttaatatcatatttaacttaaaatcaggaaacataatatagaggcatgacgttcaaaatcacatatg

SEQ ID NO: 41963 - DNA, 1370 bp, Bovine  19866881222036
aattgagttttcattttttggtaaaaggaacaaagcccatggccttcaggtagatacacactataagcacctccttggcaagattcagcacatgtcattggaagatatttagagcaggaggtgggatgcggtgtttcaagtagtgaattactaagtcacttctgaattcaaagaaaacaaaatgggagttgaagaataaataggcttccaattggctgctaccactaaaaaataaacattttttaaaacaaaggaacaaaaatttcaatcaaataataaacaaaaaatacttgtcagatataaagacaatcatctccaagaatatgaagcaaatttgcttcaaagtgacggctctgaggtagatagaaagtacatgaggagtaagagataaactcttcctatttgggaatgctaaagtgatttctatgatataaagtgatagcatatgttaatttgttatatttaattatatttttataaaatttaagctatcagccttatgattatgtttctactttatttgtttagattacatcagtctttgaatccaaagccttgaaaccactttatagacttataaattgctaccttcatcaatttgacaccaaatatggttgggaaaaaatggaatatgaattagataatgctcaactcttcaaatagctctaaagaagaaaacctaggtcagttaagagaactttcttaactgtcctggaactaaatctggtagctacattctcaccagtaaaattcttataagcattcagctgatatattcatttcttctttcaattagagaagacaaaaatccttacagaaataaaacagaaaccaggtcatacgacttacccagaggaagggctgcaagtggaagtaaatgatttctctcttttgttatgaaattacagtcttgatattttaagcattacacggcatatgccactaccatgaggagcacatattatgaacttaccagaaaaagatatcctttgctttctttgaagtatctctggagaaataaatattttaccatggagacaaatagattctaattatcagctctcccaagaaacagagtctccattacttccagcaaattcctgttctcaaagctgctctgaccagtaaaccctgtttatcctcagacacacccattagtgcctggtcctagggtagtgtagtcaagagaaatccgaatacagtttgccctctatgttcatgcgtgcatgctcagtcatcttggttatgtctgagtctctgcaacccaatggactttaccccaagaagctcctctgtccatgggattctccaggtaagaatactagagtaagttgccatgctctcctccagaggatcttcacaacccaagg

SEQ ID NO: 41964 - DNA, 1050 bp, Bovine  19866880393709
tctttcccattctgttgttttcctctatttcttggcattgatcgctaggggatcatttgaccccaattctcaaaataggaactgtctgtacttttccagaaaaaactttgctgactctgatttagtatgctgatttctctaattttctcagtagaacatatacatcaaaattaagaaaagcaaaatgcagacttgccatctgtcccttggacagtcctgtttcatggctgtggagcagtttcagcctgtgttgagtccatagctttggggtggggactccctgacccactgcacatgtccttctagtgaggcctatgtgggattatttccttgttcactgtctctcattcattctgtgcattgttgtaaataacatttcccaaaggcaggctctctcattagtaatgacagcacacatttttctcagggtttattttatttacatctttagagtatttttagttatgtgcccgtgttaatactgtaatttaaatagggtaataatttaaagaaacaaaatccataaagtgatactacaggtgtaactacttgccatgtagaacagattgtgtcaatattcataagcaaaactatcactagcttcccattaattttgatttgaagtgaagatggtgctcaatcatgaattatgcctggagaaaaaacaggactgggttcatgtcatgaataaaaaatggatatctgtatttcagtgcattacacagaagcagatattaatctttcactccttatcatgtctaggtagcaagttttggtctgaatcctttaaaacaaaattagtgatgtgctaggaacctgagaaatcctcacagactgggcttcttttcagtctctctttctgggtctgtttattaataatgtcactgtaacttatctagctcacaaagacagttattctttataaagtcattgttattttatcaagaggcttacttttaaagtaaaaatgttttcttagtgatgctgcatataagcaacagataaatgtgactccatagatttgtggacttttaaataaagggagagaaa

SEQ ID NO: 41965 - DNA, 5529 bp, Bovine  19866880499010
ccagtcaagtttctttcagtgaaaagaaacagaacctcgatgttcaaatgctaatgagaagacgagctttaaccggagggtcctcgggcgcccgaagtccctgaggaagggcggcaggagccgggagctccgtgctgccccgatgcccgcagggtctcccgttacccgctctgctcggccgcgtccccgtctgtctccctccgcagcggcagacagcgtttcccattaacgcggccagtcacagcgaggccccaccagccccagcagagccccacccggtcgtcactccccacgcaaggagcccggtgtccaaacacgcactgtaactgcgcttgtcccacagtgcttgaccttctctcacgctgaacttctgagttcagtcgaacaggtgctcatgccttttgtgaagctgccttgatttctgttggacagcttttctttcttagtgatacaaaggcatttaataacataccacgattgaaaccatgtaaacctactttggccacctgatacgaagagccgactcatttgaaaagaccctgatgctggggaagattgaaagcgggaggagaaggggacgacagaggatgagacggttggaaggcatcaccgactcgagggacaagattaagttcggcgagttggtgatggacaggggaggcctggcgtgctgcagtccatggggttgcagagagtcagacacgactgagagactgaactgaactgaaatagaaatatgtgcaagcaaacaagactagagggaagactctaaaattctaatttatatttaagagatggaatttttctaggctttctatagtgccttttcaagtgttttgtaatatgattattttaataatgaaaacattttatttgtatgttttaaaatgattttatatttttgtaaatgcctaaaatgtgtctaattctgaaatgtgactaatgtaatctacattttggtgattaaaaatagcaattttttaaacaaaatcttttctccctgaaagatatgaaatgtatcttgtcctatttataataaaatagaaaattactattaattgtgaatgtcttaggactttgaggatttaaggaaaatcaagttaatagtttcataatctaacttcagtgatcaaagggctataacctaataacgacaaaaaacaagacctgcgcatgtgaaatagtcagcataaacgcatatagcatttaactgtatgcttaaaaatggttaagatagggggaaaaaagtttcccttagcaaaactgttattgattaactctgagcaaggcaataaaaacttccaaagagattagacaatgaaatttacaatgttaagaatattaatgatcaccttggataaccatgtgagcaattttccagagacaactgttagcaattaggaaaactaaaatacacagataagcagttctttctctggcttgttccatcaaaaagcagcctttagagatggatctttattgaaacagacttggttacctcccattttgccagggccatcagctggaggttcatttcttaggctgagacacactctacaaagtacctgccatgagattaccacacaaaacgaagtctgagagtctcagtctttgaatattttcaacagattcaggttgtttgacgacatatgtatttggatggtcaagagtttgcaagtcctacagggcagtgggccccaacaccagggaccagcttcgtggaagacaaattttccatggactgggaaggaggggatggtttcggatgattcggacaatacgtttagtgtgcactttatttctgttgattattacgtcagctccactgcaaatcatcaggcattagatcccagaggttggggatccctgcttgagggaacagattggtggttgccaagaggtgggggaggggggatgaaagactgggagtctgggatgagcagaggcaaactgttacatacaggatggagagacgagaaggttctaaggttgttagcaggaaaccatgttcaatattctctgatagacggtagtggaaaagaacatgaaaaggagtgcatttagtgtatagctgaatcactgctgcacagccaaaattaacacattatagattatatacaaattaacatttttatacattaatattatgctgctgctgctgccggtgctaagtcgcttcagtcatgtccgactctgtgcgaccccacagacggcagcccaccaggctcccccatccctgggattctccaggcaagaacactggagtgggctgccatttccttctccaatgcttgaaagtgaaaagtgaaagtgaagttgctcagttgtgtccgactcttagcgaccccatggactgtagcccaccaggctcccccgtccctgggattttccaggcaagaatactggagtggggtgccgtttccttctccaatgcgtgcatgcatgctaagttgcttcagttgtgtctgactctgtgcgaccccatggacagcagcccaccaggctcgtctgtccatggaattctccaggccagaatactggcgatattaacattatagattacataaaaattaattatatagagattatataaaaatcaacactatacttcaattttttttttaaatttcttaaacacacacacacataaaactgtgagcaagtcctgggtacacaatctagattcagatacaggaaggtctttccagagaagacaagacctgggctggctctggaggaggggagactacaggctggcgggtgacagagaagggccacgtgccaccagttaaaaataaatgacagaggagcccacacaaaggccagggagggacgagtgtggagaacggcaaaccaaccagccaaattaaggtcaaggacacgcgtaaggcacgagaagtaagggccgaaaggcttgagtctgaaggcctgggtccaattctgaatttaataccagcagtgggcaggtacccagtcagttagtggggacagagcggtggctgcaaagatggtcaacgaaaagtaaaggaaggataaagagaaacctcaagttctttagaaatgagggtttcctattcctgaacgcaagttacttacggacgtgtgtcagtagcagcatggtgaacgctgtctataccaggtatgatgaattttcctgactctaaaactgctcccaaaggttttaatgggttcatatttgtgggacccatttctgaaccagagagggccactcgcacattaaaattcagcatgccataccactgccgttagccattcccaggaacaggtgacggctgatggacagaaatgcgcttatcgaccggaaattcccaggagcaagtaactaacccacgctgggggcaccatgggagaaagcatggcagcactgcattttagcccagcaggaaagtagtcagatcattctccctgattattaacaggtcaatgtttagtccaacagctccaatttgtagtggaatttttgacgttttctcctgaaaactgaatgtcatgttaaaggttttctgcatactattgtccacaaattctatgactattcatatttggtttagagaggtaagtgaagatttttcaaaatagggtagccagtttatagcttattatccttatcttttagctgaatagtatacatatgagaatacctgaacccaaaggaggcaatttacccaaaggaggtgtgactttctgtccaaatgctagatttagtaactactgtaataatagggccggagaattgatgcttttgaactgtggtgttgaagaagactcttgagagagtcccttggactgcaaggagatccaaccagtccatcctaaaggaaatctgtcctgactattcattggaaggactgatattgaagctgaagctccaatactttggctacctgagtgaagaactgactcattggaaaagaccctgatgctgggaaaggttgaaggcgggagaagaaggggatgacagaggatgagatggttggatggcatcaccgattcgacagacatgagtttgagcaagctccaggagttggtgatggcaggggaggcctggcgtgccgcagtccatggggtcacagagagtctgacagaactgagcgcctgaactgaactgaactgaactgtaatcgcagggcaagagagaagacgtttagatgaaaaatagtaggttaaaaaaagatattcacttggctttcaggttcttggtggaactaatagctttgacttaaaactaatactcacagagatagaagtaagataatctaagcactccagtagacatgataagaataaatgagccaagaaaagaagggaggagagaggaagggagagaagaggaagggaggggaagaataaagggatgacattagacccccttgaacaagtatcacaactcaattacctaatatctgtagacaactgaaaatcttgtttgggaccatgtactgtttatttatagtctgaaaagtctttgcattaattcttgacaaataaagacaagatgctcaagaaacagagggacacggaactgcacagtgagagagatctatctacacagaagccatatttacaagttaacagccctcaccaaagcttaaagtccccacattccctctgcttttgaacttgcagctgtaggttcaagcctggaagatactttactccccccacacggcatttcttctccccctgtgcatttgtgtacctagcggacagctgttccaaagcattcttacactcttaaaagtgtacccccaacacatacagaaggttttcagtctcaatccatggcaacccttgcacttattttccctaaagatgagtttcagagttatgtaataatgaacttcatccttttgtacaaattaaaccaggagtcataaagcagtaggtaaatgaaaaactgggttaaacaaaccaaaaaaaagaaaaccacacaactgaccaaatctatagcaggctcagctttttttgagagcgagagattaaggggcatgcagtcaactggtatgaaggtcaccaaacaaaatgttgcaatcttaaagtgccattgacatgcagactgtccagtagcagcttggaacaatcttcccctttgctaattactgtcttagcccaaatcattcatacatgacaagggtatgctacatttacagtaaaacatttaaaaaattaggaacattcttttccttactttgaaataaaaatcctgaatataactttttaaaattatattctcattcccagctttttgttaaagtgacccaaaggctcaaaacgtccaccattggtctctgcatggtagatatgggcttggacaaatctgtcttttcctcactcactgcctgcctgctgaccatgttgaaatcaccaaattgtctcagttggaaatcttctgattttcacaggaaaaagctgaaagccacaagccaccaacgaccacaggtacctcgcgctttctaagtccgtgtcagaaggaagcgtgcgacacaggggacctccgcgcgtctccca

SEQ ID NO: 41966 - DNA, 3570 bp, Bovine  19866880517654
tggagcttacttttttgtaatcagaggaaacagaaggcaaataacccaatagttcaaattcaggttcgtatcctgttcatggattataaaattgacttaaccagtctcagacagctttcatgatcgtttctttgaggaacaagctagaataaaataaagaaagtgggcctcactctaccatacttcttaagtgtgttatttcatgagactgccatttctgttgtatgtgagggcgtaaatcaaagttaaacacttcttgttatgagtttcaaaagtttgaaaaatggtgaaaaatttaaaataaatgaataactgaaacgatttcaattgcaatacctgctgtaaaagagctaaagagtgaagatagaaaaatcacaaaaagatgccaagtgcagggaggcagaaccaacgttagctgtgtggccacacatggtctgtctgctgaagggccccaccacctgtccccagccaggacaggggctggcataaccgaggagacaagccttcccgacaaaggaaactgcaagggcaacgggctctgttgaggcgtcagtaccccgcggggtggcaacccacatggcgaagaaaaaggacagttcatctccttcctccataggaaggaaaattccagaactttaggttgatagagtcacaaagacaaaagggagacatgagcctattccataaacacaaagaggtctcacttcaaagacttggaagatcctcaatttaaggaactcgtagtaaagaaacatacattcagttaaaattcagcaaatatttattgaggttttactacgggcaaataatttacttcttggcaaataattactctaaaggtgaatttgaagataaacaggagtttcaagatataagtgtaagggtctaaacacacatacacacaaaagccaaagatcgtaatttacctgttaataaaacagctggccctttccttttcgagcatattgattccacatgcctggaaatttactttcctcaatttggctttataacaaagacttcatttactccagaagagtctctgcctaacagaatggtttctgcctaattagattatctggtctgctatttatttagaaagatagagatgttctgtatccaatggtgatttttctgtttcagggcctcaacaaagtattgtgacttagggcctctgttaacacctgaatcctgcaccccaaggctccctgcttctttctgagaaccccaagttcaaaagcagcccttcgaaaggcattaagcctgtgtttgtcacaaacttccggtggctgtggtccaggcgagcggcattatttcagtgtcccccgtctccctgccacctcactcagtccgactgcccaagctccgtgacagccccttggagcatcctttaccttaccttcctgcggagttccagtctgcaacttctttagcacccagtctcccactttctctgccaagtgggcaaagaaattcacagacgctgcagcagtgaccacaaaagctatttctgtagttgacaacatagacccgtagtcctaccttgacaacagcagactgtggagtcataggcctttggcgagtggtctggaaactccagagatgatatttatacgttagcttaaaacaactagaatccagtaaaaactttaggactggacagaacaaagtcacagggaaattcttgaaggattctttaagcacagagtttaagacacagttttgcagtcatatcaagaaagtacttcgtattctttgaagcggtaatttgagaagcttctagaacacttttgaaaatttttcgtaaagaaagaactcagaattcagaaatagatttcaggtcagaaatgttatttgtggcattacttgtgttcgaaagtcaaccaaatatccttcaataggagactgttaaatatttaatgctttatctatatggtgggtgtgtgtgtggggtgggggcgctgtgtgtgtgtgtgtgctcagtcgctcagctgtgcccgactctctgtgaccccatggaccacagtccattaggcttctctgtccatggaattttccaggcaagaatactggaacaagttgccatttcctactccagggaatcttcgaacctgggtctcctgcatttcctgcgttagcaggtggattcttcaccactgtaccgcctgggaagcccatgtctatataatggaggggtttcgccttcaaagtgctatttatgaagagagactcacataacaaaatggttaatgttagagggaaaacaatacaaatcagaatgtacgtacaacttcatctctattatatttgcatagaaaatgcataacagatgcatagaaagactagaaaagaaataagagttgagatatctagatatattataaatttttcttatacttgtctatattattagtatctttctacaatagcatgtattccttttaagttctaagtaaataacctttaactcaaacattatcatgttatttctccccagtaaatgtaaaaataattcatggtttcatgtagtattcagcatacgtatagtgctgggtaggctattaaaagttgcttgcctacatccatgagtatatacttgtttagtttcatcacaaatcattgccaagtaataaagcaacatgaatattttataatttattgttggttatatttataaagcaatcaagaagtctcatacaagattttcattttttattgcgaagaaaaagagaaggctctagtaatcgtggtttgctttaaggatgggacctttatttagaacaagatgttataggataataaaccagctcataataaataatatgcctcctgaattaattactaaattttgtgaattaactgtaggaaagtgcagagaactgtttgtatgcagatggattttagctttctgaaagtttcatcagccttccaagccctgccatggttacaaattacaaggtcatatatttgatctacaagagtaatgtgccaatttaaggacttttagcctggactggaaacagagggttgaagcctaacaaacacttttatttcactcaactgtcaaaccatttgctttgccttagggaaaaaaaatcaagaccagttcttctgatcaccttgaaaagttggtaatacatccacctccatccctagaggcccagttagtcagctaagagcaggcaaacactaagaaaacattcactcctctgttccagagaattttccctcgttcttgagccccatttataatttctgttctcagggagtatatatgacaacacaattatcttggcccgggtgctgtgcctcagagcgagggaccagatccctctggggaagactgttttgtcaaggacactgttgacagatccctgcatcctcccacgggtggtccagcccaggcctgtgatgtgccaggaaatgtagattcagggagcgcttatcatcacagcgatgagcctcctggaaaccagaattccaggtcactagtattcctcctgtgtgccaaagtaaacccaaactcctaatccccacatggcggggggttaatattaaaacgtagaatga

SEQ ID NO: 41967 - DNA, 1130 bp, Bovine  19866880529669
aggaggaggccagaggagggaccggcacgccatgcagacacgacaggcagacacgctaacaaaatcagccttcacgtgtcaactaaacccaggagatccagagatgggacggctccataaccatggagaacatcacaaatgagaacctaaacctttacatattttcccctccttacggcagtcactaagcctaaggaaaataaggttaccttccagatccacggactcaaaaacttcaagggaccaaaacaaacagacatttaacgttaggactggggtaactgagtcaactattttgaaaatgaaaaaagaagatctgaattacccagctgtagaaaacaccaagcactgtcaaaggacctgatggtgtaaacagagcctgggactgctgctctggatgaaagtctggctgagcataaacagcgtgctttcacgcagactgctggatttgatgagacacttaaatgacgttaacactgactcatcccacaggatgaagtctaagaaaattcttagaaaccagcggattatcttaaactattcccaagtcttcaaagcatgaaacatccatgctctatatccaaagacctttttatatcatgatggttgaagaagacactttccatcccaatcaaggaattactgactgtggcaagctaaaggatcagtcccttgaggaaatcccaacgctagtaaggccaaaactaacttgaatgcctacattttgaaagggttttctaagaattaaaggatcaattcttcaaacccatattttacataaaattctaattctgatcatagtatcaagcaaataacatgcgtgtgtacctagctctgtgtgcaatcaggtcattccacaaatgctgtttattcaaaatatttgatctaaaataccacgcaaaagggcttctaataaatctcctagccctcctgaccctcaccccctgcctctgaagttggaatggcctccaaataaaaagcaagccttcacagttttcctggacacaaagtgagcaaaaaacatgatttcactataccaggtgcatcctcgctccagtgttgcacaggaaaccgttcttgttctcgttctgagaaaagccatctatggaaactctatcgcacgctcgttg

SEQ ID NO: 41968 - DNA, 1535 bp, Bovine  19866880530815
tgacaacaggaactaatgatctgaatgccggtcgggttgtagaattgccttatttaccatgagagtaaacaaaggcctagggaaagtcactggttcaatgaccgatttaggagaaaaccagcctcttatttcctaaacagcacattaccttcccctgacatcacgtccccgtaggatagacaaagcagtattcaagtactgtagccaggtgcccctcatccaggaaacactcgctgaacgacatggattcgtggctgtaaacacacccgttgctattacagacattcattaaacatttcgtaaaccatctccctgttttctcagacttttgcgacaagtatctggatgaaaaacatgtctctaaagagctatccaagatatttaatgaagtctttagtcattctgcaagaatttttctgtgatgagcacaaaaagcaaggatcatttaatttaaaaccataaattaaaccattccatccaacagttttgttggagaaagtgctgacttagatatttggagatcttgtcccaggaaggtctgctgacgtgtttgatgctttaactggctgagacctgaattccaggtgactctttcctccccacttccttcagcttgctccattctctaaaatttaactgtaaacacattatcctctcaaagacttggctttcttcacacattgcagttggcgatcattccaccaagttctaggttaccctgagcttcagcacagagcattttcaccagatcatgaggaccctggggtttgaattaaagagccatgatcccatgatgcctctgtgaaccccccagaacaatgataccaaccctatattgtagatgaggaacccaaggctcaaagaatggcatctgcatgcccggggtcatcaaagggtggaagactgatctcaacccacatcttctgtctccagactgctgccatttctcaagtgtctggagagaccttgggtgagatcagggcccaatcgtaacaggagacagaatatccccacacctcatgtgaggaagaactcacagtcaaaattacatttgatttgaaagaaatgaacgtttattgaatcttagcctgtaagctgatatttacttttagtataaacaaacaagtatttattatgtggaaatgtttatttattgtcactgaaaatgtctttatgtcaatgaaagttacaacatagtggatcaattggccagaccagagtctagaaatatttcttgactctttatttgtcctaattcatttaaacagttaattttaagacaatgcttcattgttggacttttttatatcgcaaaagtaatgtcctcatcagtataagtaaaacactgcaaagatacatgaacagaaaaatcaaatctcttgtcttttggttcagtatttcctcagtatccttatccttcaaaacatatttatgcctatagattggacctgccttcctttcttgaaaaaatattatactaaaaagtaaaaagccataatttgcttttttttcccttgtaaaacgtctcatcatat

SEQ ID NO: 41969 - DNA, 881 bp, Bovine  19866880558101
tttcgttctttggagaaggggatgacagacatctttgagactctgattttttgaaaaaccacgtggacttacttcccagaaagtgtacttatataaatgcaagatcgaaccataatatctggggtttcatggagccttataaagcctgtgtgaagaactcccatttcaggcagtgggactgagtgaatggaaatttcaggatttggttggagagaaggaagaattctcaaagcgtttggcaagtcctcccatggagctgggttttttgtcatgggatttccttccccatcactgcgtgaatgggcatgtgagctttagatgctcagaggaggcgatctggatacagctgatgctgtttctagctgtgcatcctcagacaaattatttaccctcctaggtaccctctgctccactgagaagctgaggtcaaagctctcatggagtggctgggcttacttcatgacaaagggtgtataaaatgcctatcccagttctagagaacatgaagagcagaaatcaacttttctaagtaattctcgaagataatgagttgaaagagcaagaaaaagcccaattcctgcctgtgcataagttctttataattatgttcttttctgactcttaagaatatttgaggccacattcttgctttgcgtgggaagttacagtgaatgcctaactccaaatatgtaccagatttgtattaaaaaaaaaaaaaaaccttttgaaatgcattgaaaggtgataatatgctatcctaaggttttgtcttttttttttttaagcattctgaccaaagtgtgaatgaacactgtagaaaatgaaaggtttttgagatgattcaagtgttttcaagcagcagaaacttatcctaaatttct

SEQ ID NO: 41970 - DNA, 1451 bp, Bovine  19866880587911
taaaataatatccaagagaataccaacatttcaggttcgaaatctccaggcttccaggaatattcagaggtcatttcgctcaaattcctccactggggagagggaggatcagcaaggggaagcgactgtctcagtgttaacactgccagtgctgggagccacgtctcttttgttgtgagaatattaatagatatacaatctatgtggggctaaaataaataccatgggaagggaatccctagagctgcctccgtcggaagggcctggatcatcctcccagaagtgtttgtacacacacgcatagatatctgttcatcctttttttttcatagaagaaggaccatgataaaccctcgctggctcactttgtttggctcttggtttgaattctttcctattgatatattcaaatgtccttccttcttctaatcgggctacgtcgtattctctggactgcttctgtttatactttattaaagctctttgctaatgaggttctttccaatgtttgctgttctttcgcaccacaagccaagctgtgccgatcaaatatacttcaactgtatgcatcatttaatacacttctctctctcttgtttccgccacttttctggaaacttcctacactagcaactgctctccatcattcttatctgtcactttgctttagttgcctccacaggatttatcaccacctgaaacagaacgcatttgcttgttcactttttgtcgcttgtcgctgctattagagtagtaactccatgggattggaatcctttatacagtagtaactccataggatcagaaacttacctttattcgctgctgtgttcttaaaacagagaacagcgattggcttttggtaggcgctcaataaataaggaatcagtgaatgaatgctttacacatttttcctattggattactggtcttcgtcttactgattcataaaagctctttatacggcaattaaataagactttgccatttgtcttactcacatggtttccagtgtggtgtctatcacttcactttgttgagggaattctttctgccattgaagaatggtttaattattatatacttaagcataacatatttgtctcttataacttccatgttttgtgtcttggtttgaaaggctttatacactccagagttatttttaaaaacttgtctggtactttcgtggtttgttttctcgttggaatctttgattcatttggaatttattttggcaaaggtaggggctatgtaatcagctttgttattttttcccaaatagttagccagttgattcaacatgaattaaaaaacaattcatcctttcttcattgctccaaatgccatctttatcatatatcaaactcccataaatatttacatcatatctcgtctctagtctgctctgttaacttgcctgtcccttccttgggttgggactaatttat

SEQ ID NO: 41971 - DNA, 1648 bp, Bovine  19866880619669
tccgtcccggctggacagcctctgacggtgggacgggccgggccgcccagggctatgagctgtgcccccgccgcctccccacctccggcttgagtcagcttggcaggcgcctcaatacccggatgccatttcctcccccgggctttggctgccctgtgactgctgcctgcgtcgcccagcgtagcgagtgttcgctctgagagaaggctcgctcgccctgcctttaacacacaatgttcccgttggggcacgcgctcagcagggatttcagtgcctgcctcaggcactttgctgtgatttggatgaacgtgagtggagagtcagctcccccgagtgcagacctcccctggtcggggcgccctgttgtgttttcaaggacatctcgcagatttcccagacagcaggtaagagctaaactgagacgcaggcacgcttgtcagaccgttatctgtaccccaggcattgatttcccgtctcccttccattcacaccccaggcatttcacaggttacagcattcctttttttttttaacaaaatgcacagaggcggcagtgaggtgctgccccgccttcttaccacgcaggtcacgtacagtcttccttctccgtttggtctaggagctcctaagtgtgacctctccctccgtccctcctccaggtggcgatcgttgttctagggaacaagatcgacctttcggaacagagacaggtggacgccgaggtggcacagcagtgggccaggagcgagaaggtgcgcctgtgggaggtgacggtcactgaccgcaagaccctcatcgagcccttcaccctgctggccagcaagctctcgcagccccagagcaaatccagcttccctctgcccggcaggaagaacaaagggaactcgagctcggagaactaggactcgaagcgcgcccggcgtccttcagtcaggactgcctctaggtacccgtgaccgtgttcaagccaggcccgtttgtctgccttggtccttaggaagcctctgatgcgctttcagttatcatcaagttacttgggctaagttgtattgcctgatttgaaatcatgtatttgcaccctcattgtttgaaacttgtccctgaatcgagcacctgtgccatttacatcacgttgtacttgaataaagcttggctgtacgcagaggacccgagtagctctgctcacctttaacttttctcagaagcggtcatcctgggtcactttatgcagacttctaatcgtctcatgtctagggttctaaaatgacacctcacatgtgtccagattggatcacaaacagtaaacaattggagtactgagttaagctaaacttcatctggtggagatcttgctgaacagaataaagagcatgatttaactttgttgaaatttagcatgaattgagtaggtggtgtaaatacgtttacattgcttcttccttctttaggaagctgctaaacactagtaaagcttctgccgtgaacaagtcagttaccatataactacctgaaaagtaagcagcaagccactcaagtcgtttcaaccatcaaagcagttaagtattggttttaaatgtgaggtacgtggtccaacaacaaactaagatttaaaaggtccagtaaacagcagttacctggggtactttta

SEQ ID NO: 41972 - DNA, 2243 bp, Bovine  19866880654101
atggttggaaagcatcacccactcaatggacatgagtttgagcaagccctgggagctggtgatggacagggaggcctggcgtgctggggtcataaagagttggacaggactgagcgactgaacaacatgtatctatggttatttcaagatctgagcagaggtctccaaagaaactgggcactgggagggccctagcatctgcctctcacagtgtgagaaacaaatagtaacattttatttgaaaatttagagagaaaaccttttattagattgaattgatatacatacagaatgaatgaatgaaatattgagatgggggaaattgtgctcaaaccttcccactagggcttactcctggaaactttataaacaagatcgccgaaggaccctgttctgccatcatctagttatttgaaacgcatcctcagaaatgtcgtcttgtgggcaaagtcttgcaaaatcagcctccttgttcagatagactgccttccatcgctgtgtggttttggccttcttttcctgagcacccgcctattaattttccctcttgttgagcccagcctctctgcccacgcgtgcaggtgaatttaggtctgctatctcagaagtttttctctcgtttctcccgcagcggttctcagtccataaagggagcgagatctggaaatggctaagagagaaacaaaccttttccttatctggctggtctcacttctccagttttcctacgtattccattaagaagtcactatctccatggaaaacaatcagcatagctgtggaaatcgcaataattattctgaaacagaattccaaagctcatctcctagtaagccattaacgttttttgcaagtgtgtgtttataacctttaaacgaaatgcacattcatgtcttttaaagtttagcctgaaacaaagttaaagaccaaacaacaaaataacgtgtgttcaaagagcctggtggaaactccgcttggagagtccctgcgtggaaacgaggcagtgagcaggaccacgagctacgtctaagaatgaccgactcggggacaagccgactgctagagcactgaccacaggccccaaaggctggaaaagggctttctagagaacacagcggaatcttcccctgggaagggtcactggctttccataattcatactggatttaatcagagaatcctcaggtcagatgactccaacattgaggtaattattttaaaggccacagagattccatttaggatattaaagaggctacagctgtggcagaaacattcccattaaagagccacaaatgcacagaaaagggaacagatgtttgttgtcagggttaagtttctcctgtgtgaaagttcagatcataacgtttattcttgttgccagtctgaacccacaattttgaaaaaaacatgaggtcatctgtaactctggcctcgttttttcgttcccaaacttgaaatacctctttcaaaaggagggactgcgtgtgcatcttttctaactttggaagctaggacgggggcatcatttgtgggtaaagaacaaattttgagatttaccacgtaaaaagacaaaacatgactcgggtaaaccgaacaactttatacatcacgcttaaaggagccattacatgcagcagaacacacacattctattaacgaattacactcagagatgaacagactggacaagaatataccttggtatggatgaaacacagtcatacaggctgacagaggtcccttctcagggttttcatagaatctcacaaccgttttccagatattgttttgtgcacataagtaaggaggatcaagatcagtgtggacagtcccttcattgacggaggagacgtttcagtctggagaagctgggttttcccttttttcaggaatagcgggctgggaggtcacccacatcttccttaccctcgattatgacggcaggcaagcttcctcagggacggggagaaggcgggtacttgggggtgtttctgggccctcaggacaccactaaccacatcaaaaacacattgccttgtgtggtctccaatgtttcctctggaaacctggtttagcatcagccgctcacagctctggtccaacagcagacaccgaggtagaatcgaattgttttcaacctgcatgtcttctgggtgttaatctggtttagcctgctctacagtgtttcaagagttcaggaaaatcaagaggcggtgtatttccactgtctttttcatacc

SEQ ID NO: 41973 - DNA, 2736 bp, Bovine  19866880705266
tggctgaatgggacattgctggtgacccaacgccttctaagtgatgtgggaagtggatataaaataggcagcctcagaaaaagaccccacctctgtctcctctgaatcacggggactctgtgattgcccaccagggacaaaagagcaaagcagatggtgcaatttcatgcttttttctggagagttaaaaatatcatcaatcatgtacttagaaattggcagtcactgaagttctgagattccataagtcattaccagacagaaagttccttaagcaaaacaccacagaccaccaagcagacatcgttacgatttctgaatgtgtaggccatcgggggaacccagaacgttctttcttagcttccgtcatggctggtgtacgtgcttccgtgccaccagtcagaggcgttgaatatgagacctccacctgggagtgagggtctcgaggaggcaatgccatctcgctccgccgtggagacagcagcggcttccggctttggggtggccggaactgtgagcctgagtttccgtccatggggtagcactgaccggtggccctggaggggtccctgcgctcctcaccaggccagctctgctgcagccttttgggcgctgatcctggaagcttagctcggatgtgggtctccattcctgacaaggatgctgggagatccagtatgttttcatgaactccgttgctgttatataaaccagaggcagcctctgaggcttgcaaataagaatcccaagtaagaaaacacccatggcctttgtttatgtatatgggaagtggaaatattttggcttattctagctggtctatgtcatgaataaacttaatcggacagaagaggtctaagatgctaaaactgcctctgggggaggcaggccttgaactagagatctttcctgggacctcaaaaggaccctcagaagctgtcctatggagtgactgagggacctgcatccagagctctagaagcctttcactgagaataaataaataatcttgctacaaatatcttgtgttccccaaatctgaaaagtttatgggcccaggagatacttgctttggagatgccaatcctcttcccattgcctttctttaaaccatgcatacactacccagatttaggcattaattatttggggtgttgttttttcttccatattagattgaaaattctgactccatgtgtgaaggagaaggtggaagaaacagatgcctcccatctgatgagatgcttggagaaggttgtggtgggctgggtactttgatttttctcggtaaaaaaattgcaaaatgtaatacatatacaggaaagcacgtaaaatgtatttggccattaaagaattataaaaaagtgaacatgcatctcactattgctgaaaatgagcctgaagaatatgaccaatagtctacgagccccatgtctgtcttgcagtgctttcctcttattctcctttaagaagaactagcattctacttttaggaatagtccataatcattcttttgcttttctttatagtttatcatctatatatgtatatctaaaaatactatttcatttttcctatttttatactttatataataaacacatcatgttcttcctttgtgtatcttttgcataatgttatgtaaatccctggtagctcagtagtagtaagaatccacctgcgatgcaggagacatgggttcagttcctgggttgggaggatcctctggagaaggaaatggaaacgcactccagtgtccttgcctgggaaatcccatggacagaggagcctggagggctatacagtctatgaggtcacaagagtcagacatgacttagggactaaaatcaccaccttgtgaaatgtgtgcatgtggtcgtaattcatgtgtttttcactgcatggtagtcacacatgctattgtgtgactgtcttttctagtgttgatgaagctgggggttggtttctagtacttggcttattgcacataaggctgctgtggacatttggagtgcggctccgcgtggacacatgcacatgtgtttgtacagatgcctgatggtaggactgcaaggttcgagggatgctaaattgttttgtcaagtggttgtaccacttctcagtgataaaggtacagtgagggagagccctgccttctgacatacacttgctggtgtttacagtggtctctccaggtggtttttttggagaaggtcatggcagccccctccagtgttcttgcctggagaatcccagggacagaggagcctggggggctacagtctatggagtcacggagtcggacacaactgaagcaacttagtgcgccaggcggttttaggttctgtctccctgagaatactagtaaagcatagcatagcgtgttatttattgagttattggtaaccagctggcttttggtaatctgagttttttctaccatgaattgccctttcaagtccgatactcttttccctgctgccttttgttttaaattgtagttggtttacagtgttgcgttcgtttctggtgtgtagtgaagtgattcagagatatatatatgtatgtatcctgacccttcagctagaacggttccctgataccttgtaacctgcaaagagggagccctcggggaacagggcaggatttctcaacctcggcactgttgacattttttttttaattttattttatttttaaactttacaatattgtattagttttgccaaatatcg

SEQ ID NO: 41974 - DNA, 2188 bp, Bovine  19866880737708
gagacactggtttgatccatgggtcaggaagatcccctagagtaggaaatagcaacccactccacttttcctgcctggataaatgccatggacagaggagcccttgcaagttacagtccatggggtcacgaagagtcagacacaactgagtgcacacacacagacacacacacagcaacagcaagctaagatcacaacccaatttgcaaaagaacccagtagctttctaatgtgctattaacatccaggaataaaaccctgaaagcacataaccaacaacatggaggaagccattatctgaggtttaagtaactgcatcgtgctattttaattatgcatcatgggcaaactgtgattgtgtccttgccagtatttattagcatgtcaattcaactgcattacatcccatgggaaagattagcaaggattttagcacggatgtgtgaaagtgttgctgtgctcaggccaactttttaaagttgtgtgctaattagagtgaaaatggaaagagaagtgtgagtgtctcaggtccaagaaatctatagccgctctttccaccattccaccgttccgtggtaattctcactgtgtttgcaaatggtacaaactgaacacaaagcctgccagacatcagcactgcactgtgagcattaggaggggataagagggatttcaggatgaggaaatgtatgttcagacatctactcctcagcttaaagtggagagggaattaaatattaagccatacacctggtggaaattcatttgaatcaattcttttaatctctctcaagagaaacttggaatctggggtcacctgtggtaacacccatattttactaaagaaacagaagcagagaaaacgggatcacctgacaagtgaatgagtggcagagaaaagggctcagatccccccagagtcactccaggacctttcttttctaccatcattacagtagtttctggacggggcaccaacactttacattttgtcttttttttttttttttttgaaacctgtaattaggggggaaatctgagtacataatacaggcagatgagtattttttcttggcctattttcaagtaaaaataggaccaagtaaaggaaatgggtaaaaataagggaggggtgtaatggtatactctttttttccccctccaccagaccaaacaatgcttataggttcagttcacttcagtccagtcgctcagtcgtgtctgactctttgcgaccccatgaatcgcagcaagccaggcctccctgtccatcaccaactcccggagttcactcaaaactcgaggttactcatcctcaaaaactggctgagccagtccctaggaaaaggctgtgagcctctctacctgccgccctccacctcctgcaggcttctctgtttttaatctttggtatcttctggagatgtccctggctgcccagatgaaaattataatcaattgagaaaaactctagtaaagaatcccgcctgcaatgcgggaaacccgggttcgatccctgggttgggaagatcccctggagaagggaaaggctacccactccagtcttctggcctggagaattgcatgatctgtatagtccatggggtcgggtcgcaaagagctggccacgactgagcgacttgcactttctgttactttcaaaataggatcccctcctttgtgatgactgggacataaatggccctttaatgatgccttcacaattaagtagacacaccagaaccggcgacctcggcggaccacccggcctctgcactctcccctcgtactgaccccgggagagagggaaatctggtcggtggagggggaggttggcccagcgaaagagaagcttccctgtagaaagaaactcggggtgtgccattgttcaggccgcgagctccagcaattccctccgtccgcccccagttccccgcccgcgcccccggaccgcggtccccagcctgaagcacaggtgagggcctctcgccccgcgccgggcccagcgaaggaccaggtaaagggcaggtgggcacagcggggtcgggccggctgcgcgcggacgaagtcaggccctcggagaggatcagggctccggagcccgcgcagacgccgctcgcccaccggcggccgcggctttgggaagcctgggggcattacagcccaactggcaacgcagggactctcc

SEQ ID NO: 41975 - DNA, 790 bp, Bovine  19866880769891
gctgcactagcacacacttgcatacgtgtggttcctccaggttcaagttaattaaagacactgtctactgcacttgaatttcacacgtctcgtctttctcaatcatttagtttgccttctccagacaaacatttactcttcggtatgcatttactgccaccctgcaaagaagaggaaaggaagcaatgtatcagctgatgagaagcctcaaggtgagcacctcatctatcgaaatcacacttagattaacagaaagccaacaggctggagcgggcaagtcagctgactgctcttctgtgctccactttcaggggacatcctgaggcctgtctcacacacatacatgcacacacaagaagaactgataccagagatagaactgtaaaagaccagattccagacacactcgagtgctgcgtgtacagacacctccagttccccagctcacactgctcagcctccctttcatttcagacctctgtgggcttctccccacttcacacagagtgtctggcctcaagtaagctatggggctccagcatttcaaacaccagaggcttcatcaagcccccacatggggctcttatcaacccccaggcaagtgttaactaatggggggaactgatggatagactctctcccagtcactcctcaggcagatccttctgagaggcatttgaaacactacccagaacgtggggttcgatccctgggtcaaggaagatcccctggagaaggaaatggcaacccactccagtattctcacctggagaatcccgtgaacaacgag

SEQ ID NO: 41976 - DNA, 809 bp, Bovine  19866880834876
ctttagagcctgtgctctgcaacaagaagaagcctgtccatggagattctccaggcaagaacactggagtgggttgccgtgccctgctccaggggatcttcccaacccagggattgaacccaggtcccccgcattgcaggtggattctttaccatctgagccaccagggaagcccaacaagagaagccagcatactgcaactagagagtagcccctgctgtctgcaactagcgaaagtccacgcacagccacaaggacccagcacagccaaaaataaagtatttttttaaagagtagtccagggccactcagcggtgaagtttaaatccaggcaattggctccagaggcttgaccactgctacttatgtactcatttgtgaatcacttaacactgtctgccttactgagtggttgtgaggattaactgtctccatctacagagcaggaaagtaggggtcagggagcttaaagtcccagccagacagtggggtggttggtatcagagcgcagacatgtccagctcccagactccgggcggaagcagcgagcagccttcctggtacccagtgaagcccagggacaaggagatggcactgctactgcatctgtttcccttctcaggtaccagttcaacccagccttcttccagaccacggtcaccgcccagatcctgctgaaggccctcaccaacctgccccacaccgacttcacgctgtgcaagtgcatgatcgaccaggcccacgcatccttcccgcttcatgctgggactgggggacggggagcggggggacggagtcacaggggcgtg

SEQ ID NO: 41977 - DNA, 1306 bp, Bovine  19866880859148
ccggggatctccctagaaatgcagacccgtacgcccctccccagacccactgagtcagaacctgtgagaggaaggctgtgctttaagaagccctctggtgatgattccgatgccgctggagttcgaacccccctgcccattgccacaggccagaaggtcttcacaaggtgggcacgcctctgtgcccactctcagcagctcgtccagtggtcagcccagaacattcattgggcaccgaagcgagggtcgccctacttcctgctcatcggagagagtaacccttggtgtgttgcctctgagggtttgccaacgctgcgtctaaatcctctctcatttcttatgggctgtgtgttccatattcacaaatcagctccccttaaatcctctccagggtttttttttacactcctttcagctcaggaagtccagaacaagatgccgtgtttcaaccggggtctgtttcctgcagggggaggggcgtttctgcagggtgcttcagttcccctctgccagcctccagctcattttctgaacaatagaaggagattgctgattcatgtttggctcgcggctggctccaggcgtctctttttctcctgctgtacttgtgcggctgggacacgatgatgctctattcatccctctgagttagaaatgccagcagctcagagaggcagccgaagatcccctcccctttggcttatttaaaaccttcccacaaatgacacgttctgaaatactatacagcattcactctgagccagttggctttggccaagagagcttatctttttattagctgctgcttgcacaatgcctggcaccctggaaccagaattcttaaaaaatgcccgtagggtgaatcacacacccacctcctggggttcaaacctgatccttctatcctgccctgatatggcggaaagacagtgctcatgttcaggctcacgcttgcatcattaaagaatgggtgtgacctgcttgaggtctgacggtagggggggtctctgcccaccgctgaccccgtgtgcacactgtctgctcggccactcccggcccggccatagcagtgaggcttgggtcgcccctgagcacagcgttgccaacggcagccggggccagctgtgggtttttgtttcccaatggcaaaatcaaaccggtgggactgcttcacgctcctagaactcagtccccctcagcggcacgtccacatcccctgggtggctttgcagagtcccagtgcccaggctgcaccccatgccactgagtgttttgtgagtcaggcctcagttctgtcaagccgcag

SEQ ID NO: 41978 - DNA, 1180 bp, Bovine  19866880895357
ttcaggatccatattttaagaaccactgacttaaggattttggagtctattttttcatctttgtggaacttcaaaaggactgttttctttgacttgtatatcgtctaaattgacctatttcatctagttaaaaaactgctataactgagttggtggtatctttggcatgaatatgctgggcaaccattccatcttcatgaaataaaacttgcagccttcaaaccatagatctggaaagactggccaaataaggaggccaccaggaatgtcttaatgagagcctcctccttggaaatcctacagttcaagtattaggctgcttccatcagcttgggtcccgagtcccaggttcctaccacagtgttctcagcacagccatctcttttccattgcaccaggtcagaatccattctgtttgtgctaggaagccacattgccagtttttcaagcacatttttgtaaaaacaaattctgcttggtgatggattgtgccccaaagcccccgcttccctcaagtatccttcagtagagccatcagggctagaagtatcgaaaagtttttattaatcattaaaggagaaaaattagaaaggaattaagaatacaagaagttttaaagagaagaactttgagtttcttactcctcaaaatatcaaaacagactcaatcccagagccccaaggcttgtgtggcccctggggatctgcacttcctgggtccagcctgctctgtctggccaggagttttcttctttggtaaaaatgagagaaaaggacactcacctttggaagcttcccaggctcctcctctctgtctttggtctgtaatctgagaaaaaaaaatccattctttccagtgataaatcctgcaaacagtctcacctcttgcatatcttcaacagaacagacttctgtatatctcaacatatatttcacggaatacttggaaccaatgttacgagttatacgatgaggacttccctggcagtccagtggttgagaatctgccttccaatgcaaaagatgcaggtccaatccctggtcgcgggactatgatcccacatgcctgaggacaactaagcccacacctgaagagaattccacacgtctcaatgaaagatcctgtatactgcagctaagacctacctgatgcagccaaataaataaataaaaacaagatg

SEQ ID NO: 41979 - DNA, 1323 bp, Bovine  19866880895695
aaaatgaactgtttcatgcccagaaataaatgtcttccaaacataaatatgaatcagttataaaaaagaatcttttggaagtacaaaataaccacactgctaatatatttgtgtcccagttgaaagcgtgtcaagaacacacattctgggctaaagttgtcccaaggagtgattctcatttttgctttgaatcttgtataaacaaaccgggatgccttctttgagccatgagcaaatccacagctccctgttttctgaagagaagaagaattaaagatgggactgtttaagttggaaaggtctggggcttgaccttgctactttaaatttccttcatcactaggaaattgctttgaattcgtctgcttggagaactctaatttggtttgttcttggtttgaaccacaccatgaaagagatgctgtccatttgtattatagcaaaacttggaagccgcctcagtgacactgttctccagttttcctctctgctgttttcatctttaaacctgagcttgttctcagtaattcagaatgagacccctgacatcttactgcctgagtgagcgtcccagctagtctctgcttcacagtttgcctttggacaaaattttacacctttctctgcctctcttttcctcgtgtgaacaatggggttattaataatgcctacctcatacaagcattgtgattattaaattaaatgaaattctgagaaaattagcgaacccagcccacaaaacgtgcttaggaagtgttatgtattaaattgcttattgttgttattaattattgagaatgtttagcttgttttcactgacttggattcacaaatattctctaaaatccaaatcagatttataccctcaaaaaataaattgagattcaatattattttcatacaaaggcaaagtttgtttttaggtgttagtgttgaagatagtggttgtctatctactcacatttaaagccacaacagtgacagacacaaacttcttcctgccttgtcaactccttaatattgattgaaaaggggaagaagatttataataagcagatgaatttttagcaaacgttttgccttttaccacacctaatgttcactctgcatggagccagagtatagaacaaagagcagcatcttgagaagctgagtggagttgccgagaaaacttacacacgcacacctacatacgcacacacacacacataagtagcacacagtttaatgccatgacagcggctttgatggtgcttgggggaaaggcagtgagctaaaactgagctagagcgctctcaacatggtcagatcacacacataaca

SEQ ID NO: 41980 - DNA, 1135 bp, Bovine  19866880968058
ccatgtccagtcatgaatattaaatgagatgaacccatttcagacacttgttcccttggaaacagtcatctgagactcctgtaaaaattaacatgtattttttttccctgtaaagggcagaagcttcttttacttacatagttttgacctttagttttatatcttaggcttattataagacgttctttccagagccaggcaaacaaagcaccatataagcatcttttcattagttctgaggctcagcttacaatagtatggcctttgcagctgcacgttacggggcaagtataagcagggagtcgggtaaaacctgccactcactgataaaccatccgtccccagacagcattctagctcaggctgcgtgacttcacagcatggctaattgagttaaatagtcatgttggcaatatagctctatattttaagaggcggtgagtgtgaatgaagtcaagtctctcgtttaagccaaatcgacagatgtcatgaggacagccattcaccagaggcaacagttctgtctcagtcgatgccgtggagcagggctttggtccgtggaggatttctgataccctttccaaagcctggctggttctggatttctggtatctttgcagagagatagttcgggtcaaagaggctgaactggtccagaaccaaggctgatttctaaaggcgttactcacagacaggactaaccctcacagacagggctaaccactcacagacagggctaaccctcacagacaggactaaccctcacagacagggctaaccctcacagacagggctaaccactcacagacagggctaaccctcacagacaggactaaccctcacagacagggctaaccctcacagacaggactaaccactcacagacaggactaaccctcacagacaggactaaccctcacagacaggactaaccctcacagacaggactaaccctcacagacagggctaaccctcacagacagggctaaccactcacagacagggctaaccctcacagacagggctaaccctcacagacagggctaaccctcacagacagggctaaccctcacagacagggctaaccctcacagacaggactaaccctcacagacagggctaaccctcacagaca

SEQ ID NO: 41981 - DNA, 1924 bp, Bovine  19866881010741
cgtgttcagaaaagatattcaaggaggtaaaattggcccccagggaaagttggtgtgagaacgtttttcatgatattatccagttgtttcccgttttctggagggcagaccttcacgccccttgaaactgagtagagaaaagagcgtcacacacagaaagcgttaactgcctgcttctcagcgcaagagagcggggcttttcttctgtcatcagagctcttaatttgccccaactaaagcacaatctgctgacctccttctcctctcacctcgcctgttccggaggacgtggaaaccactggcacagtttcccttggaagacccagccccttatgccagcctgtcggcagtggaaggtgccaaggagcccgagttgtcgctctcatgtagccacgtggcacgtccctctcagggaacagggtgcccctcaggtcagccggtgataacacccaagtcaaacaaggccgcatcctggacgttgtatgtcccgaggatctgaaaagtgtccacggccagccctgaccctcgagacctcacatggtcatctaagcagtatcataaattggtgcccacttgctccctagccattgccatcgggagcggggctggcgagagggcggcccttccgtggaggagcccacgtctttctaggcgctaaaaattgggggaaacgcgttgactcctccgcaggcagtccagcgccggggctccgtgccagaggccgctcagtgcgtcttatcgccgccgttgggtggaagggtccgggaacgctggcagcccccacgagccggggaagcgcttgccttccagacctcttcctctcggccccgtcttgacagtgccaacagccccatcatgtcgtgtttttcaaccctccagaaaatggccttccagcctgggacaagccgaagccttgtccagacggcgagccggagtggaagctcgtgggaatgtctgaagcctgcctgcatcggaagagccatccggagcggcgcgggcccctgaaacatgagcagtcgcccctcatccaggcctcctggacgagctccatattccatctggaccacgacgacgtgagcgatcagagcgcacccagcgcccagaccttccagacggaggagaagaaatgcaaaggtaacagctgttttgagacccgggtggccgcaaggaaaaggactctctgttgtgactgtgtgctgggtctcccctgagcccaggtgtgcggtccacgtggctccccggcagctctcttccaaagagcctgtgcccccagaccttctgtggagcagaaaagaagtgggtttctgaggagagcagctgatttcagcttcctgttggggccgcttgggggagaagacatttttctttctctaatgagcaggagggctgttagttttggcttcagttctgtttttgaagctgagtagaaacagacactgctagcattacataactacttgctttgaagtgtgtgtgcgtgtgtgtgtgtgtgcatgacttttcccagttgtgccagtagctaataggatctccaaatctacctttaacctaaatagacaattcatgttcaaaagagaggtttgaagttgttttctttgactcattaagtcctgtgtcatcaacctgaaaggcgagattatggtgttagggggttgtcacctcataaaaaatgttaaactggcctaagtttctgattgcattagatttaactggtctttacctcgggtcgcctccgccctgacagatgtctttgtgttgatcgctttatggtcttagggcttcccaaaatctttacttcttaaatcagttagtgtctttaaatgtccaagttcatgttgaccctccgccctttctcaatttagcatttttaaaaaataaagtccttttccattttctttgaggacttgattcagatcaagttttt

SEQ ID NO: 41982 - DNA, 1644 bp, Bovine  19866881135047
tgtccgactctttccgactccatggaccatggccgaccaggctcctctgtccttggaatttttccaggcaagaaatacggagcaggttgccacttcccttctcaggggatcttcccgcccctggagtcaaaccagcatctcctgcatctcctaacactgcatgtggattctttacccactagcatcacctgggaaggtctgaactaaccacagaggtttaatcaacagccagattctgttacagcccaccaggggcatcttcccattctccaagaaggttaatgaagtcaaagcggagagaaaataatgatctgagtgtgatgaacgggtaagaaaaagacccagcctccatctgcatcgcacgcctttttccaggtaacacggacttcttcctgtgggcctaaataccaccctagcttctcttgaaactggattccctttttctaaagaaacgttactggatcccagagacacaggaacatttttcaggatatcagtgctgtccatttttgccaaatacacattaaacaagcagtgatgagcccattttttgagtgatttgagtgctattttgagaatggtaaataaaaattcccttttccagatatgcatttctccaaaaagctttagaggaaattattgaattatatcagtacatcgtattttctacacaatcttctagccagcctctccattagggaaatcaacttgaaagccaatgaaatatttcagtgagataggagagttttaatatcagctaatgaaatgaatttctcaactcatctatttattttctgagggcacctaacaaaacaggctttcaaaaaatttaatatgttgtctttgttttacttaaatcaactctgagatgttgcccaaaagcattctggaagagtaatgcagctctgccctctaaattctgccgtgtaacccaactgagtccgctgttcaagactcatcagaacgcagcggcctcattaagatgcgtgtgaaatcttaggggaaatggcatattgcatgcttttcactttagtactgattttgctgtcagttaagctttatgctcttggtttccctttttgaattgataagtgttcacatcttgtccgtgcgccactcttagcaaactggctactgccgtgtgtttttttaaatttcataaagaaaaagtctgggacttcctgctcactgccgcactctgtctccagtaacgttgttcttgactttttaaaatagaattgttgcatgtttgtgtgccatgaggttaagtcattcagtcgtgttcaactctctgtgaccccatggtctgtagcccaccacgttcctctgtccatgggattctccaggcaagagtactggagtggcttgccatgtctggccccaggggatcttcccaacccagggatcaaaccaggtctcttaatgtctcctacattggcaggcaggttctttaccactagcatcacctgggaagccctgttatatgtgtattgtttattttatatttttattgtcgtttagaaaacagcatgcaatacttacgaatgaaagttaagaacaggtaagctagttactgggagaaggcaatggcaccccactccagtactgttgcccggaaaatcccatggatggaggagcctggta

SEQ ID NO: 41983 - DNA, 1638 bp, Bovine  19866881160871
ccagcagaacagctgtacttttccgtgtcttacaaattgcctttcactggaagactgcattcaagtgttctttgtaaacaaaaaaatttttaagttggagaagtgcaggtctagccgattcttaccgatccctctccctggaacattctataaattacaaatcgtgtttctgatatgagagccgggactggccccctggagggaaggctgggagacagtggcagccagacgaggggcccccggggaggccagggccccgagctctgtaatattagcactggcgacaatcagatagcgccaccccaaccgaggcggctggacaataggccagaggcgctggcgatggcaggcacaaagacagcattcaggaggcccggctccaccgccagccggggctgcacagacgccacagaccccggcccagccggaatgtcacctcgccgccagaaagccatctttcctggttagcttttaaactgctaaaaataataaacacagagagggaagtgctgacacgatcttaactgcggagacaaactgaaaccgttgttataataacgtcaacaaaccgggttccaaatgccatccagcactccaaatatcaacagtgggggactggagggaggctgggagacttgtccgtgtagaaagcgggtcttcactgcacagttgctctcgtctacctgactcgctccaacccagggtagagatgtgatccttctgccttctttagcactcaaggaagggaggttggagggaactctggttctgcatccaccgttttcccacataacaaatgacaagcgggctcctttctctctgctcccagttattactttttttccccaagggaattcgaagcatccttttctccattatgtttatttttaactggctgaatgctttgtatttctcaatacctacagagttcaaaactatcttaaataacaacaccagcaatgcataagcgagaagatcattcccagaatgccgcaaagtgacaatcataaaatcacgaatctgcaaacaagcgcaacatctgacctgccgatccatgagaccccgtgtggaacttggcacccacgcaggacggccagtgggagggagactgcagatctggaaaaagagaaacataagataaacaaaagtgtttttttgttttaaagtccccaacatttgcttaatccgccactgatcttctatgtttgaatagggtctggtttcagagctgtctctgattttgaatacatgcaaatagacttagataaaaccccattccaaagaggagccggtttcagagaaagggactttaacacaaggattctaataacacattttgggatgggacagggtttctgagtcccaaggacctactttcctgtgcacaggattcccggccttggaagaggtctaaaaggcaaacgtgaacttaaacaatttagaacttctgtgctaaacactgtgcagctgggtgtcagaagacggtccccagggtgggtcctaacacgccccagctgcggctgtgcccctgtgagtcggcaggaggcggggccgagaggaccacggagatgctggatggtggcaagtgcggtgatgctggggacacttcccccgggtcttctaacagataaagagaaa

SEQ ID NO: 41984 - DNA, 865 bp, Bovine  19866881252949
ccccccccgcccatttcattcatcgaacacatgtttattaaaagctacactgtgaattctgggcactggtgcggaccagagataaccaaagacagccactggccatgctttcatggagtttctagttcagacaaactggactgtagacagtgatagccaggagtggtcaaggcggtgatgggggaagcacaggtagattggtgggggctgggatggggaaaacgaggcaggagagtatgggctggaccagagtggggtttgggtatgggaggaaggggtggatatcaaagatgtccaggaggccagatgtacaggccgcaagggctggttggctgagagattgaggaggcatttttcagaaaaaaacccagggctctaaacccagcccggggtttagagctggggcttaggtctgggatatggataagtttcatcagaggttatagagctgattcaatatttgaataaagcaagtggccagtgacagagggagggaggaaaggaagagaaggaggagcaggctacattccccccgctactcccaccccatggagtaactggcctcagctcttgtctctgctcactgatcttgtttctcctctaggtacaaccctgagaacctggccaccctggagcgctatgtggagacacaggccaaagaaaatgcctatgatctggaagccaacctggctgtcctgaaactgtgagtatctgcctccattcccacccggttcccattgtcagcagtctgccactcccagcactgggtggggtgggagtgagaggtaacctgcaagatgtgacttctctctcttttttaaaaattggagtatagttgacttacaatgttatattagttttatat

SEQ ID NO: 41985 - DNA, 1486 bp, Bovine  19866881298897
cgcttttcttttcccattagtttccaaggcccgaggagcaaagttccttcccctccctccctctcctcttttcctcctctctcctttcttccttttttccttccatctttcatctagaacaagccctgtgatgccggactactaatcctttctctcatatcactcttagaatttggggggaaaagcgaaactgttttggatccttttagtgatttatgcatttttgactgcggggtcttcattgctgcgcgggctttcctctagttgccgcatgtgagaactactttttgtcgcagtgcgcaggtttctcatcgcaggggcttttcttgttgcggagcacaggctgtagggcacgtggccgtcagtagatgaagcacgtgggctcaatagctgtggttcccgggatctagggcacaggctcggtgattgggcatgcgggcttggttgctccagggcaagtgagatcttcctggacaaggaatcaaagccgcaactgctgcattggcaggattctttaccaccgatccaccagggaagccttggattctttaatggactattaataattcttttaataatgcactcccctttcattgcttaaaatggtaatgttattagtgctgaacacaggctgtcttttgtttggttggttgtttttggataaaagaacatgaagggggcagagtaaaaggctcttaaaggtccctttgctctggataccgctgacaaggcttccttgaggaccagacttccagattccaaatctacccaaaataaggacacaaagccagattcaatttctggagcagtggctgccgaggcagcccctcacgttctcctctggcaaacaatcaccagttcctctggtgtttcatgatacctggggctggaaagaacagaaaaggggtggggggtgctcacttccaataaaacagtgaggtgacttccacttggtgcttagagtttgaggcaagaaatgtctggggaagttgaaacaaaaagactgcactagagctgtttaggtgaaatggctacgtgggtaggggatggtctcccatctctgatacacagccctcaggactggaagtgctcagcgtcccagtggctctccttttgaacttgctcatccattactggggtaatgattttccgtctgggcaacagcaaagcccaaggcctattacacaggcaacataaagttaaaaagacattatgaataaaacgttggttctggcaggcttttgccaactcttctctggagaagattgcctgatgccgacacgtgtttattacacttaataatgtttacataatttcttccttgagctcattagagctgtcagatcccaagtaaatgtgctccctcctcggtttatctttaaagacttcgcagtcaataaagcaagatgaatggcatccagggcacagacgacgtactctccccggctttgcaaacactgacaagttagaccttccgtacgggtgg

SEQ ID NO: 41986 - DNA, 432 bp, Bovine  19866881329723
aaaagggttgcgctgctttaaaagctttgcaaatacccttcacagtatgatacaaccaaacacacaagggatctaaagccagagccccgtgccaatcccagtcggccctcatctggagggtgtggctgagacacagccctgaactgagccttgagaagaaaaggaaaactacatcaaggggctctgggcctttaagcactactgaacccacacaagtattttaaaagcaataaagtcatcaaatttccacagaaatagtggctgctcacttgcttacttgagtatcagttaacggctgccataaaaatctaaagctacattttggctttccaataatcaaagttaatcttttcactttaaaggtcaaaattacagtaaaatcccacataattcatgaaggcattatattgaaatcaaataaataaaagctac

SEQ ID NO: 41987 - DNA, 743 bp, Bovine  19866881423781
tgtttgcaaatgcaaaatgtgtgcatttctagcgtgtttctacattcattaatgccgccttcaggagcaatatcgtgcaggtaaaatgctgtttgtggctttctgttgcacagttaaagctgacccaccttatgcacaagacaatcagatataaatctgtcctcctcaggatgcagacaggacgttccagagcacaacgcacgacagaagaagacccttaggagacaggcaacttgctgacacagacgctagcagggcatgaacgagcagacattatgccactcccctcttttggttcttcctatttggcatttttcatttgattttagagccaaattagttatgaaagctttctttggagaaaacacctttattcccccatgatgttttcatgccctgagaatcagaaaaggacaacagaacagggaaagatttacagtcatcggaagatttgtgttttgcaaatggtgttaagtgatattgctagattggtaatatttttttcagcctaaaattctattgaaatctgtgatcaaaatgttttaaactatccaaaaagaaaatttgtatatttgggaaaaatggatttttacatagcttttgtatgcagatattaaattgtaattatgactatagcaggcatagataaactgataagctacaattctaaaaaagaaacaaaaaagaaaagcttataacggatatacttttctgcctctttctttaaatattattattttcta

SEQ ID NO: 41988 - DNA, 1203 bp, Bovine  19866881793057
tcaaattataggtgaaatctaatttgacaaaatcccctgtagtgttatttaggggaaaaaaaaaaacaaaacaagtggcttcagaacacacttgcacacctgcattcacacacacaggcacacatcgacatgtgaaacggtcttcttaaacattggttctccagaaagaatcaaaatgtttatcatcaagctgcagcatgtgtattaagtggcagcaatgaaatctttttagcacaaggtaagaatctgaatgaacttttaaatgaccagtacctgaaccaaaaattttactagagatgaactctaaaatacttattttttgaaaatctggactcaactgcctgttgcacttttacattaagtgttgcttaaataaacaaaaatagagcataaattcagcctctactctctaaacatttaaagcaatggttatgttatcaacaggtaaaatgcacctaatctgggtcttttgacacctcttgttttaagtttattgtatgataaagttcttcacagtttaaaatattgtgaagagatatatttatgtataactatattcacatggatattatgtacactgctatgtacttaatgtacccataatctttgaacatgtgtgtgccagaggataccccacacctacgcaggaaccctgaatagcagattggtgtggactgaaatgatttctcagaaaagagtagaagttaaaaaaaaaaaaaagataattattatgaataattataacaaaaattttaccgtatttacatagtgcctatctcccaagaggtaaagatgctttacagacggtggttaggccgtgtggggcgggcctggggaaggatcggctctcatttccacaagcagggagcctcccaggcccgcgcacgctcacgacggcggggcccccacaccgaggtctcctaactcgcggggcctcaaccggcagagccgagtcccgtggtgaagtcaagcttccgtctgacagaacttccaccgcagagggtaccttcaggccctcagatccttgtggttacgcattacgtttatgtcacagggagatcaaaatggtttttggttttggcagatgagcaagtctaacattcagtgtgagtgtaattcagtgtagcttctccagttaagtgctgcacagccggcgggtctcgggacggcgcgcggcctccagccagggctgaggaaacccgg

SEQ ID NO: 41989 - DNA, 1099 bp, Bovine  19866882077845
caggcaagagtaatggagtggattgccatttccttctccaggggatcttcccgacccagggatcaaacccgggtctcccgcactgcaggcagacgctttatcatctgagccaccagggaagccaggaggtaaagttcactgtaaaggtaaacagagcttaacccagggcattcagctgatgttttataaaagaggtagtgaaaaaataaataaataaaaataaaagaggtagtaagtcagagaaagactttaattttgttgttgaacgttttatttaccttattttaaatgaaatgatcacaaactttgcagcaaaaatcatattaaaattcataagtcagtcttcctcattcatcacctacctcaccacctctcctctccttcccttcctccaactacctccttttctcctaacctttgaccctagacccccaaattcaacgtgttagcttggttcatactgatgggtgtcatttccctcgtggaagattttccatgcaaactcccttctttctgtgcacaaaattaggaaacatgtagcctgctaaagtgttaagatgatatatccagtgaaaagaggtcatttttaaggtctcaaggcaagactcttttttgggaatgtgatataatattgctctcattcatccagacccctttgatctagaatttgtaaccttttaacaaagattgggctaaaggttgctattacatctatgaaaataatatcataaggagtttgatgacattatttacaaataagttgtggctgcttatgaattgggaaacttgcagactgtctcttgaaaggccaattttatgggctttgtttgaaactgctaaaaccatttctgtagatgctttccctcattccaaaagctcagcgattcaaatgggttttttttctaaattagccccagttaagaaggcttttacctacctgattatgcagtgttgagattctctcaaatcagtttttaatgacaaattttgaattctaggagcgactctaatgaaaattccatttaacattcagctcccaaagtgactctaaaaacccagtgtaccttgcagaggacttgatgctcactgctgctgtttg

SEQ ID NO: 41990 - DNA, 1718 bp, Bovine  19866882096672
ttggtactgttactggtgaaaagcaaggaatggcttggacttgtgcctccaatgaactagaaagggagccaggaaatgcactgggcaaaactgcaaaaactggatggtttgacacacagcttctaaccagaaaaggaggcagaaaaaaaaggaaaaaaaactgctttattgaaaggttaattttcagattagttttgggaaatttgagataaatacacgagatcagacaaagaaacataaggcctggatcctttttcctggggttttcagaaaatagtcattgcttccagtgaaatgttttgacattttcagtagggagaaaatgttaattgtaatgttgtgtgtatgtgttcttaaaaacacttgggaataaatcttttagttgtttgaagagtaatcagagagtgaaaacactgttaagatgttagctgcattccttattccttatggtaacgcctgtgctctctgctgctgcggctaagtcgcttcagtcgtgtccgactctgtgcgaccccatagacggcagcccaccaggctcccctgtccctgggactctccaggcaagaacgctggagtgggttgccatttccttctccaatgcacgaaagtgaaaagtgaaagtgaagtcactcagtcatgtctgactcttagcgaccccatggactgcagcctaccaggctcctccgtccatgggattttccaggcaagagtactgaagtggggtgccattgctttctccgatgaatcaagctaattcagggtaaatagagaaagcaagcactgtagagccaggtgggacttgaactctggttgcaaaagtgccataacgtttcctgtgctcatgggccttgttggtagccctcttcctctgctgggtggaggagctgactgtgcagattttggaaggctgggatggaggccacctgtggattggtagccaagcgcacccgattctggcattgagaacagagtccttaggtgctcctgggatcctgggtacttgaggacaatactagctacacccactgtgatacttcagagaacagaagacaaccaaccagctagcagtttacatgccagctcccttccttgtctctttgacctgatagccctggcatcctgggaccctctcttttctgggaaatttgcattgaccctaatataaggagacttagaactcaacagaaattcaaataatcatttaagggaccaagacgatcttccctgttggggctgagtccactctgagtgcagccatcacatcctcctccaacagccaccctacttctctctgccacagctaaactccttgaaggaattgtctccacatgctgtttctacttctttacctcccatccaatcttccagcgaaactgctagtgacctttttacctttttattgttggtgagcacatctcttgtcttcttgatctctttgcagcagggctaccctttcttgggaaactcacttcccttggtgtccataactccattgtctcttgacttttattctcaggttcttgccctgggccctgagtttttattgcccctcctcctgcatgcaaacctggcgccctgtgagctccgagggaagagaagatctgtttgctcaccattgtttctctcgctacagttgggctcaagtcccaagaggagagaggacagctggtagtgccagctcctctccacctctggggagagacttgcaaaatgctggg

SEQ ID NO: 41991 - DNA, 1440 bp, Bovine  19866880458199
aaaagtcacaaatttaaacctctgtgaaactccaggtacatagatgtaacttacttgataaccccacgcataggccttaaactcagaaatttcccctccaaacttaatccatgtctagcatcccctctattctgttttgcagcaaaaagttcaaacatttttctggagactcatttttctggagactctctccttgatccagctcttatgtaaatcacctctcaccagttttactactttcaaaatttacattcaggatagcttagaacattctgattgttactgttcacttaaatttttaaaaagaactacctagcaccttatattttcctctaacctcttctaacacagtgaaacaagaaaggcttataagtgggaaatggtgtaaatgtaaaatactgcacaggatcaaatattttttgaaaaaaaattacatggcaggaaatttttttttttttttaaagagaagcaacattaatagtgggcatcatgcttgtcaccttctcaaagtcagggtcactaagttacacagaaatgagagcacataaaggactatagttacaccaagaatttcagaaggtctaaatagattaacgtcttatcttagatacatacatttcttccatttggtggagttgtaaaatggagttttaaagttaattttctgatcataaaatcttaacaatgggcctccttatcctatcatatttctcaagagatctggaacatggcctgtaaaagagatgtctcaatatattttaaaatactatctttaattctaagcagaaagcactagaaagttagagtgaacatttactgtttttcttctggtcctgactgtttataccctagtaaagaatgatagattcttctgcaaagcctcctgagaatatggaactaaatgcatccaaatattgaattgtttggaaaaataatagttacatttctgcagataaaccctctacctctattgaaagctaagtattcataggaatattgataggagctttcacaaataatatgcctccctctgccaaaatacaaagcaacctccatcagttaataatgagcatgactaattattaacctgaataacacacgacatcagagaaaactggcataaattatctcaaaatgaactgtgagtgaatctgtccacttaatgaatctaatttacatgattcttctccctgctgttccctttgtaaataatctttcatttaaatcatttccagcccaaaagctgaaatcattattctgagagttatgtgggattgatgggtaagccattctttcagccataacttgcaagctgttcagatcattgatcactatacctggctcctggtttggatacagttttgctcgggtagtcagctcaggaccttgttcagagctcagatcataaagagaggctctttaaagagacctagaaccagg

SEQ ID NO: 41992 - DNA, 1311 bp, Bovine  19866880526288
catggattggagctgaccaggctcctctgtccacaggattctctaggcgagaatacggaagtgggttgccatttctttctccaggggatctttccaacccaggattcaaacctgtgtctcctgcacctcctgcattggcaagtggattctttatcactgagccgcctgggaagctggcctggtgcttagtaggcactaagtaaatatttgtagaatcaacaaggtgttatttgtttgtgcacttaaatcaacaggcacacatgtcgctctctcagtggtccattttctcttgccttgtgctcatagttcttaccaatggtgataggggccattcatctgtcttgcagtgaaataaagtaatttttttcatcagcagtaatgatccccttgaatctgtcagcagacacacgttcagaaataagtcttttaaggataattttagttgaaaaagctcagaaagggcccttgtgagtattctgagagtacagtggagagctggaaacatatttctccagaatttcaactagaactctcactcacggaggctccttcagacaggaaagaaagaggaaggaagtctaaagtctcccaaaattgcaaatgataaatccaagtgagagcgaaacttcctctcttaaaaaatcaccacctcccacaatgatagaaaaaaaaatctataaaagtagacgtgggggtgagggtagagtgggggtgaatgaacagtaaaggaacttgcctattaaatgtggggaataaagaagaaaaccaacttagacactggatcagacagttcaaaaagtccctgagtacaatgccatatggaacagctatgaattttaattcaagaggagacacagcttttgtctgtttaacttgttccagctcctcttattattactagtacattgattccatttcttgagccctgaggcttttcttgtttcctatcatttgaacttggaagtattttcctttgtcacccctctcccctgccttaagcattcttagttcttccacaaatatcctccatctacggtcacctactggagatagagaaatagcctctaatatttttctgttcaatgtacttgagggtaatactctgaatataactcaggattattaggacattctgacctcaaaattttggtgggctggcacactgttccagaatgtagtagtaactagattttccaagctatctaggggaaaaatcaagggcatgtagtaagttttatgaggagcaataccaattcttccaaattcattctaaactccttgaacactaactagtccaatccccaatgttca

SEQ ID NO: 41993 - DNA, 846 bp, Bovine  19866880559498
aaacttgtgttgtttgtcttgtctagacaaactctatctttctggcctcttggttaagtgttcttttcaccatatcatcttgtttcccccacattcctgttattttccttggattttcctacaaggtcatgcttatcatgtctaatttggctcccattgtcattttttctttttattggaaatttaaatttggatttgcattgctacttttccattcaattggtgattgaaatatcatctggagggagtggaaatgaaataagcatctggaaagaatgtgctgtgatgaagatgtcattgtttgtccataaaggctaggcaaacaatctggcttttcaaaaacaaatgaatgaaaatgtctatgtccatcccaatctatatttcagttaaaaaaaaaattaaaatccactgaaattggtagactttcaaagatgatagaattaaatataaatgattaattagctgaaaatataataaaatagctaaacattcattcattcacctatccatccactcaagggttactggataaatgatgctaagccccacaattgctactaaacctatctactaatcaaagaatatgtagtaagaggcaaaaataatttgaattacaaagtcacaaaatctaagtttgggcttccctggtggcccagtggttaagaattgcctgccaatgcaggggacacaggttcgatccctgatctgggaagatcccacatgctacagagcaaataagcccacgagccccaactactgaccctactacgcactctagagcccatactccacaacagaagccacctcaaggagaaaccagcgcccttcaatgaggagtagctccca

SEQ ID NO: 41994 - DNA, 1828 bp, Bovine  19866880564613
ttatttttatcacctaaagaagacagatactgcaactcagagcagatttatatgttgttggatttatttatctgcaggggtaccagaactcaatcagcctgtgactagtgaggagtgcagtggacagtaatcagcaaactgtagtcaggaggcctggggaaaagttaggagacagtcatgttattggtgtcctgagccctgtttgtactcagcaaatattaaaataccaattttcaaaaataattggtccttgagtatttctaagttatttctaaggtattcctaagagaatgagtaaataaatagaaaatagtcttggaaaacataatacaaattactgcccactgaagacaaaattgaccaaaatgaaaaggacattgggaaggagttggggagtaaaaagaaaatgtccttttcccaaggaagccaacaaaaggaaaagaaaattaaggccagaggactttggatcaggcagagagagagggaagcgtacattctgtgtgattctacagtttgtatgggacttcaggaagccagatctttggtacactggcttggccctggggtgtgccatcaattttattgatgactacaatggcaccccactccagtactcttgcctggaaaatcccatggacggaggagcctggtaggctgcagtccatggggtcgcgaagagtcagacatgcctgagcgacttcactttcacttttcactttcatgcattggagaaggaaatggctacccactccagtgttcttgcctggagaatcccagggatgggggagcctggtgggctgccgtctatggggtcatacagagtcgaacacgactgaagcgacttagcagcagcatgactcattttaacctgcagaaaactgatgaatttaggaggaaggagagtgttaccagatttacatctgacacaacttcactttatttcccaatcttaacccattaaattctttaaaacttaacacgatactgcctttcttcattcacttaaaaaaattgttttggtttacaaaaatctttgtaaaggttatgttttcagtaatacttttgttttagacactgactagtcagaatgctgagatgaaaagtaaatcttctgttgaaaaattgatatgtttttcctaggctcttcttcatatgtctttgtctgacttccatccaaccctcagtgttaaaggtcacctcagaaatggctccccactttctctccttgtatgggctgctactgtgtggggatttctctccctcctcccctgtcctctgtctccactactgctgagccttacaaccataaccaccagtgattcagtgcctcacttcttcccaaggctggtagtaaagtatagtaaagtaactataaagttactggggaaaagttaaggggatggggttagagcagagttacccacctcagagccactgttgcaaagcctctccccaggacctaggatggattactggggcagcgcttcccctctactctctttattaaccacctccttctccagagactcccttccttcacctttacaggcatcctcagattcagagagtggaaactcaccacttctaagtgtttctttataccattacattaaaaagatacatcagtggaagttgctagcatttctcctccctatatctgcccacacaaggaggttctgacttggtcctctcctgtagctccctcccaccagctctgagggagcatgtggtggtagcagatggaagatataagggagaatttttaacaggtattgctgggacttttgaaggtacaaaaattatacctgatgacctgactgtacttttt

SEQ ID NO: 41995 - DNA, 855 bp, Bovine  19866880629206
aagtaaggtttccttttaaggagctcaaaatctagtattgaacaattgcatggagagccagtcataaaaccagctgacagtcctgttcatcacagggtgaataaagcaggatgaaagtgttggggagagacaaatgattcctgacttgggacaaaaccaaaactggactcaatgaagagggacaggctggcattactactcagggaaaacaagaatcatctaggatttccctggtggtccagtggccagtgcagggggcatgaacttgatccctagtccaggagattccacatgctgagggggcaactaaggctctgagctgcaatcactgagcccaggccctttagtctgagctccgtaacaagagaaaccactgctttgaggagcctgtgcgccacaactaaagagaaacccccatgcaccacagctagagaggagcgcccgctcaccacaactagacaaagcctgtgcgcagcaatgaagacccagtgcggccaaaagtaaataaaataattatttaaaaaagactcatcttgattatggtgagaagcttagtgtggctcaagtaggggtgaaatgaaagtggaagtgtatggggtacaagtgaaaacaagtaatatgcttctgactaccagggaacacagtgtatagggaagagatggcagcacaataaaggccattttttccacatgagtactgatcaaattaataaatagctaacctgcaagggaataataaagctatttaaaaacagtgtacagcactcccactcagcggtaatactgctgagttcttgcacaactagaaagaaagaataatttaaaattagaaacgtgtcccattcttattaattat

SEQ ID NO: 41996 - DNA, 824 bp, Bovine  19866880631776
ccttgggaataaagatggattatataacttctctgtaatgaggctgagatggatgaggcaaactgaatcactcaaaagtcttctgaagtacctgattgaatggaacaagctggcatgcctttggagtgagtagaattatgcctcttgaacatgtcagaagtccttgaaataaagccatggataaaagggactagtggctttaatttatttagtctttccagaagtgtttgacaaagttcttcatgagaagggaatttagtaacaggggaggaaaactgcagaactgtgggagattagggctgattaagagccaggatgcctggagtcaggaacaaatgggcatttttcactgtagcaagctttagtggggacccacacaaggatctgatcaacaagctgacttttaagattatttcatttttattacccaattttaaagccttgagagacaaggcttctcacgtaaaggggtcagtgaccagctctctgccctcctccttgcccatgacagcttgtccaggacagggtggcaaggttgagtggctgttcatctgaatttgaccccagacagatcttgattcacactctgaaaatgtaagatcttctagagtgttgtaaagaaaatgagtcatgggtagttcagagactgtttggaaagactgatgggatgtggtaatccactcaatcaaaggcagacagggcaagacctgtaagcagaagagctgcttggaagtcatgagtctctcctcccatatctagggtctgctgtatcagccagagaccttgtgttgctcagttaacctaggctgccaatgtctcaagtc

SEQ ID NO: 41997 - DNA, 1981 bp, Bovine  19866880652245
cccaaatctcaacaacttagtacactgaagtttatttattgcttgtgttcaagtccactgtggcctttgcagtcttttccagaggccagtaatcatttccagcttcctttaatctagtggctctgccactccctagtatttgggacctctgccagatgttctctgggaaccaacaatggcagaaagacagagaacataggagatctaggggattttatagaccagggttggaaaggtctctaaagacagagaacataggacatctaggggattttagagaccagggttacttatattactgttatccatattcaactggtcagacctttgtcatatgtcacacgtgatgacaagtaaatgtagtctaggtatcagtccagaacagaaaagaaaagaagtgtggtgagaacatagcaagttttattacacatgccagatggactgttttacaccttgctgttttagcttcacaacaaattttagaaagcagccatatcagttcctagacagtttcctcagcctttctaacagttgcatagtattcagttttacagattgtagttgactcttgaacaacacaggtttgaactgtgtgggtccacttatgtgcagatttttttcaatagcaaataccacagtcctacatgatccacagttggtggaatctgcagaggcagaatcatagataagtaggagttgcagaaagagaagaatctcgtatatagagggacaactgtgagttatacccagattttcaagcatggggagtcggcactcccctaccctgatcaaggctcagctgtatactgtgattttttaaccagtctgtggctcagccatcctcaatgttttctttttttcccattcatccatctgcaatgaatactcttgtccttatgtcattccacacatttgcaagcatatctgtgggataaattctcaaattaggtgttgctgaatcaaacagtatggatatttgacattttgatagctgtcgctaaattaccctactaaaaagttatacaaatttatactctcaatagccattttattgtttaatcttgctgggtaaaacatttctacttttctctgtgtttgaatgaatatttctgtgcctcgtgcttccaatcctcaatccattgtgtcaatagtttctttcatttcaattcaagaacagtgacaatttcttgagaaacaatcagtgttgggtaccacgtagacccctttacatctcttattacatctaatcataaaaagcaagtctaggaggtaggcaaattacaaatgaggaaactgaggctcagagagattaagtagacaaagctcatctaatttgtaggtggtatattttcattatatattctgaagttattcatcttttaccccctctggtacttctcacaccaaagcataacctagggcagaggaaaggaaacgctcattcttatgttgtctagagctgccttccctaagcaagccaagatttctttgaagtcttctatatatattaaaaatgcatgcaagttttgattttcacttttaagtatatctgcatgcttaaaatattcaaaatatttcaaactacttgctcttaagtataactgaaacttcaggaagccgccagtttcccctgtggcttggtgaaccctggcccagtgctcccagggcagacaagggagcatggttttgtatgttggtgccccatggagaggcttctattcatccttcaaaacccagctcatgtgctgcctcaagatcaaggctccctgcagggtcagcaagcccagagtgctatctgtcttctaaagaactctggattgcagcagagaaggggctcactagatttctaatgaacaaatcattgcagataagcaaacacattattgtattaactacttttatttttccaaaggagtcgggaattgccaaaataatgaagcctatttctgagtgccaacctctcttaaacactcctaaatct

SEQ ID NO: 41998 - DNA, 1577 bp, Bovine  19866880697207
aactgcaatccctgaaattcctctctcctgagaattctgctctggactctccagaacccagtgcattcagctgagtttttcttatttgatgctcttagaaagagtagtaagggcaacttttcttgtccttgggaactgggattcagatgagggaaggaaagaacctaaacctcaaatggtccacagtccatcttcctgctagaagaggcactaaaccagggaagacatgatatatgggaagcttgtctgaagagtcagtctacacaaaccttccttcactgagttccttctcatcctctcttaatagcttaactcactataaaatacaaaatgtgggtatagatgataagttgtaagaaaaacaagaccaaatgattttgttttggtatcttaattggtattcaggataattccacaagcctcattttaatgaaggatatctatactgtggcctggaacatcacctatagcatagtaagttttaaaaagcttaaaaaatagtacaaaagaaaagaatcttttgtgtaggggcacaccaccagtgcatgagcagacccagaccaaaagccaggtctcctatgtccagtgttagctatcccacctttcctgcttctcagatgccaagcttgtatggaaatcgacttggagacacacaggataattcagtactcatattgtctcatttctgggaggcactgtaccggtgctaataattcaaaaagtcacggctctaacgcagcacaagatgctttgaaaaggacaaacacaatgaaatctggaaaagtgcagtaagtgagtctagacaggtggaaatagtcagacacacgagcatatcacatgcaaaacagagcaaagctgacctttgttgctttactgatgcgtaaccatgaaaaaaacaacctgcatctttaagtatcatatattttgaatcatctggaggtagaggtattttaaaaatgtatctgagagagagagagagaaaaaaaggaattccaacagatcattgtagccaacatgcctctgtcaatgaaaggtctttgtagctaaagtgaaatggtatttcttttttaatgaggtgaacattggtgaagagatattatgcatatttttctaaaaataattgcatagatcttccccataatgcaataaatgtctgggtttagtccacctaacctactgtctaaaatataatgcaatttttaacataagcatctacgaataaatggaatcatatactgcaagttggaacaattcacaagctacagcaaaaaaagcttttcttattaaagatttcatatgataaaaactgagtgtaataattatcttaaccatatttctcttttaaaaaaagcagttctatttgtaggaagagagcccatattttatatcttgaaaattaaatcagttatcaaatgatactttgaaactcaagaccagctcataataattaaactataacaacgtttcaaggatcaggtaaatctgaatgccagtaatacagaaaaatgatttactggtgcttttaaacacttgaaaataaattctaaacttaaatgatgtgtagcttctatgcagca

SEQ ID NO: 41999 - DNA, 6784 bp, Bovine  19866880717430
aaaagaactggaaaatacagaaaaggaaaaaagaaaatagtcacatacaattccattttaataaccagtagtaacatcccagactatgtgcttcagatctttttctgtttatagatatgcctatgttcagtttttgtaaaattagaaattattatatatcaccactttataagtttacttttctttgcctaatatacactcttgtatgttgtattgagttgcatattagttcattatatgtgtgttctgtaatttattcattggacatttagattgctatgaatttttcactcatgaataccagcaatgtgaaataatctaattacctttggggttgtattcagattaatttcttggtaatttatagaaaatcatttaataagctatagatataaaacatttaatacttttaaataaatttgaaaattggctttcataaaaactttaattttattttcatcaatagtatataatgtttttagtttccatgtaaccttgccaagccagcataatatatatgcgtgcatatatcttatcttacccagtctaatgacttctattgagcaatatggggcaagttgttttaattctgagcctcagattcctaacctgtaaaattaactaacgagagtagaattcagaaatacagtcacaggttctaaagttgatattgattgcagagcctctccgtgctccatctgggaagtgtagctcaaatgagaaaagactgtagtggagtcgggttaacaccagatgaggctgaggggatgattgtcagcgagcatctccctggtgctgtcatgactgctcagaatgtctcagtgtttatcaatgttcatcagacatgcatattctaattcagagggtgatgtgcataacatatataattaaaatctattttattttattgccagctgctttgctttaaaatgcatgctccataaggacagagatctttgtcttatttattgatgtattttaaacacctaacacagagcctgacatgtagtaaagtttcagtaataaatatctattgaataagcaaataaactgaatgaagctaccctatagctttccagaggcttcaccctctggtaaccagcagaatgccctccccaggataacctgtagatgagctgccatgactgggacctctttccagaaaccactgctatgtcccatgacacagtctttctcagatgtgttaatacctgcagactggttaagatccagcctccccttctagaatccacatactttcacagaaatattgggtctttctacttgaactcatgttggttgtgttaatggtttgactcaagaggagtattatttccaagttcctagggaccctttcattgctgccccttagtactatgtagaactaccactttatggactagttgagagaatattatatgatataacatatagtaagaaagatagaaccgttcatctaagcaatatgctgtggtggttaaaaacccaggacccagagtcaaatttcctcagttcaaacctggattccaaaatttaacagttctgtcaacttcagcaagttacttgatcacacagtgttcagttttctcatctgtaaaatgcagctcgtacctacactatagaatcgatgtgtgggtgaaatgagttaaaacatatgaagaagtagaaatagtaagtgaatattattactatatctgtaataattgcattgaaaatttactatgtgtcaaaacccaaatttatattacttcagatagtctttaaaacaactctgtagactgaccattattgttattcataactcatgaatgaggatattgaggttcagaaggttttagtaatgctctaaaatcacatagctagtgaatggtggaaactgggtttaaatgcagatgtgtatgaaatattctctcatggagaaatttttcttagaattaaaatatctacattctcactgacattacgattactattatctgatttatagtatttttagtcatgcttacaaccctagaacatttttcaagaaactagctttacatgaatatgaatatctaagcaaccatctgtgggtctgagggtctattgtttctaaagactcttacagtcacttttagtgattcaactgtggtccagtttatgcgtgtctgtatttcctttcctaggacttagaaaaactcagtcaattaaatagtgaaatacaatttaaaaattataaggtgacaaaagatgaccaaaaacagataatttgcattccatggtgctggtttggtaaacattataatctcatcaaaagaacagctatccttgaagatcaaaatgcaatgatttcaggattcattcagcagtgtgttgaagttacaggcacgctaacccaacagtgattctgtgggtgtggaagtgccctgacaccagcagttgtagagactcatgcactctaaagtaactggttgaccaagggccctgtgagtggccaatatccttctcatcacagtaacagacttgaaatttgaacccttttcagatatcctagcagacaaaacaataaaactgaaaagtaatccatttaaaatgtctgtgcacctctgtatttgtgggcatgatttgctatgccatatttcacggataattttttatacccctgagatacgtgttttcattgaagcacactgtaaaacgttgtgctatcttttgccaggggaatgagttgtgatatttggtaggcagtgtcctgagaactagcattgctacaaattagcagaatagcggtaatttgtgcatcctgcttattcaggaaacccattagaatgttaactctgatggcatgggtttacacaggattcaacttgatgtttaaagatccttttttctcctcaacaggttaattatgtatggctttgtgaaggctatggtatatgctgaccagctgaaaaatggagactttcatttcactgactgtttgttttttggttcactgatgtctgctacagatccaggtaattgcccaaataatatgttttcttctttctgagagtcaaacatttaaattgaatttttctctaaagagcatcacccgagtcaacataataattccttattccttttcacctgcagttgacatatctgttagtgattttaaaaagcaggtgaatattctaacagctctcaaaaaatggttctcaaagcaacttaaagtaatggggaagactctttgaaattctccattgtccgcttccctagaacatgtagccatcttgacttatggctcttaattcttctctgtttaacttgtcttctttcaaaaatgctccatcgcagtggtccccaaccttttttggcagcagggaccagttctgaagaagacagtttatccatgtaccagcagattggggggtggggtgcggtgaatagtttggggttgattcaagcatctattaatgccaccactgatctgacaggaggtagagctcaggtcataattccagcaatggggagaggctgcaaatacagatgaagcttcgttcattcaaccactgctcacctccccctgtgcgggccagtgcctaacaagccatggacttggtactggcctatggcccaggggttcaggacccttgctctattgagttaaatggtaaaagataattttgaaaattgattgctatatgtttcaagcatattaagaatagggaaaatagtaaaaagagttgtcatataccttcatattatcaaattatgataataatcaaatctggccaaagtgttttatcaatatcctcctacattccttctcactatgactaaattatattaaaaacaagtctcagacatcatatcattttatttgcaaatgttttaaaaaatgacagttgtcattatgaaacctaaaaatattaacaatcttaatattatcaaagtgctatcctctgttcaaaaaggcagaattttcttattgtcattatcattattagttcatgtagtagtttgtacaaattagaacccaaataagggctatacattacaattgatggatatggcatctagtatttttttaatctatatgttacccttccatcttctatttttcttgtcacttatttattgcaaaaagaaagacaattgtctatggttgaattaaatatgattgcttaaaatgttcccctagcctcaggatttcttgtaaactgatggttaaatctagaaattgagtcagatcagggttcatttgtttggcaagattacttgcgtgctctgaatctctacagagtcacatcaggaagcacagtgtttggtgacccagccatcagtctgatccatcacactgctgaattgctgctccagcaaagaccaccagaacacacctgtagttgaataagacatgtttattacatgttataatgaagaaactgctcatcagaggaacactgggacctctcagagcgtgttagaaaggaattgttataggatgtgggctaatgcttggtgattttagggagggcttaaggaatcggggtttttctctggatgagatgctgtcagaaagcacgaatgattggacattttagtaaatcttctctagcaggaggaaagactgaatagagccgaagcctacaattggtaaaggaacagcatcactcataataaccaggatagagatgctgtggtttggacagtgttcattatttgggtttaaatgtgattacccagtagtcttgtttttgtcttgattctttatggtcacagagtgaacttgtctgatgttttatgtgaaattgtttacactcaacaagagaacaacaaggcccagctgatagtaacaggccagctcccacataccaggggctgctcctctctttcttagaatagcccagcagcattggcaccatgtggcaccttgttttaaatacagcaccagagctgctgaatcagcttctaaaatttaacaatatcctcaggtggtttattaatgcatgcatgcttgccggctcagtcacttcagttgtgtccaactctttgtgaccgtatggactgctgcccaccaggcttctctgtccatgggattctccaggcaagaatactggagtgggttgccatgcctcctccaggggattttcccagcccagggtttgaacctgcatctcttgcatcacctgcattgcaggtggattctttacccactgagccacctgggaagccccaagtggtttatatgcacactaaattttgaaatttagctagtcaaatcaaatcccagtcatggggaagttctgtaatcaaatgaccttcaaccagaccaatttacctggctcctgagaaatttgtatgctggtcaagaagcaacagttagaactgcacatggaacaatggactggttcaaaagcaggaaagaagcacatcaaggttgtatattgtcacctgacttatttaactcatatgcagagtacagcatgtgagaggctcaagctggaatcaaggttgccaggagaaatatcaataacctcagataggtagatgataccacccttatggcagaaagcaaagaggaactgaagaacatcttgatgaaagtgaaagaagagagttaaaaatttggcttaaaactcaacattcaaaaaactaagatcatggcatctggtcccatcatttcatggcaaatagatagggaaacaatggaaacagtgagagactttattatcttggtctccaaaatcactgcagatagtgactgcagccatgaaattaaaaaagacacttgctccttggaataaaagctatgacaaatctagacattatattaaaaatcagagacatcactttgccgacaaagatccgtattgtcaaagctatggtttttccagtagtcacatacagatgtgagagttggatcataaagaagactgagtgtccaggaattgatgcttttgaactgtgatgttggagaagactcttgagagtgccttagacagcaaagagatcaaaccagtcattcctaaaggaaatcaactctgaatattcattggaaggactgatgctgaacctgaagctccaatactttggccactaatgcaaacagttgactcattgaaaaagaccctgatgttgggaaagattgaaggcaggagaagaaggggatgacagaggatgagattgttggatggtatcacttactctatggacatgagtttgaataagttccaggagttggtgatggacagggaagcctggtgtgctgtagtccatggggttgaaaagagtcagacaccactgagtgagtgaacaacaacaaattttagctaatgacgttagtacccatcaatgattatgtttagtctagtatgtattaggggttataaactagtgctgtgttaattctatcctacctttttgcatgtattagctggtactctcccaaaagaagtagttttccagatcaacaatttgagtgcctgtgatattatttaaacaaaaaaaatcaggataaattattgatctttgtatttactaattttcaaaataatgaattatttctctagcatctcccacatatgatcaaggaagtaaatttttccttttcttactttttttttttgcttgtctttttaaaaaaatttatttatttattttaattggaggctaataactttacaatattgtagaggcttttgtcatacactgacatgaatcagccatgggtgcacatgtgtccctcattctgaagcccccctcctactgccctccccatcccatctctcagggtcgtcccagtgcactggccctgagttcc

SEQ ID NO: 42000 - DNA, 2583 bp, Bovine  19866880828968
tgtgaatgagcgaaaataaaatacctttaaattactaaaagaaaaaatttaagctagcagataatcttaccaataattacatgtaactgtaaagtattaggcagttagaagaagatgaagaattttctttgatcaattttcttattatatcacttttttttttttttaaagaaaaagatataggagaagaacaaaacttagataaaagctttgcttgaaagtaggagaagggattagttgacctgcatgagattgtgaaaatcctaaccaggagcccttcctgctgactcattacagcccaccagtgtaaggagagggttttgatcacctttccaaggtcaatactctggccctaatcccagtgtgctgatacccctgctgggctcagtcctgcagttaggtgtctttcctgggcaacaaagtcagtgaaaacagcactagcctgaccttggaacacatgtggcaaaagaaattcaaagtgcatatgagccggatcattgccaacttaattttccagcccttattgtagagcataacatccttccttctttgtgtgaaccaggaaagctgcagcatcttgcctggcagcactaaccagctgtgtctcattgatgtgatggtaggaagaagccacgagataaaagagatggattctcttcaaattcagataggatcaggacacgattcattaagcagcatcacttatttatgatgctattctacctgggatttcatgtctgtctacctgcaatttcagcaaaaggtgcaacatggctacacagttgttaactttgggtaccaagtgaaaaacaactaaagcgaaattgccaatgatagattttactctgatgttagattcaagcccagagattggagactacacttctcttacttgaggtgacagcatgttgtcctgaacgattttcccttaggattttcaggctgtgcttttgcagatttttaacgtttctgtatttctgtatacctcaacctgataaatgagaagtcacgcaggagaagcaggcccatctgttttgtgccccacatgtgttgaacatgcatcaaatcaatttcactgaaatgaccacagcaagcaagttgctgggcagggatttgaactccaggctgcctgatgacaagagctgtgcttttgctcccacactgcagcttccaggcttcctgaggccacaaagaaggcacaagtgtctgctggtcctaagcactctagaggtgatacaaaggttatagacaccctgaattcccacgtgttttatagtcatctgatttgttttatctgagaaaatagcccccctttagaatggggcttcctggctatgaaacagaacagctcacgctgttgttctctatgcctccgcttttttgacttgcctggtgtgaggagggttcctccttctgatcttcatccaggtccacaccaaccctgttaaagagaagagagaactggtaagggtcttgtgcagatgagacgagacagtctcttaggtcagaccacctgaaccaaagacagtacgaatcagaggactggtttggcagaaaacccttgtacctctccctgagtccagggaacataaaatagatttatgggaacaggagagctcgcacagctgggcctctgtacagctggtgcaacggagcaccgacagctgttccccactgctgtctttcccagcaagagaatctgggagtgaagccctcagggaaagacctccagggcccccagacagggctcctggagggagggccacctgcttctctggcaggactcactgaccacactgctccggggatgtgggggcccgggctgcagcaggcttcccaggacagaaacaagcaaacaaacaaaaggtttttttagttgctttacaatattttatttagggaaaaatctgatctttcatccagatgctcatggagtctggcagtagggaggatccaggtttgtgggacttatacgatttagggggctctctttgagcaaattaatgcaaaaatacaaatacaaaatgaggtatgaaagtgactctttacaacaagaaaataaattgtaacacaattaataattttaaaatctgtgcaacagacatctcgaaatttataagacgtataatgttctaactaatttactgtctgatattcctctaaaataacttttcctcctgagttttgcctgcatactttcttactctgtttacatgatataatgactttgtataagagagaatgggaagataaggtagtctttcctctagtaagactgatggaaattattaataattgggagtcattatagcgtgcttccttacacagacatacttgctgtgtgcaaaaccgctaaagattaataccctgaaaagacaagatttctgataaatttccctacaagcgattctcgtcaacactactacccagtacatttatcagtgtaagtgctgcatcactgaatataagtattcttgaatttccattttgacggcgcattgatgagaacggaatcctccacttagaattttacacatctcacaactgggaagagttttccacagattagcttctggctcagga

SEQ ID NO: 42001 - DNA, 1648 bp, Bovine  19866880861972
ctgctgatgccatcagttctttctcatgtaacccagaacaactgcattaagtgactttcctaaaaccaaactcttactctcatttattagattttcctttcaggtactctggaattctatatcttttctccactgatgagattctttggatttttgagcaatgcctccagaagcaattcaatttctcttctgaaggaattgcacaaagtcttaacattttactaaatccattagcttcatctttcaagaccatcaagaaaatggcagccttaaatttggcagtattatttaacaaacacacactctggtgcatatattcagccttggtattttctgtgctgcatcaataaaatttaattaaagtgagtagaaaaattacagtaatttccatttatcatccccaaatgccattatgagaccaaagcccttcatacctacacctattaagcagggtgataaaactataatggactattcaagggggttatgccattgccattctttagaagttctgaggtaataatgagcaaccatctgtcttgaatgtcatcagaacggctagctgatctcttaaatcctattcagataaattttttccattaagcagtgaatcagacttatacatagaagggcatgaatcacatatatttttatgtgttgatactcaagcattaattttttttttgttttgttttctaaaggtgaaagaaatgagagaaaagagagaatgagacaaaaggcaaaagagagagtaaaagaaagggagaggaccatccctctctgagacgctaaagctctacatagtggtaaagaatatgaaaccattattcgaggggaaatgtagtaaaatttaatgcagcaaatgtagtaaaatttttagaaaatgataaatgaggtaaatacactttctttctgtcacctgatgcaaacagctgactcactggaaaagtccctgatcctgggaaagactgagggcagaaggagaagagagcatcagcggatgaagtgcctggatggcatcacagatgcaatggacatgaacttgggcaaactttgggagatggtgagggatagggaggcctagtgtgctgcagtccatggggactctgcaaagagtcacatacaactgggcaactgaacaacaacaaaactttcttagagttttggaagataagacaaaaatgcagagaagacttggaacagtgttggcaagaaatgtcatggtgaattaatatgaatccccaaaatgttgcctattggggtagagatagacagtcctggcaggtgactcaggtatagagctctttatgagcaagatgaagaactggaagaaaataacaacaatattcagttactcttagctacgtggaacactgatgaatcctgaagaaagaggaacccatcagtggtaaaatggaataaagcacatgtcagaagataaagaggtgattaggatagatatgatagcatcaatacttggtggggaaaaaatgtcattcttggttctacatattaaggccatcttgggtcagtgttaaggctgagaaaggaaatgaagagtaaagggaagagtgttggctggcagggacaaggtgacttgcgttcactgtcatctattaaaggggacagggaggaagaggagaagccc

SEQ ID NO: 42002 - DNA, 807 bp, Bovine  19866880896357
ctttcttagctgttttaatttagccaagaacaaactgtgtgtgtacaattttgtatcctgaactgtctacctgactgttataacctaagcatctcccattaattctaaatcttctttgttttgtcattactggtcaaataagtgtatctagatccatctattggattaaatagaaaaaaatagaatagaaaaatggaagaaaatattggattttcttctcctacaacctgtggatttttattatttcatgctttcttatttatgtatcaaattaaatcattgacaccatctaagtgaaaggtgtctttcaaagggataaagtgttcttcattataagccgagcaatatgctctaaggttgtactgacatttgaatgctaatttctaaaacaaaagaagaaatggttcccccaagacactcacagagcaataagaagattagagggagatttgaaggatgagactcagatgctacttcagcattccagaaaaagcatccatcacttagctgacagagtcagggtcctcacttgtcacttacctgctgtatgatcttaaatatgtcactgaacttccccacagaggctttatctgggaaatgggagaaataatacttgcttcatatacggactattttttttgttgtttcatcgctaagtcgtgtccgaccctttgtgaccccatggactgcagcatgccagacttccctatccttcattgtctcctggagtttgctcaggaggtttagcataatctagtatataatctcggagaaggtgatggcaccccactccagtactcttgcctg

SEQ ID NO: 42003 - DNA, 1481 bp, Bovine  19866880945682
taatctattatcatcttttacctgttagtatgcattttaaaccttaatgaaatggtttaagaaaaattactgcataaaatccgaagagttgcaatagaactcccattttgcatttaccctaaagatcaattgcagagcccaaatatgggattttaactggagtttttaaaaataagtgctgagttctatcacacagaatcacttcgaagaaattggttaagacagggaattgcccattagaggcaaaatgtgctttaatgcagagttcattgtactcagtacatggaatgtttggaagactattagcacttcttttcttttcttttttttaacgggaagcgtgttccccatgtcccagtgctagatttgcagtgcagagtataactgaccagtaatgaagcagtccccatgcttggagatgagggttgaaagaatgtaacaattgacttctctggggcattggctgcttatttcttattttctgcaggattcaatgtgaacatcaaaggtcaccacatgtctccttgagcttctttgtctctcattctccttgggcacagcacccacatatgagccccaccaagtaaacgatcatctttgtttggaaagttccagctaaaatgctgttcagttctggggccaccacaacctggatttcctcacctgctggccctcgcggggctgtgccaggagagtgcagctgcctgcctgcagcctttgtccatgtgggttgtgatttattctggtctagccagcaaaataatcccattcttttctttttattattttactgtcaccatggatctactcattattatacagcactcttatgtcaaagagatcctcaaagaaagggagaaaatataaatgtttgaaacagcaatcttaattctatttttcatgaaccattaccagacattttaagcaagtatttaatttttatgagtacaaacttaatacatgcttattatataaaaattttaaaaactaaaaaattatttaaaaaaataaaattcacctgaagtccttttatgccaagataattactaacaatagtacatttctctattaatctatagatgtatagatttatagatctataggttttttggtaatcaaattttttttacaaaactcagatctgttatttttttacttaaaaatatagcatgatagctttccaattttattagctatcctgtgaaattatgttttcaaggactgaataacaaaataatatgaatatgccaaaattatttattatttattagaacatatgaacctagaattattttaaacaattataaatgatgctgtgattatttcatacatacatacacacataaaacttcttagatctctgatttttttttggaataaaaatgaaattgaggagtcagtggtggaatattttatagaactcaaaatatattttgccaaattgctttctagtaaggtcaatggcaacccactccagtact

SEQ ID NO: 42004 - DNA, 814 bp, Bovine  19866880956307
tctgtgggtttcttatatacccaaatttaaagaacgcttatgcagaccatctttttttaattcactgaaaacaatggacaaggcaatgaatttgaattgctctagtcattcagctagttaggtatctggactatgccaagtagatcccaggtctcctggcaccgattgtagtacattttctcttacataatttgcaacgacacaatgaaccttcatatcatgtaaacatatgtttgtacatacatgtgtgtgtgtgtgtgtatataacactaatgctccctgacagggtccaaaagagggaatcacagagaacagtgtaaatggtgttctgttaaccaaaaggaattaattgtcctctcaaaactgatctctctagaaagaacttacttgccagcagaatcatcattcttcccaaagaattagggacctcctcctgctgtttcctaaacttctttgcttgccagtaatttgaatttaactgtgtacctcttttgtggtttctcaaacagctcttttagttagtgtcataaagtattggttctagtccttgctcaaaattgcagaaatgagtccttgcagacagctcttcagggagcttgcccaccactgaaaactcactatgcaaactgaaaggcaattttgagcacacgcatgagtcagaaactcttatcattattttctctaagtcatttcttgatttctttcagagctccttatttattttagttctcagatacttttgagcatgctccactccccatggacctggatgtatgtacttagttctatttgtcattgccacgggatcccataa

SEQ ID NO: 42005 - DNA, 4504 bp, Bovine  19866880967896
ctgagtgactgaactgaactgaactgaattgacagcctatacaaaatcctcaggctgctgcaagtcatttttttttttaacgtaaaggtgattgattgccctcaatcattctgattttttttcctccagcaagtggctgctctgagtagaagcaaacaccagaaaatccatctcctggtttgggtgcagtcaggtgtatcattgtttttaaagtatttttcaaaaatatgtgtatgtatgttccaagttctgtacacacactgtgggctgggaatgagttaaatcagaaataaatgactaggcagagctgactggctgctgcttgctccctctccctccctctctatgggtttcacagaggtgtttgttaatataacactgccctgtctgcctggcaggagtctgagtctgacacagaaagccacaggtcaaattgggccaaaaatgtttacagtgcccttccttttgctacatttttggtgcaggctgaaatattacacaaaacaggattcagtcttatttacagtgaaacctcttaaaatggatttaggcacaactgagttgacaaccataatactttgacattgtagtcaaaaatgaaagctcttttcttccttaaaactttccaagaccactaagatgatatagccagtttgcagcctggcacaaaaaaaaaaaaaaatgcattccttaccttccccaaatacatgagtatatatttaataaaccctttatttaaagagatccattgttattgttgttactgttatccagtagctgagtcatttccaactctttgtgaccccattgactacagcatgccctgcttttctgtcctccactatctcccagaattcacccaaattcatgtctactgagttgatgatgccatctaaccatctcatcctctgctacccccttctccctttgccttcagtctttcccagcatcagggtctttcccaatgagtcagttcttcacatcaggcagccaaagtattggagtttcagcttcagcatccatccttccaatgaagttaacagctccatcacctcacatactaccatttttagaaaatgagaacgaagagatttactgttagtttactcaaagatttactcgttgtgactcaggcggcaaagagtcagatacgactgaacgactaacacacacacactcttacatctctccatttacccactcagcagcagttgttttattgtatgatctgactgtactgaaaccttaatgtagcacatgaataaatgcagttaactagtcttactggaaaatgctaggcaattgaagggtcaatctgaaacagacacaagatcgggaaaacacttatttttgacttagtagttgccagaattaatcaaatcataaatgtgcataatttgctatttttaaagtgcttattcttaggagttctttactattaatttcattccaagtgaatcattatgaaatccttatgaagaaaattatttttaagccatgtgtttattttaaaatataatttattatttttgcaggcaataaaaatgtgctatgttggttacaacacaccatgattggtgggaatgcatgctctaaataggaatgcattttttactgaactaaaaaaaaaacagactaaaactgcctttagatacatacatatatatgcatatgcattgacgatagtgtgtgttcgtcactcagtcatgtccagccctttgtgaccccacagactgtagcccaccaggatcctctgttcatggaattttcctgcaaagaatgctggagtgggttgcctttcccttctccagaggatcttcctgacccaggattgaacccaggtctcccaaattgcaggcaaattctttaccatttgagccacaaggaaaagcacacacacacacacacacacacatatatatatatatgtaaagtttttgttgttttctgggaatgctgtcagagattgcaaaatgatagttatttctccattctacatttataggcttttagtaagagtccttcctgtttcttgaggtggtttaggattccctcctctggcttttttgaatgaaacataatagtattttgagtttatcttgttttgacatttatgagactagaagagaagatgttgattaattaaaagaagatccccttcactaggctaagcttcacaagggcagagaatatgttttttttttctctttcttttatttttttcatcaaagtaacctcaaatcctatgtatagtctaacctcagctgagttcagctgctaggaagagagatcaaaaataaccgtaattgaaacaaaacagatttgtttttcttttttctaaaagaagttcagagctaggcaaaccagatgactctcatgattattggggacccagtgtcctgaatattcgttggaaggactgatgctgaagctgaagctccaatactttggtgacctgatgtgaagaactgcctcatttgaaaagactctgatgctaggaaagactgaaggaggcaggagaaggggacaacagaggatgagacggttggatggcatcaacaactcgatggatatgaacttgagtaaactccaggagttggtgatggacagggaggcctggtgtgctgcagtccttggggttgtgaagagttggacacggctgagcaactgaactgaactgaactgagggtccttttatttcctttgttctgccatcctattccaagaccactgtccttgaggtactttatggtctaagatgactggacctctagtagagggcaagagaaagggggaaagggctaaagctccttacctactgtctatctttcgagaagcctttctgaaagtcccatgcaacagcttccacttttctctcactggctacaactttgtaacatggccaccccctaatagcaagggagtctggaaaatgtggtcttttttattgggcacattgccatgctgaaagtgaaagtgatagtcactcagtcatgttggactctttgtgaccccagggactgtagcctgccaggttcctctgtccatgaaattctccaggaaagaatactggagtgggttgccatataagtattaataaaagcagtgttctcatactaataaggaaagaggaagtggtaaaatgagattaataaagacaatctaatcagtttttcattaagtgaaatttattcaatttataagattgttcttcgagactctttcccatcctttttttttttttttaagtcaaaaatgtttctaaaaaattgaaataatggtagattctaccttactccccaaagtttttatttgacctaataaaaagttaactcttttagtgctctaatattattgacattttactggcccacatctagggagctcctggactatagaggtgagctgtgagatttctcccaactccaggatagttcgatggttctgtgtcttcagtgcaccctatatgcttcatgccttctgcttgggaggtgctcatgaggtatccacggatttatcaagtagttttatccaaagtgctaatgcccagtgacacaaagaagagctgccacctccaggtccttgatcagggcttgctttgcagtaaggaagagaaattcatggaagtcagaataagtgaaggagtgattgttgcaaggatataggggaatctcatggacaactaaaacagaaaaataagcatgctcagtttgcaactgggattaaacatgggaagttggaaatggaaactaccctctgtctctcatggaataacacgatctttcaaacttctctgtttttttctgccaaccaactttgtttgctacttaaattttttcttccctcagtaactatggttggcatgaggtttggcttctgtgatgcaggggtggtacaatcaatctcagagctgcaattgcaaattccccagcaaaagtttaattggttcagcaaatatcagattactgtttctggttcaagtagttgtggcaaggagttgggcaattagtacaaatatgtctttctaaggttcattcttttcaacaggacctacggtatgagcatgttgagggaaggggcagtactatgcaacggttataatacatttctcttttcttgttaatttccacctctggcagccctctgtttcctgacctcaggtcctttccctcctatcagggtgacagatcaaagaccttcactattacttggaccatttcattaaaaaaattatttggctgtgtcagttctttgttgccacacacagatactgccatcacacagtatcttttattttggcacacaaactctctctagttgtggcgagtgggctccgaagttgtggctcacgaacttcagagcgctgtggtgcagcttcacagtgccctggcacacggcttagttgctcctcggggtgcaggatcttcattccctgaccagggatgggacccatgttctgtgcattgcaaggcagattcttaaccacggaccacaagggaagtcc

SEQ ID NO: 42006 - DNA, 1160 bp, Bovine  19866880979480
ctagaacctgataagaaaaataacccagtttgcaaaatcagcagtaggggttttctggagatcaaaagagttttcttactattttaataattccagtaaccctggtgatctagccactttccagaccctgctcagcaatgaagaactcagaaagtcactgattcccccattccaaatcagttatccaatcagatgagacctgttacttggtgtctctgtaacagaaggaagatgctcaatgtgatggaaatgtctgggatctcaagcccaacgggctggattccactgagcaattcttttattctctttgagcttactgtcttcatcaattcaacaactatttcttgaacatctaaaatatatcaaccactgtaccaggtgaaggggacagccctaccctcaaagtgaccaccacctagagacaagaatatatggcaaaaacactttgcaggctatacagtgacagtcgctcagtcgtgtctgactctttgcaaccccatggactgtagcccaccaggctcctctgtccatgggattctccaggcaagaatactggagtgggttgctattcccttctccaggggatcttcccaactcagggactgaacctgggtctcccacactgtaggcagattcttcagcatatgagccaccagactgtaactgttaattttcttatgtgggtaccccattagctttgcacataaaataaaaacatgtgagtctgtgaaggaacaaatgaatgatcaagcaagtgagatatgatggctgttttctagccactttatcttgtgccattaccacatggtcccattggtctaatatcttagtcccaagaagtccgttttgacttgaccttcctcagccttttatcctcaggaaatcctcatctgctggctgtcatctgcccccttcattcttcccttggcatagtcacccagaatctacctccatcactcaaagcacctttgaatattttcctagaccacaaattcaataaacatccattgagcacataacattatatatggcaagctctgggcaaactaagatgttggcaaacatagatcctgctccacgtggtgtctgtggatggcacttacacattccattcactgccacaggatgtatgtgttattcctttgacctgaagctactga

SEQ ID NO: 42007 - DNA, 754 bp, Bovine  19866881002023
ttccattttaacattttttattttactacttgtacttttatttactcttcaaagtctacatctgtttttataataccatcccattttgatttgaaattttcacatttaatcttctgtaacctctcgcaagtatatttaatgtggattcataaaaattcaattagcatattattattaaagaggaaagatgaggcaaaaaatcaaattttaatatgtcagttcagattacagactttgtaaaagtacattctcaggctagaagaattcttaaatgtgatttaattatttactcattttcaatgatccataagcttggttttccttgttgtctaacacatttgatttttccaaaaattatgtgtgcccagaaagactttttttggtaaatacagacaatatttttttaattgcatggtagagtatttaaaataattttgaaaatgaaaaataagaatcactctacctgatatcaagtcctaccatatacctacaataatcatgacagtataccatcagaataggaatagacacacagatcaatggaacaaaatagagaacctaggaatcaagccaacaaatccgcagaactgatttttgaaaagggtacaaaagcaattcaatagagcaattaaatatccatggacaagaaaagaaaagaaaaaaaagactctcaacctaaaactcaccacttacgccaaaattaacttaaaatgagcatagacttaaatgtaaatataaaggtatgtaactttag

SEQ ID NO: 42008 - DNA, 1474 bp, Bovine  19866881069783
ttggctttggctacccagcatccattctcactttcactggtagtaagcatcctgatgttactgagtgaactacctttctccatcagataccatcttgttaaccaaggtacccccatcctcacctgccaaagagaaagggggcatctgaagcaaggtcaaccagacactccttcctgggggtgtgaacctttaggaggaagttagaaggatgtgtaactgttggcacccggactttccaacagaaaaaccccctgttgggaatctctattcttgccatagatccctggagctgcctttatgcttctcccctccaataaattcccttctgatcacagttgccagaattagttttcactgcttgcaaacagagaaatctaaatagtacaagggaagaaataatccatgagggtatttcaacaaaataagctgtataacttggtgacacttcagaagggaaaagaggctcaaggacagcacagcctctaggcttagatgcttggactgtcttatgccaggtgcatggtgatacacaaacaaaaggaatcaagctcacaaagacagttttcacagtgttcattattctttttgaattcatctccttgtaagattcattatgaacacttcagtgtgtgtgtggggggctcgctcattaccacaattttctgctttcactttcagttgttactaatttgatgatgatcatttgatttattttgatcatcttttgcttcaagggctacatttgcagccgcctcgtctcagtctcttggaaattgcacctgcaaatgttcagtcgtcacatagaagaacttagttttatggaaacaagtggcttttagacatgcaaatgaaggttggcatttctattacccagaggtctgatactctgctattgtaaatatacaagcgcagtctgagaaaagttttatgtaggaagactgggcagaatgtcaaatgctagtgagaagtctttctggaagatgagggtgtgtagatagaaacggaatttaaggagtcttcacaagccacaagctgggacagcagagaaggaagagaacgtatgtacaagtgtctgccctgattacaaaatcagctactgaggggtctcagatttctaactcttctgctaatttgcggaaggattggaagaagtcaccctattaattggtatgtcagttttctttattgctgaggtaaaaggattttatcattttgtagtggaaggacattgcacacatacacacagaatgtggcttttgagtaaatacaggacccatgggaccctctctatgaggtacctggtacatatgcatacctaaattctgatcaagtagaatttttctcggccaagtttttaaaagtcatcaggttactgagtcattattctaaattgaatatgggaaataattcagcagtattatttatagcatatctctggtggaattgaatcctgtcacagaagccactttttcag

SEQ ID NO: 42009 - DNA, 1952 bp, Bovine  19866881082709
tattcgggacaatatgtatcaaacatcatctcatgataatgaccatcacaatttgctgaatttccatcacaattttcctttaaagcaatattctttttaaaacttaaggaaaataactatcattacagtatttttttatcattacaattattttttttaatcagttacctctcaattaaaagaggaaagatactaagaataaatataataaaaaaaatcataactgcttgctcttggtcacctaagctcaggttccctcccagaatggtacacattctgggaaacactagcctagaaactaatgaaagctggatacaagtgtagccaagttctgatctgaattcctttatggtctgatgaaatacttcctgagtccgattaatacctctctctggcccatcctcaaacttttctataatctctgtcttatggtcaaaatttaagataaaaaaattttaatgggagttgtttgcttgaatcccctaaatgggtggagtcattgggaatcttcccaagctaaaaatttccttaatgagtgttctgcccatgggaagtatatctatttttttaactataagtaaggtatttttgtttggcttttcttaacgttggtctataacttcagagtttataaaaaaaaattaattgctgaatatactttctaaacataactaaaatgtatatttctaatccagccaaattatatatactactacaaaacaagtgatcttctgagtgttttttgtgaaaagactaatattttattaaaatgtttaaaaataaaccagatacccaaaacactacacatattttaaaatttcagactttttccgatactgaaggtaaaatggtggtaaattttaaaccaataatttctgaaacacctaagttacgtcttacagtcgtcttacatactcttagctctccaatgtggttcccagcccccatgtcccatttaaaacactagggcaaaattaaccaaacaataaacgtaccttaaagttttcagactgtaaatggccttgaattgtacgataggtagcattgaggtctgaaaatatctgacacaactttgtttcaaaactgaaattcaaataatacattactttaactattattctgaatttttcttctgcaaaagcccccaaagagtcttaagaacgagttcccttgattaacaaggaattttacatctcggttactttgggccatctagtccaacctctttgttccataaaatagggaacagaaaagttaagcaacttgttcaaggcagaaaaaggaatagcagagccaagattagggctgatatctccaaatttcccttcagagccagttcttcaaagcttccctgattcataaaataaacaccaaaaaggaaatgtcgggaactgagcaagagttttactatactcttttctgagcatcttacccttaaatattttattttaggcatatcaccttacatcactatacttacaattttctataataggaagcattggcaactttggctgaagagttgtataaaacatcagaaaccaaatataatctggcaatctagaataccaaaagatagcataaaatggattaaaactgaaaaccaacagcaaataatgtagctaacaaaaactccacattgaattttttgaatcaacagcataaggacaatgtttagctataacttaattataactaaatagaagaattttaagaaattctgtatcaccacaaccatgactttagcaggaataaaagttgtaattcatttacatttcaacctgttgataatttgtgtcaattaacctacatttcccaggcagaaggaaaacaaaactacatgggaaagatctcttcagttaagttcttgattcaaaaatgaaaccaatttcaatcaaagccagaagtcaggttattacctctttttcttaattaaatgttccataaagaaa

SEQ ID NO: 42010 - DNA, 1526 bp, Bovine  19866881110742
atggggaaacaatggaaacagtaacagactgtattcttgggctccaaaatcactgcagatagtgactgcaaccatgaaattaaaagatacatgctccttggaagaaaagctatgacaaatctagacagtgtattaaaaagcagagatgttactttgccaacaaaggtacttagagtcaaagctatggtttttcaagtagtcatgtatggatgtgagagttggatcattaagaaggctgagcgtcaaagtgagctagcgctgtagtccatgggatggtaaagagtcagacaagactgagcaactgaacaacaacgactattcctgcacaggtagcacagtgctgcccctgtgcaatgagagcattcacactagaaagaagagggtcttctgggcaacatgctgatggtctcactggccctctatgggctccctctctgagatctttttctcaccttcgctcataacacataagtgagttgtggctaagatgtcagcatttgatgctgaagattttattttcaccagtgtggagttcaaataagggccctttgaaacccaagagccttccaaatgctatcatgagtggcagaatgtagatattaatagctactgagtgtgcaacggcaggatggcaaaggcaggaccactgaccaaaacaggaagaagtgcatccagataggggcagacaggatggcatggaccttcagggctgaagataatgttttcaaatatcacccatgtcctttcttgtgtaattttttttttttttcctcttcaactcttcatcacaaagacaaagccagaaaagtaacaaactgcatgtaggaagacttatttgaactctttttctagtaagactttttttcatactaataacctgactttttaatgattttatcacatatcccacacctgggtatcactcatcaagttctaaagtttgaagatcagacaaggaagaaaaaggagaaagctcacaaaggaaaaagcttgtccagaagctagaaaaacagactggggagaaagtgagtctctgggaagttcttgggaaggcaggttctggaaaactgaagacagcaagacaaattccctacttttcctgagagaatcctgggaaaactgccagcctgtcattacagactccaacacaccggggcaaggcaaggtaatgcagcaatgcttggggaacaggtaaagacctgtacctaagtatgagcacaatctcatagcacccaacttctcctgtgaagaagcaatcgagggttcccggaactataaagaaagggtcccaaggagacccagggtcaaatgagaaggccacagtaagaggggacctgacaactgggggcaataacaaggtccatggatattctgtctttgacacgtgatagactatgggcaaagtacctaccctttctgagccaccgtttccttagccgtatctgtctcacagagctggctgctatgagaattgcacaagctagtgcccctcaagttgttagaacacagatctgcacgtacatgtg

SEQ ID NO: 42011 - DNA, 722 bp, Bovine  19866881118913
tgcttgagggtctttctttacacgtacgctgtcctcactcagccccccagacacaggtattgcttccagaaatgggggaactcacccagcagggtcacacactagtacaagggagggccctgaccgcagttacagcccagatcagtctgactgcagagcgctttcccacccgcctgtgcggttggagctttcaggacccagagatgctgtgggaatggaggggatgacctagaccaggctcactggggccattattgcaatgaccccacgatgctcccactccttcaggaggtctcgttcaagtaaggctgctattactcccctggccccgtctctgccttttcccaggaaaggagaatcctttaatcctagtaaaggagagaggtggtgataacagcaaaggaagtgacttccaacctaaccagttacctccaccaccaagaacagaccgttctcacacaagtataatacaaagaaaaatggatacattgggatcaagtataaagggtcaattaaataacccggaagattagctaaccattttcttaggctgccaaactgaagactaacataagccaggttcaagaatcctttttaaaaaatattagtttcctcaggtgcatatgtatgataagtggagccatatgctgactacgaagcaaacataagcatcttttatgattacagctgtgtgaaacccatgccaggcactctggtctgga

SEQ ID NO: 42012 - DNA, 938 bp, Bovine  19866881121429
aaataattgaaaaatgcataattgcgtatacttattccttactcgctgaagaagtttatctctgtagtgttctacttgttcctgaaagctctggcctgcttttttaggtctttttccagattccaattcatcttgaaacttcataactttgagctgtgaaataagacatttttaaaataaatctttttaatcattatagcttctcaagcagtacattgctcctttaaaaaaatattttcttctttgaaacatgtataagaagggaaaacaaaaatagcaacataaaacataaaaacatacagtaacttattaggattcagtcaaaacataacatcagtgtatataactccctaatctgaaggccacttgtgagacaagcccaactgcagaattcaagtgatcaggcacaggcccatgtgctctctgcacagccacacaagatgacttgaaaaccaagacctgtgcctcatgcccttgagaaagtacctattctttgacataatgagaatgaatttggtatctggtaccccaacttactccaatactttggccacctcgtgcgaagagttgactcactggaaaagaccctgctgctgggagggactggggacaggaggagaaggggatgacagaggatgagatagctggatggcatcaccgactggatggacatgagtctgggtaaactccgggagttggtgatggacagggaggcctggcgtgctgcgattcatagtgtcacaaagagtcagacacgactgagcgactgaactgaactgaccccaaattagaaaggtaatattgttaaaggtaagcgtaacttccagcaaggtaagacagtcagcagaacacaggggataaacaactattaaaacaatcaaagagagcagcattctggttatagctcataaagctatagcttgaagtaaaatttcact

SEQ ID NO: 42013 - DNA, 1403 bp, Bovine  19866881136350
cggttgctttttaatgatgttgtcttaattttctgctaaacctgtttcatctctagtcatccaacattaatatttattttgttcatttacttttaaaatattcttaaagctgttacaaatattctactgctgctgaagataattcagcataggcgctaccatgaaaatatcatagaaaccatgatcaatgtgttatagctgtaatctggcttaataaacacaacactataaacaattttagtaaattaagaaatatccattctagaatgtgttataaaatcaactgctgaatacatcctttttttaacctctgtgcttcatcccggaattaacagtgtagatagatttcacattgtaatgaaaattatacttaaaaatcatcttgggttaaagtatttcccatgtacatattcctttccattctattttccttaaaataaaaccctcagcatttaacctatacagattggcttgcacaaatctcacaataaattacagtaaaatagctatgatgaacttgaacttgtaccgtatttaatgtaatatataactacactctggttcctatttaggcttcataactttatatcataacacaacattctacagaatgccttcagtacaaatgggctcaggacggcagcaacaccattaccattacaggaaaactgcaatggtttttttcccctagaaaataccaaatcccaaaatccaacctactaactcataattcactttcatttcttcttccccataatttgctttcatatctaaaagaagctcttggttgaagccttataatgtcagaacatttagctacttcacaattttactttcaggaaacatgataaagaaaagcaatgtgccccacaggcatcctaagtaaactattattaattcacattctcttttcattaatttggctaggaagccgggaataggggggatagcctgtgggcgcccttacagttctcagatcaaaaacttcccttttcatatgcctccgtggactgtgtcagaggcagaaacactccaaactcagatacttgcgtcacttttctaaccaaggaacttgttgactaccattgccaacaaaacattcacactaatttttgaggtttgtgttcacaccatcagatggtttttgaactatatacttatcttctaagaaaaaattctaagaccaaaacatcggtctctggttcaaggtttctcagtgtaactccagggtaatcaaaaccaaatgccttcaaaccctcaaggggttacttcttcctttctgtgccccaagtggaaagtagtgccatgctttttcctccactgccctgcttgttttttgcctttagaatttgaagatgtgttcccattcctgggcactggacaggctacaatttacctgggag

SEQ ID NO: 42014 - DNA, 1059 bp, Bovine  19866881155566
tttttgctgagatttttgggataagcaggcacttctcattaagaggagaagaaatatggatgggtatccatgttaccttccaggagaaaggagccaaaccacaggaagcagagctgaaagagagaaaccaggtactggtggagaaagagaaactaggtatttgtgacgtcattttagccccgattcaaaccgaacctgaaatcacctttcctgggctctgcaattacaggagccagttttatttcctttgcacttcaactgctttggatgggttttcttctttgtaatgcaaagaatccaaacgaatgctgaattttcccagagtgttgtaagcagtctctcctatgacacaagcgtctctaaggcagggccccctgtcttatctttgtgtttccagcagaaggcaccatgcctggcacctgagatgcctccaaaccatgcttatttaatggcaaatggaaatggggtcctcgggtccgcagcattagcctctccctatcctgccagattggaatctgcattttaacaggatcccaggtgattgatgttcacattcaagtttgaggcagacccacaggcaatttcattgcgccaacatttagcctggagtggttttgcacaagcagtaccccatcagttaagtgattttgggtgtatttcaggcttctttccacgggcatcttgctcacttctataaatgtatagataaaggtgctcagaaaaacaggagcagcatccacagctggtcaaggcccatggagtgagggatgtgaaagctccccctagttgccctatggatgcctggacccctccctggcaccacatcctggccacctgccaaaggaccaaacatttgtttgcttatgaatatgttaacagcccaccagattcttcttgatttggggagcttgaagaaagctaattgaagcctgaaatctgtcacagtcaagagaatactacatgtcaaaatgaactctgggcttccatcctgtagcatcctagccacatggctgggtccagagtctgatgttcagtctttgtgagtgcattttttttgga

SEQ ID NO: 42015 - DNA, 1082 bp, Bovine  19866881161175
tccatattaccaatatttgagggtctcttactcatattattctgttaagatatgtttaaaatggattttcttttgatcgcacatagtactagggtgatgaatattaaaaaggagtagaaaataaaaaggcatgacgcaatgttgtttaaaaaaatatttatctcatttttaagggtagccacaataaacatttaaggtaaaaaggtatagaagcatcgttaaatttctctctcaattttaatttttttcttgtgatgtatactttttcaagtacaggtatttcagtatgattttgagaaaatgatctgttcactcttaactgaattcataaagctaagttctcaattttaagtatgctgttaccatctctaaaatctagatgaatcttggcaatcatggggaaaatagttaatctctctagatctttagcaatactttcgttattctgacaagctgtccagactgtcaaaaacatagctaggtgattcagtccctgaagaaaaatgtatttatgtcatacttttcggagaaggcaacggcaccccactccagtactcttgcctggaaagtcccatggacgggggagcctggtgggctgcagtccatggggtcgctaagttggacaagactgagcaacttcactttcactttcatacattggagaaggaaatggcaacccactccagtgttcttgcctggagaatcccagggacgggggagcctgatgggctaccgtctatggggtcgcacagagttggacacgactgaagcaacttagtagcagcagcagcagtcatacttttggatgaataaattccttaagaaaacattatagtattttgggtccctttagaaactcctagcaattctttccccttaagtgtttttactaattaggaagcatttacttactgtctttttggtgtgttatagagggataaagagtgattaaaaaaactatgaattcaagtcatttgtttttcatttacccttcttgcctggttttaataaaaattctgagttttggccattgctacaaagtaatgttcatatctgttttgtgtttccttttaaaatacttc

SEQ ID NO: 42016 - DNA, 1296 bp, Bovine  19866881199998
tttatgaggcttgcattaacgcatatttcactataatgtaattttatattagatgttccacttatgcatggagccagaatagtttctgctctgtggcgatgctgatttaaatgagtaaaccacaaggaatcaagaaagcttaactctttgtgcatctcagcatggttgtgcttgcaaaagaattctctgtgggcagaatttcacctttagttaatggagagaggacagcatttatgtttcaggtggggggctttagaaaggacagatgcaatgatttcttctatactatgctgtgtgtgtgctcagttgttcagtcatgcctgactctctgtgactccatggactgtagcctgccaggctcctctgtccatgggatttcccaggcaagaatactggagtgggttgccatttcttgctctaaacacttcttctgcacaacattaactgattagggataatcctgagcaaaccctgagcactttccttttccctaccatagacatctgatcagtttgtctgcactgagcagtcagcaaggccgtgctgcacacaagacggggtgtgaggggctggtgggctgccttgaccacatggataagaagaacatgtgcaacaaaaatgcataaagaaaccctgagaactagatggatggcccccagcaggactgtcataaagcatcctgcacaatattactaatagacattttacagtttttgtagcttccaaagttatttttgagtcagtgctagcattcaattatttcctgttgaatagagaacaaaacaggcctaaagactaaaaggaaaagctgctgaggggagtgatcactccagatggaagttttctggcagattgtgatttgtgactcagaatgagcccagatcatggtgccatatggatggtagcagagcctttagacactggctcagttgctcagcagacttctgaattcctactacgtgtcagttattagctgggcattgggaacagatgagtaagcagtgatagtatctgccaccaaggagtctattcactcattcatcaacatttactgagcattaatgatatgcttcaaacactgggggatttgaatatgtaaacatagagtaaattaccatatggtattatgacaaagtcagttataaaaataggggaaaatgcttcacaaggatagaggtgagagagagagagagagactatatctggtgtagtcataggaattttccctgaacaggtgacattcagcctgaattttgaagctggattaggggattgagtagtggtgatgttgggtgg

SEQ ID NO: 42017 - DNA, 1560 bp, Bovine  19866881220411
tccccactgcagtgatgtgtaacctttttgaggtcatggactaaatggagaagatgtatgaaagttaaggactgtcctttcagaaaagtgcgagcgtgcatttatgcggcttcacagccatccctggtctcctttgatcattaattctctggctgcgttgattgttgtttatatattcactgtggcttgctcacctgattctaacttgaaggattgcactgacctgtctccaccccaatcctcaactgagtcttccagcctacatttcccccagtttctgagcttttgtctacttgaagtgaaagtaagtgtatgttgctcagtcatgtctgactctttacgaccccatgggactgtagcccaccaggttcctctgtccatggaattctccagacaagaatattggggtgggttgccatttccttgtctagggaatcttcccaacccaacaatcaaacccaagtctcccacactgcaggcagattcttcactgtctgagccaccagggaagcctgttatcttctgacatgtgcaaaaaccatcttcttgaatcttcagactgtttcagggcccaaggtcctagccctaggagcttcacagctgatcaatgaccttggtaaatgaagtgttcatcctggtgcttggcatctgactccaagtcttagcaactacctttattacatgggtgggatagacctattaattacctgagttagaaatctctcaatttgtacaagttgtattggcttagagattcaaatatactataaagtctacatccttgtcccagacaaagctgtgtcctgaagatgcagtatcagagatgactctactgtggaacattgcattctgcaatatatactttacagcaactgctacacacataaaatgtaatttaaaggcattatgtgaaaggaaaaccctctttggtaagatttattggtccacagctcccatgcctcaaacacaaaatcaaaatctgtagaggagaggcaactgctttggtaaaatgcattagtttaagaagataactgtgtgctttgcccccaaagataaatttgtgctcaagtgaaattatctgcaactctaaaacgatggatgcagattctcaattaagttgcgatttgggatgcagatgctcacttaattgctaataaatagaagaacaggagaaggatctggggatatgagttgatcagtgcaaatattttctaggagttggcttgtcaccaggtgaaactccatcaggctgtctcagaaagctctttacaatctgagtgagtttgttatatacaggaatgaaaggtgcccagattaggaaagcttttcataggaccttatctatgaaaagtcctttgacccaaccagaggcagctagcatttcattcagcccctcatctctgtcctcagcacacatttttgaagcactgcaggctccaatgcaagaaagtgcctgtttttgaattcttttcatctctatgtggccttgcagtgagctgtggattgatgattgccatgaaagcaaatgccataggtttcatgacttttccttgattgttg

SEQ ID NO: 42018 - DNA, 1065 bp, Bovine  19866881229177
atgattctgatgtgcagccaggttgcaaaccactagatgaaagggactttggaagtggttagagatgtcatccagttgcagaaaatcatcaaaggggaagtggtggttgagatgggcagtaaaagctggcagtgtgggggagaccatctagggaaagggaggaacagggcaagatgtgacagcagggggcatggacccatccatggcgtcccacgtactggggtaacaaggaagcacacactggctgagaggcagttgagaggtggtggggtactgctctcattttgtgtctaattctgaacccgggctataactacgcgcatagccaagaccactgtccagttagaaaagcaccaactcacaaaacctgtgaatcatcaagttctaaatccctagcaggcaacacatttgggagccacagctgctgcctgaacaaaagaaagaaaaaataactgctcccttcaagcctccgtgaccgtgcaacgtcatccaccaaatcatttcaaattgtctccttttcataacactgggtccaaagatatgagctgcatccaagctggccttggtccccaagtgcatccttttgctggtaaaaccttgagccaaggtttttttttttttgcttggtaagaccaagagccaacctggccctcactgtcccccacaatctgtgccagctagaagtgaagagatgactctattcagtcagcacagcaaacgcttccttccctcctttctaggctctctggctggtctaataattaaagtgacataagacagatacacaggagaaaaacaaattttgtacagtgggagccttgtaaaaatatgagattcccagcagtcaggtaattgaggtttaaacaccttcctgagctaaggagaagggaggagggacctgggcttcaaagggggaagaagataattctcaggaagatgggaagaaccaaggcttgggaacaaatgttttgccacaccatacagatgagtcttttgaatataaaattcctctctgctaatagctctcttcctggtacgggcctctatctaaattcttttaagcag

SEQ ID NO: 42019 - DNA, 1336 bp, Bovine  19866881291530
attcagtggcaacagatgaggaaaaggagaggagagaaggcagaaagctttccccttccttacagcccaatcccctggtatccatatattgttgccagtcagtaaacatttttatattggaagggtcgtaaagaatattgtttctgagcaaactaggcattaaaacatggtaggtatgtatggaatctgctgaggagatagataactgtgaattatttagtggccatatgtcttcgtgctgttatatattcacaaatgttcctgataaaaagtgcacttttatggcctgtgcacaaatgggcgatacaaatcacagcgtgcacaaaatattctgccgtgatcttgtcataaaccacaaagcattgctcctctccagtgtaacccttcagaaacagagcccagacgacattcagagcatcacaggattaacctctggggagagacaaaaaccctcattttcccaccgaaacaaatggcagcagctgcctgaggtcatcttttatgccccgattctgggggctgacaacagatttatatccacagagaaaaatcaatccaccaataggtggtttgttcactgaaatatttttgaagacgtcatatttgctatttttttcagccagggcctcaaaccctacagtgttgatgtaaaggacaaggtgtgacctattttaggaaacatgagctccatcttgtagcattaacatgacagatatgctagacccagtagtgttggggagactaataaagtcccttttcaggtttttttttttttttttaatacacgttctttaaaactaatcagacaaaatcaagagtttctcagcagcttctggaaggaacttagtagccctgtagagagcaaagaggataccagacacactgacttgagattagacaggtgtttacagagatgtaactgaatcttttatggcttggacaattaaagtatcttaactctctgacctgactttttgtgtctggagactgagagagttaagagagagcagggagagtggattccaattctcctccaggaaaatgtgtggcataaaaaaggtagctttaaatgtttctagtttttccctggatgtctttaaaccccaaagtaggccaaacacttctgctttgatcacgtaattggataaggaagataaatgcggatctcaaatggagccctgaaatgtatgcgagaaagggattgcctttgaagtgtttttctttttgtaaagtgttgtgctttgcaggaaaaaaggaaacgcaaacccacatttgggtcctttgtggctgacagtcctgggaaagactataaaacccagggccattctgaaattca

SEQ ID NO: 42020 - DNA, 1229 bp, Bovine  19866881344615
ccttcctcgctctggggggtgaagctggccgagggagatgggggcggggggggcttatactggacccggttcacggcaaagcagctccgcctctcttgctctcagtctctgcgccccgaatcttcccatctgtttagcggtggtagatggggcgcagcgcgaccctgcagccgcggcggcaggagccgcttcttccatcaccaggaggatgccctccgggagggcattgccggcagcccccgccgcttctcagcctccgaccggcccggaaaccccctatatacacacagctctaggcaaaggaactggggtctgcagcgctgtcttgcccgtcccgcccccggcaccaggctcttctgaccaacgaggaatccgggcagagaaaacccccgccgcagcagcagccgccgcgcgaaagcagcgcccaggaggatgcagctacgcgcctctccctacgccgagcggctgcaacgcgctcgggccagcctctgcgcggctcctgtcagcccgcgccgggttggtgcgcgccgccgtctgtcgctgcggctcctccccttcgccgtgccgcccgccccctcgcagcgcccagctccagtcgccgccttgggggttgaagatgcggggcccgatttacagcggcgtcgcttgggcctccatacgctcggctgaggccgtagccatcctagctccacgcaccagggtacggatgcggggttcggagcgctttgggcgcccggacctctgggaaacttggattcttgtgtgtgctgctgccgggctcagccgcacatttttgctctcggaaagagttggtgacaaagtttgggcagaaatcccccagtggcttcccactccgctctgccccgcccgggtcggcgccgccggctcccggtaggaacccaggacgcacccgcgcctcggagcgcaccgaggacgccgagcaccgctctcgggcttcccactcccggcgcgcccatttcatctggcctgaggcttctccctcaccaaggaagtaataaatctttctggccccggggtcaaagaagaagcttcagttttccagtggagtgtgccggcggggcgtcttctccgcgctttcctctaactatggagagggcctctctggttttattacgcccccagcagacgccctcggcatctccgctcgtaatgacgcgcccgctgtgattgatgtcctcgagaattggggtgatagggggtcgtggggt

SEQ ID NO: 42021 - DNA, 1197 bp, Bovine  19866881394862
aatgaaacaaaagtgagatagcatgcaaacagaagtcaaattatggattataacttaaaaaaagaaaccttttttgtgaagtataatatataagcacaaactacctaaaaatcataaatgcattgtttgatgaattatcacatagtgaacatacctgtttaatcacccaaatcatgctgtggaacattatacttttctagtggttttctgattgtgtcagaaaagaattttgacatattttaaaaccacatccatttacattataagatggataagcaaaatgaaaatattctattccatcttctaagaatttattgtaccatgtgcagagagagacccctgctggaacgatttttttttaaagacaatgtctgaaccaacccaaggaaattattttttggggaaaaaaaagctgccaccagttcttatagcacccttgtaaaaattagaaggtgcccattttttagtaccccttacttatctctgccaggagattgatttactatacttatgttaacaaattaacatttgttaagagcagcccagaatattgaacggtgagccacagttcagcaacagatccaagagaaactgaaataaagaagttattgttcacaaatcctggaggaaatgcccagtacatctcaacaggccacatacaagggtcaagtcagaaagagagaggcaagatcttggcacatacctcgattaagcactggtgaagtgctttgggatttccaaacaagggccagattgaccaattcaaaccaaaagagctgggttttggtaggtcccatgagggtcttacctaaggggcacataaggctaaccaggctctgggaggcaggggaaatctgatcacaagggctgttggagaagtcatgtgaggaactgttttttgcttctgattctattgtctgctgctgtctggggcaaatacttgtatggcagatctagtgtccatttaaagttacagtaggcttctttggtgaacaaaatggatgtggaagcaacaatactatagagtagcttagcaaaattctcaataccttagtttgttgaaacaaaacacatttcttctatctgccagaaaaaagtgttgcaataactctaagatgtctgcagtgggaatgatgcccctttatatgtggttcccctaaggattgcagacctgcataatggtatacagcgtttatg

SEQ ID NO: 42022 - DNA, 2431 bp, Bovine  19866881587065
aacttagaagctctgatggcagtacaaatatgtgtatgtatatacccatatatacatagaattttttattaccaaaaagtaaacttgtaaaaagcagagacattactttgccaacaaaggtctgtctagtcaaagttatggtttgtccagtagtcatgtacagatgtgagagctggactataaataaatctgagtgccaaagaactgatgcttttgaactgtggttgttggagaagacttttgaaagtctcttagactgcaaggagatcaaaccagttaatcctaaaggaaatgagttctaaatattcattggaaggactgatgctgaagctgaatctcaaatactttggccatctgatgggaagagttgactcattggaaaagaccctgatgctgggaaagattgaaggcaggaggagaaagggacaacagaagataagatggttcaatggaatcaccaactcaatggatctgagtttgagcaagctccaggggctggtgatggacagggaggcctggagtgctgcagtccatggggttgcaaagaatcagacacaactgagcagctgaactgaactgaaacttgtacaacatatctacagctatgaaattcatccagcctaaagcagcaagagagaagcctgctaccctgtacagctgggcccttgaccattactcttcatcattaaaaacacattcacaggactttcttggtggtccagtgactaagcctgcacaatcccaggacagggggcccaggtttgacccctgcttggggaactagatcccattcccatatgcagtaagacccagcacagctaaataaataaataaagctatcaaaaggaaaagcacatgcatagctgctgcctctcttgctcttgcccttcttgctctccctgggaggtgggtaaagtcaagctccatcatcttactttcacagagggagtaactgtcacaaggacctgagcaacctattcgccacttcacagtctttattctaccactttcttcaggtttgaaagagaaacactttggaacagttatttagatccagaaaaaaaaattcaattcagaatccctatttaaagatataaaccatggcccacctaggctaaggtcttggtcaaattcacactgaactcagttgatagaggagccagaactggacgcccagttttttcctaaagaaattttaccagaactcgcagtttgcatagatgctcagttgcttaggagagcatctctaatccctttcagcaaagggattagaatctgtgatctgaatataacttgcctaatctattattcctagaaaacttttcatcctttctcatattccctaaagcatatttatgttcttcagctgtaccatttggaaccctaaagccaactgctggtggcaacagaaagtaaataacaagaaaatgcaactctctggattttctccaatcagatcaattttctagcaagtagcaagttcataaataatgtagatttttaaaacatatttagctcagagtaagatgttacactatttactgtttgattgatggctttaaaatatattatcgttattggtaacaagatagaatgaataatttatcttgagagtgatgaaaatcaaacattcatttcttgccctgattcttctttttcaaccacttcaatatatttttaaaaactgtttgatctagaatggagaatttcagatagcccgttttgcttatgacgcatgtaatacaagcttttacttgaaatcccttcgtagttgtaatgtgtatttcttttgcaatatttcaaatcactttttggagcctagagacaggttgtcctcatgggcttttctactaataacagagtttaccaactaatcaaacatagaagaaatcaccaaaatgatttagaaaacatttagaaaataataaaatatttagatccataaggaaattatgtattcccttatcgatcctgagcttggatcactgctgctgctccccatcaccccagcaacacacacattttcaacacacacatcctgttattcccaagtttccctgctgtaatattaaatgaccagactccatggctagatctacacggggccagcctgaccaatctatgggaacatttctgacaattatccaccagtacacagcaccagataattgatataactcacttttttaaaaaacaatttttaaaaaatttaatattgctgacaaaggtccatatagtcaaagctacagtttcttcagtagtcatgtacagatgtgagagttggactatacagaaggctgagagctgaagaattgatgcttctgtggtactacagaagactctcgagagtcccttgggcaacaaggagatcaaaccagtcaatcctaaaggaaatcaaccctgaatattcattggaaggactgatgctgaa

SEQ ID NO: 42023 - DNA, 704 bp, Bovine  19866881702753
atcctttcttttctaatataattcagctttctaataacttagctaactgaatattccctagtaaatattataataaagattagttgatgtattacaattctcattttaacctatcaaaaaataatgctacttatatgaaattctttctaaaatatgtaattgtataaaacatctaatttttgtgtataatttacttactatttaaagatacttctggattgtttgaatattaaaatatatgaaaaaacaattttaagaaaaaaggtagttacagctgaaaattatcacttcttagtcatcagaaagtttttttagtcatactctaaaatggcctcatgcatcatccaatataattcgcacaattactcttgtgttcatcccagggaaatttaaaaagttgcaggggcaacgtttccttttatatatattttctgtagtaaaagattacaagtcatcaggttccagtgtagttgagaaggtcaaggtataactcctaaagaaagtaggaaaggaaatgaccaaaccactttgtttaaaaacagttaaacttgaggggaaaaaaagtacacttccatgtactagtgatgatctcatttatatctgcagccttgattgttcttctaagctccaaatacacatatatgccattattacctatccattgggatgaccctttaagtgccttaaacttaacctggtcctaa

SEQ ID NO: 42024 - DNA, 1705 bp, Bovine  19866881859779
ttaagatggggtgaatggtgcaggaaacaagaggaacacaggctgatgctgggggagagtgtgtttgactctggtttgccattttcctctgcaggcgagacccacctaaggattttataagctctgaaagcacagtgacttcataatgtttcctgtaggaaatccaaaggtcctttaaggcatcctaatgatttgtttaatcgccactatgctaatgtggtttgaattctgggagatggccctattgtttattgttggcagagcggtggcacaccccattgggtacatgcagttcttcatgaaataagccataggaagctagctggaggcgctcaccaagggcctcagcaagcctttgcttcccaaggcagggtctttactgaacattgagatgctttctctctttgatatggaatttcagaatgatttcagaggactttgtggtagaaaaccatttgaatagtacatcctccggaggcgctttgctggcaaaattgaaactgtttaaatacgttcatatagaagaggctttaaaataagcctggcataacttctgtgggttgttattttacagagctcagcccagaactataaagatgctgttcttgggaattctatttactgaattgagcaccctgaggggtttggccttgagggagtgagaaggggtgggagggtggaagggagccaggctgtagaggcagacactggcacgcacggcggatgctgccttttaagtaccatatgaaccaaaatggacatacaggatcatttacacaaacaagttaaacagcctacagagggggttctgaaaggactcagtgtgttggagaacagcatcttgacgcccctggatcaacataatggaggggatccactctcagcttccctgttcagaatgctcaccaagctctcactcactgaacaacctgtcacagagtgattagcttttgtaagcagcttgctacccaagcaaatcctaacttttaaaagccacatctttcaagtacactttgttaaaaggggaaagagaaacaggagtggtgaggccagttattaatcctaggctggattaggtgtgtgactggctgagagggcccacggggttgcataaggaaactgggtgggtttgtggggcctggtggggcaggagctggtgatgaaggacaaggtttttctcctacttcagttggtagaatgttctctgaggttatgatcctttgattgtttccagtacttaagcatcatcaactgccatttaagctgtgtaaagtatgactaaggactctggttacagcctctgggaaagaaaggggtttttgaattctctgtaactctttctggctgaacggacacgtgaagcccagtgtgcaacagacgacccacaggtgaacagagtagggcagaggtggggagggttggagaattacattttgaggtaaaacttggagtaattttatcatcatgtgcttcccatgtatgagttctcaaagccactgtagggctccagaactgcttgcctgggtgcctactatactgatgaggtgaatcctgctttcaggttttaagcataatagtgttttacgatgtaacctcttttgctgctctctcaattgctgctctgtaatgttctaccttttttaattactgttttagtatgctgcttgtagccccaggtgcttctgtgaaggatggcatcttaaga

SEQ ID NO: 42025 - DNA, 1179 bp, Bovine  19866881988480
tcccttagagggacatagtagggacagaggtaggagcaggaggaatgctgtagaaaggcaagtcacagaccttgacaacagtccttcaagatgactgtgccagtttttatgtcactctaaactaatcaccccgtggatgcagcccatgttcctcctcagcctccctcaccctcaggccgggactttccctctttgcctctagtctctctccacccttctcttgctccaggttcctggcaatcagccctcacattgtctctccagatacaagggatgtgggggcttcccctggtatggggagaagtaggttcgagtcttcatgaggctcactctcggcatccatggagaaagccctgactggtgggcacagggtctggtctcggttggcaggttcagctcatgcccccatcccaggcatgccctgcccccaccccaactggctaacaagccagacttgggcctgtgaacattgattatgagggcacttagcattagcatgagaccctgttgcttgtcacgctcacaaaacattttgatggctctgggtggacagtgctataaatgcaagacagcttcagttatatcttgtttggtccatcagcaactgagaggtgagctactgtcctgttctgatgagccacttgtgatttggtcaaatgatttgtgaaaatcagagcagaagcgctgtcctctcccttcctttctttgttgggcagatggaagaggtgacagtgagaagtacagctgccctcatccttggtctaacacagtaaaataaaacatttcctctttatggatagcagcttgtgactaattaggtataagtgctttctggctgaccagctccagtccagaggtttgcaggtgcatttcctaatagagcaactggagagaagacagatgcttggcacaggaaaatgagcatcctcagccagggtgcttgacaagtctgtggtagcattgctcctttgtctgcatgggtctgcccgagtcatattcctcttggttaacacatcttttttttaagtctttattaaatctgctacaatattgcttctgtttcatgctttggttttttggccacaaggcctgtgggatcttaccttcctgaccagagatccaacctgcagcccctgcattggaaggcaaagttaaaacactggaccaccagggaagtcc

SEQ ID NO: 42026 - DNA, 2702 bp, Bovine  19866880399945
ggtggcatttcccagcaagtgaccactgagaccttggtgagaaggatttacaagcaggttttaatgcagcaatatagttcttgctcaataaatgtttgccaggtgaatctaaaagaattctaggtgttaaaactcaagagaaagaagtagtcatccccagacaagctttggcacaggactagtttaaagaaaacaacacacaacaacaaaattacctagcatccaaggagcaggtcaaatttttagtcacacattacacacctggtttttccaaaggggaggaggcaaggaagaaggaagtgagaggcatcgcagagaagggtggtgttctgaggtagttttgacaatgattgatggccccgtgctgtattctcactcatgcaggaaattagagagagattgctccagatcctggcccatctgagttccttctatgtccagcccctgcccccagtttctctcctgggagccctcccttcctgcctgagagcctcattattcaaaattcccagcagaaagaaagtaaaaccacttctttctttgctattctctctcttctatgaggaataaaatcatcattttgaggagctcttcacttagtgacttaaggggaaattcatttctcttggtgcttcaggttatttttccaaggggttcaaaagcgacagtgacaattgcttctgagggtgccttcatcaaatttgccatggcgccatctctgctaaattggcctgactgtctctccacccctctgctgggctcccccgcaccctcctacacatagcctgctttgtaccaggctggatttattctataactctgcttttccatttaattagtttgctaccattttaggcagatcttataaggtttcagtttctcagtttctctcctaaggggcggagcaaatgaacatctatatttttcacagggtctatactgggtccaaatctagcctccatccaaccaggggaggccatctaaaagctgatttcataagatgcctccagaaaaaagtacggtggagtgttgtagcatcatttagttttaaaaggatgtcactctatgaatgacattgagtacactctcatttatttttacaacctctgctaataatatcactttttacaaaaacccaaagtccactgcaagatttggcaagtatatatatttaaagttataattggctaccactctgcttcaacatggaagcctgaaatacctacccaacccaggtcagaaggggattatatttatcagaagttgctacaaaacattcatgccaaccaacagattgatgaaaactgtacatccaatcagccacacattaatctgatcttaggtaaccaaataatattttcaccctgttcaggagaagttttattttaaaggaaaatcatcatgaatcctatagtgaagcagataattgagataccaatcttctgacttcactgcctaagaacaaatatgtgtttgcagtacatcagggatttgaacccatgggagagaaaaggatgagagctacctctttgcccccatatcctctacagcatcgtgtcatatgaaagttagttgctcagtcacgtctgactctctgcaaccccttggactatagcccgccaggctcctctgtccatgaaactctccaggcaagaatattggagagggtagccattcccttctccaagggatcttcccaacccagggactgaacctatgtctcctgccttgcaggcagagtctttaccatctgagccatcagggaagcatcctatgacccaataccaaaaacacttcatctccattcctcgcaaattcaaatcagtaccaggaatgtggttccatccatctggggatgtgcagtgttggggtgccacacagttaaaactttatagattaaatccagcaacttcagttgcctgaggcagagtggcgaggcagcgatggggctaagaccaccctaaactggataggcagaaatgccattggaaataccaagtgtgtcttcagccaaccttctttttaacacaaagactgttttctgcagaagaacactggctgaaatgtgatctaaattcatatcaagaaggaaaatggatgcctggagttgaaatcaagagctttctctcccctttgaggcccatggccctcatggaagatgattccttcgagctttgttggagccagtcttggacagatcagcacgggggttggggtgacagagttactttctggctaactcttcttctgtcctttctcccagcccacgctctccctgctgttctcttcagtacctgctgcccagcatggctttgttctagcttccggcaaatgtagcaagcttcagtttctctcaccaaatgggcccttcttgttgagcccagagtcctttttaagtccatttcctctgctcccctttctgttctttaccttttttttttattttatttttaaaatattttattgatgtataattacctgcaaaagaatgcaagaccttaggtgttccactattgtatatgcatttaaacaacactaaaaacaaggtacggaatatttttacacctgaaaaagttcatttcactgatcacctatgtggtttttaccccaaagatgtggcagtagtgtcagagttagtctgtcaagctcttttttttttttttccctccaggataaccataaaggtcttttggttttaaggg

SEQ ID NO: 42027 - DNA, 2451 bp, Bovine  19866880424185
agatttgacctagtcagggaagtcaggaaaggctctctcaggaagtagtaacacttgaactgaaatctgaagcatgaataggcagttgatgaagggagaaaaatccttccatgtagaggaaacgttgtgggcaaaagccgtgcagtggggaaggagagtgttagtatgaaggactgaaaggattcaaaggaggctgaagggatggcgtaggtagggaccaggctatgttgaggaattttggtatgttttgtgttagttttatagagtagtgggaagcaattgaaaagtagtatgcaggaaacttgtatttggaaaagattattctcactatagtaggaataatgatttacaggggactgtagtagatgtaggtagataaatgtaggataatccaggtgagaaatgatagtagttaattgagaggaaatggtgagaagtagattaaatatacttagggaacatcagcgaggttcatggatttaatattgaatggtaagagagggagatgactaagatttgggactgatacagtggagtggatgttatttttattagaattagcaacactggaatgagaacagattttaaaggaaagatcatgggctaggttttatacattttgaatttgagaggccacaaaacgtctaattgaatatatgaatatgttggtcaaaggagatcatgtctgaactggaggtataagttgctgtggtaactgtgaatgatgatatgcatggtgagaatatggcgatggggtgcctgggacccggtttgataaactcctaacatttagagactagatagagaagaatgaatctcacaggagacagagaaggtgtgacaagagatgtttagaggaaaatcagaagtttttattttttaaaagactttaatgatagaattagaagtcatctgtgttttggtttttatcttaaaacattttattaaaaataaattctgagagttgtctattaagaatcacctttatttagctcctctagacatagctttctcaagtgagaagctgtgtacgtgtcaggtgtgtctttgagttctctcacttagaaaggaggtagtttttgccacaggaagtgtttcatcgggaagcagatgtgctccagtgataggagatgggaaggggatgttttgttattaattacttagctttgaataaacaaagactttgtatttttgaaagatgtcttcttctggtttatagaaattaatcctatttttaaagcttttcattagttgatctaagaagtatgtactctgttgttccagtaacctaactcctgaactcttggttaattgtattatgtcatatcttctattacataagagcatgtgagatttataggatagaatttcggtagagaaaaggtgtgtcttaaaagataggaagtggtggcagactagtatttgtaatctgagaaagctcaggttttgccttttcatctctgcttgcttcccttcgttgaaagaaatcagaaaagccattttaatgagaaattgatatcctattttaatgtttaaaaaataaagaatttagcatttaaactagataacaataaaatatcttgactcaatgtcacaattatgccccgtaaacctaaatttatcaactgtattctgtgaaccatagttggaaaatgctaatttaaagaggttatatagaatcctgaattaggaattaggatacccatgtgttctttttgtttgtttgtttttgctgttgactaagtagtcatggacaagtttttttctctagcctcatttgattatatttaagtgttggttaagttaatctgggatgtcttgtttagttctctgttctctaattctgattctgtgtattgatattaaaagtttccatttttgctctgggtagatttttaaaatatgcttatttaaactttgtgcattcaaaaggaataaaaatatacagtcattataaaatttcatatattatagaaattaataatataaaaacataaatctattagcagcaataataacacattttattatttttaaaaaagaaaatatttaaaagaaataggaacagaatttctctctacgcaaatttcatcatatgtatactgacatattaatgataatcttcagtaaaagtgggatcatgatctactttttatagtatatattgcttttataccttatcccttagacttcttaccacctaaatttccgttttttttcttcttactgtgactatagtatatactcatagttaaaaaatagaaccataaagatctaaggtgatacctcagttgtactccctacaggcaatcactctttaaaaatgtgtgtgtttctagcacagttaaataatatgtgggttgtttttgcatggtatgtactgtgatttatttgggcatcctcctatagatggtcatttgcatctccctcccttgcttccttccattaaaa

SEQ ID NO: 42028 - DNA, 2029 bp, Bovine  19866880505015
aaagctgagagctgaagaattgatgcttttgaactgtggtgttggagaagactctcgagagtcccgactgcaaggagatccaaccagtccattctaaaggagatcagccctgggatttctttggaaggactgatgctaaagctgaaactccaatactttggccacctcatgcaaagagttgactcattggaaaagactctgatgctgggagggattgggggcaggaggaaaaggggacaacagaggataagatatttggatggcatcaccgactcgatagatgtgagttgagtgaactccgggaggtggtgatggacagggaggcctggcgtgctgcaattcatggggtcccaaaaaggcggacacaactgagcgactgaactgaactgaacaggacaagtgatccaacatccccctggattagtgattatggcatccttggcagaagatgccttcaccttctgtttgaacaccatcagtgacaggaagcaccacgccttacaaggcagcctgctctgttggtaggctgacctgagggtcacctatttccttcttgcactaaacttaaccatgtctccatgtgagttccatcccattgtcctacttctgccttctggaatccatctgcatcctcttccacatgacagttccacaaaaatataaaaaatgccatttctttctgctgctgctgccaccgctgctgctaaatcacttcagtcatgtccgactctgtgtgaccccatagacggcagcccatcaggctccaccatccctgggactctccaggcaagaacactggagtgggtttccatttccttctccaatgcatgaaagtgaaaagtgaaagtgaagtcgctcagttgtgtccaactctttgcgaccccatggactgcagcctaccagactcctccatccatggactttccaggcaagagtactggagtggggtgccattgccttctccaattcaactctaaacataaccctaaacttccttgaagaaccttccacataacttctaactgtaaaaaggacagttttagtagggatgctaagggaggggtgtcaacacagttcaaagtctgggcactgtttgaaaagagaatgattgaagaacattattgaagaaattaaggcattcatatctattcatacaagagagaaatcatcaaaatgagtgcttccccaaattggtcatgcagcagaatagtctaggaccttttagcctcagattcatgtccctacttcagaattactgagtcagaatttctgggagatgggacctggcaatctagatgtttatcatgggtcattgagcagggcccaggtgattctgatgcagcctattgttgtgagatactggatgaaatgaccctaagacctctcatagtgagttgggaatctcacagaatcttagactttggttaatattttcaaaaatatttttgtcaaagaggaatgagttggttcaagtaatatcctgacatcttactgaaggataaaggtcttaattatctaattcattaaaatgcaccccaaacctaataaaaaaaaaacccagccatccaaatctaagcagatcatgaatagaactgaactcttatactagcagagtcgggggagaagctggttgctttttgagggtagggacatagatgatgaatttatttcacgtggtagagcagttgtcatcaacctggctgaatattagaaccaatctccagagcaattaggtcagaagcactggagatggagcttgagtgttggtatttttaaaagagcacccccaggtgattctaatatgtaactatgctgagaaccactgcattaaagaaagagatgtgctctcaggggaaaggatagaaaggcaggttgttagtgcaacacaagtgaatcttccctggctaagaatagcagctcctttctcttttaaacaatcaagatgggtgggcttattctctggaaactgaggagagaaggcaggtactgagaggaaaaaggagtgaaacagaacctgatttgcacttta

SEQ ID NO: 42029 - DNA, 1557 bp, Bovine  19866880542019
tgaaaaaaatgggaatgtataagaagcaagtatatagatggctgagtcccttggctgctcccctgaaactaccacaatattgttaactggctatgccccaatacaacataaaaagtttaaaaaaaaaaaaagtaagttaggacccagaaggagagaaggaaaagtctgtaaggtgaattgcttcaatcagattggcagagaaagattgacgtttgtgtgatatgcagactgacttttttttgtttgtttatttttaaattggcataaaagtgaaaatttatttagaatgagaaaataaataacaatgaattacttattttttaaagatgacatatctgacacattttttgagtctttcccatatttttatttgtatctcaataaatgtatacattaatctaaatggaattgactgctttacaaatttaagctttttatcccaagataagtatgtgatttatttaagtcatcttttacggacatagagataaagatataacattttcttcaagaaggttctgctcatttctagttatatttattccaaggtattttaaaaaatctttctgttgctactgttaacctatctatatctgtacatatactttttgatacctatctctatggcatatctgccagagttttaagactgatttctacattgttttaatctgtatacacattgaccatctctttaaatgacaacagctcatattttctaaagagggaatagaaaagtaattcagtctttcttctaacacagttggcagattttttgtttttattaaaacagattctaaaagtttctttcacaacatcacctaatatggaattgagaaaattggggggatttttttttaatttgacaaggcttctcattaagtttcttttatttatgcctggtctctggttctctgcatttcaaaccctgtttctctccgctgcctatgcactttcagccccaagaacaaatgcacattgcaaatgctcctggtcttgcaccttccaatccagctgccactgtaagcagcagttctactcagggacagtagcttcggttgtgaaaccacatgttaaatgtagaacatacatcagcagctatttcccttttataacatttctctgtcaccaagctgcaagataaagaagcatttagagtatcaagcaaatccataccagcttttaattgtatgttaaatggcataaatcacgtgaatttgctgataatttcctcctcaccagagcagttgcttctagcgatttggctttcttccaggccctttcagatagcagtgctgaccaaattatcctgttattcagaaagctcaatgaaacattagatcatatttattttcaataattaaattcataccagctgccgaacaagaaaagtgttccttctaacgcaaaccaaaatcagttttaaaaagacgttgctcacaaagagtgcatgcaacgaaccagaatattctacatttaaagccacacatagcaccatgggcaactgtagacacattaatttgcagggagcaggggatgtcttcctgttcacggtat

SEQ ID NO: 42030 - DNA, 1773 bp, Bovine  19866880543836
tttgggaaatcttccctacagggccaaatatctaagggcaggagggaatgtgtagcactgaagaagaaaagcaggagacaatattaaaaaaaaaaaaaaaagtagatatagaagtccaagaatagtagagttatggaatagtaaaaatataaggatgaatcaaagattcatcagatctttcaagacaagaggcctctctcctagatctagcccatctcccataagatggctagttgctcattagcagggcccaagcctctgaagttctaaatacaaatcaccaaggagctgaaatccactcctaagcctctgattttagcggcttatgcctttccagaagaattaacttgcctactgaaatggctcctgcccagggctagaaaagtttgaataaaatgcatttagctactatctaaagatcttaagtcattgagctaaatgcaagagccttttgttaaaaatcacactcaactagatattgaggtttattacacactttctccacttttccttctccttttatgtaatctcagctgggctgatttgccggcattctttccagtggaatcttcttattactcccaagacacaacagagaatctccaaccctgtacagaggggcacatagctgcatctggattataaaaaagggggctatttatactcaaatcaataggcagattttagcataacattgcaggctttctgcaagagaatgaaagaaaagaaaatgcagttccttttccattcttctttactgtattatttgccccaaagtatgcttgtcacatggcccagagcagtgtgatctaataatgataggcctgcttggcacaagggaggggaaaatccagctgcactgggggtttcaggggatgactcagacagctggcccagccctcaccccatgtgtgtttcagggaaaacacccagtatgttgctcatctcacttgcatgtaattcttcccaatgttgaacctgactctggatgagagctgtgcagagcctcttgtctctcaaacaaccagagggccaggaaaccttggaaaataccaaagtaaacaaacctgaggccacagaagtctttgattccattccagttgggagtctgtccaagtttgtactcaaactggccagcctgtggcctcccaacccagctgtgaggaagagccaaatagcctgcctctttctgcagcttttattaacccccgggcttagtgaagccagtgggaaatgcttcaagataagagattcctaagtcaaagtgttgagatttttaaatgaagggatgggtagcccctccataaacctgaaggaggcaagagagagcatagagtccctctgcagccatcctaggggacattcgtcatgtaggctgctccaaggacatccatcaagacaagctgacaagacacagcacaaccactatgctcctaagtctgtttgtgccaaggactggcagtcccctctgccattctcaggacaaagtccccactttcatctatttgcacctgtgaagtcttagtgccaggagcagtaacccatgcctaccaagtcacttcataaatgcatataagaaaatccttggctgctgtcactcaacccattctgtgctttgtcttccaggacactgagtctgatatgagcagtgactgcaggaagtctggaacacgagacagagtctaatggccctcccacctccaacaactattgagtttctagctcctcttccttcctacatgcacgatttgtaagcctgggatctgaccagct

SEQ ID NO: 42031 - DNA, 862 bp, Bovine  19866880566468
atcttttcttgaatcaagaaacattttcaatattttttttcctaaattaatctggttcccatagtttgggttccctattcagaagcactttgagttatctggtaaagctgttgccttctttcctctacattcatagtcatatttctcatcttccccctatttcctctgcatacctgaagagcttctcacattgctcttgtgaattgtgattcacattttttcccctgcagaatcaattctattcctcggtgcttctgatgcagactcaaatccatctacaggagattctgatttatagttaagagacttgtacttcctcattcccacagttgctatgattattcttagcatgatcacagtaatgatctaaactaatattaaagtttagttaatgactgtgaatgacaccatcactaatgctattgccacgccaactcaattatcacactcagttagctagtgaggtatatcctgcaaacatgcttgagctgtgagaatctagttgacttaagctctacagtgagactcttattgagctaaaagagcaaagaacgagcagatgagagggagaaaatggacatctcctttgagagaaccaattagaggaatgtgctgcctctgagaagaccttgccctgaagatgaacagaagataccttggactgacataaaatcatgttaaagagcacagcttggggaatgaagcaaggattggataccagcttctacttgctcccttgtccagggacataatgtgcaaatgcacacaacagctctgtttccagtgtatcctaaggccagagctaccagcttatgatttggttgttgcagatcaatctattgtttgtttgcttaaaagaatt

SEQ ID NO: 42032 - DNA, 819 bp, Bovine  19866880594649
aggggcgaacagtctgaagttctgatgggagtcctcccgggctgccacagaagagcagtttgttacggtaacgtggcctgggggcctccgtgttcctttctcgtgcgatgcagatgggaccaccaaggcccggctgtgctgggagctattttctaaatgtcacaattctctgagacgagtgagtcccatatttcttacggtttcttaaagcctgtattacagagctgtcatttgtttgggcttcctaccagcttccttccctcccccttctcccctgtctttaccctccttatgaggaggtggagggaaaagcccctatttctttctgctcatcaaactgagccctgcctgctttcccaaggcttagtccttcctctgatccctgtgcctggctgccctctccactggaagggacaagccctcttaccaccagggatttttcagagggggcccttgaacctgctcttggctctttaacttctaattgccttttaatgcctcaccttcttctatctgccttttgaatcccatcactcgtttccagccttgtagaagaggctgtctcacaaaattaattgcaaagcaatggaaaatgtaaatgtagtagaaaacatggtgaatccctcttctgagactaaagtatggttaaaaatggttgattcatttttagcttagtcctctctctgatgaacagctgagctggtacagctttttgggcttcttgggtcatatgaacactcttaccattgttcacatctgaggttttactgtaaagcaatgagtgtaattttttttttttacataaatataccacaattt

SEQ ID NO: 42033 - DNA, 2208 bp, Bovine  19866880648518
caggagtagaaactggcaagtggagccatggaacacagactctcttcacccacgttgctaaagggacacagactacaagttaatgttttcctctatgttccacctgctacaattctgtgtgatcatctgctagactctgactgatgagagcagtggaaaccctgcagggtggaaggggcaagagtctggcaagagtattcagagggagaagacagccttgttctgctatacttggagccacttagagttatcacttgttcgggttccttgacaagcatttagaggacaggggtgtggggctagggggatttagttagcaagcaagagcccgggaatgctctcctgtgtgtttttctgcacatacagagtaagaggagggtccccaaggcagctctcctggcaaggagaggaagtaatacagctagcttcaacaagggtggcactgggcacatgaaaacatagtttttacatctttgccaaaacgtaagaatctcagtgggtacctggaaaggagagaagtttagagatagtaatctctatcaggcttcactgacattgaacagaagattcaaaagagagggaaaaagagaaatctgaaagtttcagatggtagtccaagtaatgtgattttagttcaagtttaccctagagagtacagatgtctaaaaacagttccaaaatctcccccatgatcttgtcctttaacatcaaactatgagagctgtggtattttgtttgttttagaaattacaacatgtgctgttttattcctagtttactctctgggtttccattatacctctttgatctaagacatatataatttggtgctggaaagaatttgcaagattatccagtatagccatctcattttgcagatatgaaaaatgagatggtaagttagttgcttgagggctcactgtgttacagcaagagaggcagtaccgtactcaaatccagctccttagattcccatgtgcttcatctttcatcacaaaatctgcttctagtggcacaaagaagtagttctaaaaaagtacaattgaccatcaggattaatgttcaaaatcaatgtggatgatctaaaatatttttagatcattataattaccatagtttcacatatacaacttcacttgattgcaaccctgataggcaagcatccttattaagcccattttccaaatatggtgactgagttcctgagattatatggcttgtttaaaatcaggcacaaactgtcagttctgactcttggtttaactttatttccatatcatctatcacaagtctttgtattttccacaaattttaacatcataattgactacttcacacctgaacttgatgttttattcatctccacatggataagcttcagatcaaccatgtgtttattttctaatgtgtctgctaggattttattatgagaatatggtgtattgaaattaacagccagaagccatactgactcaaagaagttcaatattcattttgtactacttttcattttcttagcttgggctggactcctttggggaaagttttcagcagactcagagatactttaggaagagcagggtcaatgaccctcaggggactacttccagcccttctcctcctccttcacctgtctcccactcattgcccccaacaaacatccacaaagccaccctccattggccctgtgagcagtcaaatgggttagctgcgccagacaggtcttgacacatggctcacccagcctctggtacctctggcttcttatcttcaatacacaccacttggccaaattaatttctgtcacaggggggagattggtcagtgaaatctaaatgggcttttcctatttattgatacaatttcgtggcaagagcaattttcagagcttattttccactccattgaatcccatgttactgcaaatgaatatattcctcggtcagtgcaatggcaaaacacagttgtaagtgctttatgcttcatttggataaagtgttcaggatattaccaaatataaaaggaagttaagggctatatttcattagaagctgtctcccctgttaataaaacctgatgctggtggtagatgtgtaaagaatcagagcagagacttgcggctctgcctggtattcaataaggcagtacagcggttgcaaacgccacctgaggagaacaccacatctccagtcaaactaatatcaacac

SEQ ID NO: 42034 - DNA, 1156 bp, Bovine  19866880754937
tttttgccatgaaagatcaataggagagatgtaaagcttctagtccttctagtcctggtcctaaaaaagcatcatgccagcaacttccaccccttgcttctctttccagtgaaactatgagtttcagttggcataactacatgatggatgaatcccagatctctgagtcacttcctgaagaagagtcacctaatccatatgagaaagtgacatgggcaataaataagcctttctcatgctaagccacagataattcagagtttatctgttactttaacatagtatagcctacactgatgaatacatactgtggaaaagacagaaaattaaagtcagattattgcttccattaataacaactgctattaacaatgtttttctatgctgggcactgtgcttaaagagctagtaagtgtgtgtctgtaaataaacaattacccattttacaaatgagataattgagactcagagaggtttacaaaaagctgctccaaggtcaaacagttagtgataaagattttctgatgcctgagtttaggctacttcaatgattttatgtctctctcttagtaaagattccctctttccatttttgcaagagattacctcaattgtgttcactttcctttactgaaatcttattattatttctaccaaactcagaattttctccatactgcctcattacttgccctacagagtctgagcacaacagtttccagcacattctgtattgtcaatcattatggaagccagtgggaattggccatcactctgagtccttatcctgaaaatgagaacctgtcaactagtttagctatgatccaatcagaagtaaggtgttataggaaaaataacctagggtttcggtctatgccactgcagtcattaaaatattaattacacccaaaccaatctagataaaataaatctaatctacaaatatttattgagtctcctgtgtgtacaggacatcatagaggcaaaatggtttttgtggtttatattctgagttctgggtcctaatgagcctcaagagacagccttaggcagcaagtgtgatttccaaatcatatatatttttacattaaagaaaaaaattcaccttcatttctgctaataagataaaataaattaagatcccgttttggtagta

SEQ ID NO: 42035 - DNA, 958 bp, Bovine  19866880778238
tctgtgcacagcaatcctctgatgcttctaatttacttgaaagcatcttgtctctccttagaaatgtcacctagcccttttccaagtgcatttccaggcaatcaggatcaatatatcacttaggttaaccatataagatagcaattgacagcgcaaatgagcttacactttgaccctcagcatcagttctgatattaggagctgctaaaacccattcatatctatgagcagagatcaatgacctagaaagacaatgtcttgagaacaggtatagcctagagtagagtttatcacagctggcctctaggttcaagctagtcagaggcctcagaattcaaagtcaattccaattaaatagttacttgctgggtcctgttttgttccagacattgtgttgccatgagatataaggaagatcaagcttgtgccttcccataatgagcttacagtatagtagggggttaacacgcacgcacaatgtgctcgtgtctgttggactagggctgtaacagcagcagaaaaaataaaaacttccaagatccgacaaaggagagataatatcctatctatttggccttcatttttctttatttgaacagtgggacaagcctgagtaaaaatagacttagcttgagaaattgcaaagttaacccttccaccagcttagtccagaaacaacacttatcaagcacttctttcccataatatattaatcacggcactgggtcctgcttaaattaaagaatattcactctcttatgaatagaaagatccctggttttctaaggttgtgcacaagaatttgactgaactataaaagggcacaagggaacttttttgggtgatgggaatgttctaaaactagattgtagagctggttgcctaagtctttaattttaataaaatcatgggaatgtacaattaaaaaaagaatattcactctccgacttcaagaaga

SEQ ID NO: 42036 - DNA, 1024 bp, Bovine  19866880821273
gtttaaatagaatcttgattagggaagtgcttttgtattctcctctgttacagcattgtacacagtggacattctgcagcccttagataaagcacagaaaagaaaaaaccaacaactgaatagtagttggaggttagagagctgggagagttttggtcagctggtgatagaagcagaccttgcttttcatacctttgctaacttttgaatatttgcagactccccagccatgctgggtccaaatgacataatacagcagcattggatggaggtatgtgctctcagcttctgctagaacattacagcattagaattcttgatacaatttattccaagcctcaaatctgtgtattacttatctgctgaattgaacaaattgaaagtgatcacatttaggaactattagtgggaggttggttcttcctcctctttaataacatcttgagagctaacgggcttcagtgctattcctcacatccaccctgcctccctccacacaaatgagctcagttggaggtagggtttattgacatttaaatgagcatatttggctcactgtagcatggatctaaatgaacactgctttggtgcattgaaacttaatgatttcctctgcatccaggtgagacgggaatgttgcggcattcaggtggggatgaagacatatggaacacaaatcttccagtcaagaattaatatcttgattatatcataggttattttaatattggggatgtgggaactttaagaatgttcttctgagcctggaaaagtaaaacaatagctacagaggggttggaaatcatgaggaatgcccaggtgagattattgataagactagttttttcttatggcttcatggtctctttggggactaaagacacaactaaagactaaagttgagctatttcaaatcctgaaagatgatgctggtgaaagtgctgcactcagtatgccagcaaatttggaaaactcagcagtggccacaggactggaaaaggtcagttttcattccaatcccaaa

SEQ ID NO: 42037 - DNA, 2636 bp, Bovine  19866880897642
acatctctctcttcctgcagttttccccatttttccgctgctaaaaccaaaaacctatgagtcaacttttacttctgtatttcactcacgtcccacagccaatcccccagaaaattctaacagctcgaccttgagaatatatccagaatttcagcacttcccaccacctgatccaaccaccatgacctattgcctagattattccaagagcctcctgtctctcccagaagccagagtgatccctgaaaaatgtaaagatcatgtcagtcactgctctgctcaaaacccaaccacagtctccctctcacttaaagaccaaagtccttaccttgaccctacatcctatgagatctgcctctctgcttcagggagctcttctccttccactccctccccttccatcacctacagcatgctggcctcatggctgttattacacatcaagcatgctgtacctcgagaccttgacactcgctgttcccttggcctggatctcgagacggagagattatcctggattatccaagcaggtccagtgtaatcaaaaggcccatcataagagggaggaagagggagattaccgctagagaagaggagaaggccatgtgatgatggaagtggacattgttgtgatgtggccacaagtcaagaaatgtgggcagccaccagagctgagagaggcaaggaagagtctcccccggatcctccagaaggaaccagccctgctaacgccttaagtttagtccctaagactcttttcagacttgcaagctccagaactgcaagataataaattcatgttggtttaagccattaagtgtgtggcaacttgttacaacagcggttggagacatagcactggggattcaccagtgcaagtggaaagggcactggacaaggatattggatctccaagaatcctttctctcttgaaattctagaattaaaaaataactggaggggctttaaaaactcattgcaacctctcctgcttctgggtctttccatagcaagatgtttaagactgagtccagctctgtctactcagttgggcctctcttgtagcaagggttttaggaaacactatttccagacctgacaaatcgtcttgtattttaagagcattagctttccaagttttttctttctttctttttcccttgatgggaggaggagaaagagaagtcttcatgccctgaagtagaaataattatcttgaggacttcaagaccgcatacgcactgtttacaccattctgatcaaagtcaatcatgacttaagaacaaactgtagccttctattcagtatttctttaaataatctttctgcttctctttgaggaaagaaaaaacttacaacctggagactagtattaaccataatgataatgttccacgtttacatgctcagagagctttagcatcattagacagttaatgcatatgacacttcattgcatgaggtaggtcagtactgttcttccctcttagcgacagggatccaggtgctgcgagtttcagttctcactggtacacttgtcatccatcagtcatagggtcagggctgggaaccaggtcgacagaatctctgatctctccaacgtatgtagaactgtgagcagccaacacttcccaaaaaaagactgttgacaaaaaaaaagtttatcaatgaataacaggattcaaatagagtgtttccattctttaggagagataagattgtgaataattaacagcacagaagacaatgtaaaaacgaagggctgttgtgctgtgtggcatagacagtatgagctccagggattcagataaaggagacataattgagcagatgtgtctgtgcagagtcttttttttttttcataccaaccagaattcttgtagctcagaatttacatgtatttacatgattgaaacacatatatgttccacctaaggacagagcaactacgtctggagcagaaggaaatgtattagaaatcagtgtgttggcttctgtgctcctgttacagggactgacctggatgtaaaaagcctcctatcgcctagtgatggtatccctgcatgactcatgtggcccagcctggacccctgctctgaagagtcaagacagagaggagcctgtggggctacaggcagcttatgatttgctgaaatgagctaattcttttaagcaggccagtgtctcacttaaaacaaatagggtggtttcactaccatatgacccagcaatcccactcctagatatataccctgaggaaaccaaaattgaaaatgacacatgtatcccagtgtttattgtagcactatttacaatagctagaacatggaagcagcctcagatcagatcagtcgctcagtcatgtccaactctttgcgaccccatgaatcgcaggcatgccaggcctccctgtccatcaccaactcccagagttcactgagactcacgtccatcaagtcagtgatgccatccagccatctcatcctctgtcgtccccttctcctcctgcccccaatccctcccagcatcagagtcttttccaatgagtcagctcttcgcatgaggtggccaaaggactggagtttcagcttcagcatcattccttccaaagaaatctgagggctgatctccttcag

SEQ ID NO: 42038 - DNA, 1597 bp, Bovine  19866880926338
ctttttctcttttttttaaaatttagagaacatgttattactttctgtaatcaaacccacatagataagaccttacatatttaatacagtgcattacccctgtacaaacagaaaaaattggtttaacgtttctagaccaatatgctgttaatttctgtacaatgccaacccaacatggtataactgggattgtttgtcattgttcagttgctaaatcaagtttgactctgcgaccccatggactgtagcatgccaggcttccctgttcttcactatctcctggagtttgctcaaagtcatgtccactgagttggtgatactgtctaaccctctcattgtctgctgcccccttctccttttgccttcaatctttcccagcatcagggtcttttccaatgagttggttctttgcatcaggtggccaaagtagtattttttccaaagttgagagcacaactaaagtttccaaaaattcaaattatatatatatatatatatatatatttatattaaaggaccaatagcagtacgttatgcatcaatagcagcgacagcttttccaggttcaacagtcatctgagcagacttatagagacacccagcgcatgccatttaagaaagaaaaggaaaaaggaaaacctcggaatatagcaaagttccattcctgttgtgctacctggcaccattttttaaaaattggcttctcaatcgtcatctagaaagaaaacattctagaattaggtcattaaaaacagacctgataaagcactgtcactactatgtatcatgaagcaggtacgaggcattctgtgttcacagaggtatgatacaattttgttaagagtcattaggcttcctgatgctttagcagagatgcctgcctcaccccatggagggagtggaaacagacagcacgccgagacccctgcctctgctgtcctgcggaggtgggtgtccaggccccagctttggtgccgacctctcaggctgacccactccaaccacagctccagggagggggaagggaaggaaatgagttaagtctgtcttcagacgcgttggtattgattctgtcagtttcttgctgcttgctgacagaagatagatggctcataacgcagctgggcacagcacattagatctccgtctcggggctcctaaatcatttcgaaattttaaattccctaatcaatattttatggcaagcacgagacagggattgggcccgcttctcttcagggtgtgtgctcgcacacggggtcctggtggaagtgagtaggctagaggggtccctccctgcctggggagaacttgagggcagtcatttcctaccggccagaaccaaggggccctcacaagttacatgatcccagtgatcacctttaaaggggaagaagtctgaggacaagagatgatgaggttggtccttagtcgcctgacttgtaacaaaactgagaccagaattcaggtcttctgacttccagcccaaagctctttctgtgaaagcatgcctagcagagtgcatggtacatagtagatactcaacatgtgtttgttcagcattaagcaaatgttaaaactcataaacagccaaagt

SEQ ID NO: 42039 - DNA, 999 bp, Bovine  19866880958920
cagagactgctttgtggtggtcacagtcacagccatgtcctcctggacacatcacatttcctcccttgcagttaggtgtgatgtttggactgagttctaaccaaaggaatgtgggtgaaagtgaggtgtatctgtcacacttatgtctgctctgttaacattttccatattcagtcagtcctcctcactcttctttcccacccatcagctaaaggtagagaactctacatacctaggaacagaaccacaagatgaagagtcaggtcctcaaataactggacagaagctccctcaactcactgggaacctctgagtttgactctatacgaaaaaggaataaactttaattttgtttagccactgagattgttgcacattcattatagtagcgaacattattgtataacccatgtgccatctgctttcttatctacatgagtttatttgcatggttacctttgcttggaatgagtttcctcttcgtattttaaacttttatgctttgtctgatacctggaccattcctgccacctccatggggctttctacaatttcaccaatccagagtgacttcctcctcctcctttcttaaaagtcacacaaactgctttaccacccactcaacaaatactatgatactgcacatatttttatttagttttaatgtgtatatcctatcttctctgataatttttaagatctttcaatggtagtacctttgccctgtgcttcacagtattgggggatgttataggagcccaggaaataattgtaaaatgaatgaattttgttacatctcatcctttcttattgatacatcttacactgtaatagtttgctccttccacaagggattttgatggcatttcttgtttctctgcctgactctcagaaatgctgtcaaaagaaaatcacaccttcccagtattccttctctttcacacagttcactttagtgccacttacttgtttgtgtttaatacatgctagttttgcatt

SEQ ID NO: 42040 - DNA, 2190 bp, Bovine  19866880968801
ctcattagatctgtagaatgtggcacaataaaatatttcatggtcaatttagattgagaaatgatgcatacagtacacctctcttggaaatgtgtaatgagctttttaaaagacactgaaggaaagttatttacatttgtttatgtaaatatatgcacacttatttatttaatatcacagtgtccattagcctcccatagaattactagttttcagcattttgctttaggtattgttactatcaatgcccacaggctgaaaattcaatatagactactagacatgaaagttacgaagacatggccatggatcatcaaaccctttgaaaaggcttacttttgaaggcaaaggataagcactggctaatcatgtaaatagaagccaaaggaatcaaatgttcagtaaagcatagactaactagaataaactgggttggctactgtccatgtgcagaggtgctgaagcagggatatgctgtgaaaaatggatccctgaaggagcccttaaaaaagaactgttgagagagtgaggttttggggctacatcgaacacctagatacaaaacgtgtagtaaaactgcacagagacagcatgggagaaaagagtcttatactgggtaggaaattaacggccatggtatttgatctcattgttccaactaattggatgtgtgagcctgggcaaaccatccaatctcccatgccttatttttcaaagaagatgattggacaggatgtaagttcattcccagttctaaaagttataatatataatgattcttcaagttggtctttatgtgagcatgggagaaatcaaactgatgggtacttgtcccaggtctctgggcttctctagggagaggatgtgcttctgaaccatatgtgttgcactcattggtaagaacattcagtcttgagtcagtaacaaatcacaatttgggaaaggagagagtgcctgaaacaaatgttacaagtttcagttaccattattgagaagaaaatttctcttcctcctgacttctaaaaggagacagcttttaataatgtgtttagcaaatgtttaattatgaaataactattcattaccagactctgttccagatgcttgggttactttgtgtgtgtgtgtgaaagtgtaggggagacaaaatagacaaaatttcctaccttcaaggagtttatattttagtatagggagacaggtaataaacagtgcacccaataaataacatagatagcaaaagtcaattatatagaatgttaaaagatggtaaattttatggacaaggtaaggggcatgaagggttgtaattataaatagagttgtttgggtgagcctttttgagaaagccttccttggtggctcagatggtgaagaatctgcctgcaattcaggagacctgggttggaatccctgggttgggaagatccccctggtgtaggaaatggcaacccactccagaattcctacctggagaattccatggacataggagcctggtgggctacagtgcatggggttacaaagggtcagacatgactgagagactaacacataaattgagtcaagacctgaaggaggtaatggtgtgaaactcgtgtctttctggaagaaggatgcagacagaggaaacagggcagaggcaagagtgtgtctggcaggttgcaggaatagcaaagcagcctgtgaagctggagtagagtgagtaggcagctgtgctgtaaagatggagtctgggctgctttgtctggcgggaagaaagacattgaacctgcgagagcaatttgcacacccaacagcagcatagcctgacctcaaacttcttttctttgtaggaagccctgtagcagtcccggagtgatgggactccctgcctggcctgagatacccagttagcacctgcgaatcagaatttcctcttcgcagcaataaagcatccagcctttgcatctgtgacagcctcccctgtaatttatgcattctatggtgagtttaaacgctgactctatcattatctgagtttattaccatggccatttgcatatgtttgatggggacggggtgggcaggaatacctctggatagattccaagttgaaagtctgcatgtctctcctcacccttacttcctccccagtcctatgcctagagcagagcctggaccaaggccaagtgtgcacagtgctaagga

SEQ ID NO: 42041 - DNA, 1264 bp, Bovine  19866881005640
aacaatttctgtgttgtaaatcacctcctgttataggacttctggtttcaatttactttgtaagagaaaaagctagacattggatttcatttatccaggtcacatgctgtggcttgagtcccagaacccaagcccttagtttccttggcctctgttttccctcaaagccccagtgcccatgagtcttaaattttatccaacgtggcttccaggtttcttacaaaagtctccgggcaaggtaaataagttgctttgacattcaaggtacactttaaacaccattagatactgtactcattcctagaagcaattattcctaattataaccaatttttatgtgtgatatcagaaaaaaacaccaaactgcagtttaaaattggaaatctgtatggggaagaacagtgatacagagctattcgtgtcaactcagagaatttctcctttgaaggtagcatttttaagaactaaaagaatttccacattttgattctttgaagtaccaaagtgacaccacaggaagagatgacacaagaaaagtggcaatttagatatttacccagaaatgcagaattaggtgttattaatgagtggctagatcacacctgacgttttacaaagtgatatgcaatcgcatctgtgtgagcggttgcatacacacacacacacgcacacgcacacacgtgaatacatactccatgtggaatagaatgaaagaagaggacaattaggtctcatccttagaggcagaatctactgtaaatggtgcctgtcttagtaagatggaataaaaaattataagcaggagatagagagggaaggagttaaatccatgaatgatgaacactagctggatgaggattatgatgtatccacataagtcagaccactctattcacacatgcacatgcacttatggtttgttataactcctcagaggcttccctgatagctcagttggtaaagaatccacctgcaatgcaagagactctggttcaatcccggggttgggaagatctgctggagaagggataaagctacccactccagtattctggcctggagaagtccatggcttccctggtggctcagatggtaaagtatctacctgcaatgcggaagacccaggttcaacccctggattgggaagatcccctggaaaaggaaatggcaacccactccagtactcttgctggaaaattccatggacagaggagcctggtaggctacagtccatggggtcacaaagagtcggataggactgagt

SEQ ID NO: 42042 - DNA, 1361 bp, Bovine  19866881017468
tgcaatcactgatcagatcagaatagcacagagtgctgtgggtatagggtgcaggacacctccatggaagggctttgatggaaaggagagaatggcccccccaggggaagtcagacacctatgagcagagtccttcctaaggcagagcaattatggcaaccaccacaggcctaacttccaagagttgctgtcctgctgtggacacctaagggtacagaactgaacaagcagaagaggaagaagcagcagaaatggtggtcctgccagctagtcctcatgatgaccctaaactaatgatagaagatagagcactcaggttactcactcccccgacagacatttcctgtctacctaccacttgcttgccccatgctagctgctgctgagtatgcaaagataaatcagagacagttcctgctcttaaagttatatgttccatcatgcctagcatgtcacaggggcccaataagttttcattgagtattaccttagccttcagctctgtgtggcctctattctctgccttcccaggtactttcgtatattgttctgttgttgtttactcattaactctgactcttttgtgacccagtagactgtagcaggcttctctgtccatgggatttcccaggcaagaatattggaatgggtggccatttctttctccaggggaccttcctgacctagggaccaaacccatgtctcctgaattggcaggtggattctttaccactgagccaccaggaagcccacctattatattgctctgaattttagttaatgttgcataatttattcccccagtgacacaataggattgctgaatacaggatccatatattcttgtcattgcatcttctcaataaatagtgattgaatgaatggctgtgtaatcctaactggtgtgtcaccaccacccactgccatcagcagaaaagggtggaaggtctagggcttgtaactgcaggagaaagcatgctgggttaggagtcaggagacctgccttctagcagaagctgctgtcaccagcttgctgagagactgcgaacagctgcctgagagcctcggctcagctggaagaaatggtagttgatggtggtggataatctctaaggtaccttccagccttaagagtcatcaccttaatcatagatcacagatgacattccctgagcacatggcatgttctagcactgtgtaagaactttgcctgcattatgtcatgtagtcctcaggataaacttttggggtgctatgattatccctattcagataaagaaaggaagcctggggaggctaaggaaggactgggggactggaacccaaatctgaccaacttgcaaacccacttacaaccatta

SEQ ID NO: 42043 - DNA, 1259 bp, Bovine  19866881053673
ctaggtcatggggggaccatgcaagtttgaaatagaatcctcagcttttcccatcaggagtatttacactattctgcttctcaagaaccataaatgtactggaaaaaacaagttagcaaacaggtccctctcttcaattttgggagacagccatgctatatgagcttaacaaatatattttaaactctgctgggtttctgattacaaaagtcacgcttgttcattgtagaaaatacaaaaaagcatctagaagaacataaatatcaactcaaattccccttctgagagatggccactgtgaacagtctgttggtggactgtgcagtccacacacacttttctaacaaacaggatgatcgtacccatcattttgtaacttgctttttcacttagcaatagagtctgaatatttatatatgtctttatatatctagatttcccaggtggctcagtggtaaagaatccacctgccaatgaaggggactcaggtgccatccctggactgggaagattcccccggaggaggaaatggtggcccactccagtattcttgcctggagaattccatggacagagcagcctggtgcgccaaaacccccggggtctcagagagtcaaagactgagcaactgagcgcacgtgcatgccttatgtacttgcactcaatgtggtttttaatgtagggcactgactctcagctggatcttcgtagttactgatgtgactgagagatcagggcaaatatggattcactacatttgctctggtccacgtggaagttacctctggtctctgcctcactctgctttgctctgtctcagaaattaaagggacacgactgagcctgagcatgatgatgaccttcttgtgaaggtgaagagtgcttcaacccttctcttgatcacattcctttcaaaaaacttgcttgttagccccctacaccccattgtttttcatattttttgtgaccatggttatatctctagctcagacccttaattcttcccacttagtaagccatcataagagagttcttatttgtcttctcagatggctcagtggtaaagaacccaactgtcaatgtaggagatggaggtttgatccctgggttagggagatcccctgaagaaggaaatggcaacacactccagtattcttgcctgggaaatcccatggacaaaggagcctggcgggctgcagtccatggagtcacaaagagtcagacacgatgtagtgactgagcatgcatatatttatctt

SEQ ID NO: 42044 - DNA, 1382 bp, Bovine  19866881072475
aaaaagagaagtaaaggaagaaagggaaaggcaaaggtaacttagcagcatggcaatctggagaattagaggtgctttttgaggtctggagtgtggagaaaaggatagtccaataccaccagataagaaattaatttgccactcatcatagaaacacgggagttaccacttagaggtacatttataacctcttaatttcagagatatgcagcaggagacaacagatccactgtgtcaaagagagggaagatggaaggatttgttttttttattctagggcagctgaagtaacagaaaaaaaagaaaagagacccgaggagacttaagagacagcaatgatgaaaaaatgtactgaccttcatggaagaagatgtgagatcctctagacaaccaaggttagggcttcatgcaaaaagaactagggcaaactggtagataattgggcagaagataaatccctttgcctcaactggttgtgcaaattagttattcaaataatttccacagttcctcacttactgacagttacaagatatgactaatctcgcacatttttagaacttttagaatttcacagaagcgtctgacagaaaggaaatgcaatacttttcaaaggaaaagttagaatttgtcagcaaagggcattatttagcaaatggcccattctaggatgcaagagggtatttcaaatatcttcaaaagagacaatgcaactcgaagagaaaaaaaaaaacaatactttactttcagatggaagactgttttatttttttcttttacttctagtcttatggagatataattgacatataacacagtatgtgtgtttaaggggtataatgtgtgacttgtttatatatatatatatatatatatatatatatatatatattctatatattgcaaaaggattaacacagtcatgttggttaacacttccaccacctcacatatttaccttggtgtatgtgtatgtgtgtatgtgtggtgagaacactttcgatctattctcttagcaactttcaagtatgtaattctgtattgttaactatcatcatcatgctatacattagatcctcaaaacatactcatcttgtaactgaaagtttgttatacttttggccaaaatttccctgttttctcccaagccctggcagccatcattctactctgcttctatgagtttgactgtttcagatgggaggttgttttttgttgagtttaattccattttgattcatgtatttctaacatggtatgagaaaatattttttaatgtttaaaactgtgtctaaatgcaacaagtttagaatcaagaacaaaccaagagccctatgtatgatatgtagacaatgattcttatatatttcaatttattaaag

SEQ ID NO: 42045 - DNA, 2511 bp, Bovine  19866881174582
tggggacaggagatcttttggcatctcaaacagttagtcccaagttgagaatattttaccaatacagatgtctcaaaagttttgtgtctcctatgtctgattttagtcaattccatgttcagttcagttcagttgctcagttgtgtccgactctttgtgaccccatgaattgcagcacaccaggcctccctgtccatcaccaattcccggagttcactcaaactcatgtccatcgagttggtgatgccatccagccatctcctcctctgtcgtccccttctcctactgcccccaatccctcccatgttagttacacctataacattaataaattctgagaggtgcctccctcttgagactaattttaggtatcttgggtttattaagtgtccatgggattatgctttctgtctttctaggagcactttcggagaaggcaatggcaacccactccagtactcttgcctggaacatcccatggacggaggagcctggaatgctgcagtccatggggtcacgaagagtcagacacgacttcactttcacgcattgaagaaggaaatggcaacccgctccagtgttcttgcctggagaatcccagggacagaggagtctggtgggctgccgtctatggggtcacacagagtcggacatgactgaagtgacctagcagcaggagcactttgttcagctgaaaggaactgataatcaccaatgcagtcctttcaaaagttgtgacaaaggatgtgagaactgcacccttgatatagtctttgtcctgaggctgataagatggtaaagtgaaaaacagttttaaacccctggaaattctgggcattctatattctttctcagttttgttggccagctgctcagtttctttttaaactcaagtttgtcttgcaaaaccttatccagctggtaacaaccaaattatactatcaacgttctgccctgacactttcttactcaatgcttcaaattcattaagcacattttctatcttccaagttatcccagatgagttttgccaagggcttcatcactatataacatgggatggcatgtttctagctctccataacggtttcctcatcatctgctgcctaatcaccaaactacggtcacgtattttagacgttcatgatggcaggactgcacttctgctcaatatttgtgttgcctaactattgtgacaataatactgcattgtaaactacccccaaatgcattacttacagtaataagcacttatgctcacagccacatgtgtcctgggtgattgttattcgactgatctcagctgacttaaactaatgaacctgtcttaggctgtgtattgactgatgttggatccaggctaggttttgggctcagatgtttcttactatttcggcctagactgtaaagggcagcagcagcttggggataagctctttttatagtgttatcactgagtgctagcccagttgaactacacatggaaagcttcttcttgcaccatacccaccaacattccactggacaaagcaaatgacatgatcaaacctaacatcagtggaacagggaagtatactctgtctacagtgggaaggggaaggaatgactttttagatgatttcattcaagtgatcaccctaggatttactttcaagatattggtgtcaaaaagagaaaagaaatggatatttatccaatgtcttactcaagatatctggcttttcaatttattcctcaccatagctctatgaccaagttctgacaaatgggatgcaaatgatgtgtgaacttttggattgtgtccttgaaagaaacgggtatgctctcctgttgctcctttctaactcctgatgtctgggactttaagagcatcttaggtcccaaatgaaagccatgcatttttgatggcaggctgctttcccagttctggactattatgtgaatgagaatctttgctcttgtttaagtcacattaaaaaagaaatctttgttacagtagcttcactgctgttgttcagttactaagatgtgtatgactctttgcaaccccatgaatggcagcacgtcaggcttctatccttcactatctcccagagtttgctcaaactcatgtccattcaattggtggtgccatctaaccatctcatcctctgtcacccccttctcatgtcctcaatctttcccagcatcagggtcttttccattgagtcatttctttgaatcaggtggccaaagtattggagcttcagcagcagcatcagtgcttccaattaacattcagggttgatttcctttaggactgcctggtttgatctccttgctgtccaaggcattctcaagtcttctccagcaccatgattcataagcatcaattcttcagtgttcagccttctttgtagttcaactctcatatccatacatgactactggagaaaaacatagcttttactacatggacctttgttggcaaagtgatgtctttgctttttaatactcgtcaaggtaggtcat

SEQ ID NO: 42046 - DNA, 1229 bp, Bovine  19866881182113
ttttagaagttactgtctttcctcttccccttgtttttctgcttctatctcctgtgaacttcgcacaccagtacctgctgcacaggtagcttctccattccacaccaagtctctcctaccttcaactctttcatttcaagcatttaaagttttgtttatacttcaaattttcctaaaattatcacaaaaagctttaaaggaattaattcagtaattcttggcagataaaagattcttgcccaaacttaaaagccatgtcaaagctgattttcttcacacgatttggataaacaaatgggttacatttttaccacaatgcagacctatttttagagtcaaataccaagatcacttaaacagagagggatgcacctacgttatgtagaaatgtggtggttttgtggcctagacaagttttcactcaaatgactaaccttcttatgtaagttggccatggatgacctaaactgccccctgcaatttaatctgaatcttatgatccacactgagcaagaaaatgttgataggctctgtccgtaaaaactagaatatggaaaacttttatagcaggaaacccagggttcctgacaaaatatcaatctgccaccagcactgaatttaagaaaacctgaattatcttgcctgtgtcaacccgagtaatcatcttacagtcccccttaaagtcctccccttctccaatgtgagctttgctcctagttccttcacgctattgtgaaacaagacaatgtctcatgaagcatgctggggaccctgaactactcctctccagtgttaaaggtagaatgaaatagaaagcagtacttccacattttagtttttctgtctgtctaaattatgaggttgattagccatgtcataaattttgtagtttcacattttttcctactatctatggtccacattttgatcactttataagactgcattaaaaggaagaaaacaagaagtcagagtaagtgggattgtttgttctttttggcatttctgggttaaggtttaaagggcattttaagtaacaatctaaataagatatttctgaaaacctatgaatttaatttattcattctactgtgtcctcatttccatagctaaatgaaggtttaatagtacacttgtaaggcctgtttactgaggctgtattaaactcaggacaaactcacattgttgcctaatttcactttaccaagtctctcaatccctcccgccca

SEQ ID NO: 42047 - DNA, 783 bp, Bovine  19866881201370
ggccccttaatcctttctgagatgcagccttgcctctcaggacagctaacattctgtggcttcccacatgagatcaatgtattctaggtcctccattctttgtgtctaactcagcaaaaagcaccggagtctttgcacctgcgttggtcacagtgggggaaacacttttccttcttcttgataatccatgtggagtgatggacaaggtgtctacccagcaccaaccttgatccactgtgagcaaagctgatccctgcattggtcagatcaggaggatgtagccaaacatggcatcattaaactggtcaaccagctgcaagacattaccagctgccgtgttaatcattaatgaggcagacagtgcctgttgcctgtgtagtgaaccaaacgttatgacttgggttttcatttcatttaaaattaactcactgaatgaagaatcggcccccagcttgtgagagacagagctgctggcacaaagaggggactggcaggccagaagtacaaaaggaacagaaagtccctcatcgatatgatccaaccgtatgtaggccatgtcttttaattcaatttcgatctcagctcctcaaagctgccactcaaaatatttctgtgttcccaagcagcctccatgtgtcacagttccttcctgccatggcatgtgctgatgcctctccaaattacttttactatgtctttaaatctaggcaaagtgagagtaaagtcctactcttcatttttggattgtaattttcctcttcaggaaaagcaaatgtaactttt

SEQ ID NO: 42048 - DNA, 1634 bp, Bovine  19866881364214
tatgtaacaattcaagtggggtttttgatgtctcccttgtgtcagccactctaaacacaagcctgaaaataacttacataggccctatataattggctcaggtaaattagcctaatccgactctacactatgcaagacaacacccagtagttatgtgcacaggacacaaagccattcagtactgttttcaaccaaaactgacttccctagtgcctcaacaggaccatctaacactctttacaaatttaaagccaagcagtaaaaccagaaacaacacatcaatcgacatgcctaggatttttctacaaccacgctagtgctcagataaattttatctctgtaaaacaactttgctatcgcttggttataaagaataaaactttctaatgacctctgactgtattttaaagtacttacttaatactaaatccaagatgttttcttttattgtaacactctcaataacaagtccataaattaccggataaaaattagtaatttctttccttttgcatagtagcttacccagtttagtggcgccctctggtgggtattcaggaaactgaccctcggaaggaacactgacagttctccgcaggcatcgccctttggtggaatctgcctgctgttcttgtcctccgtccacaggtatctagtaaacaaaaaagagatgaagcttaattgtgccatgagtaccttctgagcgaatgacatttttaggtgatgatggtaggagtgtgcaatcatcagagcaaaacagaagaaatggagaaataaagtctacacaatggttaaagtattactaacccctttcaggaagcttttctttaaaaaagaaaactgaaagatcaggaaaggtgagtatgtaaatgagcttttgcgaagtatgtacaaatcacattcaggtgtgtatctgcttgaggagcttggaacacaaaaacaagacacccacacaagttaagattctttcacatcagaaacctgtgcacgagttccaattctgcccaccgttcagtaaggaaatggaaatacaacaaatacaaccaaccagaaagattttgctccaaaattctcgtaaaagaaggttttgttaaacaaaagtagtaaaatcaccccaattttctccaattttagaagcacttagagatagttaataaaatactagcatatattcttccacaagtgagactagtttttgaaattctaaaaaatatttttttctagcgtaatttttctttctgattgtacacgtggaatgagaactacaaatggtataaacgatgtttgatgccattaactattttataatttacagaccggtaatcattgtgaagtaatgagatggctcgaagttcctttttcttcccccagtaagaccaagtcatcttactttgggagaagggcaaaaacttttcacaatgagattttattagtaacctctatcggaattaagaatagtgttcataacatcttaaatagtttggcaaactatgtcaagaattatggtaccgaggcctcagaatcatgcccccgcccctcactcaaatggacactaaccgcccttatctgagtttcaggctcaatcacaaacagaagaagttacagagagaaaaaaaagaacggctagggccaag

SEQ ID NO: 42049 - DNA, 956 bp, Bovine  19866881365203
gcgctgtgggatctgttagtgcctagaatggtgctgagcagactgagagtgccctggatacactaactggaagccagactgggcaccagatggcagctctttgatttggctcctctagggtgtatttatcaaactcgagtctgagcaagctccgggcattggtgtaggacagggaagcccagcgtgctgcagtccatggggtcgcagagtcagacatgactgagcaactgaactgatactgggtgtttttaaccacaattcaaatccactgggatttatataccattttataacccacagtcttctgatcttggtatgaagaatgtgctggaacagcccttgactacaattcacattaatattaaaagcttctaacagtggacagaggcagaactgaaccaaggttttctatcccaggcattgggacaattcaagtgtgttagtcagttttccctctcgcctgtgacagtaatgtctaatggtcccctactactgtcattctttttatttctctttctctctggaatgttatttttttaatgtaaatacctatctagggctatttgcatttaaagaatataacattccagaaaggaaggtagataggtaacatagtatgtagttattagcccctaggtgtaagtaagcttaagaaccaaattaaattggggtctttaagatggaaacttaggaagggattaaatgtttgtttacatatctatgactatctgagatggcagaggagggaaatgaactttcagtgaggaaggtccttagggagtaatgtggtcccagctttcactaaatggttgtcaatatgtgaggtggggtgtgggggccatgaaggttgatagacttcaactttaaaagcaggggaaatcaagtataattttcaggtaccatcttaaggggagccataacattagcctggagagcaatgctgtagaaactttgaa

SEQ ID NO: 42050 - DNA, 1901 bp, Bovine  19866881462126
aatgagtgaattagccacatattaaagttggtaagctctgctgcaagctacctccaacacatctcctaccttctgaccttgtgtcaggggtccacgctgcccctgattctttgcctcctgtcccctcctatagtcctgttctgggaagatgtgctgtgtggtttgcttggtggccctactctgctcgtgataattagagtttggcgctacacttcggtttctcaaagggatggtttcttatgggagtgttggcatgaaggagagtcagcttttccatggtgacggtctgtccccggaggtctggcactgggcctcgaatgtactgctccccaactgtgctcatcagatcactgtgatcctgttattctctctgagcacacatggaaccactgaaggttgaaactctccccacctggctctccagtctgcccatccctccccttgggtggatgttccctgtagtctacttacaggagaggaagaaactcaatagcatttggctgctgtgcgcagttgctgattgacatgaagtgttagtgttagtagctcagtcgtgtctgacgctttgtaaccccatggactgtagtgtaccaggctcctgtgtctgtggggttctccaggcaagaatactggagtgggtaaccatgccctcttataggggatcttcccaacccaggagggatggaacctgggtctcctgcattgcaggcagattctttaccatctgagccacaaaggaaaccatgaagcatcatgaaaattattactttctgtttagcacattcatatgccaggcattgtgctgggttttatgatttccattgtacagatgttgaaaagaattcttagaaatgtgaagtgatgtactgaaagtcacatggctagtaagtggtggagatgggatacagtcccacaattacttgactctgaagttcatgcttgtttcacattacctctagaaaggcttatggttcctaatttctattaatcaaagtgacagattattgtaactttgaatctttgcagacttctagtgcagtggcttttaaatgttagtgcacatcagaatcagcagatgggctggttaaaactctggtttagtagttacgatgtgaggctagagcatttgcacttctcacgagtttccaggtgatgctgctgctgctgctgctccaggccatgctttgagaaccactgcccctctggactcgaaggggtagagacgagcagaaaacaaagcactcgttgttcccatcccctcagcctgctgggcagtgctgctgagatgcctgtgccttgctttttgcttcctggacattatttcacaggagagcagaggtctggctacttgcatctgtttcagttcagtatctcctcttgtctgggtagtatgtaggctggtccactgccctgaactcaggagggtcaccttctaacaagctgaggatttaaaaagcatacaataacacaaacaaaggcctagaaactgaaagcatgttgatttacgggcactgctcaggaactagtaatccagttcagagaatgaaaaaaccttggctcatccacccaactagagggcttctctgaaattcatgagatttgtaaaaaatgggattcatcatttgcctttccctagagttcttgccttgttgtatatacccaagcttccaaacagagttgactttgaatttccatgatggactatctaagcatgtttgggagaatgctgggggtctatctacatgctaaccctataggcactctggcagtgagaggcacggtgtacagagcatcggggctaagagcaagaggctatggagtgagatagagctggttgcgaaagctggctctgctatttaacagctgagtgtccatgagaatattacttaacctgtctggat

SEQ ID NO: 42051 - DNA, 1572 bp, Bovine  19866881694364
aaaaaacccgtcgccgtttctgaagagccagagcgaaatcagggtactgtgcatgtctccttgtactcaaaccacctaagccagcccttgggcccaacgcctggacccaccccctgtgctcaccccatatagggaaccagctcacccctcaccacccctggggagtgagccagggaacctgttacttgttcttctgcctcctgcagccgcaggagcctccataaagccttgcctgaatttcttgtctggcctcttatcaatttctattgattggggaaaaccaagaaccccagtgggtatcagttctactgtggtgggactgaacagtgacccagtaatagtggttcctcccatcctagtgtgccattatttcttgcatgcccagcttcctcgggaatttcctgggtaaagagggattgtcaggttggaatttaagccattgtgtgtcatgccctggggatcacaggtggtgaagacaagggatccaaccctccaggaggtccccgtgcagcggtggagagggccaaatgcacgggaaaggacagcatggtagggtgactgctattctaggcgtgtgtgcccgggtgctgctggagcacatggagggcatctcatcccgcctgaccaggggaggctgcctggacaaaggatgtctaagctaagaagctgagagctctggcagaggcaggggagcaagcagctgtgctgatttgtggagtaatcagatgaggacgctgaatctaggcaagctgaatagaatagacaatgggattccaagcagagacggaggaaaagtaggactgaggatcaggaaggggaatcaagaatacgaagcacctgatgagaagatccgactcattggaacaggccctgatgctgggaaagactgaaggcaaaaagagaaggggcagcagagaataagatggttagataatgtcaccaactcaacagacatgaacttgagcaaatgttgggagatagtggaagccagacgagcctggcatgctgcagtccatggggttgcaaggagtcagacatgacttagtgactgagcaacaacctctctcctcgagggtgagaactggagctggaatgggggtgaggccagagttggggaggagagagaagcacagagaatcaaaggctaagcctgggaatgcccaggtttcagggctgaaaaggcagaggggctagagaataatttagagagccagctgggaaatcctagcaacctgatcaaagcaccaccaaaccctaggtcctctcacagtccagcttaagagtgtgcagccctcacccctttgtgtttctggccttacaggtgatgttcaccacagctaccatctctcaagggagtaccaagcagcaggcactatgctagactaatatatatattatcatctgaagttcttagaattcagcgcagtaaacatcaactttcccattttacagatgaggaaacaggttcagagaggttaagtgactttctcagggcccctgtgccacacaagctggatcagaactgggatccaaacttctaaactccatgataaacacgggttgttgttcagt

SEQ ID NO: 42052 - DNA, 778 bp, Bovine  19866881737836
atccctaatgtaaagacttaagggttactttgtgtcagtgatagcaagtgacataaacatctaagattttcctggaatcctagtgtaagacatggtatagtgtagtgggtgagagtgagggctctggaactgtgtgattgtggacaagttaatcttccagggcctcaatttcctcatccataagatgggagtaatgatatttctcacctcatgattttttttttttttttgcattggttaaacaagttaatacttagagctgggtgcatagtgaatgttgggtatgttttagctattttatgtgtcagttaattataaaatgtcagagttgtatgttagaggatatgtctaggtctgtgttttaagaaggtttaaaatttctgaggaagatttagatttttatcacactgtcagtctacccgaatagtcagtttatatcctggaagcaaaaatgactcttcttgtctagagggaccatcttatgggagctggttatgggactgttatttaggcagctgctttttggcatgatcccaagtgaaatgtttgagctggctcttccctcaggctcagaagtcacctggctaatgtgaacttcaatggtcctgggatgctcagctggaatctctggcttgtgttaccccaagcaggtgttctgagaccaaagggacagtaattggcaacaatggttgttggaaggttaccaaagactggctgggaatagtctcatcagcgtgcgcgcgcgcgtgtgtgaatattctcatcagtgtgtgtgtat

SEQ ID NO: 42053 - DNA, 696 bp, Bovine  19866881785679
aatgaatcctaagatctgggcctggaaatatgcgtccaacatttccaaaaatcccagtagaacaaaagagatgccagctatttagctttgatattcaggagaccatttgtagacatttttcataacagtttctttaggaggatgagaataacagggataaggagatgctagagagaggggagggaagggtggtaaatatcaaccatgagtaagagatcactgtttttctatgcaatcccaacctcaaccacaactcttgatgagagaagaggaatatttctccctactttctataggatataaatttcaacagataaatattctgagtcttcagccaatataaatcagtcttggtcctacttcaactccaactatacttataaagtacttactgagaaatatgctaaagaaattcttagtcacaaattatctttcagaacatagggattaagggaaaagaaaatgtggtggtaaagcagtagatgctttagatctaattgacaaatttagaaacaaataaattaccaggagtagatggcaccaacccaagggtctgaaggaactcaaggatgaaattgtgaggctgctggccaagttgcaaccttgcagttacaaatggccacatgccatcagagtggcagactgccagagtgacttctctctatgacatgggctgcagaggagacctgagagcca

SEQ ID NO: 42054 - DNA, 892 bp, Bovine  19866881933621
aagaaatcaataatccaagttttgtatgctaatgtaatttggtgaaaaatgtactacattgagctcagttagaacattctctagattgctagagtttcttacaggccgcatctccagaaagacctacaaaaatgagatttagcaaaaccgtcgtccacgtggatctgagcgatgtagagacgtgtgagccccagttccattgtgctgaagccttgattagcatttctgttcctggcagaaaagactgacagtcagtcaatcagtcccaaataacaataatatagctctgcaaaaaagcaacttccactcttaggggagttattgttattcagggtaaaaaatatcccctgggcagattcactccactgcagaagttggttactttgcaaaacctggggggagaaaaaaaagaaaaccaaaaaaagttgtacatgcaatatttcacattgtgagtagatttgctttggggacaataggcaggatgcttggagagacccctcctagcaaatgacaaaatagagggatttctatctttaactgcaaaaatagtaagaggagagacttgaagactgaacacagtgaggctgccccattgttgcggctccccgtggaggtgggggtcacacacacgggagacgaagccacggtcccaggctttcttccaccagccccagcttctggctccctctgcagtaatgttaattatagggtaagaaaaactaatcttttctttttctaaagacattaatcaaacctatcaaagaggtaccaaaaaaaagaaaaaagacaaactttcaactagggattgcaaagaaagatttaagagaaaaaataggatttgcttattattagccatgggaaggttaaaaagaaacatgataattgagtaaaa

SEQ ID NO: 42055 - DNA, 812 bp, Bovine  19866882141936
ttggcaagtaaggaagaaaggctctgaaagaatcttttcctctctaaaatttatgagtgataactcccagtgctaaatttaggaaatccactccaaaaatgatgatggatgagcatgaatcaagatggctgccaaatctgttttcaagaacagaaggtagagggctggctctggagtacacaccttagtcacttcatcttagtttgtctttaggacctgtacctggaatgttggccataaatttaacaatgtactatatattccctttctataaaatcacaataatcactcagactataattgcacttcctcaaaatcaactgatttttgtggatcaaagcatgaatagtgagagaatcctagagaaggtgagaaagagagtcatcaacataacattacaaataatgacagcaaaggagttgaaagaaggcaactctgagctagtccagttcacacaaaacttatatgtgaaatacaaacaggctataaaatggtcacacccagacaggtttgcaacataacttaagcccacacctaaactggtttcaacacattttaaagaagtataatggaaacaggatcagaggaaaatctgattcttccaagtatgaccccttgaagaaagtgtttgctaaccctgactaatgtctagaaaagcaacaaatgtcacaggataaaaagggaactaaaggattcaaattctggacaaagttccatttagaaaatgaaaagatatgaagaaaaaggcaaaaacaaacaaacaaatcttgattttaaaaactacagcaaaatcacagaattatccatactaa

SEQ ID NO: 42056 - DNA, 1893 bp, Bovine  19866880558760
agttctttattgctgtttggcacgaacaccagaatctgtgtcaagccatgcatcgtgctctgatttttttttttttttttttcctgcttttgaggcaaaacgggaacaactcgcattgtaacactttctgaactggttcggctttcttcacattaaagccaaccaatcccagtatgcaatgcaaacaatgagttaacagtcgcctagaaaccacatatcccagaatgccatggtctcaagcaatctcggaagtgggtagaggagacgccactgcattctgggagttgtagtctcacaggactggcccgcccctcgtgcaacttcggcggcctacgtttggaggaaacgctgctcgagtggcttagcgcggtgcgggccatagagagcggttccgcccaacaaaaccttcgcctccggcctggtggccagctccgcctcttctcgtatctttcccacagcccaaaatggcggcggaggtggattttggcgacttagagctgttcgaggcgtttgaccacccagaggagtcgactccgaagcccgttcatacccgcttcaaggacgacgacggcgacgaggaggacgagaatgggattggcgacgtggagctgcgggaacggcttcggcagtgcgaggaaaccatcgagcagctccgcgccgagaatatccttcccgctctctgggccctgtcatcagggagtgtggtggggcccgtgcccggagggcgcgggcggaaattccacaagggccagaattcagcctgagaatctagggttcgggttgcgtaagctgtcctcgaggcctcggcgcagacctctccccttgtgggattcgtctcctggacctcattcgtttctcccgtccgcgagtctggggcgggattttagcgttattccggactctttcaactgttcagttgcagactgtttaccacgtctgttcccgtcttttgagtcattatccggtctccttttttggaaccaatgtaaagttgatgcagtcacgctatgtggtgtgttaggagataccggctacattgacctgggcgcctgtgtctttaaggcgcggccaaagttagtggccccattctgtggagttggggttcctaaggagtcgaggcatgcacagagaaatggttcattgctgatgaccattggggattcatttgaaagttcttccactttgaaacagcttccgtgtggaatgtgcatttaagtttccgtttgactttagttacatgtccacagcctttctagcaaaatgtgttaatatgttaatacattcttagaaggtgtttgcgggtggggtttaacttattttaaaattttttgtttatttttacttagcttacaattttggttcaggaacttttttctagtgtaaggttttcgaagccattttttttcataatgcctttttcctggacattttattgtggaaaatttctgaagacagtaaagttgaaaggatttggcagtgaacattcgtagattccatcctagatttttcagttcttaacagtttgttatgctgcatttaccttgttgagttatcatgatgcttttgacctggaacgtcttcttaagtggctgtttaacttctgacggtgcaccgttgaccgaatagcatttttggtttcagtctgttagtctattttgaattacatgacccccgtcttagaaataccatgttggaagggtatgtattttagttttttagatccagatactagtcctgcaacagaaaaggtcaataagtgtgtcatcctcaaaacatttgtcttttaacttttgtaacatacgtttataacattgacatcaaaagtgaggttagtagttgtattttatgatcttatttctgtttaatgagggctaagtccttaacaagtaataa

SEQ ID NO: 42057 - DNA, 993 bp, Bovine  19866880560214
ccctgggctcgacaaataacttctccaagtttagtcccatctactgtcaggtggtacactgacggcgtctgatgttccgatgataaaattcctgtttgccaaggagagaccaaccccgtatcagcacttgcagggaacagggcatgccagcaattctgcttctaattgcacacgaaacgcctctgtcgtctataatttagtgacattattaacccagcatctccaaaaatacgccaccaaaacccaacagcctccatttgcaagtgaaaaagcccacatttctacatgtaaattgagtcattaagtatgcagatggacagtcagttgtacaattagctaatctgcacatgcaaatattcatttgtgtatgcaaatatggtgctgggtgcacacatacagatgtgcctgcaaatacggcaagggtaattaagcaggctcacagataattctgtcttgaaatgttatggctattcactatcaaatccctttaaccatagagctaggacaaactcagctcagagaaaggagaccaacctacaatgaaggactccagaggtcactgagatcagagccatttccagcttcctatcactaaacattcttaataggagaatgatgtttcacttagaaaaaaaagattaaacagtgatcgtaatcagccaaggagatccatctctgacccagggaaaggcctaactagaaaggccaggttcctatttcacatcccaggaacaggaagaatataccacggcacacaaactaaaagacacagctttctgactgtttcaatgatgaggttcatgaacgacttcaactgagcgctgaagaaatgatgctttcgagctgtgtgctgggagaagactcttgagagtcccaaggagatcaaaccagtcaatcctaaaggaaacaactctgaatattcattggaaaaactgatactgaagctgaagctccaatgctttggccaccctgatgtgaagagccgactcactg

SEQ ID NO: 42058 - DNA, 692 bp, Bovine  19866880630507
gataattctccttggatggaaagatacaaaaagagttttgccctcaccaggataatctttcccacatgaattctgaattctttggtttatgctgggatgttcgtacagactgacaatgagatggactggttttccgatcactcttaaatactcagcagtgttcagcttgtgggctatgagcacagcttccgtgcctgatcgccggtactgaacatgaagcttcttcagcagagcttcagctttttcacgtgtctcatccttttaaaaaattccaagcaaacagaaacttgttttctaaatcttcagtgagactaagaatctatctttatcaatcaaggtcccttcctgccttagttacaaccttagtaatctacaccaagcctcattttctttctccagtttaggtccccaacccttgaaaatatctatcaccagggtgggctgaaaagggatgctagagagcacaacttaaattaaaaagaaagtggactctgacaacccagagaggtgagatgagggcaggggagggaggttcaagaaggaggggatatatgtatgcttatggctgattctcactgtggtacagcaggaaccaacaccgtgttgtaaagcaagtatcgtccaattaaaaataagttttaaaaaagaaatagaaatggaaccttaaaaaaaaaaaaagcagagcctgcacc

SEQ ID NO: 42059 - DNA, 1772 bp, Bovine  19866880680778
cttcttagccccacctcccaatctctccatctaccttctcctcactcctagccctaggcaatcactgatttctgtctctatagagttgctttcagagaaggcaatggcatcccactccagtactcttgcctggaaaatcccatggacggaggagcctggtaggctgcagtccatggggtcgctaagagttggacacgactgagcaacttcactttcacttttcacctccatgcattggagaaggaaatggcaacccactccagtgttcttgcctggagaatcccagggatgggggagcctggtgggctgccgtctatggggtcgcacagagtcggacacgactgaagcgatttagcagcagcagcagagttactttcttctaaatatgtatataaatagaatcatataatatgtaatcttttgtgactgacttctttcactcaacataaagttttcaaggttcatccatgaaacctgtgtcagtactgtgttcctttttataaaactgaataatattccattggatgaagagaccacattttgcttatccattcatccactgatagatatttgtttctactttttggctcttaggaataatgttgctatgatcctttgggtatgagtttttgtgtggacaagttttaattctcttgggtagatacccaggagtcaaattgctgggtcatatggtaactcgactattaactcttgaaagaactctcaagactgttttccacagcagctgtaccattttacattcccagcagccacataggagagttctagtttccattgcagaatggaaacaggggaatgagatgatgtgatttctaaaagatctctgtctgtgtggaagatggattgtaaggagacaaaagcagaagcactggagagctgtgtgggtggtacttgggtggtacttgtgtggtccacaccagccttaggtggctgatacaggggctgaagtggggaggtgctaagaggacaattgggggatctgtttggaagtgtctggaactgctgcagaaaatggtcttgtcttggctttgggggtgcagaaacccccatggcctttctaagaatcccaccatttcaggctaggggggcgggccagcctgccccttacctagtcccctgcctcctacctaggagctgaagatcctggtagactacgacgagaaaggctacctcctgcagattttcaccaaacccatgcaggaccggcccacgctcttcctggaagtcattcagcgccacaatcaccaggtatcactaaggaccgcctgtcctcggcgggtggctttctgggcctcgcagctcatctcctttctcccgctccagggttttggagccggcaacttcaactcactgttcaaggccttcgaggaggagcaggacctgcgaggcaacctcaccgacatggagcccaatggggttgtgtccggcatgtaggcgccgcaggtccagcaagagccaccgaggccccgcccaccttcgggagcggggcgcacggtggatcacgctccctcgccctgtgacccgcccactccactggagctgaagggagccctccttgccccgcccaccatccgactccgggacccctcccacacacactaaaggctccgcccactacttaccatgcccctctttggggcctctactctcctgcccttgggtataaagcaaagcagggtccaaggcagtgtccacgcgtttgtgtcgggctggatcagcgacgttcttcggccgccagggggagctcaagg

SEQ ID NO: 42060 - DNA, 1087 bp, Bovine  19866880681021
tagtgagcatataagtcagtcatataacttttcccttctttgaagttctctttggacactctgtatgtgtctacagccaaacacgtttttgaaaaaaagctgaagcccaagctcctgcagttaacacagggtaaatcctcaacactgattaacaaggagatagccaagatcacgcaaaccatcgaatcctacctgttgtccatagttaacccagagtgggccgtagccatcgccatcagtcttgcccaggatgtcccagaaggtatggattcttcctttaattgagcttcaaatggttggctgtgttgttttcgtaacttgttaaaaaaaaaaaatgatgctcctttcatttccttctgtttcttttaaggagaagaagtatgatagcttagaaatgtatgggactccactggcagtccaatggttaagattccatgcttccagtgcagtgggaggagttcggtccctggtcagggagttaagatcccacatacatgttgcgtggcatggctaaaaaacttttttttataaaagtagagaaatatatttgcccccctgtcctcacttgtagcactgtcatatgttaaagaggcaccagtgaggggacttccctggtggtccagtggctaggactgtgctcccagtggcagggggtctgggttcaatccctggtcaaggaactaagagcccacatgctgcaactaagagttcaaacgccacaactaaagattctgcctgccacaagtaagacttggagcagctaaataaatacattaaaaaagaagaggcaccagtgaactaagcaagatgcaatgttgcttgcttggcgctcagtgccagaggcactgcctaacttgagtataaattcatactctctcatgtctaatcatacgtactttctgtaacgaaaccttagacactgtctcatggtcaaacaggtatacaaacacttaaataacttatataacacttatataaacttgccgtgttttcagttgtaacaaaagtgaaaataagtaatttttctaaatgctcatttgtcaaaaacggttaaaaaaaataaagggtattcatagagtactgtgta

SEQ ID NO: 42061 - DNA, 1748 bp, Bovine  19866880692941
tctgtgtatccgtcttaacttcctttcttttgtccccttacttcctttattctatccattctttttttaaaaatatatttaaaattttatttatttatttgactgcgccaggccttagttgcagcacatgagatcttcagtcttcattgtggcacatgggatctagtcccacagccagagatgaaagccgggccccctgcattaggacttcagagccttagccagaggaccaccagtgaagtctgtccattcttccatccacccatcatctatccatccttccttccatccatcccggtctgtccaccaaaacctacctatgggtgaaattcagcaggctgcgaatgtatgacttcaagagctgagatctagctatgaattggttcgtactcacagaaagttcccaagataatgctaagtgaagcaggacaacaaagttgtaagagttcaggtcctggagttagttggacctagatttgaattctcactctaccgctccttggctgtgtgaccttgggaaaaccacagaatctctctgaacatctgttttctcatctgcaaaatgggcatagcaggactgcactgctggggagctgtattaaatggcatcagcttgctcataacggatactccatattggtagtttgttaggtgtagaagttcaggcaattctcctcttaaaaggcctgatactgtctccaccgacaaaaggattgttgactgacttcattcacctcagtcctcatgtgtgttcatctgggcttccctgtagattgagtataacctactcaagagctacaaagaccacctggcagtcctggacattcaccgaaccgaccagggcagctatcccacctgtatggtctggtacccgccactcaccaaggagctcttcctgctcatttgcaacagtggctacaaagtgaagctttttaattctaccacaaaaatgtgcaggtaagccagggagcttcccgcaaatggtgcataaatcaatttctcagtccccaggttatttcaagtcccaccttaaggacctgcaaacagcttgcctaccattacaacccttcttactttgcaaagtaggaaactgaggcacagataaggttagttgtccttgctcaagtttacatggttagaaagtgccagaggcagggacttcactggcagtccagtggttaagaatccgccttccaatgcagggggtgcgggttcaatccctgttcgggggactaagatcctacatctgtgggacaactaagcctgtgcactgcaacgactgagcccaacgctctagagcctgtgtgctgcggctagagaagcccacataccacggccagcagtccctgtgcagcaatgaagagccagtgcagccaaaaataattttaataagtaaataataaactgcattggtaacatctaaaaacattttaaaaaggaagtgccagaggcaggattcaaacccagaaacgttgtttctgagcccagcacttcacagggataaggtactcaggcctcggagatggagattcagcaaaggcatcagaccccacagccccagaaaagctgctcatgtgcaatggaatctcctgttcttctctcctggaaaaaagcggattcacctgaatactaccagctgtttgatttttcttattcttggttcttagagaagttataagttcaacttgatagcattctttcttctctcaagcccactataggactatagcccaccctatgaactgtag

SEQ ID NO: 42062 - DNA, 1783 bp, Bovine  19866880837400
actgtctgccatatctactttatacaaaaatgctgatgatggtggttttttggaatattttgtaaagaaaaacaacgaaagaatgacaaaccgctaaatttaaattcagagatcacttctcaaggagaaccatctgtgactacaaaagccgtattgtacccattcagttaacaaagaacaatatcagtagggtaccacgcatcatgatgtaaactgtatttagggccttctaaatagactactgctttgagagcatgtactttcatgatgagggggttgaaaagatgacttataaagttcctatcacaaacattttaaaaattctgtgacttctatccagtgaagcaaaacatttgtgaaatcagtggttgatgcagcagttttaatctaatgcaacaaatatttgttgagtacatgaaaagttgattctgtctgcagccaaaaaaaaaaaaatcaagtagactcagacaaatacatgtacacataggttcacagaaacactattaacaatagccaataggtggaagcaagtcaaatgtccatcagtagatgaaaggataaacaaattgtgatacatatgtacaatgcagtattactcagtcaaaaaaaaaaatgaagtactgatgcatgctacatgaaagatggaaggcaaaaggagaccagggcagctgaggatgagatggttggacagcgtcaccaactcaatggacatgatcttggacaaactctgggagatagtgagagatagggaagccaggtgtgtacaaagagtcggacatggcttagcaactgaacaacatgctacaagctgggtgaacatcgaaaacattatgctgggagaaagaagccagacacaagacgtcacatattgtctgactccatttatatgatatatgcagaaaggatatttatatgagatagccagaaatatctaaggccatagagacagaaaatagattagtggggattagtgggggagaggcaagttggaatcaactgtttaatgggtttatgtctccttttggggtgaaaaaaaatgtctggagctagatagaagcagttgtggcatactaaatgctactgaattttatactttaaaatgattaatttgggggactttcctggtggtccaggggctgagactctgagctcctaatgcagggggtctgggttcaatccctagtcagggaactagatctcacatgctgaaactaagacccagtgcagccaaatacgtaaatatttttaatgattaattttatcttatgtgaatagtatctcaataaaaatacacatataaataaatgaaagtaataaagattttaaaaaaagacaaatggagaatatatgaaaaccaggtaggtgagagattttagaaaagagattttttaattggaaggattaaagtccttccccggagaaggcaatggcaccccactccagtactcttgcctgaaaaattccatggacggaggagcctggaaggctgcagtccatggggttgctgagggtcggacacaactgagcgacttcactttcacttttcactttcatgcattggagaaggaaatggcaacccactccattactcttgcctggagaatcccagggatgagggagcctggtgagctgccatctatggggtcgcacagagtcagacatgactgaagtgacttagcagcagcagcagccagggcttgtattccaataaaatgactaaatctcatttagataccttgtagaaggaaagactcaaaccaaacagccagatttgggcttccct

SEQ ID NO: 42063 - DNA, 1226 bp, Bovine  19866880846321
ctgcatttcggactcttttgttgactatgatgccatcatagtcaacactgtctatagcacttgccaatttctgtagtgtaaacgtgatctcaaactattgacatgaggtcactgaacacagagttgggatgtgtaggcctgtcagcactcactgaccccaccctgggtacaataagcaaatcagtctcatcacttaggcaacctgtattggtatcacctgcaggtccagggacccaccagccctgaacttggatgtcaaatatttatttggccgcacgaggtcttagttgagacacatgcaatcttcaatctttgttgcagcatgggggatcttttttgttagttgcggcatgctaactcttacttgcggcatgtgggatctagttcctttggagtccttagccactgggccaccagggaagccccctgaacttggacgttggtcattgtgcactagcactgccctcaggagcctggcagaagcaaatgtaaagtatctggagatgaaggtagcttcattctaggcctccaattatccctataaataaatttggaaatacagtgtccagcaaggttaaagaaaatcaggcagatcacaaggaaataggacaccatgagtaagaactagcagaaacagactctcagaaacttcaaatatcaatggtcagacacagactattaaacacctgtgctttgttgaaaggaagaagtgtaaaaatatctgcaggagacagtaaactataaaaagtgccacactagatttataaagaacatttgtagagagctttgtagtttaatcggagatgaaaaacatacatgccttcaggggccatgcggtaacacaaatgagtacagtgactaggtgacacattggtgacctggggagctgtatccaaagggtacagggctcctcagctccagctgattgttgccatgtggcacacagtgcccagtttgcagatttgacatgtctatagaagctggatgtttggatttctttttattgtggtcaaatacacataacataaaatggaccactgtgggacctccttggcagtccagtggttacggctcagcgctttcactgccaagggcctaggtttgatccttggttggggaattaagatcctgcaagctgagtggcacagttaaaaaaaaaaaaaaaaaaaaaccaactcaccaaacactgtaacaatttaaaggtatacaattcagggcataaagca

SEQ ID NO: 42064 - DNA, 1261 bp, Bovine  19866880848593
taagagtttctttgtttgttttcgaagtataactgacctatgacactgtattatttcttgttacacaacatagtgcttctgtgcatttattcctatttctatatatttcaagatgatcacaacaatatgttgtcatacaaggatattacatagttattgactgtattctctgcattgtacgtttcataactgggactcatttattttgtaactggaagtttgaaccactttatttccctctcctatttctttcctcccccacaaccctcctcccatctggcaaccacctgtttgttctctgtatctataactctgttcctattttgttatatttgttcacttgttttttttagcttccatatataactcaaatcatacagtatttacctttctctgtctgacttatttcactaagcgtaatacccttcaggtccacccatgttatcacaaatgacaagatttatattccatcggatatatgcactacatcctctttatccattcatctattgatggacatgtaggtttcttcctcatcttagctattgtaaataatgctgcagtgaatataggggtgtgtatatcttttcgaattaatgttttcatttagagctatgaaatcaggcatttctgccattgaagagcaattggaaattagtataaagcatctttcttaaaaaatagtttattaaggcaaaattcacatgatgtaaaaccaaccattgtaaagtgaacaattcagtggtattcagtcctttcaccacctacctccatctagttttaaaacattctcatcattccaaagtaaaacccctggcataaagcatcttttaagctgtaggaataataaagccctgtaaccacaacttaattgggaaggaattgccttttgatgataaatccaaaagaattttaaaatgcatttaaaaatatttgaaagaacacgaagaggcagttcagagaaaaaggccaataaacctatgagcagatgcttaccagtacatcaaagatgcaaatgaaaagaagacatcatttttcacaaatcagattagcaaagataaaaatgatcgatagcgtcaagtgttggcaaagtcgtcagatgctgtaatgggctgctagcggccgggctggggggggtgtagtgtaaagggggacaaccttttgggagagcaatttgttaccctctattaaattacagcctgtcttctgacttctagggaatgtagcccgcagaaatactcgcacaggatgccaaggcata

SEQ ID NO: 42065 - DNA, 1570 bp, Bovine  19866880870064
actgcctataaaagatgttactgcctgggacttccctggtggtccagttaaggaccacttccctggtggtcctggtgtgagctaagactccacgctcacaatgcagggggtctgggttcgatccctggtcagggaactagatcccacaagctacaactaagagtccacatgtcgcaattaagacccagcacagccaaattaataaattaaaaaaaaatttttttttaaagatgttattgccattggtaaactactaccttccccttagaaggttaaataattgattcaaggatacactgagacaataaaggatgagagacaggcaacttttaaaacataactatcctgaagagtttggctctcctcccatctagaccttccttgagagcctaacctaaagcaggcgctcttattaatactcatacatacctttctttcagacgtagttcgtcattcatttttgtcagctgagaagaattgtctccagacattttcattattgctgcaatgtcattttccagtttttcttttgcctttatcagctgctcttccctttcatctctctctctaaattttgcctccatatctgaatatatatatatatagaaaaaaaaatagagctgttgtattataatcaacaacatattaactacattctgtatgccaaaacttgctctgggaatatctgtacatagcaatccctgctctcatgaaaattatattctagcagagaagagagacaatgaacaagaaagagaacaaatcatatattagagagtggtaagtgctaagagggggaaaagaatacaagcagagacaggagccaggaaggaagctggggagtgtgaaatcttagaaagagcctctctgagatagtgacatttaagtaaaaccctaggggaaatgagggaagagaaatgcagacagaagaaaagcaggtgcaaaggccctgacgcaggaacatgcttcacaatcgagtatcaccaaggaggcagatacggctgcagtggaaggaacctggggaaaaacagcacaggaggaaatcagaaaggcaacaggacctgacgggagctgaggaccacagcctttactctgagcgagatgggtgccactgggccaccttgagcagagatgtgacatgagctgacttaaagttgaaagcatctctttggctgctatgctaagagaagactgaagggggcaagagcagaagtgggcagcccaggtggccagctgttactacagctcagattaaagatgctggctagctgggatgaagggcagcactgggagtggtgaggtgttgggtgggattctgacttgtttgaaagcaaggcagagaggatttgctgcggtttacagacctccaacaagatttcatcacaagagaacacaatgagcaaagactttatgcttgaacagtagatacattgtaaccacacactaaaacaatctcaaatcctaggaagcctactatatttaacgtttataataaccagagacgtgttcttacctgttaaattttctctcaacttctccagttcggaagacagtgcgttaaactgttcct

SEQ ID NO: 42066 - DNA, 1743 bp, Bovine  19866880898430
cctcccccagctggtttggtgtgtatttttgttttgtgtccctttttctatgccaaagaagcataattttgcctgctttacaaaatttaccctgtatacttcataaggcaaaatatattttctgaaaatgggatcactctaaagatgttcagctgcccctttttcatttctcaagatgttacggccttcagtcggcgtcagtgtgtgtgaaaatctgtgtcatgtttgtaaagactgccgtgtaccccgttgtgaggtcacctgggattctggggctcagggaatacgtgcactcgtgggcatcgccacgtggcctcccgcagtgccctcctagcctctgcactcgccactgtgagtgagggagcctggttcccttctcagtctttcttggtggtagtggtctagtcaagaagtcatgtccaactctttgttaccccttggactgtagcccgccaggctcctcatccatgggattctccaggcaagaacactggagtgggttgccatttcctcctccaggggatcttcccgatcctgcttgccaggcagattctttaccactgagccatatggaaagcccgtaaaatcttttctaatcagtagcttattcaagagctggtaaactaggaggagtgccttccagaaggctctgccctgggagaattgcttcctagctgtcccctgatggcacagctcttgggctcctggcctgggctgccaaacagcagcttcgtaaactggaccccagtttgcagcttcctggcaaagtggggaagtggaacccatcttacccagtggctgccaagtcccaccaccagacggaggcaggcaccacaaggcacccaggtgaccgtgactgtaactagcccttcctctccacaggagtgctatctggaaagtgaccagaccagcctgtaccatgcagccaaggggctgatgaccctgcaagctctgtacgggactatcccccagatctttgggaaaggagagtgcgcccgggtgagaaacgggagatgcttctggtggtggagcaagggccccctggtgcctgggatggggaggagtgggaatctgttttgatttgaaaattcgcatacttgctaaaatttctttatagctcccaaattggcacagtgctctgcagatacgctcagggaagcagtaatttgtatcatccagtaattgaagttgcgcatgttctcagctgagatcacagcaagcaacgctctgccttcaactcataccatgaacaagtgtgatttttgccactatactgccgtgcagtactcattgccacttttgtgtgtgtgtgtgcatttttgtgcctttttttttttttttcagttggtgatttcactgttaaaatggcccccagcggtggtgcggaagtgctatccagttttcagaatgtaggaaggctatgatggtcctttagggagaaaactcatattagatgagcttcatttagtgtaaatgatagtgttggagaatcaacagcatatatttaatgtctttaaatagaacacacataaaacaagattatatattgatcagatgatgaaagtgttgtaatcagagactcaagaagccctcaccctaatggccctgcagagcggtggttcagtattcactgattcagcattcatggtgactttatagaatagaacttccgtgaataatagaaatagactttgattttatgcctcgttgagaaatagctggtaaagtgtaagcactggaatg

SEQ ID NO: 42067 - DNA, 1596 bp, Bovine  19866880979097
cttgaagtcacaggggagaattaaggggaaaggcctgggctggcggtggcttgccggagggaattttccctgaggggggaggagttccggaagtgttcggcttccaagcaggcctggttcccctcgcagcgcctgcgggctccacgtcgtgtcgcaaggaccatcagaccctttgcagcctaggccggaggaccagcgctaaatcctgcctgcagaagcgtttttatttgggccttagtttttaaaaagctttgagaccactatttacacgtctacacctggtacctctcaaactccaccaccatccgccctcattcccgcgcggggggagccaagtagcgattgcctgtttgtgcgagtccaggcctctctagtccgccccgctgctcactgagtcccgtcctgtgaaaaggcaccctacgtcgtcatttgggttccagcctggccccactttgagtctccaccccctccacgtaaattgaagaggttcttccagatgggtggttgtgccttattaaacttattaaactctgtttctaggtacagacagtgtgttccagtcgtggctaactttaagaagcgctgtttctcggaattgataagaccatggcacaaaacggtggctgtgggatttggggtcactctgtgtgcagttcctattgcccaggtgaagtaccatcttgtcactcagtgtttttggtctttgtgtactgtgtcctctgaagtctcaaataggcgatgaagcatctgacaagctctaatggttttcacccagtgctctccccagccccaggtgatggtatgctgtatcagcattgtttcatagctgagcagatatattaatatcctcattttggtcatttggtagaaactggtatgtcagtttggtcaaattgtataaaaagggaagaaagaaaataatgtattacagaacaataatcttttcattgaacaaaactttatggggcaacttttatgtgtcatacacaagagactaagtaaatcaagatttctgcttttgtaaatctcacattctggagaggaggaggaagaaaaagtggaatgagagaaaaaagatgagctcacagatagcggaaggtcaaaatgtacttagatgtttgtactttgtgggccgttgtaagcattggaatttattatgataaagaagccactggggattttaacaagattattatggtctgacataaatttttttttaatttatgtttaattgtaggatagttgctttaaactgttgtgttggtttctcctatacaacagtgtgaatcagctaccagttcagttcagttcagtcgctcagtcatgtccgactctttgcagccccatgaatcacagcacgccaggcctccctgtccatcaccaactcccggagttcactcagactcatgtccatcgagtcagtgatgccatccagccatctcatcctctgtcgtccccttctcctcctgcccccaatccctcccagcatcagagtcttttccaatgagtcaactcttcgcatgaggtggccaaagtactggagtttcagctttagcatcattccttccaaagaaatcccagggcgatttccttcag

SEQ ID NO: 42068 - DNA, 756 bp, Bovine  19866881010861
tgggtgcagcatcgagattataataaaacgtccccacagcagtttgggggcttccccctccctttacctgtttcatgattttataatcacacctaaaagtatcatcaagcctgaaataaaggcactactgacattgggtagtgcaaagaactcagctatttctttgactaaaaataaacgagtagatgaaaatgcaaagtggcatacttttttttcaactcattccagtgtcaaagcttaacccaaacatctaaatatacaaatgcagcctggaaatattttagtgcaaatatgaagaggaacggcataatttaaagttaacttaaataaggtactgaaaggctaggagttgttctgtgaggtctccctcatagggacgattcgtgtaatggcatctggtgcaatggaatactttttaaaaatcaagaagacaaaaatcagaggtgaaaacccccccttatttattattctaacttataaacttatacggggagactaaaagggcgattttgtggaagatcaaaatattttcttagatctgttgatgggggtcaaaaataacgtgagttctcctgaagtctgcacgcataatgctggtggtcagttgcctacacgctagtgcatctgagagagcccagttctgggtggaaggcttcatcagaaggtctcgtcgtcattgcagttggtagcccagtgcccaaacatctcacagatgtcacagtaggggcgttcctcgctccgactgccgtggtgtgt

SEQ ID NO: 42069 - DNA, 1739 bp, Bovine  19866881041323
aattttagtaatggtatttttttttccatttcttttgaaaatattttggcagccagccgttgctcatttaactttcttggttgcaaaatgcacgcttagtttggtttgaggcttaccttgttctttgagacatccagccctgctagttgtctgtccggctttgctgtcattccccatgcagagtctcctgccactgcgggtcccccattgggcatccgcctagtaatttctcatgaagatgctcatcgtgtccctctctgcgtgaggctaatctgggtggccccagaatttagttggcagcgtggaacgtgggtacagattgacaggaggaggactcaaacccagttatctgggctgcagcctctggcccagaaagcagcataagaacaaatgtttctgacctcagctatcctgcgaagactgctcactggctttcagagaaggagggttgcgatatggggggcagaggggaaagaaaacaaccccagaggtggcctcactcccctttcagggccatgttgagccttcacccctgttttccaggttttctccctctcctggccgctgggcctcctcctcttctgtctgtttctggcctgggctctttctgacttcagcttcctgtcggtcccccggcctcttcgttctagccgcctaactctccctggtacactctgtgctttttttttttttgggtttggtttcctgttaactgctgcctcccagctgtttccagatgaggttcagcagctctttggggggaggaactaagggcaggggaagttgtggtggttttttccccagtcgtgtgaagtggactagggactctgatgtgatctgtccctgaacttgcaaagtcatgaactgctaaagggtctttggcaagactgactttggggaaaatgtggggtgccccatggtccacctggacaggtaacagtgtggacggattccagcttcctgtagctggccgtaaaatccacatccttcccacaccatgatgctaagaaaagccccctgtagtgaaacatcttgatttggtcctgcagtgtgaggtcaattgttggaatgtttggaagaggaagaagttgcctctccccaaggcagagcttagaaattcatggcctgccttctctaaagcttcctatccgccactggggacgtggggagagtacggtgtccctgcaggatggaagggaggataagtataacttataattatacttataacttataaatataacttataactaagataatgtctataaatgggtctgcctgccttctcagtcatgtccgattctttgcggccccatggactgtagcctgccagggtcctctgtctatgggattttccaggcaagaatactggagtgggttgccatttcctcctccatgggatcttcctggcccagggactgaagccacgtctcctgtgtctcctgcattgcaggcggatttttaccgctgagccatcagggaaaccccacgaatgggtctgctgctgctgctgctgctgctgctgctaagtcgcttctgtcgtgtccgactctgtgcgaccccatagatggcagcccaccaggctcccccgtccctgggattagaatgggtctagtgcctggcaaataagaagcaacaggaggtttaatgggctgaatcccttctgcatcatcattcagctgacattttttaggagcccaagttactcatccataaactaagggaagtaacatatctga

SEQ ID NO: 42070 - DNA, 2407 bp, Bovine  19866881120291
cccgagagcgcagtcgggattggacagacgaatgaaaggggcggggctgaaggtaacggcagaaaccgcgtggccagacacctaaccgccagagcttccgcgtggggcgcggcggggcggagccgaccctggggtagagggagccgagcgaagtcggccgtcgccaagggtgtttggacagggtctcgggtcctcgcccctggagagttctctggttggctggccggccgtgcgggtccgtcaggacagaggtcggaggcggagcagaggtcggaggcggagcagcgccctggagggcaggtggttggggccgggtgcggggcgggaggtgggaggggcagggagccgggcaggcggcgctgtcacttcagcaccaggaagtaggtggtccaaccggccagcagcagcgccccgatgagcaccgtgtagctgaggagcacgaaggccagcagctctcgcagaagctgcagcacgtggatggtggacgaggtcggcatcgccctacgcgggaggcccgagaacctgcagggtgggggcacccaggagaccttgagcacgccaagaggacggttctttcgctagaccaacctccgctgaacactaagcgagcgcaaccgagtcccgcaccgttagaggcagtgtggacacggggctagactaggacctctaaaaagtataaacacacccttcctaaggctgctgctgctaagtcacgtcaagtcgtgtccgactctgtgcgaccccatagacggcagcccaccaggctcccattcctgggattctccaggcaagaatatggagtgggttgccatttccttctctagtgcatgaaagtgaaaagtgaagttgctcagtcgtgtccgactcttcgcgaccccatggactgcagcctaccaggctcctccgtccatgggatttcccaggcaagagtactggagtaggttgccattgccctctccgaggctaaggaagcccaaagggctgattttctccctaacaacccacgtggacactgtctacatttatatcatatagttcttttaaactgaacgttctcattctttggctcctgatctggatctgagctcggagcagggaagcctggagaggagagttcccagctcccgctgctgcactggtcttcatctccagccctctcctcccatccacctcctgcatttttaatgttgtgagtgttgttaatgggctaatggagtaaagcttgctttttgccatcattcaagccgcagccccagctgtcagcgctgcttaggagaggaaaagagatcgttttgagtagggggaaagcagcgggccctcactgcagcccttctgcaatttttctggccccaaggcttatctatttacaagagtccgaggaccgctgctttatggccagccaggatcgcaggagtgccaagaggtgggtatcagtttgactctgggcttatctctttgcccattgtgctcttggcatccgctccagccctctatcttccaccatccacctcggatggaatcagatggtaacaattacaaaccaattctttacctccactgctgccctgcccagcaacacccctcagtgccagccaccaacttccctgtctccccatttcactcactcaacaaagtttccacgaatcctccactgtggcagctctgcggtccctctccggtctgctgtccgaaggtaggcttgtgtgcgctccagtgatgtcggcaaagctgagggactttcaggcagcagctgcactcaccaactaggtgtggtctagagaccaatcacaatctccacgtggtccctgagctctcacggagctgcgcacaggcaagtccagaccaggcagggcgctggcaggcttgcccaccctctgcctgtgtcaccatcacagcccacacggctctaaggttgcctgcaaaagctcctgtcttagaggcgctgagcaagtggtacacaggggggatttcatggcccttctgcctggcttttctaaacactgtggatgggatacagtccagattcttttctaacaaacttccacaaacagcagtcccatccttgagtctcagacaagaagaaccactgtacatacaacattcacttatgactgtccaactaaagcaaaaactttagcttttttgtcttaaaacatgcaattacaagcatttgtgtgagaactagctcagaaaaccaagagctctcaagtgctagattctaattcagaggttgcagtttagagacttattatatagacaccttcgcaatgtacctacttccaatttcaactcctccaaatgttaagggtaaaagaaccagtcaggattccagccaataaagaacagaccctttcccagatgtaacaatgaagggaaaagaaagcacaaactttatgctgctccccat

SEQ ID NO: 42071 - DNA, 1338 bp, Bovine  19866881177536
cttctttatctacgggacttctttttgtaggactgctgggtgttgcagaaccatctatccaactagacaaaaaggtccagacatgatgtaaacaatccaccctttccaagaataaatgtaccattcacgtacccgttttctcagtaagggcacacttctttgggacaaagactgcttccaagtattaagtgaacttacacaaaggcgtataatatataattatcccccactttctatttgcatacaaatggagcaattgaggttttgaagtcttatgctgaatgcatttttaggagctgacctaactatgctcagagcaagagaatggagagtcatgagtgaatgcagacacatgagacacaactgagcatctgttcacaggacaaaacccccagccaagggcacttgcctggactggaattgaatcccaggagccaaaaacactgatggacaaggtgcattttattctctacagcagctaagactgagagccactggggctggaaggtataaactaatctccctgggctaacaaggagttgagaaaggattcctaaaacagggattgctttctttaagacctttccaaatactgaatgttaaagccaagttaaattcacaagaagcttatcttttaaatattccctcttctacccctcatttttacattaaagagatttttttaaaatgcaggatttctccttcactcataacatggcatgtgctaacagaatttcactagagacaaaaacatgtacaggtactaattaacaacagaaatgacacctcaggggacttccctggtgatccgctggctaagactctgtgctctcaatgcagagggccctgggtttgatcccttgtcagggaactagatcccacatgctgcagcaaagaagatcccaagtgctgcaactgagacccagtggagccaaataaataatttaaaaaaaaaaagaaaagaaatgacacctggggagggacactgactttggaccccagcaaagaagggggaggggtcaactaattttgctggagacttgggcaagggctataaaaccattaatttagtccccttcttggccttaactctttcggatgctgggacagtgcaggagggagatttccaacttctctgccagcaccttccctcttcccttctacagcctagcagtctcccccaggaaaggtagcagctggatgcctggatcaccaacaagctgcaccagaggggggatgacatcaccaaaccagggagcctggggtgtttcctagcataacaaacaccggaggctgtgtaaggagtggctgcagactgctggggcagcaggtgtggca

SEQ ID NO: 42072 - DNA, 968 bp, Bovine  19866881191421
gaggagtatagcctagatcttattctttttgatggggatctcctatccatggaatcggagggtgcgttcaaagtaagtttggcattttctgttttaatgtcaggctgtgatttttgcccaatttatgagcttgatggtcatattcatctcagatgtacagcagaatgcttcagtattttttcagattatattctattatgggttattatattaggtatagtttcacgtgctgtacgtatatccttgtagcttttttttttgtactagttggtatccgttagtcccatacccctaatttgtccctcccctcttccgtgccccactggtttcttgtcttgtcttttttttggatggggggctgtgaagtaaaaaagaatagctttattgctttgccaggcaaagggggccacagtgggctaatgccctcaaaactgtgtgtcccctcctggagggagtagtgaggagttttatagcaatggtccaaagagggcgtgagcagcttgtggacacgcttctgattggtcattggtgagatgcatggaggtcagcatcatcaaccttctgattccaatgggtctggagtctgcatgcttaatgagcagcatacagttaacttctgccacctggtggggggtgtcagtagctggtgtctgggcttactaaggctcaggttctttgtgtctcagcgcagaagggattcagtgagaggcaaagggttaggcaagaagcagagttattaacatgggacacttgtaagaggtgcaggccggcaggtgggggctctgccaccgctagttggttttctgtgtctgtaagtctgtttctgttctgtgtatacattcatggtattatctttgcagatttcacatatgagtggtatcacgtagtgtttgtctttttctgtcttatttcgctaagcataatattctctaggtccatccatgttgctacaaaggcactatttcatt

SEQ ID NO: 42073 - DNA, 1278 bp, Bovine  19866881223347
cccccactcccatccgtccctctggagcctcccccccatgaggagcagcccccacgtactccgagcctctgtggcagcctgggcaagtcccagagcgccgaggcggtgccggccacgccgagtggggagcccttgccgacggcgggcagtggcggcctggccctgagctccccgcagctgcccggtagccccttctcctacccatccccatcccccagcttgagcagcgggggcctcccaaggacacctggccgggacttcagcttcacacccaccttccccgagcctgggggccccctacttctgcctgtctgccccctcccagctggccggcgtgacgatcggtctggccccctggcctccccggtgctcctggagacaggcttgccgcttcctttgcccttgcccttgcccctgcccctggcgttgcccgtacctgtcctgcgggcccagtcgcgggcccccacccagctgccccctctgctgcctgctccactggccccttgcccaccccccatcaagaggaagccgggccggccccggcgatccccgccagctgtgctcaccttggatgggcctttggtccgaccgccaggaggggccgccctgggcagggacctcctgcttctgccaggccagccacagacccctgtcttccccagcacccatgatccccggaccgtgaccctggacttccggaacgcgggattcccagcccctccaccacccttgcccccccagccccctccacccccacctccaccacctgttgagcccaccaagctgccctttaaggagctagagaaccagtggccttctgaggccatacctccgggtccccgtgggcgtgacgagatctccgacgagttcatggccaaggtgcgggggtcctggcgccggccaccgaagaagcgccatgaggacctggtggtctcagcctcgcccgagctctcgccaccgcagcctctcttccggccccgctcagagtttgaggagatgaccatcctctatgacatctggaatggtggcattgacgaggaggacatccgcttcctgtgtgttacctacgagcggctgctgcagcaggacaacggcatggactggctcaacgacacgctctgggtctaccatccctatatcctgccaggtggggcgggggccacacctccctctctgggtggcatctcctacgagggcgcatgtcaccaccacttgtggatggtgtctgtgtgttggtgccacaccaggctctgtatggagtcatctctgccttgtgcg

SEQ ID NO: 42074 - DNA, 919 bp, Bovine  19866881244527
gggctcctctagttggggcagggggagggcggcgggcaaaggagggccactgcacaggactccagaagacacacagaaacattttcttttttaaatgcaaaaaaattatcttccttcagatacaatagagaaactccaagcaaaaaaggaaatgagaagcgtgtgttggagtaagtcctgttgtgagcaccaggtaaacactccatattcagtcccttaagaacaatggatttttggctcctttgcctgagatatccttacagggcactggggccaggtcacagaaggcattagaaacactcaacacaaagaaatctcataaacaggacagtctccccttctcccctaaactcatgcccctatggagggagcaaatactgaatcacattagaaaatgtaaataagatgggaaaactgaggttaaacagctactgaacttgtggacatgacagagaaggccccctctctctggccaggttggtgaaatgctctgggtgagaggtaaaaagatccatgggtgggcgagagggcaaccctgctgagtggggtgcagtgcccacaggctaagagccaggtccagtacaggcctgagacggtggggacgggggtcaggcactcacagctcccaacgacctctggtctgacgggcccgggcaggccctgccactgcctctctgtgcggaggaagctgtgctaagccggggccgggtggcgcctgccctgccttctgcaggctgagcggcagcagtgtcaatcctcacgcaggtaggcctcctgctcctccggctcggccctctcgctcccgtcctcctgggtttttctgtccggagttcctctgtctgtgcttctgccaacttggtttccgccttctgggaaagctggcgtacctcctgcacctgcgatttcaccagctggatgt

SEQ ID NO: 42075 - DNA, 979 bp, Bovine  19866881418933
agtttcaatatgtgttagggtttcagcataactttgattaattacatgtttaccggacatactagcctatctagtgctgacgtcaatattttaactcgctcctcctcaaaacattgtaggctgtatttgacatgaattagatgatgatatgaaacttctaatgaggttttggggtgtttttaaatggatgagaacaacacagaagtcaactaaaggagtgtgactctatatgaaatgagtgaggaagatagctgtcaaaattactcataatccattacattctgggccttataacagcagacctcagaaaatgtttcccttactctttgttgattgtaaagatacatttacttcaaaagaaatcagccttcttatttggaagggctttgaaattcaagcatggggtgggcattcagtagactctaaaatcgcaatggtagcaaaaatatgtattctgagaactgcacagacaagaaacttctattaagatattacagattaaagtaccaaaaatctgctaaatttgaaaatttttaaatttgcatttgtcatacatctagcagtggtttgaaagcatcaaagccatttaattctggggtcttattaaaaaattcatatgaatcactgtcgtcgtttagtcactaagtcatgtctgactcttcgagaccccatggactgcagcccaccaggcccctctgtccacgggatttcccaggcaaggacactggagtgggttcccatgtccttctccaggggatcttcccaactcagggatcgaacccgggtctcctgcactgcaggtgtgttccttactactgggcctcctgggaagtcctgaataactgttaagagatgagaaaagttgatgctaaaggaaaatctctgaatttaaagtatgccatgaaataaaaattgctttttcttttctggtaattactaatactttaaaaaatcagttaccataacatatattattttc

SEQ ID NO: 42076 - DNA, 1337 bp, Bovine  19866881459322
gcgatggtggtaaggaccttcctacggaagcaaagaagcttcagctgaattctgcagaggagctgtacgctgagatcagagataaaaacttcaaatgctgtgggctccgtgcttagcaagaaagcaaaggtgatctctgcagcattcgaggtgagatggtttggttgttacccagcttctgtaggtcacaggctagactgcccacccctcctagcgagcaaggactgccaaagtgcagccactgagcagggctgcagttctgagcaactgtgggctcagccactggagaactcaaggttttctttcttttttttttaaatatatgcaccttcattcattcattctgcacttcgtagcatgcaggatcttagttccccaatcagggctggaacccctgcccctgcattggaagcaaggagttctaacctctggaccaccagggaaatccccgccaaggttttctttttaaacttctccccagacctatgagaaaaggtgtttttctctttcagggagagaaaggggtagtattttgagtttacaagcgttcaccataaatatttgttttaccttctttgtaattatttcccatctctctcaagaggaagccagctgtactctaaatttaagatcctctataatagaacttgcaatttgggccaatagctcccagtttagccaacatgccaatggcaagggaactctgcagatgcaggaggtgataataagagcgaaatcccaggagcccagagcttttaaatggacggcttcattatcaccttcctgcctcctcttgcccagccactggtttattcttggttaagctcatttttgaaatgggaattcagtaagatgctgaactctgcgtgtttagtctttggaaacatgtattaggagaactttgaagactgatttttttcactgagtgtgtatttccaggtttcatctttattttttttagtgttttttttttttttaacgtggaccatttaaaaaatctttattgaacttattaccgtttttgcttctgttgtttatgttctggtcttttggccatgaggcatgtgtgattcgaccagggatcaaacccacaccccctgcatgggaaggtgaagtcttaaaacactggacatacctgggaggtccctaggttcatctttgttaggattcgttaattgattttcttcaattttctgagttacttgctttacaattactaaactttgcaaaaaaaaagaaaaatttctcaccacgaagtaaggttgtttttatccgtggataatattcaagattgaggttcagcagtaagaaggattttttttctgttacagaggaaa

SEQ ID NO: 42077 - DNA, 837 bp, Bovine  19866881542976
cgagcgacaacactgagattcatagcaaatggaccatgacaacgcagcggaggggggcggggggcaccggtggaagaagcagcaatgggaaaaaaaggatggggatagtgacctcggtggagacaaggcaaaaggtttgggggtgattcggaagggatgcaaagtacaacaacagagaaaggccaagaagcagctgaagaggctggaaaaacctacgaagagggggtgaagaagaggtgggtcgccggaggcgcccagagtgccgggtgtgggggcggctggatgccaagaaagggacgctttagagtcgggagaggggatggaagtgagagagggcggggagaccagagtctgaggagatagaatacgggcgaaaggaccagaaaggagcagaatgtaagcggactaaggcgacaagagcagtcaggtgtgagggcgcgacctgaagcgaagggggcaaccccggggacaccagagcggcccatgtgggcgggggtgtggagacgcccggcccggcccccttccgccggacagcacctcagcttccccacgctctctacaagcttctccgatgcgggagaggcacgaggggttattacccaggcggtcgcacagcctccgccgcctccgctcccgccactaccgccagctgaagcgacacatgcgattcctcttccccagccagagccgcccgagagcgcgtctaccagcggcggtcccgcgagacaataagcctttatcgcgagattcagtggccgccgggcggctgtcgcgagaagcctgaaggctggggcggggaggaattggagagcatgcgcatttcgctcagggcttcca

SEQ ID NO: 42078 - DNA, 1206 bp, Bovine  19866880617750
attctttcttgaaataataaaaatatacacagggttattgttaccatctttctaaattccatatatagctgtatctactggttcaaagtgaattttaaatatgtaaaatacctaataattttttcaaacaaattaatgttttacattatatttataatgaggtgttcataaatgtcatgaatgtatctatacatttacatctatttcttcgaatataaatgtatttggtgtgtgtgtgctaagttgcttcagtcatggccgactctgtgtaagcctatggactgtagtcctccccagttcctctgtccatggggattctccaggcaagaatactggagtgggttgccacgctctcctccaggggatcttccctactgagggactgaactcccacctcttaagtctcctgcattggcagggaagttctttagcactacctgccatctgggatgcccaaatgtataatatcacttcataattgagtccttagctagttgtccctcgatacttaggcaacctaggaacattgtttaatattttcaggtatgttccttacctgagaagtggatgcattaagttaaatgcttctaaggccctttaggagtcaaatactagttcaaaagaaccttcaacttagttgtaagctaattaaaagcaggcttacttagataaactatccacatggtttcatatgatctaatttgctcaatcctttacatttcaaataaatatgaggcactattacaaatgcacattaccaatgtttgtcttccactgactacttcagtattgtatagacctattttcagactttccagttgttttcttattcttttctcacctcaggtagagggcaaaattgaaataaagaaaagtgtaaaagccattttacactggggagttccttacaattatgaccataattaatcacattcatccattgggagaaaaaagaacactgtccaacaaaaggaacaaacctccacaatgacttagattttcttgccagagtgttaagagacttcagtattggtagtagaaaaaaaatgaaaaggtcttttcatagatcatcattgaattaaaaaaaaaaagtgattgctataatcaaaagtaatataagcttgtgtagcagtagaatgacattttataacctaaaatatgtcaaccttatatttgagtctaattaaaaattttcctctactaaca

SEQ ID NO: 42079 - DNA, 804 bp, Bovine  19866880898902
atctagtatggaagatctgcttagatgtgataattaacaatattataatgaataatatctaaggtaggctatatggaatcagaaaaaacaacaacaacaactttctacaggtatggaactaaggtacaccaaagcccaccccactaataataataaaatgagatggaaaaaaattttctaatatagcaatatgctgaaaactaataaagagggtatatattataggaattgttaataatggcaagatttaagtcttcagtggaatccttgaagagttgatttttctagaagtttgtaaagtcgagtcttcacaacagacacatatcaaagacttgagctcagactatcaaccttacacattcactaagcaaggttctgcttcctgagatgagactctatggactcacacaagtacaaggatggctcacttctcaaggttaaaggcattctagcctcaagctcagcagctgacaactgcattgaacgtgaatcatattttattttgtctttttagaggaattctgccaagatgaactataaaaataaacacaaataggatttatgagagtttgtaggatatgccttaggccaactttcaggatcaatgaatttgtttctgactttaatgtttagaatgactcatttatatgtcttggagtaaatagtttgtctaatgttatccttttagaacatataataaggtggaattttcttcatcaagtcaaagtgtttattattagaatcaagttagagttattgactcttctcaccaaagttgttataaatcctaagacagtactgaat

SEQ ID NO: 42080 - DNA, 1684 bp, Bovine  19866880999561
tggttttatataaaagatgtaatcaataactgatagaaaaaacttgatttttcttctttagtaaaaaaggatttgtgaccaaacttgcttcctccaatatagaaataattgtaatgtgtcctttatattatatggactattttgaaggttaaaagcaattgaaaatattgatacaatctaatgcatagtgaaaacacctgtaagcttatattaacataaagaattgggtagtttattattatgaatgattatttcataagcttattaataagcatatttcatttgttaattgcctttcagttaagaaactgtacttaatgtctaaccaaatattgatgattccgtatttattttctcttgttccttcttctataaaaagtaatgaaaacatgccagtaaaattatcattattctttaaatatttgtagacgctcagaaagtttctcctgttttataatctcaaagcttactagctgtgaatctctttagttttttacatttgatatagttttcttcctgaaacaatccctttcatattttatgcatcacttattttcacttaaaaatgagaaactgtgctcatattcacaatgtggggagctgttgccatctttttgtgccatcttcttgagtaacaaggcgctgttcttttctagacgagcaataacttcattcagattttaaacaaatgtgattttggccttctcactgacaagtttagattaagtcaaatcttccctcatgttttgctttctgcagcttcagaacccacctgcccatacaggagatgtaagagacacaggtttgatccctgggtcgggaacatctccaagacaagtgcatggcagctcactccagtattcatgcctggagaatctcatggacagaggagcctggtggggtacagtccacagggttgcaaagagttgaacataactgaaatgactcacattaattaatgaattactacttaattaatcaataacacattaatttaaaagtaacttcactcaatgttttcttattatatctcatatatgcatatttaaatgctaaaattatacttatttttattgtatactgcaagtaaaacaatacgacagcatatattgtttcctctaaatccagtcttactgccagacctacctaatttcaagggccaatagagtatccatcttcaattctccccacattcctacatatagaaatgtacaaagtcagggttatttttagaaaattgaaaactgatgctaagcatattttacattttaattttcaacacatgctcctcttaaaaaatcattgaaatgtagataattcatttaatatttgtataaacattcatggtatggatatattaatatttactcaaaattttcccttattaatgagaatttactctttttgtttttttcattttttgtataaaaatgtggtttaaataataacccttaaattcatcttaaagcactgctacattagtatctaaagtgtacattctctaaatgagatcgttgtgtcaaaaattatgtgtatcttaaagtttctcatagttttacccagtgtgtacgtgctcagtcacttcagttgtgtctgactctttgtgactgcctggactgtagcccacaaggctcttctgtccacgggaatatccagcaaaaatactggagtgggttggtatttc

SEQ ID NO: 42081 - DNA, 951 bp, Bovine  19866881842086
aaaaaatatttttttggttgtgctgggtcttattgctacatccagcttttttctagttgcagcgagcaggggctcctctttattgctgtgctctggcttctcactgcagcgatgtcccttgttgaggagcacaggctcttaggcatgggggcttcagtagttgtggtacgtgggcttagttgccctgcagcttgtgggatcttcccagaccagggatcgaactggtgtcccctgcattgcaagcagattcttaaccactggactaccagggaagtcccaatttttacatttttaaatggttccccccaaatcaaagaataatattgcgtgacatacgaaaactacattaaatctcagtttcaacatccttaaataaagttgcactgaaacatagccatgctccatttgtgtgctgtgtacatgctacaatggcggtgctgaatgcttgcaacagagactgtatgcgctgctgctgctgctgctgctaagtcgcttcagtcgtgtccgactctgtgcgaccccagagacggcagcccaccaggctccgccatccctgggattctccaggcaagaacactggagtgggttgccatctccttttccaatgcatgaaagtgaaaagtgaaagtgaagtcgctcagtcgtgtctgactcttagtgaccccatggactgcagcctaccaggctcctccgtccatgggattttccaggcaagagtactggagtggggtgccattgccttctctggtatgtgctgcaaagccccaaatatttactttctgctcctttccagaaaatgtttgccaatctgtgctctccacctaacttccacttacaagtgataccggatttagaggaagaggataaacaacacttagagggaaccttcacactcagctataatgtggaatattctggaagaccactgacctggtcattttaaaaacttgt

SEQ ID NO: 42082 - DNA, 1021 bp, Bovine  19866881845340
ttaacaccaataggtaaagctacttagattactgtacctcattcttctgcaaggctatttgtcaaaacgcttgattttctgatccttttcccaataaaatagagtgcagtcagtggaaaagcattgtgatgttaaaaaaaaaaaaaaaaagtagaatacatcttttaagcctttcgatgcttataagaaactacacaaattcattttatagacatgcttttatctgtttgtaattgaattgaaaattgcagtgagctacttaaaaggaactctattgaatggattgttttatataatagagcaacttcaagtgcgtcactgtttactagggctcctataagcctttagcattgcagataatatacatggaatcagaggtcaatatatgctaaaaacgtttaagaatatagttactgaacagcaattacagacagtgtgcttcttagtaagactgaaaagaagggatataataagcactgtccctggtcccaaagcatttaaaatcgaattactttgctggcagtacaatatatcatcatagttgccttatttaggaggttctgagaaaactgaaaaagaaaggataatgagtcatattttaaaaggttctacattttccctggtagctcagatggtaaagaatatgcctgcaatgtgggaaaccggatttaatatctgggttgggaagatcccctggagaaggggatagcaacccactccagtattctttcctggagaattctgtgtacagaggagcctgggattcaaggggttgcaaagagttggatacaactgagtaactaacactttcagtttctacggcatgctttgatgaccaagcacacttatattcataagagagagaacgagacacaaggagacagagagagagtcagggagggagagagagagagataaggcattcattcaaggaattggctcatatggtattttgtggtactggcaagtgcaaaagttgtagagcaggccagcatgcggaagcttagagaggagcttcagc

SEQ ID NO: 42083 - DNA, 1602 bp, Bovine  19866880347357
aaatccttaagtttacttgtgagaagatgaactttttttttttaatgtgtaggttctaaaatttaaaacaaggaattgaaaaaaactgttcaggtctgcaggatggtacatccgtaaaagttttaaaatataaccaatttgtgtcctgttagaaatgataggtacagaggtttacatctaaggaagggatagtcagggagattaggatggacatgtacacactgctgtatttcaaatcgataaccaacaaagacctactgtgcagcacagggaactgtgctcagtgttatgtggcagcgtgggtgggaggggagttcgggggacacctggatacatacgtacatatggctgagtcccttcgctgttcacctgagactttcacagcattgttcattggttataccctaagacaaagtgaaaagcttttaaaaagtaattaaaagcaggtttagctggaggggtagaagcactgctgccccctttttcaactgtggagccagtgagatgagtggtttaggtgggaggtgacatcaggattccagggttctcagaagctttcagtcctctgtcccagtcttccagtgtgcatagaggtgcatgagggggaaggtgccaaaggctaattatcttgggcttgaatctcacttctctttggcaggctgtttggccatagactattacattcattttgtatttcttgacatctgggccagtataatatttactagatatgagtggtttataaaaaagcaggctcagagatttttattatatttagtgatctcactgatttatactgctaggtagtcgctaactagaacttctaaataataacctgtaaagattaggaaatgaaccctaaattcatttccaattcagaaatgatcctgaattgtgcttggaaccaaaccttgttcacactggaaagtcaggcgttggttttgggttggtgcacaattccatcttggtgggcatagaggaccttatttttccgtgaaattttcttaaatttcatatttccatgaaatttaagaatttgaagtgtcagctattctgtgaagtcctgtttttaaaatcaatatgaaaattaattccttacctttttgttttcctttagaagtacattttggttatccatgccttggttaaaaacaactatactgtgtagtagtgggcttacgtgatgtccttcatttattttttgatatttgggtgtgctgggacctagttctggcactggggatcctcagtgtaccttgcagcatttaaggtctttagttggggcatgtgggatctatttttcaaacctggggcccctgcattgagagcttgaagtcttagccactggactaccagggaaggtcctgcatgtggtcatttaatggcttaataagaccatagtcctaggacaggatctcttgtccccttctcaggaacccaaagcagtgagtcttgtacctctagatgccattgtttgtgggggtttttttaccctttgcttgcagaaaataattgccgctcttttatgccaagaagttgctatttttaagctgaagttagatagctaattgggtagtttagaacagtggcttccaaactttt

SEQ ID NO: 42084 - DNA, 2105 bp, Bovine  19866880479784
tgtacatggtgatactgacttcccatctcagcctgtgcctggccccctccctgcaacttctcaagggcatcacacacatatcttggcacacacatgtatgcaaataaatgcacatgctctcaaggtcactgacacgtgtacacactcacacacacactcgtgggtctctagcctttttgtccctgcttttcacttctgccatattgaccattactgggcatggttaacacctgtctatcttccagctgttgtgtgtgcgtcacctcctcaggcaagtcgtcaaatccccaagcccccagcctggcccaaagatgctctcagagaatcataactctttcccagggccctggtctcagcatgtggcatgctcacccatgtagctgctgaatgcctctctccagatggtacttgggaaggataaagtttatgtctagatttgccatccttcctgccctgcattgaagacagtgctgacacttagtaggagctcagtcaactgctgactgtggaatgaatgtgtggatgggccaccagcctggcttaacccaggaaaggaaggacaaggcacagagcagaatccaagatgctccaaacagtttaagttgtcccctgacctctttctgactatagctaacatcttggcagaaataaccacagtttggagtcagacagtagagtctgtgctggatctctaacttgctaagtgatctaggatgataataataatagctcacatttgttgggtgctcactttaatggagctggccttcgttatacattatccccatttcacagatgaggacactgaggtttagagaggttaagtagctttcttaaggtcacagttagttagtgtaaaacagatccagtatcagctgacagcgcaggaagacacacagttcaccagaatgagggggaaggaatgtctgtttgtccaggccattcagggaagggacatcattccttccatcagagaggcccaggaagaatccagacaataacacacagcttcttcattattacccagaagccccagagattatttacatgatgtctggcatgcatcaggggctaggacctgtctgatatggtctacctaccctgccatgacaatgaagaaatccagtcggttccatgtgtccccaaggtagcacttcttgccaaaaatgcccagggccaccatcttgagcaccatctccatggcaaagaagacaaagatgaagtcatcgaagacctgcaggggcaggaggaagacaagaagcaagggacagcgtgaggtcccagatcaggacgcagcgttggagccacggtgtgaggtgggaacatggggatggacacccgggcccagggagagacctggaaacatcttctcctggttcgggagagaacctcagagatcctagtccaaggcattcatttcacagaggaggagactgcccagggttttccagccccctctatttgttccctaaaagcaagcataatgacaagggacccagatgggagtgggcaaaggggggtctccctaataattgccatgccctgggctagacctttgccctgcattctctcttcagttctctgagtgactccttgaatgctgccattttacagatgaggaaccgggatctcagactgcttcagaaactcgccacagttcccacagcagtgaagggaagaaatgacactcaggtctccctgactcctaaacacacacggaaggagctttctcaaaataggcctgacacctgcagtgggcacaggtccctgtgatgtcttcctctgctcggaaaggaaggccccaaatatggccacaatcacgggctctgtgagcgtctatttgctgaggatgggacctgggtggaatccctctttccagaatcaatgaaggttgaagacaattcaattcagcaaatggacactgagcaccttctctgggtagctcataggctgagtgttgggggcccagagatgaatgctcgctaaattcaccacctagtagggaagccagtctagtactcactgaggttaataatgggttctaactccacccaggaccctggggccggcccaggagcttgttacccacttggaccccagaccca

SEQ ID NO: 42085 - DNA, 379 bp, Bovine  19866880509867
ccttctctggttcaccatcagtgacctctcactgcagagattcccattcttcagcttcctgatttggtaggatgtattttactatgtaaacatagccccctaggattatggaacccaaaagcagcatgtatctctccatccacatggagaaagataaaatagtccagaaacctctcctcaggttgcttctctttgtctggttttagttactcgaaacagggagggggtggggtgggcacggagtaagttgtaagcaaatgatgggagacttaggagtgggcacagttgagctgtttcttttttttttcctcccagaaaggttttttttttttttttttaaacctgttaaaaatgttcctgcacctaaagtcatactaag

SEQ ID NO: 42086 - DNA, 1589 bp, Bovine  19866880513831
ttgttcaaaatatggtcaagtaattttttgatacaagaaatcagtctatgaaaagtctaaattctgaaggtattttagctcagattttcatcataaaaaaaaaagtcagcctgaacacatgctttgccagcagctctcctgtgctgtcaccacatgttcacccacttcctctctgtgcctgtgaacttgatgccagagacagtggcagaccctgctcctgcccttctggctcccaggccaacgcaggcccgaaggcagggaggcaggactgagtagtgtggtgctcaggacaactggggggacatcaaggtgaaaactgggagaacatctgagctggagaggagatacttctgctttatctcactgggaaattggctcagatgcacaaaagaagacacagatgatcactgctcctggaaggaccagggaaaaccgacaggaatcgtttggcttatcatcagaaggcctagaatatatgtgttcacaatttctttatatcatatttaaagctttatatgatattttatatatcatatatacctttatatcatatttaaatcatatgacagaattaataaacttttatgttccaaatcatgaggaggaagaatggtgtatatatatgaatggtatatatatatactacatacatatatacaatggtagtatatatggataatatgcattaatagagactatatgtattcgtagcacaaatatactatatagaaaaaggtttaggacacagactaaaactcatttttatttttgctttagtaaaaattttagacttttctacaatgaaaacagattacatgtatcagaatataagaggaaaaacagcaaatactctcactgctctactagtctactacacatccctagaacctggcaataaatacttggtgaatgaaaaacaaatcaattcactggacatttcagaagaagccaggttacaaggcatcctttgcacagatgaatgccaagtcctggctccaaagtcaccttctttcatcctcagactgtactccgctaacttctttgacccatctgtgcccatgctgtatttaccactcagtaacttgttttgcaggtgatcagcatccaccttgtcttcctgactgaaccctacagagcgaagaccacctcccacaaccgcatgaaaatctgctatttttccaaagaaaagcagaaaaaattaactagatgaaaaaaaccaaagtgggtggcaaaaggcaatctgttcagaacctgaaattaacgattacaaaacaaaatgataccccagaaacaaaaccaccatcttctggacggtaatacctggaggccaactggcattgctagatttacttccgattttatttgttggtggagatttggcaggtaaccagctatcaccagcaggacccgtatggccacccagtgtgtcacctgggatgatgtcaaactggttgtatggtgaccctcctcgggtcttaccaggggccacaatagcgcctgagaaaaaagagaggtgatgagctcacagcagaaaggactcctatgaacagaacttgctgagctttcattcagaggaactcagtctccag

SEQ ID NO: 42087 - DNA, 1287 bp, Bovine  19866880528705
tggtctcttttacttcatccctgctcaccttggtatttgacatttgctccccaacccacatgtcttcccatgtgatgggagaaaggaattccagagccttgaaatttgggggagatggcacagagtaaaatgcccttgtgttttttatgtgatgacgatgccctggtgccgagtttcctagttcttcttttgacctagatttcctgctcccctacccccgccaccctcctcggcacacacatacccgcacgtccttagcaataccaacagtcacatttgatgttagaaactataaagtttccttttctcagcaattctagaactcaaatatgggacacacttttatttcttcagaacaaatgatcacattcaaaacatacacatagaacactttaaagaacttatcaaccctccgtgtccttcagacctggagttctccttcataagaatatcacgttggacagaattatatttaaaaacacagcctgtactctctggaggacgtccaagtatgagggagcatttgatccttgcatcagctccgtgaaggggctgccagttattattgcccccattttgcagatgataattgactcgcctgaggtcagacatctagggaaccaaggacccaaggaccaagggcttctccttccaaactcaggagtggtattagaactaggtcatcactgcttctcaattccattgctctcttcaattctcttcctgtctctggaaggcagaaaccagaggcttcaagtccacccactttttttgatgactctgaaatccagctccagccctcacctcactgctgaacccagacacacatctccagtgctccctgagctttccttctctgagggtcccaggggcaacttgattcacccgcaggcgatctgaggtccatgagctttccctcagacctgttcctcctcctgtcttttctattttggtaaaagcatcaccacccactcagtctcccaagccagaaatccagagccatcccagaatccccttctccctcagctcctcgaacagtcacgaaatcctgcctgtttgtgcttcctgattcttctgaaatctgtcctcagttccacctagcccagatctccttcgtctatgcctggatggctacgctcctcttcctacactctctcccctgacttcacccccacagtccatcctcaagttgtgataccccacgcttttcttaacactgattctcactgtgctgtttccctgatgaaaatcctttgatggctccccgtacatttcaagatagaaatc

SEQ ID NO: 42088 - DNA, 1067 bp, Bovine  19866880538953
cctccttgcctccccacccccgcaccccagagaacatgctaacatccaaccccaccacctcctaaggtgcacgtcctctccaccttggcctggctcagcttcctgaacccagggtgcctgttctgcaccacacctccttctgctgctgcaacagcagtgcagacaatgacagtgacagccgctgggtcctccaggcgggaaggacagtggcgcacagccaggcgataaactatacgcacagcgcacggcagggctaattagctgctaagggggcttcgtcagtgtttactcggaacgtgtcatggcaccccaaggagcagtccccactggccctgtgtggaggaagttgggatgtctctctgctgtcagccctggctgcctttggagggggggatgtggctgggcaacacacagtgtcaacggtgctgtctgtgtaggactttaaccgagactgaaggaagggggacagattgggaggaaacgtggcagggctgagtagagtaagacagatgtggcacatacacacacctgttctggggagtccaaggcggggacaagcttagttaggtaactagaatgaagatggaagatgctattgtgtcagtcacagaaagcaaaatctttggcaagtcaaccagtctctctgggccaaagtgtcctgtcaaacaaaaggaatggttttgcaggaggtatgcccaggaaagcagcccagggaggagcacgtggccttttcaactgagctcaaagagctctttttcaactggaacgattttaacccccagggacacttggcaacttcgggagctatcttttggtggtctcacctgaagggtgctgtggcttccctggtgactcagacagtagagtctgcctgcaatgcgggacacctgggttcgatccctgggttgggaagatcccctggaggaggtcatggcaacccactccagtattcttgcctagagaatgccatggacagaggagcccggcgggctacagtccacggggtcgcaaagagctggacatgacagagtgactaacacttccgttgtgaaggtgctactggcggt

SEQ ID NO: 42089 - DNA, 1597 bp, Bovine  19866880543152
cacaaaaacaatactgacttggcataggcaggcccgaaaggtgtttctgacatctagttcacctctcctcccctcacatttccaggtgttcacatattttatggtaagaattgagtgctaaatgacctaaccctctgtacagcagacttgcttaagactgaccaccttttcagaattccaggtgtctggaaacaaggcattttggcatggtaattttggaatccaaccttggttccttagtatggtgactgagacaggtttcgattaaatgattaagtcacatggtgtcctcagggcagtgcccagctaataggaagcaattagtctgtgctacctagtttgacctgattgaattctgctgagttgctgtttcctcatgaaacaggctttgctatagtactatccgtttcactcagcattctgagaagtcaatcagacacactacctgggaatgagacagtgtattcatctccttccattcttcccctctgctattctagcggtgttgcgtgatcacaggtctaacaagtctccagcagtgaacaataagtaagagactgttcagatgggaacaagctggcctttagcgtaaggctctcccgtcctcagtggtgagcacagcaagcagggcgcaggcgcaggcaaggtggcttcctgttcagaggtggcacgcggctgccctcccaggcggtggcagagccccaagcacgccttgtctttccttcagctcccttcaagtgtcttccctcccaaaggcacatggggcgaaaacaaggcgacaaaaaggcagcaggagaactcgagctgctctcagactgtctaaacccagcagcgcagcaggtggcaaggagcctgagcccaccaccgactgtcaacccgagaaccccagcaacacaagccacaacaaggtgagatcgatcaagtggaggtcctgttcagatgctgaatgtcagtcagcttttgtgtgtggactagagtgacggagaagagtggaaaaaaaatataaatattcaacaaatgagcaaactaaatgggcacaagaaaacaggaaaccacaataaatgcttagcagccaaacacatttattagtcttttttctttttttttttttccaggaacccaaaaatattttgtagttataatgtaagcaactgagttgcacataatacaatcatatctttccaaaataaaataaaataaaaaactaaacaaaaacaaaaataagctgtttaaaagcccaaaaaaaaaaacccttcagaaaactcttatatatgcattacatcatctctcagttttaatgaaatgacgacgacttaattccttattactcaacctgtcacaatccaataaaagaccaccctttagttttttttgtttttgactttttttttttttgaaatccagcatgagaaatacagtacctgctatggcaaaaaatacacataaaatgcaacttttcagcttatttgtacattagtagagtttaacattttattgtttgttttttaagtgaaccagtgattttaagtaccactatactaaaaaagtaaaataaaatatagaaaaggggggcccagcctgccatgcaagtgcacct

SEQ ID NO: 42090 - DNA, 1730 bp, Bovine  19866880611538
actgtactgaggtgcctcagccttactggcttctaagaggccctggcctaaatgccacaatgccaggccaggaagaccagctgaaaatcgcacactaccccctcttcatatgtgtgactgagcagatctgcagagagaactggggagtggacagcagagaaactgccggaccacaggggctgagctggccccgcctcgggccaggttgctggggggcctggagagcccagggctacggcaactgcgaaagcaccacgctcagcctctcccagcctcctacttctgagccaaactctggtcctcgcctctttccttctgcaaaacgctgggcaccggcagcaccttggggagggtccagatgctccggtggcgcggacaccggcacttggtggcagtgggagcaggggagccccgagcatcctctgagaggagcctggcctcccaggtgggcgggaggaggggcaggggaaggaagggaggacctggttcccgaggcgggtagggggccaagggacctgatccccccactccctgagcttgtgtgagattaaacacttcctgggaactgtttccttatgcaccaaggcctggcgacatggccctgcttgttctagaggggaaaagagcggggaggtggcaaacaaggtggggggagggggctacacctcagctcaaggtgtctgtgtggagagagcgcccttggtgggcaggttggacacctctggcggccagaggaagggaccggctcctaagtgattgtgccaagggctgtctgtgcctcccctacaagaaaaagtgaaagtgaaagtcactcagtcgtgtcccactctttgtgaccccatgggctatccagtccatggaattcttcaggccagaatactggagtgggtagccttttcctcctccaggggatcttcccaacccagggattgaacccagggctctctcattgcaggtggattctttactagctgagctaagcaagcccaccaaatctttttcctgtctccaacccaaagcaggcccagttccctcccctcccctgacatgcaggaggctccagactggaagtcccaagtctctgtagccttgagccaggccgtccatcctgccccggcttctcgctgagccagcccagggtgattctcactctcttcagagaagccaagcggggtgggagaccacgtgttgaggaggacgcagcacagtgtcccgggaagaacgctggcctgtgacgggacacctctccctgtccttacagaggttcgggtgagctggcctcatggctgaggaccctggagtcgtaaaagcagcttgtctgcctgagctccagcccctccgttctgcctctcagcttctcggttccagcacttgtgcacacttggtgaaatatcccttctgtcatcaaatctcaaagggacatctggccttcccagttggacggcaagttcaaggatggatcatgcccttggtccctccgcagcagcttccagaaggctggtgacgtcagaagggctccaggaggaacggggaagaaacagtgctctgggtgcagggcctggcttcgtggcccccacctcaccccggtcgccaagctgcccactgtcagagtgcagccctctgtagaccgagtgccaccaaccggcacagccccctgagaggccagcctcggggggagcagaggccctttgaggtctgaggcctcgccccattggagcgagaaggcggga

SEQ ID NO: 42091 - DNA, 3961 bp, Bovine  19866880612505
ctttcttcctctgtcactgcctccattatatgagaatccctcccctcctccacccacaccccctccatctctacccaagccctggagctgaaccctgcagagcgtccatccagcatggctaagactggccagacaccctgtacttctctcctctcctgtggctgggttacagctcattgccagactccagcaggtctgtgcctgggctccccctgacccctgcacaagtcagggtggggctcagcctcctcaggcctgtccaggcagaaaggctcctgcagccagcagcctgggccaggcctcaaagggcacatgcttagacgcgggtgagtgggctttccaggccaggctgctctcctctctaacaccttgctccttcctggctggttcctgctcaatcgtagaacacagcccactgatgttcagccccatccctccctcccaaacctagaatccccaagcccccaagggaatcaggggagccagaacccagaagggcccgagggcctgggtcattcatgggttaacttgctgacaggctcattgtctttatccaaggctagaacctacattccaaggggacaggggggtggcattcatgccccaacagtgccaagcatctaggaggagcaaaataaatgtctgtctgattgagtaaacctctctaggtgctgcccactctgacacccaaagattcttgagtgtccccacatgaaagctctggcccctcaatttcaaagccctttctctgagctcagatgcagcaatgccagtcagactctcagccagaccccacccagcagtggggtgaggatctcttgcttaatggaagattgacctggtttccttggcaaccgcttccctcccatccccggtccttgctcaccttgggatactgccttccctcccgcctccctgtcagaccctccttgccccaactctgctccttcctgccccctcaaacctctgccactctcccgccacagcctgtaattaacttcagtcgttgccagggcccccttctagcctgagcatcgctccagcagcagcttcatcattaattaacttttttgaagttcaaacgttctaattaccagcaaacgtcccccatcctctttgccttttcccctggcctgtcgtgctctctctccttccagccacctcttctgctccctttgcccttcctgccagcttcaagttcaaagtgcacttggcaggtgtcttccaggaacctggcactcccacttcttcctcaccaaggccctgagcagtgggggtcagcagacccattttacggattaggaaaactgaggttcagagaaatgaggggcctctcccagctcacacagtggggaagtgctggagctgagattcaccccagacctgctctcctctgtgatgcagggcttgtctctgcccgtgtctttccttgccagcctctgaggcctcagctcatcttcagcacctctcacctgagccctgcccagcctccctgctggcctccagctctggtctctgccgctccaatctgccctgcatacaatccccaggtgtttgttgtgtggccaatactatccaagctctttgcaagcattatcgcatttaatcctccagccctattacaagccccattacaagtgaggaaacagagtcacaaaggggaacacaattttgcccaaggaccctagctggaaaaaggcagagctgagctacaaaaacagagcctgctgttcttgccccatttcgtcatcgccaaattaatctggctgaagtccaattctgattagacctctcccctattcaaaagccttccagcctccctagcctgacacccacagcctcctacactctgacctcaatgaactcttctggcctctcccgccagccttggcatgcactgaacttcttgctgtccccaattataccctttgaatgagatatgcatgcatacctttctaccaacatgcatatctttctaccaactttaccaggcaaactcctactcatccttcacagcccaggtcatctgtcacctcttctggaagctttcctgaagcacctttccccactcacctagtggtggctcagcctccttcccaaagtgctccccacccacctggtctagctcatattgcgttaatgaacttggcagtagtcatgactactgcctgccaggcccctagggacatggccctaactcttctcatagcccacagggagcagatggagaaatggcctggagagctggaatgacctggccaaggtcacagtcaatgagatgcccgaacggtgtgacttagtggtgccggagccgctgccacagggccacctctggtgcacgtccctcgaaaggggcagatggagcggctttcacctctagatggctcagcttcagggatggacagtctcagccctgccccaaggcactcagggaaatcccagatggcagggctgggccctttccaggagcctgcgaggctcagaagtcaggccagagcgggcatcgctgtctgcagatcctgacacactccccactggctcggggatcaaaggcataagccctccttgaagttaaaccagaccacgtggcgcggggaaggagagtggtggaaggcgtgaagggcctggcccagcgcccagagctgccatcgttagtcacaagcaccgggcaattctgaaagccgtcaagcagagctccgggactctgggacagcacaagagaggacagaggcccagagagggtggtacaggattgctgggtaacagggcaggctggggcctgggtgccagctccaggtgggaagctggtgtgaagctcagggccccaccggcacccaaggctctgtggttagggccctgccactctgcccccttggccgcccagaccctcacgcctctccaggtgacctttgccacagaacaaccccatcccggccctcagagagcccctgatcccatccccactgcacagaggggacacagaggggcagagagcatcccagggacacgatgaccctggagcggaagtgaccctcaggaaagagactccccagccacagggtccctgagcttttcacttttctaatgaaatagcaaatattaataatatgtcatttaaaccttacagtaagcacatgaggaagggaccccagaggccccagaacacagaacccatgtgatcgtggacaagaaccagggcttgtcatgtatgtgcaacagggaagcccctatctttgtccacctcttctataacagggtccagggtttctcattctttgactttgggcgaaaaaaaaagccacctcaccagcaaaggactgagaatctcagactggtgttatctgctgattacttaacatgaccttgagtaaggacaagagatgcgatcacaaaccctttagaccatggctgcctcccaaggactgaaccttcactcacaggctttaaatacaatcaatcaacaacttggagagtcgtccttcaccttcagccgagtcccctcaactggcaggtgctactgttaccccattttacagatgaggaaactgaggcaccagcattggctccagggctccagccacagccacctagggtcataccatggctggtatgtggcaaagtcaggatttgaacatgcttctcctgactccaaaccccatgttctcagccacatgctgtggcctcagggaacagggcctggactggcacatgctcagtggaatatttgcttttcccttccgactgggagacttccctggtggcttagacggtaaagcatctgcctacaatgcgggagacctgggttcaatccctgtgtcgggaagatctcctggagaaggaaatggcaatccactccagtgttcttgcttggaaaaccccatggacagaggagcctggtaggctacagtccatggggtcgcaaagagtcagacacgactgagcgacttcactcactcactca

SEQ ID NO: 42092 - DNA, 611 bp, Bovine  19866880623922
tactagagcgtttgtttggtctcaaaagtgcctggcccctcttggagtctctcctcaacccttctccctgtgggtcatctctccctgacttccttccctccctattcccaaaccccatcagtctggcatctcaccaagatcctctgtttttatctcacctgataggtggtttcacgaaggcctctcacgacaccaggcagagagcttgctgatgggcaaggagcttggttgcttcatcatccgggccagccagagctcccccggggacttctccatatccgtcaggtactggccaatcctgactccgccctgacctactaaagcactaaaacgacaaggtgacctcttaaacatgacctatccctcaggagcatggtggcaaggggcccgggcacaacgtatcaatacattcacctgcctccccttccagccccggtgcttctggaaagacaggatttttatcaacctcacctctgtgtgtttcacagcaccatgtaaacccaacaggtgctgggtgagtgtctgcggaaggggaatgggaagggagaaggaacaagaatttccagaggtccacatccatctttggagttgcaatcttttttttttttttt

SEQ ID NO: 42093 - DNA, 1160 bp, Bovine  19866880670738
cttggagaaggaaatggcaacccactcctgttcttgcctggagaatcccagggacgggggagcctgatgggctgccatctatggggttgcacggagtcggacacgactgaatcgacttagcagcagcagcagcagcagccaggaacacccgaacatctcagtttcccagaatacaccagcagacatgcctcagcatctgtcagcctctctccctgggacgcccttcccagctttcagatcccaccccagggcatctctggctcgagggggtgctgttgtgtccttgttcctcaggtcatggctcagagccctagttaggtccctagcccctcatccagcacctggcttggaggcagctccccctgccagcttgtcaaacaaataacttgagggacaagatcagaaaaaaagaaaaaaactaggagctgacaagaagcaacataaaatgactgagacttaacatctttccaggaaatacccctcccaggagatgatttctgagtgttactgataaaaatagggtgtttcctcagtctttacaagggactcacaggggctttcttaaaatgtaatgtaagatgtagctaatggaaaggaagctgagatgctggaaatggcaactcatctgtcaggaggcagctctatgatgactcaggcttgtgtcgggtggtaactagaccaccagcttatgctactgtctcagcacccagcacatagtaggtgttcagtggagggagggcaggcgggagagaggaaatcatggaaagagaaaattaggggctgataatgttaacccttgactctggccagtgttttatgattggtgggtcgttattgcccagataccatcacacaattcttatgagaccagaataaagtttctttcttttttggggggaggggattgcactgggtcttcattgctacatgtaggctttctctagctgcgagcagggctactcttcattggggtacgcgggcttctcactgtggtggcttctctcgttgcagagcaagggctctagagtgcaggctcagaagttgtgatgcataggcttagttgctccacggcatatggaatctttccagaccagggatcgaacccatgacccctgcacggctggggatttgtatccactgagccatcagggaagtccaag

SEQ ID NO: 42094 - DNA, 2268 bp, Bovine  19866880687124
ttttcttgatccagaatagtagacagcaacattcaaatggattttaaaattacaatcaacaaatattcactaagcgcttagtttactttaaggccctaaatcagtgctatgggtaatataaacagttattctcaagaacttcaagttcagatgggaagatggaacagatgaacacagagttgtaaccccagggaacatatctgctcaatacgtggaggagaaaaacaatgctgggctctcagcaaagactgtgccaagataagtcttgaaggattgatataaatggatgggctcagcaaaacaggaaaatacaaaccaaggttcaacttgaactctctctggaccaaatacatttccctgcaattgtggccgaacaattcccggggcagagaggtacaggaggccatacaggacaaccgggggctgacccaagttttagataccatctgttttgcagcagatttagtaggtagtattcaaacgagggtcagaacctgggtgacagcacaaagaatggaagagcagaaatggatgtgagagagaagaaagcacttgggaggcgttatcagtgcctgaatcctgcgagcaggggagatgggaaagagtaaggaggaggctaaagggaagagatgctgcaactaagggatgcacgacagcaccactaagcagttagagtttagttatgaaagaaagacaatttgggggtggggaggaggtatatgttcagttttaaacaagtccaggtgatgcgtggggttacctctcaggggatcatctgcttgtaaaaaaggggtatgggcagttacaggaataagaggtgaaaacgaatttttacatgtaaaggcagaagtcctaggccttcagtcctccattggtacctcttaaaaatcggacacagggggcttccctggcagtccagtggttaagacactgagctttcacttgagggaactaagatccctcaagccacatggtacagtcaaaaagaaaaatgcaaaaacaaaactatgaactctgggtgaatgaggtgtcactgtaggttcatcaactgtgacaaatgtaccactctggtcgaagtcctatgaaagaatgatggagggtggtgtgcagaaacatggaacatggagctggctcctttacacactcactcagacctgcaacaaactctatcagctctttgagtctcagtttcttcatctacaaaatgggataatagcaggaacttccccacagattttggtgaaggtaagataagaatttatgctcaaggcttagcatgctgcatggtctgcaggagcattcgataaatgaggctactgtactgtcggcacgacgcagaagtggaaacaaaaagaaggtgatctgtaaggtcattaacctgcagtgtcttggtaggtagctaagaatttgttttacttgcatttacttggacaaagagcagaagccttaatgacttcaatggcttaaggtccaacttttgcaagaccaacgcgccaattactaatgactggtttacgaacctgtaaggtgttgtgctaagtaagtgacttcaaaggcttttttatatccattaagttttccattcccaactgtctttaaaaacaaaacaaaacacacacacaaacacacacacaaggaactcagcaaatgttgtagaattaaccaaggtcctcttttttcccccttggccatctgcccttagcctttgtctgtaagtggaagaatttttagagaaaagcaagctctaattggctgccttagaaataacaagctaaacttaactggttcttcccatggcccctgattttcttggcagaccggttaaaagaaaagcacttgtgtcatcaggatataacctctgtcctcacaacacccacagctccttgcaatgatgtcaccatctgcctcggtcctaaatggtatttgtctcatcctgcctctgtgagcctgcaagttccccagggacgcggcctatatgagaggtgtctctccatccatgctgacctgtgttgttcagctgctataatttattccttaagaaataaatgccaatttcctttgtacaatgcaacctgatagggaaagtgctagccagaggggaagaaatgggtcacacacctaccctgaagtgctatgaacgttggtaaagggagttgtcagaggcactgtagggccaggcaccaggtgaaggcagcgaggtgttgagggaagaattagaccctttggatgacaaatgaagaacgagatgaaaaaactgcaggtaagtat

SEQ ID NO: 42095 - DNA, 850 bp, Bovine  19866880730938
tctgaggaaaggccctaactctgatgcttacagctcagtaaaagctgagttatcactgtgctttatacagctttctgtcttgccatcaagcagcacttatccttcagctcatctcttccttcaaacaacaaaatcatctaaataaaaaatacccaagctatccacccgaattaaaacatgaggaaaacatccaggaataggaaaaaaggagtagaagcagcggtgtgtgtataacaccttctctaaagtatcttttttcccttgctaattcaccacaaagaagtgaggcacagctgtttcagctcaggatcctaaagccagggtatcagatttctagcaatgcattcaattttacatttcattataactaaataattcagaagcatctttaaattccttctgatggaaatttacccttatgaaactataacttgccttcattttctctgactcaaatgttagagtcattttcgatttctgtctttcttctccaatatatcatctatgtatccattccctctctatattctgtctttaaacattaccttttcctcatttcaataacctttgagcgggtcctagattcaaacaactgtcttctagaaagcttccctccaatttgtagctccttcatttctacacaaagcaataagaattatcttccaccaacagctgttttcagtaataagaaagctaagttctgtgactaagctgaacatcccttctgttctccaaggcctactatggatccttcttgctagttgtatcaaacaaatttccaaatactgctaataaactgtatttataaacggggcagagtactctcaactatctgcccgcatttttctat

SEQ ID NO: 42096 - DNA, 962 bp, Bovine  19866880784457
tgtctcataaatatactaggttttgttactttgtttgctttgatgtgtttttcctttgcaacccatctatcaaagaaaccaggctatttgtcccatacagtttcccaaagcctagacttttcttattagacccccatgttggtatttaatacgttgctctgtcctctgtaattcttataaattagtactcagatctagaagccagatcaatttgtataggaacagaaagacacaagcttaatgtagcactaacaaatggtaaccaataagcttttataaagtattactatgaactaatacatgtttcagttactgtttttattggtattcaaactgtcgcatcattggtcaaaaagagtctcttcatgtatactcttgggtccttttttagaaaaatttggttttaattggtggataatctgtttacaacattgtgttactttctgccacacgttaacaagaatcagccacaggcatacatatacgtcccctacctcttgaacctctgtcccacctcccaccccatcccatccctccgggttgtcacagagcaccgggctgagctccctgcatcatacagcaaatttcccctggtttcctcttttccatatggtaatgtacatgtgtcaactctactctccatccgtcccacctctccttccccgtgtccacaagtctgtgctctacgtctgtgtctctgttcctgccctgcaaataagttcatcagcaccatttttctagattccatatacatgtattaacatatgtatttttctctaactcatttcattctgtataacaggctctaggttcatccacctcactagaactgactcaaattcattcctttttatggctgagtaatattctattgtatatatgtaccacaacttctttgtccattcatctgtcaatggccatctaggttgcttaccatgtcctagctattataaatagtgctg

SEQ ID NO: 42097 - DNA, 726 bp, Bovine  19866880790127
cctgttgaccctagaactagctcctgtcctttcccatgggtgcttaaggccccagccacccacgggctttgaagttgcctgcctctgcagttcctgcagtctcacagagtagtcaagctcactgggaaatatacagacctgtgttggaattgtgataccgccccagtacctgtgaccttgagccctggctggactgccctgcccaccgtgtccccgagctgaggtctgtctgtaggactgtgaacgtggcccttgctgaagaggcctgggcggcccctcagtacctctcctcgcttcaccttccgttctcggcctctgcacctactgctgttagcactttcattagtatccttattgccagcattggttattttttaaaagcgcacctttgggaacagattagcttggagtttttgtggcctttgagtgtggacacaggccaggcttgtggcctctgtgtactgggtttctgcatgcttcccgcatgtgtcagctttccttgtagctgcggctttgctccttcctgggtgccttgcctttccagtggggtgtttctgatttctttttcaagttgtatgaagcagtactgtccaggagaacttcccgtgatgatagaagtgtacttacacttaagctatccatcaggtagccaggagccacacgtagctcttgaacatttgagatgggactgaggaacaaattttaaaatggtattttaattttcgt

SEQ ID NO: 42098 - DNA, 807 bp, Bovine  19866880808904
aaaaggtatcagagctcagtctagttgaataccaagctatcataaagctgggaagtatcattttgggtttaaaaaaagcagtgactgtaaggcaataagctggattttcgtatatgaatcacgaaaatggctcagagctgagctacttctgcagcagtttagggattcatctcatgagttgacggtgaagggcgccaagctttctcccatctcagagcatctgcaccactgtttcctctgcccaaagatcccagatatacctggacagttccctcacttcattcaggtctctgtttacatctctgcctcctccaaaagaaccccccctcactacctgacctaaaataaagccattcctgtccctctctgccctgtcactgcttccctttgctttacaggacttgacactatctgacacagtattttacatctgttttatttaagtgtgtttaatatttatctctggcactagaatatttgctacatgatgagaggggctttgttttattcgctgctttcactccaaagttctgctagatatccaaatttcaaattataaatttaataaatatatttataatgaaagaaaggaagaggaaagcaaatggaagaaggaagaacaaaaatgataacagagaagtagtgaaagagatgcagaaactctaggtgagtcataattggttattttactctgttacttcattttaggtatcagtttgaatttaaggcttctatgagaaaatttcagaatgtgtctctttcaagattgtttcaaaggaccaggtccccaaagaaagaggttccaga

SEQ ID NO: 42099 - DNA, 1060 bp, Bovine  19866880827899
tgacgatgtagaccaaattagaagttaaactgggtccctacgtgggagctgtgtcaccctctttgtcagattcttccttctcattctcatcttggtttggctggagaacatccttaagtagttttgttttttagagagttcatttgggttttcccatcacatgttaaggaaaaatccgaacgaactttttgaccaactcaataaaaagaaaaggtgcttggatagtgtcgtttttcagtcttgcctgtccacgcatatatccctttgaccttggtgggtgaagggcggtttttgtctgcactgcactggactcgaagtttttctccctcagagccctgtgtgtggtactgtccaaatcgacaccatatattgcagccgaggccactatagatctggttcttctttgttgggagaaacctgctttttctttgctagaagcttgaaagttttctccttaccttcagaattcagacatttcaaaagggcaggtgttaagtgaaggatcgcttctggtggggccttttggaactcaagacttgtgcatccttcaggtcagaaaaaaattattccgtatgttgtttggtgactggccattcttctctgctctctcctagaattcccagtaagtggttatttccatcatctctctattctctgcatgtttcgttcacctctcttacagatttcatctgtactaagaattccttgacttggccttctgaatcactatcaatgtccttttctcaatttactgcccctaatggaagtgctcatctcctctgtgtctttttaattctcaggatcgcttgttgctcttgaatttcttatttttcagagcagcttgtttttatggatgcaatattcactcacatctcttcgtagatacaaattaggctttactgatcctgaagtcaaagtataatttccagaaagttaaaaaaaattaccctcacacaaatcttagaaggaacatgtatattacagatttattcgactcattaatgaggaatcagcaggatggtaattgtcagaaccagaaaaacaggcaaggaaaaaaaaa

SEQ ID NO: 42100 - DNA, 835 bp, Bovine  19866880864778
cccaaaacaaaaaaccttaaggaggaaaagaagagctaattttaagagaggaaagcatccttgagaccaatgaaatctcccataatccacagtgacagacagggaccagccgaagagcaatttgattaaataaggatatcaggagcttagagggactctctagtttgtgtcacgtttgtctgttagtctttgaaatatatttctttagcttccaaacctataaaccaagtgccttctagctggggagatgattcccatttggaaaataggaaaaaaaaaaaaaatctcagggcaaagccaaggggtccaggtggggctggggatcccaggctggactggaactaagaggctggcagagggtctgcaggaggccctgatggagagagatgttagaagtttgggctgggtgccaccagccttgcagtggatggttatgggctgagcttgagtccatcccaggcagcacaccttccctgcccacgttcctatcccactgcctgctgcccattacctgacatcagggaccgctctgttgctgctttcctcagggaagcatttagaggatgcattgttctgtgtgggacacacctgtgcagggagatggcgtgtcccctgaggcttccgttcataagccacttcctagtggctccaggactggcatcagcaggtcagccgtcaaggaatcaccatcttcggacaagcttcaaaggccccctctggttgcatgtctttacccagggcggacatgccaggggatttatcctttcctggggcttgttgttgtcactgttgtttagttgccaagttgtgtccaactcttttggaccccatagac

SEQ ID NO: 42101 - DNA, 4893 bp, Bovine  19866880877754
aaaagatgaagactaaatagagatgtagggaaatacataaattgcaaaaaagtatataactgccatctcaggatcccaggaaaagaagagaagagaacattgcaaaaaaaaaaaaaaaaaaatatatatatatatatatatatatgttcaatatatatatatttgaacagtaatagttgagaaatttgcaaaattaatagacaacaaaccaacaaatgcaagttcatagaccatcaaataggacaagcaccaaatgcatacctgcatgatgatctcaatagaaacagagtgttaaaaaagatataatatccatttattataacaattttctaaaatacaaaactaggagaagaaagtagcattctcatctaataatggtcctctacagaaaacttacatcaaatatattaatggtgaaagattgagtacttttgtcccaagattaggaattaggcagctgctctcatcactcttattcagcatagtactgccaatcttatagtaataaggcaaaacataaaaagtaaaggtataaagattggaaagaaaataataaaaataaaacagtcttttttcccagacattttgattgttacatagaaaattccaaagcatctaccaaaaaactactagaactaatctatgagttgagcagggcatggaatacacacacacacacacacatatgtatatacatatatggtatttctacatattttgaatgaaaagttggaaaatgtaatttttaaaaatatcatttaaaatagtcaacaaaacatgaaatttagctataaatattacaaaatatatctagagtatgtagattgaaaagtgcaaagccttgatgaaagaaatatatagagagaatataacatattcatggcctaggaaagtcaatattgttaagatgtcagttcacttgaaattgcctcacaaagtaaacacaattgcaagcaaaattcaagccattttttaaattaaattcaaagatcttattttaaaattaaaatagagaaattaataaatgttaataaacatagagggagaaaatgacagtaatagaaaggggttttaacacctgatttacatcaatggacagatgacagtgaaaaaatcaataagtaaacacaggctttagataacacactagatcaagtggaataactgtgttgataaatatacactccatcagtggtatatgaaaatacttgaaaattttgtactattttagtaagatcttctaacttgaggatatataacaatttaatgtttaacctttccctttgcaaagacatctagaagaagtttctagtaaagaaagtttaagatttacacttacaacctaacttcaaggagcattccttgtgttattaagatattggtgaggtcataatactttcactgtaggatattcaagaaaacagcactgctgcagggcaaccaagaacttctctacccaaataaaaatctttactacactttgaaccaaacaatagtctcagtttgttccactgtgactaatctgttacaagcagaaatatttttgttgttttttaactaaaattaaatcagacaaaatagtttaaaggtagctggaacagaatgtacctggcacacaataggattgggggctagcaggttgacctcaattcaattgccagcttcaccacaccttaacctttaaatccccaagaagtcacatgaccttctcaagttttttgttttctgatttaagaagtgaagaattgaagaagaaatgaatggaaattcttcatttattccctctctcgacaattactttttgagtatctactgtgacatgccctgagctagaaaggtcagcaagagaatactctgaagcttactatagctggtcagaaaacatatcaatcagctaataatatgtctaagcatataaaatctttaaagaagctcaaaatattcaataagtgtcacagaaaagagagacatgacctagaaggggctggaaactttgagatgagggcaggaaaggatttttccaataaatattttttgctgagattgtgagcaaagaagaaagcctgggaaataacatgctacttgccattagttaagtgctcaatgaaaatgtcttattttatgcaagaaaataaaaacaatcagcctatagcacttatgaaatgccgtgaagttcagatggagtagaggagctgactggagaatgcagcagcccctgttagaattatccttgcagggggaacctcaggctctaaaaagcaatggcagagcttcacagaaacgtcttttccagaatactgagacttaatgcttgcccgtctctctcctctttcaagccccacaaagcttttagtaaaggaaatttctcagtgtctaactagctacaatcaataccatccacatcactgtccactgtgaagactataaaaatagaacctgaaatttaggcctaagactctggggaatagaaacacacataaggaagggaaagtgttttactttgaatcctgatacttgacatttggacttgaaatgacagggaagtaaagtaacataagaaatgagaggctcatagggaaatgatgccactaagatgtttcctatttatttctcttctttgtaaactctgactttaaggttataagaagacttctcagagctctctaatacaattttctgtgggtgaagaacttacaggaaatgtttgtctttggaactgctcctctccggaatgctttgaacaaactaggactggaagaattatttcttctctttatctgccatagtttgtgctctgcagaaggggaccctcgcagaatcagggcaagaagacaaaacagaaaggcggtcctgagcagtttggtgtatttgtttctttctctacggttttcttcaaaatgagtaaccttcattatccccttctttgtgaccttcatccttaggtgtttttcatcttagttataaaaatatatagctttagataagttggaagaaatcttatagagaatctagttcactgcccattttttaagtatgagataatgggagacctacatagatactatctgactttctcaatatactgctttcaatatcatggatttaaaacctattcagatgctggagggaggtggggggtgattgcaacaataccttggttgttgcaagtgttttaaacagtgatctctcaaatgatctagaccatatcaatcacttcttcaggggatattcttccaaatatgtttattcctctctaaacagatgcctgtttctccaagcattcttcatatgctcgctctatctcattagacaccatggcagtgtatcacccaaagacctctcattctacatgttatacaatgcaaacttgccagcttcaaacctaggcttgtgtctatattctcttcctttcacacttctgatggcttcatcacagatgtgacactgtgtgactttcgagtctgagtcataaaaagcagaggagatatgcagatagcaaataagcataggaaaagatgctccatgccatttgtcatcagggaaatgcaaattaaagcaacaatgagataccactgctgtttttcaaattggccaaaatccagaacattgacaacatcaagtgctgaggaggacgtggagcaatgctgctgttgctgttgctaagtcacttcagtcgtgtccgactctatgcgaccccatagacggcagcccaccaggctcccccgtccctgggattctccaggcaagaacactggagtgggctgccatttccttctccaatgcatgaaagtgaaaagtgaaagtgaagtcgctcagttgtgtccaacggactgcagcctaccaggctcctccatccatgggatttttcaggcatgagtactggagtgggttgccattgccttctccgaactctgctctaagctagttaaaaagagtttcccaggtggttcagtggtaaagaacctgcctgccaatgcaggagactggggttcaatccctgggtcaggaagatcccctggaggagcaaatggcaacctactctagtattcttacctgggaaatcccatggacagaggaatctggtgggctaaagtccacggggtcacaaaagaatcagatatgactaagcgactactaacaacacaaaactagtaataaacaccaaatagaattttgttaagggttgtttaacaacataaggggtaaagtgagatgaaatcccttcactctaggtcagtgttcctgagatcttattgtgcaggagaatcacaaaaggactttttaaaacgttccatatcctgatttggcaagtttcaggcaggatctgatactcagtcctaacaggttcccaggtggtatcaatatcacgggttcccagaccttccattgagcagcaaggccctagaacaaaatcactcgtgagaggtaggggaggggctatttgaatcgtaatagttacaaggtcatgagagcaagattaaaatttgtattagaagaacagtctagaaaaatgtgactgtttcttgcatttttctgtaaagaataaaacagctctcagagatgcgttttgaaatgtgacatttctattcgcttgaaattataaatattatacaagctacctgcaaaaactggtgagctgctatattagtttggcagaacttggaaaggtttccaaaaccctgatgcaaatctgaacttcaaggttttcatagtccttgttttagggaggaagaggctaggggtgcggaggcctagggaaggggatggagaaaggaggatcattttaaatggggccttgcaaagaaacagattcgtgaacctgcctcaaatgacaaattattccgtgctgaaattatactgacaccacatgaagttaatgcaacctcgaatcag

SEQ ID NO: 42102 - DNA, 1576 bp, Bovine  19866880887947
tttgctaccggtccttgaagaagcgtctcagaccaatgccccagcttcagcacagcctccagcacaaagacagtggtgaacatgtagttgcagtacttgagggctgtctccagagactgcaggagcaacaaaaagaagcatgacccaggccccatgacctgtccgccacctttactccagtcagaagaatctctgccttgtaaggggagaatttactccattcacacttaatgcagtgatttacatatctgcttttactcttcccaccttacttaatgtgcactatttattttagattgcggtttccttttccttatttctgctggtctggtccaatcgccactcagtggaggcagtatggggtaatggttaaggtagtggttaagaaccaggccgcgtattaatcgatgtgaattcagactcagcacttattccttgtttgaagccttggcaagtcacttgacctctccaggacttagttttccagtctatgaattggatgataatagcacccacctcagaattaaacgaggtaatagtccaagaccagacagaataaatacttggttaatatgaacttattcttattccatttcttcatgttaatttagaagttctaccattacggccgcatcccatcaatggctgcctgcactcattgtatttcactcccaccgtttaaaataacgtaccaattcctcatctggaggctctgctctcccctcttcccccactccagttagtcttcccagagactcgcccctacataacacacccctcgtgtccctcatgaacactgcctgcaaccagctggggactggtcacctctcctaccccagtgtttgccctcagaggccctgcccctctgccaggctccaaatgcccaggagcagtggagccaggtggcaaaccacagttccagtcccacctccactcactggctgaatgactagggcagcgtgttttatgtctctgagcctcggtttctttacaaaatctggagaaagcccaccacacacacacactaaggttgctgcgaggattggagagttaatatctgtagtgtgtcctgcaaagagtctcagtgaacacaccacggccactgtcacccacgttcaaggctgggcctgaatgtcacccccaccccactcctaccccgttccaccccatcccaccccactcaccaggatcttgccctggaaaggggtgacttctccctctcactcatccatcctaccaggccctgagcttcttaagcataggaccccgtgcaggacctgctcagaccctggcccgcccatccctggggtgcgggcccctgaggacccaaccccaccacacgacctcgggccaggggccaggccggggctcaccgtgggctggttgtagtgctccagggacatggtgaccacgttgaggcagatgatgaaggtgatgaagatgtccaggtagtggctggtgcacatggagtggatgagcagcctcgtgggacagtaggtagcgtagtagggcagccgctgggcctctgcaggggtgcggggtggggtggtgcagaccacagagggttggggcagag

SEQ ID NO: 42103 - DNA, 2336 bp, Bovine  19866880899164
attttttgttgtgcctagagcatgtaagacgttagtctcccgaccgggatcaaacccgtgtcgcctgcattggaagcacagaggcttaacagttggagcaccagggaatgccctcattcacacgttatgaatgagaaacgtgaggtgagagattagggtacatgtctgctggctcctaaggctgtgctctttcttctctgtcctagcgaaatatgcaagtcagttcaggataattgctaactagcttagggcccccgaaccttcctgggttgctgtccttcagccaagaaattgatgggaacaattctcacataccctcaaaattcaagcccattgctctttggtcaaagagcaaagactctaataaacctggctgacctaacaccaagcaattgtgctttctggcaattgcagacgtggaaacaatctcagttaataaacttacaaggagctgtcctcttctttcctttccgttctccctctctttctctctctccctccctgtttctctcttgtgatgccatatttttctaacctttcccaccatcaccttttcctacaacgtgttctactttttttttttttaatgtggatcatttgctaagtctttactgaacttgttacaagattgcttctgtcttgtgttttggggttttggcctgaggtatgtgccatcttagggattgaaccagcaccccctgccctggaaggcaaagtcttaaccactggaccaccaagggaagtccctgctctgcgttttttctctttttctgtgtcttcaaaacatcagcgaaacttaccatgaatctagttagaaaaagtatatctaaaatgtccctgtttaaaaatcttctacactgtttgtatttaaatagccccatgaaaacatcaatccaaaacaatagccacaaaaatgaaacagaaagagcccaccccgctgaggtgttacctccagcctgactctgctgcaagacgaatctatcatggccacttcctcattttatcctgattgtttcctaaagcaataacaattgtctgcagaaacaccacgaatcctgctggcgaaacccaaccaggagtgaagcattaaaaatgcccacacagaatcagaaattacttaaggagccctgttcggagggccgggggggatggtggtatatgtgagtggaagagaagaaagagacagcccaacagacattttacacatccccaggcttcattttttcacttcctattttctattcacatcatgagttcctctggaatttatgaccaggattttatggagccttcatgttctctttccctttcccccttctgttcacttcgcatttgtttttattgatttgggctctgaaagctttggctcatttatcacatatttgaaagccttcatcattcttactctgctgtcaccagggctgtaacaccattcacaaacaccacaaatactctcggcctccccctcccttcccgcaccacctgtgctcggggccaccttaacttcaccagagcacacagggtagagtggatgactgcgtgaccacagctacttcagtcttcttgtcacttttacttatattccccagcccccatttattattggaatgcgggtcattgttttagttcactggtcacaaaagcttgcaaaagcggacatgaacccttatgacagcttgccttccttcatttcatgcctatccctgagaaattggaggtaattacatttttattgatcaagtcaccccataaaggtactaaaaagctgccaacagaagggaggatattgtgaattgcttccatcaaatgaataactggaatattcttgttttttggatatgtaggtcttaatttgagtttgtttgaacagaggaacacctgtatgggccttgtttaaagtccttctctttcttttttaatttccagttttattcaagcaggccctaaatcttggattctcaaaggtgaaagtgattcagaaagttggtcttttcccaatttttaagatgatagagaatggacgtggcgggggtggggcaggtggacttgaaaggaacagactaacagcttggtgaactggttacatgaaaccaaaatgtctgatgataattttcagtctgaatttttccctaagaagaaaagaaaatacaagaagatgatgcttataagccccaaattcttgtgtctaagcttaaatatcagcctcccccaccaccattccaggtcctccaccacactaactccttgctctctgggtcacactgcagttttccaatattcttctcaaaatgtgttatctagaatggattcaggattcaagatgggtttcggctggg

SEQ ID NO: 42104 - DNA, 1090 bp, Bovine  19866880979853
tgtttatgagttttttaagagcatctaaaggaatatagacaatgcaccccactccagtactcttgcctggaaaatcccatggacggaggagcctggtgggctgcagtccatagggtcgctaagagtcggacaggactgagtgacatcactttcacttttcactttcatgcattggagaaggaaatggcaacccactccagtgttcttgcctggagaatcccagggacgggggagcctggtgggctgccgtctatggggtcgcacagagtcggacacgactgaagcgacttagcagcagcaaaggaatatagatactattgtgattgatatctgtaatcgttcattttaaaaaatgcatggtcttctttgttagaaattttgtatcattctcttttctccttgaagtcatatttctatttcacatctcacagaatttttcctaacagaaagtatgcttatgcttgaaagccttctctacgtgaaatatgtatataaattgtgattatttttctaaattgtctgcaaccagaggctttaagtggaaaaatagtccctttagattgacttatcattgtaattatttttagtacacagtcaatcacaaccacataaatgtgttatacatttttataaatacttattaaacataaagaataaaattttattggaaggacatgttttttatgaactacatgaaactgttcatttaccacatgtgaatattacttattgcttgaaataaacaaggttcaatgaaaattgtttctgttttacatttttatagatataaatgctgagaagacttgttcacataaaattgtcggtgggaatagaaggtgttttattatagcagtgtcaatcaattctatgatttctttccaagtaatatgcccagaattatacagtgatttattataaaaatgttttccatcacttgtcaactgttaacatgattaggtctttcttcattgttgaaagcaaaggattggaaacagcctacttaggaaaagacttgttaaacagtcactgggagcaatttatgttctcaatttactgggaataataccaaaaaactttcgctaaaatgtat

SEQ ID NO: 42105 - DNA, 875 bp, Bovine  19866881019529
tttactgctttccctgacaactgacgttgccaccccttcctacaaccccatctttcaaggtgggatccttgtcccatacctgtgctcctgagcacttagataaaacatctatgagaagccctgcacacggatgtatttcccactccagaccacaagcatctcaggacagggattgtggcttatacaatcagatttccttcaccccacctggtggttagtgcacgggtgctcagaagaaaccattttggttgaggtgaattttggattttgaaagaactgtttgtgtttcttgagaaacagtttaagcagttcaactgttagattaacttcgcgattagaccagaataacctaaactctctctggctctcctgggccccatgtcacctaccttcagaacatcgccagcgtggaagcccagttcatcttctcccgaggccatgaaatcgaacttggcaatggcttccatgttgtaacgtgaagctggaagagaaataatgtggtcattgtgttttctgccagaagggcagtcctagcggttggtagtggaggatccaatgtctccaggctggagagggaggtgcaggcacacaggaagggtttttgttttcagaaagagctgcctgagcccctaggatccgttttccgacatcgttctctgaatctccagatgccaggaacaggaaatgaaggccagtgaccgccttccccctctcctttcatccccatttgcagtcctggcctgtgatcatttctggggcatctctgtttccggttgataaggacagaagactcgctatcatcgctaccttggggcctgaggggctggaaggactgctctgtaaacactgtccctcggcagctatatttaaccagc

SEQ ID NO: 42106 - DNA, 775 bp, Bovine  19866881073996
tgacctctgatgctgtgtactttttcattctgttttttcctctcttctgccatcttgactcttaaacagaatgaatatgtcgtgtgtgctgagcagaacgtttaggcctagccttttctctgccatgtaaacaggatgttttcagcagatttggctataatagtcatctctcagattcgggaacaattgagtctttatgcagaaaaggtccccttcgcccccatcctcagagttcaaatgcaacatgcaacactctaggtcattgttctgagtttgggtttttttctctgcttttacttatctattacatctttaggaatagagatccatttttagctggtaaaaaaaaaaacctttcttccagtgttttgccatatttcacgtatatgcattaactacacttcttagtgttactacaggagagaaatcttggtttcccccccctcctcgaggtgtacaaataaggttatgtgcgatagtgcagatgtaaatagcctcgcccatgtgtataaatgaactgtcaatctctagacctcagcagttaatcagaaaacgggctgccctccccctgggctgcagactgtgccacagcctctctgctttcttatccccaagtacagggtatccacacagtctagaaacaggcaagtatataagctgtcatcaaggtcatcatcagtctgttacaaaacatagaatattacctctatttccagagtttgtgcacaccgtgtgataaggcctgtaggtttaggccaggccaaaggtgtgtgta

SEQ ID NO: 42107 - DNA, 1257 bp, Bovine  19866881098698
atttgtacattttaataccgtaaaactaagccctatttagaaatgagacactgtaagtgctgtcccttttcataatagaatctcgctgcttgctttggcctcttcgtgagtggtgatgaaatattgtggtcttagttctgcctacagtaggtggggctggatcagactctgaccatcctccttcccgccgccgtcaaggtggtgaacagggaggagctgactccccgtggctgcaagtgccacgatagaaaggtcacacagaacaagcgagcgatggcaggcttagacagtgagcccaccctgcggtgaagcagcgcctccgatttctggagctgggtcaccttgatgctttgggctgtgatcttttacctccaagggaaaaaagaggcccaatattcacttgacaagcagattctgtatcccgagggatattgctacatcgtgtcatccagtagtctttgggtatcttgagatcgagtgatacttcattgctctaaatcagtacttctcagtcaccttggtggtctggttaaaagacacgctccaatgctggggatgtggaagctgcaggtgacagacgtgtttctttgagtagcgaggactcgggatactccgtctccgtgcctgcttcaagaccttcctcagatgcatagctttctccctcccctttcttccaggtgtgtgttgggaaacactaccatcctggctgagtttgccactgatgacgaagtcagccgctttctggcacaagctcagccccctacacctgcggcaaccccgagcgcgcccgccgcgggctggcagtccctggagaccggccagacccagtcagagcccgtcggacctgctctgaatcttttcggtgggtccacggggctcgggcagtggagcagcagtgctggtggcagcagcggggccgatcttgccggcgcttcattgtggggcccccccaactactcttctagcttgtggggagtcccgaccgtggaagaccctcataggatgggcagccctgctcctttactacctggtgaccttctgggaggagggtcggattcaatctgaacttagaactttcaactctgacctcgtgaccttttttggaacagcagcagcactaacttgaccttttcgttttttttttcaacttgcaataaatacatttttaaaaggaaaaaagaaaacggagagagaaaaaaaaaggtgggtcatcgacagactgtctgagcacatagttgcctccctctgacttcagtt

SEQ ID NO: 42108 - DNA, 1398 bp, Bovine  19866881141467
acgctgcctccaagcgccgggtccccgtgtatatcatcctggatgaggcaggtgtgaactacttcctggagatgtgtcagggcttggagctccctgacttccgtattcgggtaagttgtacccctgggcagggcggggggtgggaaggaagtgggatggagaccccctctgccccttcctaggcctgctccccagttcaggggtccaggtgagcagcactgccagcccccttccctctgtctgaaaccttgcctcgtgaactgataaccctaaactgcacgcccagcttaacattttatcccaagactgctgaagctgaggtgggaggctctggcccagtcctgggtgctcagcccgcagagtcactgtcagggttgacggtagggttgtgtttctctgctgaggagctttgagagcaggccagggctgccctgggcccgtccatgcccaaagcaagacttgctgacctcctccggccgtaggaagcagagtcaaatacagataggggccagcaggcaggaccctgtggacaagagggcttgtcctctactcaagaagatactcggcacagagcttctaggctcccagcctgagtgacagcgcccttctcctcttcccgacagaacatccgtgtccgctctgtgacaggcgtgggcttctacatgcccatggggaaggtcaaggggaccctgtcgtcaaagttccttatggtagatggggacaaagtggccactggatccttcaggtgagttgggccctggttggggcggggggaatctttgttcttggtcagaaatgttcgcattcagaaggatgctggactggagcctccacagtcctacgtgtcgtaagtctaagacccgctcatattctaagtctgttctgatggcaaagaataaccccccggccgaccccttccctcaaactctctggctgacggactattcaagaaagacggtcaacttctgttgaccattcagcactgcctgccttccacggtccacagcagcaggttgcattttgaggctggaagaagaccctggcagatggagcaattaataaatggcatcagccctctcacatggttaaagtatggtgctttgcagatgccgtgtgttctaaaaattcagagaagaactaataagaaacgaaatgctcgtaacagtagtggcagctgcagattctacttttaaatgtatgtttgtgccaggaactgagaaaccttctgtatacgttgttggactttagcctcacaacagctctgaccacatgcctcacgagccctgttttacaaggcaggcagagtggaaagcaggtttggatccaggcctgacttttctcgccctcgccctgcacccactgcctgctttactgcacgtgaggccaagacctggaccc

SEQ ID NO: 42109 - DNA, 712 bp, Bovine  19866881149205
cccacgactgcccggttcccttctccctgcatatctggctaacccccattggaagccaagcactcccggaagcatcctacacggaaccctctcctgtgccccacgcctccagcaggcacctccatgacactggaaatgcattgtgagcgcccgcccggcagacatgaagctgacctcgcccacctcctccttcctccgccccccctcctccttcctccgccccaggagccccacccagtggctggcaccaagtggggatgggcctccaatgccccctgtggaatgctgctgaggggcaagtggatgaccagctgatggaggctggaccagagcctggggcccctggcagggggaagggagaggtcccttccttcagtgaagccagtaccttcagtgtcatctcgcccacgaagatagctgtgaagatgtagttggacacagtgaggaagatgcgttcctgaaagagccgggagaggcccgtgggtccaggggcctcccagaactgtcaccctctgccttcagccaaggggcacccaggagaggctgccacttcacagtcattgggaggtggccccctctccagaagcatgctcccggccacacctccctccatggcatccggcctcatagagctctcccaccccctgcccccagcccggcatgctgtcccacagcaggcccttggcagtctgtccctctggcttgttccctg

SEQ ID NO: 42110 - DNA, 1567 bp, Bovine  19866881160230
tagctatttttgatagaatacaaaacattttatagattctcatactgtgcaaaaatagaatgatagtttgattattctttgtcaggtttattaaacaagtatacatcaaaccaataaattcgtctgggtggtttattttttaaagagaaaaagaatcacctttgataatattttcaggtttaaatattagttcatttgaaactgaagagaatttcattcctccatgctctgaactttacctcaaaataacattgagcaatagtgaaagttgtggtaatgcttcaaacaacagatgactattccagagttcctggataagttggcagtaagaagcctctcattttccatcagtatggagcttcatcgttaacaagcctttgccttgtctcaggagaattgagtctggggtatatgtttcacaccttttcatgtcacctttcaggttctgcagaaaagggccaaaagtctttcccttcttgtggatgccacaggtggttgcgagttaagttgagataagtagggcatgaaataggtggggttttgctgtttttgttgttgttatatgcaaagtgaatttaaatgtgtacctttttcttgtattttggaaaataaatttggtgtttttagtcttttatgtatcttttttaattctttaagacagctttttaaatagaactgtctcaattatctatgggggaaatgatctggtttggggattacagaccagtgattctcaatcctgctgcgattagagtcaccagagaagcttttgttttgtttcatatttatttgaaagaacaatgtaaagggctccatgtacccattgttcagtctcggcaattactaaccaaaggctaaaataatctctgataattttgaagaaatatgagacatttaaaaaagaattctagtgctctgggtgctggtcccaaatgaaaactggttttcgtcatgcacactgggttaagaaccagaggacactgatagtgcaggaacgtggggggtgaggaaataagccagtcggaaggctgttgaagttacccggataagagctggacatggctcaagccagggtcagcacagtaaaagtaaatgagaagtgattcacttaggggtttgctgatgagttggataaaatatgtgaaagagaagagtcaaggatgaacccaaaggtattggactgagcaactaaaattcaagatgaagttgccatcaactaagatgaggaaagttgcagatagaaaaaaatttagggacttccctggcgatccaattgttcagactctactcttccactacagagggcatggatgggttcactctctgatcagggaactaagatcccacatgctgtgtggtgtggccaaaaaatacaggtccctctagtcaaggctatggtttttccaatagtcatgtatggttgtgagagttggactataaagaaagctgagcactttaagaactgatgcttttgaactgtggtgttgcagaagactcttgagagtcccttggactgcaaggagatcctaaagatcaatcttaaaggaatcagtcctgaacattcatt

SEQ ID NO: 42111 - DNA, 1388 bp, Bovine  19866881181775
gctctgacccatctcccttcccctcacccatggtggggggcgctttcctaacttcccagggtccccacccccaggtcagtgtctcatgctatcccctcctagaatgtcatacctgtcacctctctatccacatcaccacctcttaccaagccaccaacaaggtcaagccgccctataaggtcatgctcgaagtgccttatgccttctctgattccccatgtgcaggcctctccccacactgccctgaagcctctgtcgttcccctagactcctgagggcagaacctgggtcctcagcgtccagcccaagggcggggtacagagcaggcaggtggggcaggagtggggagagggaccaagggctcagccaagaaaggaaggaagaagtagatgggaacccgcccatctctcacgccctgagctcacaattgcttctctggaggcaggactctgcctcagctccggtttgggcagatctggagagaaagggaagtcacagcccatgccccccaggggcccagcgtgacactgatgacggccaaggttgggcgaggggcggctcttacctggggcagagcttgcaccacggtgtccagcagggcccgcattcccgtggccatcttcaggagcttcagcactgtgggcaacacccaacccggcccactcagcccagaccagcagggacaggcctgtgtgtgtgtgtgcatgtgaatgcaatagagcgagaaagtggaggagcgtgaacgagacgccacactacaatcccctgggtgcagatgaatgggggtggtgcacaaaaacacgtcccccctggggtgggtgtctgtgtaaaaaagcccaagagaaggaggacaggcacaagggagcagacggatatcaagtgtgcgcgtgggcacgtaattcaccatgatgaggccacagtgagcagcgcgtgagggcccctgggtctctcccttcctctctggctggagaggccccagggtgactgctgagtttctccaccggatccctcaccacctcggaatctgggggcaacgggcggggcaggtagaagggtgaggccagaggcaggaggttttttgaaacaaggatgaggacagccttggggcgaaagggagacttctgggagaacaaagagggtttcaaggacaaggtgtcccagccagagctggagaaaggctggtgaggacccagtgtcttcttggctgccctggggtcctttcaaccccacctgagactggaccacactgggcagggtgttatatggagggggcatgccagggcgcagtacagagctgtcaggacgagggcaagtgtgggcacacagcatgggggcgtcaagtgtgtgtcaaggacgggctcctattccccatcctgccccgcccaacc

SEQ ID NO: 42112 - DNA, 1169 bp, Bovine  19866881234794
tggaatcatattagcgtgcattatggagactcattctacaaaggaaccccatggtgaatccctgtattaaatgaaagggaaaatttgttatgcaaatagctaccttttaatttctctgttttaaaggctgggttttttcgtgcactgagtcttaaaatagatcgcacctgtgtatcttctcccaccttacatagtgggttaaataaatttagtttacccttttcttaacccccaaatgctttgtaaaaacctatatatattgatatataacattttaccttggagtatagacgtgtgtgtgtgtgtgtgtgtgtgtgcgggctcagttgtgcccaactctttgcaaccccatggactgtagcccaccaggctcatctgtccatgggatttcccaggcaagaatactggagtgggttgacattccctcctctaggggatcttccccacccagggatcaactctcatctcctgcattgcaggtggattctttacctgttgagccactggggaagcccgagtatagactagtaatcctccagaccgtttttgcaaaggaccagagagaagagattttcagctctgggggctgtacagactatgccacgaccaggcgtctgtcctttttcaggcaggcagcctgagagaacagtaaaccagcaggaggagctgggttctaatacagctggatgccgtcaccgactcaatggatgtgagtctgagcaaactccaggaggtggttaagggaaacctggtgtgctgccgtccatggggttggaaagagtcagacacatcttagagactgaaaaacaacaagttttatttatgctcactgaaacttgaatttcatataatttttacatgccaaaagatattattattataattttgccccactgttcaaaaaagtgaaaaccatctcatttgtgggaaaaatacatgagtcaaatttgacctacttgccatagtttacagaccccatatagtctttaaaaattttctttttgttttttagagagtttgggaataggctatttttattttattatttatatactttcggccatgccctgaggcatgtgtgatcttagtttccggaccagggatcaaacctgtgtcccctgcagtggaagagaggagttttaaccactggatagggaagtcccatgtag

SEQ ID NO: 42113 - DNA, 1596 bp, Bovine  19866881238064
ggattgtttttcttagtttactttatttttaatagaatggattctgagatgtgatttttaaaagcgggcagggtttagttacatggaattgagaaatttttatttcttgcagaacaccaagtcgtttggggaggccaaccatattattgttatgctagaatatattgtcaccttttatcagcaggcaggctcagaaaagagtcatttggctcagaagaagctaggttctgaagatgattgtgtttggtaatttcaaattctgttttctcacggatgatgcagaaagttcttaaagatacgggtaattattgcagaatgatggcttcgggcattcgaagctattcaaacagtaaaattccattataaaagatcacaatatgtgtgttcagttgtgctgcagttgagaacttgtccctatagtgttgctgcatcgttcttaacactgaagaacactgaagcaaaatgcagtaggtctaggactagatgatggcttaaatctgggagatgcaaaataagaaatgaatcaggatgagatccagagttctgggatgtgtgtgtgtgtatcaactcaacaataagaatagttgacattcactgactgctaactatgttctaagcacgttttaattttctcaacaaccgtaccaggaaggtattgccacgtttcatatgagaaaacagaggctgagaaaagctgagtttgcttgttcagggtcacacagatagttgtaagggtcaaagccagaccaggaaccctggtccgtctgagtgtagaggttgtgcttataatcactggcttcactgcctcacaattcagggtgaggctaacaaggtgggcgtcggtgtcattgcctgggatgacagatgaggaagatgggcggggctagcctgtctgccccgggtttggggaggagctggagctcctgcctccacagcagctgtccccttcgcactctgccctccagttggtcgcccccaacttctagagccacctggcagaagcatccatcccagaccttttgggtctttcttttgttggtatcccttttctgaagagctatctgcctccacacacactccccagccgttccctgccctctttcatgtctagaccaaattagcagaagctggagaaagctagaatatcataagagctggtttggaggtgaagagactgtcccaatttcttttttccacacaattaaacctgggaaatgtcatgtggctacacacacaggattttaattggggactgctttcactggttcaccccagcagcagagaattttcatttctcccttttttattttttgctgagccacatggcatgtgggatcttagttccctgaccaggaactgaacccaacccccctgcagtggaagcatggagtcttaaccactgaccaccagggaagtctgggaattttcatttctttaatggatctctgcctctggagcatataatgtgcaattgaaaaccacagagagcaacccagaaacagccaacagaagctaaagaaaaaatcagttctgacttcagtttcatatacaataatatgctcgtacttcattttttaatgggaaacactttctcca

SEQ ID NO: 42114 - DNA, 1037 bp, Bovine  19866881279671
tcctacccaacctccttctggttcgatgcttccactcttttggtcccaactaccaagtaagctgcttcctgcttccctggtggctcagaatctgtctgtaatgtaggagacccaggttccatctctgggttgggaagatcccctggagaagggaatggcaacctgctccagtattcttgcctgagaaatcccatagaccgaggagcctggcagactacagaccatagggttgcaaagagtcggatatgactgagtgactaacactttcactttcacccagtaagttaaaactatgtgttaagtaagagtcagtaggagctgaattagcatctaaaggcctatcttggactgggactttgtgataacagtttggagggctcagaggccttttgctctcattttggtgtccaaccattcatgggacacctaccaccaactcacctgggcacatcccttaatctctctgctccaccgggagtaaggatggggaccaggtgctcaatggggagaccttcctagcctggaaacattctgcatgaacaatgccccaggtaaagccagccaggagtcccagggcaggggatggggggctgcactcacatagtgaagttctcctccaggaagcagcggttacgaagcaggccggcccagagctgcacgccgatgatgccaaagatgaagaagacaaagaagcagagcaggaggacattccccagcatgggcagtgtgtccaggagcaggttcaccaggatccgcatacctgggcgagggaagggtggagggattggcagacaggggcagagggcccggagaggagagggagagagcagggttagaggaacagagagggggtggtgagaggagaggtgggacacgtgggcaggggctccttactgccctcaacctgctcagtggccaccagacaccttctcccggaagccatgcaaatggctctgcgtcctgctatatttccactagatcatgggtgaataagcagatatttacagagcgcttttaatgtgccaaatgcttttcgg

SEQ ID NO: 42115 - DNA, 1768 bp, Bovine  19866881300697
tagatgactattgaaataattttaaaaattgatgagtgaatctctgttttaaaaattcctacatttacatatgttattgcatgttatctactttatccattagtgtccttagtatattaatcttttgttgttcagtcactaagtcatgtccaactctttgtgactcatggactgcagcatgccaggctcctctatgctccactatctcttggagtttgctcatattcatgtcaattgagtcagtgatgccatctaaccatctcatccactactgtacccttctccttgtgtcttcaatcttttccagcatcagggtcttttccaataagctgactcttcgcatcagatggccaaagtgttggaacttcagcatcagtctttccaatgactattcagggctgatttcctttaggattgactggtttgatcttcttggagtccaagggactctcaagagtcttctccagcaccacattttgaaagcatcaattcttcagcactcagctttatttatggcccaactctcacactccaatacatgttaaagttgtggaaaagttccatatctgtactggaagaaccacagctttgactagacggacctttgttggcaaagcgatgtctctgatttttaatgtgctgtctaggtttgtcatagcttttcttccaaggagctgctgctgctaagtcatgtcagtaatgttcgactctgtgcgaccccacagatggcagcccaccaggctcccatccctgggattctccaggcaagaatactggagtgggttgccatttccttctccagtgcattaaagtgaaaagtgaaagtgaagttgctcagtcatgtccgactctgcacaaccccagggagcaaacgtcttttaattttgcggctgcagtcactgtacacagtgattttggatcccaagaaaataaaatctgccactgtttccatttctccccatctatttgccatgaagtgatgggaccggagagcccagagaagcaataactctgtctccagcatgttaggaaaggcttcctggaagaagcaacatttagctgaaccctcaagattcaaatgaacaggaatgggagaacagggtaaggggcacattcaaagtgggagagaacacggcattttggcaagctgctcagcaaccactgctagaccactgcgtgtgatggaggaaggaggaggcaaaaggcaagctgcagaggaaagtggaggccaacgaggaaggagcttatccgccaggctaaggtgacagactttatcctaaggggagcttctcagaattctgaccggaccagagctgcattttagaaatgatcttagtctccagttctgttttgacccctgactgctcttcataacttgtcctcctccaatcttttctttacaccacatccacagtcatcttcctgaaagcaaggaagatctggttgtctcatgtccttgcttaaatcacttcaaaggctccccatcattatccagacacaactgaaactcctccagcacatgcttgccttcgtccattagcgctgcgataacacagtaccacagactgggtagcttagagacaacagaaatttctctctcacagttctagaggctgaagtctgaggtcagggtaccaagatagctgggtcctgcaaggccttcttttaggtaaagactgctgactgctcaccgtgtattcagctggtgggagggctggggagctgtgtgaggtctaagatccccttccgacttcctctaccccacccc

SEQ ID NO: 42116 - DNA, 651 bp, Bovine  19866881359841
tcacgttggcagtaaagccactgaggcctggtgagttggtttcggcctgtgccccagagttgatcagagtggggagctgcccagaggtgtgtttggcaggacggagagccatcgtggtcatcttgggtcctgtccagtagggctgcctggagggcagagagacctcagcagaaagagcagtgaccgccaacagtatatgaccacagcagggaccagtgaggaagagacagacccttgtcccttacctgtccctcacctgcccctgtgagctcataggagggagctttgttcctttaagtcgacctccagaagacagagggaaagaaaagtaaaagagcggccagagcaaaagccaggtgggacagcccctggtgtgcgggggaacctttgaggcacttgagaatggctgactcgcatggggcaggcagctggagactggaaggagagttggagctctggccacttggatggagcacctctcactcctcgcatccgtactgtctctccctctgatctctgtgctgtgcttctgaatctttgtacctgtcttccagttcccagttttttcttcaactggagttaatctgctgcttaaatcaaccagttacatttaaattttcagttattttatttttcatttttagaggaggg

SEQ ID NO: 42117 - DNA, 1881 bp, Bovine  19866881465817
cttccaggatgaggatggaagctcgaatgtccccaggtaagggggattcctcatctttggcatcttatttaaggaaaaatgctaatgaaaggttaggtaaagaagatgggacttcgtctgatcagaatggctcttcggtcctgtgctctaacttttgattcaggaggtctggggtcttggcacctcagccatcatatccaggccagaggccgtcagctttaggaaagtcctcggaagagtcactccacctttagctcctggaaggtgctcaaggccaaggcccctcccagaagagtacatggggtgggctcaggatctcagggccgctcttccaacgagttcatctttctgccccccttccccagccgggactatgaagccagattccatcaccttccagagagactggaggtgaaggtgaacctgtgatggaccagtcaattgagtcctctgtcctcaagcccagagcccagccacaagcccaaagtgcaaacagaggacgctgagggtagggctttgtatgaaagagctattgaggaccacaggcatctgctgttcagcatcaccttgtatgacgatcttgtgggataaacacctctcaaattcagctctagaaaaacgcttcaataattaggcagcttgccttctgcttgatgagagctgtgtgtgccaacctgtttcctttttcaccacagctcccaggacactcaacatgaatcatccattagcccagattttcggtataattatgacctcatctctctgtattatttggctcctggtcttttgtcattgttctatcaggcctgagattcctatcttttattgtcaattaaccatctggttctttctggactcgatgtaatagtctaggcaaaattactcaggaaaaatctcagccagttccctctgaagccaacacccaagatcagggccatgggagctggcagggctcccaccctcaccttggctgctctcgtgtttcagccaggactggacggggttgaatgggatggcctccatctcgcacaggaagttctccggacccgatgagacggccgtgttgggtaaggggaagaagcattcgcccaggtcccctacctgcatgggctcaggcgggtcaggctcgccctacaggaaaagggaggtggaaggggcaggatggtggaggggggaacagcccaccatagctgccttcatgcccctgctctacacccctttgcttcgctgctctcactgcctgggacggccttctcttcccctccttcacctggccagcgatcatcatcttccaaaacctcctggaggtaaaaggaccccacctccaggaagccctctctgatgtcccaggcaggtagcaattcccccactcactccccttgtgaccctgagactcttgaggctcttctttgtctctgtagccaagtggtacagaccctggccagcagaaaggccaagcctaggctggtgaaggcaccagaagacagaccaagcagcttcaaagcctccttgtgagcgtgaccctgggcaggtcccttcctgtggctgagcctcagtttccacatccataaatgagagaggaaccactccttctggcaaccagctctccttcctggcactccctgagccctgcccttcttcaaccctgcagcccaaggttacctctgaacagtatgtgtctcaaaagctgcctctatgccccctccaagatagatgagccccctatgaactattatttgagtcctaataaaacagcacccaccaacaccaccagaccctagaaactgcaccccaacatcctgtgtgggagaatagtgcaggggtacaggagatgcaggaaggggctggcggcagcgggggacaggggctgtcagctgtcag

SEQ ID NO: 42118 - DNA, 670 bp, Bovine  19866881575745
gaggtgacctgctcagctggactctgtggctctgacctggcatctacccgcgggtcgctgacactcactgtgcccccaggcagcgggccgggaggtcgagagagacttcgactccgtgtactcgcgcctggtgctgtgcaagacgtacaggtaacctggctcctgcgtcctcctgcaggtcgccctcccagcagcctggggccgggatggagggagggcgtggcccgagcccaccagggcggtgtgggcagctctggtcccccctcaggttggatgaagatggcaaagtcctgaccccagaggagctgctctaccgggtaagggggccgcgggcggaccggcctctagggtgggcagctggggacacctgagtgaccgctgtgccccccaggctgtgcagtctgttaacgtgacccacgacgctgctcacgcacaaatggacgtgaagctccgctccctcatctgcgtggggctcaagtgagtgtgtgcgcccccgtgagcgggggctgtgtgtgtgcgtgccctcacggggggcggggctgagctgggcggacggaggtgggttggcggccagggtggctcccgaatatcgtcctccagtgtgagaccagcaaccgcttggcagcgaggggcactgggcctggtgaagcactggttccagtgaggtgag

SEQ ID NO: 42119 - DNA, 1227 bp, Bovine  19866881685474
ttttgataaagtttaaagataaaaagtaaaattttacttggaagtacactttctaacaagatgaatgactttgtatctagattacttcagatattagtgattatgacttgatctagttcacactattctattcctatttttaaaatttttatagactttttaaagcactaagaaagtttacacaaataagtagatgagaaaagtaggagccttgtaatcacatcagttatttctttatattactttttggatatatttccttctcccagctcaataagatatctaaaaattatgttttagtatttattactaaaacataatttttagataggtcattatcacttgacaattcaattaggtatattttccattttgttaaaagcagaaaatattttacaaaaaacaatcagctaagggttagttaagcagtcatggaaagtcattcaactctttaattctgagaaaatatatcagtagaggctttatcaaaatgtactaagaaaaaaacatactatgaaatttttaattattcttgctagtctttagcctacaggttatcttttttcttttttactctgctatactaggcactatttatattcataatatatacattcattgtattacatctttttcgaaaaaactttaatctgtataaatgctttacctatattttcatcaaaaccttacagctataggtttagtttattcaaaataggcagccaaatcagacttgttttcagtctcagtttttcaattccaataaattgataatatgaattaaggaaaattgtaattgaaataaactgcaaaatgcatcgtgattataagtggtcatatcacaattaatatagacctaataaaactaatgtatccattgtttactaagttatcacatgaaaatgttagtaagtcagtatgttctttttccttaatttggataataaagcataactaaatttttaagttacttatgaaacaggaatatgatattaaaaaaccatgaaatgtatccagtaaatgtacatatgtataaatactgaactctgatcctttagtcattaagaatagttaagtataataatcacaaacaatatgattaatctaataagacatcatgataaaacttttctatataatattcaataaacaagagaagtatacatacactgctaaaaatgaacagatttacagccaacacataattttactttttaataggtgggt

SEQ ID NO: 42120 - DNA, 869 bp, Bovine  19866881706177
atgcacggccagtgaaagaggaggggtcccagtacacggtcccagtgggagtggtctggactgaagtaggcatcagctggatgtgctcggtgaggtcattttcacccccttcctgcttaaccacgggcagctgcctgctgtgaggacactctgattttctcatggcaagcctggcagttaccccaggctttcaccatggccataatgatgttctctgtggccgtgaaaggcagctcctgcagagcgcaccgctgggtacattgggatatcccaccaatccttcagaaatgttctacaacatatttaatacagtatctgcactgagaagggcttccctcatagctcagttggtaaagaatccacctgcaatgcaggaaaccccggtttgattcctgggttgggatgatcccctggagaagggataggcaacccactccagtattcttggggtttctcttgtggctcagctggtaaagaatctgcctgcaatgtgggagacctgggttcgatccctgggttgggaagatcccctggagaagagactggctactcactccagtactcttacctggagaatcccagggacagagaagcctggtgggctgtagtccatggggtcacaaagagtcgaacacgactgagcaactttcactttctgcagtgagtaatgcctcagccaaacagattcatcagtgggcactgtcaccgagtgtgggttcaaactactgcacggatgctgtctgcagggggtccatgacaagggtcatcaggtgacgggccaggctgcggcactgctctgagcgtggagggttctgctggtaggtgttgcacttagccgatctgcttttttcaaagggttcctccaattc

SEQ ID NO: 42121 - DNA, 1239 bp, Bovine  19866881817384
aaaaaggaactggcatgaaatcataaggaaaatcccgtttccttactgatccaacagcatttaaggaagctgagctctgccaatttgtagctgggcagttttttaactgtgcagaatttgaaactgggcagttaaaaccaccatctaagctggcagctgtgattttcccagaagcagagcttcaggaagaaaaatatcttttaaacgtcagttccatttttgcaaaattggatctgttcatgaaaaattgctgtaagtccagggtttttttcttttctttcctcattagtaaaggatatgatgatttcttttttgcccacatggaaatgcattcatttactcaacaaataaatatgtaccgagcacctaccattagccaaacactgttttaggtgctggggatgcggatgtggacagaagaggcaaagtctttgatctttggggcttgtcctctagtgaggaggggggtggagagactgataataaccaagtaaatgaataagtagatatcttagtagttatcaggcacagataactgaaacaatgctaatatcttattgtacctagaaaatcaatttccggaaaattaaacattaagactcccacatcagtattatcttagctcatgtaagtaacatatattaaggggtcttttgaaaagaataactagtagggaatatacgtatattactctttgcatatgacattgacattccctgctgacctttaacaagtcttcgaggagcatttctagaaggatttgtgccacttgcgtttgctccgtttgggcacagtatggccctgtggcccgcatagtggtccaccctggaaacctctacgtccttccgagcgcctctctctcttctcctcctattccccaaaactggcacccctctctactgggtctttatttatttttaatttattttttaattggagtatggggatgacagaggatgagatggttggatggcatcactgacttgacggacatgaattgacggacatgagtttgagcaaactcagggagttggtgatagtcaggaaaaaccctgggggtgctgcagtccatgggggttgcagagagtcggacatgactgagtgcctgaactgaactgagcaagatgattaaagaatggaattcatcaatgataacatggataactaaaactggccatgagcttaaggatgaagggggtaccattttatgacaaacaaacctgaaacctcaagaagtta

SEQ ID NO: 42122 - DNA, 2900 bp, Bovine  19866880371900
gcaccccactccagtactcttgcctggaaagtcccatggacagaggagcctggtaggctgcagtccatggggtcgctaagggtcggacatgactgagtgacttcactttcacttttcactttcatgcattggagaaggaaatggcaacccactccagtgttcttacctggagaatcccaaggacaggggagcctggtgggctgccgtctatggggtcgcacagagtcagacacgactgatgtgacttagcagtatcagatttatatttacatgtatgcaacatatacacacatatatgtatgttaatttaaggcagaattttattaagggttaattcattttttttgatgcaataaagtgttcattgccttaatggcctaaattatacatcacttgtaaccaaatatgaatatcaattcatcccagcttcattgagctgggcgcaaaaatttgcatttttcaattcagtttctttctggtaggccaaagatctttagttgagaaaaaggcagaaaaaaagataagatcctccttatcagattgaacaaactctctcagagtcaagctggaaaatgcctcctggtgctgtcagaatcaaatggaaacaagtgttacataagggctaaaaaatcttctgaaaattactgcagcatacccactgcattcttagatatagatcacagaaaatgtcagaatccacaggtatggaataaaagctaaaatagttcatcaaatgaaatcaaatgaaatatttaaatatgtatgtacaaattcaacctactgttttttatctgcattcaactctagatgtgacatctaatccatgaattccatgtttagaggctggaaataaagagagactttaagctcttcaagttttaaagtttgaattgtggtttctttttgaaaatcttaaaaatccatcaattcttcaagagatacaaaggtatattattatgctggttaatttgtattttgcagtagctctgttttttatgagtgtatttattaaagtgcttcaaatacattaataaggaaattctttctaatctaactatcccttaaaagatacatttgaaaaaaaggacatttgctctctctctcttattttcatcctattagtttggtgagtatattcctttcctaaattaacaaagacagagactggcataggacttgataaactttgaaaaataaattgggaagcttcaaaacaggtgtatgtggcattctaacccatttttcagtttgctttttctttttaaaaaaattcatttatttaaaaagaattttatgcattaaaaaaattgaagtatagttaatttctcatgttgtgtaacccatatttttaaattaagactacctagaagcagaaagagcttgaaatacacacactcccttctgatgaactgagtattttcactcttgcatgtttcatctcctccccacccaagaaagtacattgttggctcactccatcagacctctccttattaggagcctctcttcctgtctgacattacctaactccattgtgtgcccgagtgaaacgcctccgttctgtggaaccaggagtggagtgggtgagacggcaggaggggccctggtttcctcttgaggaaatcaaccttgcagcttgattaccacatttctcactgtggcctgtctcgttctgagttatttatgcgtctattccttcacctggcagggttgtgttgagttgaactgaagtcattagtcctggctggatctgtctctggatcaacggccttccttgtccagagtcactccctgaaagttgatgaaaactcatcgcatcctcaaaacagatgagggaattcttgggccaatgggcttgggagccgagagtgagagaaccaccctccctggaagaaaaatttctgctctagttcagaacacgctggtttcaggatcagccatagccatagcccttttcgcctagatttcttcctgcaagaaatctacccctgtaggcatcctgaccttacgtggatttctcaaacctaatttagatcagggtgtgagtagggaagagagttcaaaagaagaggcccctgaggctttcggaaactttctatttttaggatgtcaactttgatgtttcctggagtcttgagccaagccagccttggaacaaggagccagtgaggaatggggtgaggggcaggctcaaatgccaggtctcgtgccgaccagttgtgtaaccttgtggtctaacttctcagtgcctcagtttccttatctgacatgtgaatataataatagtatgcgtctggtgtgggcttcgtaggtggcacagtggtaaacaacctgcctgccaatgcaggagtctcaggtttgatgcccgggttgggaagatctcctggagaaggaaatggcaacctgctccagtattcttgcctggaaaattccatggacagaggagcctggcaggctacagtccatgggggtctcaaagagtctgacacgactgagcaattgaacatgagcgtccgtctggtaaggttgtcatgaggatcaaatgagttaatacacatcaaaagtttaaaacagtgactgacatcaaagaagcatgtgattttaatctaattgcgtgtatgacgcctagggcttatttgctttcaaagtttttttgacttttccttcaattctaagaggttgatcaaatgctcaaatgcctcttgctcccttgtttctaaggcaaaaagatactaacaagtcacggagtggaaatgaagaaaccaaacaatatagtcccttcacaatagtgtgtgtgggtgcctctgtttttgatgacctaagaacaccttggttctttccctgtctactttgaatttctaaaaaaaaagctaaaacggactctcttctcaaaattatta

SEQ ID NO: 42123 - DNA, 3299 bp, Bovine  19866880592067
gggaggaggggtccaggggacttgtcagagattgtttttagaagctttgatttagagcaataaatgtagcaaagatacattccttcccattttattataaagaataaaaacatgttttatttgtatttgctgtattattgtgtggcttgagagccggcagatggatcatgaggggaagatttaaccaccacctaccagtcaacccttagacaaaaccaccaaagacagatcagtgggagaaaaatcgggaaacctttaccttcaaacccctcaatttttacaacaaataaatatatcagcaccaaacacatgtgtgcttgtgcttctgtgtgaaagtttttataaaacactctgggtcagaccatacgaaattgccttttttggcttggggagtggggcggggggcggctggcaaatgagtcattgtcagcaaatgcagaacctgatatttcctggatttgctgtagaaaaatcactgacctagctgaaaaggttggttttaaagataaaggggacgcagtgctatagactatttcgtcctttcatggaggaaacaaaaacaagccctgctaagcaccaattctattttaccatcattgccacgatggttctattagctgcattaagaagccatcacgtaagatattctgctggtgaatcctttagtgaatgtgggtagatttcagcccttgactaatgaggaagggttcatttgattagacactgtgatcgagtatcagtgtggcttagacgcacactgtatgcggtacaatgtctaactggcacagattctaattccgatgtttttatgtaggctcggcttctctattaaaattcaaagtgttaatttagcggtaatcactccactctctcctctcctctcactgaaaggacaggcccttactgcatgggatataatgtagaaatgcatttagtgctaggccatgattttagacctccagctgttttactggttgtgtaactaaaaataagataatgttgtgctgcgtaaccactgctttcgccggcactcacattttacaaatcactgcacagtatgtaaaccattatattttttaaatgctgaaaattccagcctaggagtcaaacacttccattattttttttaaaaaagagctttctggactgtaaagtggaatgcatcttagataggaaagccactgggctgaggtttacaccatcagagtctttcctgtccatcctcattccggcagcagagctgggaatgagcattcctccccatctgcggtgtagagcaagatcttcaaagaccatcattgtttagtctctaagttgtgtccgactgttttgtggccccatggactgtaacctaccaggctcctctgtccatgggattttccaggcaagagtactggagtgcattcccatttccttctccaggggatcttccctatctagggatcaagcccacatctcctgggaatctcttgcttggcaggcagattctttaccactgagccacctgggaagccccttcaaagatttgtgggttagtttttggttctaaaatgtctgctctgtaaacttacaacttattccaagaatgcaaacctgagaagagtgcactgaataagaacagtggagagaaatagtacgcttctctacacaggattatattaaaaagtaagggtcagaggaaggaactttgctggttcacatcatacagacacataaaaccccatgatctttatacttctgtgatctaatcagaagcccaaagcgtgcacctttaatggaatatttgtttcacatgaaagccttgataagtaaatggagttctacactgcatttttataatagcacctgctttcagaacttcgtattagtattcttaggaattcagaaacattaaaatgtaggaaactcattttttttcctaccaagtgcctcgtgtcctctgatcctgaggactggaagcactccctccccacatcactccctcctgcgcagaccacatttatcacccttatggatgcaaaacgaggtgaagcaggaagggacagtcctgggtcgggctaaaacgtatcttctgttggtttgggatcaggatatttagagctagaggggaaccaaccacccaggaaatggttgtgaatatcccttccaccatggacaaagatgcgtcagaggagaaaacttgatcagcctcatttaggcacagacagcgggcgtggagtgtcagagcctctgagtagacctgaggctttggcacaggcgtggccagtggccagaaggcggtaggcaaaggccttggctgggaggccagacagtcgagcacagccttttctcttgagtcgctgactcaccgagtcccacctttcctgtctagctgacttcggcttaatctgaagggtgcggtgaagactccccgccttaagctggagatttaacctcacttttttttctagggaaagtgaatgacccaaaggatttcgcttgggacttggctgctgttgtgaaatctatattttaggctaaatttataaaactatgctacatatgaagaagttggtttttgattttgctttttaatgccctaaagaaaccacagggcctttgcaagcattttcaaataaagataagttcctaagagcatattctaactctacatgttgcaggtaattttgccaatactgtttcaatatttaagaactagacttttactttattttattagacaatactctaataaatactctattttattagacaatagcccgtgttgatacagtgtcttcacatggttaccaggcccccagacatggctccttcatcagtggccaggggagtttctaggactcagggttctgaaatgagagctctgtttcctggctcattgaaacacatcctgtctgctctctggcccaacctccaaggccccttcctggcttctcgatgtctcagcctggtaacaacatattaatttctttgtttggtaaattctactgttgctggaaagtgaaagtgaagtcactcagtcatgtccaactctttgcgaccccatggactgtagcccaccaggctcctccctccatgggattttccaagcaagagtactggagtgagttgccattgccttctccaggggatcttcccgacccagggatcgaatccgggtctcccgcattccaagaagacgctttaacctctgagccaccagagaagccctagctcacacaaattatgcatgtttgtgctcagctgcttcagtctgactctgcaatcccatgaatgtagcctgccaggcgctctgtcca

SEQ ID NO: 42124 - DNA, 1171 bp, Bovine  19866880592651
atgcttactttattacttcagaaatgtactgtactcctgattcatcgttgtgtttttatttaaaccaatctacaatgtagctcataaacattactggaaatgaatttacattctacaatctattaatctaaccctactcattacatacgtgaaccgataaatggccaataaatcaagccatgtgaaacaataaaacaaattaaccagcatcatttaaataattgccatcccgagcaagcagaacaaagtctcaccaattaacactttaagggtgttctcacgtgaatctcgtccttacacaaatagcactaaacttcagatggattttggaaaccatgtgagaaaaacagtggaaatcaaggttgttggaactggccctgagtttttcctgctcctgtgaatgtttaaatttgaaccatctccaaaggaaggcccgtctgcttagctccagcctcagcatccctgggttactttccctttcccagttttgagggacagggccgcgaaggcccgtgccacgtatcatctcggaaggccattttctggagcaggcgcaccttgcagcagggaggaccaccggatctccaggcaggtgttgtagccttgctggttatttcccagctgggtgaattaaacttctgtaggcctcgatttcttcatctgtaaaactgagatactgatgggatttgcctgaagaagaccaaatgtgtaatgtatggaaggcacttcgcagcggctatcgtggtgttcagttaacgactgacgctactactgctgtaagtccttctgccactttgcgcttgcactcagtcgctaagtcgtctgactccctgagaccccagggactgcagcctgccaggctcctttgtccatggtatttcccaggcaagaataccggagggggttgccatttccttttccaggggatcctcccggcccaggcatcgaacctctgtctcctgcattggaaagcagattcctgagccctgagccacccaggaagcctttactcaagggtatactcccttcctttccctactgcattttttttttttttacattctgctttgttcttgggacttaggagtacttgtggagtctgtgtgtgtctgctttttgatattgtgatgtatgtctatattgatacctagaaatagaaagggaatcaatt

SEQ ID NO: 42125 - DNA, 1834 bp, Bovine  19866880649072
ttgttcccacaaggctgcttttaaagataaattgctttggtaaactgaaataattcagctccaaagaaagatggccatgccgttttctactcggcacacaggaaaggaagatgcagattttcagggccgtcttcagaaatagagccagttttaataggatcccaaccagtgcactaattaaatatttcacagctcccaaagttaatgtgctaatattgggattctttttccaccaaatcagacaaattggccttctgtaacaccatcccccaccccagcgacccctcccatacacacacacacacacacactcacacacacacacacacacacacactcccagccacaaactcctaccgaatggttttctgaatggcattacaaagaattttgttaaagaaaagtcagactaattgctgccagaagacccgtctcatagagaagtctggttttcataagccagattcagtaagggttgtggttaaatctaaacctagtagaaggttcttaaggttttctcggcaaaggggagaaatacaaaggaacacaaagttcagccaaaatattccatgaggagggaggggaaggtagggaggaaaagggattcaggaggatgctctgaactcctgtttccttcttgaaggaactcttcttgctaccttttcttaggactttctccatacttattaacacccactgagatagtttctctaagtagctgtagctctgcactcagaccagtgacttaactctcttgacttccaagggctgggaggaatttcccaaccccaccattatctgagccacctctctgctccaggcttctccctcagacctcctggtagagttagtagcaaaaagccccttcagaaacaagcaggcggattcttctccgtctaagccatgtcgctgagggacacacggcttttctggagcctcaaggggcatgaccagtccaagcatccctgtcagctctccccggctttcctgaactaacccagcaagatgcttctcagccttgaaacagagctagacagcagtggtgtcagtgctgttgggtgagatcaatatctcttcacgtgaaaataaaatgaaaagtccccctaagaatggtctccttattaaaggattggtttaattttagatttctctcatcagaactttattctgttgttcctggaacttttttaggcggagtccccgggggatgattagaagccccctgcaattcatcatttccccataatcagtctccctcatcccacgttgtttcaggagccacccgcttatgtctcataatgtaagaggagaaacccacccagttcccaaccttcgagcttaatgggaatcttcaagaccattttaacttggagaaatagcctcaaggttagaactcttcactaccatattccctaatattccagaaaacacattcttttctggagcccattcaactgaccatggagggagtgatgagaaattgagagattatgtaacaactatgtttattgagcctggtcttccccactggagggttcttacagtccctgccatcatggtttttaacttctctctcctttccaagatgactacttcctttctgaattcccctctggccccctcgccacccccaacctcaccatagagatgaaaagagaattggaggaagacttgatgttactgtgcatttcttttgttttataactacaaaaagatcataatgtatgcaattgaataaaaactgaaaactcactctctttttccctctgacgatcctcatggtttaaattttgaaagatttccaccatcctttagtgtttcatattcataacaa

SEQ ID NO: 42126 - DNA, 2126 bp, Bovine  19866880696974
ttcccatccaccccaccctgacgcggcatatttgagaatggaggctaccgggtacacccaggattgtgctgggagggtcgagggaccctcccggtcacgggaaacaagctggggtgagtgtcgcagcctgtggggtgactagcaggaaatggcatgcgaagcgcatcatttcgacttttttttttttaatgcatccccccatttcgacttttgacgcttactcattctccgaatgaccgccgcaagggggagggggtcggggagagaaaaaccttgtgaaatggaagaaaagagacgtgagaaactaaagcctcaggcggcgtgggaggggtggggggaaagaatgaccggagttgtagtgaaaccggcagctacggcgagccgggaagccgctggaaagggaagaggctgggcttaaagaacctgctgcgggttgtagacaaaggcggcttgggaggcagaggccggggcgggatccgtcgctactatcaccctggggagagcgccagcggctggactcccgcgtggaaacccgggaaattcaccagccctcccttcagggcaggaatgcccggagtatgcaccaagctaagaacccagagggaaaaagtaagtttgggagaggacttaaccgatcttgacggtctttgaaccctcaactcctcttggaggcatgccttcaccgatgcgttccctcttcatcatttctgtctcttgtgtcatcgttttcatcgtgttttgtgtgttcaactttgggggagagcaaggcttccagaggctaaataactcagacacttgggtgctgactcaggtttgcacatcccttatcaaagacaaaacaccgttactttggagaaacaaactcatgatgtatgagaagtcttcctgcgaggcgtacctgacccaaagccactacatcacggcacccttatcaaaggaagaagccgagtttcgtttggcatatatcatggtcatccatcacaacttcgacacctttgcgaggctcttcagggctatttacatgcctcagaatgtctactgtgttcatgtggatgagaaagcgacagttgaatttaaagactcagtggagcagttactgagctgcttcccaaatgcttttctggcttccaagatggagcccgtggtctatggtgggatttccaggctccaggctgacctgaactgcatgaaagatcttgcagcctcggaggttccctggaaatacgccctcaacacctgtgggcaagatttccccctgaaaaccaacagggagatcgttcagtatctgaagggatttaaagggaaaaacatcacccccggggtgctgcccccagctcacgcagttgggcggactaagtatgtccaccgggagcacctaggcaaagagctttcctatgtgataagaaccacagccttgaagccgcctcctccccacaatctcaccatctactttggctctgcctatgtggccctgtccagagagtttaccaactttgttctccacgacccacgggcccttgacttgctccagtggtccaaagacaccttcagtccggatgaacatttctgggtgacgctcaataggattccaggtatgtgggattccctacttcacgtgaaggcgacattctgtacttgaaagggctttttgagagcctgcacctttttgattaggagataaaagctgaagtatgtggttttcacctgaattctttctaaaccctgaaagaattgatgttctttaggtgacaattcagtagtctaaccaagccaaacattggtggtattgatctgcagttggtcttgttctcttgcatttagcatcttattaaatctttaccgaagtcaggatgaattgcaccccatccccgctggtgattttcttctccccagatttgtcagacttgctgtaaccccagggccattggcttggccactcccctgcccattcgtagattcccccttatcagccagatgtcatcaactctgagaagctgaactgatcatccctctcttttccttcagagatttttatcatcttctggaattattaaatctacttttttgaatgcgtttgtttttggccttcttcgcattatctccatgaagcaggtcattttctattt

SEQ ID NO: 42127 - DNA, 2658 bp, Bovine  19866880857152
ttccagatgggagaggatactcctccagcgccaggccacaacacctgtcagctgtcagggcattgtgtgctctggctgcagcagccagccagcctgttacctgatggtgatcacacacagaggcaccgggtgctggtgaagcctgcggggagaccatcaagacagcaaaagcgccttaggttccctctgtcagcatctaccacccgtgactctaaggccagccccgatcacaaagaagtatgtgttgaagacgctgttgtttagtggctaagttgtgtctgactcttttacgacccatggactgtagactgccaggcttctctccaggcaaaaatactggagtgggttgcccatttccttcttccaagggatattcctgacccagggatcaaactcatgtctcctgcattggcaggtggattctttaccactgaagacgagaagaggccaaaaaccctaacagtgacttgtttacataaccatgattttttcaaaactttctctactaaatcttcagtgggaccctatttcctctttctggaaatggagcagccctgaggcaatactgaggccaacactgctgctgaaatactcttggctttatgagtcaacgagagagggttttctttggaaatttttctttaaaggaaaccattgatcaggatggagggcacatatgtatacctatggctgattcatactgatgtagggcaaaaaccatcacaatattgtgaagttattatttgccaactaaaataactaaataaatttaaaaaataaagtacacactaggcaacaaaggtttactgtatagcacagggaactatagtcaatttcttgtaataacctataatggaaagtaatttttaaaataatataagtgtatatgtataactgaatcaccttgctgtgtacctgaaacattgtaagtcaactatacttcaataaaatattaattaaaaaataaaatagaccattgaaaagtctgcttcactttagtgagtgaatcacaaaaggagcagaatatcacttagggctggatgctgtgctgtgctcagttgtgtctgactctttgccaccccacggagtgtaaccaccagtcgcttctgtccatgggatttcccaggcaagaatactggagtgggttgccattgacttctttagggggtctttccaacccagggatagaacccacttttgacttgatccaaagtcatggacttgattctgcgtatctcaaaggtaatggattacttaagcagagcacaatgagttcgggagaatatctaatttggaaaggatggtactcaaccatgctcaaaaggaatgttttgtgtttttttgtgttttttttcccccataacattctgactttgggctttgcaaccaaaacctccaatatgagatatgaaagtaatctatcaaaagattgctgctaagtcacttcagtcgtgtccgactctgtgtgaccccataggtggcagccccccaggcccccccgtcccagggattctccaggcaagaacactggagtgggttgccatttccttctccaatgcaggaaagtgaaaagtcaaagtgaagtcgctcagtcgtgtccgactcttcgcgaccccatggactgcagcccaccaggctcctccatccatgagattttccaggcaagagtactggagtggggtgccattgccttctccgaaaagcaggttagaaagtttaaatgccaacagccagaacatttctatctataaccaaatagtaagtacacttaggtatcttatcagttttgtgattgcatttttcacacatttatcatattctgaataagcaatttctccttcctcagaaaagaattctgaattgcaacacaagtttctgttgtccctgcccctttggtaaagagtagttacacaagtggccttttctctaatgctcatataataggggtcttgatgctaataataggcactctctcaggtacctgggttaaagaccaaatcctcttcataatcctctgaaggagtttctcaaaatcagagagaatagcttcactttaaaatataccacttgtaatgaaaaaagaaagttctggatacgtaaaccaaatccacctcttctttcatttaactgaggtagtggacatgaaataacgaaattccaaatcaacaaaagaattggcatgaagttttgggacctattttatttatttcacagtcattttttttaatcacttttgtttctttcattttttttatttttgactatcctgggtctgcatcgctttctgccagggctttctcgggttgcgcccagcggggtctattcttcctggcgacagcttctctagctgtgacggaccagctctagggcaagcgggcttcagtcgctgcagcacgtgggcccggttgctcgcagcacgtgggaatctccccggactggggactgaacccctgccccctgcactgcaggcagcttcctgtcccttgcaccaccagggaagtcgttggaacctattttaaaagatttgaagtctagggtaaatatgagcagctactcacagggcagaaagttacagaggagaatctcccagcttcatgactggacatcgaaccaacaaggaaaaaagaagaacaggaaaccatttaagatttattaaag

SEQ ID NO: 42128 - DNA, 1587 bp, Bovine  19866880899483
cagactctgcagttgtccctcggtgtattagtgctttttgaagcactagactcctccagagagaatgtcagccccagccctgggcagttttgacaaacagagtatatattgatacatgataaagtatgctagaaatcaccccagcgctaagggctactatagttttaatatcatcatttgaattaacaagcattctgtggagaaataatgagctttcattattcagaacatcatccttacccggggaactcagaaaccattagctcttgagaacttaatgaaaagatgataaagaatgttttagataaaagtttgaacgagcacacttgataaccgaggtaaaatattaatgtttgcttggatgatgtattggggtggctgagctgggctcagtgaagccacaatgccaagtgtgtgatgagcctgtgggactgctggaccagcccaaggctgggcgccggagctgtcatgcccagcgtcacctcgctgacagcgtggccaggtttcttttagacttacagacaagaggggattctggtggttaggaaaaagaaggaatattgctaaagtgtgatcaacaggtattgatggacagattcagaaatggcttatcaagtaatttttttttattggagtaaaattgctttataatgctgtgttagtttctgctgtacaacaagtgaatcagctgtatgaatacattatatcccctccctcgtagacctccccccacgcccctcatcccatccacctaggtggtcacagagcaccacgctgagctccttgtgctatacagcagcctcccactaaccatctatttttttttaggtctctgatgttttaaatatagataaaatactagagtctatatggtcaatattttgtttctcatgtcttagtgtgattaaaagactaggaaattttaggttagcctttcagttctgcattttaaaataaatctgcattgggaagaggaagaaaaaagaagtgaaaaacaagcaaaaaaagggattgtatctttaacacttggatatcaacgtgaatggtctctgaactggcagatggaacttgatcaatgtagacatgaaataagaataaagcttacagttgggctcttggaaaatgtagaaggtagaatacaaaaaagtgccattcacttgttcactgtacaaagatcacccctggtaatacttttagcctttttttttgcagggtttagattatttacatggcagcgaccatgtagcatatgcagaattatgtatgttgtcatttttagagacagtttctggttataaaaataatacagaattatctaaaactggaagatactggagattattaaaacttttgtccatgaagatcaccctggagagcttattaaaaggcacagtctcctggaccccacctcagaactactgaataaaatatccagcgaagaggcagtctcaggggtagaactgtccaggttagactcttttggtctcatcacttagcagtacgttgccttgagcgtatttttccacctcttgaagctgcagttctctcatttataagttaaggctaaaaagagtacataccttaagg

SEQ ID NO: 42129 - DNA, 1152 bp, Bovine  19866880902066
ctattttcgctaatttgtgttattgggcgatcagaaatccttacttaagggattagccactgttgtactgttttactccagtgttccaagaattccttcagagattaagaacaaatcccttggaaaaatgatccaattttttttagtccaaaattacttcccgggacaccagtgcaaaacatcagaaatgagctaatcccttaagaaagggatatttgataactcaatagcacaaattaattgtgagaatgctcagggaatccaaatgcattataattaatttaattcttgagaaatacgttgaataatgtagttaatccccataaatgtaacctagtggagggaaggtgggagttgccgctcttgcccgtctttgatttgataagccaacgatcagcctgaagttcgagaagcgtgtttcattctgcagctctgcactctacacttccacacggaacagactgtgaaagcgtgtaaactacatagaaatgagacgaataacatttttgttgtaggaatagatggaaacaggtatggacttacggctgttattactcaagttagtcatctctcgtgcaggagaatatctatgttcttttcttctctctctcttcttggtttctctttttttgacggcactgggttttcatagcctggcatgagcttcctctagttgaggtgggggtttagttgcctcatggcatatgggatgttaattccccacctaggagtcaaacctgagtcccctacattggaaggcagattctcaatcattgggccaccagggaagtcccaaattctgttcttctgataaaggcaaagcgccataccatcagatcagatcagatcagtcgttcagtcgtgtccgactctttgcgaccccatgaatcacagcacgccaggcctccctgtccaacaccaactcccggagttcactgagactcacgtccatcgagtcataccatagagggaaaaataaaagtctgttcggtgaacacatttgaagctgaaggcatatattggctttcatgaacttaatgactcattttattctttccccaagaggtccagagttacaaaagcattatattttaagttgggaattcctcattacagaaatgttttatgtactactgcattcagattaagctt

SEQ ID NO: 42130 - DNA, 1343 bp, Bovine  19866881090605
cggcaaacatggcgggggaggaggaccccgccggccaatcagcacgtgccctgggttcggatgcggatcgctcctgacgtctgctgctgggccgtggggggtgtgacccgagttcattgcccctcgagctgtagttttctggtggtgttcttttgcaactaaatatttcaaccaggctttcagtgggtccttccagatctgtcatctacactatttttactaatagctgactgtggatagattggcatttccgtgagttgcctgtttgctccagaaacctgctcaacttgtctccagcggcagaacaagagttttgttctctgaacctgtcacttaactataggtttatgaacagaaagttgaaggcacccaaaccccaaggttcttccctgcccagtgctgtgtgctatgcttagctgctcagtcgtgtccgactccttgtgaccccctggactgtagcccaccaggctcctctgtccgtggcgattcacccacctctgattccaattcccactcttgttaaacctgcttgtgtccgtagctgtatgtgtctggtcttttatgttaagaaaatatgcatacatgcaaaggagaacagccgttgagcttaagtgttcctgattatttgcaacatattgttcagccagattaaactttttcatctttttctattgcatttctttatctgtctttatctactggatgtaatcacaaccaaattgtgctatggaaagaaacacattccataatttgggcttattaaatttcccatcatcttccttttatgtttctttcaacagacattttatcatcccagaagatctaagacattttcccatgtaaatatacatctaaatcaccaaattcttcattctcgtttcttctcactcagtgcatcgattctttttccttttcactttataaaattgtaaataaatagccaattaaatgttaaatcactgcactgattgtattctacttgtttagtgataaacttctcacatatttacttagtgtgtcattataagtttccttcttgcctgataatactttgaacattgggccatatgctttgttaaagatagactttgagtttgtttctgagagaattctcactacgaaatccatctctagtaatggtctctaaaatgctgtttagcactctgattttctctcattatttccattggcttaacaggtagtcaaagatgctttcctctgttgctgtattaaagacccattacaaattaataatgagaggagcagcaaatttccccctaatattttctcagtcttccactgattgaacacgattctgcgcatacaccaattccattaaaaag

SEQ ID NO: 42131 - DNA, 833 bp, Bovine  19866881149475
tgctgctgctgctaagttgcttcagtcgtgtccgaccctgtgtgaccccagagatgggagcccaccaggctcccccgtccctgggattctccaggcaagaacactggagtgggttgccaccaccaggctcccccgtccctgggattctccaggcaagaacactggagtgggttgccatttccttctccaatgcatgaaagtgaaaactgaaagggaaatcactcagtcgtgtcccactcttagcgaccccatggactgcagcccaccaggctcctccctccatgagattttccaggcaagagtactggaatggggtgccattgccttctccgaataagacagtagagctgccactaaaaagcaagctgactaatcgctttccaggcatttatttatttttcccaaataatttcaaagaagagctgaatgttagcaaactcaatctatggataagtgaaaaaaaaaaaaaaaaacaggaatggaagttcatacccacctgggatcctattaagagtcacccagaaatgttcatcgggagaataggtatctttggaccactggagcagatcaatggcccttcggtcttggaagacaaacttcacaaactctctggtgagggccacgtaggcagtgccaaagtagatggtcaaccggtggggaggtgaggttttcaaaataccggtatttttcataaaagagccacctctgcccaagtgctcccggtagacatatcgagtccgctttactgcatggtcaggaggcagcaccccggggggtgatgtttttccctttaaatcctttgagatgctgaacgatctccctgttggttttca

SEQ ID NO: 42132 - DNA, 1055 bp, Bovine  19866881196208
tctaaccagggctggtcatttcccaatctcattttccccgttgagttggcatgagaggcatgagcaaggcaggaagcggtcctgcctgttatttggtttttattaccttctgcatatacagagaggtccctggtgtccctttccatatctaagttcaacattttgggcacagaacccaaattcagtaacacgcagttatggaataaacaaggaaatgaatcacaacggcttggatgaagtcagagctctggagccaaggcacccacagagcgcccacatttacaggcatggtcgatggtgctgctgattttatttaaagctggggaatgctggactcaggctgcagcagagagaggccgtttcaaggtaaatgcatcttttgcaacttaagctggtgctgtttgtaagcctggggttggagagccttgtgcaaaatactttccaaccaggcccataattcccaacaagatcagatccaccagccagggacactggcgagaactttacggccgccctggttcatcagcgctgcagtagacatctggaatgccagagtgtgaacctgagctgatggagaaagaaaaaggcccctgggaggcataatttcctcctccatccaactatgcttaactttcctctgcattccgagggcttcccacgtggcttacgtagtaaagaatccacctgccaacgcagaagacacaggagacatgggttcaatccctgggtcgggaagatcccctggagtaggaaatggcaacccgctccaatattcttgcctggaaaattgccaggacagggggagcctcgcaggctacagtccatggggtcgcaaacagacacgactgagcactgaacaggcctctgccctccaaaagcacacaaactctactgccttgaatcagagtttgaggatgccagcctgcttcttttccttctcaatgaaatgtcccagatagccaggccctgcactgtcatgagatgacatctgccacacaaaaacaccagttcatcatccctccctcctcattctgtcatttcatggcagaagtgtc

SEQ ID NO: 42133 - DNA, 936 bp, Bovine  19866881261166
ccgagccggcctcggtgcgcagtcgggccgcggggacttcggcacatctccgcccggccgcaggcgacgcttccatccccccagccgccacccctcccccctttccctcacccaccctcctggcctgggccccctggggcgaaccatcaggcgcgcgggagccacggcagagggccggggggcggggggcagccctgccggaaagagggacctcccgtggggccgggaagcggggtattcagcagcaatcgcgaaaggccttggttagggaggcgctcggtcccaagctgggcccaataacccgcctgtgggccccggggaaagaagtcaaaagtcctaggcggccttgacgcttgggggaataaagcggagaccccaagacgctgcggcctgagggcgcagccaagtgaccccggagccaggtgacagatgctgggggaaatgaacacgtgagcaccgccttgttgtgctctaagggtaaaaatgggaaacagtggttcaaactcaagcatctgtgtgtctaccttgatgcaaaaacaataccctactctccaggaaatcgattatttggtccgtgagatgtttttctgccagacggctcccaaatcagatctgatgaaggaaggcctctaagagcggtcagcaggtgacccggacaggggcaggggcgacccggctgtccggcctcgggagaggcggtcgcagggcccggtgtggaccgggtcccggagcttctcggatttgctgagtcagctgccggcgccgcggctttggctgttttcaaccctggcgactgtgcttcgctgactggtgtgtgtgacttggtggtgtaattattggttttgttttctaatatgtaattactctttgtcgtcgctattatgaatccgccgagcctgattcgagcagcgaaatggatgcaagttttgggggtta

SEQ ID NO: 42134 - DNA, 1045 bp, Bovine  19866881631009
aaacggtcacctgctgaaacaccctcaggggcctttcaggaagatcaactgcatatgaaacaagtatttcctgccgccctgccattttgtggattctgtcagataaaatacagagactcttttttttccccccatctgcatgatatcctttggtagttgtcgcctccataatagggagctcttgaaaggaccaaggaagatgagaaagcaggtctggacctctctttggagatgctctgcggtcttgagcaatttggtgaaagaagaggggcaagtcagaagacagggggagagaggaactgcagcggccctgctccgaatatagaaaccttggtttgctctctggatctgatttggcctgagaatgcaggcatcggataaaaataacaagtcacccagtagaggacggatctccggcttcgcccctgcccggggctgcgcatgcccagtacgcgcctcttcggtggagaagcgccccgccgcatcccccagcagaaggcccgagtgagaaagggcctgtgtttgatgtatgagctccggctcgccatcgtgagtcaccccagaactagctgcaggcaaaacaaaaatcttttgtgattaattagaaaaactggacaattatgaattgactgcacacagccagggtatggtaatataaatagtaatgactctggcagagccggccgaaagctccatgtttgtgtgagctcactggaggagggcacatttttaaacagggaatctgctgaaacaggacaattcctgatttttgacgatctgagggtcttggtggagatttcagctgacaccttggaaagggattccagttgaccactctccgacgcgcctccaaacattggcctctgtgccaaatcgattgttcttttctttctttttttaaaagaccccagacatatccttttcagcagctctgtgaaaccgctcacatcttttgctaacctccctgccagcgcacgtcctttgccttcttggggtacttgcttccactcttccactctctgaggaaggaacacagataccgttt

SEQ ID NO: 42135 - DNA, 1058 bp, Bovine  19866881888778
aggaggttacaaaccagaacagcttgctggcgtataataaagatggaaagtggcctttgagagcatggctcttcatcctctttgatcatatcttcatcacctttgatcatatttcctcttgtgactgacaggtgtcagctgtcaggcagccaaatttatctgaaaaatgtggctgagcgttttttagaagaagcgtttttaagaagctgaattcaagtctgtggctcaatatgttttagacagttttttctcctgtttttgctgcccccttctcacaaaggtgcaaggaaggctcccaaacattccccgcccacattcctgctacctcccaggcaaaataaatattacacatcttctcatttcatactggtgcatgtccgtgaactgcttaaccagagctttgattccagtctacgcttttctgtgttccttcgagttgaatcattcctgggttaacaaacagtaatgatttagagacatttagaacaaggacttcatttgcctcatgtaaatacttcgctgttttttggcgctaaattgtgtctgactctttgccaccccatggactgcagcataccacgctcctctgtcctccattatctcccagaatttgctcaaattccatcgagtcggtgatgctatctaaacatcttatcctctgccacccccttctgattttgccttcaatcttttccagcatcagggtcttttccgatgagtcagctcttcacatcaagtggccaaagtactgcagcttcaacttcagcatcagttcttccaatgaatattcagggttgatttccctttagggctgactggtttcatctccaagtatcaattcttcgggtgttcagccttctttacagtccacagctataactctcacagccagatgtgactactggaaaaaacatagctttgaccatataaatactacatgatcaaaaaaaagtgtgtgcgtgtgtgtgtgtgtgtgtgtaagattattaaggaaatatgagaagtttgatctacatgagcaaggcagcacttttttcatgatgccttgatggtttctt

SEQ ID NO: 42136 - DNA, 2153 bp, Bovine  19866880279966
tccatcctaaaggagatcagtctgggtgttcattggaaggactgatgttgaagctgaaactccaatactttggccacctggtgcaaagagctgactcatttgaaaagaccctgatgctgggaaagattgaaggcaggaggagaaggggacgacagaggatgagatggttggatggcatcactaactcgatggacatgggtttgggtagactccgggagttggtgatggacggggaggcctggcatgctgcagttcatggggttgcaaagagttggacacgactgagcgactgaactgaacatgtgtagatgtgacttactcgaagttaatgtgtctgagtttccttctcaggaaagtggagaggacgataatatccccatgtacctcactgaatgcactgatagttttgggggcctcggacagaacgcagggttgagatcttgggaacatgcatcaaggcatggaagaggaggacacccatgaggcaagcaggaagcaaccatgctcttctcatccctcacatgcctcttaatctgctttgccagctacttctttcctgcgtgaaatctcaggctggtcctcagaacttttccgaccattggaattatatagtcttctcatcacttctcaaaataataacagtcttatttgagaaattacagcgcccagtcctacatggtcaagtgccaaacttcatttagaaggacagcgtctctctttccccactttatcctggcttcaaagtgaatttgtaacttctgctaagaaggttgatgaggggcaagaatcgtgaaactgactttcaccacctcctttgaaggacacactgtcctcaccggggccactgtgactgtgtgacattaagcaggctgtcccctcccgggcctcgtgcttctcatcattggaccgaaggaggatgactgcacatgggagactgaggtgtgagagacatccctgcgggccccggcgtagacagagcgcccagtgaatcaccattgctgtttccccgttactttttttttagactgacagtcttgttgcaattgtgtaagaacaggctgcaatgcatttggcagattgagagtcacctgcagccaaagctcgggttgtgcaggctgccgagggctcagggccctgccctgcatggtgaagagaaaactgagaggtcaagttctaacccaggtgggaaggctggtccctcgggcagtctgactcccttgccttgctctcaggaaggcaaagggcatcatttccccgtgttgccgcagtctccttggtgagaggctggggaaggtttacgaaattcccagggaaggacaggacctccctgatgagcaccccctacctcccaccccgctgattgttgttctcttccagccacttcccagccctggccaccctgaccgcctacgaatcaggctgtgtgttcccataacctgccagcagtacatcaaaattacacgctgtaactgttaccctatacatataatgtgattatgcatattaactatgtttaatatgaactggaaaagaccctgatgctggggaagattgagggcaggagaagaaggggaccacagaggacgagatggttggatggcatcatcgactcaatggacatgggtttgagcaaactccaggagatggtgaaggacagggaagcctggcatgctgcagtccgtggggtcacagagagtcagacacgattgagcgaatgaacaacaatctgagtcgtctaaagaaaagtgaagatttggagtctggctggataccctttccatgggctcttcctgtggacaactctgtctcatgaatcatattccatccagaacctatctcctcccctgtatcctctctcaagttgttgtctgcaaggaggcatggatcttagctatttgaaactacccaattaatgaagaatgttggactctactcaacactaaatctactttataactttttgatgttttttatctggtgtctcaaacttctttaaaaggaaaagaatttcaaccttgaaaatggcatcagtaactactgaggacttttcttgagaacacaaagccacctcttattcataattagtttttcccagacccctgcccataccacctatgcaaaatcacttgaagacaaatggtattattcattat

SEQ ID NO: 42137 - DNA, 1382 bp, Bovine  19866880591663
tcataactttccttccaaggagtaagcgtcttttaatttcatggctgcagtcaccatctgcagtgattttggagctcagaaaaagaaataataaacatgatcacctctgctctacaggtggcctcagtcccaccccagcaggtggaggagctgaacccagtgtggggccaaggtcacctcagggggcactgtcgatgcgttgtccagacatcaaaccttgcttccacacctgtgaaatgtgggagaccgcctcagagcccctccagacaacatccagggaccctctggagggaggtccctgcaactccagatcctcatgaaataaggaagcactccagctcccttcagtttgaaacccgaagtctttagcaaaagcttatttaaaaaatgatgcttgagaactttactgaaggactagcaaaatgattgttccaaaggactttaaaaaatcattattgttcttataaaatcagcttataatactagaagccccatgttttttatttgcttttctgcacagctggaaggtaaaacagacatcttctaattatatacctatcataagaggttggtaaaagggattctttttccactgatgtactttttaccactgaacaatttttttttgagaaattttctatctccgtttcactgtagagattgtctcacaggaggtctagttaacagctttatttgtggaaaaccacagcgctcttgtaagtcagtactttgtgctttgggggttttcaatgaatcgaattcagggtttttttcccattgcgctactttatatttaaaagttcttccacaagtttggtagagaaagcaaaaggcctgagaaagattggtctgaggcattgctgataaaggagaagttgctagaaaattcctgcatgactacatcttcctgctacaggggctgaaagaatagtggaaagcttggtgtttctatggtccttccccgtgacacctccaacgtgccttgtctgtctgcttctcgcatataagagcatccctgtagatattagaggttaaagaaatcacactgacagaggagagattcaaagggcacctgctgcaggtgtggggagggagcaggcttcttcacctgcagaccaggtgagatgggaccgcagaaggagagggagcctgggggcccccgagcatcacaagctgtgcaggtgttctgctgggcagggactcagtcacatcgcgataggagcttctggaacgacttgtagctgggaggccacccaagttgcacctggacccacgctgacacctgagagctgggggccgctgtggcaccaggagctggtcagggcatgctgcagtgcagactgggggtctcggtgccgcgaagggtctgggtcctaaaggag

SEQ ID NO: 42138 - DNA, 2323 bp, Bovine  19866880710622
aggttatttacacaaaaacatctcttctatctggggtcaagatacagaagaaaagttaactcacttcctagtctttatatagagaaaagatatatgtgtatatatcattcccaaggcttcttacagccttcgtgctttacttgtcatctgtaattctcacaataatcttatacattcatcagttttatcccatttcacagagaaattggggatgagaaggtcgcataacttgttgttggctctctgtctaaccctggaggcgggtggcacaataccctttgattgacaggcaaatgcaccaatgagctgtgtcccaaggaagaccacttgttgatagtagtgtagcctactctatctgaatctgaaaatttcaacattatttctaaaatgagactttttccacttggttacctcgacctttcctagagaaactgtgtttgtgtgtgtggtcttattttctataatcactcaagtgaatgtttgttcaagaccagaaaagcctaatgacccggcgctaagcttctctcaggtttaacttcatatttttttttatttgattcccaaacagaatcatgtaaattaggtagaaaacatgtttcctgggcactttccccggaaacttttattcagtataaaacagtataggagactgccttatgaagcaaaaggagttttcaaaaccgaacttagaagcatttattctcattctgtatacctgcataacaagaaatgcaggctgaagataagcaacaccagatggatctataagaaggaaaaactgcactagaaattatattatatgccactataaagagttataattttattttagctcatttgagacatgactgtttaaagctaatattacagcaagtatatggggataatgtcatatgtagttgtaatatataatgtcaacagcacaaaggatgggggaagaaaactacactgttgtacatttcttatttattatgtaaaatactataatactaactctaagcaaaatgttcatagagatgcattgtaacctttagcgagcatgcatgttaagtcgcttcagtcatgtctgactctatgtgacactatggactgtagcccaccaggctcctctgtccatgggattctccaggcaagaatacgggagtgggttgcctcgccattctccaggggatcttcccgacccagagactgaacccgtgtctcttatgtctcctgcactgacaggcaggttctttaccattagcaccacctgggaagccccgtaatctctagaatagccactaataaatgatgcaaagtgctatagtcaaaaagccaactgaagagttacataaccccaaacaagatgtattttaatagaaattcacagactgcttccaaaatgtataaggaaatgcaaaaaagccaagcagttataaaaaatcttggggaaaaaaaggaacaaacttgattctcacactacttgacttaaagtattattactgactctctaataaaattataatttgcctctgcttctgaaggataacttagagaaaaaaatcataacaaccaagataaagtttctttccaattgacccactcagcctgttttcacacgatcgagacctttagcacaaaaagaagtagatacaattataaggaagaaagaactgaagggaagatacaaatatcttcccttcaatacaaatctattgtctccagctacttgtaagaaaataaactatatgaatgttcgagttaaggagaaacagaaggaattccataaaatacatgtgaacacgggaagagaaatggattgtttggacagaattatctaaatttctcatgcaaaaagaatttaccaagcccatacatttgataaattcatggattcttcaaatactgaggaagatccatgtgcataattccaaattatttgtcctgagattgtattatactggttttgtagcacatttactatcaaaatgaagctccgttcaagctaataggaaagttttcttgcaatattccaaaacaaaaacctcagatgattaaacttcaggctggggtgaacattgtgctgtgcagagtccacagaagcggtctgcatgtgcagagctagaacatgattataatttattttctcaagacacagagtctcagatggaaattttgtgcagtctcacttatacatgtttggaatattatgtattatcatgctgttccaccaataaattcaagtattaataagtacaaaaaaaagaacaaataaaacacaaagattaattcactacccaagactgagggtaaatcaaggcctaagccttttcttagcatgagg

SEQ ID NO: 42139 - DNA, 714 bp, Bovine  19866880808278
atgggaaccaggactgtcctcaagcccagttttgtcagttttgaaatctcgaatctcagatgccccaagtcacacagctcattcagaagatgggaagacatggctctccccacacccctcaccgcagcgtcacttggaaggaacatccctttggagaagccctttctcacctgggcagcctcctaccatccagtgaatctgcgtggccttgcctttctatcctcagataacaaaattcataaccttactctgtggttgactgcaagtaagaagcgagtacaacaaagcacaagcctataaacaggtgagtgactgactgtgacgaccatgggagacattccatttaaggatccaggaactagtaagggttcaaagattcttgagacctttgttatcaggaccccgtggaatcgctttcagatgtgggaataaaaattgtaaatacctttaagagtgccctggggatttttgacataaagaaaatcatcccaactttcaagactaagtctgtttaaattgatacatatgtgttaagctctgggttctggtctagaaattgaaaacgacctcagttatgcctgtaaagtttttaccatgaccgttactgtgagccattcaaagttctaagatttcagcatctccttatctattgagtttggggtttaagagtgaaattggcttttgcaaaggcagtagagaacacagtgctttctt

SEQ ID NO: 42140 - DNA, 1582 bp, Bovine  19866880823702
tgttatgaagcagcaagcggcaggcaatagagagaatgtctttagaaaaaaagggccctgatgctcaccaaaaatctgtgcaggagtcattcctaatgctttcccccctctcggcaatatgaatgcagacctggaagcctttctcttgcggagtgagcagggtaatttaacgagctgtttagaattatcagatgcctttgaaatttccaaatattctattcctgaaaatagcacatgaaatggcccaggtatttttcttttctcctcccccaggcactctccctactgtgccattatcttcggctgtgatttactccggctctcccaaacagacaactgtctgcacgatgcagagatggggccagcacccaagcagtccccacttcttggaaattgaagggcagccatcactcacccgagttactcctaatgaaggaaatgtatgcatcttggaacacgtgaccggatggcagtaaacgaaacagcacagggagctagccacccagcggccagagacaagcgtgcttgccatttttctgagacttgtcagaataggaatgactccatccaggagaggtaatggatgtgaaaatgggagatggagccgtgggagtggaaagccgcatcactgctttatttccacgcctgtgggttttactctgtaatccaagaccatgttcatgggaaaggtgtgtgccggccgtttttcggccagggccaccactttgcacacgtccaagactgctttttgcatcagggtacccttgatcatcagggtgcctttgccttttgcatcagtgtgccagcctccccagcccccacccccagagtgctcgcctggcactgcctcatctgagtggccctgctgcaaatccaccctgaaccaaagctgttagagacctgcaaaatcctgctcccgtttctgcacttttcctgagattggtgttgtgcgtcccctgtacccacgctgtgggcttggtttgtaatatggcatcgagggacctaccagggcccccacctgggaccaaaggtcatcctgctctgcgtgcatgctttgcttctcttctcacgtaaatggtggctttattggagagcaacagtctaagctctatgttgctcttttaggacaaatttcttattgtcacattgtcactattatcgtataagaaaatatcaattgaggaaaagctctgtagttatttcgaaatagctctcccaatgtaaggagtctcccttacatggatttttttatccctcaatacttataagatcatctttcattactaaaaacgctccagggctcagtggtcacctcgtcctgccccattgtctggttcagggtgtcaagtgtaattcctccaggtctctaaattagaccaaggctgacctggtgtctctggattatatcacactgtctcaaaactctcggatcaggttttgatggaagaaataattgtttaggggttgatcttcaaggacaatagtttaatttaacagagaccttcagaaactttacagagcagtcctccaacctggcttgggtcaggccctccgatttgcaggtttagattttccagggtcc

SEQ ID NO: 42141 - DNA, 2751 bp, Bovine  19866880899528
gcatcctatttatgtaaataacagcaagggcaatatctgcccccaacacacacacactgacctgctttctagccttttacttaaaagcagcatttctctcccagtataagaaaacagatcgccattaatacttctcaaatattatctcattcttctgtgcttctgtgaaagcacctggaagtccccaccatcgagtaaaagaaagaattgagcccaagaatacagagggagataattgcgtgcagtaagccataaaccaccctgttaaacattaccttccggggtagttctgtgagcacagaactcagccccagaaatggcttgtgaggagcacacagcagataaatacttcaagaagcaattgtactaaattctaagcaacagcttacaagcattttctgtaagggtacactgaattgagtccattttggcaggacagcagaaaggcatctcatacaagaagttatttaagattctgtttaccactgtaccgacaccaatcgatactgtaagaggatcaaaattataaaaggacaagtgagtaagtgatagttgcccagctgtgcccgactctgcgagcccataggctgtagcccaccaggctcctctgtccatggaattctccaagcaagattactgcagtgggtcgccatttccttctccaacaaaaggacaaatctttccccaaatgctttcctatataaagcacatataccataaccagtttaagtttttcagatccacgactgccaacaactactgtaacatgacctggtttatcactaacccaagcagctggatattccagcctcttaaggagagtgatctagcagagaatgtttacaaagcacaattcttgacaagaacatgatgtcacatggctgtaggacgtatcctccttcctgtctaaaaatatactttcaagcacagttaatgacacctctctgcaagttctgaattctgcagataaaagactgtctatactttccctgcaaggataaaagaataaacaaacaaaaatccactttcagcccccacaataacgttattgtgtgattcagctactcaagttaagaaaattctgcacaaggtcatagacgaacttgcagaaatgaggacggaagtgtttttcctaagttgaagcatcttacccagcatcagcttttggaaacagtaaatataaaatacaatcaagtttttccttttttttttttaaatttcagagctcccagccccaccccactggtccctggagagaaatggtatcgcacttgaaatggagtctctccactggcagtcgagcctgaatatttgggaagagctgtgcttctgagctcaggacaggcctgcggtgaacagagaggcagcaaggggcagagcaggtgctgcaaacattttccagaaacccataggccaagatccctaatcagcgaccacgtccgtctggttctggctcagaaccgggtccacactgaagggcgctggggtgccccttacctctctcactccccacctccactctctactacacatcagaccccagacgccctttctcgacggggttttcctccgttcagccaggtgctgtaagctgcccagaacaggtgaagggccacgtgggcactggtggcagacaatccaaagccaggccagcggctgccaggctgtcgggggctgcgtccaggtgatggacaccctggtccaggaaaagttacacaggcctgggaaagaaaacagcgggacctgcgtgtcctgcccacgcaattcgaaacaaaatgcaatcgccctaaagtacgcgttcccaactcaaccgtctaaatgagcttctgtcacattacgtgataaacacaactaacgatcagaagccgccctgacctcccgagcagactgggcgcgagggtgactaacagttcctgtccagctcaaggagcaagcagctcccctcaacttgagatgccttcacagggctccccactcccagaggaagatgctgtgtctccccacccctccttgcccgagtggcaggtgcttcctccactctcgctccgaaccagcctcggtccagcggaacctgtccaccctcctgagcccctgaccagcagctgtaccacttcaccgacggggatccaaatccgagtctgaaccatcgccggggacttgttggcgagagaagtgagcaaacccaatgacgagcccagagctccagctccttccgacccccaagtagcccaatgcgagctggtgagtcccagcattggagcccagagacgcctggtgccaggtcgcagatactgacctgttcctcagtggccttttgggcaccaccgctcccccgaacaaggggcccgtccccggacagaagctgcattaaaacaagagctgtgattcccacaccacagaatccatggtacatgattgcctccgttcaccatgtatcattgccttgcgccttgtctttctggaagccacgaggagggcagaacagactttcaccaccagactcctcagtgatgtttctgacacagaactggacactggtcaccgccaccaaggcccccgctgcaggggggtggcgggacactcctctgggaaccatggctgctcccccacctctcaggacagcggcccctggaaaacaggaccatccatcccacatgcgggcaagtgaaggaggcctggggcggggcggggggggccagaggggtcagcatctcacgtgcctggacccacgcctttgagaagccctgtgta

SEQ ID NO: 42142 - DNA, 1097 bp, Bovine  19866881278843
aacgaaaggagcgtttacactacctaccgaagcattaactttgtgtatgtaagaaaatattttaaaaacctcttcattaaaaatctgcaaatatgggactttctttttccgtctcacagatcttttctccttgtttttcctctgacacattgaagtacatcttaaacttttcttttaattaaaaaggagtataaaaatgtaagggcgggaaggaaaccaagaagagggggtgccctgtgtgcttgctagcggaaacggatatttgatatatgagacagatttggagaatggaaaagtaaggcataaaatatctttctcaacaggagaagaaaacttgtgatgcccagaaccaagaaccaattatttttttctgattggtgtcttaatttttgaaataggaaatgctatggaaatccatatatgccaacaagggtgtgaaagtgtgtgttggtagtatttgaaggtctgttgatggggaatttagcttttccatgcaatttattttgcctcattctggaataacatctatctattgagtctctataaatgatgggacctctgtgtgtgtatatgtatatatgtgtattatctatgtgtttgaagacatcctttaaatcaaacacgttcactgagggactcttatctgtcaaatattgtgctaggctctagaaaaagtcaagactatattaaataaaagcatttatccagaaactttgcctcaatcatggattttcagactgttcaggtgttttggcatctgcatgaagttcaaaggagcggagtagatgacaatagaaaaaacaacacgcacacacaagtgtgcacatgtaaacacacagatgtatgcacaagtacacccgtgaacacacgcatacacatacatattagcgtccagcatactccagaacacaccagggttttcctcagtactgctcccaagggcaatgggtgttctcggggaaaggattctgtgatcaacccgagtttgagacacccgacaccctccctttcttgcagagtcacagtctgcggccgtgacaggtcctctgaagaatctggcactgaagagtccatttccgtcagcgtttctccatcga

SEQ ID NO: 42143 - DNA, 626 bp, Bovine  19866880411796
ctctgctgctgctgctgctgctgctaagtacttcagttgtgtccgactctgtgcgaccccatagacggcagcccaccaggctcccctgtccctgggattctccaggcaagaacactggagtgggttgccatttccttctccaaggcatgaaagtgaaaagtgaaagtgaagtcactcagtcgtgtccgactcttagcgaccccatggactgcagcccaccaggctctccgtccatgggattttccaggcaagagtcctggagtggggtgccattgccttctccacaagttgctctagtagcatcaattggtctgacctagttcctttaaaagtgaactctcttgacgttctggcattggttccaagtcaaaggggagggcgtgaagcccaaacctcagtgagccccttgagatacaaagatgagtcagttaaggaacttaaatctagcaaagataaggcatgcaaatataaccatgatgcaagttacacagtgtgagaagtgtctgtgtaaaggatgtggagtgctgagggaattcaaagggtagacagcttgtggaggatggaggacatctctgcttccacgaacactctttcctgtgagaatccaatccaaagatactcagagt

SEQ ID NO: 42144 - DNA, 2585 bp, Bovine  19866880560067
cctttatctgtatctttatattgaagatgtgttaccttagataatctacagttgggttttatttttatgtttattctgatcatctctatcttttactttttgtatttaaaccattcacatttaaagtgattagtgaggtaatgtgttaatattcatcatttataaatgctttttgtttattgcacatattatttgttttggttatttttaatcttctctttttttgccttctcaggctttaactgaagcctgagatatatgattccatctcgattatgcttcattttgaaaatttttagtggttcctgtcaagtttgcaatatgctttctaaactactttaagtccactttcaagtctacactaaattgcttcactggtagttcgagtgccttataatattcattttacttatccatatactataatcactgatacgttattgctgttattactttgaacaaagttatatgttaaatcattgttttaaaaaaagaaaaggttttattttgcccttatatatatatattccttctctgatgctcttcctttctttatttagatctgattttctggcttacatacttttctagaaaaacatattttttacatttttttgcaagccatgtctactgatgacaaatttcttccgttcttgtttgtctgagaaaggtttttgtgttcctttttgatggtaattttgctggaaagagaattctagcttgttgttttttctttcaatgcaagatatttccttttactctcttctttcttggatgatttctgatgagatgttcaacataattcttatcctgttcctttataggtaagatgattttctttcttcctctggcttcttggaaaattttctctttgtctttgattttttaccatttgaatatgatatgccttagagcaggtactttggtattcaacctgcttgtaactctgagtttcatgggtctgtggatggtatctattatgaattttgtgaaatttttggtatcatttcctcaaatatttcttttgctctcttttgtctttcttctctttctataattgcaattatacatatgttacagattttgatttttcccacagttcttggatgttcctttttgtgtcttgtttttttctcgccatattttcatttgggaagtttatatcaccatttctttaagctccctggttctttccttggtcgtttccagtatactgataagcccatgaaaggcatacttcatttctgtttgtgttttctataagactgctttattcttaaggccttgaagggaactcaatggtttatttattcttctctccaaatgatgtatggcaaaaccaatacaatattgtaaagtaattaacctccaattaaaataaataaatttatactaaaaaaaaaaagaagtccagtcttctactgaaaagacccttggtctgggtctgaataaagaaacatctgcaccaagtactaaggacagtcattttgctctggtgataggatatatgtcctgggttaataggggacaagttatcgattcgtttaaagagaggcgatagtttgattgcacactttacataccaaaccatattggaaagttgtgtcccctttggagcaacataatttaagaaggaagttggtaacagtaaaatgtgtccaaaatgggtgaccaggatagtgataggggtattagtaaatctagaaaccttgctatatttggatgtgtattaatttatcagatgtctttatctgtatcatctgtctttctatatatagtgttaaaaatagaatgttttctgtttggtgccaaatttttcataatatctctgattttacattgttctaatttttcctggatataatgcttgactttttcccaggaaagagacagaggaaaacctcccctagcataagtgtaccttattatctgaccaaaaaaaataagtaggctgaacattttttgcagtaattctagctcttggcttcatttcaggaaacctcaagttgccaacttcaagctgagcgtcacttttcacctggtgttggttcctctacgtccccaaggagtctttgcttgagtagttatggtttgggctgttgtcctgtgatatagaagtaagggggttgggtaaaacccagagatgtgctaagtggattctgagctgtgaaagttggagcagggagcacatgtgagtttgaggttgcatatgaacccctagccctttccccctgcaatatgtgttgttattattatttctggagaagagttcgtgatcttttataattttcttttcctgttgatccagcagtgctagtaacagaaacttaaaacagttatggcatatagtgtatggaatttcacggtcatatatcttgcacattagagaataaatgtactgtgccaaagatgaaatttgccttgtagagaattcattttagggtagcttcaatgactgagatccacagggtagcatctcagcagccgtcttccttctctgaccttatgcagccccaagacaaaggtgaaagtacaattggctttagccgcaatttctcccagacttttccattcggagaggagaa

SEQ ID NO: 42145 - DNA, 1869 bp, Bovine  19866880795586
taaaatgggggctgtatagtctgaatatctctgcctagttctgaagccccattattatctttatcagagaggttgagtaacggtacccatcaataaaaagcagatgtgggatttgaaccctggtcttatctaattccgagtcttgtgcttcttccccatgcatcaagatattgtcttctccagaaacccctttgtctctgcctatctatatgtcatcttcccttcacaccagcctacagggctatttcccacctctgatttcctatagctcaggctcactaggcactgacgccttgcttttaggcctctctttagtcttccctaaatattgtggtatttttgtcttgtctctttaactgagttgtaacctgggactgtattttatccctttggacttacattacttcacactatgctgcccaactattggttcattcattcacttaacaaatgttttctcagaaacctctatgtgctaggcactgtgtgagagactgcaaaggcaaaactaaatgtttgtcaaaaaatattctccaagtcagttgtaatagattcctgccctgtagcacagccccagctgccgggatgctccagtcacagaaaggtatgaaccaacagcttccttcctggtccctgtgctctagctttggcctgaaaatctgtgtagaattggctttgctgctgctcactagggtaccttcaggcctggaccttgggggtattgtgactcccaaatatggtccctttttactaagctcttatcaaggtttgtatcttcaataggtacctttttaagctctgctgctgctgctaagtcacttcagtcgtgtccgactctgtgcgaccccatagacagcagctgttaatatacatttttttgacatattgcaatttgcagttttgtagtttgtagttacaatatttaattctaataataaatgtgcatgtgagatgagtacctgagataactttttccatattcattttaaagaagtttttcactaattaatttgcttttctggatggataatatacattcacgtggtttataattcaaaaagtgccaaagagtatatacaagaataagtttctttatatccttgtagaaataaaaaatcggtgattatgggacttcccttgtggtccagggactaagactctgtgctcccagtgcaggggacctgggtttgatccatggttggggaactagatcccaccatgctgcaactaagagttctcaggctgcaagtaaaatcctatgtgctgcaactaagagctggtgcagccaaataaatatataaaaataaacattcaaagcacgtgtctaaaccctaaatcatccctgcatctttgtgcaggtataacactctcaatctttcatgaaaaaattgaattttattttagaaataaacctttgaagtttaggggaaaaaaggcagaaaagctgctttcaagagccaaaaaagcaatatatttcaaagggtaatgacgactccctctgaaggccagagttaaggagaacagaacacaatggtaagttgcacacccagcgcctgccaggtcttcagctccctgcctgtctccctctcttttctgctgcccatcttgctgtttccctctggttctctctttggactgattttatcctctctctctgtttctggctttggccgtttccccttttctttctcttccttatgactcaatctgtcctctcccctcaacttctgtgtctatctccctgtctcctacacctaagaatgtccgtaatataaaatggaagaaagtcttttaactactcgtaaataggtttatggtttcaagtcttaattttaaaagcagctgagtgaactgtcatctatttctcaa

SEQ ID NO: 42146 - DNA, 824 bp, Bovine  19866880900336
tgcagcctgtctaaactgtccttttcccctcccacacttacattctcctattcctgctactctgtcactaccatcaccaccaaatagttgtgtgaaatagagaaggaactcaggtaagatagccagccaagctcttcagttctagtagcaagcaaaatgtacataccccatccaccaaagagccaacaaggaaaataatttatcataatccctaggacatatacaccaccaaaatagcacagaatcaagctctgcccaacactgaatacaaattagctggacttggctacatggtgctcttcccagaccttgtggttaaatcgtaatgagctttttaggaaaaacaaggggcctgtatgagaaatggattcctaggcagagccaataggagaaatgcttgatgaggtttggaatttaagaataagaagcaatgattagagaaacgcagatggggatgaaaatgattatatctgtactagactccaactctgcttatttacttcagagaagtgaaattaatctaagatatgctaccaagtggcaagtatttccatatactaagtgagtgagtattttatttaggggatgaaaggtgagtgtgaaggatagtttagccaaatgctaagtagcagttatttcataagtatatacaatcaacccagcagaaacttctgcaggtgcaatttctaaaagtatttgtattttgtaaataagttcatttgtatcctagtttacattccacatataaatgataccatatgacatttgtctttgggttacttcacttaatatggttatctatagattcatctatgtcggtgcat

SEQ ID NO: 42147 - DNA, 976 bp, Bovine  19866881720004
cgtatgacactcagttattaatgaagtggtaaagacgagtagtcccatcaaagaataaaaacagtctccaagttataataacatttctaggaggtttactctaaatgtactgcttttcagaatgtttagacctaaaagtttcccagaagagcaagagaccatgggatgacgatctattatcaaggcagcataatccgagatagcactggtgtcctgccagacaacgtgatctaattgtctgtgtgactccttttccccctcccaccatacacacacgtttaacaaatactgcactgcgctcctgtacctgggaccactgggcacgcaacacaccaggagctcgtgccctcggtttacttacagctgaggcaagacgacacacgtgtgcctgcgcacacgatgaactatgatacaagacagctgggtgcaaagaccatggatctgattcaagcctgggtttcagaaggaggcacataaccctgcgggggttcaggagtgactcaatgaaactatcatttgagatgcttgaagccagggaagctcaaagcggaggaatgactccactcacagcactgctgaagggaaaggaagctggtgatactcaggatggaatggggaagggggacagaccagaggcaggtagaccagttaagaactctttaaaacagcctccctacctttatcccccttgcctcaccaaccctgaactcccagtgcgccactagttatcttccagaaacagtatgactaataacattcccctcctcagaagctatctttggctccccatggcccaggaaatacaatttacagttaacattagattgtctccattagggtacagcatcagcatagtgctgtgatgatggtctttagttagttactggttctttcatgggcttcccaggtagttcaggggtaaagaatctgcctgccaatgcaggagacacaggttgatcccggatcaggaagatat

SEQ ID NO: 42148 - DNA, 1174 bp, Bovine  19866880427223
atctgaggttttgatatttctcctggcatcttgattccgcttgtgtttcttccgtccagcgtttctcatgatgtactctgcatataagttaaataagcagggtgacaatatacagccttgacatactccttttcctatttggagccagtctgttgttccatatccagttctaactgttgcttcctgacctgcatacaaatttctcaagaggcagatcaggtggtctggtattcccatctctttcagaattttccacagttgattgtgatccacacagtcaaaggctttggcatagtcaataaagcagaaatagatgtttttctggaactcccttgctttttccatgatccagtggatgttggtattctatttcaattaacatattaacgtgtatgtacatgttgaaaacagaggctggcagccactgtctcatgatgttaatagaggcttccccgagtggtgggttttttggattcattttctccctggatgttccgattttctgccataagcatgtgttaactttattacataataaataaataaatccatgtgtatcctaaaagaagagctagaaaggaacccttaccagtccttccctgaatccaaagctattgtagcaggaggtgggggtttgagcggggaatttggtctgcccttccaatctgttccaaataaatatttttagccccattacccaccccttcaaatgtcctgctaatgatttgtggctctgatgatccaaagagactttctgtggagcgtgtggcttggcagttacctcacctgtgtcctcttctggagcgaggacggaggtaataatagaactgacctcatgggtggctgggaggcttcattggaataatgcacgtgaaaccctctgcacggggcggggctgccacgaataccctcccgattaggaaatgcacagaccacagtggcaggcatctcgctgtcctagttgagtggctcagctggttaagggaaatgatacctcgtcccggagcacatggtcatccttgggggatggtcaggggctgatgggggcttcccttcccggcgtgttttcgtgttttgctcccttttaacacagcttggtgctcttctcctgctgacctccttacctgttgcagctgtgtgctaattaatcgtgtttaaggccatgcgctgacgt

SEQ ID NO: 42149 - DNA, 1061 bp, Bovine  19866880511782
aaagctgagcgccgaagaattgatgcttttgaactgtggtgttggagaagactcttgagagtcccttggactgcaaggagatccaacgagtccatcctaaaggagatcagtcctgggtgttctttggaaggagtgatgctaaagctgaaactccagtactttggccacctcatgcaaagagttgactcattggaaaagactctgatgctgggagggattgggggcaggaggagaaggggacaacagaagatgagatggctggatggcatcaccaactcgatggacatgagtttgagtgaactctgggagttggtgatggacagggaggcctggcgtgctgcaattcatggggttgcaaagagtcagacacggctgagcgactgaactgaactgaagctcctttagtaaatctctcaatttttttaggataaaaaatattacacagaactaaaatgtgctaacacgttactctggcatgacataatgagtctgtcggtaaaaatagctactatggatggctagttcctttgggtcttttggggtagaatattagcatctgcttttcaagctgtcataggttcaaaatatagcatatgatttatactgatgcattagtggttggaaactttaatgttgccaaagtcttctcaattgatatctgaatatctcaattatgtttctggtaaatttattatttaaaaataccctgccagaccatactgctttacaaagttggcagcatattgctgatgacctaatttattatttaaactcattataagtgttctaaatgtttcaatatacaactattcaatttatctgtttgagtacatttttggtgtattttattacatagaagggttgttttcctctaaacaagcataaaataaatgtttaagtattttaaaccccgcttcccacatttgttctatttttagatgcaaagtactttccagaacatcagaaagcatagtccagtttccagtaggatttcttcagggtaatagcttctttcgagtctacactcaggcttcaatttttccctgtttctgctggctctg

SEQ ID NO: 42150 - DNA, 782 bp, Bovine  19866880640843
aaaaaaaaaaaaaaaaaagtatctagtgctgcccccttgtgttctttaaagaaacacaggagtcgttcttctcaataagagagagaaaccacaagtttaatttccaccatatgggaagtacagtcatatgaaaagtttttacagatgtgttaagtagctacagacctttggccagaaagctatactgttctggcattcatttcactcagccatataaactcacttcagaaagaagcaaatgattatatttttacctgaattctcttgattagactatatatccaaaatatgtaaaataaggaaaaggaatgagtgtatgcatctgtaatctattcaaaaattcattatatgttttaacattaaaaatttacaatcagaaggaaaaaactcccacaattccactatgcaaagacaactgctattcacattttgacatatttatttctagtctttcctcaatttcttttttatcttttttgttttttcagagaacaagaggtgggtaggggggcagttgtattggaaagtgacattaactgaccagaattctaaagctgttagcagcaatcaggaaaatttcaaactataatttatcaacaatagttctgattttttaaataccttaaaaggttgtgtgctggccatcaattttgtatccaagagcctaaaaacagaattttttaaaaaggtaaacaaaatggatagcaacgttcaaaatgtactttactccaatgaataaccgcggatgggggcgttaggcacatcagtcatcgcatctccat

SEQ ID NO: 42151 - DNA, 1408 bp, Bovine  19866880901304
aacatagtttacaagaataattaagtgaaaagtagttactgaccttagagcagcaggcatttaatactgctgggaccaagacaggcttagaggctttcccaggcactttccaggaaataaatgaatggaggaaaaaaagccactctgacgtgcttgaacatccagggttcattaattaaatatttaacaatcacctctctgagggatcgtgccctatgctgggggtaaggactaggacttggtctccccaccccgccaggttgctggtcagcacatcacaccagcaagttagccgtcagaactgaattttttcctccaaagaccatcacagtgttactgaaacatggctgtttttgaaaacgcgaccactgcagcacttgtctcagtgaaagataacagagaccacataccccacagggagtctgccagacgactgagtcataccagtaacagcacaagctccccttaatgaatctggggactcaagaggcctcattagagctaaatgaggcagcagctcctctcctgtgccattcatgcttgaccaggccttcaatagtggggcacaataaaaactttaatggctgcataggctggaatggaaatccgagactctgtctcagatagtacgcacagaaagataattctcaaccgaatccagatttacaagctctgaagagaggtcacatgtaatcttaccgttgcgaaaaactttattaaaatcaaatccttggcttgctagaaagtcaatgcttgagctctgaaacaagagtaaatagaacatgcatttcagtgatgttcatggcaggtgtgtgaacagaagcagagaaataactctggggagtaaatgaaggcaaccaggcaagggggcagcatgccacgggtcagaggacaaggggtttctactccacggctgctgaactgtccattcattcccttcaactatctgggcttctctcctatagtttatgagagaaatatcctttgttacccaacatttaagaaaattttacttggtgaacttatattctcccaacaggaggaaactcctgaataaaaattaaatgtatttctattatctcaccccaggttcaagtttaagggaacaactgtgcaaattataaggtatcaatattcacttcaacttagattctagaagcccaaaatcttaattggatgttctttacattcaacataataatatagaaaaattcccagtaaagagacttattaaacacatatttcaaagtcaaaatataaaagtaaaggtagcaaaaatatcaagtaacaatacacaagaatgggaaaaatttcacaaagtccttactcaactgactgaagagtggaaaacatcactgagcttctctaattttattctgttttaagtcagaacagcctgtctaactca

SEQ ID NO: 42152 - DNA, 1336 bp, Bovine  19866880949911
gagacaggaagttttaaagaagctcgctcacatcaagtggcctttgccctcaataaaatagaagccacgttcatctgctccgagtgacggggggagggtgatgctggagactgaaagaaagtagaaaaccaccgcttgccgtgggctttggatgggccttatcagaggtaaataaaggatttactgaaaaacattaagaatccagttgaaatgaattaatgagtttgtggtgggctcatttcagttttctgaatctgttcagtggggaaaccctgacttggcgtcttgcagttgttgaatgggggggtatcccaccgctcccctctgccccgttctaagctgggtgcagaggcaagtgagggcagatgggctggtgagcttagcacaggaagggctgtggcctcagagacaggccgcatcggttcatcctctcactctgcagtttctcctttcagtccttgaacacttctttccttgcctcacactcacttgatggcctcgctcccattcactgagaagcagccagaagagaatgtcctcaagcctttcctgcgcaacgcgcacctggcctttcctccccaccgcccccccacccaaaccctgcgcacagttctccgctcacttcgaaggcattgctctgctagcttttggctccccacccccgtcatttttccgtgttcagggctagagtcggggtagcatgagtttaaacagcattgagaatctcctcattggagttgagagactcactgtggagtagaggaggggagagaccatcaaggaacgaagggcagtaagaaggtggtgggtcagtggtgtggagaccccaggaggtgaatggattgttggattcagaattagaaagaaagtgagctgggagtctgggaggcagtggccagggggtaggtgcagggaattgcggtgctgaaggctacgtcctggtctggtgagtgatcgtgggggcaggtggctgaggaagagtgagggagatgttggatcacagcctcagcagtcgtgacagagtctcaggatatgacattcaaagccgagggacctagggaggagggagagaaaggtttgggaaccacagtgataaacaggatggtgcacctcagttccagcccaggagcagcagggctgtgcgaggcaagcccggcactacttgagaaagctgcaggggggccaggtaagagcctggtctgcttctgctctcagcccagaggccagagctgaggtttcccagaagaagccactgttctcatccccatcttactcagggcacttttttttactttgaccttcttctccagggctggtcattcaggtgtctccttct

SEQ ID NO: 42153 - DNA, 1636 bp, Bovine  19866880975567
aaaaataggtggccacaggaatgttgacacgcctgccattactgagactctagatgtatggacaaaggaatttggtgaaggtataaatgaggaaagtggttgtgacaaaaaggaggaggatgtcccagaaaaagtgatattgaaaaacatctgacattagagaaaaccttagagcgatttcacagcattgaaagttcagtggataaatgttgaaaagatccaaaggagcatgaaaattcactaaggcatgtaaatgatgcttgccctgtattgcgaattatgtgaagagaaaaagaaggcaagcactgttcaaactactcttgataagttttttcttaaaccaagaaatagaacacactctcaaaattcctaatgttttaaataacaatgtattatataaataatagagttactattttttccctctacctttataactgacagtaagagggttttaattttgacaacaaatttaaaggtcatggaacaatcctcatttttcccttttgactatttaggtcagtttgaatggcgtcagcttgcatggttatgtttatggtcctgtgctgctgtgcaaagcaagattacctttacttcctcctggaaaagtacagaatagcattttttggttgttgttttaaattgtggtaaaatacacataaattaaccattttaatgtttttaagtactcagtttagttacatgaagtactttcacaatgttgaacagccattatctccagaatatttccatcatcacagactgaagctctgcacctattaatcagtagtgcccccttctgcccctccccctgcctctggtaaccacctttctttccgtctctatggatttgcctattctagatgagcttatataagtgggctcatacaaggacacattcttttgtgtctgttttatttcacttagcataatgtcttcaaggtcgatccatgctgtggcatgtgtcagcatttcattcctttttatcatctaataatattccaccgtacaaacatgccacattttgtttatccacacatttgttgatggacacttgtgttgcttccaccttttgaacattgagaataatgctgttacaatcatgggtgtccaataagagactttgaagagtagttatctctgaacagtaggacttgggcttacttttcatttcagacccttctgtactatttgattaaaaaaaaactatgagaacatgatatgtttataataaatagatcaataacatataatactgtggaatttggaaaatcctaccacatgggagtgggttaaatgtatacagtgtgtgtgaaggcaccaagcttgccgctggaacatagaggtaggtacctggtagctgctacttacactggagttagaatcggatgcttctctctgggcagagggtatggggtgccctagactggcaggagggtggaactcaaagggctgtgctagaatttgccttggtgacccatttggaggtggttacctatgttttggtcccttcccaagaaacccaaggtctgttactgctccatagtcatcccagctttccttttgtgcccctatctgggcttgtcctcctcaaccatgaataccaggtctcaggcagcataccattcttaaatcc

SEQ ID NO: 42154 - DNA, 1367 bp, Bovine  19866881028018
ttactgttcagcttaactggtcttcctgctagaatcccattctccagaggacaaccaaaagtgaggttccaacataactatgagcatgcatctgtaggcccatatcgtctcaactttgttttaggaaaactaggtaaccgggcctgaatttagccacagggagaccacttaatgggccgagacgctcagtgacacaaagtctgaatgctaaccactaactcttgctctgagatgcttcatggaggtgaagacggtccatcgtgatgccaccctcacttggctggctacgtctaaatacctactcttagatttccctcactctctttcaggttttgctatgaattcaattcttatacgggagaaaatgagtcactaaattgaatccaacataggatctacaattctgttgccatttctcacccaaaggaaatgagtgtagttcaatcacctgttccttagcatgtttctgttgctctcttcttttgcgttcttcttcatctactttgctgataacaatatatcgctctttctaaaagacataaaggagatatacaattttctggaagctacctgaccctcctcaccctctgaaattcaggttctgccaccattagaagttataatttttatcagtgcacagtctttcaggggctaaacacactcaaagtatcttgaaatgccaccaaaagttgagttgttgctttacaaactagaaattcatttccttgtttccacgacattttcctatgatttattaattcaccccaacagagtcaattataaatatcaagagactgtgtcagtaagacacttcataatggacactaagatgttgcatttgaacacggatttcaaagtagttggttttgaaataaaaattctatgtaacccatataaatttgaatcatattatatacctaaaactaatactgataagtcaaccatacctcaattttttaaatttctatatcatttctcattaacataaaagaaaaatcctggattttccagtaacctgtcagataactagcaccttctttctcacactgcattctggatcaatcaaacaccacaaaacctcctgtgtcaaagtttgagacttatcttctagcaagatttaatttatgcaatctcttatgtaattagacatctcacttaagaacaagaactaaattctaaaattctatagttctgtcaaaggaacccaccatcagcccaccactacccatttcggttctatcactgctctccgggaatacatgatgacagactgctgatgccccagattctaaaacccaattttagtggcccatgtaacaagaagaaattactacatgagtaccatgcatatcagctttccgtgatga

SEQ ID NO: 42155 - DNA, 1968 bp, Bovine  19866881036206
tttttaagacttaggcagtttctgaaatgtcaggcatcatataatacagtcaacacattaccccacagtcgaatcttgcttctaaatgtcacaatgcttacttcctaagtgaagaattttgaaggtctctttggatggtctggggcacacaggggaggtttgagatgagtagctctgtggtaagctgcacagtagctggcatctgccaaggagagggatctggaacccatggggagtgtgttgcaaggataacatgagaggaaaggagcctgatcaaataataatggcccttttcctagtctggtcaaagtaaattcccagtgtacatgccactggcagattctaacgaaagaacaaaaaccccaaagtcaagtgcaaatatccatctgtccaatcctgacattcaactgctaagttaagagattcacttgaaaatataattaaactaatggaaatacctccagaaaaaaacacatacaaaattttggatattatttcaggagattcacaggcatcctgaaacccacccatggtctaatccctgctttagaaaaagcattcgcctttcatttaatctaatttatttcaatatttcttataaacagcaaaaatatgaaattaaaaattctgtgtacgatgctactaaagtatagtaaagaaggcagcctaatataattaaatattttaagctgcataaattaaaaagttaacttaaatgacaagaatctaaataaaaattatcctgtttcaaaaaagaaaaacaaagagcattcacctgagtatttcccaggtcttaaagccaaatctttatcatataccttcaaagaacaaaaaccaatactacaatttaggattcgccaagttgatcattaaaagaaaactataaagcctttacagcagctactaagaagcaaaagcaaataaattaagcgggtatttaacctaagaaactggggggaaacagtaataaaatgaagcactgcccaagaacatggtatggtcaagtcaccaaaaccagcagaacatcaaaaatgaaataaaggctaaaaaactgcatttaattttttaattctgggtccctcacagaaccttcatgtataatataaacacttacttccagctcaaagtctgatatatcagttttctttggaacctacgaaaacaagtgaaaaggtattaatttgtgatcattgaaggaaaattcaaactgaccaagcactgattgggaaagaccgtatcagttttaaaagaggcttcattagaagtgacagttaacatgcaaaagagaacagagaggatgcttgaggtgggaggattcctcaccacttttcttcatcaaaatgctctttactgggacttccctgatggtctacttttcaatggagaggactcgggtttgatccctagtcagggtagtaagatcctatatgccgaggggcaattcagcccacacaccacaactagagagatgcactcaagctgcaaccagagaagcccgtgtgccacaactatgtcaccacacagtctaattaatgaattgaacataaaagtgaaagttgctcagtcatgtccaactctttgcaaccccatggaacagtccatggaattctccaggccagaatactgaagtagccattctcttctccaagagaattaatgaattgaaaatgctctttatcactgctattattatactgcctttataggagaggcagaagtccttatccaaccaaaatattacctcctgtggttgtatgaagagaattttaagtagacagatgcattaacacttctgtgaagctagtcacaaagtaaaaggaaggaaagcaggctgtttcagttactgactctttgaaacaccgatgctttttactgcagagagaaatgaaaaggacagaaatagcctaacaatggactctgctcttccgaagcctttctgtatgaagcacacatcaaggctacaatagt

SEQ ID NO: 42156 - DNA, 1835 bp, Bovine  19866881059014
ttttatttgtttattttttaatggtgactcctagaaaatttaaaattgcatatctggctcacaatgtatttctgttggccaagcactcctccgagattacagtacacctctttcatgaatcacacttgaagaactttatcttcaagtgaaggttacattgcttcatgaacagtgtaagattattacgagagtgtatttccatctgcctctctcatcctttgtgaacttttgtatcatattttacttctacattctgtaaacttgattatgttgttgctgttgttccttttctctctctttttctttaaaagagttaatactctttaaaaaagaggggggactgaagtatggggaaaatagcattagtataaacaaaaattcaggcataattagaaaagtccagttaagattgtcagggcccttacggttggctctatgacttgctcctgttggctttagagaattgacctgagaccgtgggagacacctcatgactactgagtttccagggttggctgtcagcgttttccctggaggtggttgtcaatttcttcttctgtttgcactgatgttgtggtggaagtcttttctgtaatagattcagaatattcagggagtttatagttgataactggacagaagatagggcttcggttctgggaaactgtactggatttgcttgagaagggaaaaaggagatttggtttggtggcaagagatctgagtgcataagtacacgttggcatagcatttgaagaatgctcctttgcaatggatactgaaatctctaagatctcactaatagatacttagtccccataagcagacactgatgtctgaacagtcttaaaaaaatagatgctctttcccttctcattttactaaggatgttctgtaattaaagaaaatggttttccaaagccactttgcccttaacagaggtttggtccatcatgtctgtgggttgtttgctgtttttggcttatttcaactattaggaaaaaaccctttggcatatcttccttctagcctttcctttctgtgagactgaatttcagcgttccttgaaaatgttgttgttgttgtccagttgctcagttgtgtctgactctttgtgaccccatggactgcaatacagcaggcttcctgtccttcaccatctcccggagtttgcccaaactcatgtccattaagtcaatgatgccatccaaccatctcatcttctgtagctcctgggaattcctccttatgtaggaaatactaaagcatacatcaaagctatggttttcagatttcatataattttcatctgaagttagtggtttttgcaagtaattgaatgtacatatttcattaggaaatggagggaaagccctttggaggcacagaagattcagatgaagcaaactgggtcccaggacccattgctctgtcagactgcttacatgtttattcataaatgggtctgtggagcaagtgttttctctcctcctactgaaaaaaaaatgccatagagacagcagagcccacaaagtgaaaagggaactgacttacaggcagctggacaagaagtgttctagcttacattctgctggtaccttgggaaagactatgttcattcttcccttcggtgaataccagcaagagcccagtatttgtctgttttctcatcttaaatgaggcatcttattggaaagaaggccaaagtcccttctagatcttaaatccaagtgtttttacattgtgtccagagtaggcagggcatgaagaggaaactgatacaaactcttaagaccctttgagaatctcctcaaatagcaggtagcttcttctca

SEQ ID NO: 42157 - DNA, 1306 bp, Bovine  19866881132191
aatgacaagaacaacaacagtgggaatccagctttgaacactaccacatctaacacaccaagacagaatacacctgctcctgtgagaaagccaggacctctgccatcgagcttggatgatctaaaggtgatcattgcaagtggggtttattcacccgtaagaaccacaaaactgtaaactatgccagatctgtccagcagatgtaggcagtttctaataggccttcaactctaccagcacgaggataaccattacagaagtactttctttttacatccattaagtttcctttaaaatgaccagtaataaatttccatttattgagcagatgccatgagcaagcaccttcatccctgcttgttgggaagtttgggagaagaggaagatgtaacagttaagaacaccatctccaggaccctctttactgggttccacccctatgcagccttctgttatctatgatagcttggaccagtgacataccctctctccccatctgtaaaacaggaataataatatctacacctcatgtgaaggttaactgaaagagtaaagtacttctggcactgtctggcccatggcagttacacagtaaatgtaactgttatcatttctggtagtaaatcttttgaggtagcaaaggaattagcctctaataacccttgctttgtcactggcctttcaggtcctttatgtctataattctgtgtttttgtgtgtttaaaaaaaaacaaactgtcacacttacacgcagtcatacagagctgtctgacagatgtaggcaccttttccagcacacaggtgtgctatagatttgccagaaggtcgtaacaccgaaaaaagcgatctgattgatttgtacttccaggtatcggagctgaagacagagctgaagttaaggggtctccctgtgtcaggcaccaaactggacctcattgaacgcctaaaaccctaccaggaagtgaacagcagcggccctgctgccggtggcgtcacagccgtgcccacacccgccatcgtccccagcaaccccgaagtcaccgtggccctgccagtgacaacacgacagaactctgtgaccagctcaggctccactttcaaggcagagctgccccccgccagcagcagcagcgtggcccacgtggacagcggtagctccccactgcccatctcacctgcaccttccgaacagtccagcctcagtgctgaggacacgagcatggctgatacgttcaccgagatcatgaccatgatgtccccatcgcagttcctgtgctcgtcgcccctgcgggcaaccagcactgag

SEQ ID NO: 42158 - DNA, 1301 bp, Bovine  19866881137488
ctgggtgtgcagctggagttaagcagggttcactagctctctctggtgatgtttcaggtgccagatgcaaacatacaccaaacagaaatgtcccccgcgtacagcaggacaatccttttggactactgaccttggcagtttgggcactttatgaagcattacatctgccacagtattagcgctattgtgaacacacataaacgcaccatcttttctttatgtcccaagaccatgtttatagaaagcctgacagagcagcacgttttcagatttaaaggtttcacagttgaaaagcttaaaagtctgtttgtgtatcagccaaccagatactgcgggggatgctgagccgcaatatttacactttcactacatgtctctctgtggctgttttgatgtggttttcatttgataaaagaatttacttacacctcgtgactcagcttattcattaaccaagtgaaacccaggagggcaggagggagagaatgaaaatgacaggcccttatcagcaggcagggctgagctgtctcacctgcagggtgagtcattacccttgggaggaagggcatccgctccccaaagcgaaggggcctctcccaacccagaaagcagtcacagaaattccgtataaagtgtacacagggcgattccgtgtatggttcccgttaacccttccttgccgcactactggtctggaacctctcagggttctcctgagggcatcgtgatgccacccataaacaagtcctcttcctcgtcctgccttcttcccttccacccgcctcgcccccaccgctatgatccacctacagatgtggaaccctccgaaatccccatcagatgtgacttgcctcttcagtgttttcaggacaccccatatatgacctgtcaccaccaaaaagatcaggaaaaaatgcccagacaacctgctctaacactcaggcctgcggcctcggtgcctgcacagagccctcactgacagtaactcttcttacctgttcacctcgatgccagtcctttgtacgccagctgctgtactatactagagtccagtctctatgcagggagaactgattcacaacaaaacgaatggaatctgctcttcagcccacaggttgccttgggaccatgcaatgtatttgttataaccggcaacatctgacttcaagagtgtatagagagagaatcgcatgcttcgccaatggggaaataaaccacaaatgataaagttagccttattttccacatcaattttactctttgcctttgctgagactatgtgcccaacgactgattttttt

SEQ ID NO: 42159 - DNA, 2543 bp, Bovine  19866881182315
gtgaagtctgaaaaatacagatttttaaatgtaatctttaagtgaaagtgaaaatcactcagtcatgtctgactctgtgaccccatggactatatagtccctggaattctccaggctggaatactacagagggtagcctttctcttctccaggggatcttcccaatccagggatcgaacccaccctgcattgcaggtggattctttaccagctgagctaccagtgaatcccataatcttaaagacgcttaaatgagcttttcctttaagatttaattaactcatgaacttagactccacagtccatttttttgcatagctgtcccattcactgggcagctttcccagttaggataggtgatcactatattttcgtggcctccatgatgtagaaactatagttgcgtgtggttagcccaccctggagctgaggtgttctacgtttctactttgtttcctttaaggacttggggccgtcacagtggcacccgtgcttttgttggtcagataataaggggtaaaggtagtaggtgccaggaggaagggaccttgtatttttttaaaaaaagaaaaaaaatgagatgtgaatgaatgctcagacattgaaatttaatattatagaaatcagcaaactttcagaaagtaagcagcctcattaagaatgaaaattgaacccatttttcctttccttggagttgaaatgctgagctcggagaggccttgagaaggtcgtcttatcctaccaccagcaccatgccccattgtctcatggaggccatgtttcaaattagcccagaggggcctctcctctaatctctctgtatacagaattgtccatgacatattttataaaaaggcagttgtcaggaaggagtggcatttattactttaaaaataaaatgtcacaatttatatcttttgggctatgggagtctgacatacagctatgacctgattaggtgtattgttcttgagtagacattttagatttgttaagtaataagattctgtccttttgttaatggaaattatggtctagttatgtttgaaaaattaaatttcgatttatcgttagtggtaaagctagagtgtttttagagaggaagttacagaaagttaaatgctgtcattctgtctcttcatactaagaacaaaagcaaataattgtgaactatttcagtgagttgaaccttaagtcagaacttgccttttccggtatcataagaagcactttgctagttgctatggaaacacatttaattattgagttggaatttgtgatgtagatcctctatacaaatctgctgtgaaagatagatgttgcagactaagactcttaatgctgctcctacgcctgggtcaagaacaaacactgaccacgcacttgctgtaggaaggtcctaggtgtacccaagagacctgggtacacagacgggaagacaaggctcttagccttgaggagctcagattcttgtagggaaacagtgatcagccatgtggacccgagctggaccagtgatagaatgctggtgtgtgcagagtgcactgggagggaacatgtgaggtgactttgaggatgtgtgaaatttcctggtagacagggagttgagatgaacactgtgcccacaacggaactgcctggataggggctaagaggtgaggagtttttggttgttgtttttagtcactatatatctccatagctgtactattgggaaatatttggggaatcttaaatttttaaattcatgagccagttgagtgtagactgtggagtcaccttgccagctgcccacttgactgtgccactctgagatatttaacttctccagtcctcgtgaggatgaaatgagagactattggtgaagggcctggttcaaagtttgacatttagtaagctctgagtaaatgtgaattgctttttaaacagcattagctttatcattgttcattctagcctcctggtaatcttgaatgtgttttgtaacagtgaggggtctgtatttgtaaaacatgttatgcttgcttgtcttttgggtgtctcactgtgtgtcctgttgagtactgactgtgtgctcagcactgggctgggactcgatgttggggaagtgtgccggctcctgtccttcggcagcttacaacttagttgacaatgaaaacgggcaaacctgagctaaagcaagtgcgcactcaactgtgctgcgtggcggcctgtgcacacaccccgagtgttacagtacaggcctcttccgttttgctgcgcttcattcactttgaaaatcctgcatgtttttaccactgaaggtctgtgtccagcctgcatcaaacaagtccactgttgctatttttccaacagtgtttgctcacgtaggtctctgtgttgtattttggtaattctcacagtatttcatactttttcattactgttatatttgttttgctgacttgtgatctgtcacctttgatgttattttactcaatgaatgctgagatgatcgttagcggtttttttttttttaagcaataaaacatttttaaattaag

SEQ ID NO: 42160 - DNA, 2734 bp, Bovine  19866881227601
aagtcttaatgtctgttatttactgtaagaagacatgaactccttatcctaatctgaaatatgtataatccattttaaactttgtaccacattactattttattagtctcttctgttcctggcttgttttaaatataaaaattattggaagaaattgtttctctttaaaggatttgaagcttaactgtctaaaggcttaaatataatttcttcattgttcctttgcaatttctataaaaatacaaaattattttcatacaggaagctgaaaaagcgggctgttgtaaaggaagctgctgtgcagttccttcctttctaaacttcaagctgaatgcgtttcctcactccaagttcaagggcttagtttacgtgcctgaagataaactgaacagcacctgcctcttagtcacaaagggaatgtcttgaagctgcgaagcaatcatgtgtactcagtttcagcttttgagattctcaaagcatgtggaaaaaaaataaattcagtaacgaatagtataggacattccagggtttcggcagctcaccttgggcttccctggtagctcagtaggtaaggaatcagcctgcaatgcaggagacccaggtttgatccctgggtcgagaagatcccctggaggaggaaatggcaaatcaccccagtgttcttgcctggaaaatcccatggacaaaggagcctggtaggctacagtccacaaaatcgcaagagtccgacatgacttagcgactaaaccaccaccataggaaattaaatcagaagaaagtataaaccaaggggtcaggtttgatgcctgaattgtgtacatgttaatcacagtactgtcatcactgcagggactggtacttggaaaatctgtccttgaaaacataaaattgtcactgttttcccagagaaggatttggcatgttttatagctttttaaaatttcttttaaaaaaatttgttgttgcaattctgtggaatggcaagaggagaaaaaataaacaatactaaatacttctgctataaaattattcagagttatctattgacttcagttagttcaggacagactactctaaatatctctgttaatgtggacagcttgctgaagtccatggtagcttgttaaaatttttcttgacatagaagaaatgagatagccaacttgtccatatttttttagtgtaaataattgtgcttggttttcataaaatactggaagctctattcatgttaacttctgtcaaggctcaaagttcactagcaaattacctagaaactccactattttctaattgggaaaatatgtagaagccttgctagaaatactagtggctgcattttgttatcagcagagttctgtgagctgacagtatgaggaataacaaacacaaattccggtctttgccaaggaatcatacaagatttccatcacagatgaggcaaacagcatctgaaattctgttactgagtcagaataggaggggaagaaggaaacaataagggtcagtatggtttaccctttaatttccagatcagtttaatgacccttagggcaggacttgtgtcttggttactctgttgccctgagacttactagaaacttcaaaactgcgcctgagctgggctccccatgaaaggacaaggcaggcttatcttcaggaaggtcctggatggaggcagtccagcagctttgaagctctgatggttaagagctagctctcctggaccagatacgtgcggaggccaggctcaggcggccagttccacagtgcagtttttgtcactgaagtgtggccctgagggtctctgggcaaatcgggctgttgtggaaggcactgcagaggtgaacaggagacaggggtcccgtcccaacccttgcagcgactggttttgggacttaagaccaatcacttcacttccttgggcctctacttcctcatttgtaaagtgagggagctgaatcctctgctctgaggtcccagcccctcctggcccccaactgctctgattctgagaacttcacagtgcagcgtcctgtcttccatcttgtgaggagttacaccccccccccctctcctggagttggggttgaaattgtttgacagtatgtggtccattcaccaggttcagttcatttctttctgggaaatgtcttttttcctttcctttcttccttctcattgccttcacctttgaccaggctctcaccatgcgcatcaggaatgtttgccttcctctcttgcctttcatccccccatccctccatccccaagtgtaaatccgtcctttctcatccccccctcatcccacgctgtgagtcttatctcccttaaatcctactttcgtcacaagcattttcttgttcagaagtcatcagcctgacactctgtggtaagattctctgtaatcttgtcccaccctatccatctaactttgtgacttctaccactttccaacacaccatgctgtgtaaaagactggttttagcactgttttcataagtattccatgctctttcctgcttatttaacttgttcattttgcttctttcatctggaatacttttttcttttcataacctatacttttagcaaattcaagatgctcgaaagggggatatctgaataaggtggcgtagcttgtggtggggagaggtgggttagctgtagcatgaaggaaagaacatttgggggccaggcccggaaggacagtagatattaaacacacacaggt

SEQ ID NO: 42161 - DNA, 1375 bp, Bovine  19866881239489
atttagtaaaagtctcaacacttataagtagatttcgggggggttttttttttttttttttttcagttattttatattttgtcatatacttaaatgactagcaattgactgaaataattttggaaatcctgtgacagttggcattttagaaaactctgaaactatcctactcgacaaatatgactttttcaatataaaaaactactaataaaacctccagtttctcaaccttcagcctgatgatacagtgagagctcaggtatgacatccagttacaagcctggaaaacggtaaccagggattggtgaccgagaaaaagaaggccagggctgggtctgctggccgacctggtgccactgtgccacctgaaccgtgctgggaatgcccttgggggacgacagactgctgccttccttctcttggcagcttaccagcgcagaaagatatttcatgccaaagccttttcttggttctttgaaatggacctggttacctgaaagttagtcagcaattccttaaatacggaaataaacatggctcaggtactctaaaaatattcgagttattaaaacaagtaggaccactgggtatccaattccttactccaatgtaggctgtacaaatcacaatgtcagagcatacatacaagtgtctaatatacacattaaaatcaatgtaatcaacccggagggctgctaatagacttttcagtgttatcaatacacctggacttcttagagtggattgtttatgacagtattttgtagacattgtctggtaatggtgaaagatctcccatttcaatttaaatctggagatccgaagtaagattcccccaaatcacaaaataaactagaacacacacaaaaattacattggtttctgaatggaaccaaaagtcttcagcgggaagctgtcactgaactggctggtgctggccactgcccttgaccctggctgcatcttgggccgggctcaggccatttctaggagataccctgtgcagtgatcgctcacctttctttttgagtggagctgtctgccttttatttaaggtcttaaaatgaccacagaggtttaactgtagctgatgaccagaggccctcatgttgtcaccctgcataccttattcttcgcgtttttaatctaaaggtacctttcgttctttactgaagtctggagaaacagatgagtcttcttggagtagtgttattttcagaaggctctgtgctatattaaatcacaggcattcactgctggatgcaatgaaatgttttcaacttggtttccagcctctgaccatccatcccattcctctgtgacaacatattataattgcaatgatgcaactctggatctgtctctaaaatctgac

SEQ ID NO: 42162 - DNA, 1087 bp, Bovine  19866881331791
ctgacattactaccgttttcctgcttacagcttccttcttctggaactgtttgtggaacagtccaagcgtttctgtcctttaggcatttatgcctgttccctgcctgaaatacccttcccccagctcttgcatgtctgatccatgctcaccttttgggtcctcctgcccggtggccttctctggttgtcctaaggtgttcccttcactagcaagcaggatgcatcccccttgttcatcattagctcattggtgcctggtacagtgcctggcacagtgtgcatgccaagtcacagcctgagagatgaatgaatgaacgagcacatggaatgaaggaaatagacatacacgtttcaaaatcacttgctttttccattggattttttttttttttttttgagctgtagtcaaatatggtctttcccgagtcttttagtctctgtggtttgttacaaaattttttatgataaacagtgacctctgttaatgcacacttttaaaaattctgttcaggaattccgtacttaaaccaggaagaagaaagacagttaagagagcagtatgatgagaagcgttcacagtccaacggtgcaggtgctctgtcctacacgtctcccaacacttcaaagtgtcccgtgacaattcctgacgatcagaagaagtttattgaccaagtggtgtaagttctaaactgaaaccagacgtgcggtgagacgtgtgtcttggggcaggattgatgcctgtatctcaggcttgtgctacacacagaagtgtgatgtgagggtaggatttaattgtggcatacctgagtttgtgttacatgttgttgttcaatcgctaagctgtgtctgtctctttgcgaccccatggactgcagcatgccaggcttttctgtccttcactgtctcccaaagttagctctaactcatgtccattgagttggtgatgccatccaaccatctactgtcagttgtaaattgagctctgtactgtgcgcagaattgcaatgtgtcaccaggccagagactgccttggcaagtgcgcagacctcttgtgtggaccacaggcctgacagccactgttcccccg

SEQ ID NO: 42163 - DNA, 1076 bp, Bovine  19866881352442
aaaatattgtggcaggcctctggaagcaacagacgttgtttatgtcacatccaacttgagttttgcttagcgaatcaccaggctggcgcacgacacgcttttcctgaggctgtgttcccttcggcccctgccctgcccttccaacacaggtgagctgcgctgatctgtacttactggggggattaaaaagaatccctgaacccaaggccctgctggataaaaaaatacatatctgtaataattctcgaaacaggccccaataacaaagtccacacgtccctttgagacgtgctggcgaatggactctaagaaatccattacccttccttttaggatcaacacccttgtgttaatcccttcctctgaaatgtgagtggggccacaacagcccacaggctacagtagaggtgtcacaatgtcacatctctgttgtcacattagatggcaacacccatcttgctagaagactctctcgctgttgtggggaaacaggcggccatgggagggagccccaaatgacaagaaaccgaagccttctcgccaaaaccaggaaaacacggaggcccttagtccaacaggctgcaaggatgtgagttcatcaacagccacatgaatgtggaagcaagtcccccgctgggtgctgtggcctgaatgtttgcagccccccaaaattcacgcactgaagccctaaccccttgtgtgatggtgaggcctttgggaggtgactgggggtcgattaggtcacgagggtgggaccctcatggtagaatcaacgtcttaccaggcgctctatctgatatggagtgaagtcagtcagagaaggagaaatttcatatgacatcccttctatgtgggatctaaaaatgaaacaatacaaatgaacttacttacaaaacagaaagagactcacagacttagaaaacaaagttatggctgctggggtgggggtgatgggtgtgtagtggggagaagaggcaattaggggctttgggatggtcctgttcgcacggccatttataaaatgaataaccaacaaggacctactcacggaactctgctccatgtcgtgtgccagc

SEQ ID NO: 42164 - DNA, 1132 bp, Bovine  19866881409420
ataccccgatccctgggcagttatatctttaagcagctgaaggcagccgttaccctttcgttcccagcttgacctgcaaatccactcctgctgctggaagcccgaaactctctcccacgttgggaggcagagccacggaggcacgatgctgaaatcccaccccttttcccagccagccccctttcccttgccattccagcctcccccgcacccgggacttcaatctgcagtttgatggtccgcatcatctgacaaacactgactcaagcagttaaaaataaatcccctagttgttaaaagagaagactttgctgatacctaagaagacaaattgctgcctgtggtctctctccggctctctataaacacagccgcaggctatggaaatactttctatcagccagccaagcacatccattactcattaagttctccagctaaacaaacggtggtctagggcatccgaaggaagagggtcttatcacagcagacgcaacacagtgaatacacatgcttctagcatatctggataaaaacagaggcatgtcaccaccaactgctctcgtggggtgctttttccgcgtccggctctcccggcacagccactgccagtgctccctgtcgcagggaaatgcccgtaactgcagctttctgctttcgccagtgcagacccaggcggcagttttcctttgtgccactagtcggctgagagagttaacatcgccatgattgtgggaaggaaaaatctcctcccctgtattgaaggcagacacagagagcttctagttcataacatattccaccagcaaccagccacgtttaatttcacactagctatcaacaatgggtacctctcccccgggtcactggcttccactaaggcacagggatgctgcctgaaggaaatctgcagggaaggcaactccaggcaaagtaaaaacgcctgcttttacacacaccaaacacctatctatccagagctggagccaaaagaatctcattttcacggtttgaagtcagctcctatgaaaagagctcccataaaacccattagaaattttaagagcaggagactggtcctcttccatgagcaatctgtttttgttttgtttactttttaagtagtcaacat

SEQ ID NO: 42165 - DNA, 1716 bp, Bovine  19866881152718
ttctcttcatctatactgaataaaaaggatctaattaaaaaataatattttcatagaaaatatgaacaatttctttctttagaaatgatattcccttggtacgctaaagcaaaaatggtaaccaccatcctcactgaaaagaatgatcagccaagtaatcaaggatttcttgtagttacagcccaacaccaaacacaatctccagtcatacataatgtttccttctctggacactggaatattttaagttcagatcttgggacatcacgtgtttctattacccagtatgccaaagacatatcctaagttcaaaaaaagtatcaatgggcaacataccagcactgtagcagactcctttgtactttacaatgttgtcatgctgcaaggatttaaggatttcaatttctctttcgaagtctctgaggtgctcttcagtactgtgctggagctttttcacagccaccacctccccagtattgtcttgtagagggtcataccggcacatctccacactcccaaaattacccttaaacagcacatatcacattaagatacaaatctcaagttttctagaaaattactaattatgattatacagtcaatttcagcagctagaattagaagatgtatctctaaactcacattaaacaactttcagaaaaaggagataatattttagtaggtggatagtaagcctaaatatttaatttctccaaaaggaattagaggctgaaatataaataacttcaaaaaggcattataacaaaacataaacattattttttaagataagccaaaggacatgccagggaatttctaaatttctgtcactaacttccaggaagaacttttctttttcacaatatagacattgatatcactgtcagtgagctgtatagaataagggtctgttatggactgaatgtccatgtcccatcccctcaaatttgtatgataaagctctaaccccaatgtggtggagacagggcctctgaagaggtcgtaaaggttaaataaggtcataagagtgaggccttcatcctgaaggctagtgccattacaagaagaggaagacacaccagtgctctctgccgcatgaggacacagtggagaaagttgccatgtggcaagctaagaagagagccttcaccagaacttgaaccctactggaaccttgatcttaagacttatctcaagaactttgagaaaaaaaatgtctgctgcttaagccaaggtcatgctgtgtcattggtagcttctgtaattatctcctaatattctctacattctgatattcaagctcttttaaaatccccttcctttgagtgtaggctataaactcatttatactgaacattgactgaaagtgaaagagagtgaaagactgaaggcaggaggagaaggggacgacagaggatgagatggttagactgactgatggacatgattttgagcaagctctgggagttggtgatggacagggaagcctggcgtgctgcagtccatggggtcacgtagagttggacatgactgagcgactgaactgaactgacagtgaacagaatatggcaagagtgagaagatgccacacctgagataaggatataaaaagtctatggctttaatcttgggtgtttgctctcagcaaccatgttgtgaggcagcctgtggagaggcccatgtaagtgagctaggaagcagatattctaggcctat

SEQ ID NO: 42166 - DNA, 895 bp, Bovine  19866881409427
tgtgagtccgtgcgtaggaaggttggaagcgtgtgtcgacaggcaggggctcattgttgcttacttctttgaaaatggcagtgctgaacttggaatgaacttggagggtagttctgggctttattgttattctttaagaaacagtcgttatttgtttctctgctgaccgtacattgtttttctttgcagagaaaacgtcatccaataccctttctcctcaagcaaccaaagattcttaatctttgaaggaggaacattttcaagtaataagagatacttattgagaggacacgttagctgctcttgctggggtttctgctaccgcatagaatgcttcctgggcagttttatctgcttaagtttactttgtcggttgaatttacccattttgctttccggtggttattaatctgtccggaggaactctcttttctctgaatgaaaggacagaggcagctgagtatgtcatagaggggaggagaaatgtggaggaggaaactgcaagtgggaataagtgatgacgattggttttggtttcataatagttttgttgggctactgcaggtattctgatataacacccaacggatattaagatgaataatcaacctttttcctccctttcccttccccctttaccacttgggtatgagaatcccttgctcctgtgtgcgcgtatcttttaatatgtaacatatctgcaaactggatgtgtccagcatttgccttaacatgtatttacctgtacaggaaaactacagtacttgctgactagataagcatacaatacttgtttctttctctgagtgtcctacgtttggagtatttagcatgttttaggaacccattaaagaagagtttgcttcatttgctggtttttcctagtgatttgaga

SEQ ID NO: 42167 - DNA, 721 bp, Bovine  19866880394953
ctgcactgcagatggactctttaccgctgaacccccagggaaaaccataaagtagaaggaagaaattgagtgatgggtgatttcttcactgataagccctatccagtcagagcttgtaaaaacaagttgggctaagaaatacagaataaatttactcagagaccactctcacaaagacaggcaagatctcaaactagggataagaccaatattatcattgatataaccctaattaaataataattgatttttccccttcgatttgtgaacagaagattaaccagtagcaatagtaagaagtaggtatcaggagcaggaaaaattgctattaatttagtgaccttgggaaagtcacacaatatttctgggcttcagtttactcataaataaaataaggaagttaatttacataatctctaaggtccctttcatctctgaagttctgcctctataacagggacctttggctactgacaagtttacccgagacattaagcatggtgaggtggatcttagagtatcaaaataattaatcttttgacaaagactggaactcagataaatatgtagcaacaagaacagattaaagcattgtaaggatattggagctgctaagctggtcctggaataccagatccagtgtatccacctctccaagaatgccaaattattttctaaacagcatctcagggaagagaagccctgctggttatttaaaagt

SEQ ID NO: 42168 - DNA, 3453 bp, Bovine  19866880490116
ccactatggaaagcaatatagaggttccttaaagatctaccaaggggttctctgggcaagactactgaagtggtttgccattcccttctccaggggatcttcctgacccagggatcgaacccagttcttctgcattggcaggcagattctttaccatctgagccaccaggaagcccagaacttccatttgacccaacaatcccactcttgggcacatacacagagaaaagcatagttccaaaagacacatgtaccccagtgttcatagcaacacatttacaatagccaggacatggaagcaacctaaatgtccagcaacagaaaaaatggataaagaagatgtgttacatatatacaatggaatattactcagtcagggatgttatttgaacccaggtttcactagctccaaagtttcttaggacaaattttgtattgcctaaatgaggatgtttcttgaaatggtcaatgttttggaagctgcgtctttgataacaaatgactccatataatttcaagtagtctgtttactttgaagaaaatgtttcagtactacctaataaaactgaagaatttagacacgtggtgaaatgactgtataaatcttttcaaattgatgtttgaatgctctgactttgtattgattacatttctgtgtctgtcagtatctaggtggggagatacatcaagtatctcttgatgttggcagcatttacatgggtgagtacttacataaaagttttgttgagctgtatgtatatttaagattggtatgctatatttgtaagttatacctctataaagacttttaacaattaaaagttaaaatgccttaaaatactctgacttcattgttatttgatgaaatcttaaattattgatttaaaaacctttcttgttttctaatagggatagctgctgctgctgctaagttgcttcagtagtgtccgactctgtgcaaccctataggcgacagcccaccaggctcccctgtccctgggattctccaggcaagaacactggagtgggttgccattgccttctccagtgcatgaaagtgaaaagtgaaagtgaagctgcttagtcatgtctgacttgcagcgaccccagggactgcagcctaccaggctcctccgtccatgggattttccaggtaagagtactggagtggggtgccattgccttctccaatagggacagaatgcacctcaaattccccttaagcactgcttcagttgtaatacctatattttgatatattgtgttgtcatgctcattcagttcaaaatattttctattttcccttataaattcttcattgacccattagctacctactggtgttgtttaactttcaattaacaattgggaattcttctatttttaatttctagtttaattgcattgtgtaaaaaaaatattcagtatgccttcttgtcctttaaatgtgttttatagcttataatatgacctatgttttatgtctttgaaaataatttacattgttctgttgttggataggatgttctatagatggcaattagattagttgggctgacattagctttcattttaacaggtcctggaaatcttaaagtctctattttaacctaaatttctgtctgctatcatatttattttacttgaataacattctttttaaaaaatttatcgaagcatagttgatttacaatgttttgttaatttcaggtgtaagcaaagtgagtgtgtatatgtacacgctaagttgctctagtcatgtctgactctttgcgaccccatggactgtagcccaccagactcctctgtccatggcattctccaggtagaatactggagtgggttgccatgccctcctccaggggatcttctcgacccagggatcgaacctacatctcctgtgtcttctgcttcggcaggcagattcttcaccactgccccacctgggaagctctcagcggtagctgggtatatttattagttgcaggggacctgtaaccatctgcttccaaagaaatcctggcggtagcactaactaaatcttagggatctttgactttctgggcctcagtttcattatctgtaaaatggaggcagaggactgttttaaaggaaagtatgatggcctattaactgagtcaataaagggtgagtcaataaagagacagtactctgactagtagccagaacatagtcagtgttgggtttaatggtcgctgttatgatttcaaaatgttcccttcaccagagacaggaagcagcagagaatattattggcttctgttatggatgccatctcaaagttctttccttctgcttttttttttcctttccagaatacgttggaaattataagcaaatatgcaagtgatgcgtgtatatttagtttcacataaaacctcattgttacttcctggcgcgcttccaaggtatcttacaagttatcaatctcaccaggacagagtgtgttttctgaccacttcccctttgcaattaaggactctgaccactcgcttacgcagactgagaccagcatccgtaaccccaaaggaggtcagaaacccccagctcttgccgccgagggagccagctgagaacccgacactgtgtttcagggctgtggccacgaccgtgaccataggaactgggaacacccaccaacaccctgcttcccccagccccacttccttcgctccagtgccatcaagtatggttgcagtgccttcgtgaatgttttgagtggagttaggtttctggtgtttattattgaattgctaaagatttggagagaagacaaacagacagacgaaccagcaaagcaagagacagaagacacccttgacggacgcgcactaagtgcatagctggggtccgtgacggtctgggctctccccagagcccagggttttgtcagtggctctgcaaataaaacctgccctagacacacacagaggaggctgtatttgcctaggaaacctgccactctggccctgcagatagcaggccatagtcaggggggtggtgagttttcctgtttaccttccaccttcacagaaatattgcatgcagggcctggggagggtctgggagggtcagctcctctcctcttctccagacagactggggtttcgattaaatcccagccattgcctctttgctctctgtattgcctctcctcaacagcatggtgaacacagagaagttaaattcacagtgacttcccttctgaggatgtgggagggcttgagggtcgggctggtcaggctggcagctgaaaggccaggctgcactgcgtcgtccacaggctctcccagctgagcaggaaggcttccccatctgacttcttggcgcctcttacacaaactccctcagccacagaaactaaatccacgtaggtggaggctgtgtctatgttctttgccatttgcaatcccaacatctaccacatgtgtg

SEQ ID NO: 42169 - DNA, 2588 bp, Bovine  19866880712080
accaaagacccgcacagccaaaagaaacaaattatttaaaaaaagaaaggaggtgagacaaagacagatatgataggatatcacttgtatgtggaatctaatgatacaaaggagcttatttacaaaacagaaatagactcagacaagaaaataaactgagggtccccaaaggggaaggtggggagctaaattcgaagtttgcaattatactcactactatatataaacaaggacttactatataacacccagaactacactcgatatcttacactaacctataaggcaaaagagtctgaaatagatacatgtgtgtgtgtgtgcgtgtgtgtaaccgaatcatgctcctgtgcacccaaaatgaacacaacattgtaaatcaactatcagttcagttcagtcgctcagtcgtgtccgactctgcgaccccatgaatcgcagcacgccaggcccttgctgtccatcaccaactcccggagttcacccaaactcatgtccatcaagtcggtgatgccacccagccatctcatcctctgtcatccccttctcctcctgccctcaatcccccccaacatcagggtctttcccaatgagtcaactcttcgcatgaggtggccaaagtattggagtttcagcttcagcatcagtccttccaatgaacacccaggactgatctcctttaggatggatgggttggatctccttgcagtccaagggactctcaagagtcttctccaacaccacagttcaaaagcatcaactatagtttaatggaaaaaaaagagaaggaaggtgtttgaaaaaaaaagaaggaagcaactaactggatgcccaggatataaagaattgtaaacgtatggttccattgtggagctgaagtgtggacatgaagttaagtatctagttgggaacaggatatttgcatgataacaatgttgaggactgtacttcctgcctactcagagtcttgctgatggtctctgccacttaagcttcttatttctgtcacttacgttgcttcagcttccttctcttttccagttcccagtctacatcatggcactgaagatacaaactccccctcacacaagaaattccatggctattcttttaagatcttacaatttttattgcatgacctagcagtagttattacactatttttgagtccgaatcacacattgtgaatttgcagggtgatatcatttagatcgttaatctctctgtgtccatttttttacatttgcaccttgagaatgttattatttaccccatagtatgtgtctagaaggcttccctgctggctcagatggtaaagaatctgcctgccgtgcaagagaccggggtttgattccggagtttggaagatctcctggataatggctacccactccagtattcttgcttgcagaatcccattgacagaggagcctgtgggctacagtccatagagtcacaaagggtcggacaggactgaacagctgtgcacacacatgtaggtctagaggaagaaaaacaaggagatataaagaggatgaagcaagtctgaagcaagtcatgtttctattcccaaaggaaatccaaataacttttcaatcgctaccacatttctttgaatctgcctcccttaatttttagctgagcagtatttctgtatcactaagaaaaaacagggtttccctggtagctcagctggtaaagaattcatctgcaatgcaggagaccccagttcgatgcctgcgggaagatcctctggagaagggataggctacccactccagtattcttgggcttccctggtggatcagatggtaaagaatctgcctgcaatacgggagacctggattagattcctgggttgggaagataccctggaggagggcatggcaacccactcagtattcttacctgaagaagcccatggacagaggagcctggtgggctacagtctcggggtcacaaaagtcagacactactgagcaactaagcacagcacagaaagaaagagcaagaaatgttgtcaactgaactgtgacacatgttttcttaaaacgtcaattttaagatatgtatcaatgttggagatgttaaagcgtgaaaaaatcgacaaaacatgcatgttcagcttatatcattagagccagtggtatgccatgaccaacccaagctacatttcaaaaattataaggcaggcataatcgactacgtgtgtttttattttagaagccttttttttactacaattattgtcatgtgaatcctgaaagaactgaaagcacagagcttctgagagctgttttcatgggcagtggatggacaccgtctaatgctcagtattggacttacattacagttttattcagcttctatgaccatttatttattttaaatccaacattctttctctgagaatttcttttaaaataatagccactctttggtgcctcccacaaataaccatccttgcacgcttgctgctgactcggcactggcagttaaacacagtctgtttcccagggctatgttggctctcccatccagcagggggacgctgaggcagccgggccacagcgctagactccgatggc

SEQ ID NO: 42170 - DNA, 2293 bp, Bovine  19866880974837
actcaagacattccaaagatgctatatccatctctttgtgcattcattcagagttactcagcatctgccaagagctttccttccaagagctttccctccaagtgcttatcctggagggaatagtcacaagattacatctctaccagtcgttcaatacaacgatggatgcacgttcagtcatgtccgactctttgccaccccgtggactgtagcctgccagctcctctgtccatgggatttcccaagcaagaatactagagtagattgccatttcctcctccagaggatcttctcaacccagggattgaacctgggtctcctgcatattcatagtctttaccgagtcatctgggaagtcaatacaataccgtactgggtaaataagttgcaaaagcaaacacaccgtaggagtttaggggaagagaaggcgaagagttggcaggttacaacttcctgaaaagcaggggaggtgagttggatgatgaagcctcagtcagcatgggtcacaggagaacggaggagcctggctgtcatttccactgccagcctggagggctgcagggaatcattatcctcgcacgcctgaagcatgatgtcttgaatgttcccggcaactcaattacggcatgcaaattttccgcggagttgacttcttggtcttcgagagccacgcacacgctcctctgggctgtctgcacgggggaaaacattgttgggaaaggagcctgaggaccaaccactggaaagtgcactcaattgcactttggttgagataattgctgcgttttgtgtgtgtgtgtgtgtgtgttttaaattgtaggctctggaggtgaccgcaagcaaaatttgtgacagacatttgacactgagaaactgccgtgtacggggtgaaacttttcacatccttcaaccccctcccctccccccagactggtttgttgactaacaaaggaaaattatctaaaaccgctggagtacgttagccaagtcttctcttttgtcgtaatgctctttgtgctgggcatcaagatttctcatggttacaggcacgcggattcccttccaggcaagcccattcaagttcacggcctgggtgaccttggcagcccagcagcccaatgggctcaaggtgatgcttcttgagctcgaaagtacggatttgcagagacccctacctgcaatgcaggagaccgggtttgatccctgggtcagaaagatctcctgcagaggggaatggcagtgcactccagtgttctggcctggaaaattctacagacaaaggagcctggcaggctatagtccgtgggatctccacaagtcagacacgactgagcagctaacactttctcgcccattgtgggctccaaagacttcatagccttgatcagttcctgcacagcaaccttcatatcctctggggagatgtcctcctttctgcctgtggccacttctgtctccaagaaagctggcgggcatgactgtacaaagcacaccagtccatcaagtggggaaaaaaaaaatccccagcctcatggaagtaaaaggcagggctgtcagagacattctccctgcccgcagccatcaggaccctgtgatgactcccagcattgcaaggatgtaatcagaaggactgagtagagagcttagagagacactttcatggcaaatctccagcctcagccggggcggcaggtccagaccagctggtgggagctcacaagctgcctccatggtcactcccaagggcacctccaacaagatcccaggactcctccagctgacttctcaagctggcttctctcccagaggagcattcttccctattggccttcacaatcctacttctcattgtcaagaaggcatgacagcagaagtattagattgggaggtcatactgactttgttcctgccatcttttggactgggggacctcagggaagctctccatggcttggttccatcacctgagaaattaaaataatattcatctcctggggtcctggggaagactcagtaagacagtggaggtgaaaatgattacctacatggcgcctatcccatgatttgtcacaaatgaaaataaatagccccacaaactaccttaatgaatcaaccaagaagcacttccagggaacctgcgtgtgtgctcaaggcttcccctgtggctcagcagtaaagaatttgtctgcagtacagtaggctcaggagatgcaggttcgatcgctgggtcagggaaggtccctggagtaggaaacggcaatcatggcagtattcttgcctggaaaatcccatg

SEQ ID NO: 42171 - DNA, 1215 bp, Bovine  19866881104308
ttctgcttaaaagcccacttacaccatgaagtttcccacaaaaccgagaggcttgggcaactgatatgaagggtcactgggtttagacctcaagaaagaagtttcctgcgaaggcctcagttggctcaccaccagaaagccgctgagctagagagacagtgtggtattagtggggaaacgcctggggaccctaacattggttaagctccaaccccgctgacaagctgagcgccatcaacagaaacagtagcccccatgactcttgctgtgggaagtatagtcctgtcatcttcagggttacaagatcagccagattttgttagaaatgcaggtgcccaggtcccaccctgggcagtgcctgtggatctgcattctaactctgattcgaggtgattctcttgcacgttaaggtttgagaagggatgctttcaaataccaaaggtacaaatatcaattgtctactattaaaatgtctccaaatttccttggatacccacttttaaaattttttcacaagtaatatcagctagcacaaaaatactgatatggtcaataatggctaaaggtttaatgaagagaaatatgatgcaaagattttagtcttttctctcttaaaaaatagccctgcccaggtcccaccctgggccaatttattcaatatccctaagagttgaggtcaactgaatctctctccccgagtgtatctaatgtgtaagtgagaaccactgtttcagatggtcatgtagggcttgtttgttgtttagttgctaagtcatatctgactctttgcaaccccatggactgtagcccaccatctactgtccatgggattctccaggcaagaatgctggagtgggttgcccttttcttctccaggggatcttcccaacccagggatcaaacctgcgtctcctggattggcaggtggattctttaccagagtcatcagggaagcacatttagagctaaacatatataaatgttaccaattattttccgaaatgaaagtgtgacatcattcagtttgatattatactcacttattttgtttacttaagggtcatacattagaaatttatttttaaattttattttattgaattaatttgcaatgttgtattattttctaatgtagagcaaagtgattgagttttttacatatatatgtgtgtgtgtgtgtgtgtgtgtgtgtgtgtgtgtgtgtatatatatata

SEQ ID NO: 42172 - DNA, 3222 bp, Bovine  19866881158399
gagtaagaggccgtgctatctgctgaaccccagcctcagcccccgtgtgcccggccagcctcggagggaagaccgcagtgctggggcgccggccctttcagccgccgccttctttcctaaggtccttaacgagcatgctaattagtggcaatttccctggtggtttgtgtgatgtggagactcctccactaagaaatggcccagaaccacaaactcatttaaaatagtcaatcctactggagatagaaataactccttgtctgtgttgatcctagctagtgaccagtgagcaggaggttaagtcttgggaagagaaggctgggctctgactcagcagaaaccactgtctgacatttttagcctcttctttggtcctactggagggactcttcttcctacagccaaattagacagagtatctctaccagctcgccttctgctgcaccagctgccctcctgccaatcaacttggacttatcttgttacccttctgatgcttgagattcatagcacacatctccgagcatgatatccaagaagaggagacaaaactagcatccccagagatcagtagtgctcagccaggagtgtcttggattcctggggacatttcagaatgtctggggacctttttggtcatcacaacatggggagagcagggctttggtgctactgggatggctgctaaagacccacaaggccagagcagcccccatgactaagcattctccagtctccaatgtcaataatgctggtcttgagaagccctgggataaatgaaggcaaagaaatgtcttcatatattctgcagtgtaagaaatgagaaaatttcactgagcatctattgtgcatgtaaatgatatgttttatgagagagtctataagaaatgagtcatattcactaacatcaggaagtttctaatttatttggacatagtacatatgcactgaaaagttgtgttatttgctacagcaataactcacttgcaagggagattggtatttatattagtttgctagggctgcgataagagagtaccacagtctgtgtgacttaacagagatttattttctcacaggttttggagactagaagtcccagatcaaagtgtcagcagggttgatttcttctgaggcctctctccttggctctatagagctgacttctcccggggtcttgagatggtcttccctcagcagctgtgtcctaatcgcctcttcttttaaggacaccagtcgtctaaccaacaagggccactgtggagcacatggacctctgctcccatgttatggggcagcctggtgggaggggagttggggagaatggatacatgtgtatgtatgactgagtcccctttgctgtccacctgaaactatcacagcaatgctattcagctgtactccaatataaaattaaaaaattaacatacatgttaaacggataaaaaaattgagtaaagggcaccagtcctatggattgtgcttagtcgctcagtcgtgtctgactctttgcgacctactggactatagcctgccagctcctcggtccatggggattttccaagcaagaatactggagtgggttgccatgccctcttcctattggattaaggcctatctaatgattaattttaatgtaatgacctcttaaaagaccttatctctgaatacagtcatatgctgatttatgctagggcttagggcctcaacacacgggaggagacaccatttcagtccatatcagaattattttgttataacttgataaccaggggtagcaatataagaagcataggaatgtgttccaaagtattagaaaagtactggtgtgctttaagaaaaggaaaatgggcctaacacaaattttaaaaaatttttgagtcttcaagtaggaaatgctgttgatctgaagagggatggtatttgaggaaattctctgggatgaaggccagattacttcctaccccagctcattcgttcagtatattaatagctgcattgagctcatgttaggtagtacctggattatatatgttactctcctagttaaataaagattcttgccttcgggatgctcacaggcacatttgcatgtatttgtgggtgtcagtgcagtggggagagtgggtggaggataaggcaagaagacatacagaacagactttaaatactttaatatttgtgtggtcccatgggcgaggtgatgacctccgactagggtggtgacagggtagaaataaagcttggaacttgggaaactggtggctgacagctggtgtccattatgattgcccagctggctgctcagtactttgaatgtcatccccaggttgttgaggaaggtggcagaggaggaagagtgtgggctggatcttgtgaatcagtaggactttgccttgctggggagcgggctgtggagttgtaggaaggctgaggatcatgaatagagggaacagaatgcagtcagtctggaaaagaccagactgtgggcaacaggaagtcaaggagaacatctgtctcgctaaccattctgttctcagggctaccatctgacgcataataggttttcaataaatactgactgaatgaatacatgaacgaaagagcacagcacatttggaaaagggtaaacagtggagaaagcagggtttggagagaaagtttgaccatgtgtcagggcttcccaggtcatggggaaaaaatcaaagacacagactccagcacgccagagaattttcaggggggaggtgagagaggacatatctggggattggatgggaaggagagaccgtgtgttgccttactcatgaatcactcctgaagtgtccttttaggatgctttaatggctctgagttctcattccattcagttcagttcagttcagtctctcagtcgtgtgcgactctttgcgatcccacggactgcagcacaccaggcctccctgtccatcaccaactcccagtgtttactcaaactcgtgtccattgagtcggtgatgccatccaaccatctcatcctctgttatccccttctcctcccctcaatctttcccagaatcagggtcttttcattagtcacacacaaactgtggctgtatagtcatggtcattgtaatgacctgagtcttctaattttctaagtctcggttttctcatctgtaaaattgaaataacaatcatctcatcaaggaggattaaattacttaaaacctataagcatca

SEQ ID NO: 42173 - DNA, 720 bp, Bovine  19866881171382
aataagttggggactcaaaatagtcaaaaaagaaaaattcttactgcacaatctttatagacattttattttaaagcaactttttaatgttaacagtgggtttgtaaccagaaaagagtaaaataaaatagggtacccaccacgagcaaggttaaagttctcctttacatacacacaaatacacacacacacacacacacacatacactcactcactcattcactcactcaatttcatgtcagaacaattggaaacattagcgaataatatcatttaatgaaaggctggggaaactatcatttatagtatttatagaaacctaaactactgtttataataaattaaataacttgggggattcaaaaaaataccaatagctgaaccatgaaaataaaactgacccctaaaaatagaaaaagatgtcagaaaaataaattagcctcaatgctgttttttcgatgtcagatttgttattaacaggaaaccatttgcttgaaaaggagtaaaattataactctttatccctggaacccaccttcagccacttcagtgcaatttctagcagcactatttggatgcgaaaagaacgccgtcagtcaatgtttctgaaagcctcacagtcagaccttccttcaaatacatgttcttagggtcttacttaacacactgcgcatgtgtacagaagaataaatgaagataatatctgacagattacgaaa

SEQ ID NO: 42174 - DNA, 739 bp, Bovine  19866881171628
tgaaaacactaaaagtgaaaatgtcgaggacacactcaaaaggtgacctcaaaatgtcatcttttaactttaaataggaatgataacagaagagtttaacgtaactttaaggctaatgagcaaattttccatgctctcaaaatttgtttcaaataatctctcatgtccctttccagttcaataaatcgaccgtacctgtatatgagcagcatctgtttcttcattaaaacctagaaatgtgacctgaataaaaaaggaataaaggtccattaaaatttttaagtcttgtctcaattagattgttgacagagctgagaaacagaaagcaaagcacacaatgcattaaaatgctgctgcaagatgattaattttttcaaagatgatcacaaaggtttttcaccaaaggtctggctccaactggggttcccaaacctctcccacacccactcattagcaaattcaatcctcaccctcaaacataaagcacatgtctcttctctccacagcctctgtggccacttctccccggcatgaccccagtcctctcctacctgcctcaggaaccatcctgtcatttccctgtcaaaacctttccaagcttctcaatgcagagtcctaatggaggtcccaaggctctggcttagctggtggcttcaactttccctcaccttcattcaaacacatgggccccctcgctgggtccaggacacgcctgattgttcctgcctaagggcttcag

SEQ ID NO: 42175 - DNA, 863 bp, Bovine  19866881214874
tagacgtgttgctttgctgggaccctgtagccagctgcagatttttatcttcccttattccccttctggaattgttctgggccttagaagtgtaagcttctacctttctgcatcatttttcttcaagaatcttgtgtgctatttagtgttctcataactggacccctagaggttggatatgggaagtttggctcctctgcatatcacaggtgagaatgatctggtccttctgaagcctgaaatctccagcagactattcctatctccacccacttaaccttggaacgtgatttcttgaaatattggtgtgtgtttgagcctcagctgtttctgtcagagaaatcactttgaaagcttcattttctgggataataggacttcagaaatatgaaatttctcactgtccatagttactggattattttaagcaacaaaatcatgtataaaatgttacaaattgtttagggtttatatctttcttactgacaagcagggcttggcataatctgaaaaataagcattcataaactgagtctactgaaatggaaaaagagaattacacactaagaagaaggagaaagccaaatgggttagcttatctgatacatctaagtaaaccagttccttgggagatacaatcatttcctggtactaaaaggaacatgttgtgtctgtatatgttctaacatgcggaacacaaagccacttactgaacgacatcttcgagtgcagttttggagacaacagaatgagcccaggtctgacaatggattgtgtgtgctcagttgctaccctaggagggtagggtgtgtcctaccctcctagactgcacaggttcaaatcccagctctgctgactgccac

SEQ ID NO: 42176 - DNA, 826 bp, Bovine  19866881322373
atgtcatttgtcacaaggtcccattccttttgaaatgtttttcctctttggaattacagtcaaaagaatcttatggcttgagagcattttgttttcttggttcctgagatgtactcatacccaagccattatatgtgatcattatttcctaacattttgaaacattcatgaaaagctacaagatcactaattccaaggctgaagacacttaaagtcaaattccattagtaataaataatcaagcacctagctttgaagtacctgatactatacagcatgacaaaggtctgatctctatatcctatggaagaagtgctcggtccagactggagaattccctaacacacttatattcaaggcaatcacaatattctactttgcactaaaatccaaaaggcaaacagcctgtcaagtcatcctgtcagcattcagaggcactcaaataaaaacttaggattcagtgtccaattacaaatactctagcttccgttcttctttaaaataatgttagaaacgtagaggttgtttgatgtgccttctatgcttttgttttagtccagtattgagtgtgttaacaagatactacagattgaaaaccaaagtcaggcatctcttaagtttattgggaaattcttaattgggagagaaagatcacagacttaaacaattggaaaaaataaaagaacaattgatcgcaaattattacaaaagtaatttctgaaatgtttatttttgagccactgcaaaaacaaaattttagtgcatcctgaagttcatattttggtaaatgaacatattaaattactgaaaaagcaaaagaaaaaag

SEQ ID NO: 42177 - DNA, 1361 bp, Bovine  19866881341614
cctataccggggatacatcattatctcaacagtcattgagaaagcagtattccattttatacgtgagaaatgtgaggctcagagagatgaatggagttagttgctcaaggtcacgtatttggttaacaatacttgacctccatctttgcttgtgccctgtaaagcattctaaccaaattttttatatttatttatctggctgagctgggtcttagttgcagcatgtgagatctagttccctgaccagggaatgaacctgggtccctgcattgaaagcacaaagtcttagccaccggaccatcaagaaagtcccccctaacaatattttgagttggatctttcctccaaatgtctaggacccataaaaaaaaattgaattaatacaatcttaaaatgccaaaaatttatacatgcctgagtagaacagtttgctttacaaggtttgctcatgttattttttgtgaattatgataaatgcaaggaaagtttaacaatcatggaatgaaagaacccaatatgattttacaaatgtgtataaatcctttcctcaaagaaaccctcccctggacctggaataatcatatgcctctcagttgaaaatccatattggtgtgtaaataagcagctacaaatttcactcacccaattatttgtcctttcctgagtatgcaatcaatttggtgtttctaagcatcatttatttggaccacaatcacacatacaactgctcatttttgcatctaattcaggcttggttcctccagtggctgcctgtgggccaaagtccttgaatcaatttgtcatcacatcagatgtgagtgcatttgactgtgacctacacaattttagaaatcaagttttttcaacaaggtattgtttcttgaaacatcatttggccttgcgggaaattgactggaaactggagttactctctgactcagagttccaaatccaggcattgcccgaagtagccaaggcagtccctgaagcatgtcaatgaggtgatgctctgcaaattacacagggctggccagctactaatgaaactcactgtactcaatttggccctttagattaaaatataatcactttcaatcaaatacatggcagtcatcactttatctgaaataaatctgtatgcacttaatgttactgttgtttcgtcactaaacgtccaactctttgtgaccccatggactgcagcatgccaggatcctctgcctgtcactatctcctgaagtttgctcaaactcgtgtccattgcgttgatgatgccatccaaccatttcatcccctgtcactgccttctccttctgcactcaatccttcccagcatcagggccttttccagtgagtccact

SEQ ID NO: 42178 - DNA, 1023 bp, Bovine  19866881380682
tgtattttgttccaacattatttctaatggtttgacatttattaaatatagtaattagctggactaattttctttgtgccaataattgaaaaatatgtcatacatttgattttatatgcttcatgctatacttggccttctcatgaacttttgagaaaaaattttctttctcactttaaaggacaggaaaaagaataattatctgtaaaaggcatcaaaatggtcctgtaatttttttaatattatagtagtatttttctaggggaaggattccttatttgtccattcaggaacactgtaacttgagcagttatacctgaatgactgaaaatacgtaaactcattacaaaaatacagtataatataacagaaggcacttcatgtatcattctctcagttaaccttgttcctaaaaccagttttagaatattttattaattagaattatttcctttattcgtaatgctgtacagaccttcctgagtaacctataaaatgttacaaaatctttattcacattaagtgatacttggaaatagtaaacactgaccatagctgagcctagggagaggagggggttttgggcacttgtagaaaggaccctgtgaagcttctgcagaacaggcccttggaatggacttaccaggaggaggaggaaagaggggatgaggaagcagaaggaaaggaaatggtttttcagctgttagaacacatcatctcggagtacttggtttgatgcttggattaaccagtgagtgttaatatttttatatttttattgtcatagtttttaaaatgtgacacaagccaccaacattttacaaaatttaaatccaaaaaaggcagtctttaaaattagtagtaggaagtggggtaatatcacagattatcatttggccctctccatagctttagaatgtttacacttaaattcttctctcactttgagaaacaggcttctagaatttcagtggagttgacattgtgcttagaaatccggtgttaaaggggagaacttaaagg

SEQ ID NO: 42179 - DNA, 3552 bp, Bovine  19866880391618
caaaagagacactgatgtatagaacagtcttttggactctgtgggagagggagagggtgggatgatttgggagaatggcattgaaatatgtataatatcatatatgaaatgagtcaccagtccagattcgatgcacgatactggatgcttgggactcgtgcactgggacgacccagtgggatggtatggggagggaagagggaggagggaggagggttcaggatggggaacacatgtatgcctgtggcggattcatttcaatatatggcagaaccaatacaatatagtaaagtttaaaaataaaataaaattaaaaaaaaaaagaacctcaaaggcttaattgtcctttatattacatagccatatgtgctggccggtactgctcatcaaagccactcagatatcaagcaggtgaggagctgctctcctagatatgtcaggcctgaacaccaaagagagaggagtgtctgtgtgtgtgtgtgtgtgcatgtgtgtgtgtgcatgtgtatatgtgtagaggttcttgtgtgggtatttacacaaggctccagcaggaagcattcatgaatcatggccacatctagtcatatggcctctcccaacctcaaagatgtggttactttataaagtggctgcaaagagcactcctgccaaaaaccttcttggggagaaacggcaagcgcccaaagaccagcaaaggtgctcaccgtaccagccaaagcgatgtgcgctgggtctgaatcactcctgcaggcagagcgatggaacagcagatgaaatctcagctctctctgactcccagatccatgctctggtgaacagctttatttttccatcttgttaatctttattatccaaatattgaaggaagtgtttaaacccacacaaagctacagactagaaaattgtcctatcctcaggaaatttcccaaagaggaaacgtttgggagaaactgatgacattagtcactgtccggtgccctggctcaggctgagggcagctgagacaggaggagggaggaggtctgtgtgtgtgccccatacatggggtacgctgcatgagtgagcttgtgccaggagttgtgaccctcctaatcccatatgtgcagaaggccgagctcagagaaggtgagagacctgttagggccacagtgagcttctgtgaggtgaggccatctgagccccacccatcctgagcttggctctgtgcgtggccccacaatgtcctttaagagatcctactcatccaggagcattaagccgagaatgagacttttctcttgagaactcagtttcttcttctgtgtactctcctctcttcccagggggatatgatgacagtcaatacaataaaaagtcatgtcagtgttgaagcgctaagtctgagagggagaatgaaaaacagcttctgcacaggtaaggggtgaggatgacttcgtgggacagatttcctttggggttttgcactaaggctcctccactgactttggtgcaggacagtgggcttaagaactccgccttccttgcattcctttaatgggctcccatgctcactgaagcaaaatacacaaaaactccctgtaagtgcctggtaatgcagcccggaattgagccctgcagaattattagagccatccatcttaattacactgaaaatcacttaagtgctttacataataacactgcatttacaatctcccagcaccgagcagaggctggcagggccgtctcactttctcatggaatgtttccctaaggtcacatttcttgtttcccctaggtcacatttcttgtttcccctctctgggtgggaagatggttgggtgtttctttaactccccctttcctggtgggccatgagttcagggctggttcccttgggaactgagtcctctcctggacacagcccaggtacttcacatctggtatattatcagtccttagaatcaccctgggaggtctgtgtgcttatcacattttacagatgagaaaagagaggctcagagagactaggtaacttgcccaaagcaacacagctaagaaatggtggttccaagaagaaaagctcctccttcatagtgaaggtatgtctgcagattccccttccttccttgttttgattctgtggtttccaagaagcagtgatgcgaagaaactatctcctcatctaagggagcccatcctatatagctccagaaagcaaacacacacatacacagaccccacaacacacgtttcacaaatgcatgtacacatttccacaggcatatgcacacacctgcacacatgcatacctacacacacattcatacaaacacacacatataggcatactccacacattcaaacacacacacacacacatgcacatatccatcgcatgcatatgcacaaaccccacacatataccacacgtatgtagtccctcccagtctagcacagacctggctctctccattaaagtcttatcatgtagggtaatgctgggacccccaatccttgtgcacatgggagggaccatgaagataaaactcagttggactctaagctactcaggaagaaaggtgctttggggtcagtctcaggaggtggacctttcccatgagaaagagctgggatggtgcacacatgtaagtactcgggactggagagcagtgcacagacacccttctggcctaagggggccccgcctgcagatctggagactactgagaaccaatagaacttatatacacatatacctttttgtttgtttgtttgtttgttttttactggaaggaattggctcacgtgattatggaggctggtgagtccaaactctgtagaactgatgtcccagttcagatccaaaggctggaagacccaggaagaactgatggatgatgcagttgaaaatcttcaggcaggaagccttctatcctaactgtagggaggtcagacttttattttatttatgtcttcaactgatcagatgaggcccacccacatcagggagggcaatctgttttactcagtccgttgatttaaatgttaatctcatacaaaaatgccctgatggaaatacccagaatgatgattgattacatatccaggcactgcatggcccagccaagttaacacatcatattaaccatcacagaaagagtgtgtgtgggttgtatatcccctgccagggcctgggcatgaagcctgcctctctgagttttcattttctcatctataaaggaggtgctgtgagcagcagaggagctaatgaatcagtgacactgatgcccctgtgaggtacttagctcatgacatctccttccagactcatgctggtgtctcaaccatcctcccagaagaaacccacacaagtgctggggttaatgtttttaatcactcaccctcttctccttggccacagttactgcacacccctgtagctagtgtctgtgggaccacaaaccatgattctgtggattctgtaaggtcactataatctctagtgtcagtccccccagagaacaggaaaaccaatgtgtgtataagcagggctaaagcaccaccaca

SEQ ID NO: 42180 - DNA, 1628 bp, Bovine  19866880392662
tttggggtccccggctctccttccactcacctgccttcccctggagccctggtccccactcttgtcacttcccttggtcctgaccacaggtcagcgagagacccctcaggaggtcagctgcatacctgactggcagctcacatagtccatccatctgagcaccccgttcctctcccggtggcagccctggatgtgggtgtgccctggcctgtggtctcggtctcctgaaggtgtccaggactcggtcctctggaggcctcagagcctagttctgctcatgccccacacctattgggctcgagggccctggggtgggcctggggtgggcctggggactgtttgcctgcctgtctctaacctccgtgctaactgtccttctcccctctctgcgctcagtcgattccatgggacctctgggaggtaagctgtgctggcgctgtgcccgccccgcaggggagccgctgtgctgtgtgtgcggccccgcccaccgcgtgccgcaccgttcacaggtgcacgggcacgcacggcggcgcctcccgctgttagggaccctgcgccttcagccaggccctttgggacagggctcctcagttcagcctctgaagagttccccagggtgcagcccagttttcaggggctgtgaatggccctagacagtgaccagctggtccccagggtggatggggtgtccctgtactgggcccaggtctggggagcagggggacctcggggtggaggggttttctgtcagcagaggccccttagggcagtgggactagcgagctggtgggacacaggagagaggggtggcgactcgaggagcaggacaagctgcctgaggctggaccgggagccgccgtcacctgggggctcagggacggagactcggggggcaggggacgccccgcagccggcgatggagctcctgcaggagcaggaggggctggcgtgaaggccggcagcccaggcctggggcttgcgaagctccaccggaggaggcccgaggaagtctggcgccggcgggcagcgccgcttccctggcaggagctgcgctgctgcggcatccacacctccctgccctctgggcactcagctggcccatgctggcggctcaccaccttcttctcttgtctcctgccccgcccgacacctccccctgccgccccggccctccctccccgttccccgcgctggcccgtcactagcccacagagagtccagctggcagcttgccttccggggagcccagcgctgccgagggcacctttgctgtggcctggcccagccagacggccgagccggggcctgcccaagtaagtgccctgtcagcgcccccaccctccctgcctcttgggggtgtagcatggaggaagaggctggaggaaggggcacaggaggggtcacggtgggactgagggtgagcctttagccaggaggcccctgcacagggcttgtctgtcactcgtgccggaggggcgcagatccgctcagccctcgtctgctggccagcaccagcctcccagctcagggcccccgcggtgggagggaggtgtgttgagatgacctcctggtttacagtgggcactttctagaattctccttgaatcttcagcctaacctagacattg

SEQ ID NO: 42181 - DNA, 2158 bp, Bovine  19866880453881
ttggacacgactgcagcgacttagcagcagcagcagctctaaattccacttttcaactgatcagaactgttaatttgttttatcaagaaaggtttgcctggtctgctactcagtaataaagggaacacatcatcagcacatgtcacaatgtggatacatcattatgtgaagtgaaggaagtgagacataagaaaatatatatgattttgttaatatatttccagaaaaggcatgtatccagaaacagaaaacaattcagtgatttcctggggctaagatgaaaagcagtgatggtgagtataagaaagatgttctaaaactggatcatggtgatggctgtatgaacgccttactaaattcaagattactaaaaatcttgaatcatatacttaaaatggatggatttatggctcataaattatatcaatatggctattaaaagccatattgtgatatggctgcctgcaatacttggacaagtacaacttctataacataataaggatcaatactttagtcttaaaaataaaacaaacattgcaagaactattttgtgctcctagtatagtttttgtgggactgtaaaaaaagcgaggggaggggttaaggataagtggataagttgaggtgcaaaaacagtatccctttctaaatgactactctgggccagtgtaagaagactgtcagtgtggacgcccacccacccactaacccccactccgcacatgctcattacttcactgaaagcttcaccaagaaagtttctcttgcaagatggatgtattacacagcagcccctctctcaacccaagaactggaaaattactctgtccatacggtgagcagcatcccagctctcagcctgcttacctggtatggtgtgtacttcatccaggatcatgaggccccattcctgagttttgagccactccatcacccgctcagcctcccaggaccttttggtggtgtggcccagcatcgagtaggtgctgatggcaatggagcagcctatgggcttgtccttggcatcggaggtaaagcggcagatctggctgtcgtcgatggtggaccacatcttgaactgggctttccactgctccacagacacggccgagttgcccagcaccagacagcgcttcctgacagtacacgcggctgtcacgcccaccagggacttcccagcacctacaagacaccaagggcaacccccccaagccgagctgaaatgagggacagggacagacaaaaaggctcgccggcacaccaatctggcccaaattattcgtacgatcctcacagcggacactgttgaggcattttttctgctccaaacctgtttccttctttacagaaaaggaggcatgcccacttcacacacagatgtgaaaactgagagacaagtgccaggccctgttagagcaccatatatgcaccttgtttaaatcttaaaaagcaacatttgtcaaaacaaactatgaataagagacacctctactattgccgttttaaagatgggaaaactaaatctaaggtgcaacttgcccaagaccctgggacagcagtgctgctagggtacagtgtacccaacacacggaccaccttcggagggactgagtaaaagatggctactaagatcacacaatcaactgggctgagcactcaggaatgtggtagtgtgaacactgctactggcaaagacacaggaaggtgaaactccaggggcttctgagtttaccaccatccaccatgagaagatcaagattaaaactcaagctgttcctttaaaaagcaattcttccttaaccagggatgtgcttcaaagtaacccatggagcttaaaaaaaaaaatgaaggtgcaggccccttcctgagacagtgcaccttctagagtctggggcagggctccagctgactctactatgactgccagcctagaacctaggctagaccagacacgactcaggacagatgcagagagagcagcccacccacctccttcactcagtcactcaccacaaggaaggacaatgaccccgggagcgtgcacgcccgttcccaaacatcttccgcaaactcttctcctgataaggtctaaggacagctgtgggcttcaggtcaatgttgatatcaagggttgacagaatcattccgaaagtca

SEQ ID NO: 42182 - DNA, 950 bp, Bovine  19866880560082
aatatagagaatttaatggctacatttaaaaatgtacattaggtcaaagggtaaatttacaaattgataatcagaatttgcaccaattaaaagtttattctcatatttatccaagtttacttttatttacaatgatatctgaataaaaagaaccatgtgaaatgtaagagatgtcagacattaaaagtatttttggtattaactcttttataatatttcagaatgcagggtagcaaattttaaaaccaacagcaatagaaaaaatgtaaaccttttacttactaagactgtattaaaaacaagtgcttgtttttaaagaagtattcttatccttagacactgcactttcacttgaatggggtatattccaagggtttggcctactttcttttgcctgtaaacctttccagcgcaaatgtttccactagttctttcttattccaggtggaaaaaaagtctttggaaaaatgagaatatgacaaatctattttgaagcctaagtgtctaacagagttagatgtaattttgttacttatctctcccctccaagcaatgctaatgctaaatcaccaacagttaattacacaaataagtgaagacaaaagtgcttttcagtacagtcacaaactttactgtcctcaactggcattaagggactcagaaatcctacttggggacaaattctgcatgtatgctggagagcagacttgtccttgtcttccaaaatgtctatggcacaaaaagtccataacctacttttctgcaaaactttcctggaatgcccctcaagtcaaacacaagttcataaatgtcaagacattaagaagaaagtacgcccccaacctgaggcatgtgtgtcgatgtgtatgtatatgcatctgtggtcaagtgacattaataagattggcacgtgtacaagctcaagtctgtaatgtctatatagttcccta

SEQ ID NO: 42183 - DNA, 1427 bp, Bovine  19866880682080
cttgaggaactcaaattggttggaagcacgacatggaagagggaaagcttatcaggtgaggagtgacaaggacgccactggctttctctttattagagaataaggaattttgcatctcttcaatgcccactgcacaaaagaactgctgtctcagagatgacttctctctctgtactttcatgcactccctatctatactctgcttacagtgtctactctgtgatcagaatagctactgaagaccctctgttttgatcaggcatgaaaacagtagccagtttataagtgccatggaaaagacatgtgttccacaagcttcccacatggctgaccatttctatgtagcaaagtgattcagactctttaaacaaccaaccctctctctatgctgctgtctcctggccctgcaaatttcagcttgttgaactattccataatatggtaaatgccaccaagggagctgaggacagatcacaaggtggcacagccatttctctcgtcctcacaagaaccatcaccaatgatgatcagtgactccatcttcaaaggaggatatcagggtcctcactttggtttgatgccaaagccctggtttgtgccattgtaaaaggaaagagtcaattttgactcttctgtgctagatctgtttctttggccactttggttattacagtcacacataatggcttgcctcagagaatcccgcccctctgcctgactggtaagctgaagtgcctttgttcagaaccctgtctgcctgtggatggcagaaggaagaaatttacacaaccccttgcctgaggtttgccattctaggagacacttgtaagattttactttctttcctcacctccccccatctctgatccttaaaagaacctggcacacagaccccaacaagatggttatttgaaacactagtgtgccagcttcacagacaaccagctttctgaataaagttgtcttgtgcagccagcagaacaagcttggactcagtaacgccataactggctttcaccttaccctgtggaatttacttttgttctgtaaaatgaatgttgtttccagggggacaggggtatcagcattctatgtggaactgccaggcaaggtggtaagggcaccagaggaaaaccccagaagatgctgcttctcctgctcagctgtctcctgcccaccaccaatgggaagaactgcctccaatgctggcaagagctgcctgcactgatagattatgacctgcagattctttggggcactccagggccacccgcagagctctcccaaagcctccattccctattcatggacaatcagtcttctcctgaaaactcgtaccttggtgaggcacagccaggagaccccagggatcaagggctgacccctttacctggccccggcgtcttaatcctctaactttgtcccaa

SEQ ID NO: 42184 - DNA, 1279 bp, Bovine  19866880761277
gtcgctccttctcagatgggacacagccaaggagaacgggcgccttcgcctgctcccctgagcacaagggaggccaagccagaaaggccgaacccacaggggaccgcaggaagatgccttgccccagaggacacctcccgcagccccccagcaccctcaggggactcacacacctaggctgggccttgactgtgaacgtgttgctcccgtgctgcttctccagactgatgagcacatcgttgaggttctggttgagctgcaggagggacagcaagcatgttgggtgggggccaccaaccagccccacctcccagcgaaatccctgcctctcttctaccctggtcctgccctgtgcctctgcttggaccaggaacaagctcttgtctctccatcagtgggagctgggagccagcacaccaaccccagaaagaaaaccaaagaggaggaagtgggctgcgctgcttagcatcacggtttctgcggaccatctttttcttctttctacttataggcacttcctaaaatgccacacaaagcttgtactgttttattttgcttgttctttttttttttttccaattttgcaaatgaactgttgatcctaattgctgaagtcatttgccaagatgctttcaggccacgttacaactgacagagatttcaccaaaagcaccagcaggatgagggactgaccccatgcatcttgtggttctgcttactgaaaatatttccctctccttcagccactaggaagcccagagctgaatcttcctcctgactttacaaatattttctccccaaaacacatctctgtttttttcttttaatttttcacaagttgtctcatactgaagggaagaaggaaaagaaggaaggaaaagggaaaaaaggaaaaatcaggcagaaaacaatactcagggtggtccctcaggacaggccccaaggtggccaaagcctttttcctgtcctgggcttggaatcccccatgatctatagcttcattcttctgggccctggagacagtcaggcccacccacggcacagggaaggaggaagttgccaacatgaggtttttacaactcagctttgcagtttaactgtcattttcatcaaaatgaaaataatacaacataggaatttaagctaatcagaccccatcttacatcagattccagtaggtaaggcaaatctgctttaatgtcttcaggaatattaaaaaaaatttttaattggaaaaattttactatttatcatcagcctacaaattgggaaaccacca

SEQ ID NO: 42185 - DNA, 1819 bp, Bovine  19866880789389
cacagcagaacagccccttataatgtttttaaatcagctttcttccaacttccttcatgttactggcaaggtcagaagaggatccacttgagcaggtagctcccctcggttcctttgccttatcttattatgaaggttaaagagaaactggcttgaatagagattattactaacagaataactcacaaatcatttccctacaaagtttagggcatatacttaactgaagtatacttgacctacaacactatgttagttccacagcatacaacactgtgattcaatacttctatacattataaaatggtcaccaccttatgcagttcttggctttcaggttttgaacttgatatttgaggtctgcctaagcagggaaaattttgaggtgaacaacaggctcctaattctttcagatcatgagtcacattgccatcctctaagagtcactaggcaggtccattctgtacatgtgaccgagctccagcatgctacagcagactctactccatgaccaacactggttaggaatattctccttagtctgactatggccatatttggggtgtgacacaccacaggaaagaagtaacttcctggtagctcgtaagagcccccagaaagactgatgaaaaactttaacaacttgcttatcaaagctcagtcttaggctctcttattctcttcagtaatgaggtccatttcccacagctttaaatacaatctcaacatacatcatcattgtaactaactttgagtgctttctagataccaggcatgattttaaggatgctatacacattaactcatttaatccttataagaactctgtgatctgtacactattatcaccctccttaaaaataaggagctgaggatttccctggtggtacactggataaaaattcacctgccaactgaggggacacgggtttaatccccaatcagggaagattccacacgcctcagcaactaagcccatgtgccacaactgctgagcctgtgtacctagaacccgtgctccaaaacaagagaagccaccacaatgagaagcccatgcacctcaactaagagcagcccctgcttgccacaactagagaaagttcaagtgcagcaacgaagatccagatcagccaaattaacgtttaaaaactgaggagccgaggcatagaaagactaagtgtcttgtccaagattacacatgtgatgatggataaagcctaaatgcgaactgggtcaaatctgagccccccttttttttcttatttttaattggaggatgttttataatctgtgttgtctctgccatacaacgtaagtcagccataactatacatataccccttccccgttgaacgtgtctcccatacccctctatgtcgtcacagagctccaggctgtgaccactgtgttacactgcagctccccaccggctgtctgtttgacacctggtaatgtgtatgtttcaatgctcctttctcaatttgtcccactctctccttaccccaagaccccctattcccaaccactatgttctaagcctgtgtgctgtgtatgaaaatatgtctcattcttatgttcaattgaactttactgattctgtgaacctccacaggacagcttcccttttggaaacctgaacaacaggactagctggaattgttttcctatggcattgtagaggcagatgaattaatttaaatgttaaatttcttaaccatagcacattttcattaaaaaaaaaacaaaacaactgagtacttaaaaaacacctcactacttaccttttatatctctatgaacaatcatattactgtgcaaa

SEQ ID NO: 42186 - DNA, 2550 bp, Bovine  19866880903598
atgaatattcagggttgatttcctttaggtttgacagatttgatctccttgcagtccaagggactctcaagagtcttctccagcactatcactattttcactatcttgaaaagatagcctagaacaaaagagtcagaaagcacctcattttctagataggctgagatatgagccaaccatgtgtctctgtgttgcatcaaatggatagcagctagagtactgtcccaggatgggctgcctgggcatagctgggtctggtttcaccttctgcttctggactgcagagctgtggtgggctttacatctatggtgtgtggggtttcctagggaaggtatctgcctggctctggccctctccatctccaggactctcagagagagtacagccatgccttccttcatcctgccagggtccacatcccaacccctttttgggtggggttttacctgcctgggccagcagtcacctggtattctgtagagccctggatcctctcctctcaaccctaaaatctcccaacatgaattctgggtgctgccagaatctttttttgtcccaggtaccaaaaagcataggtacctgggacttggagaggggattttgtattctcagtgtgttatttttagatcccttagttctgtcatcattgtaaacttcagggagtatcttccctttagaaatcttcaagtgagaaatgagtcctggtttctacatccatgcatacatgtgtgcgtgcatgtatgctcagtaatgtctgactctgcgaccccatgggctgcagcctgccaggctcctctgtctgtggaattttccaagcaagaatattggagtggggtgccatttcctcctccaggggatatttcccaacccagggatcaaacccacttctcttgtgtctcttgcattggcaggcagattctttatcactggagccacctggaaagcctttccatgtccacatttagctccaaagtctggggcactcatcaagctttcccagaactgtgctagggccctgttttttaagggctagctctagaagggcccccaagcttctgcctcaccaagctcctagccaggcagtcaggtaccaggctctttctctaggggaggcctccgtctgtgaggggttctcttggaaacccctccttaactcttttgcttttctggggaggtaggcagtggctgtaggcagtgtgtccctccatgacccctgtttatcttgattactatgtggtaccctaattttccctttcctcctcacacagaatcaggggaggtggcagttagtcatgaaatgactgtcccacaacaaatgactggttggatgacctggcttctgtattcagccaagacgggcacaggcatggcttaaaggtctgggacctgagaagacagacctgtggcaggtgtgcaaataattgtttcaataaaatcactgaagaagaggaaatctccctcctgaaacatccccattttgtgggaggggttgagggagaactaggtcaagcaatggtccctgaacaccaggaagccaccttccacggaaattacctgccttggaaattgggtcatgcttgcactgttgggacctgggagctccccaagctcatctactccgtcctgcctcccaattcccttcccagcagcagtgaatgtccaaggctggactatttttagccacttcatcagctggtcatgtgcagagggttctagaactgcagaagtctggcccaggctactcccaggccttggagagttggtggactcgacctcaccatgtaaatggggtctcaaagtgagcctactgaagagctgagtgctgcgccatcccccagacttaggcacacagctaatcagcatcttcctgatggaaacctccagaagccccagatcctgaaccagcctgtgatgcactccgtgccatggatgcactcatgcatggtgtgctcacttctactagatcccacgttgtggctgcctccagttgatccagaccatccagagcttcccatatctgccaggctgtacctgagcacacaatggaatgcccttccttccatctgcctgtcacagacatttctattcacaaactctgttcagacatcctattttctgactacttcacccaagattcacacactgaaagaatatgtttaaatatgagtctcccctgttaggctggggctcctcaaggccttaagccaggcatgtcatagggaccctaaaacatatatatcagacagaccttacaaagaccatctgtagagtgagtatggtgatctctagggtgttgggaattcactagttcttggaaaatacatactttccttagcatgggagaacttcttcctgctgcagcattggtttctggtcccagcagagttcctggctgacagcttctgtaagtggaaggaggatggggcccctgtcaggcttagtgtaagtgagttgcaagaatttcagggttgagcaaagaaaaagatatgaccacaaggtggcagtaaaacacacaagtttgatttgggagatagtttggcttttttttt

SEQ ID NO: 42187 - DNA, 2791 bp, Bovine  19866881030869
cctaactcacctgggcccggcaagggcagctggtgttttgaacacacgcagtcacacagatacatccagataagaggcgacgcacacaatgatgcacaccttcccttgcaagcacagagtctcatacagggcatacaacgccaggccttccagccccttaatacacgtcgtcagccctagagtcactccacagttacatggccccacatgcacatgctccacgaggtctctttccacagcccagagacccacaggtacagggtttccagctcagaaaggcccaggcctggggactggaaggccagcctcagagggagcagccccagaggatgaactgggaggcgaaggggaggcctgcctccagccctgggctgcctgcacgcccccgcacccctctcccactcccgccccccgacacaggctgccaggccgcagcaggatggagggccagagcaccgctcaccttgatgtcagggaactggcccaggtacgtgtccatggtcagcagcgcctggtccaccagcttctggtggtaatccatccagagcaggtcattgttctgcagaaggcgagagcacaggcgtgcacactggggcgctgggctgcagcagggccagctccccctcccggggacccaggggccagccccgtcgccccacagctgggcggcacctcagaacctcagactggtggtggtggtggtggcttagtcgctaagtcgtgtgcgacccttacaaccccatggactatagcccaccaggctcctctgtccatgggatcctccaggcaaaaatactggagtgggtagccattcccttctccagggggtcttcccgacccaggaatcgaacccgggtctcctgcatcgcaggcagattctttaccaactgagcgatgagggaagcgcaacctcatctataaaacagggtcacaagtcctgccttttcacaaggtgaccttgaggatgagatacgcccagggctggtggggtcggggagggaggcttctggagccaggcgatgcgactcagagaggagagatgcctccagacaccacaggaaacgcatctcagcgtgacgtctcagaggagaaaatgacccccagagaggggcagggccttgcccaagagcacctggcatgtgggaaccggaagggctgttcccagagggtgcagggtgcgatgggcggccagctgaggtcagaggcccctcagggcaaggaccaaggccgctgggcccacactcacctcagcgattttgcttgcttcatccctgccaggccagtcgggctcgtacacctcctgcagacactcgttcagcttcttggaggcctcatgcatggctagtgggaagacaggccacactgcaggcagggctggtggcgggggcagggggcgcaggggctaccccttcccccacccctgaaggcccaggaggtgtgtggacatacctggcagccctgctcccctcccagctttgcacccatcagctccacctggggaaggccccgctcggtgtcccaggaagcccacccgtccaggccgggcctgccccttacctttgaccgaggccaggtaggtccggaggtccttctgcaggcgggtgccctcggtctacaaagagaacgacaaggagaaggggagggcctggagcacagcccacacctgccccctgccttccgcatcctggggacacctgccacggatgggctgtctactgcaaagcatcgggtctacgggagactagataggaaaacaccctggctttggggtatggcggctactgcctctctggccacagacacacactgggctcccacctggggagccctgtgcctgaagggacattcaccttctctcccaggcactgttctcagccctggaaggaaggcagcaagacagggaccctccaccctggacgagacactggagcacagcccgtgtgtaagatgggaccagtgggtggcaagcctgccctcaggcaaccatgagccaggtgaccgacaagcacaggaagatgatgggggtacagggaccacccagcacctggtcctgaaagcttgggttctgcctgaggccagctggctcccagcgcatcccaccggagatggggggccgggggcaggcctttacagggtcaggagggttctgatggacagaggacgacctgctggggagaggagagacccagaaggggggaggcctttgaaaggagtgcagagaagggtggggtcgtgtccaggcttctcaggataccggccctgttgagagggaagatgcaggggaaaggggaaaggggggagtggcccagggaatgaaaccctcggagctgggagggcagccccaggggcttcctggagcagtagggccagcagaacggtaaaaccatgggtgcagcctcaactccctctggcgtcagcaggaggcaggagcaggaaagctgagctccaggtgtgaggacgggtgagctggctgaggccagcaaggaaagtctgagactcccgccagggagatgctgaagtttccagaagccgtgtggaatgcaggagattccacacacaggctgtggggctgtggagacccagctctgtctctactagacacatgtgttcaggcacttcagtcgtgtccaactctgtgcgaccccatggactgtagcccgccaggctcctctgtcaatggaattctccaggcaagaatactggagtgggtggccatttccttctacatactagacacgtaaccctaagaaagttactgaacctcttggagcctcagtctcctcatctgtca

SEQ ID NO: 42188 - DNA, 686 bp, Bovine  19866881064642
agaatgatgggcgggggagtggacggatgtgcgagaaggaggctcataaccaatccctgcagtcagcctcctgggtcctgaggcacaggcacagggcatgggatggaggggaaggccatgcacgccccgaaagagcaagagaaggcagagagagagctgggccgcggtggccgcggctgacctgggaaggggtggtcacgctgatctcagggacaaacgtgtcgtcaaacaagctgaggatctgctcctgcttgacctccttggacggggtgtgtttgggaggcggagggactggtgggcctttccgaagctgggggtcggcggcaggtgagggggccgcgtggaaaggcgcagcggagcgcgggggtgggggggacagagacaaagccacggttagtcacctcccagccacggccccaccagcaaccaaggaacacagacagggaaagccatcacccccaagacaccgacacggagaccacaagggcccctgggagcggccgaggcccggcggtcaggagccctgcacagagagaggtgggtcagagggcaagggagtgagacaggagaaagggagagagcaagacagaaaagaaggcaagacgggcctgccgggctgtcagggccacgtcagagggtccggctcctgctgcccttggtggggaagctgaggagagaaacaggag

SEQ ID NO: 42189 - DNA, 1040 bp, Bovine  19866880398554
tggcaggattaatgcttttagcagaaatgaatttagagaaatttgaggaatagttcaggctgaaatatatgtgtattccagctagaagaacaatttggcatcttttcaaagcaatatctaaaaaatatatgttcaacacttaaccagaggtaaggctaagtgcttaatggcaaaagactgtatcatttattgattgctacataacacatgactcagcaggttaaaacaacgtatattatctggaaataacggtgggtcaggaattgagaagaggcttaactaggtgttttctagctcagggtttctcatgagtttgtagttaagctgtcagttgacacagttattatatgaaggtttgactaggttggaggatctacttccaaaatggatcactcaaaagaagactcagttcttcatcatgtgggcctcttcataacattatttgagtgtcctcttgggatggcagctagcttcctccagagcaagtgatccaagagaagagcaaggagaaagtcacaccttttgtaactgagtcttagaattgtttctcatgctatagcctattcataagaggcaagttgcaaagtcccagtcaacactcaacagatgaaatagggaagatggtaagaaccacccgttcaaaggaggagcatcaaagaatttgtcgatatgtctcaaaaccacagaaaataagaaggaacaagtatactgccgctcttccattgttctgaataacttagctttaatctcaaacttgcatatactatcatcaccgtcaaagatagtttagtattcttagcatgccctatgggaaggaggctccacccaccagcctcaagtagttaacccaaatatttcttttagctcataaacatcaaacaccatctataaaactttctccatataataatattttcagtgatattttagtctcacaatgaagtctataaatgtcctaagttaatgtaccaaagaactgccttgctgaactttagctctgactaaaggcaaaatattatggaaaatactggactgagtct

SEQ ID NO: 42190 - DNA, 952 bp, Bovine  19866880414385
cctcaccctgctatactagagaacaaggatgtgaaagaaatgtactacctctgcccaccccacccccccttcagctgggaaagaaataccactttgtttcagtaaatggagagtctgtggaaagcatggcaggcatcccagtttcagaactagatgaaagatataccttcaagtttaattcctatggaaataatgatgtggttaattctcagaaatgtaaaaactggatttgttaggccattgagtacttaaatattccaggagcaaatcttgcaattgatagagtaaatctttcaactgttcgaaaagagtaaaccaaaatttttcttcagcatttcataaagttagcattgaaaagtatgagtgtacacatgtattgcttcacagctttatttttgaaatcacaagcagttcaaaatgaccatcactgaggcctctgttaaaagattttccagcagagctgccccagttttaagattaaacaatattgcactttcagatgaattaactttcaggatcttcttccaaaaagaaaagtattgcttccatctgtgcttttcttaagactaaaagcatactgcagaaaactctactttaaaaattaacactgccgggtacagtaacagagaacagtacctgcctattttataatcttagaggaacttttcattgtaagaaactgtttagcccataatgagtataaagtgtgtacagtatttttcatttcagtggtccaagatacgcaggttcccagatacaatcttgttctctaatactgctccaggtgggatgtcaattcggtcaccgtgatttgcgatgatgataaccgttccctaagtgacagaaaaaacgagtaattggaacggcaagctgaaatgcagttgattttcatacagttatcaagtttatgtagaacttcacttacaatggagtaagcgtatttataaacggt

SEQ ID NO: 42191 - DNA, 623 bp, Bovine  19866880500088
ggaaggatatcggtaagtagccatttgctgtaatccagagatagatttttatatacatagcttgttatggcaacccactccagtactcttgcctggaaaatcccatggatggaggagcctggtaggctgcagtccatggggtcactaacagttggatatgactgagcaacttcactttcacttttcactttcatgcattggaggaggaaatggcaacccactccagtgttcttgcctggaaaatcccagggacggcggggcctggtgggctgccgtctatgggatcgcacagagtcagacacgactgaagcaacttagcagcagcagcttgttatcacttcctttttctgtatatgtctgagattcaagttaattattttaatgaaggggatattatatgtaaagaaaatgtttatctaattgagggaaatgcatttttttattagatttttatgaaaccagattttgccttggacgattccttaacttttaattcagttttaccatggtctcattttaatactgctggtggaaaaggaaatcgtgatgcagcttccttcaaagttgctgcaagaaaaggtaatttttatttttttccatgtagaaaactattttaatcaaat

SEQ ID NO: 42192 - DNA, 2713 bp, Bovine  19866880531328
caaggctatggtttttccagtggtcatgtatggatgtgagagttggactgtgaagaaagctgagcactgaagaattgatgcttttgaagtgtggtgttggagaagactcttgagagtcccttggactgcaaggagatccaaccagtccattctgaaggagatcagccctgggatttctttggaaggaatgatgctaacgctgaaactccagtactttggccacctcatgtaaagagttgagtcattggaaaagactctgatgctgggagggattgggggcaggaggagaaggagataacagaggatgagatggctggatggcatcactgactcgatggacgtgagtctgagtgaactccaggagttggtgatggacagggagtcccggcgtgctacgattcatggggtcgcaaagagtcggatacgactgagcaactgaactgaactgaactgaggagtagaatggctgggtcatagggtatgtgtatggtcagctttaggagatatttctggttttccaaaatggttgtacaaattcatactccctctagaagtgtaccagggttccaatttctctacattctcaccagccccttggatttcactgacactttaaaaaaaggtttgcttggatttaagacactggtatctccatttgattttcacacatattaagtctactgtacaatttctatcactttcaagaaattgagacatgaatctgtctttaataaatgaatgggtttcacaaccaatttgtaaatagataccctaaattagtgaatttgctacctaagtaaatttttttcctgccaagctgtaatctaaaggtataaccaatagtactttgcatttgttcactgggtgctgttgttcgtagtaactcttcctgcgagtgatgctcttttagaatcacaattttagtaatgcagtaagaaggcaatggcaccccactccagtactcttgcctggaaaaccccatggatggaggagcctggtaggctgcagtccctggggtcactaagagttggacacgacttcactttcactttcacttttcactttcatgcattggagaaggaaatggcaacccactccagtgttcttgcctggagaatcccagggacgggggagcctggtgggctgccgtctatggggtcgcacagagttggacacgactgaagtgacttagcagcagcagcaagaagttcaagacctcactctataacctcagtgatttctggataatgtctgcccacagggaagaatgttggtagtttctggccaaaggttgactctaatgatctgtaacaaagtttctaatatcattcagctcctctcattatgctgtaagtctccttcaaaaaccctgagataaagcacaaataaaagacattttttgtctcactatcaaggaccagtctcaggttcctgggacctttttttttttttccaaggctggttttctccccagaatctctggtagccaagtgttataatacactaaatgttttattaattgttcaactgagcaggaattagccttagcaaaatcaaggtattatgtatttcccatgcttagtgttaatttctttcctttgttcgtttatttctttcctttgacccagtgatttctgactttgatactttgcatcttaaattttgttggttcacctggtaattacaatatttacacctttcttcttttaatattttacagcttaacaatgtaacttctcattccatatttgtcacttttaaccagcagctgaataagcagaaaatcattaatttggatgattttattttttaaaagtataaaagcttcaattaaaaaaaaaagaacagaaatatatggacataacaaaagcagaagatattaagaagagatggcaagatatacagaacagaagaactatacaaaaaagatcttaatgaccaagataaccacgatggtgtaatcactcactgagagccagacatcctggagtgcagtcaagtgggccttaggaagcatcactacaaacataactagttgaggtgatagaattcaagctgagctattttgaatcctaaaagatgatgctgtgaaagtgctgcactcaatatgccagcaaatttggaaaactcagcagtggccacaggactggaacatgtcagttttcattccaatcccaaagaagggcaatgccaaagaatgttcaaactagcatacaattgcactcatttcacatgctatcaaagtaatgctcaaaattctttaagctaggcttcaacagtgcatgaaccaagaacttccaaaattttcaagctggatttagaaaaaacagatgaaccagagatcaagttgccaatatttagtggatcataaaaaaagcaagagaattctagaattctagatgggttcaaaattgggaaaggagtatgttaaggctgtatattgtcaccctgtttatttaacttatatgcagagtatatcatgagaaatggcaggcttgatgaaacacaagctggaatcaagattgctgggagaaatatcaataatctcacatatgcagatgacaccacccttatggcagaaagcaaagaggaactaaagaacctcttgatgaaggtgaaagaggagagtgaaaaagttggcttaaaactcaacattcaaaaaacgaagatcatggctaccagtccctcacttcatgttaaatagatggggaaa

SEQ ID NO: 42193 - DNA, 1757 bp, Bovine  19866880582942
tctgaaggagagacagcagtgcttcaaggaggagactatctagcctttataacagcttaattgttagaccatacattactctccatgcataatcctatagtctgctttactgggcaggagtccattgctatcgtttgtaatcttcttgctgaatatacagtacttcccctttagccagagagttcagctttttgacagtagtctcttatcttaaagagcaagaaagacagatagctagaggggaccatttccattaagtaagggaagagtaacaagacacagtccttcctcagtatccacaggggactgggtccaggataccccgtgaatatcaaaaccccatgcatgctcaagtcctttatataaaatggcatagtaaagtcttccctctatatccatgggttctacatgctggttagtgggatacagaacctgcggatacagaggaccaattgcaatgggtaattaaggaaataaatgacaattagatcaaaggactaaaattacagtgaggttgaaaaaagttttatcctactagaaatggaaaagaattccagaaaagaaaggaatggaagctttagcttacaatggttgtactttggagttttggagaatatacaagttgagaaaaagcataaattctattcacactaattgagtgcttattaggtgccaagaaaaattaaaatggtaaatgatccccatctttgaggaattcggataataaccagggagatacatacacaaataaataactctactacactgcagaaagagccatgatagaggcacacagagttacaaggcaaggataattcattcttcctggaggggatggctatttcagaaaagactcatttagtgacaagaaacaaagaagaaaagtgacaaagaattatgatatagataatgggagctagattttgcttctaattctggctccatgtgggtaattttatattaaatacttaaacttctaagctccaattctcttaaccatagaaagggaacaataatacctgaaatgtctattttatagtgtggttggagagatcaaataagatcacatatataaaaatacctaaactattgttatgaaagtatatgaagatattatcttaagtatctattaataaaaggcatatagtcctagacaaacaacactggaatttatatttttcttagttaacttgaatttgaaatactgttattggtaaaagaataaaagacctaatgacaaatgatggtaatggaaataactaccaacaactatcaacttcttgttaggtgaactagaactgtgcaagatgttttacaggaattacctgtttcacaataattctaagtacagtactatttcccacattttgttttacaaagaaggaaactaaggcacacagagtaacttgcccaaagtcacaaagtaacagagttgttgggattcaaacctaagcagtttgactccagagctcacaacttcaataagctgcacactgcacaccaagaaaagttgcaggtaaaaaagacaggaagagcctgagacatttacagcagagagccactgtagcacccctggatgtacctcaaagttcttgtggtatgagaaaaatcaaccaaccccttttttgtttagccagtgtagtctctaatggatacagaatactacaaaataaaaaggaatccataaaatttatttaaaattctttgtaagatttacaattgttaatctaaaatttctaatttacatcaagcggtaa

SEQ ID NO: 42194 - DNA, 1891 bp, Bovine  19866880610790
caaggaataggtggtcagaagtatgaaaatttgcaagtcagaagttggacgagtaggaactaggggccaaggtaagactgaattctcaaccaacctgtgaggaatgtaatataagacatcagtaagagaagggcatgtgaaacagacaattcctacctcagacgtgaagtcttttatatattacacttcctcctggagcaggtgtcaaccatagagcgtatctatttgcatttggaacaggaaacacatgagtcctttaacatcagaaaatagttaataaattgttgaagagcaatatagcaatgaaagtgaaagccactcacttgtgtctgactttttgtgacccagtggactgtaacccacccaccaggctcctctgtccatggaattttccaggcaagaatactggagtggattgccatttccttctccaggggatcttcctgacccagggattgaacccaggtttcctgcattgcaggctgattcttagcaataaatagtagaatatagcaatgaaaaatatggccatatcctgacaaacataaaattattttcaaattggaccatttccctagggaagtagttatatatatagtatctaacccatcccattataatattttttttcttatgttgctctattcagtactgattcttttctctatggaggctttgtgtaacaaactagttatgtttccaggacaggattttctgttgttgctgctattgtacttttcaaatatcctacagaatctggaacaaagaactacaaagtagactttcaataaatgtttgttgaattaaaaaataaatataaattattcctccttagtaaatggcatttagtttaatgaaaaataataattcatgaaagtaatggatgaccttgaaatcatacttgattctttcatattccacatctaccatgtcaaaaaatcctattagttctatcttcaaaatatatcttgactgaacacttctcaccattcacattgcatccaccctggtccaagacatcttgcctatgggccacaaactacagctgttgtactatatactgctcattacaggaagcaccattcacagacataacaggtgaacgatgcttcttggagttatgtagtgcaatgatcctacttgcctggattactgcaaaagtctcctagtctttgtccctcaccagcttactgtcaacataataatcagtttgaccttcggttcagttcagttcagttgctcagtcgtgtctgactctttgcggccccatggactgcagcataccaggcttccctgtccatcaccaactcctggaacttactcaaactcatgtacattgagtcagtgatgctataccaaccatctcatcctctgtcgtccccttcttctcccgccttcaatctttcccagcatcaggatcttttccaatgagtcggttcttcacatcagatggccaaactattggagtttcagcttcagcatcagtccttaagatgaatattcaggactgattttccttaggatgaactggttgggtctccttgcagtccaagggactctcaagagtcttctccaacaccatagtttcaaaaccatcaattcttcagcactcagctttttttatagtccaactctcacatccatacatgactactagaaaaaccatagctttgactagacagacctttattggcaaaataatgtctctgctttttaatatgctgtctaggttggtcataacttttcttccaagtttgaccttgctaaaacttaaatcaggtcatgtcatgtcatatcattcctctgcttagacatgccagtggctgtatctcattcacagtaaaagaaaaagtcctgacaaggtcctagttgatctcataccactcttaat

SEQ ID NO: 42195 - DNA, 1172 bp, Bovine  19866880868031
ttcttgcctggagaatctcagggagggaggagcctggtgggctgccatctaccaggtcgcacagagtcagacacgaccgaagcaacttagcagaagcagcagcagcaactgatatgttatagggctcaggatatttgtaagtaactattaaattattagatgacagtcttgccttattttacaattggagtattttaagtagtaattatatggaataattttttaaatatgtaattctataatgaaaagaaagaatggctaaacatttattagaaaaaattttttcacttacaagttccctaggttaaggagaaatttctttaagacttttccaggagaaattatgggtgatttagaaaccatacatttttcagagaaacagaagccatggttggcctctcaatggccgaccaccttctacgtcaactgcgtacatgactcaataccagccatcactcagaaaaaaccccctcagcagcaggaatacaaattcttataccacaatgtaatatttttaaacagaggggaaaaaaatcaaacaggaaatattttggaagcaaaataaacagagaccaaaaaaccccacttggtatcatagaaacaggacaatctcactacataatccaaagtaaaagattactataacaatagattgcaattatataatagattttccttggataccaaaatacatttagttctcatgcaattgtctggtcattttggttcccatctaccaggaagtaaaatatctctgttttcttgccttattctctttatttgtgtgaattcctgagtgttaacaagttctcagtcagaattttattttaatctataagtcttatttccaaacatctcattttagatttaaaacagtattttccccttccatacctttatttattaacttttagggagctatataaaatgaaaaaaactaaaaactaaaaaaaaaataattgaaatcgatgactttggaaaagaagaggtttttcacttgcagatgaggaaatggaggtccaaagggctgagacaaaacatgttagtggtgggagctggtttccaatcagaaaccaggtttaagaacttccactttctgtcccatgccctttgtcccatattatattgtcacatggaatgctgcagcaacaaactactaaaagcaaataatt

SEQ ID NO: 42196 - DNA, 1197 bp, Bovine  19866880885102
ttgtattcatcatagattactactggagaaagaaaagttagcatgaatgacttcagtgatctgaggaggtggtttagtcagctgggagtcagtaagtaaaagttgaaggagtgtttttgccattggatattagagttgaaaagatcttaaaggtcatctgcttacttctacttccttcacaaatagatggcaggaaccagatgaggaaatctggagtggaagcttgaatctctagggcacatgatttaagaaccacagtgttaccatgtaaagcaagaaatggggatttgcgagttagaactgttaagatcttatgtataagtatgtacgtacacatggatgtatgtatttgacattttactagcagagtagtgagagaactggacatttccccatctttgggatggagggaggaaggggacgatacatgtgattcatattacaaaatcctataaaatgctttaagctaaaggaagatagcatatatattatttaggtatctttttgtactgttaccatcttaattttttaaaaatccacattttagaaacacaattaaaaaaaaattatacagggctggttggaggcctctttttttcaagacctaggaccctaacttttaaatcagtggtactcaaagaggggcagttttgccctccgagggatatttggaaatgtccaaagacatttttcatttcacagctgagggttggatactgttggcctctagccagggatgttgctaaatatcttataatgtgcaagacatatcccattccaccctgcctccccccaacctcctgacacacacaacaaagaattatctgaccctaaatatcagtaatgttctaatcctgtggtttgcatgattctggtaagggcctgagctaatgttcctgacttccaccagatgggaaaatattctcactgggctctgtttggtgggtaaggttaaactttaggtcctctggcaattctctctctttgcaagaggaggcagtgagggaagaatctgtgacataatgcagatacttttttagtctgcttagttgtcttcaaatctgaagtaaaagaattgattttctttctgaaaatggcagccttattttattgcagatttgagctattatgttttgaattgttcattactggtacataggtttttgaatttaaaatagataaatagtgttttcttta

SEQ ID NO: 42197 - DNA, 1537 bp, Bovine  19866880889280
aggaatttgaattgtttaagttttgttttataaacatttctgccttaaatgttattgtacacattggcttgattctgactttttgagattattttcttaaataatcttaaatttttggaagtagaaattctgggtcaaagaatggcaatattttagtatctcatttcatttttctaacatggttaaacctactccactgaaagattgtattgatttgtaatgctatcagcaacatttgagtaccagtctctgtatactgttcagttcagtctttcagtggtgtctaactctttacgaccccatgacccacagcacaccagacgtccctgtccaacaccaactcccggagcctacccaaactcatatccattgagtcggcgatgccatccaaccatctcatcctctgtcgtccccttctcctcctgccctcaatctttcccagcatcagggtctttttcagttaaaaaatatatacatagtatttatatgtgcatagctagaactcataattgttaattttatttttttattaaacaaggtcatgatttttcagttattgtttcagtatagttctttcatctggaaagtctagagtctggatgttgatctcacagttctgcattaagatcatacagcaagaaagtgactgaattaagatttgaatttagatttgtctgacctcaaatcactcctccataaggagaggggactgggctggaaggttgtgggggagctggccacaaatacaggaatgttctttgtatattttataaatcaaaaaattttaatactatattagtttcattgctaaacatagtattcatactgaatagtatatatgtaattataaactgaactcttgctaggaaatagaacattgttaatattttagaagctctgtgtgggttctgtactctcttctagaagtaacctacataacctactctcccatttctgtgatttttttttcctttgcttttctttataattttaccctttatgtatgcctccctaaattatacattggttgggttttatctgtttccagacatcacgtaaatgaaattatactgtctgtattcttcctgactcaatatcatgtttataagattaatttatattgatacatatagctataatttattgagttttatttctgtatagttgcaatagttttatatgctgtataacaaactgccacaaatttaatgacttaagacatcatttattatctcagtttccacagggtcaagagtccaggtgtgacttaacttggtcctttccttggagtcttacaggtagtaatcaaagtgtcagccaggctatattttcatctgaatgcttaactggggaaggatcaactttcaatctcattcatattgttgacagaaagcattttcttgcaccaatcatggagtgatattccctcaccttgccatacagcataatctagtcaagagaggaacatcccatgatctttgtcatgttttctcagaagcaagtcatatattctgcctgcattcaagtagagattatg

SEQ ID NO: 42198 - DNA, 1727 bp, Bovine  19866880903805
tggagaaaaaattataaatgaaatcctagaaaatttatttaatgtgaagaacatgaatctccaggttgaaatttccaacccttgaaaaaaggcctgtaacaaggagatgatgatgaaatattagtgcactgaaaataaaaatcttaagagcttccaaagagggtaaagacgattgtatcaacagtatcactcaattttggaatgacaatggaatattatcttcaacattctgaagtgaaattttttttagctaagattttacatccaaccaatatagtgtgagggtagaataaagacattttcagagattcaaaatttcaaaaatttatgtcttatataccctttccaaagagattactatttcagagctataagagagtcaactgagaaagatgacaaggagcccaggaaatgaaagtgctagcccagaggatggtgagagaagtcctagaatggcaaccatacctcaagcctagggttcattcagtcttgattagatcaagaggagaggggatttttttcttttttgagaaaaaaaaaaaatggaactgttagattgatgattttgcgtgtggagacttgaaaaaatattttaaaaaatattgctggccatttgagactcgaaaatctttatatatataatcataattatgtaaattcttattactgaattaatcaaaatatttttgcctgtgacatttttgccaagaagtcttgccatgtgacatttaaagtgaaagtcactcagttggatacaactctttgtgaccccatggactacacagtccatagaattttccaggccagaatactggagtaggtagatggtcccttccccaggggatcctcccaagccagggatagaatccaggtttcccacaatgcagacggattctttaccagctgagccaccagggaagccctgtgacatttaaagattatcataaagatatagtgggaggaggtagggaagggaagtggaggttgaataaaagacataaattctcaaccaccataagaggatgtcaaaagacaatatcttaaattgataaatcaagaaatagctgagtgagcaaattactaaagtacaaagagataagtaatagataaaatagttagacattgaaagtggcagcctcttaagagcagtatggataagagatggagcagagatccatacgtaccaccaggtatgtcttaaaagaattcatttatttttagaaccatatgatcttccaatctttcttctttcagaccttgaccagttggccaaccctttgtcactgctcaggactctatgtctactctaacccccagccacttctctttccacacaaagtgaatgatgagtacaatgagataactatttattaaagcacctcattagtggttctccatgctgaggctatatatctcaggacaattaaataaaaatttctgggagtggaacccagacatcagtgtttctttaagggtttccaggtggttccattgttcatctgaggttaagaaagctcggtttagctttcttctaaaacttgaaagatagtggctctcaaactttgttgtgcattagaataaacttgtaagtacagattcttaagctccaaacccacagattctgattcagagaactgaattaagacccaaatctttggatgttttaagtcctcaagagggaagtagatacaagtcaaccaaacaggtaactcagacagtctctgata

SEQ ID NO: 42199 - DNA, 2230 bp, Bovine  19866880956233
taggttgaatgaaaaagctgtgaaggaaatagagtgctgtgatccagaataagaaggagcattaatatgataaggtggtcaagaaaagcctctctgagggcatttaagctgctgcctgtaggggctcaaatatagtccatatggtgctctccagaaaggtaccttttcctaattacaaagaatccatgtgtgggttaaagtggaggctctgaacatttaagccaaaacctgaaggataaaaaggagtcaagtcagtcatgtaaagacctaagggaaaaagtactccagattatcaaattacagaggctctgagatagaaagagcactctgtgttctaggagatggcaggaggctggggtgaggaaataagagaagagtggcacaaggtgagagatgcatctggagaagtagaaaggaatcagacattcagggcagctgaataggttttggattttatcctctccttcattttaagcaagggactgacatgatctggtttacattttttaaagacaatagagctatattttgaaggtagaaataacaggagttaacaatgaactggatgaaggtagaattggatgaggagggaggagtcatggggaatgaattaaaagggaagagtcaaaagtggcagttcatcatagcaccaggtattgagatggtcaaggctgagggggaattcagattcaaagagagaaaattctgtttggtcatattcagtttgaaatgcctaggagacataaggagatgctaagtagatgtttaaagttgtgaatctggaggtcaaaaagaagtctagcctgcctgtataaagttaggaattgtcagcagatagtttttaaagctcaaggactaatataggggagaagacatacagaatagaaaagagggtacaggaactacagcatttagaatcacattagaaaaaggtggtgttagtggtaaagaacctgcctgccaatgcaggagacccaagaggctcgggttcagtccctgggtcaggaagatcccctggagaaggacatggcagttcactccaatattcatgcctggagagtcccatagacacaaaggagccttgtggacagtccatggggtcacagagcgttagacaaagactgagcaactaacaagcaagagcaagaggagccagttatttaagaaaaccagtctagtgtgcaatatagagtccagcaaagagagtatcagaaaaggccaattatgaaagtttaattagtacagaaaagagagccaaattgagattgttacttttataggagtgatagggagattgaaatagggagattgaagtttgccatttatcttagcaatgctaattataagaaggcagtggaactttgaagttctgagagaaaattaattctgaaactagaatcctatagacagaaaaagcattgaaggatgagggcagatgagggaattttaaactattttttgatctctcatacatctttttcagaaaaaaaaaaaaaacatgggaagctggtaataggatctgctctatgaatgcaataaaaagatgtttcagtgcaaatatttagacttccaaggtgatcagtagtaataagaatgaaaagtaagaaggaactcagaagaacatctttaagaaaaaagtagattcattttatacaatagcatgtttaaaaaaccttaataattttaatgagagtgacatgtttttcctgtcatcaaccaaaaaaaaaaagacaattaaaatctttagtaaaggcaaaaaattgtgtaaatcatggtccaaatatgaaactaagatgtgacagtattatgagtaataaatggaaaagagaatctgtttgacattgacacctagaacattctccttcaataagcatacatttaataatatggtttacatttgtctttttacacatctgtttatacaattgattcagcagtaaatgagatttacaaaattgtaatattgaaaaaaagctactggaggtgatggaattccagttgagctctttcaaatcctgaaagatgatgctgtgaaagtgctgcactcaatatgccagaaaatttggaaaactcagcagtggccacaggactgaaaaaggtcagttttcattccaatcccaaagaaaggcaatgccaaagaatgctcaaactaccgcacaattgcactcatcccacacgctagtaaagtaatgctcaaaattctccaagccaggcttcagcaatatgtgaa

SEQ ID NO: 42200 - DNA, 1102 bp, Bovine  19866880964048
cttctctctcgtctcctttttccccctttttcttatttcttttaatctcacctccagttgatttcttgctgtttgcctgtagatgtgctcgtctcccatggcctaaaaaattcttgctcaactcttaattgcttttctttcgtcaccaaaaacatgttgatattgttgcctttgttacttcattatttacttaacctcttgtggtatggcttctgccccaaactttgtcctaaaactgttctaatccatcgtcctttctgaagttaaaaacctccttgacctctctctctgcagcatgttcacactactgttcatactttccttctggacccttctcccttggcttctgtaggatgatttttctgacactttctccctcacctcttacgtgtatttgccccgctccttgctctgagctctcattagccctcttttccggcactttcttcctttgtaatgttactttcctgtgactagaattatttattattcctgtaatgtgattgaactaggaacggtgatgcaaaattcagggaagcgggattctgtttactacaagagatatttttttcctaaaacaattatagttgctttgtagtagtaatctgcttttgaagcagtcacttctccattactgacggttttcaaatggaggcagagagaacccgagtagaaagaattcatatattgataaacagttgagacagatgatcttttaaagtctagtccaactatctcatccactccacttcaatggattgaattttgaccattattaaatgtcttccaaaaatagtttttctagcttctgtgcctcatcatccctcttctttctcacaaacagttttgcttttattttatcaaaaattgctaaagtttcatctttattttccactactcttttttttctttcctttgactggcatggctttgaggaccaccgttgctttgaccacttttctgatagtaaattctatctgcccatattggtttgcttcctccacctcaaactagaggcactgaagcaaggaagaggtttggaatcctaaactttaattttaaaactttgtaggcaacggagaaggcgaaggcaccccactcc

SEQ ID NO: 42201 - DNA, 1181 bp, Bovine  19866880975958
tgtaagtgtctgaaatatggctgtatagaagtcaaagctgccaccaacattgtcttcccaggagagaaataggaaaggtacccaagatggagtccaataaatgaatgccagtttaacatcaaccatgctcgtcttttgtgcacagagacgccccccccccaaccctgctgttccaagagctgttcaggcgttgaataaacagggttccaatgagacgaaaatggctgcctctgccggggtccatcaagctgttctcttgccaacaactcaggaaggatttctctacccttagcagaattaccacagctcacatcttctcccaatacacttccagtgctcctgtcactaagcagggaagagacagaccaaggcagaaaaggaaagcctggtggacaccattcagcttgatccacctctttaacaacggagatgaaagtagccgagaggccgagggggagtcactggccctcggacggggcatcactgatggatctttactgaagtctgcactcttgcaaagcctggaatactcagcaggaccgtcctctgaggtagataatatgaagaaggctggagatcatagtcacactgcatgtcttcatacaaacataacccaatctcaaggatggaagccttagtcacagacacatgaaataacatttctgaagaatgactagagattaatatttaaaatgtgcatgtaagactgagatcgtcaagggtgcagctcagaatgaattgctacgaccactgtagggaaggaaaatctctttccttctacccttgtaatttcaacaactggggcctgagaatcaaactgataaaagacagatcaacaagagggaaaaaatgtgtgactaagtacttacatgcagaagtttcacaaagaagtgagaccaaaggaggcagccggatgatggagactgatacaccatccttggctaaacaaaggaaaagaggatgggcttctggtggaggaggcaagtcatgggcagagggaaagaaatgtacaacaaatatgggttatctgtcttgcagataagagtctctcaggtgataagagttgtcaccaaggagtagctctctaagccatttttataaatggaaatttcctttacaaaagaggaaatttaaactttatttttaggcactaaggcactctttgggcttcccaggtggct

SEQ ID NO: 42202 - DNA, 1074 bp, Bovine  19866881017315
cagcagcctcggcgcgacgtggaggcttggaggcggcggcgatgcactaggcctcgctctagggcggctgcccgggacccgcaggtaggtgtcgggccggccccacgcggcccccagcgcttcgcggcccaccctcgccccgacttgccgtggagggaggacagagaccccaccccctctgtctcctcccaggcccaagccggcggagtttcggtcacaactgaccagcgccgaagcttccattcctcccggccaccacctcctcctcttccttctcactctgccgccgggatccgggccggcagctgtactcttcgcccctagcccgcggctgcgacgccgctctcgcccctctcgcccctctcgcccctcttgggatttcggctgtggaacttccaccaccctccttagacgctgcccccaaactttccctttctttttctagccgggcccttaacctgctttttgatcctactggaataatttaaatttaaaaagtcattttttcttcctggagatggccagcccagaaaataactcggtgttttgcagtttggcagtttagctcgcaatcattttgttcaatagttaattttcttcagttatacatcttcccgtctctgcattgatacaaaggcaggccttacctgctctcctgttgttgacaggggaacttttgcctgcccattatgattaacacttggtctgtccatgtgctgagtttgggatggtatttttagaattttggctgacccgggttgcagtttgtttttaagagttccccattaactagatttattttgatctttatttaggctctctttactttcgaagaattcagttggaatgtttttgtgttttatttttaattggttctgtgtctgatttgtcaaaccccagggcagtcttaatagtaaatgctttaaaaaggcaagtgatgtcatgatagtgtactgagaaatgttattgtggtaacttaaattgcagattttgacggacattcaggttgactttatctgatgttctatttggaaaagtagcttgagagccttaatgacttctaagatggaatga

SEQ ID NO: 42203 - DNA, 1484 bp, Bovine  19866881294257
taatttatgtcttccagcaatttagtgaataatgtttcagttacattcatatttaaaagtcaatattttggaagtacaaagtgaagccatcttaccattttaccattttaaaacattcacgaataatcacagaaaaatcagagtcaatgttaagtacttcaataggctcataactgatagaattacacaaactatatgtgcatttttacacttttctgtgactcatatatcctctgtcagagctatataaaaatgattgtatgtctcagtaatgtaatgaaacaacgtagaattttaaattttttataaacttattttccatttgcaactatacaaaaattacgtttttagaaatttaaatttatatcttacggaattctttccctttaacatatataataatacttctctttctatcacttttagtatttttgttttgaatctttgatatttcgaattttgaccaaattatgtattgtattatttattcattatttatttcagaatatcttcaagcttctttatcatgtataataccaggtaggctattatcagtaattggcagagtaggttcataaggcagagtcattttctttttgtgaaacaggaggatatatatatatagactcacagacacacacacatcagagatagtttgggattactttgtaagtacaagtagttggactgtggcttattggatgatctatattgctatttaaaatttatttttggtctcctttttaacttttggaatgtaatataattaatattttatttaaacaatatagatttagtttttgagtaatgtaaaccaatgttagataaaatatcatggaaacaatttgtggaattgaaaaatcactatttttatagtagttggcagcatttatagaatgacttgctgctcttgcagatatatccattatcgcagttgtcactatttaatggcacccatgttagttaactacattagccagggggctgaatagctatgaaaatgggagtaacctttgacctcagaaatggttcttttaaaagaggattgaaacattggtgataggaaatttgaattgctcctgcagctgcactgtttgttctgtgaatacttaatttactttggagctgtactttttcttctcaatctgtcagtcagaagcatcaaattcacttcaggaaggaaaaaaaatacttccttcccaggtctgtattattgaatgcagtattcaggcttcaaacagtttcatttaggtcatacacatataatcttcagaatgggaatcctcacatttgacacgctctgttaaatatatagctcattcagaccctatccaaggtattgttattcagcccgttattttggataatccttttaatgactgtaactcaactcagctatgtagaagcctggtagactatggagatatatacatgtggggtgtgtgtgtgtgggggggggatatgtatatatattattggaatat

SEQ ID NO: 42204 - DNA, 1695 bp, Bovine  19866881345057
atttaactggcacaccagaaataaattggttgtggtttaccagctgtttgaatggctgtcagttctcagtttgtggtttttacatttttgttttagatctcagcaaggcaatgtctcaggatggtgcttctcagttccaagaagtcattcgacaagaactagaattatctgtgaagaaggaactagaaaagatactcaccacagcaccatcacatgaatttgaagtaaggaccctacactatgtttttgctttcatccatctacatgctgagttgttattgctaccactgatcatctagcctgaaataattacaaaatgtaatgatatattttaaaaattaagattgcttactaattaaggattttcagtatttgctcagtataaaaccattgcctgttttaaatattttaaattctggtaagtttctaaagttaaaagaatcagaacaaagttacaatttatttttctgtgttttgatatcattgggtggaaaaaatggatgtaagtattcagttaaaattgtgagaagttaatttatcaaccttatatcctggatgccttttccaaagagcctgttctaacagaactgggctactctgacagctatgatagaggtttcccagaaaaggcaagtgtttactttcttgtaaatcaacagattatccttttcattttcaaatttaaatttgtacttagccttttgaggttagctgttttttgttctttcttattcttttggtggagattaatttgcatttaaaggaagtagagaactatattggtgagtaaatgtagagaagcagttggaattcaagtagaccgaatggtattcagatgacatgatactggtgggagatggggagattgcttgtattcctttaagtatggttcctattagctttcttcctctttagttttaaaatggagtgtaaaaaagtctctgctgtactccatgctttaaagctgtaaggatttctctgaaaggtattttaaatgtacaatatatgtctgtttttattaaatactaagcattctgttagctataacaatgacttctgttctcatagcacactaaaaaagaccttgatggatttcggaagctatttcacagatttttgcaagaaaagggaccttctgtggattggggaaaaatccagagacctccggaagattcggtaagttttagataaaatgtagggaaatgtaaggtaatttagaacactggtgtcacttttgggggtggggtactatagggtacctgtgggaaccatcacttcagactttgaaactacagagatagccttctgccactttcctttgttagactcatccatcctgtcctgcagagaacttacgaaagtctgatctccctaaagcactgcctcataacttaacatgatttagtatgaggcagttcttttgttcagacacatgataaaagcttcattacgttctcttccttctttctccaaaccatctaatgtctcattgtccttagggtcacgtacagacatgaagtcagctactcagagctctttccgtgctttcaacccatatttctaactgtatgtcccttacctgcttttcctgaaccagcccaacattcccttcacacacataggatttccctagtcttttgggtatgttggttccttgggaacactatgggctcttcgcctgttagtcctactcat

SEQ ID NO: 42205 - DNA, 1231 bp, Bovine  19866881358745
ctagtgctggaaaaaaagggaaatgacactcttccaagatttgattgcatacctctgctgttaaagtggggaacctggaatagtttttagtttgggttcaggccctccattttctttttccctccttccttccctccacctctccccttccctctttcaacccctgcccccatacacactccatgcacattcacactaaccactcttagccaaagtgtattggttctgtcctggcttttgacagtggaggttcacaagttggagaactgatacacttaccacccagggcattgagtaatctatgaccatggcaaatcgttactaggaaaggagtaggattatctctcccaagtatattaataggatagagatctaatgactttgatagggcattagagtacctttctcttccacctgaatttccttttgtcttcttccagcctttccttaagaatgtttgattttaactacctgaaggccatgtggattatggtaattcctctgaacagacatttagcacttatgcttgattattatgtaagaacagtaattatgacttttaatcattatgacattaaataaatgtcaggttactattgtaaatttcatataattatggtattttatcactcatggatgcaatttaaagaagttattgctcaacactatagcaagagcatcaattttaaaaaatccaataatttactgcagaaactatagtagtatgttttccttatatatagctatatagtatttaaactgtgattctgggtagagaacagaaaactagccttctgttgccctcaggaagccaaaggagtagacagaagagaaagtacgttgttgcctttgcccatgaagaagccatcaccattcttatttttctctgttaattttgacattgaaacgtattctagattttaaaataatttttttcttgaagtaagacgtgtcagtttgagcacttttgaaatacgtattttcacagttgagagctaaactcagtggacattgagcataagtagatcacaattaaaatctgaaatgttaatacattaaactattaaatttttgtaagctaaacagataaagtttgtatgttgatgtagtgtggtgctatcattttggtgatggcagtggttttgctttaaatactgaaaacgatactaaatttgtatgattattgcctagtcaacactaggtggcgccattgtgtaaggaccatatgatg

SEQ ID NO: 42206 - DNA, 950 bp, Bovine  19866881661155
tgtccttaataaatgtatacggagggagattcgaagacagagaagaaaaaaccatgtgatgatgcaaggagagggagaaaagatgatgtgattcaaagccatgagctaaagaatgaagatggccaccacaagctggaaaaggcaaagaaatgtttgtcccttagagcctccaaaagttgcgtggcccctcttacatcttgatttcagcccagagaaatccatttcaacttccagaactgtaagggaataaatacatgttgttataaaccacctggactgtggtaatttgtttcagcagccataggaaactgatgcagtcaccattcatgaggaacattgcacaaatacatggtaaaaaaaaaattaaaccttttttttgcaaccgttcaaaaatgtataatgattgatattctattcaaagaatctgacagcttttttgtctacgaacacagtgttatgataaggcaaatggatttttgaatccaactgaagttttttctagcaagtattttaaaataatgttgaggctttaatttgtaaaacacacgtgtgttgttggatcaatcaagctgaaactactttggatgacattaagagggcacatcagctgcaaacaatcagaagaatctgatgtctgtgaagtcagagtttcagaaccatcagagttgcaccatcttggagctccatgctggtgacaatgtgctgagtacagccaaggatgtattctaccatctggacgtctacttcagcagccaactgctgagcgtactgctattcaccttggataagaggcctagtggaactactagacatttcttttttttcttcttcttcttcttttattcctttttttttttttaaattttattttatttttaaactttacataattgtattagttttgccaaatatcaaaatgaatccgccacaggtatacatgtgttccccat

SEQ ID NO: 42207 - DNA, 986 bp, Bovine  19866880532199
caggaacagttatgaagtggcattatttctttatgggcctcgtggtaaactcttaaaaataaattttgactgaatgttaatggggtacaaaaattatggaggaggtttctctgtactatcactgggtaaaatgaatagtcacagtaacataatagttcaaagcaatcttatcttttcctttcaccaaaatacttttcttctcatcctggagcacagccaaacataaaggtcaaaccctaaatggagggtcagaggtgaagaagagaactacatatcaaaaaggcttatagaagatactttgacattttccccacattaatatagtcatgttagagtctccaaaaataaagacatgataaaatatttccccctcttcccttctgacagttatggaaagatgtttgttttttcacatagtttgcgagttggtcatagccaaaacacatagtaatcgtatgaattctgcttccattgttaactgttcatctctgggcagaggctacaactcccattctgaagccaagaaaatgtaccatacatgccattatagtttactaaacgagtcaccaaagagaagcaggcacttcagaaagtaattaaggtagtcagtgaactgagctatctagaagtgctctgagattacaggagaagccatcatgaagcaagtattcaagattgctcacagaaagttttacccctgtgggtaattcatggttttcacttctacactgcagagagcaatatgggttctccgactatacacattaccacatcattccatttatcaaggaaaaaagaaaaaaaaagacgttgtggctgaataaaagtcaagaggtaggccccaacacagaatcctcaaggcaatcccaattcaggtgaaaagctgatgacaacaccatacaatgacccaaaatcagactttcatatataatcttaccatatttaacagacacagagaaaaatgtattagttttctataacaaggc

SEQ ID NO: 42208 - DNA, 1122 bp, Bovine  19866880535750
tccatggggtcgctgagggtcggacacgactgagcgacttcactttcacttttcactttcatgcattggagaaggaaatggcaacccactccagtgttcttgcctggagaatcccagggacgggggagcctggtgggctgccgtctatggggtcgcacagagtcggacacgactgaagcgacttagcagcagcagcagcacaattacactttcatcttctttactgcatctattcaggactagggaaataatggccccaggagcagtttaacattttaatttattattttggaaaaaaaagcattcatatgtttcaaaaataaaaaagtaaaagttataacatggggtaaaaaccttccctcccgcctgctgctctgcaggcctggctttcagtttcccgtgtgtcctttcagggtttcacttactttcagaagcaaatacaaacacaagcatcttctgaatggatgactaagagatccggggggctttcatgcaatgccaacagctgggcctcccatccctgaccagcctcagacccgaggatgcgaccatcccaggatgataatcaatcggacactttcaaatatttatgaaacactgatggattttctcagtctggagttgtagctttcatggaattgggctttattagccagaaagtcaatattttccctgggccacggcccagctgcatgtgctcctgtcgtgcccctggtcttgtgggtctcgctgcttctgccgtgtcagcttcttgctgggggctctcaacttccctgccactgaaagctggtagggaaggacacacaaaggccaagcctcagggatgagcctctgtgcagagacttactctggggcttgtgctgggcaagaaattttccctccctgagcctcagttaccctatctgaaaggcgagaagactggtcagttattgagcttcattgctgcttggtgctcaaggggaccctgcagggctccccagacaggggctccctaagtgcagagctaggtcttctcttcctcctttatctctcccagtgtccccaggcacaggacaaagctcaagctcgggctctttccttctcaaagtagacagactcaaggctccatattctgcgaagagg

SEQ ID NO: 42209 - DNA, 1774 bp, Bovine  19866880558274
tcagtcgctcagttatgtctgactctttgtgaccccatggactacagcacaccaggcttccctcttatcaccaactcttggagcttgctcaaactcatgtccatcgagtcagtgatgccatccaaccatctcattctctgtcatccccttctcctcctgccttatatcttcaatctcatacccacctaaaaaaaaaatgacgatgacaatttttctgcccagttaaactacctacattcctagtttctcaggtatatatattttatcttagggattctgttaaaggaatgttacagctgtttgaaaatgattgaaaatcctttgcatcagatctggttctcagagtattctttagtgttcttttagtatattcttgaaacgtgcttcaggtccagagaatctattctagcacattattgaccaagacatatcaacaccacaggcattaattaatttctgcaaaaatcccccaggcaataatgtgttaaagtttttatatcatttaattgctagataaaccagtgtaattgctaatttatatgtaagttgcttggcttgtctgctatttgtatatttgaacagaaactagtgtgtttagtaggaagtgccttttaaaatggcaaaaaggtgattgtttactttgctggtattcacacacctctgaaatgattgattaaaaagcctagctctatttgctatggtctttgtccttctaagcatttactctgtggctcagcgtagcagtaatctatagatcagcagggatgtatttcatattttctctgtgtaaacactgtcatttagctaaaaataatgaaacatgaaggtggtgtctttacccaagtgaaatcctgatctgtgcatttttaatgactttatgtgtggtaataaagctgcatatattagcatgcagcagaaaagcttaagtatatgatgcttatgatcatgaagtatgcaacatgtatatagaaggctaatgaaaatcaacactcagatatgtccctcatctacttgagcttattaactagcttattaatatttcttcattaaatatttttcagtggggactaataaacattctaaccagtctcttaaatatgccttcttataccatgttataggtaaatcaccgtggcttaaataatatctgataaagctttgatgtttcaagtttagcaaaactaagtcagagattgagaacttttgcagacttgaaacatagtggttttgaaaatttttaaaattttagttttaagaaaagaaacatccatttgcagtaaaggattttctaatatgtgtgagtgcctataaatgtttaaactttcggtattcagaatctgatgtggattggtgcccaggatatggaaaacctaggtgaaggcagaaacagttcaaagagcaatgagcttttatacttactgtgatagagaaagagctagaaggatgcttggagattctccagtccctgttcccttagttttgaagaccttgaaattgaggaagagcaaggatagcatgatttaggaccatcactaaatcttgaaccttgtctccatgtgtgctctgcctctgattaccaattgaagaattaagattctcaaaagattaaattcctaaattctgttatgaaatctgacagtgaattgatactttaagctggatggaatacaaaatgtaatagcattgaaaaattgttagcatttttcttcaggttctaaagtggggaagctctaagagctattgcggtaaattgttttatttaaggtaaagaaag

SEQ ID NO: 42210 - DNA, 923 bp, Bovine  19866880666446
ttgttaatgttgacttggtgtagattattgtggacagtacagtctaagaaaattactgtggaaaggcacaaaggggaagcagtggtttctaaagtctttaagcttgtcttaatggaaattgagagctcatcaccaaattccaaaatattagggcttgtagtgtgaaaggttaattttggacaagtgaagggatgtgcaactcggatctctttgttttttacagaatggcatagctttaaatgttagtgtattagtgctagacccatgatgatttttggaagataaaagtgtttagttactaagttttgaaggcttttagaataaacagtcattaacctcttctctaaactgcacttttgctccaaggtcagacaagagccttaattcagtgggtcatttgatctgacctgggaggcctcatctaaaacaagtttaaatcagtacttgataatttcaggtttttttctgttcagttaattgagtacttaattaagtcccatgttatacaaattacctttactttttctaccctagaagaagagccaattggctagtgtttattttgctcacacatatcttaggcattatagagactgtaagggaaagctttgtccatgcttgcagaatttctagtctggcacatctgcttagggtgttgtttttcatcagtatgaaaagccatagtaacgctacaagggctgtggagtaggaaataccacaaggtaaacaccttttaaaggcttttggaaacaactttagaatgtcgcagcttcactaatcattcattcatatgaaatacaaatcctatttaaaagccttatttaagctttaaaatttgtcttgtcttaaaaaagtttcaactttcatttctctctgtgaatacataaaattaaggaaatgtgctgttaagcagatactacaca

SEQ ID NO: 42211 - DNA, 2613 bp, Bovine  19866880690943
ataatatcgaagttatatgcaaattgtaagaatgatacagataatttttcctgaatcacttgagagtaagttgctgatgttatactgcatcaccactgaatactctagagtacatttcctacaaagacattctgccacatgatcaggataaaataatcacaatcaggaattcaattggttgtttggttactaccatctaacctacaacctacaattggttgattggttactactatctaacgtacaaccctattcaactcataccagttgttctggaattcagtggtgaacatccctagaaaggagagaggcacagagtaggcaccctcaaaattagcatgtctttcctttcaaatctttggctgattacttaagttcacatgtggaggagactccatagggcctagtggaaggttatagcagacatgagaagtttttgaggggatatttcaaatttgaagtttgagttctaccaaacacatcagaataaagcattcagaaaaagactatttcaaggaatgcagggtagattataaaaggataatagatcactgcattaggaaagagtaaggcgatgtaggttctcatttcagttttgtcactaaccaacacttacccatgggaaatcacttaacttctctctcacaaagtacttttctaggttatcactatttgtatgtctgtaagttcaatttcttttcatattcaaatttcaaaataaaataggcattgattgcatttttcctctttaaaaactcatagtggaaaaaagaataactgattttgccactgtttttgtgatactgggctttgagcaaactctggtaaacagtgaaagaggaggctggcatcttgcagttcatggggttgtggagagtcggacatgactttagtgatatatgtatatttcttggtaattttttggtaatttcttggtaatatttctcctacatgacactcatcattgttatacaccacttgaagtgatagatataaacactgtaagaatattggatattgttttcatcatgaataacccagttagagttagatattgtttgatgttgcacaaaagtgtccttttttaaaatgtgcctttgttgtattaaaatctcttgaaagattcaattctacagtatgtaagctcaatctggaatcatttaaaagttttcacattatctttttctttcttaactcttctagttattttccttgtatttagtgttatagaaaaagcaaatgaggagttgggcctgtttaaacatacatgtaattagtgctcaagagtcagaaatagataggaatttattattttaatcttaagtgatattttgtatgccaaattataagtatattttatacttaaacctaaagtaaaactgcaaagtggctatagaaatttttgtaattggagataaatactttcatatttgagagaggctgtatcaaaattggatattgttacttagaattgaatttttatgaaggtgaagtagattttatgtttcatattcttttatttgtagccaaaaatagaaatatatgaagacaatcaaatgaagtcttagaaagcttcaaatgcatcagtactagtttgattcatataagttgcttcattcttgggtatgtcatggatagttcttgagtgtgtaagattctatccatgtcacttcctaagtaaggaagttacttcttaaacaaataagtccaattttaactattgagtaagggtaaaattaagaatatcctaaatgaaagaaaatgtccaatatatttaaaactagtttacttctccagtttagctctattttgtgctgttctcttgcagtaaacaccactatcttcagaaaataaggaatgagaagcaaggaagaaaggacattcattcatcttggaaggacccaaagcactttgagatataaaggaatgtaattatagctgctaaaaccacctttgtcaccgaaatggatgaagtacttcaaatttaaatggtaaccagaattctcatgtttccaccaagaactttagatcacttgaaaggatttttttttaactttaaatatttaccttaataaatagcaaagtgcagatagctgataattttataacttatttagcatagttaggattttattttctcttttaatgcttggctctgatattagccaaaagaattgttgttttttcccccaggttatcaacttcttaacatagaaacagataagcctatttgagtaagaatatggcatagtattagtatacttacaggtctgtcctttgccaaatattttttcctttcataaaagcaactcgggcaacataaatggtagtattctatcacatgtgaaagtgttttataatcttattttctgaactttatttcatattgtttttttagtttccttatgtgacatctggtctcttgatctttttcctttcatatctgacatcttattttaatttaatctttattttatcctctccccctccttctcaggaatttagggttataaaagacaccaggttttaagtattctgtcatttaaaaaaaagacacaaggatccaaaatgaaaaggagagagaagttgaaaaaattatagaattatttctta

SEQ ID NO: 42212 - DNA, 1837 bp, Bovine  19866880725626
tcaggaagcaacagaactggacatgaaacaacaggctggttccaaataggaaaaggagtacgtcaaggctgtatattgtcaccctgcttatttaacttatatgcagagtacatcatgagaaacactgggctggatgaagcagaagctggaatcaagattgctgggagaaatatcagtaacttcagatatgcagatgacaccacccttatggcagaaagcaaagaactaaagagcctcttgatgaatgggaaagaggagagtgaaaaagttggcttaaagttcaacattcacaaaactaagatcatgtcatctggtcccatcacttcatggcaaatagatggggaaacagtggcagactttattttcttgggctccaaaaacactgcagatggtgattgcagccatgaaattaaaagacgcttgctccttggcaggaaagttatgaccagcctagatagcatattaaaaagcagagacattactttgccaaccaaaggtcggtctagtcaaggctatggtttttccactagtcatgtatggatgtgagagctggactataaagaaagctgagtgctgaagaattgatgcttttgaactgtggtgttggagaagactcttgagggtcccttggactgcaaggagatccaaacagtccatcctaaaggagatcagtcctgagtgttccttggaaggactgatgttgaagctgaaacttcaattctttggccacctgatgcaaagagctgactcatttgaaaagaccctgatgctgggaaagattgagggcaggagaagaaggggaagacagaggatgagatggttggatggcatcaccgactcaatggacatgagtttgagcaagctccaggagatggtgaaggacagagaagcctggcatgctgcagtccatgggtcgctaagaatcaggcatgactgagcaactgaacaatgatgacaaaactaagatttggggtgcttttcctttcttctatctttgtttattctccaagtttgctataatggtatttattttataattgaataaataaacttgtaaataataaaaccatttatataaacatctttctaaaatatattttaaacttctgctgttttcttccctttttaaatacaggataccaaacatagcttaacattttcttgatatcttggtataattagtatcagtgtcaatcacagtgctgttctggaaaatatggtgatgctgttaagggatataggggcttgtttgccccaccctgaaatgctgtttgagttcttaaatttggagggggcgttattattattattttgctgtcagtagtcacttgtcacttgacacttctgtctgaattcttctgtccccttataagttatcttgatctctgaaaccagataataaagcatcatttattcatctgttcaagaaatataaagttccaaaactatgtaagaaatgtctcctgtcttcaaggagactaagtgtagtgagagagagagagagagaaagttgtattcaaacagtcataaataccatagaatgggaaatttgaggaggaaacagttaatgctttaagaggatgatccacaacttcacaggggagttggcatcaaaagttttgtagaatttttgaacagttgttatatggtagacatatagaagatgatttttttaaagggtaagacagtatctgatcccagaagagcattatactctaagttcaaatagattgtatagacatctgagaaccagtcatgattttatgaagaaatcggtaaagtggtaaagatttgttttttagaggaattaggagacaacagaataccatctcagtat

SEQ ID NO: 42213 - DNA, 3148 bp, Bovine  19866880752125
tacatatagcctatcgttaataaaggtttatggatacaagcatttttatttcagagaagggaaagatagttagaatgagatgaaaatatcctaatatcaattaccataccataactccttcaaatatatatacaatggtacaataattcagcactgggcaaatggtatatttggtaacagtttttgttttgtaacccgagtaacatttaacattaaagctactaaggatttaagatgtttaagaagctttaagcactcattatgaggcttctcaggtggtgcagtggtaaagaatctgcctgccaacctgtaggagatacaagagacccaggtttgattcatgggtcaggaaaattccttggcataggaaatgacgacccactccagtattcttgcttgaaaaatcccatggacagaggagtcgggggcacttgcagtccacggggctgcaaagagttggacatgactgagtgactgagtacacaatacacacaagcattcatcataatttttaagaatgccaatgtagaaagaatcaactttttcaaaatgagaataaagacaaaaatcagtggtggtactcttctttggcttaaaaaaaaagtaccttaaaacacagacaatgtaatcagtcatttgtgaggaacactggaagtccaacaagggcattaatgcccttgtgtgaattagaaaaagatgccttctatgggcggagaaggcaatggcaacccactccagtactcttgcctggaaaatcccatgggtggaggagcctggtaggctgcagaccatggggtcgctaggagtcggacatgactgagcgacttcacttttacttttcactttcatgcactgggagaaggaaatggcaacccacaccagtgttcttgcctggagaatcccagggatgggggagcctggtgggctgccgtgtatggggtcgcacagagtcggacacgactgaagcgacttagcagcagcagcagccttctatgggagagagaatgacctggcaagtcttgtggaccctttgggcacatatgctgcaggtgagcagtacgtggtcttgagtaagggcatgtagactcctcattaattacttatttaatttaatcattcaactcattccgtaagcatttgagcatctaatctgatgcaggtataaattttcttggcaggggataaagaagagtctacttgtctttatatcattaaaaacattaatacggttctatgtaaaaaaagaaatataaaacagaatattctgcagaatggaaggccagaggatgaacacttcaatcaactcccttgctgactgcttctttagaagcctcagagaccagtaacaagaggagatgcttcagctcacctcatcttcatgcctctgttcattgccttctgctgtatttgaagattcattctgaagcagctgaccttgggagagatcctctacaaattctggattattgggtgggatgacgtggctccactactatatggagcctctgggtgggttaacctgcagaatgatcggcagagtgggagaagtttagtatcagcagcatcgaaagctcctacttatcaaggttcaagacacatttcactgccagcaaaatcacatgccagcccttgaattaattccccacctcattctgtataaatgtaaataaaccatatctccatagcaattatagaatacttttaaaaaggtttcaatgcttgattggactagctcagttccgagaagaagtctcctactaaaaacaactataatctttctcctgcaaattacctctctcctcaatgtagactttacattttagctctgagcatgcagctgacttttatgtactacttttcatgtacctccaatgtgataaatggaaaatagtattaatggaaaagaataggaatgggagttgtagaggcagtttgcccccctatcacaaaacagcgagttcattaaaggcacaagaaatttctcttacagtacattccataggctattccttctgtaggattatagtgtttgttgacaatgagatcatctaagaacagtattatcaagttcagaaattcagctataaacattaataagttagagatacacactttctgttcttaccattctgtttcagatgagtcatcaaatctcatctttctgaaaagtggatacaaggtacagatgatggttggatctcagatagagttacaccctaactaaacatttagataaaggaatggaaataaaggtaacatcatatgctagggagtttggggtttgtggcaggtagcggggaaggtggaggaagatgtataagagagcaatattcagtcattattctggaagaatgtacactttatagagttatagaaaatactaacaagtagtgaaacagaggtctataaaatatgccacaaaggtacagtagaagggatgaggacttttacatatatggagagaatgtttaagaaaaattttacagaggaggacttaaaaggtgaataggcattcattaggtaaacaacggattgtaaacacgtaaatattgactatcacccatcaggctcctctgtccatggaatcctccaggcaagaatgctggaaggggtagccatttccttctcccaggggctcttcctgacccagggatctaatctgggtccctgcattgcaggcaaatgctttaccatctgagttgccagagaagccctaggtaaacaatattatcacaggtagaaagaacagggtataataggagaaaggagaacttttcaggaggctactgcaaaaaactgagtgagagaccggggcaagcggaagaacagggaagagaaagctaaaagggataattaagaggcaaaatgatagaatgtatataaatagtgagggaaaaagaagagtcaaaggtaattctgttatccatgttaaattactgaagttgacaactgtactattacagttattaaccgaatatccctattcttaggaaattcagaaatatgtactgaagtatgtgggatacttcatgggaataaaaaccatgatatctgcaaaaaaaaaaaaaaaaaaaagaaactccttgctcagtactgcttcagtgtgagtttcatatgtttatagattttaggatgccaggggagggag

SEQ ID NO: 42214 - DNA, 2685 bp, Bovine  19866880775626
actattgttaacactgtatgagtattaaaaagcagtataaagccatttattaataattaatctacggacccaaatgaatttcttgttggtaggaagaaaagggaacagtgttgaggggcaggaggagaatgagggagtgggagcaaacctctcccgcctccaaacccccatccagttgtacagagaagtaccagtgcatctccactgcacagggattacctcccactcagtacacggaagagagtccagttgtctgcactgcagactgtgtcaggcattcacctggggtcaccttgcaagggcaagagagtctcctttgctccctgggggctccgggttctcccaggagatgctgggaggctggtgctccagggttggcagccttcccccaggaacctcagagcaccccttagaagggcccttggtgcctagggtcatcacaagggccccctgagaagccaaatgcaacgtcctttatggtctctgaacccctccacgtctcccatggctccactcttgactctactgtaggctgcacgtgccccagagcccatctataagctggactttttaacatgagcttcagacaaaccctataaggtgagtggagctgggacaggatccccattctgtaggtggggggacagaggctctgagaagagaaacttactttgaggactcctcctatctagaaggatgccctgatgagctctgcagtgaggggcgaggagagctgattgcattctgacagagacctcgccactttcaacagacgagcgtgagatggtggtgacatttcagtccttacccctctccctctctaccaggcggtctcctgtttctcccaggcacgccctcccctattggaggaggctgagctcttgctcccaggctacctcctcaccttactccagcctttcttgcctgcaagctttcaaggtcagattgcctggtaattcagtaattgatctaggagacttccattataaatctcccagccgtggccagcttttcccatatacccagctactacgccccacagcccattctatccagcttaccctggtgatgaccactcatgtgttcctccaggggaagacagccgatcatcctctgtttcccccctttcccccagccccctgccaacaacactgctgtgggcagggccccaggggctctgaatttagacagaagtgacatggttctgaactgacctcaaccatcaaatgctgtatggtcttaaacaaaccacttcccctctctgagcctccgtggccacacctggaaatggatctggtcagatggctttgaggatctagtgtgacaaagtgtgggagctggcagggtagccactgtgatgagggctcccttgggacccagacttgcggatcctcaggttgaaggagaccagagtagggcatgattgcccctgcttctctcagcaatcagggaagacttctcagaggaggtccatttgggctgggccctgaaggatgaccagactctcctatatttgggggtgggtacagcaatggatggtgttctggggccctccacagaggcttgaccaacctgtggcctttggatttcttacttggaaatctgaccacagtaagcccacattatatatacccttctgtggtggctcagatggtaaagaatccactttgcaacgcaagagacttgagtttgatccctgggttgggaagatcccctggagaagggaacagctaaccacgtcagtattcttgcctggagagttccatggacagaggaacctggtacagtccatggggtcacatagagttggacacgactgagcaactaacacattttttcactttttcattcccttcagtggctccctgatgctctttggctaaagtccccactccctcgggaagcttcagaggcctggcaagatctagtccctgccagcttcacatacccgagccggtgtctccagctttgatgaattttttaaacatttatttatttttggctgtgctgggtcttcgttgcagcacgcaggcgttctctaggtgggagctactcctcgttgaggtgcgcaggcttgtcattgcagtggcctctcttgttgcagagcacaggcattaggtgcacaggcttagttcccccccacccacatgtgggatcttcctagaccagggattgaacccgtgttccctgcattggtggcagattcttaaccaccagaccaccagggaaatctcctttgatgaattttttaaaaaattccgtacaggctttaacctgtgcaccaactgctccctaatttgactctatgaccacagtaaaatttgactctgtgaccaagtaaaacccctactcccttccagggcctacttactcccccacccctagagcctgccccttctttctcagagtctcagaccctcacaccgagtccccacgtttggactcagcgcatacgtgcccagcgcttcccaggtggcgctagtggtaaagaatctacctgccactgcaagagacacgagacacagatttgatctctgggtggggaagatcccctagagacggaaatgacaacccactctagtattcttgcctgggaaatcccacggacagaggagcctggtggaggagccccagtccatgggggtcacaaagagtcggacagactagcatgcacgcacgcacgca

SEQ ID NO: 42215 - DNA, 1522 bp, Bovine  19866880799170
atgcagaagttttagtgccaaaagcaggacagtccccggacacatcacgatggttgatctcactgattcccctccagccgttgccacgaagcccacctgttttcttatcctcgccacccttctgttggaagacactcattcattgaatgaatgaatgaggggatgcactcggacctgagcaagcttctcctcctctctggcctcagtttcttatatacatcatgaggggatctcccagaccttgtgcacacaaacacagcaaattggagagaaggggcagtgcccagctcagtgaggggctgtgcgtgcactggaccccagggtgggcagaggtgacagtggtctggcagtagggtgggccagcatggctggggatgagccaagtgtccgagccctcaccttcctagatgtcctgccattaccggagggccatttctgggccaggctgttggtccagacccagggttgggggtgaccagaatgctgacaccgactgccaagcttcactcccctcccacccccggggaacagatggcccaagcttgggcgggcggcagagatggggactggcatttgtgtatgtgtgtggtttttaaaaaatctgacacatttttgtcacgtcttggtgcatcagaacagtaaaggaggcgggagtgtgaagaatgttttaactcgcaactttgtaacagttccagattctctaggcctcctccccctcccccaagcccctgcggaggagcctcaaagcccatctgttcctggatccctgctcccgactccccacagcaccccccatccatctactcatctatctatccatccatccacctatatccatccatccatccatccttccctcctccctttgctccatcagccgagagggagaatcagagaaagcagcttgatactccaagagaccctgagcagggaggcaggagccctatttcagggctaacttgacctcagacttgctgtgtgaacttgtgcggtttctgatcctctctaggccccacctgtgtgcacctgagggtcaggtgcaccccctttgggtgtcctgactctgacactcatagacatgtgtatgacatagggagagagattagagatgaaaagacacaggaaggcaagttttgcgtttagagcttccaggaggatggccccacagtggcagagggaaccacgtacatgaagccagactaagcgggtcccaaccttcactcccctcaggtttggggcctgggtcccccacttgactcccactgcacctaacccacccagggtggatctttgaaggtgacctagggctgacagaggtctggaaagctgctccgagtcaggtggggatccaggcagtaccagcgacctagacatccctgtgccgccccgctgtgcttgtctagtcctgcagggccctggaaaaggaagcagcgtgggtgccaggccctggaaggtttgcttctcagccgccagccctgctgtccccaagcctgcctggcactagcttccgtttcattagcca

SEQ ID NO: 42216 - DNA, 3022 bp, Bovine  19866880822963
ttgactctggagctagagctgaagatggagatagtatttgcattctgggaagaagcaagcccatctgggaaaggaacgttgggagagaagagatcacagcttaggacagagcgctgaggtggttctattctgcagatcagctgaggaccaggagagcctgtagaggcaggaagaaaacagcagactgtgatgcccagaagccaggaggagagggtgactgaagaggggagtggcatctgtgtccagtgctactgagagcttgggaggacaagacaagaaagtgtttggggacctggtgacgtgggggtctctgatgacctcacaagagccgatcagtgaggaggtgggcgtaggagtcagagagaacggaggtgacgcaaaccattctttgggaacgttctcacctttgcaaaacagcggaaattaagcattagtcatagggaagtatgagggatggaactaaatccacacactttctgtgagtgcccactctgtcctaggcacagtgccaggcacagggatacaaaggtgggaagagacaggcccaaataaccacactccaatatgatcagcatccaaataaagcgcatacagcaagcggtattggcaagaggaatgttggacccacagattctgtgtctggggatcagaaaaagcatcgcagagtgggctctagctgacctgatccttacagatgaggaagatggaggaagaaaaggtttgccaagctgcgggaaaattttcaaagggacagagttcagaaaaaacagggagagtttggggaccaacaagtggccggatctggcctgatgggggtggtgatggtggatcacagggagtggcagggaatgccttagaaaaataagctggccatgacagaataggcctccacatcttgctaaagagactgaagtccgtaaaaaggaaaaatgggaggaaaaatacattggttcatctgctgtgtgccaggcacagagctacaaccttatacgttttcaacatggattttgcaatataagacagaccaaatcctggtttgcaaggtatagtgaccttgcatcctttaacccagcaagtctcagtttcacatgtaacaggtcaaggataatgcttatcatatggaattattgcaaggcttaaatgagataataaaataaaagccactaccaaaatgataatttacaatagagtgatattggcaagattagacttgcattttaaaaaaggttgttcttgcagtggtgggcaggacagaagaaagtctgctggggaggggacagatgggcggcaggagggactaaggccagtgaagagctactgtagaattattaataattaatcaagaagaaaaacaaaacaatgagctattgagggagctcagaagagagccgaacgctgagtaccttacagaaacttggcctggggatggtgagaaggaccacttcataggaggttccatggctgaatgaggggggttcctgtgaatgaagggatgcagggggacagtgagggagcaaggtaaagaatgaggaagagggatggagaatgacaggcttttctagcttgagtgggcggtggagttcttaactgagttggcagatgcaggagaaaatgtgggtttggggagactatttaattttggacaaattgagtttgaagattctacagaatgccagatggagaaggcctgagggagctggaaatagagatcaggaactccagcaaggaggggcctggagattcagatctgagccgttgacatgcaggggggaaagcctggctcctggagagagaggaccaaggtccagatggcatctaagcagtagcgattttggaaggtccctaagaacccagtttttagatcaggtgggaataatttaagacatagctcatacagaacgttggtttgttcaaaactacaggtgcttcagttattttgatctagacccagagactcagagctagaagggaccacctcatcttttgtttattcacaccttttagggccaggcaatgtgaatgaataaaaggagacagaagaaatctgctgcctgagagtagactgcccactaggagaggtagaaggaagaatggaatcagaaagtcagagtagcacagtgaagacccagtcctatccgcaggcttcaccatgaaccgccctgggttttagtggagagatggtctggagatgttgcaaggtgatatagaagtggcttggttgggaataacagaatgggggtctttgtggtacccctccccccaaatgttcatccactttggaattgtggtatgtcgacagctgattaaagtccccattttacagatgagaaaacggagtctccaagcgattcaagagaccaatgctaaagggtggctgcagtgggtgtgaacccaggtttcctggctccatccaggtcatgtatggccacctgagctgagggaaggtgggaaacaggaccagaggtgcctggggactgagacccacaaggtggggatggggagagaggcacaccacttcaagttcaagctgctagttttgcagagtgtaaaattactgcccaagtcccagagaataaacagagttaacaccccattaaatacaatggactttcaacgtgagcttgagacgtgcccagattgaaactagctgagcaggagctggcccgtgagtaaaatgtatcacaggcattgccttaacatttccaaaacagaaaaacccagtgtggggagaagaaagcgccagcagcagctctgcaggcttggggctgagaatccggtaatgaagtctttctggaaggtaagaaagggctgtgtgctgcatgctatttttaaacctgctggagcagcacgtgtatcctgccccgcgcactttctccagcagaggaggggccccagggaatgcagccaggaatttagatgctatttattgtatttccttttatcagtcaaatgattttcctatttcccacatagataaagatcttctgcttaccgctccagcttgttgaccttgtcaggactg

SEQ ID NO: 42217 - DNA, 1857 bp, Bovine  19866880837875
ggatgtgcttagattctacttttagtttgccccagaaaagcagttgcaaaaaaataaagcttcttcccactcacgcagctcttctgagttgacaaggagctttcagatttactaatttgcagccaccagggtgtgactctaagtttccagtcattgtcactcttcagaagccgagtgttgctggtgttgctggccggaaggcttagaagacatcacagaagtgctaagtggccagcgggtggccagcagggtcaccaggaccccccacccagccccgtagatgtgggggaagggctccttcggtgaaggctgagaaccaccatcgccagttcaccagtcagagggtggaggaatgcagaggtggaagggcccgcagagaccctctcaagggtctccaatggcaagaagggggcctatcagaagacctgtgggacttggttaaaaaacataaggccagatctcagcttagacttactgactgggtaggggcagggaatctgtcagtttctagtcaccgtctgtgagtcagacgcacacgcttagaagggaactcctctcattcccttactgctccattttacaggtggagaaactgagggccagcaggacagaaccactgagcggattctttttaataacagagaaggcagggtataatcacctcccacccgccattcctgctctggtcctttctagcctgttttggtttgtgttttccataacggcagctgtctcaaaaaagagcatcaacagtttttcaaaatcctctccccagttgggctggtcttcatttggtcagaaagtatctttgctcacagtaaggcaaagcttgattttggcccagctggtgtttaattattactgagatcctgacattcaaaggcaggggaccttgatttcagtcttgtctgggccagaaaatcactaagtcgagaaatggggaagggagcacggatgcagcaaaggagatagcatacaccaaggcgcagaagcagggggcgactgggtgtgtccagctgaggggtgggaggtggggggagccactagacttggagactgaagaacaggatttgaatcctggctccagcctcacctcaccgacaaggttcctcgtcgggaacaaggggatgatgagcctatgtatttaacagagttgctctaaactttatacaagaagtttctaacatgcctcgcccagtacttaagacatgacatcatccagctcagctcatgtgcacagaggcctgtcagcccaccgcgatgacagcatttcagacctggcagtgttgctgctataaggtgctgtgctcccaggcagtgactggagaagacgtactcccaggacttcaaacagcagaacaaagcccaggactggctggtggcctgagcagtgtggagggcatgacgatagactcttatcagacggcgagaccccatgttcttgggcagccggtgctgccgagctctcgagtttcttcccaagccctgtcctcagcagcacccctttccagatatctctgaaagacatgtgttctcatatatattatttaatttttacattttatttggatatagtttaaaaagtaaagagtacaaggaactctcattctctttccccagattcagcagattatttacatttttgccacaattcattattatatctctctctgtacttacacagatatgcagatgacaccactcttatggcagaaagtgaagaggaactaaaaggcctcttgatgaaagtgaaagaggagactgaaaaagttggcttaaaactcaacattcagaaaacgaagatcatggcatctggtcccatcacttcatgggaaatagatggggaaacagtggaaa

SEQ ID NO: 42218 - DNA, 1538 bp, Bovine  19866880881480
tgtctcctcctcctcctcctccgagtgcaaggctctgcccctaggaacggccgcaggatgggcgcgccgctgcaggccagcactctgcgctctctcggtgtcctgcaacctggccccactttgcctagcaggctttagtaggttgcccttagctaacccacgtgcacataaccccctgcccagttatacactgaggtggcagtgcacagaccactaccctgtcagccagcacacccccctagcagcctgctctccacggtttgcacattgagacgctttctcaatgtcactctcatgctgccttgcccgtgtgaatttgaatgttgaccatttagtgcagtttcatatttaatgaagaatgtttcctggtccctttattgcttttctaggtatccttcaccaccaccaccctcctttttccctcctgtttctgttttgacttggatccagtcttcttcattttaactcgatagtattataagcacggacaccctccactaccattatcttatagcactggcaaaccgagcaccttttcacattagctgtgtttagtactgttttcatagtcggaagtgttaagggcaaaagatgaatgccagctagtcaggaagggactcgggctgctctgagatgggtggctagattaatagttctctgagtgagggccaaaggacgtaaggtggggaaggacgaaagtgttacaggtgagaatggaataggcaagataaccctatttctaggcaagaggtattgtcagatggtcctccaaatatttttccaaaatgatgaaattcagtctcatattaacacaaatattttgcatctccattttaattgtagcagaaactttgaattcattcatcaactgcaaagaaatcctgccctcagacacggacatacatatttatacatattatatatatatatatatgagttttgaattgtgactagtatagcactttaaattttctcaagtaacatcaagttattgtcttcaatacagattggattttttctcttcttttgaagtctgtactatagattcttccatgtatattgagaatttgaacaattaagccgctattggaacttttccttaagccacacgagcaagaataatctcttgtacacttttaggtaaacaggacaatggctggagtagccaagaccaagactgaatgtacagcagagtgccttgttagcgtgctaacctcgtctgggaggaaaggaattagatgttccacaggaaggcagggggctgtgaaagggctcccttgctcgcctgaggagagcccttggtgcactagcatgatgccaaggagctgattcatcaagaataacagcaagatggtggaaagagcagttgcaacccatggcatcaacaacaaaagaatggtgaaggacgcccaccgacccacaggctaagtcagaactggaagccaggaatatggcagtggggtttttaagttttgccctcagaagataaaccagctgagatagacagggggagcacagcactcacattccctaatcga

SEQ ID NO: 42219 - DNA, 1261 bp, Bovine  19866880903866
ctcctaatgtcctgctggctgatatgtactgtgtatttggcctctcatattagcccctgcccattaatgccaactgcccacattagtttggggccttacctggtatggtattacgaaagttgaagcaaccacatttcctccaaccttacctcttatcagtatatcctttccatatccacctgagttcttaaagcatagtaatattgtattactctattgctcggcaactccttcctgataaaatctgagagcatctcttgaaaataatgcaaaacacaggtccaaaataggatgctaaagtttctttgcaaatcagttgattcagaacttgggagtgcattttccttgtagaaatactacatggtaggtttacaaaatagccaaaactttcaactaaagcatccataattgaagcctcctagtttagttaacagtgtttccacctggaatgtcaagatgcagtccaaatatgtgtagaaggtatggaggaggtcatttcccttcctatcctccgttggacatagagatttaataaaggaagagatttaataaataaaggaagaaagaactaatatttattaagtgcttattatttatcagtctctgttaggcactttacatattttatcttttttgagacacagttgacatttaacattgtgtaaatttaaggtatgcagtgtgttgatttgatacatttatatattacaatatgattaccaccatagcataccatagaattagctcaccccactatcacatcatataattatcattttttgtgtgtgtggtagaacatttaagacctagtctcttagcaacttttaagtatgtaatacagtattgttgtctataatcagtatgctctgaattagacccccaaaacttactcatcttctaagtatgactacatctcccaattctcctatccttcagtccctgataaccaccatttgggtttcccagctagctcagtggtttaaaaaaaaaaaaaaaaatccacctgccactcaggagatgcaggtttgatccctgggtcaggaagatcccctggagaaggaaatggcaacccactgcagtattctcacctgggaaatcctatggacagaagagcctggcgagttatagtccatgggtcacaaaagagtcagacacgacttagtgactaaacagcagcagcaaccaccattttactctgtttctatgagattgggtttttagggtttttttagattgtacatgtaagtgatatagtacttgt

SEQ ID NO: 42220 - DNA, 1062 bp, Bovine  19866880904371
cgggttacagagaaatgggaagaagcacaaatgcacaatgaaatgacaggcttccctactctgagctgaaaaccacgtgtctgtgtctatctttaccaggagctaggaggtctcccatctctgttcgcctccatatatcgctcttttctcttcctcattctcggtaaccaagctttcctctcactcatcagcttgctcttagctgagcttgaccacccactccgagatggtagcccttgcctggagccaacacaatctccagtctcagttccctgctgctaacctaatctctgtgccccgatttcaaattcccatgagacacactgtgattggccagattttagtcaggtgacctcaacctggcccaatcagctggggcttggggcaggttgctgtgggaacaaggacccaccctcatgcaccagatccaagatacaccatctctggaatcctgggacaggagggagatcacttttggataaccttaaatgaagctgcaccatctccctgagagcgtgctcctcagcaagtcaagaagaggatgggagtttcaaccagggagtcagctgattctgccagcagggcctagtagctggcgagaagggacaagccaggtgaccctcatcctcacccttgaggcagcagctgcaggcctgttttgcatcctgtccagatatttccagtaaataaacattgacgctttcgatatcatgttaatttcacaggcggctgctctgctgacagtttccacactccgccagcgcctcttgtcagttttatactcacaggcagacaccagtccctcttgcaggccacccaacatacagacaataaaaacaaatggctcagaaagccctgatggagtgacaggaaacagcataagtgcctaggctggggagagcagccctgtgcagggtcctaaagttgaccagggcaaggccacagggcttagaaacctacaagtgtaatcttggtcaaatctctccacatttctggaccactggtttcgagcctgtgaaaggagttaatatgcagcccctgcttctctggggatcttgactg

SEQ ID NO: 42221 - DNA, 2573 bp, Bovine  19866880927847
aaattcgtaggctgcagcttgagctttctttctcagttgctccacttaggatcaggccttttcacacagaagaaaaggctttctgggtcctctttcacttctcacagtctgtatgtggattgggtgccaagaattctgttccaaaatgaatgggcacaaatcagtcacatttcttgagtcaggttggaatttaattgtttttaatcagagacttctggaaagtgtatagaatgaagagttcaatggggtctttccactgttaggaagttcaacatagaatagttttaagtttcagaatgtgaatagagggaacacgtcaggattgatttttctaaaacaattttgaagaaagaaaagaaaaaacttttattacattttaattttagctttagttctgggctttgagacagtacatggaaaaaaaaaaaaaaagacgaatgtcctcaactcagctttgcacatattgttctccaatgagtacaaggtaaaatttggcccgctcctgatgtgattccaattacaaaatgtacgatacaagattttatggaagttcttctgaacccaaggtctccccagatggaggctttgaggcaaaagaaatctaatgatatctaaagaggagataggccaaacagcataaatgtgaacagcatcagaaggtctggattttatctttcttcatcccctaaacagatccctttccttctttggcccttattttttcatcagtaggaaaatgattaggttagctcagagaatcttaatttaagatctttgcctgttaggtggatcctaagtggtatgataatcacaaaaccccatgcaaaattttgtgcacagtagatttctggagaggagggccatagttttgctttcatcagagtctcaaaaaaatccaggtggcagcccttgtagaagtctcaaagcagctcttcatcacttaaaaaataattttatgatcttggcagttaggattgttaggaagcagattaaagacctatgtttaagagaggcaagactgatcccattttcattacttgtaattagtccgttttatttagtgaaaaataaatatctaaaataagcaggctgtcaataaaaaaggcattatgagaatccagaggtcaactttcttgccctataaaagccatagtacatagcaaacatgtttgtttttctaatttacttatttgtctgcattgggtcttagctgtggcacacgggagctttattgtgtcaggcaaaatattgtcattgcaatgtgtgggctcagtagtcttggctcgcgggcttagttgccctgctgcatgtgggattttagttccctgatcagggaacaaaccccgagtcctctgctttacaaggtggatccttaaccactggactaccagggcagtcccacaaatatgtttttatttgtatttttgaagtataatttacatacaacaaagtgcacaaatcttacatgtacagctcgatgaatctatacgtatacaaacctgcaaaacctgcccagcaccccataagcctcccttctattccccaaatatcacctctaccaaacatagttactattctgacctctgtcatcataggtaagttttgcctgttcttgaactttatgtagatggcatcatacaggatgtaaaactactagcatatacctttctgctctgttgggaagcagtatggtgccagggaaagaggacagacaattttggaatcagaaacacagtgcttgaatcagtctccatagctcacccactttgttatcttgaacaaatgacttaatctttttaaaattctgtaaaaaaaaaaaaacaaaaacaaaacactgtagtaataaaaacctgtctggcaagtcttatgctgctgctgctaagtcgctttagtcgtgtccgactctgtgagaccccatagacggcagcccactaggctccccggtccctgggattctccaggcaagaacaatggagtaggttgccatttccttctccaatgcatgaaagtgaaaagtgaaagtgaagtcactcagtcgtgtcagactctcagcgaccccacagactacagcccaccaggctcctccgtccatgggattttccaggcaagagtactggagtagggtgccattgccttctccagtaagtcttatgagagtagcttattaaatactttatgtaaggtgtctggctcactgaaggggctcaagtttgtttaattttcctttccttctccctagaaaatttctattccaccttctagatcctgggtctaggagtgcttcctaaaggaggccttttctaacttcctaccaagcaaaattgctattttcttgggtctctttatttcattaatgtgctttgtatgttcctctgctatagcatttagcacagtctactgtcagacatgactaaacaaaaacaactgtagctatttgttgctattactacaagaatttgagagtcttgtggtcaggaactatgtaatttcacctgtatttcaccagtgcccttactaataaaagaaattcaataaatttttgtggaataaatgaattctgctctactggcatt

SEQ ID NO: 42222 - DNA, 1349 bp, Bovine  19866880941658
cctctccctctagtatgagattgggcaaggggatgatgtatctgcaaacagggatatgggtgagtgtgatgagtgggataaccttctggaacaaggagccctctgggcagagcacttaggcaagtcctttcacctgctccaaagtattgtgaggatttaatgacataacccattcagagccctggaataggacccagcgccacgatcggccttcaagagagtgcaccgctgtgatcatgagtctagttggtgcggcaatgtctgctctgtgtgtgtatccagttttttgtgctatggtcttatcatcatcattattataacagtgctgtgttgcaaatctgtttgtgtcattgttgaacgtgatgtgtcatttcggtcacgtatgtcagggttaagtgacctgaacaggacttttctgcatctccccattttcaaagccccgtcagtccacagatggaaaacccaagtccccattcaggatttccagctgtgctggagaggagcaaactgtggtctacacctagatcatgtccaccctctcaatcccctctctgcccatgttgtcctagaagcccacctcccccaactggctgacaagagcctgaagggcagatgagtgaggggcgcaccctggttccaggagttccaaaagcagacctgagtacctatctgccccttccgggcctgctacctaatatggcatttctataaccagtgaaatgagggtggcactgatagacatatgaatgacaccaggagggcaagaaagaacccagcacaggagaggggccccaaagcacggctgaggcctggttgacttctcactggtcactcctgaagctggtggacacaatgctggacggtaccctcaattccttcagcaacatgtacagagggcactactgtgcccatttcacagatggggaaactgaggctcagaaacaggaagtgacttgtcctagtcagtggagccaggaatagcagccaggtctggccctgctgacagtcacagaggtttgggaatggaaggaggacactccagttggaatcttttccaagggataaatgatgtggctcagggcagcctgaggtggagacatctagaaggccccagacaaaggggggcccccacactgaaccaaagcatgggctcatacactcagatgcagtgtgttcacaccacctgctggggtgtgaaaaccagccataaatacctgcattgtcgtggtgctcatcaggcaagtgggaagagaggcctggtgtgccctcaggaaatttcccagtgactcacagacttgtggacccccccctcttggcacacccagacactccttgcataagcacatccc

SEQ ID NO: 42223 - DNA, 1723 bp, Bovine  19866880943331
tgggatgccagcatgagaagcattattcttctcctaaatgctgggaaagagataggggagtaaagaaaatccaaataaactcaactgggccagtataatcataagagttccatgtaaacaaaaactgttctaagtacaattatacaaaattaacatctttcattttaaaaggagccaagaatatttcacatattttagaaaaaattcagtaaatattgattttttttaaaaatcaagaaactataatcattaggattatagtcaataatctaaagtaactatatgaccaaactgagaatttgatgatttgtctgaaattactaggtctataacatcccaagattaatctgagtacaatactgaccataaaagaccctgaagataacattccaaacactataaatccagcattgggaatctatacaaactcaatttttaatttacacatttgtcatagaaatcatgttacaaaatatttaccatagaccaaatcctgtgaatgaaataacatctaaaaccatggcatcacataaactttagaaaatacagtaggaaaaagtcacttctcagtacctctttattggtatagcacccatataaacacagtcttaaatagaaggagtacgaagaaaaaatctgaagcacacttcatctgagaaatgaacaaagaagaggaaactattttagcatttcatgcaatggaattgagcaagaacttttgaaaaatcacttcccttagcatattggtctattcttattaaattacaactgaatctgccaatgatgctttacaatataatagattcttcaggaagtcaataaaaaaacaatctggattggaagtgcaattatatagctttctggaacctataataaatgatcttgaggaagagggatatcactatttttcaaatgtacaaaacaatgtaagttcaagcttttttctgctactgaactcaaactatacaccaaaggatgcaaaatgagcaacaataaccaaatcaacagtgacaggttagtgtgcacaactaacacagcagacaatgggaacagctttctctaaagactgcagtcctgtgtaacgcagatttaatttaggtcacagaaaattctacgaagatctgacagcttctgctttgactagatgaaacttgctgcatacatcagcataaataattaggttcaactgtacattcaccaaacaaaataaagtaactttcctcaagctgggggaggaagctatagctttacctctaccttgaattgtagggatcttctgatttatcctagaaacagtgttctcttttagaactgataattacagttgtgctgtttggttgctaagtcatgtccaactcttttgctgcatcatgaactatatctcaccaggcttctctgtccatgggatttcccaagcaagaaaactgaagtgggatgccattccttctccagggtatctttctgacccagggatcaaaccccacctcctgcaatggcaggtggattcttttccactgagacccgggaagcccatagtaaaggaaacacacaataaacagagtccccaaagggactttcactgagggtgtgctgattttatccgaggttagggaactaagatcttatattcttcattaaaaaacaaacaaacaaaaaaaagagtcaccagaaagaaatctacaaaaggtaggatcttcaattagcagttcactttaaataatta

SEQ ID NO: 42224 - DNA, 825 bp, Bovine  19866880979742
caaactgatgcttcacatatgtgttatttattatctataaattatacttcaataaagcgaaacaaaataatatatttctcataggattattttaagaataaaatatcgtacagaaaaaatttcaaataagcctgtaaaaatgttgttattctggtaccgaataaacacttgataaatattaacttctcatgtaacaattgaaagtacttgagtaactaattcaatgttcaaaacacctaagacataccttagcttcttcttcttgtgctttcttaacaattgcttgtaattgcacctctcgtttgaattcagcatgaagtaatttctcttccatcatcctacgtcgttggtctaataacccttccttccactttcggacttctttctcctatatgcaatgaattatcacatcattaatttcagcatacatagtcatttgacaagaagtgcaaacaggtaaacagcttaggaattacaaagtgaaaaaccaggaaagatctaaagatcatgactaattattaagaacacagactataaagcctgacagttcataatctaccagtcacttgctagatatgtaaactgggcaacttttttagccgacatctcagtttcctcatctataaacagaacagtagtagtatctaactcataggttttaaagactgagtcagtcaatatatgtaaaacttttaaatagtacattagaaattgctcaagagaaatagttgctgttattattatattgcactatgagcacacttaaaaatagtatttcttatccttataaatgttgtctctataactcaaagtcaagacaaatga

SEQ ID NO: 42225 - DNA, 902 bp, Bovine  19866880994637
ggcaggcattctccagagacagcttagcaccttcactgggcgcccccgcaggcctgtctgggcaagatgagaccttggccgttcccagctgctgcttggaatcaggtccttggccattggcctcaactcccccacgtgccctgagcatcttacagctcgtgtagtacttctgctcctgttgttagccttgtaaggcggtggctgtcacaagtccactttacacacaagcaaactgaggcacagggggttgggacaatttggtagagttgctaagccagtggacaggtgagaggggagttgaaattcaaatccgagggttggttcccaggcctgaacacagccctctcagtggtgggtcaggttcccagggaccccagagagagcaagggcaggggtggccccctcccaacttccttctgcccagagtctgggccgtggccagggtaccgtggggaaggagggccaggccccttccaaagaagatgtcatgggaaactcagggcttcagacatccctgggtgtccaccccactccagcaaagcccaaagggatgaggggatttcaggccccacggaaggctccctgagctgggaaccaggcaaccccgttcatgccccagctctgctctagactagggagaggccttgaacgggggaatctctgtccttggttcccccatctgtgaaatagaaggtgaggagtgtggactagaagatccctctggctcacacacagaggatctgctctctactcactctaaatggcctaggtggaggagctgagcccactgcccacagcgtaggaattcagcacagggactgggggtgggaattcagggactagggtcctggcaacaggctgtaagccatctgcagaacccaaactttcccacagatacagcc

SEQ ID NO: 42226 - DNA, 1111 bp, Bovine  19866881022129
cgtaagaaaaatttcctggtcaaattacaataaaaaccccaaacattaagcctttcttgctgggcagctacctattatgtttaacaggcttaaaacaaaatgtgtcagagatcaagagtaagttatctgatatgtcaagtgcataaggtcaaaggtccaattttattaggtcagaggtggtataaataaaatcttatatgtcaaagaagaagggtcacagataaggtgtatataatataaagacatcacagatgacaagcaataactttaagtagaacaagtatgtttactatagttaccctcactgattaaaaatgaaatgtgtgtatgagtaagtataaaatggcctttatatatcatgtaaactcatatgcacacttggtttgaggaaaagggggctattaccaaaaataactacatgaatgaagtgaaaacttaaagaaaatgtaatacttctaaactgaaacagtacacaaaatgaatatctcaatccaacctcaaaccacaacagctaaacatcaaactatgctgtagtagctacaaaagttatacaatactatatatttttcttccaaagtaaatgtgtgaattaaatatcccttccttctctatttttctcaatgagataaaaacacataaaatttagatttcagtttacatagtagcagtgctgcacaaaattttagattttttttggtaaattaaatagaatagcctttttattaagagaacttagttacaaataatttttataagtggaagattttctttaaagagactaattaaattttaattaatggggcttccctggtggctcagtgttgaagaatccacctgccaatgcaggagatacggattccattcgtcgcccgggaagatcccacatggcaggaagcactcagcccgtgtgccacaactaatgagcctgtgctctacagtccagaagctgcaccaagagaagcccctgcaataagaagcccgcactgcaataagggtagccctcgcttactgcaactacagaaaagcccatgcagcaaagaagacccagcacagcaaaaataaataaataaataaataacgaaacaatttaggattttttaaaaagggaaca

SEQ ID NO: 42227 - DNA, 1668 bp, Bovine  19866881056954
tgggtactcttgctattcttacaaatacgcacatttttctcccctcatccctttttttctatgatgcatatactaaatatctctgctgctgctaagtcgcttcagtcatgtccgactctgtgcgaccccatagatggcagcccaccaggctcccccgtccctgggattctccaggcaagaacactggagtgggttgccatttccttctccaaaatatctctatagatattttaaagtattttaagatagatttttaaaagttgatttgaaagtggacatttgagatttagaaacttttcctccatgttttcagatacccagttaagacaaagctattacaagacacgcataaatcataattgctacccataactttgttaaaatttcctccagatgatttgacatagttaatggtaatatactgtaacaatgtttctcaaacttcagtcacttgagtgcatttttcagaagttagatcatacttacttatctattatttccttaatatagtcttgattcaactcaatgtaaaatgtattttaaactgtatattatttttgtaaatgaagaacacttttttctaatacgtattaagtgggtagctattcaaatatttgtgcttcctgagaggtctgtgataattagcaaagtaaaagttgctcagtcgtgtccaactctttgtgatcccatggactatacagtccatggaactctctaggccagaatacttgagtgagtagccttttccctctccaagggatcttcccaacccagggatcaaactcaggtctcctgcattgcaggtggattctttaccagctgagccacaagggaagcccaagaatactggagtgggtagcctatctcttctctagtggatcttcccaacctaggaatcaaaccagggtctcctgcattgggacagattctttaccaactgagctatcaggaaagcccaattagcaaaagttatctgcaattttttggataatatgttttaaaagtcaagtgctttcttggccaattggtagtttatttaataaatacttcttgagcccggtgctttctagtcatttggagtaccttagtgaacaaaatataccaaaactctccatactcaaagggcttacgttctgggttgatcacatataacattcttagattccaaacagctctccttgtctcctactcctatttctatgaacgcagctaaaccaattctcactcaaatatttataaacactaaagttttttttttttttcttttaaagaatgtttagaaatcctcactactcttaagtatcagaattactgtcacattcattgtgttctgggaaattctcataggtgaactcagttcatggattcaaatgtcttttaaacattatgctatgcaagaagcgaaacaacagtttattgagtatgataaaaccagtgatggtagtgtgtcatgggatgaatacaacattcagatgtatgatcgggtgatcgactttgttgagaacactgctctcgatgatgcagaagaggagtcttttaggcaggtgagtatgtgtgcccaagctttttcttttgattatatcagttcagtttcctgcatgagtgagcacaagaaccctgaggtcatcgactggattgccttgttctataggcaatcacctgttccac

SEQ ID NO: 42228 - DNA, 719 bp, Bovine  19866881102137
gtcttccctgtgcacctcagttttccaggtattgagatgttgtccatacaaaccccaagctcagggatggggaagaacagtcagggagttctccccagtgggtgagaatgaaggaggaacagggagcgctcaagtccctgcagatttagagccaaaggaatcctagcagcactgtgttcacccaccggatgggcagggtggtcccagcttgggaggtagagggagagtttgcttcatcattttaacaatgcagagccccctgataaacccctggcacctggtgtggggcttggcctggctgagtgctcagtaagagtttggtgacccgaggagtgaactcatgtatctgtgttcctccgttcccacctccttggaaagtcttccctgattgcccctgcccactgagcaagtgagggctggctgaacaaggtggctcctgggcatttgcaaggcccccaagcccctgcctgccctcaggggctgagccacgcggggccggcaagctaatttggagcggctccctctaccagcctggtgcaccaacaattgattccgcaccgctttccccgcctgggcccgggcccctggagctggttagagacgagcgatggggctggcggaataattatgcctatttcatgtgacacccaaattgattgccgccagggtgacattaccagggcattgttcctcatctccaacctcttattacatgttat

SEQ ID NO: 42229 - DNA, 1208 bp, Bovine  19866881107487
ggggtggtgttggttgcaaagcattgggtgcttcttggtctgttttcccgccaaaggcgatgacatcatccaaagctcccttaggctgccgtggatgcttgggaggtatcatggctgctctagattgtcctggattgttttagaataaagaaagaagaaaaaaagaataattaaataaaatgttcattctggttacataattgaaacttaaacagaaataaatgtagtagccataataatttaagaagttaacaccttaattcaagaacggtaaaagaaaacaaagaacaattagctaaatttaaaggtagaattcaagacctaatgggagcaacaaatgtgaacaatgtctcagtatttccttgccataggaacagggcgatgggttttgctttcaagaaggaatcctgattctccacttctggccccaagagtgctgtattcactacactagagtactaagtacactcaaataactgtattgtgacagaagagagaggataacatttgcaggttaaaaagaaatacttgggagcattactaaaaacaatcgggattagcaaatgagactgctagattggtgctcagaagatactattctattaactttgttccaaagttacattgtattatactgtatacaacacttgtcattctccatccaaaacaaacaaacacaatttcataaaccatgctatttcatttccctacagagatggcttctggcaccacttaaactggtctatgtataaagacctctgagattgtggtaagggaaaccatgtgtatgagcaggcaactgctgtttcaaacatcacccacaaactcttacatgattctgttttatttgggggggggaatataaactgagatttgagagatgctacatttgaacttctctgacaacaagcttcagttacagaaacaatcacctttgtttcctttccagaatttatgcttagaagataaaacatgtatgtatgaatcagtgataccttcaggccttataatggggatggggcattattttttttaaagacttagaaatataccatgaagttttaataaaagttattaaaattagtaatgttattaaagtgaaatagtcactcaatattttcagagttaaaacataatgctctattatggggtggaattacatccttttccccaaaaatatacttatggtacttctaaatatgacctta

SEQ ID NO: 42230 - DNA, 702 bp, Bovine  19866881155485
agctttttttaaaccccttaaaagtttgaaatggtcctgcggtcaagtccatcactattttcctttagagtttctggcattacccaccgaaaagttttgaaaagttgtcttatgttgttttctacttctttatgatatataaggggcttctcaggtgacgctagtggtaaagaacccacctgccaatgcaggagatgtaagagatgcatgtttgatccctgggtcgggaagatcccctggaggaggagatggcaacccactcaagtattcttgcctggaggatctcatggacagagctctcatggcgggctacagtcaacagggttgcaaagagtcagttactactgaagcgactgagcatgcagcacgcataatatttaaaaatatttaaatttctggttcattcagaatgtttctatgggtgtggtttgaggatagctatctaagcagtttccctccaaatgactagccggttgtttggacactgtttactgagtgagctgtcctttctctttgctctgaagctcctttcccatcatctgaaaagtgtccccacaatctcatgtctgtccaggccttgctgtttgattccattgatcatggcctggggaaagatggtagggggttcagagaatagacttggccattgattaggggtagagtgtgaggaggtgagaggtgggaaggaagaagcaaagggaa

SEQ ID NO: 42231 - DNA, 1336 bp, Bovine  19866881201991
cttaagaaaaatcccaagtctctcatactgtgggcagttccttactgtctgagccacttgggaagcccttaaaaaagtaaccctacctcaaacattactttcaatgaataacaatactttgttaaagaggacttaactagtcaggataggattgcacaaagcagtatgcacagatgcttctagagctatatgtcttaatcttttgcgtgaagggtgaatggtgaggtattatacacaactatgagaatctgatgaaagctacgaattgcatgcccagaaaaaggcacatacatgcatcatattttacatttaattttagttgagtcatgaaacacagtaattatcctatagagttctaaaatctgttagtagatgttaagcaacctctgtttttaaatttttcaaaataatggacttaaaggattttacaaccttaagcaatttagcagtcatctaatgcaaactgctaatactaatgaagaaatagtgccccagaaagataaaaagaattaggtaaagccgtattgcactcaggaacaaagacatgtccaactaccatactaatctacataagactgacaaggcagaatttagtataaatcagtgcctttgggtcagaataattatcacaatggaaccagaataggagactttcaaatgatcttttggcctaaacacataatagatcatcattgatggttaaaaaaatgaaatctggagttagatgacacgtgaaaaagttgacaaaggcactaaatctttcttattctcaggttcttcaaaacaaaatggaaaaataattaaacctacccttgtaggattatttgaaggataaaatccaataacatacattaaatacttaacacagtgcctaggtatatcccctggaggaggaaatgacaacctactccagtattcttacctgaaaaatcccatggatagaggagtctggcattatagttgggctacagttcacggggtcgcaaagagttggatatgactgagcacagcacagcagcagaagcaaggtacacagtaggtgctcatgaaatgatataaattttaaaatatttcttgtcaagtcatggaactggataaaagataaaataaaatctcaaagtaaatgagatgctttccagctaaataaaataactagcaaacatttacaaagtatctatattattcaaggttttaccaaggatacaaaaggataaagctgtcctgtgttctcttttcaagcaaagacagagtttttcctgctcagtttctgccttgggttcctctttctcttttccctttcttgtttagctgctcagtctttcgactctttgcgatc

SEQ ID NO: 42232 - DNA, 2656 bp, Bovine  19866881233842
gggtgctgggggaattcaaggagagaatggatgcgaaagttcagcccaagagattgcccagccaaggcagctgctcctccttactgctgctgtctattcactctccttcattctacaaaactctccattcatgctaattaccctctgacaggcaccggggatggagcagtgaaaagtgactgaccttttggggtttacattctagaggggagactagtctagtcttagccactcagttgtgtttgactctttgtgaccccatgactacagcccaccaggctcctgtgtccgtggaattctccaggcaagaatactggagtgggtttccatttccttctccaagaggggagactcacacccaacaaaataagaaagaaaaataaattgtatttccgatgatgataggtgctatggaaaaaataatcaggaacttgggggttctggggaggggttgtggtttaaataagtggtcaaggaaggccttgttgagaaggtggcccttggatagagaggcaaaggaggtgggggagagagtcgtgtgggccctgagctaggagactatcagatccagagaatagtaagtgcaaaggccctgaggtgggagcgtgtctggcaaggggaggggcatcaaaggacccagcacagtggaggcagagtgagttgagggggagagaggaaaatgtgaggtcagagaggggatggggccgagtcagtaagcccgtgtaggtcacgtggagacgtgggctttctctctggtgtggtgggagccgtggtgagtatgtcagatgtgtgagggggtgagtggggggcttgtcatctctcttcctggacccagtgggtgggatacctgctcctcacacaagagagagatgagccagagtcactgactctcctcagaaaatgcccagaaggaagtgcagcctatgacaaggaaagatggggatgggagaggccgagggagccccagcccctctgcaggcccctctgcctcagggccgcctctccctgccctgcgctctagcttcacattcccagcgcccttcgtatcctggacacccagactgtcagttacaactgtggtttttgtttgtacgatatcaacaagaagaggaatgctgtagattcgatatatgagaatgaacatctaacacaaatggccagagtgccaggcagatgctgggcagatgccgggttgggagccccactgaggggagagcctcactgcagcagacgcagcagaaagcacccacgacagagaggaggacataacccacctatgggagccatggccagcgcagggcagaggcctggagacctggggccctctgagagggacaaggcccgctccagtttaactcagcctgcttcctctgagtgctatgctgggggcagtgccagccctgggggaggtggcctggacaaagttgagtttggggtcgcggtatttgggcggggaggaaggaggactgaagtccagcctgtgttccgctcgtcaagcccagcagctccgggtggggttgtgtccaccagaggaaggaagtctccttttagggcacaaatgcactttatgggcccacaggggccaccccaaggaccctgccttggctcaactgagtccctgccccatgcagggtggacggcaccagggctgggcggtgggggcagaggggtggtcaggatgcagaggtggtgtgagacgggtcagtaaagaagaaacctctgctcagaatgtactgacaggtatcagaccaggaatgccaggggagctcatccagtctgtacatcctcaagaaggcagacgcccggaagggtggggaagcctgggtaccagctaaggggctctcctgggtactagctaaggggctctctggagaggttctcagcaggacctaatgagggaatcagatgattattttagtgcaaatctctgcctcttgggtggaggctgaatgggaggggccaagaggactaatgaggcatcccagagagagatggggtacctgagggggtgcagtatagacccactgggtggagccaggttgagccaggtcagatcaggtgagggtgctgtaggccagggacgagatgggtagctctctggagcagagcagatctgagggggagggatccactctttcctacctgccaacatttctggagccaggtttaaaccgaggccttctcagccccaaagccctggcttcctctaaccatggctgcctgctgccttctcacccatcccttccttatctctgcctgtccccccacctacttgcccaggtccccaaatggaaatccctggagaaggggtcagccgaaagggctttgccaagcagagttatttttacttggtgcccagatattttaaaaaaataggcaaagcccatggggttccctgccttctaaggtctcactaaacccaggatggggggcacggaccaggctggctggcccaaatatttgttgcgttgccgggtaaccaccagttggccctgcaagctggcatctgtggaaccgaggacttggaaggaaagtcgcacagccgctcagggcctggaatcagaaacgtcagtgaagtcaggaagcgccccacatgtctcctgcggggagcgcttatcctcaggaaactgccccccaggagacaggaggcgtgaga

SEQ ID NO: 42233 - DNA, 1548 bp, Bovine  19866881298654
tgtgcctagtgtttaatgctgccttcagtgctgtgtgacttctacgcccgtctatattttactattgtgcaaactccttggacctatctctacgctccctgctaatccagggtctggcttgtgtcggttttagttgagccaaactgaatttgttattaaggatgtcactataccagggccatgctgtgtggccttgggcatgctccttccctctctgggttgcagtctcagcatctctataatgaggaagctgccaggatctctgggctgttctgagtttctggaactccccaggtctgcctgcctacactaggggtgaacaaaaatttggggggtgggttggttcttagtgcctcacagaccatctgcctctcctgttagcaacttggtccccttggaaccaggtgactggtattactaggaaacaaaaggactttcgcagaagttaatatttctttcttttccccaaagaaatggataaacctcattaagccaagacaagggaactaggtcatgccctgatgatgtcaagcagaggcttgtgagtgaagcaggctattaaatttcagatataaaaaataatctgctccttgcacctgcctgattactttattagcacaaaagataaatttaaacctcagacttatgacaaaaagaagtaagtctgcactctcctcctaattaaaccaagagaagccagcctgatccaaggacacccggcccactcaattaattaacatttattacaatcagaaaacaatctaattcaattaaaatgtttccacaaaagtggtttaatgacttttcccaaaataaagtacattcgaccggagcatttattatgccaaggcccagttgtcggtcgtaaggggagctggaatgacagccctgatatggctcgtggaaaagcaaggatgggccaggcagggccaggaggatctgggctgagccccttgtcagggcagagggatgctttctgcctccgatgtgctgtgtcaccttgaacaggtaggaggtgttcagagaaaggacagttagcagggctttctgaaacttagccaggagatgtttggaaagctggagaaactgccgtttgaaagctgtgaacagttttctgactctcatgaggcagagatttgaattcatagtgcctctgttcagcaaaaatcccttgataggtcctgagtgataaaaacagaaagcaaatagttggagttctctcttttgagctaacaaaatagtacgagcacatgctattgccagacagcgggctaaacacctctgatggacttaatcctcacaatggccctgccagctggcactctccattggaaccaaggctctgagtgtgcctgaggaccgcagtgactagaggcgaagtgtagattcaaacccaggcagccagactcagggcagagaggcccctggcaagctccaaataactgtgggaccctggggagagggaggcctctgccatcagacttgggtggggccccagagtctgtcctgttgaaaagccccctctagactctgctgctctggtcttgg

SEQ ID NO: 42234 - DNA, 1149 bp, Bovine  19866881324088
acccctcctctacctcatatacaccttgtactttccatagtaccccagtgtcccaggatattgtttgggaaagtacactaaggaagtagtgccaagttttattgggttacgttaactcttagttccagcactggtccagaagtttcttacttgggcagttatctctttgtttactaataataaaagcagtgcttgaataaactgtaatggaagggcaacttgggaccattaggcaccaggaaaaagaaaccaaatacgtggactatgacctcgaaagacaacaccctccttgtaaaataacaaatttgctttggcagaggaaaatggttttttttaattttctccatattatcaatgtgctttaacctgtgatacaaaacactgtgtctagatgtttcaggttgttttcttttcacaccatattttgtgtcctaatggtgatacatctccatcaagatttcattgaggggaaaaaaaatgcatgtacagggatcagactgtctagaaagaaatctaaaccatgctcggtttcttttgatgatctagtgcttatgttttttagaaaatatctaattcaaaactctgcaaaacttttgcttcaaaaaatcataaacaacagtagaaaatttatgtttgtttctaaccctggcctcttctttccacttatcatgttgtctgagaacagtgtctctagaccaaggagaacaacagactgtaaaattctgtaaagcgtagctacacaccacttgataccaggcacaatcttagttacacagtaaagatactcaacaaatgtttgctgttgaaatatgaattctacaagcacttaccttaaaaagagcacccccccaaaaaaattaatatattgtcagtatgtgtgctgtgctcagtcgtgtctgattctttgtgaccccatgtagcccgccaggctgccctgtccaggggattctccaggcaagaatactggggtgggttgccacttcctcctccaggggatcttcctgacccaaggatcaaacctacatctcctgtatctcctacatggcaggcagattctttactactgagccattggaaaagccaccctttatcactaaataggttataaaactacagctaaataaatgcagggcatagtagatagattct

SEQ ID NO: 42235 - DNA, 1000 bp, Bovine  19866881338270
taaggactgctgggaggggtcagttctttgagcgaaacggaggggtaaaaggcttggatactgttcacgtggagaactaagactctgggggcagtttctccgagatatacagcactttcttcgtccctgctgcctccaaggtttagagggcacaattgtgggccccagaagacctcatcccaggacaccaactttctcagccagtacctgcggggtggggcgggagcggtgggctctcccccatttccccgtcgagatcactgaggcggggagcaggtgagtcgggggcggatagaagccttggccgcgcggtgtctgcgtcagtcgccgcaccaggaatagcccccgcccccgcccccgccccgcagcgggtctgagcgcccgccgggtgcctggcagagcctttacgcaggagctagagcgcgtctattcctgtcgggcttgtgggaggaggcggcgcgggaggcgggagctcgcgggtaactcacaaacagccgaggtgggggagctggggagcctgggacaggggtccaggcggcacagagtcgaggggcccggggagtcgcctgctgggctgttgaagggaaggcggcgactcatgtgtcgcttcctctcttcccctcccgccttttgtaggtccctctgccgagcctgccccctgctggtttactcggagccccggaaggcgattcagattccctttccgggcttcactagctgttcgtccgcacggaaatgacagaacctctctgagcctgggtttccttctttatgtcacagggggaaccacagcgcctcctcccagggttgttggaggatgaatgcagagtgcacagcacagcgtcctcacttgctaggaggggcttcagctaggcataggatttggatggacacggaatacagcagatcgttctgcagacaggactgcagagctgtggtgtggccgtgagcctgagaaggacccaaactctgtttagctagaacaggtctgtgcaactct

SEQ ID NO: 42236 - DNA, 862 bp, Bovine  19866881351378
ttgccagtgaggaaaatgacttgcctaagaaaggagagaatgtcccagaatcacttacggaattggttagaggcagaattgtgactgaaacccagggcgtctgtagcccaggcttattaaggtctcttggcagtgcccgcacactatatggaataaacagtgttgcaagttaaaatgggcctggctgcctgtggtgtcagcaaaatttgttgccacttgagacagaaatgatttgatttgtatatatgtagtaaagaaacctattgtattccttaatggaacttagattcataagacatggttaccaaggtagatactggggagccctgttagagctcaagaaatgctgacctgaaagccattcaagccattctgcatagcagtggggcacttcagcctggtacacaatattgagagcattccttaaagtaaagggcacttgagagaagcatatcacttcatgagattctggccctgagcctagatcacagcaaaatagtttcagttcaaaaggcctctgttctcttaccctccactcaatatatagaatgaaaaccaaagtgaagagtattcttgctcctctcaaatcagaagccagcctcctagacccaggagtcagctagttttactctcaagaaagtgtctaaatctcatgtggggactaagatagaaacaataattttgtttctcctttaatttatgaaaaatgacaaaatgacactcaacgtgaacaaattagaccccttcaatgacgaggtaatgaaatccttatgattttaatcccttgagtgatccttggagcagcttaagtatatctgagcccccaagagtatcccctccaatgccgagtaacgtactcagt

SEQ ID NO: 42237 - DNA, 1244 bp, Bovine  19866881360369
tggggaacaaggcctttacccagagcctgcccctcagaccacttcctcgggtagctccagctccaccagccagctgcacacatgcatggcccaagcagtgcccacacctgcctggacaccatgtgacccagggcctggtgccgttcatgagctttcattcagcaggtgtgcaccagtcccctcctgaatgccaggtgctattctgagggcacccaccccagcaccctcagagtgcatgtgcccacatgtgagcacacccttgggcatgctggtgtccacgcaagaaagaggggagggcagagggcctcacctgggctgtgtagtcatagagtgccctatagtcctggcctggcatggtggggggccctggcgcctcctgcacggcgatggcagcgtagacaccctcattccggtcaggggtaggagtcagggtctctgtggaggctgagtacaaagtgaggtctggcacccgccccttgcaaaaatcagtagcccccagagggccccctgactcacagcgtcctcagacttgctcagcttcttcccatcctccaacctcccagctattggagggcccatctgtgccaagtagacatcctctcctcttcctccccccaaccagggtgacagttgtcacccctaattacctgcagaggctgctgacagtgtggtcttgggacttccatgcagcagcccagaaaacctgggggcaggaaggacaggtgagtcagggcgggggaagtagatgaggcagggagcctgcaaggtcagccctagcttccaggcacagatgtgacttatggggtgcccctgggcatgagggctctccaaagggtcgtcccagtggctcttccccggcagcactctcccagtcccttaccctgtagatgtcttcccagtacctgttccccgcagggccaaattggcgtgctccagggcctgggccagacccctctccagcctcccccacaggcaaaggagctgtcccctagagctcagcccactcacgccctgctgggaccttcaccagcctggccagccccgccactccccgaccacacaaagtggtcgtccaggaggaagtgttgagctgattcaccccttcctctgtacttggttcagacctggactgagctagagtcatgcaagtatgttgaataaaagaaaaaaaaagtgcaagaggcagacactgggcacctagtacggaggcccatgtgggtgccctgaagcagaggtgctgagag

SEQ ID NO: 42238 - DNA, 888 bp, Bovine  19866881464758
tggtagacagtaaaaataattctctattttgagtgcacataagtcaattcagtcaagagatgctgctgagttgattagcagctatcacattatcaacaggatagacaaatgaggttcaccaggaacacaatcagcttatgtcagtgctgtgtgcaatagaaacccatcaataaaactgaagccttgggtttggcattctaagttctgtgtccgtctgtattcaatcttataaaaccaagagatgaaccaagcaaacacctttagcaagcagcagatggagctgctgtctaagtcacaaagccttaactatgagggtttcatttttcaacactaattatgtttggagacaaagatgtgcacttaaagacactgtcaaaactattttaacttataacaggctcttagaaagagaagctacaccagttgtagctctatccaaagagcagtccttgggttttactgcctttgaaatgacttcaatggcaatcaataactagcagctttgtctgctcaacactgacacctccaaaatgggaaactctagccaccaaagtcatgcttgagaaataaaaaatgtgtctcctgaggcacttaagcaaggatatatgacagtctaccctggtgtcttctatttgtttgccaaaacaggtcagctatggagcatcaaatggaacgttggataaggaaaaactcattggtctccgcctcccttataatctcaaagcaaatcctgcagatgaaatgctcggtgacaaagtgtaatggctgaagttgcccctaggagctagccaggattccacgatctaaaatctgatttaatatttgacagttttcaaggccaaaacccttcaggctatagagaagctgttcacgggagctatttcacgt

SEQ ID NO: 42239 - DNA, 943 bp, Bovine  19866880761471
ctgacaagactgagcaactgaacaacaacaaccaacaaaaatgtctaaaagatgctactaagtagttcagtctccctccatgagttatttaacttcagtctacttttctgtaagtgtaggttatcagttcagataacattcattgtctaggttaccaaggcagacctgcttttggacttgcttaaaagttgattaatatcattaagtctcctattaattatgtgatactggtagactctctgtgccacagtttcctcatttaaaaatagggaaaataatagtacctattgaatgcatccaatgtgcttagagtattcattaaaatgtgagtgtggataaagcatatgcccagaaagatgattttgccctcggtaacataacttctgattaaattctaggcctagagctcagactgttaacttccattccatgtcattcccacagtatctcacacaatggcctctctggtaatttttgcctctaaaatttatcaatactacttttaaattagttttaaaaatatataataaattcatcagtaattactaatgaaaaagtgcagctaatccttatagtttttagttgattttgaagtgatttaaaaatatctgtttaaatgtccttatttagcatcagtttggaaaaaatctgggactccttgctcataaggatttattctgattctttcagaagaattgctacattttagaatctccagctttatccggtttgggaaatagagaagacttgacaaactgattctccaaatagattctctaatacctttcagtgatattcagcatgaaatgggtttatgatgctgaataagaccagaaatcaacactcttaagccgaataccaagtagaggagaaattccctgggggaatcaccatggaaaccaaagaagctcaagttagcaatatcggaggaaaggaaaataca

SEQ ID NO: 42240 - DNA, 1237 bp, Bovine  19866881247433
ctgactcactggaaaagaccctgatgctgggaaatactgatggcagaattagaaggagatgacagaggatgagacggttggatggtatcactgactcgatggacatgagtttgagcaaactccgggtgttggtgatggacagggaaacctggtgcgttgcagtccatggggttacaaagagtagagcacgactgagtgactgaactgaacagatgagaaagctaaggccgagaagtttaagccatttgcccaaagtcacagttagtatacatggtaatggcagtcctattgcagaatctatactatactgactcaaaacatggtaaatattagagcatcatctttgaagaattttagaaaaatacattacttttcatattaaaataagcaaagatatactatggaacagaatgcaaaaagtaatgtgaatttttaatatgaaaaaagaaacttcaaagaatgttcttatatctggtttgcttctagctaaggcacttgatctcaggggagttatgtattcactgtcctatgccaatacaagtttttcagtggaaaacataaaaattattacattacataaagtttatcctttctgtgtattgaatttgttaatattacaacttcttataggcatatggttagaacaaactcttcaaaacttaaaaatatattgaaggaacataagacaaacataaacacagcggcagaggaagactgcattgtggaattcggggactgcactttctttaccagaatctctgtaatttcacagccatcatgggactttaaagggaatcatagcaccaagaagatcacaagaatccagattcccatgtgtggaggtgggtagaaaggtgcaatctaggtctccatgtcatcagttctgcatttgacaggtgatacaaaagttgcttttagcactttggattgtggaatctctagcttgcagaaaacatgtgtttcctctttgaagggggaagattttgtaagttagaaacacactctactgaaactatagacttgttctaaataacagaatatgccttttcccctaaatgtcttttattgtatgtttctgagctttcttccatcatagaaggtttgttaccattaagaaaatgtgaagaaagtctggttaaaagcaggtaatcagaattcttagagatttttaaaataattttgctaaatgtaatatactaaatatttacatttccagatataaatgaatattttatgt

SEQ ID NO: 42241 - DNA, 752 bp, Bovine  19866880437439
aatccagctgtcctggggaagggtattttcaggtactttttaagaacaacataagttttcctttaaaattatttaaccactctgaaaatctgctttcaaaatgtcttcctctcattttcatactaaactcagatcttgaaaatattttacataaagctttaaaatgattgaatttttttatcatgtatatttcataaacttatgcatgaatatattttagttctgtacttataatttaatagtaattatttaacctcaaaaattaaaggactaaatcagtgtaccaaattaatgaaatcataaaccaaaaactgccatatattagttatttgctaatctttaagtgaatctctttttccctacattcatctataaaaagaatctttaaaaaaaatgagttacctaattcaaactagaatcaaactatcttagaataacaaattaattattgaatattatttattgaatcactgatataaaaaagcatatataaaagtattaaaaattatgttctaaacagtatagaatgtgctacacaatcatttataagttaaattaacacctttaaccacatgttttccctaaatatagttgtaagagtaaaatttaattttaaaattgtaattgtatagtaggtgtataaatctttgtctagaaattttccaccaagttacatttaaaagctggaacttactccacatttgttttgtttcacttcccccactcttttaagatagcctcaatatatatcc

SEQ ID NO: 42242 - DNA, 2191 bp, Bovine  19866880567231
aaacagctctatagggaatatacagaaatgttcaggatatatgtaatgttaggaggagaaaagcaagttgagcaaaaagatgtatagtactctacttatatttaaaaataatagactatccattatatgtattacatatctaagccatatatatacaccacatatgcatatatgtacatatgtgatgtgtatatgtatatacttttattaatctgcaaaaacagtagcaaagccattacttctgagagataactattatttaaatattttacaactggcttgtaattattccttaattaaaaaaaaaaaaaggagggtggtggctggaagacaggacatgacaggcaagaaaggggcttttcctgcccaagcacacatgccacagcctctccttataactatggccaaggaacagatttctcccacctctagaatatcaacttgatcatctgtcaattgatcatctgtcattctaccaccatgtctgtctttcttcagttcttaaatccttgtctttttttaaaaaattaaaatgcaaataccaagcaatatcaaactcaaaggcttcattaaaacctcagaaatatcagttaacacctcagcaagaattatttgatttgatagctctgagtgtaagaacggaagctgaacagctgtactgttatctaaaaggggaaagggctaggttacaaacaaagaaggaagaacaccaacaggaaagacaatggaggaagggagaaagaggaagcagttatcaaggaataaaagaagagtcaaaaggccctgcttcagactgtattgttccaaaagcagaccacagtgtggattgagagcatcgactgagaccacctggattcaaaaaccagttcgaagattatagctatgtgaccatgggcaagttacctaacctctccgtgctcttattcatctgtaaaatgagaacactaatagtatctacctcacagagtttacagtttggatacgtaaagcatttagaacaactctggcacacagtaggttaatacactgtgtaaacgcctgatgctggcaatcaatgccactcgtgctttgcccatatactgctgatattcacttctacaccagaagattactcattctcaacacttgtaacaccctactgtaggctgctttctgactgcagaaatgtgttcagtctgtacttagggtaggccagaaatgctgaattaaagtcaatgatgcctagaaagtcgttgggtaaacacctgcagcctccctgctcttgacttgggataactctgacgcatattttatttggtctgtgagagatccccagtggtagtgagctccagatgcccacagtagtaaccgtatcttagcattcatcacattttaactattagtttcgaagtctgttccccacaagactgctaactgctctttaaggatgtctttgctattctgtctgccctggtggttcagatggtaaagcgtctgtctacaatgcgttagaccccgggttcgatccctgggttgggaagatcccctggagaaggaaatgtcaatctacttgaggactacttgcctggaaaatcccatggacagaggagcctggtaggctacagtccatggggtcgcaaagagttggacacgactgagcgacttcactttgccctattcatctgcctatgcaatattcaaaaaagttcccggtatgcagtagtttctcaataaatacttgtttcataaatgaatgaaataagtgcatcactgtagaaagtacataattatgaactattgccaaaggtaagtacttattcaaggccaagagactcctagatgatctttttcacactcaagaaaatttggttttcatttacttgagtttaagaagaggatattcaacatcttgataacccattgcactgcctcgcttctaaggcttatttgccacctagattacaatagcctctaactgactgccttgcttccaagctcatctctctccaattatcatgcagattgttacctctctgaccatgtctcttctttttgtcatatataagttccctgaagatttctcaaattaaagagttaattttcttaatctcccttaaacttttgggattctaacactatagtttttaatttatttttgagggaacatcggtttataatattaagtttcattatatttttacttctgcataaa

SEQ ID NO: 42243 - DNA, 1195 bp, Bovine  19866880586981
aatagtaggctatattcaataatatgcccttacagtctggttattatttcttgcttattaagggcagatccacgtgcgttgatagttaatcaagaggaaatagagataattgatgtttctttgtggcaaatttaaaagcctaactggggcatgtgtctgagtagatatatggccactagccatctaaggagacaggtcccttctgtgagtagggtcaagattttcattaggaagttttagaactcctctattaggagaaaagagtgtccagtgcaaaactactatgccatagagcttggttgagataatttaagccaggagcagttttaaagttgttacttgtccagtgtaactctttacaaaagagaaaaaaaataatacatctaatttgtttaccatagaatttgttgtaaaatatttcctaagtcatgaactagtgatctgttatagatgggttgttgactaaagactatttaatgaggatttcagtcaaaagtctttattttgaggatacttaattttaagggattcttttgggaaacaaatagcaggaccagttacctcttaatatacagtgatatagtatttaaattcatactagtctgactagctagacatgcatccttcatatccagaggaattcttagattattaaggagtgaaaaggtgatggtaaagtatgtccctattattttgttgcttagaagttttagcctagtataatctagtactgttaaatatgtagcatctaaatcttgtttgttaaatacatgaaggaaataaaaatccctgaacaatttttgaaaggtcaatagacttgattctgagtcttggtagcacttagattttttactacaaataacatgtgtcccaattgcataattaaatagcgcctttttcctgatttccctttggagaataagtctcaattagctatttgttcaggagacttacactgttctacaacatttatttacttttttccttcataaattaactgcttgttaagagctttttacgtctgtacttatatctattgggcgatgcttactccttgaaaggaaagctatgacacacctagacaatgtattaaaaagcagagacatcactttgccaagaaaggtccacacagtcaaagccatgatttttccagtacccatatacagatgtgagagtggaccgtagagacgtttca

SEQ ID NO: 42244 - DNA, 767 bp, Bovine  19866880630991
aatggaatttaaattgtttcctaagggtaactaaagctttgtaattctcaaggctttgcgaaaactacaaaactgagtgtccaaaatatctgttgaggagataatacctgaaaacccattcaaatataaataccaaaggaagaagttaattatcagttcatgtcatttattttgtattctgtttacttcctacttacttcacaagccagaagaatccaattcataaccaaatacattttaaaaagtataaaagtagcaaagaaccaaaatgggcatttaatattttttatttcaggaataactaaatataagcttacctgagaagttcaaaaaagcaccttcttccaaaagaaagggaaacattgaatattgtgcaaacaaaagcatatgttcaagccagaatacatataattgccttacttaaaatattcttagacttctcacaagatcataaaagtcatattatactaagtgtgattacaagttatcatgaaatgaaaacctcaacaataatggatctgaattttaccttaagtaaagcttcatgcatgcaaaatttgattttacactgataaagtgtaattagtgaaagaggcccaagaggtactgaaatctcactcaccaacaagaatactattgatataaactggctgtataaagtgactgagcaatgctccctgtacaccaagcacttcccatcttgtcaacttgtcacttgaggacatactgcttattctattaacaacatctgcaggacagtagacagt

SEQ ID NO: 42245 - DNA, 1647 bp, Bovine  19866880658624
ctactggctcaggtaaagactctgcctgcagtgtgggagacctgggttcaatccctggtttgggaagatccactagagcagggcatagcaacccattccagtactcttgcctaggaaatcccacggagagaggagcctggcgggctacagtcaaaggggtcacaaagagtcagacatgactgggcaacttaacaccacacagcaaattattgctgctatgaggattaaatgctttgagtgtgcttggtacacatcaactacagaattgcttctatgttaccaggtatagcatgttacatagaagagctagaactgggactcaaggcacccaaatctaggcttagcagatggtatgttggctattgtctttgttttctcacttgtaaaatgagaggtctgtataggtggatgattcctagagtattttcctactatcaaatgctaccttgcttttggactacatttattttcctcttccttaaaatcccatggacggaggagcctggaaggctgcagtctatggggtcgctgagagtcggacatgactgagcgacttcactttcacttttcactttcatgcattgggagaaggaaatggcaacccactccagtgttcttgcctggagaatcccagggacggaggaactgggtgggctgctgtctatggggtcacacagagttggacatgactgaagtgacttagtagtagtagtagtactgtcctactgtgatataacttgaaattgtttttctactttacaaaaggaaaatctgaggcacagggaaagcacaatgcctttttttaagtgcatcattgattcagaattaggaaatttcagcttaataaatggctagcttcctagccactgacatttggaagatgaaacatggagctcagcctctccaatactctgtttctcagaatagcttcagacagcatttgcacattgaaaatacttctttaataacctgtcaccaagctgtcctccattcatctatctaaatctatatcctagaatgtccaaacttgggataatgagcttcatatgtttttggcaccatgctgcctgtactcttcaaggacctttgaagactgcacgatggctgagaaccttctctgaagcacctaagtgacggcagtctgagggatgagatactgggtcttacaggccactgataagatgaatactcatatgcatttgaaatggaaaaaaaatcatgtctttttttcaaggctagtactttaagttcaaagtctttacggaaagaatataatgaacaccatggaatagggcagattaagtgaccctgacttagaaagaagcttcactttctgcactttcaagggaggcagtctctgggtcagtgctgtgaaagcactattttttctgtctaaagtcctgacagatggacatgagtgtgggatgagaaggcaaagtgatgaaaagcagacagataagaaaagtaaaggataaaaaataagaaaagaataacaaggacaagtgaatatgggaatgaaaaggtacatttagtcaggagagagagacctgtagtcctttgagatcataacttacaaagacctgtctgtatcttgcttcttatatggttacactacacaaacaccttccatataatttcaggaaaaag

SEQ ID NO: 42246 - DNA, 2389 bp, Bovine  19866880665430
acccagggattgaacccaggtctcccacattgcaggtggattcttgaccagctgagccacaaggcaagcccaagaatactggagtgggtacctatcctttctccagcggatcttcctgacccaggaattgaaccagggtctcctgcattgcaggcggactctttaccaactgagctatcagggaagctggtattgttcaccaaaagaactacagtacacttttcttcatttcatttgtcaatgataaattcctgatactctataccataacatttgaaattgatatacaatatgaatgggtatataagaagtaaataggaagtgatacataaaatccatacaacagctaggattaggttcatattctcaatggcaagataattagatctctcaaactgtgcttctattagaaaaaattagtttttctagagatgacatgaaatttttgttcatttattcccccacataatctttaatatagccattcagttttaaaagtgtgactggtattcttttaatcaggtcttcaaagtaaagaaggaaaatgattaaaaatctacctaatttttagcaaaacagaaattccttcatgagctatgaaagctaagtttttataaacagcatctgatttactactctatgtgtgtgtgtgtgtgtgtgtgtgtgtgtgtgtgtgtttatatatatgtttaactttacatgtttaacattatggcatacaaaatttgccattattcagaaaggagcttagtcactcattcgtgtttgactctgtgaccccacggactgtaggctgccaggctcctttgtccatggagattttccgggcaggaatactggagtgggttgccatgccctcctccaggggatcttcccaaccccgggatcgaacccaggtttcctgcattgcaggcgggttctttaccatctgagccaccagggaagcccagtaacatttaaaggattgactaatgttaatacagggggcttcctagatggcactagtggtaaaaaaaaacctacctggcaaacgcaggtaatgcaatattcttgtctggagaatcccatggacagaggagcctggtgggctacactccatagggtcacacagagttggacatgattgaagctacttagcatacgtgcaatgttaatatagagtgttaacaaaactctaatttcaagagaaattataagtattcatgaagatactagattaaatttcatgtgattgtatttgccagaacaatatactgccaaaatactcaaatgaaatgccagataaaattataagggccttctttaatgaattttcattagaatttacaatcaaattttcagaacttaaactaaatactttttaaagtataataatacttaaagtagttcaaaatgatatgcagcgtttaaaagtcagttttaatatcaacatattcagcactcacctgatgtttgacaatctgtcctagagccagatttaaatccacttggcatttaccaaacagtttcagatagctgctacttcctggtgaagctttggtttgaagtctgtttgaaagttccagttcaatcaacccagtttcaaatcgtacagctctcattgagggagttgtggccgttacctgaataccctagtagtttatatatgtttggaggaaaaaaataatcttaaatcaacaatatacacccattcaaatgaaatatttcaatacgtgataaataaaataccaagttctaaaatatcttggatgcctattgaactgataaaactggcaacatcctttaatttctcatgtcagtaggaacttttttagctattaaattcatttcagtattttgtattcaaaatacagactcttcatgggttaaatacattaataacaagtagctatttggtatgaataatttttatttttaagaacacatatcataaatattagaagtaataagatttacattaaggcattattttaattggacaagtgtacaaaacatttcttatagagtaatttataatagcaataatcagaaaaaaatcaatgttcattagaaggaagtacttaaattgttacgactgtataatatagcacagccatttaagaagataaagtagatctaaatgttctgaagtggagaggtattcaaagtttttataaaggcagaaatatatacatatttaaatacaaacaggaaaaatcctaaaggatattcaattgttaaggtttcttctctaagagaatagggttatatttaatacttcaattttattttctatttggaatattcatgtatcatattagttttctataagcatacattacgtggaaaaatacttcttaaggaatcattattatattattatttatgttaccttaaactgcaagttcaa

SEQ ID NO: 42247 - DNA, 948 bp, Bovine  19866880672418
catgaagccagtttttttaatcacataggaaccactctttccagaaagaagacatttactctaaccaagtactgtctgaccaaacacaaatttccccttgatccttgctgacaaaccttgattttgctcagagtctcaatgtgccaagctcaaaacaacagattataaatgttcgttgttcactcatttcccagcccctccttaccagttataaccaataagacccaaaggtaaatttgctggagaggattctgaaaaatctttctctttccttactaactaaaagtaatggacgaataggattagttcacccttgtcttcttgctgtgaaaacggctcgtacgtttggagcaacatcagccatctcgtgacaatgaggtacggagcatgagaaagaaccagagcagagaacagccgagcagcaagcagaaagagcctgggtctgccaaaccacccaagcaacgcccgacagagagccccaccctaaagccactctcagcagggttccctgttactcacaactgaactaccacccgctagcaggaccgatgaaaatccagagcagagctctgaggtaccacctacagctccgtgatgtgtgactatgaataacaatctagtggcctatctccctcgttaccctgacagcaaagagtgaataagggtctcgagttttgtaaaacctacaatggcagtaaaaagaatgatgagatttcccaaggtcaccaaaggaagaaaaaaacaaaccagattcattcagtaaaagcctgttatgcatcaggtattttggcatactggctctttactttcaaaattaatcaaagtacctgtatcatacacatttttctcactcacctcttctcaagtgagacacacttcgtgttccaaagatggtaataaacttttcttcatctgttccccatttcagttctccagccggaacaaagc

SEQ ID NO: 42248 - DNA, 1490 bp, Bovine  19866880695859
tcatggaaagagttgactcattggaaaagactctgatgctgggagggattgggggctggaggagaagggacgacagaggatgagatggctggatggcatcactgactcgatggacgtgagtctgagtgaactccgggtgttggtgatggacagggaggcctggcgtgctgcgattcatggggttgcaaagaatcggacacgactgagcgactgatctgatctgatctgaagcagcactaagaagtggagggaggcagatttctaatgacagcatttgagcatttcggttcagatgaacttgaactctcaccaagactttcagttaggaggaccaacaaattctctttttggtttaaatcagtttggcttaatccagtcgtttttaatctaaagagatctgactgatatatattgctatgtatatacttggctaatgtaacttgtattttcagccatttttaaggaacagatatgttttgaaggaaatttcatttgctatctttccaactgtttaatatctacttagaaaaataagggacagtaaatgtgacctgcctttgcacacctaccctctgactggccaggtccaatcaggcccggtggattcagccaatcagcactgagcaggatttgagtttcacttttctagcgctctggcagagcaacaaggccttccacttgtcaaatccagtgaaaccctttcagaatttaatcatactggatttctctggaccttctgatattgttaacaatccttcctttctaaaacattcttctcctttggcactttccccccttaggcctctaagacacaccttttttgcttatctctctctttttttttttttttttttaccccagccattctttccttttcatactcctcttctcatttcactgatcttcaggagtcatcttatccatttccatggctttgacctacaacctacatgccagtgatgttcaaacctttttctctgtcctgaattctagtcctttgtatccaatgcctatactgaaaaattctatctaggtattcatgaatagctccaggatgtcaaagacagaactcatcccctttgctccttaatttcactccacttcctatgcagccaagctacccttcatcctgcattccctgctttagtaaaggcaccacaattcataatgagtgcaaaacaggaaactgagtctcactaaaagctatgttcgatcaactcaacccccaaataaccctccatctcctctcccacacttgtttctgtttagtcactaagttgtgtctgactctttgcaaccccatgggctgcagtccaccaggctcctctgtccatgggatttcccaggcaagaatactagagtgggttaacattttctcctccaggggatcttcctgacccagggattgaacttgtgtcccctgtattagcacgctgactctttaccactgcaccacctgggaacacaacattaggctctcacttttcttg

SEQ ID NO: 42249 - DNA, 1087 bp, Bovine  19866880716175
tgcaagtttttctttacgatgacctgaaatatgtttcccctgatgtttggttctcttcctgaaaaaatttagaataaatcgaatacctcttccatataacactttgatgttcatctccttttttaataattctatgcccagctgacattaaaattctcatcttctgttcctccttttctttacagccttctagtataaaactctatggtttccagacccttccttatcttgtcttcttttcaacatgcttgattttcctatagctcttggtaattgaatatagacgtattgtaattataccaatgcaagtatctactgattaatcagggcacgataacattttagcctagagaccagtgtcacaaatgacacacagacatgtcttggttacctttatcaccaacccaaacttgcttctcttctcaaagtaaagcttgctgacaacaatcagatctcaaactattattttcaaaaaatgactagcaaaaatgcactgcggttcctttacacatggaaatcaatatgtagaagaacccattgtgttcctggcatggtaccaggtgctaagtgaatgctagtgaactaacagagatagtcctgtaaccaaaaagcttcaaattttccagtaagaaaaacaaattaaaagaaaacaggtaacaaataaatataaatagtataaaagaaacaaacaggagaaagaaatggattaaaaatggtgggtcccacttagatagggtgccggaggaaggtttctctgtggtactgacatgaagttgagataaagaggagaaacaggctgtcataccaagtgagaggggcagccttccaggaagaggaaaccaactgtgcaacagcgttagggaggaagaccttggttaagttttaaaaccaaatggaggccagagggcaggggcaagtgtagaacaaaacaagactggaaagcgagcaaaggcctggttactaagggtcttctaagtcatgggaggttttgagcaggatagaatattgaagtggcttttgattgaaaaaatattcaggctgctacaaatccagccaggaggcaattattggtggcccaggcaagaga

SEQ ID NO: 42250 - DNA, 1046 bp, Bovine  19866880780442
tgtcccaccgctttgtgtgattgaccttaagcttcaaaaagcaaagtgtataatctttgcttcgccctactttctcagataagcgcgctcttgtgtcccatttagtgtggatttaagacaagagaaaaaaaaataatcaagaaaatgagttgggttctaaaaaccagactggcaaaagggaatacggacagtgtcttaaaaccttaaggaggagggaaagcgagctggccggggctttaatcccaaaggacctaccttccctccatttcctgggccatttccactccaagctaatcttcagcaacaactgaaccacgttgggatgcgtcgctcatgtaaaatcagaaacctttcacagccactgagttctccttttaattaggccggtccagccgagttaggagcggacactgaccagctcagccttgcactatcctgccgggtcgaggtcgccccagaggcttcacaccctagctgtatgcagctcgcgggcagcagggggcgctgcggaacctccatcccttcccgggagaaccccttccccggcccaagcggttagtaccgcccgcaaagactggacccaaggtctctacctatctgtgcgctcttcctaaaaagacagtaaaccctgctacacgtccaaggtacgtgacaaaagaaacagagaacatgcaccctataaaactaaccactctattcttcatcctctctgcgtctcagagaggctgtttccaagatttggaaatgaagaaaagttgttcttgctcatgcattaaagcgcggacctctaccttcctttaaaaaaggaacagctactgacccagagctgcctgggaactccaaccaagtagctctaagtcggtacccgcggcgccccgcgctcactctcccccgggagacccgccaggcttcggctccaggctagccccagctgtgaatggagggtaggggaaaacggagtccgggcagaccttccacccacctctgtaccatacaccgtccgctcccttctccccactcccgacggtcgggagcgtcggaaggga

SEQ ID NO: 42251 - DNA, 2244 bp, Bovine  19866880811591
ttgtatgttagaaaatacactttacaggtaggtttttactttcagaagggatggataaatagcaaatttaacaaattcattatagtgggataccgtttgagttaatgaaaagttgaaaacaaaatcagaattaatctcggaaaactgatgaagttaagacagttttggggcttgcttgacatttaagtcccagtcatttttccacctagctttccagatttccttttcttcagtgaagtagctgcttgcatttaggggacatgttgtaatgatgcacactagagtcgtctcattgtggtgggatgcttcctttctagaggactgcaaccctcagttaacagcagacacataaatcccatctgactccagtccatatgctcatgagctatattagggctcttgtaatttttattattctcaatctctgttgttttttgtgaaggaatctctgtggttaaatttgtataatgtaagtactcatatgatgagtttctgctgtctcaatttttagctttgtgtgtaggcaatataaagtttgaggttatgagaagcatgattattcctttttagttgcagcttttgaagagcttgcgattagattttctagggcttggctagagtgacacagttattttctctgcttgtgtaccagggaggctgtggatctacctggtttcactcttcagatcactgaatttgctaagtatcttgaaatgtatgctatgcacactgttctatatttatgggtacaagttgtaatactgaaaaaataaatcctgggttttgtgaaaattactagagagtaaaatgaaaaagtatcccactgtttctgtaagaagagttcactcttcaaaagtaagtatggaggtagtatgatgaaattgaatgctaaactttatgatttagtatacatttagaagaagactgttgaatttgtatgtgctatattatctaatgatttagatgttaattttgatatggaaggaagatatagtggtatatgaccaagataaaggttgttaaattaaagcaagtaaagtgggaaattgtttgatggcacagaaacactcattccagaatgagttcaagatgtgtgctttaaatttatttcgatttatttcaagttgatcaactaaatattcttggaaatacgtaatataaagttgtgaaaatgacaaaagatttttttatttaatgtttctgaaaggttatactttgttttacagtatataaggtgatatttctcaatcagttttatagtattattattataagttggttgaattcgaagtctaattttaaacttatcattgaaaatgtagaatatgattattctattccagtgaacattgtttttcattgtatttaattagattttgttttaaattgatttctcttattcaaaacaaaatgccaaacatttttttctttcttaaaccaatttgctgatcaaaaatttttcagtgcctactttttaaatagtctaatatagaaagcagttatggaacaatttattgtaaatgtgaaagatgttttcccttttcaagatgctacacttgattgctttttagttttcttttttcttttttgcttttacctattaccatcgttaattaaaataccaaacattttatattctggagatgtacttagtttgccttcttccttcctttgtgtagaccaccaagattaatgggagaaggttttgtggtgatgcagtcaaatgatgttgacatctactattacatggatgagccaggtattattttttaaaatatgttttatagctatagttctgtttctcctatgaaatgctggtatgtactattatttaagtatctttacttaggatataaataagcatcagtaatggtaaatgtgcatgtaagaatgcctacctaaaaaatatctgtgtcatttgtccaaagctgaatattaatacttcagtatttcatatcaaaaaagaacagtatagaaatcattccttcagattccatttttgcaagtacacttcagaaattgtgaatacaaatgaccgtgagtgaaagccattagagaatgtggtgatagttaaagtagttcatgctgacttaggggaaaaaaaatcacactaagttaaatttgaggcttaaagtttaaggattgaagtctagctatttatagtacttcacaggtggtctcagttttataaagtagctaaataatggacttctagtcatattttcctaatgctctttttcatac

SEQ ID NO: 42252 - DNA, 2892 bp, Bovine  19866880824463
tttttaattgcagttgatttcccatgtaatgaaaaatcatgacaaatgcatcctttaatttcagaactcctctcaaaccctaaaagacatattgtggttcaatattctaggaagaataagtgaatacaactagagattctgacaatatgcttcttgacaagagttttttcacactggttcaacatagcaaaacacatctccaaagtgggctaaaagctctgttactcacaacaaaacctattaactgatagagttgtccatttttcatttgtgagccttagaattaaatcttgattagtctaaattaatcattggcttatacctgccttggcagtgattgatttaatagttgtcaagggacccagttcctgaagaaccaatgcaggagacacctagaaaatgtctccttctctaatagatatatgggaagagatggccaccttatccatcagactttgacatatctgcacatgatgcctgaggcttcatttacaaccaagaagggagttggcctccaagtaaaagctgacattctagaatagtgtaatggaaagaacttgagtttctgataagatgattcatacactgataacttctcttaactatggactccttgttatgtaagataatacatacctttaatgcttgagcagggtgagatgagctttctactaattctagctgaaagcaacctaagtgaaacagaaatttcttgcttatttaatactgtgccagctggggaacggtcgttaaatcaccaaaatgtgcaagcattaccctctaagtcttgaatcatctagagatgattataatgattataaaatagactgagtgtaatacatttctcactagtaacctaattaggaagagtcattccttcaatatcaaaagggagttttgtgtcactatcagatttgtctgttggtgaccttttttaaaaaaagatttcccacagaggaatgtgactcaattaaaataattccttttggcatatataatattcaataatgattacaggcttgtacttttatgtttattcttcattccattcagagtatcttacttgagatgccagagtagtaggtttacatttgaaaagtaatatggtgacaatgtatgttttatcaatcacccattctaaaggaaatcaaccctgaatattcattggaaggactgatgctgaagctgaagctccaatactttggccacctgatgcgaaaggtccaatcattggaaaataccatgatgctgagaaccatcgaaggcaaaagaagggagtggcagaggacaagatggttagataggatcactgactcaatggacgtgaatttgagcaagctctgggagatagtgaaggatggggaagcctggtgttctgtagtctatggggtcgtaaagagtcaggcatgacttaacagactgaacaataacaacacatgcatagcaagtcacaagttgagctttcttaaaacactagtctagaaatgccttattttagattaaggactgaattactcatcttcctcatccagttttacataattaagtcatgttggaatggacgtggtaaccttggccaagtagcttgggggttaatagaagcaggaagacttttagtttcactgagaggaatttgtgcaccaggagatggggtaagtcctggcaaaacttagagactaaaactttaaacgtttgccatagattctcttgaccccaaagacttttctgtggtagttactgcagaaaagttcacgtgactctctgcacgtgaagcatttgagctctctgtgagtttttttaaagttgtttttcatagatacactttttcctccagtgttttttatagctgctcacatgctgtgtccattgtgtacatccaaacaggaactgttgcttcaattcctcacagtttgaagcattttttatgttgttagttccctgcagtgatttgtttctaattctcacgaatatccattttcaggctcatcttttgaagcactcctgtattccacaaaagacagagtgagacatggggacaactgaggccctggacccatacatatcacccaggaacagcactgccaaccaacgtgggcagctttcaccaaggatgcaaattcatagagtcaaggaatttcagcactagaaggggactctcaggccaggtttgattctgtgcatgccacagactaagtggaacctaacatccagtgagatcacaaaaagattaatagaacatcactatgacaacctaaggcagagcacaggctaaatgctagactctgataatgtggtgggccagacttttcttttcccttctcctttagtccttattccctatcacccactcctatataaggacagtgctctgggtaaggcagaatagagagacaaaggctttactgcaaaataatgcatcagttatgttgtgaaaggatagcagtattaagaaagggaagatttgtttgtcaaacagcctaaagtgatagatgatatttactattgcagttccccacctcaccttaaataaaagtccctcagctgtgtccagctctttgcaacacagtggactggagcctgccaggctcctctagccatggaattctccaggccagaatactggagtgggtagccattcccttctccaggggatcttcccaacccagggatcgaacccaggtctcccacattgttcatttcagttcagttcagtcgctcagtcctgtctgactctttgccacctaatggactgtggcaagccaggcctccctgtccatcaccaactcccagagcttgctcaaactcatatacatcacgttggtgatgccatccaatcacctcatcccctgtcaacccttttctcctgtcttcattcttttccagcatcagggt

SEQ ID NO: 42253 - DNA, 1910 bp, Bovine  19866880905079
tgatgattggttttgacttctggagctgaatagctcatttatggacagatgaccaaggactttttcttatagcttatagcctgtagccaggtatacccatgcagaccactgggcagttctcgatactccccacccccaacagaaattatgggtcattgtggatgctagtcacaaaattcctttgccttttattgccatatagcataatggcactcacccttgtcgaaccagtttcttgtatctttccagttaccatcatcacgcctttggtcactcctcatttggtgagagctctacactaacagcgtaaaatggaactggattctgaatcagccttccaatgatacggtagcaaccagtctcaaaacacaaagtaggaaagatacttctggtagcatttgccattttgatagcattatgatccttattttataaaattctcaaacttaggattcagctggtcaaactgttattttttaaccttaaaatatgtcctaatactgcaacctctgctttacacataggcctatttccataattagatcatgagttaaattttcattatatcagttatttataaattatataggctaaagtgtgactaatgaccctaattattaaatgaagaaatatgttggcaatcaagtcatttaacagtgcccaagtaggcaatcatttggtagaaaagtcttaactagcttaacaactatataaaataacacatcacatatttttgcaaaatgacttaagtgttaaaaatcaaggttagaactcagagtgttctcttttgtcatgaatacatttcaatttttacagcagaaacaagagactgcttttattatactatttatggtaactaattatctctttataaaaggaggtttcatatataacctatttttggaaaagcagttaagaagctattttggctttcagtgtccagagattttgctccttaattttataccatagttatatattgtaatcagagtaagttttttgtacatgggttttattcagaggagttactgtaattcagagaggcagtcaccaatatgaatatagctctagattggtcaattatttcttatactagttccaggaattgattggaatagaggcttgtggtggcagggctggctggcgcaacttggggacagtaacttcatgaatctaggggaaaattttttggtatgtgcacatttgctgttacttggttttgtagccaaacattgcttcttggatttcttatcttatcagtgaaaccaaagatattccagatttcattagtgctgtcagatctatgattatagatcattctagtaatctcaatcctggtattagcctcagctaaataaattcttcttgaatgtgttattgtcagtcttaggagaagttacattagagttagtaattaaggtattagtccctgcttaaccaatttagggaaaaggaacttggctttctgagtattaagttgattgttcatagaatcttgactcaactgaaattttgacatgtaaatataagttgaaattttaactggagaattgaaatactcttttacactactatacaaattctccctctttattaaaaaatacagtgttatataactggctttattaacagacatagtagttatataaaaatttttatgagcaatatcatgtaatcaacggcagagacagtgaaacaaaagttcctataaggcatcatcaataaaataagcaaacaaaagaaccaaaagtgtttatcaatgtttcctggtgaaggacacaatgtaatacctgtaaacagagtcaggccttctaggttatttataaagcctgtttgggattgtgataaagatacttttcaatttctggatcctaaatctctcaaggacttgtccttttaaatcatataca

SEQ ID NO: 42254 - DNA, 876 bp, Bovine  19866880919959
ctaaaatattgcagaattggtaagatcttaataaaagcatattattcctaagagaaaaagctttatgtgcataactctctggtggaactgttgtttttttttgaatgaaaatgctcacgttatccaataatgtgacatatctcttctaggctaatagagaccctgacgctagaattgatgaagcacaggttgaacaagatgctcaggtaagtgggacttaggtgatgactttactatgacagaaatgaaaagaaaaccatgctaatggaaaaccatgacatcttataatagcatctaaaagtaacctaatgggttatttacaaatcacaagacacatgtaagtcaatgtcgctcattttgatctggacaacaagatattttatcccaaagctgaaacagaaaaaaataaattgcatataaatattgaattccacctggatgtgttacttttctttagattatggaacacaccccaaatagagaattttacaggaaaaccaggtgttatgaatgctactggcaatgtggcagtcagtttcttggcaggaaaagacaaagaaaaaataaagtattttagtaatacatggtgttttattacataagaaatgacacattattgtagtatttgaagattccatctccttttccttgatagaattataaatagaattgtccttttgtcagttgctcttcagcaactccctaatgacatttttgtagctaagttgcttttaaatcccattatagtctgaatgtggtttgtaaagtagtcaaatgtaggaaataagtgttgcgaaatttgaaacatgagacctgaaaactggaaaatgttaacaaaggaattaccttgggttcccagaggcagataccctagtc

SEQ ID NO: 42255 - DNA, 1306 bp, Bovine  19866880955804
tctcctctgacctgggattctccagcaagaatgctggagtggattggcatttcctcttccaggtgatctcccatcccagggactgaacccatgtctcccacactggcaggcaaattctttaccactgagccacccagggatcccttattacctatattaacccctgttaaacagtataaggagaacattttattctcattttatggttcaggaaactgaggctgatatgattaggcaaatttcactatgatgtgaaaatggaagggaaggataggagaaatgaaaggaatgaaggtgaggacaggcagtagaagatgagagaaggcaagaaaggggagatggggagagaattacaggaagctaagagcagcctggggaaatggagaagcacaagggaacatgggttaagttccccataactcctgagccttcttcctgctcagcacccacccacccacaatatgagacaagacctcatcttaacatctccttgatttcctgtcccctgaagccttcactaattttaccaaaatacatgctttcttaaaatgctatcgatttgtacatttgaaattatttccaaatgcagagttaaaaataatagacaactttagtcaagaagagcattgtttgtaaggaattcccaaccccctggaacttgtgagttcctgtaattataggcagagctggccttccttgccttctgtccctgcctcaggtggtcccctggttatcacagaactaactgtcattccacctggacagaacgttcctgtactgcactcagggctcctgagctttctctccacattatcaccctcccctattaaaaccagcacctgtgcatttcaaacccagaagactctcctctctcacagaagactaatgtaaaccggttctttttattctgggtttttaaagttaattttttctggactatagctgctttacaatgttgtgttagcttccactgcatagcaaaatgaatcaacgatacatatatatatatccatgtgacccagaaatcccagagaaaaccataattcaaaaagacaacatgcatcccagtgttcatagcagcactatttacaatagccagaaagaaagaaagtgcagtagctcagtcatgttcgactctttgcgaccccgtggactgtagcccactaggctcctctgtccataggattctccaggcaagaatacaggagtgggtttccatttccttttccaggggatcttcccaacccagggatcaaaccccagtctcccgcattgcaggcagatgctttatcctctgagccaccag

SEQ ID NO: 42256 - DNA, 1554 bp, Bovine  19866881017308
tggcatactatctaggatattttttttcccttagctgacctaataacaagcattttcaaacaactattaatgattccattttagcagtaatactatttaagttgctccattttggcttcccagatggtccagtgctaaagaacccacctgccaatgcaggagaagcaggttcaactcctggatcgggaaaattccctgaaggagaaaatggcaacccactccagtattctggagaaacactggaaaaatccaatggacagaggaggactggcaggctatagttccatggggttgcaaagagtcagacatgactgaccacacatgcacaccaatcaatttagaccagtgtttaaagaaattcaagcacctgtgaataaataaacagcctttaaggtgtacacatttatgctaaaatggtcttggtactgaaatagttctttcactaaacaaaaaatgtagagcccagaaactaattacttctttttctaagtgaaaactgtatccacaaaattaaaaggttctgctgctgctgctgctaagtcacttcagtcgtgtccgactctgtgcgaccccatagacagcagcccaccaggctcccccgtcccagggattctccaggcaagaacgctgggagtgggttgccatttcccttctctgatgcatgaaagtgaaaagtgaaagcgaagtcgctcagtcatgtccgactcttagctattacccatcaaatattaactatagcagaatttacttactgtgctaacattgacctttatgacaggaataagtgatctccatgaagatgtggggtcttgagattctgtttttactttaactctgaaatgaaaaaacaaaaattgacatatatgagaaaatgagaataagtacctaagaatactgttgacttcctcacaatacacatcattaatattagctgtacctttacaaatatagctaaagactattgagtaacaaaaggactatctaatggaaaactaatatccctaaaatgtctcataaaatgtactcttaccacatatcaatttttacataagaagttgtaacagaaaagaatatttttagaatgacaaacttcaatgacaaaagtctaaattttaatttgctgtcattatatctaccattatgtccatgacacaaaaatgtaacattttacaaaagagcaaaaattataattaaaacaaaaatgatcaaggtacatgtcatttagatgttttaagtgcttcaagtacttctaacagttcagctgatccttttccttccctactcccaccacttggtgacaaaataattttcttttaataaaatgaaaaaggatagaccaagagtaaaaaaaaaaaaaggaaattcagttcagttcagttcagtcagtcatgtccaactctttgtgaccccatggaccacagcacgccaggcctccctgtccatcaccaactcctggagtttactcaaactcatgtccactgagtcagtgatgccatccaaccatctcatcctctggcatccccttctcctcctgccttcaatctttcccagaat

SEQ ID NO: 42257 - DNA, 2036 bp, Bovine  19866881100670
ttgtttccctccttgagggcaagaatcttcctttattgcttttagtacttcttaaatttaattaaatatttaagtaactataaagagtatgtactgctgttcttagttgctctattatgttcgagtctttgcgaccccatggactgtagcctatcaggctcctcttctcctggggattctccaaggcaagaatactggagtgggttgtcatgccctcctccaatggatcttcccaacccagggactgaacacagggtctcctgcattggaggcgggtttttaccttctaagccaccagagaaaaatgtttgttattactctgcagaggactctggataagctgaaagtattttctatattgtaggtacatgatatcatcattatactttgcattttttcatttatctccttttggtactttgaaaattaaaccagacacattaaatggaaattttaaactttttaaattatatatctcacatttgacatattttcctttccacaagaacactgagctactgcttatgactctctcaactgcaatattatcaaaggtaaatgggacgatttcaactacatggtaaacttaaacctttgagatatttttaaccatcctttgaaaaataggatttactaaaactttacatgcaccccttagacagttaagtaaaataacatgatagctcaatacctgttgggagactattgtgtcctgattttgtgacaggagactcctgtaccacacttcctcggttacccacagcatttgacatccagttatagaaactcacagatgatggctcagataacaaggggtgttcagataacatatcagaggccattgtgtttcctgaaaataaagttttactgagtatagcattacttatgtactaaggagcagaaaatgtgatttatgtaatcatttttaaaaactcaggttaaattatcttccttttgcatatgtctttaaaactcactacatactctttgcatttggatattaaggcattaataaataatttacttagactataatgagaatattcactcttggctggtctagacagcattacacaccatgcctaggttgagagtaacagcaaatgctacaatttaaaaatgcaaactaagagacacccaacaaattaaacagaagagcttcccaaaaaacattctcagagataagttgtcatacaaaagactaggtatgcatccaaaatatatatctgaataaacataagtcccatttttttttgttttgtttaaatctcccacagaagtaaactgataattgtcagaactaaggatatacctgttctcgtcagggagctacttttcactgctgcactacttctctgaggggtcccttccagaaggttgtgcaagcttggaaaacttccagtcaggtagctgagtaggctttccttccttggactctccttaactggtactcctgcacgtcccacatgcactggagaatctgtggcagtgtcaccactggtatagctcagagaatggtacggatgaatgccctacagagagaacaacatggggctctttcttatgcacataaaaaagactatggataaccacaatgactcactgtttttattactatattattcacattaatacaacagtgtctaaacagtttgtgtctactagaattgcagtgaatctcaaatgtatgtaataatgttttaaaactctacagtacaatgcaaaggacaatatttagtatcattcacttaattttaacaatgattaacctccctttgcgggagaaggcaatggcaccccactccagtactcttgcctggaaaatcccacggatggaggagcctggtgggctgcagtccatggggtcgctaagagttggacacgactgagcgacttcactttcacttttcactttcctgctgggaaaaaaggaaaatggcaacccactccagtgttcttgcctggagaatcccagggacgggggagcctggtgggctgctgtctatggggtcacacagagtcggacacgactgaag

SEQ ID NO: 42258 - DNA, 1526 bp, Bovine  19866881118922
tagctgcttattgataggggaaatagggaatgtgacacgtggcagttagcagcctactactgattctattactgctatagtcagagaaaccagctgatgtgtcagacatgttaaaaagtgaaagtttgccacagtgtacatttgctgtagctttctccccaagcttctataatgatgcttgttacacaataataaggacaaggcaggggcttaggaattcaattttctacagggtcctgtcaattcagccatacactgacctattctctaatggaaatagccggagaaatacaaatatcaagactctgagaacatcaaaaggccttgctggaaaagcccccacacagaaaaaaagtgtgggtgtgaatccttccactctggaagggtaaaagcctgagctgatgatgctggaagacacactcaaagtctttaaagaagtgaaacaagtataacagagttgacacacagattactaaatagcctttcccttagaactaatgctaaatttgtggttttgatatgaaaggtacagagagacattacgcagtttttagtaaaaaagaataaaataaaataaggaaaagagcatgatcatttgtctctaatcttttctaaaagaaaaagttatttgcctataatctggttttttctttactttttttcctccttaggaactgtaatgcttgtttttacattttaggaagatgtttcatattcttcagaatattgtctaatgcatatctaaaaagtactgaaccatttttctctgttctttttaagtacaactgtgttccttagaatgtataacctggacttccctggttgtccagtggttaagactctgtacttccagtaagggaggcactggtttattccattatcagggaactaagatgccacatgccctgtggtgtgaccaacaaaaaaaagtaaaaattatgctcacagaatgtataacctttcctgcctacctaccctcaacttaatcttaaatttaaatatctacattttaaccatgttgtcaaaactcagtttaaagtcatgtttcttcttcaaaattgtttatatccacctttctcaaggcagtaatcatcttttacctggcattatacttgtctacctatgaattttctactgcacgtttcctttgagaaagaatataaatgataagagtgtggagtttggagtaagaatattctgatttcaaatccttgttctgtctcaaactggaagtaagggctaaataacttagaacaaattatttaacttctctgacgttcaattttctacctacaaaatggtaccatcacttcacaggtaaggcttaaacgaaatcatgtgtctatgcatactttttttctttctatatacctgacagtatcataggagttagagaagtgtctacagaatagacaaaaataaataaggtagtaaaaatggggaagttgtaagacatggcttggaaaagtatttcctcaaattttcccagtttaaattagaagtatatatctataccatcattcagg

SEQ ID NO: 42259 - DNA, 2302 bp, Bovine  19866881143794
ctatatgtaaaaaatacccatccaatttctttatataaaaagagaacttaatccatgacatacgggtgaagaaaactcccttgatttccaattcagaatctgttttgatgttgcaaaaaagtgaaatatctggttatttcattttatcttatggaaacactaagagaattttttttaagaaatcactttgaagtggcattaaaaatattactatttcattgtgaacttgaagtatgggcattgttatctcaagaggtaaacatttttcttgtaaatgttatttctgatacccatggagttttttctttagaataccattgtcacagttttgaagcacactgagaagttgggatctgatttagaaaaagtatctttgctataatggaaaatgtgatagtggttattaacctgagtaagtagtttagaattttattttagctaaatattttcaataacgtggaaaattggaggcccaagtttgtgcattttgctgtagtattattacatactctccagatccagggaaaatctagtttgtaagttttctgtagtaccagtttttatatgggtttggagtgaacctctgtctgctgtttgttccaagtatatggtcttgagctgaagtttttgtgctgtctgtcttctgaaaaataagctcaatgtgtgcacgaaccagcagtaacagtagcctttcatttcaatctgtagttaatgaattttagtagaagtcttttagatggtccattcaaaatagaatgcacagaaaagttatgacagttttagttaccagtagctgtttttcttaagtattggaaaagagaaaatacagcctccaatcagcgatttgttatttttgtgtattaagtgttcctgttctttttttggccataccatgcagcttatgggatcttaggttccccaaccagggactgaaccccaagcctttggcagtgagagcacagggtcttaaccactggaccactggggaattccctgtttttgaatattaaggaactttatgtgatagtttctgaagctagtggacttgcgttctgaggagtcctaacataacagtagatgtgtacacgttcagggaaggtgctcttctgtttgtctgggtgtttctaccaaaatgggcaagtctcacacggctctgtgtgaatcatggatgttatagaatacagagggaatacctagattaagattacaggcagatagtctgaggttggcagattacatagggtcatggtgtacattgtttgcttgaatatattgaaatgaaaactcctaggagatctgtataattcgtggggatgaagaaggttgtggcttaacggcgcaggctgccaaaacttcggcagaaaggtggtcatagcagaaagggggtgacagccgtgcagcagcccctgtgccgcgtgcctttctgtgtagacttcagaactctgaggagaactcaggccaccgtctgtggagatgctctgtgaaatcagagcagcttgtgaatgagcagctctttgacctgcgttactttcatacttgtgtttaagaagagccataggcatggggcacctttgattttaattacttaatccttttcacatgagaatagcatgtgaccattatatttattttcttagtgaaatccattcgcagtatacctgcctaccttgcagaaaccctctactatgctatgaaggtaagtgcatgccttgaatcttctatctaaattatctctgtaatatgttctagagaacagaccttgaggtttgttttcccctccttaaaacaggtggttgaattctactacttgctttactttattgactcacccaactcaggagagtttgatgctataattgatatttttaaacaatgtgtgtctctctttttctttttcaaagggagctggaacagatgatcataccctcatcagagttgtggtttccagaagtgagattgatctgtataacatcaggaaggagtttaggaagaattttggcacctctctttattccatgattaaggtagtaaaacctttctttaaattatgtttggaaatcctcagcaggacaataaataacgtggaagatatggatgggagaacccgattcttctgtcaactttaaaattctagtgttgtgattagagctctgaggtacagaatttggcatagtgtctcctgaagtgcagatgctggctcccgggtgaagggttggctcctggtgaggctgaggctccaggtgagcttaggagcgttatttagtagtggtgacagatgactcactaaatccagtcttgtcca

SEQ ID NO: 42260 - DNA, 1174 bp, Bovine  19866881189975
atattcttcctgtttaatcaacaaatctaaaaatttattcttttcaactatttactcttgttcttgtccacccacaacatggtgctccacatgttccgcacagttttatgacaaagagaaatttttcatgagccatttttgtatccccacccccttaaagaaagagggaggaaaaactgtttcatacagaaggcgttagttgtatgaattagaactgccacctaagtgtgggctaatgtaaccaagagggatttcacctaaatccattcagtcagtttatgggggtttaaagaaattccaaagagtcatcagaagaggaaaaataaaggtaatgctttttgccacacaggtagaatctttgaaagtatgtgtaatatgtaaaacattttgacacccccatcatatttttccagaattaaaagtataaattgcttctcttgttctagaacttcctatctgcttctctaatcactactcacagtaacctcaactcctgccacaatgtacaagatacaactcttgtcttgcattgcactaactcttgcactcgttgcaaacggtgcacctacttcaagctctacggggaacacaatgaaagaagtgaagtcattgctgctggatttacagttgcttttggagaaagttaaagtaagtttattttctttcttactcaaattattacagttaatttttctaactagagtctgctttttaaataacaacctgttatgctttctcagaatcctgagaacctcaagctctccaggatgcatacatttgacttttacgtgcccaaggttaacgtaagtacaactttctatgttcaattttaagaaaactgaaagtaatgtgaaaatttacacactaactggattaatagcacttcatctgaggagaagaaatagtaacttcagtatctttttaaaaagaatctcaagtttgataatgggtttctgaaaaatggctttgcagttttttaaaaatatatacttatgtatattttggggtagaggaaatgggaaaaaaggaataatattcgcactttattgctgcatatttaatttaaatatttaatttaatatttaaaaagattgtgttgacttacttttttatttaaaaatataaaactctggagatacttgagcatatcactttaccattcaaattagcaaaa

SEQ ID NO: 42261 - DNA, 1661 bp, Bovine  19866881270808
tgtccttaaatatttattgagtacctcctttttgccagtcctgtactagtgagaagagacagaaaataaacctttaagagaagaaataatattaactactaaaaatatgaagaaagtgaaataggctaatgtgatagtgagtgactaacaagagagggaagagtttgagttggcagagaaggatcagtcacttcaacaaggtaagccttgagcagaaagctaattggtgagaaggaagcagatatgtcaagatctaggagaagactgtttgtagaacacagatcagcaaaaacaaaagcctatttctgcctatttttaaacatgaggagtggaaaggaggctcagatatatcaggggtgttggaattaccagaccaggaatttaaaacaactatgactgatttgctttgggatctaatgggaaaagtagacaacatgcaagaacagatgggtaatgtatgcaaagagagagaaattcttaaaaaaaaaaaaaaaaaaagaatcaaaaagaaatgccagagatcaaaaacagtgtgacagaaatgaaagcctttgatgcgctcattagtggactggacatggctgaagaaatcctttctgagcttaaggctatatcaatagaaacttccaaaactgaaaaggaaagaggaaaaaaaattgaaaacaagcagaacagaatatccaagaactgtgggacaactgcaaagtgtacctacccatagtgtaattggaataccaaaagcagaagagaaacaggaacagaagaaatatctgaagcaatcatgactgagaatttccccaaattaatgtcagacatcaaaccacagatccagggagttaacaagatggatggccaaaaaaaaaaaaaaaagaagaaggaatgatagaattctttaaaagaatggtaaacaaaaagtccatatctgatatatttgttttaaaaagttttatatcctgaagcaaaatccacttatttcaaaagtgatagtctctttttctgtcaaaatgtaaaattgcacaaacaagggaaaaaagcatcttacttcttttcggctcaatcagggaaagacatacaaagtccagtcttaatcaaagtaacagtcttactatatttatattttgtggtcaatacaagaaacataatggggactctgaaccagaaccaggggtgtgagtgattcacttgttcctaccaagaatgcagtgcattgatcagactgatggtgactatgggtggcaggcagcaagtgtgcctgaggcagggcacagaggaggcagaggtcccccaggcactgagaaaaccagattcaatcagattgaagcttcagcaggaggtgagcccactctctgggaaatgccttctgccctaggggcatcaaaggagaggatgaaagtggagaacctgagttacacctgagcgggctaaagagctggctaaactaacgcaaccccatcaaagactaagtacatgcctcagtgattcctaattgcaggtgactggtaaatttttaacagtttaacaactttaaattggatttgaacattaaaaaaattaatttttaggtaagaatataaataaagcaatattattcggttataactatatattccatcacagttaggaaagcttatggtatgcaagtaataatgacaggaaattct

SEQ ID NO: 42262 - DNA, 1441 bp, Bovine  19866881353178
tttggccaatgagatgtgagcaaaagttgttggacttctgagaaagctctttaagaagaggtagcctcactctggcatgccctgttttcctcttgggcttcctccgtcttcttgctgggaaccgaaacaaccaccttggaacctagggggaaagccatgggaacctcagggccactctgaccctgatgtctgtgagctgctgaagcaggcagtaccagcagtagctgagcccccaacctccatgctacatgagaacaaaaagaaacccctatcaaaaagaaaattttcatctgaaagtaaaaaatatcttgcctgaagaatatgtgcatattcagtaagtttaagtaacttcacagaatcatattaggagagggcaatggcaactcgctccagtactcttgcctggagaatcccatggacaggggagcctggtgggctgcagtccatggggtcgtgaagagttggacacgactgggtgacttcactttcaattttcactttcatgcattggagaaggaaatggcaacccactccagtgttcttgcctggagaatcccagggacaggggagcctggtgggctgccgtctatggggtcacacagagtcggacacgactgaagcgacttagcagcagcagagtcatattaatagaacaaaagtttatttgaacccaccaaatcctcaacagaccagaggtggaggaaatgagcaggtttattgtgtaaaatagctgctattaaggaaaataagaggatttttagattgatccatcaggaagtgtttttttgagtgcattatgttgtgattactcttctgaacacaggtctacccttctgcttatcctaattcttatatggtaagatgctaactactcaatacttaaccagatcattatttcatatataactttattttgtatagacaaagtaaaaaatgaagaatttatcattgatttccttaattcaaacccccccaaaagaaatatcaatatcaacaacctacaactcaatttttaattctcccttgtatgtaacatagacatctgacagcaatttcctaatggtttcagagttttaattaattgtggatttagcttaaataagcacaggtaccttagaggagttacaaacattaaaaacagagtacagtattctggaagtactttcttcatattacatcagtatacccttagtattctgcaagtccctatattagtaggtatggattagggaaaaaaaaaagcatttaccactatcctaaatggttttaccattgacaatgttcagaattttggccattaaaaatgtttgactctattgcacttattttgaaactataggcaaaattggaaacatgaaatgtcaagctaaaaatgggatattgcattttttttttttactcacctagttaccaagtttccacccctgcaaggaaccaaaaa

SEQ ID NO: 42263 - DNA, 1886 bp, Bovine  19866881430943
tatatacacacatacacgcacatatacacatacacatacatacacatactcagttacacacacaaatacatttgcacgtctggtcacaatttgacgtgtattatattttatcctgagcatctgatagcaggagatctgcttagtgtccagattctatctagaatgaatttaaactaggaagattgtttcttcatggaataatgggaatacacagctgatagaggttaagaaggattactaaagcttaatatataaatacattataattaagtggtagttttgggtacaagtctagatgaatttgtctaatattgatgactgatatttcctgattgttgagaataaatatctttggttagatttaagactaattatgtccctcttattttgagccagagtttagtaattgaacttggatctctattcatacttagattggtgaatcaggactttaaaaatatgatacattgtcttatattttatgtagaaatgtggacatctttgttattactgtttgttatagttttacattcctctctttgaagaaagcagaatatgatttagtaaactttcacatttattaaattcacctttcttccccttacataggttaaattctaaatttaacttttgaactcttttaggccttttagatgctattctggaaaaattttagtaatggatcaaagaaagaatgagagtattgttcctagtatcactcaactagaagattttcttacagaacacaattccaacgttgtttggctccttgttggtaagtagaatatattttcttgtactttattttgtgtatgaattaacagctgccagattttaagctgtagttcactgaggttagagtgcttacaataccatttgtttgtgtttttggagacaagtattttaatctgtgtttctatgaatatttgctctggaaactgctcttgagggctgttttccttaggctgcttccttgtctgtgttaggggaagtgggatgataagagacctagcttttctttactgtttcagatcagctcttccatttcccatcccaacatacacgcaaacacttttgttttattataaagtgataaatcctcatggtaaatgtttttgcctaattaaatgttatctctttcctcactccttatgtacctgacagtggaattttccagtaatgatttttttgtcttatattccagaacttttctaggtatacacaaataatacaaagcagtgtataattaaattgcagagagagggaagacgtatgagtgagtgaatgaatatgaacagataaggagaaatacatcaagtactgagaaagggagcaattactgtaggttgttactgtccaggatgtttcatagaagaacgctatttgatttgaattttagcataggaattagaaaagtgcagagaggaaaatagaaagggtaagatggagtgagagaggaaagggaggtgatggaaatatttattaaacatctgtgtaccatgtgccacaggcattttgcgtatgttgtctcagtaatgttcacagcagacttatgaaggtagctgatattttcctattaacctattggggaattgagacccataaaaagtaaataacttacacaggttacacaactgttctttttcttgagtgtaggcttgtgcttctttcatgatgctgtgtgatagggttacagtagaggagaactgtatataaagggaattataataatttatggtttgtaggtaggattggcttaccatttaaactttgttttttctcccctaattgatgaacatgaactattctaaattatcataatgaaaacttaaaagtaaaatgaagtgcaaaacaatactatgaaatataatttcataaaaacagca

SEQ ID NO: 42264 - DNA, 992 bp, Bovine  19866881463763
tttttatctgacttggtaaatttggatggctctttataagtacagcatgaaatctgatttatgagaaaatatgttaacaatgcaaaacatttaagggaaaaaaatgtctgggaagaggaaaaaataaaggcagagaacttgaggcagaggtaaattctattcgtttgaggagcagaaggaagaccagtgtggctaaatatggcatgaaatgaagtcagaggtaggctatggccaagtcatgtaggtccttgggagccttggtaaagggtttgaattttagtctaggtgcagtggggagtcattggaaaactgtaagtggtaatatgatgtgatctaatttaccaaaactaaaacaaaaacactccgtagagagtggatttgccaggaaacaggttgaaattaaggacagggaattgaattaggaagttattgccatagttgtaatttactgttttttttttttttctctactctgatatatagattttttttcattcatagtatatttgactgcaatatcagtattattgctaatttatcacttacctttttttaaaggtattttgtgtgttgacagctttgacattgtgggtgatggggttaaagatttacttgttggaagagatgatggaatggtggaagtatatagttttgataatgccaatgaacctgttctacgatttgatcatgtaagttcatttttaagaagactatatatgtttatcattcatcaaacaattatagaaatggctgacagtctgtgttttattaaatgattatgttaaaatcttgtgtttggcttaaaatattgctgctttgatattatcaaaatcttgtctagactgctcttatatttgaatgatagatattgccctcaagctgaacaatgaattactttttcatttgatttctaaatattctatatctaaattattaaatattttaccttagtttctataatgcataatatattataggagtaacatttatat

SEQ ID NO: 42265 - DNA, 1599 bp, Bovine  19866881471318
ttggagaggaagacttctgaatatacaccttttatattgctgttggagtgaaaaaaaggtttcattttaaaatatcattaaatgagtatgcttctcctgtatcataagattttggtgataagcagagccaagttgctgaatacttctcattcatatttttagtatacactatacatttttactaacaccaaaaactaatttttatgccacacaatggtttttgcaaatttaaatgaaatatatgctagcaggcaattgtaataatttgtaccttcacacattgtggttagataaaagaatataaccagtagttcattcttctttccctcagaatttcattttatgattttatatatgaagttctttaactctttttgatgtgactttacctgtttttgctaagaaagcattgacaatattaacaaagaaaaattcaagtttgacaaatataaataaaaacttgtaaatggcctgagattagctgtattaactaagactaataatgttaaaatttttatcatttgtttgcctttttaatatattaagcaggtaagaaaagaatttctatgaaagtatatttatatgtttcatatatgtgcaatgcatgagagcaaaattgtgtcattacttttttcctctgaagatatcatggactgcaaaccatttgataagactacttagcagccatcatggaacatcaggaactttcagtggcttagtaaacaagtaaactttgagaaatactctaaagtgattctgcaacctctcattctctagaataatgattcttccctagggatacacaagcatatatatatatatatacacacaaagcaataggtggccaaggtcctatctcagaacctcaaaactttcatattttttaaaaagtccatgggtaagttttgatatatattcttggttataattctgtagtaatcctaattactttaagctacctttatctcctttcaaagtctgggttttttcttttttttttttgtaggaacatggaacaatatcaagagtttaagtgtttagtgctatttagtggttctcagtggggcaaatactaaggagtatattttgattatcacagtgattagggaagactattggttttcactgagatcgtgcttgtcagacaatgtgggacagtcccttataacagagaattgtcttgtgtcctgtataacgtttcaatattttatcaaatacaaatcagtaatcttataatttgtaatacttgcgcttctttttttaaacaaaaatctatccaacagctcaataacttgtatgcttttagaatggaatgctttaaaatctcaagtcatgacataaattataaatttgcttacatacctctgaaaattaactcattcagttgaaaggttattctggcctctggaataaagcacagtgttcttcaaattcatgttgcatttgatttttttttctagaagggagacatattcagtttgcaaagatttcacagattgttaaagaaacatttagtcaactaatttctagtcaatcagactatctgaaatgtagcaactcattagctgcttttataatgaaagaggtaagtggagtatt

SEQ ID NO: 42266 - DNA, 1210 bp, Bovine  19866881540080
tagagacttttttgaaaagcagagagttgggattgggaaaagatggaagaataattgtaaatgtatataattatagaattataattatgcgattatagaattcatttttatttgtcaattttagtttagactataagaatatctctgtagaaaggcaataatggcatacagaactaagcctgaattattttttctaaagcttattttaataaatttcaggctatgtcagttttctcagcatcgatggagtagagacttaggacatgcccttagaagagaacatgatatacagcagatgctcagttattatcagttgaattaatgattaaatgaataaacatgaatctattgagcaggtacaaaggttaagattcacctattgagaaggaggtcattcctaagagatcacgtgatacaaattgtaggaaagttgtgagacatcatcattctattttattgatctgaaaagtggcagaaaagatcaaggggagaaaataagtagaaaatgatttccagcctgatctcataaaatgcaaaacagtgagatgaaatctttcccctttgctgtatcataaagcaatgatgacctgcttaggtaatctaccaaggaaatgtttatgtatatatcccttagctatgcttttaatgcttagaatagcaaagaaaaaataccattcattattggaaaaaaatctcacgaataagtaatcaggcatatccaggagaagtcgggagtggtgcaagactgttcttgctttctttccttcaatcccacagccacttccaacacgccaactatgagcaggagttgccctcttttttctgcctttgacaccagccctgcttgttttcagccactggtcccatgcctgcctctgtcccttcatacacaggcgctcatggagatctgcttcttcatctctcaggctttgatttgagctgtcagtttttcagttcatttcagtttttccctggaagcaactggaatgagggcgcttcagatgtggcaggtagaagaaaagaataaataaaaaagacagcttcctggtccaacttcagggacatatacaagggaacaagctgcccctgctaagacagactgtctctcagtgtacatcctggtgttcactggggttgatgggagtctttgtgttcctttgattaatcaagtcctgctaatactgctcaatttttaacatactgtatcata

SEQ ID NO: 42267 - DNA, 1283 bp, Bovine  19866881796065
ccttcaacaaaaatctgagttctcttcataaggaagaaggtaacagtgtatcttgggtgaacaacttgtagtctgtgccccaaatacaaaatacagtggtaaagaagcataacgctcgagacagttcagaacggcagctccttcacaacagcagcacgccaagcagactgctgtgatccgagagtgactagagtgaagacaggccaggttttctcatgaaacacttaccaggactgactgctgtctcagccgatacacctgtccccatcaggcttctctagacgaggaccctgggaacgcttggactttctcggaagatgtgcttgcttcttggaggcttgaaacgagatgaggaatgttttaccttgctgcttccacatctgcgttatcttttctctcattttcctaaaaaaaatttggtgtagtctagttgtgtatttgatccccataaaaggatcgttcttttcttgtacaggggagggaaatctatgtaaagaaaggctactttactcccttctgtgtctccaccacctcatctaggaatatcatggaagaattgcctctcggagctgcctccataaacagcctacatcctggctaagcaaagagagaagaaacacttcccacatccagggctgtccaaaagaactttctgtgatgacagaaatgttccatatttgcagtgtctgatacagtagccactagccacatggctagtgaacaattgaaatgttgctactgtgattgaggaagtaaattttaatgttatttaattttaaatactttaaatgtaaatagccacatgtggctagtgactagtgttgtggacaaacctttctctttcttgtgttttacaccttgctgggtgtgtatgtgggtggggggtgttgaataagttgtatgcttgacattccatggtctttactattccaccttgccatcgaacttgtctcccagaggaaagggaaaaatggtattttggaactaaattcagatgttaacttgacatttacacattgaacatatgtatttgtatgtgtttctgtgtgaatagaatggttttctgggaataggtcctgtggtgatttcagtgataactgatgatgggaaagtggtggtgctggtcacttgactttcctagtgaacattatgtgttccttgtcatagtagagattctgttgtgcagttcattctgttactttatttttgtactcttgtggctgctaaatgattattccgtgtctgtttttcaaaatactttgtggtttatattttttaaaagg

SEQ ID NO: 42268 - DNA, 665 bp, Bovine  19866881905154
aatactggagtgggaagccctgtgtttcccagagatcttccccactccagcatctcttaagtctcccgaatcagcaggcgggtgctttaccgtctgagttaccagggaagccccccagcttcaactcctccctcatcccctacgcacaggaaattcattctgcagtgttgttatttcatgcttttcaaccaaaagtcaacttttaataacttttgacaattcagttgtcaactgataacactgtcaactgattagcctgaaaaaaatatattcttgttcaatacgtaaatcaagtaagttttctagacatacacccatgagaaattcaggaagacagatatgtttattattcattaatcttttgattacaaccattataatttttttggtttaacttggtagcaaacttgattaataacacttctaggagttcacaatttcaaggctaaggttccgattaaggtaatatggttatcaatttaatataaatgaagctttttaaaaagggtgaaagcagtctgcctcttacaggaaaatataaatgatccagactttagtcctaataacataagtacactttagtgctacaacagttaaagagaaagatcttaactaaagatcagaaaggagcaccgctacattcttctacacattttatgttttgg

SEQ ID NO: 42269 - DNA, 1535 bp, Bovine  19866882011174
atctgaaaaaacactgcaaaaaaagatatcatggtggaaaattaatactatagagattagtacattttgttaacaagaagtgtgtgttaactattgctgcatatactattgttttagaggcttaaaacaccaaccactttttactgctcccaagtccttaggtcagctgagctggatttggtcaagctctcccatgtgtgtggggtcagctgtaggtcaactgtaaggcagcttggctgatcttagagggacagctgggctctcatcttctagtggatcaatctcagcaggttcatatggtagaggaaggagtgccaaggcatagaaacacaaactgcttgcagcccaggcttgcaacaggcacagagtattttattgaccaaaacaagttacaagaccagtccaaattcaaggggaggaagaataagctgtagttgttgatggaagaatctgaaaaattacattgtaaagagcatacaaacaagaataaaggattttggcagtttttgcagtctatcacaaaaacaactaatgagaatatataatgaagggaaagagttacagaagcaagaacgctataatatgtgaacctatttttattagaaacacagaaaaatatatatatttacgtgtgtacacatatgcacgtatatatatatgaagggtgatggagtacatatattttacttttttagggagtcaaattgtacattaaaatgtataatttcatgagtttacatacacatatatatatttgtgtatgtatatatacacacctgtgtaaccattaccccagtcaaaattcaggatgctttcttcatctcaaaaaagatttctattccctcatctagtcaatccctggtagaatcactatcttaatttggatcattatagattaattttgcctcaaacagtagaaattttccaaatatccatatttttctttaattcttaatgtaatactctgataacatacactaattttataaaagaaattagcttcagaaaacagttaatactcagaataattttatatagaaaatttcactatctgtgcataattgagataaatatacattttgtattgattttaatccctgtaagtgctaacataaatcattaaataatgattagtgattgtttcattcttttctactttagttccccatttaaaagtggtgtgtcaatggcaagtcggctttgtaaggctgcaatgttaagtcgatttaacctgcttgccaaagaagctaaaaaagaagatatacttgaagctagtacatatcatgcagctaaggtaagtctttaaaagaatgaaattgaacattgaaataaaaattttaagaaaatagtactgtggtaatttgatgatgatacataccaaaataatggttaaataattctgatattgccatgtagtggtaaaattagattttaaatggatatgttggaaattggatatgtgaaataagttttaccacttttagtagctgcctcagtatggtatgtactaaccttgcaatattgctaaaaacctg

SEQ ID NO: 42270 - DNA, 1682 bp, Bovine  19866880140116
agacattactttgccaacaaaaggtccatttagtcaaggctatggtttttcctgtggtcatgtatggatgtgagagttggactgtgaagaaagctgagcaccgaagaattgatgcttttgaagtgtggtgttagagaagactcttgagagtcccttggactgcaaggagatccaagcagtccattctaaaggagatcagccctgggtgttccttggaaggaatgatgctaaagctgaaactccagtactttggccacttcatgcaaagagttgactcattggaaaagactcttattctgggagggattgggggcaggaggagaaggggacgacagaggatgagatggctggatggcatcaccgactcgatggacgtgagtttgagtgaactccgggagatggtgatggacagggaggcctggtgtgctgcaattcatggggtcacaaagagtcagacacgactgagtgactgaactgaactgaactgaactgaagaaagaaagcttgagaaattatcttccaaagggctgagacatatcactgaattggaaatacaaccttactcactgtgtgtaatatataagctacacacaaaatatggaagacctgtccctccctcccttctttttctttctctgtaaaagaactgccacataaaagaaaatacagtcactgggtgggcggggaggtgggtgggggagtgctcaacatggtaatgatgcctttgagacgtttttgttttgtcctttcctatgccccttgtcgtgttcaagtaggggtagtccttaatgaactggtaaggtttcttggttaacttatgtaataaaggtagaaaaagagtttgaagtgaaaaagctttgcagctctggtacctaccaagttataggtgctcaaaaaaatactgtgaatgaagaaattgaacaaaactgtcttctgattaaaaaaaaaaattaggcaaaaatatcaaatactgccagcttaaatcagtccaataaaaaattgtctacattttccattaactcttaacaatgttcatgatttgaatgagaaagtaaatgtgaaaatgctcggtaatatttaaaatatatcgtaagcactgttattgttgtttctacactttgaagaaaactagtatttaacaactgaatcattctgaatggtccagtgttaactgagaactggacctaagagcctttttattaagtatatatttgcccgccctaaaaaattttggatgcaaaggaaattgaataatgcaggcattagacacagatgtgtttttaagccgatcattcacatcatttacaaagcatttttgtgatcaatatttcatttacagggggcttcaagagatttccttagaaacagaataggaccagcacttattaaggtctgtgttggtagcttaataaagaataaactctcaccctgtcccatttcattccaaataacctgacccatttaagtacccacacatatttgcattaatccttcaggagcctcattcttccgccacttgacaacttgctttaaatatggctttcccatattttccacttaaaaaaaaatgtgtttaaaaataaatttattgtcaagggaaagaactccatgggtctattccaaaaccccaaattcagagacatcccataaataagtccaaacctaatgagttgactttctga

SEQ ID NO: 42271 - DNA, 2972 bp, Bovine  19866880167442
aatttgctgtatggctcaggaaactcaaacaggggctctgtatcaacctagaggggtgggatggggagggagatgggagggggttcaaaagggaggggatatatgtatacctatggctgattcatgttgaggtttgacagaaaatgacaaaattctataaagcagttatccgtcaataaaaaaataaaaagaaaaaaatgaaaaactgaaaaaaaaaaaagataaagtgattaaaatacaacaataactcccatgttcctctcttttccagcaagggactgctatggctttgtttaactcccctctggacacacggcccagttgcttaagaaccgactccagctacttctctagatcagggtttgtccatgtgtctatatgaagattgaaaagtaacttgttcaaacaccacaagttatttagaacatacactagtcatcattgattatcttaccaattcacaaagaccatttttaaaatctatgattactatgacacttatttttattattctgatcacttctaaatgcaacatgtaagaaaatataaattcaaatataagctataacaaaacatattcttgacatattggcaatcctgtcaagaacagcaagctacttatgtcaattacctcaaaataattgcaaaagacctcatcacaggtaacgaaagtgatgactttgaaggatatttctacttatgattccagttcaaaattatgtattgcccaatggctcagcacacaaagaatgcaggagacactggagatgagggtttaatccctgggttgggaagataccctagagaaggaaatggcaacccactccagtattcttgcctggagaatcccaaggacagaggagcctggcagcctacagcccaaagggtcagaaagaactggacacgactgagcaactaaacatatatatatatacacacacacaaatatttacataccactataatttctcagatgtgatgaaaaagacatttggacattaggtgaggttttatgttgttctgagtaattgaatctccaatctcagactcttcttcatgggaatctattccttgatagttagccagacggctgtgatattggcatgcaaaacccaagtttggatctcttcgtttattggtctcagaaatttaccgtgtttgagcaaagtccaagatttggagatctgcaccaacagagttgttaaaatcaaagagcaggatatagtgtgatttccattgcttcagttagagtctgtgaaatgccaattctgcatatcttcaaagagcagaatctgtctccaaaaaccgtacaaaatagcccactacaaaggaaactccttcaagatctttgctattgaactaggaccagaagtcagaggaaaacctctgagaacagtatataaatgacagatatcagaggagaccgcgcacgccatgaaatgagagacattctgctgacagatgagcacctttgaactctaacccaataaaagaattagcactcccaatgtataatcagtacagcaagcaaaatatgtcaacacacgataggcaggataatcaatcgacttagagcgtaggaaacagccagactaaatagcagcccggtcccagtgagccagacagccctttcctgctccttaaatttctcataccacggggatgaggaattaatatgcagtaaaggaaaacccctaacaagtaaaacaacagagcaaggctgccgagtcctcactaagaagagacccaggattccccaaactatttttctttttcttagacatgttctaaggatcttttgcttgtcaggtaacagacaattttaaattagaaaccacagccctattctttactctctctcccctgtgaagatttcagaaataataaatgtagcagtagctacagacataaacagggtgagcttttaatcctggttgactggatgctaacatggacttcaggcaagtaatttaaccaggttgggcctcagggctgtaaaaacagaagagttagacttttaaggggcttcccagatggttcagcaggtaaagaatcagcctgcaatgcaggagacacaggtttgatctctgggtcaggaagttcccccagaggaacacttttaaaggggattttgtaacagttaaaagaaatagatagaatggtttcagtgatacataaagtggataaaaggtcatattcaacaaaggcagggctggcaatcccaatctctttgtaattaactcttgatccttgcaagaatctaagaaatgcagttatggcctcatatatatgtgtgtgtgtatatatatatatatataataaaaatctcacaagccaaaatagaacattatagttacagatgtgtataagagggggcagataacccaggtctgaattccctttctaccatgttagttgtatcgtcgtggaccaccaagttttctggctcacagtccactcatttgtaaaattggagaaatagtattgcaccaacctgtagggccaaggctgagaagaaggacccatgttcctttcagctttttctcgataattgcaaattgtctgttgctggttctctttatctcaggtacccacttgacaaaaccaacaagaaatcgcctcaattctggatatctacgttccttcaggaattcagaaatgattcttttgttttattttgctgtgttttccatttttccaaagaagaatcacttgtgctctctgcttaaaatcacacagcaagtctgcaggatttttaaaaactcagccccaaactttctagctccaaaccacaggtgggtatattttataatgccttccactcatgctgcttttaattcaagatcccacctgttttaaactgaaaggctctgtgtgatgcaatattttattttcacttatctcattttaaatatgtttgctttctaaacagatgcattgcaagaatagcgtttcaacaacacatttttaac

SEQ ID NO: 42272 - DNA, 1634 bp, Bovine  19866880344835
ttggtagtttgaatactgctttcacagtcgaactctaaaccaatcactaggcagaatctctttctgttccaaagccattgggcggcttgtacttatgggaagcagcatggcacagtgacagtgactggtgaccaaccgcttataagatggggactttcagcaaggtgagactcctctttaagcctgtgaggcaataatggaactatgtcatagaagtgatgtgagctttgatgagtaagcatgtgagctatgcttactatgtaccagccaagagcagctcctggtacgtggtaagcataaaaacagtaacagaaaaggaactgactacaggtacaagtcatgagtatcaacaccaaatctgtttccttggaacaataacgcaattatgacatggatgcttcttcaaacaagagaggctttccaggtgactgctaatggtaaagaacccacctaccaatgcaggagacatatgagggttggggagatctcctggaggagggcacagcaacccactccagtattcttgtttggagaattccatggacagaggagcctgggggctgtccagtgggtttcaaagagttggacacgactgaagtgacttagcatgcattcacgctccaaacaagataatacacagttgtcatggggaaagcagagaacaaagaaaacactgtcatggccaatggcctaatatctcactgctgaaaacacactagggatctacggagtctaacaggactcaactggaattcagcagataagcagttgcctccgtgagccttaaatgttcccttgaagagagacaccacacccatctttggaaatatattcccatgttaaaaccagacatgcgtatggaaattattattatcccttggctgagggcttcagttataaaacatttgtgatgtttgtaacctaaaaaagggattttctcaaatttgttgaaactgcctcgttttttgtagggtcaccatcgccatacctcatttgagatcaagtgaattgtcagattaacgtgtttttgcaggaagccgattctgttacttccttaaaaaagcgtgtatctcttctgagggttatcggcaggctgccactccagcttctcacaccaggtgcccttcctgactggtcatttcccctcaggctggcgataaccctgcagtgactccaaattctttcattcagtatctgattccatctctatcagatggaacctcctccagaacatgactggacctaagtatttccatgtcttggttcattcctaaaatcccaatctgacttttgcttgaactgcaggggaaaatccaaatcatgtgataatcagaaagaaaatgatggctttttcctgattccattttctaaacatgcagtaatgaacaataaatatttacaggcaatggtgatgataactgaattttttgtggggggggcccacataaaatagactctgctccataaaatatggccaatcttgcataaattttaatgaagattttggccctccacccattaaaattcttacttcaataaaaataaataataaacattcatcagttgatggacatttggggaaaaaaaaaaaaactattacgtatttctctccctttcactgtcaccgatcatct

SEQ ID NO: 42273 - DNA, 1813 bp, Bovine  19866880365717
ttaaatcatgattagatatacaaattgtgtaaattgtatgtgtgtatatgtatatatggggcttccccctgtggctcagcaggtaaagaatccacctgaaatacaggagcctcagaagatatgggtttgatccctggattgggaagatcccctggaggagggcttggcaacccactccagtattcttgcctggagaatccctatggacagaggagcctggcgggctacagtacatagggttgcaaagagtcagacatgactgaagagacatagcacacatgcacatatgtatatatgtataatagggaatcctaaaatttctttgtaatgagcttcaggtgccttgaagatgagtaatttgttcatgttcttaagatttgtttttctcttatttgaatatctatttctgttcactgtccttgtttttataaatttgacttagcaaattagtgagatgtgaccttttgatataatccatctcttaaaactttatcatttatcgtccagattctgatgccagacactaggctagaacattactcctttctgattggggctcagtgagtttgtgaatattttgtattatccatttttataatgtgtgcttgaagtacattcaagtacttcaacacagtgaaataatacctttttaaatgactgttaggaaaatgcacacagcatctatgcttgggccaactgtgattaaaaaatagatacatatttaaaaaattaaatatgtaaaatgtttatataatatataaattatataatacataaatatgaaggcaagaattggacaatatttctaaatctacttaatggcaagctgtgccataacaaagcctactctctttttaaagtccaagtaaaactgtagataccaaaggttttacgtaacaagaaagagtaccaaagaactagaataactaactttaggtgtcagagaagtctaaacaaattgagaacctactcaagatgtacttgaacaccagaggcaaatgataccttcattttcctggcattaagtgacgttagattaggaattcctattacagagagcgtgactagggcttttactgagcaagatgtcaaaaaattaggaaacctttttctaatttggcaagatattacctggaattcagttgtgttttcttccaggttaacctgtgaaacacgatgatagttttcatttttcagtcacaactgtgaacatgttttgagttcattatagctaagtttggtgcattcgaactagagcattttgctcacacattattctgaatttgttagcaaggtgatttttttaaataagtgacttttctatcacaatgaacccattagctgatatttttctttttttcaagctggatacaaggacacaggatagagaaataagaaatctttttcaaagagttagaagcttggccccatgattccaaccctcatttaatcattaacttaacatgctgctttgggtagatatggcattcaacaaacactccatgcctaagagtaataatctcagacaccaagggcagccacataaccactgaggaacagcattagaatatgcaagaaaacatgtgagaaatgggctttgtgtgtactgagagtacacacgaatactcacagtattatggtatggtaattttatatattatagtaatttatatagtaatcatggagaaggcaatggcacccctctccagtactcttgcctgcaaaatcccatggtcggaggagcctggtaggctgaagaccatggggtcgcaaagagtcggacacgactgagcgacttcactttcacttttcc

SEQ ID NO: 42274 - DNA, 1333 bp, Bovine  19866880469917
ctgggaagctcaaagatagaataagtactttattttagctcttttcagaactggttattaaatatgctgtcttccccttcttcttgtactcctcagtatttatcttatgatagcagtctttgggaggttttttgtgtatacctgtatttctgttgcaagttgccttgagtactttatggaaataaagatataatatatttttttaaaccaaaaaattttagaatagtaaagtgtcaggtacaaacatgattgtatttctggactagctactccaaatggaactgcaaaatgctggaagggaaggtgtcttagaaccaagctaatccaaaacccttgtcaagcaaatagggaagcagagccagagaagttaagtaacttacctaaaagtgaaagtgttgttggtcgttcagtcatgtctgactttctgtgaccccatggaccgtagcctgccaggctcctctgtccatggaattctccaggaaagaatactggagtgagtaactgttctcttctccaggggatcttcccaactcagggattgaacccaggtctcctacattgcaggtggattctttaccataagaggcagcaggaaagccctaacctatctaagacaacagataattaggagccatttctcctgtagcatctcattccctttcgctatgtgatgtatctctgcttcaagtacaatgtccaaatctccacatactatattgacttaatttatttattttgctcaagtttttgaagctttctacataaagaactagtatttaaactgaatgtgctaaacagagacccactctcatcctgccaatggacagtggtcctttccacagactgttgctcaggcatctgtcaagggaaggagattatacccgtggactcctgccagaagcctggctggggaatgtgctcagggctaactgttgctctgagcagttacagtagtcaggagctagtctcatcaggatctctaccaattaggatctgcttaagcagcagcaaaatagaaaaagcttagagaaagctcagttgccagtattcttgatatataagttaacctcagtttggagaaaggtttctcaaccttatcctaggctatgatatttggtaaataatggcaccttcaagctgttcatgtaaatcacggcaccatcagttgggtaattggtaggcttgatcctgggcacataggtcatgttgtggctaatatataggatcctcttcatagggctgtgcactgataagatatggcagctggcatgatggaatccagacaggcagccaggagtgcagggtgtgcagacagagatgggctccaaagaca

SEQ ID NO: 42275 - DNA, 1751 bp, Bovine  19866880498305
ctaggcaggggtttcttcatgttgaaatgaaacagtcctctttatttagtctcagagctctagctttcggccaccagctcaattagccaaaatggaaacaattttcattcattgcaataactcactgttcttgagatcgctttcaaaatatacactttattattatacgctgacctccgtggcgtggagtggcaataaaagaaagaggcagtgagatctatctagcccccttcggctataattattagaaattaattgggttcaggaccctaggtagtctagctaaattaatagcttgtctagtggttaaaatccgaatttttagtccacgggagagaaagagagagagccacagacatgaaatgcagacccaagggacgcctgagtttacttgcaagacgctcatctattaaatagtgtccagaatacatttggagttggggagaggggcccggaattggagggggcgggagccagaagaaagaaaggagcgagatggggagggtggctacgactgagcaaaaggtctccagttgattttattcgatttttcttgtgtgcattgttttcgggaggggttgcatttaggggttaaaataaaaaataaagatccagtgtactcgggagctgtcgtgcccggagtaaaagtgaaaagggagccttaggcaaaaggaaattactgcgagcccgcgtgacctttcagggaggtaatcaatcaagtgatcaacagggatatttatcatcgctatataggactacttcgccttgcacgggcgggggtggggtggcgagaggagggtggagacgcgcgcgcacacacacacacacacacacacacataatcacaaaagtttggacaaacccgattaagtctcaagacagagaacgtaggctttaatagatgttaagattgtccctttagtctgggagaaacacagcctcatacatccacgcaaggggaaacgcgcacatccccgctgcagtggctgtgtgaaggtgttaagttgaaagcgtccactgagctttgcccagaaaggaaagctctcggtgattagagcggtggaagggcaggcgaggcgcggggctagcttggtttcattgacctgcgggagaaggggcgccacgggccgcagggggcgcgggaggcgggtacccctctccgcggcgcacggactccaggtcaaagcacccaggcagcctcctcttcctgcgaaatcctcgcgctgccccagggagagaggcgggtggcgcgctcggggccagccggctccggcgagcacgcgctgcgggacttcggcggccgcgcgttttctgcccagttgttaccttctctaccttgtaaaactcgccgttttgtaaattgagttttcggtcctggatttcttagcaaatcgttagattttacaatcctgctcctacactctggtcgttcaacacccccctccccaatgtcagaagtatacgtaagggaagagggggcgcgaggtggctgacttttctataatgataatgatattaaatagtatacttcaaatctaggctcccgaggcccttgcccagctcggggattgtaatcagcagttcttgcgagagaaggtcgggctgattactggccctcgaggctgagaactatttcccgacgggtttatgaaacacaggttggggtgatgcgcgccacctcccaggtagcttgccgccgctcccgcggtgtgggaatgtggggccgcgccagggccccgcggtggcaccag

SEQ ID NO: 42276 - DNA, 1615 bp, Bovine  19866880552961
acagacagacggacagacagacacatgacatgagtcagcaaagtcttagtacagaagagagagggatcacatagaacaatgaggttgtgactcagagctctgtcttcttcccttgccttctctttctcactcatttttccccagtgccaacagtaatacagattgcaagtgaatagagaggagaaagcagagtatgagcttgtgtgagtctctgtgtgtgtcttcctcaatgatggggctctcaggcctttattcagtctctggcacaatgctgcctctgtagaaaagatattaggaacaaaaagcaaacttgaagattcaggagcaggctgccagaattattaagaaaaacattcagatgatgccattaaaaacatatggggattctataaagccctgaaaagaaaatgtttaattatgcgccgtatgcaaaagccatcacgttgagattaatactaaggactgaactgtgtggggcgtaagtagtccacagtgatacatcaatctttttactcttttaaaaataatgtttttctttcgctgatgacaaatacctttcaaactgttgagatcatgctgctagagtgatacatggagtttaatgaagtccaaagtcactaacaaaagtttccaaattaacttttcaaggtctttgagttagatttctttcctttccttttctcccctaggttcccactgacttccagctcccataggggagcccccctttcccctccaatacacaaaggttgcctacgccggtggaaataccgttttgaggtttcccatttgaaggccctgtaatgattcattgcccaacattgaagtgttaatagttacagtgattttgatttccattctcaatagctcacattaggaaacctgaagaagtctagaactcttggccatttttgaggaacacagaaactgttttctttcacctgaatctgatgtgtttgaggattcctatcatttcctttggttcttggtaatgcgtgcaatcattattctatttagctctgtatgtgtgagaggagagccacaatgagaagaagaaaatcaaactttgtagctaatagggcttccaaacaagagtactggatatgaactacatacgtagaagtaagtcacaattgcaaaaagtctctgggctttaatgacctgagtactgctatctttttttttttttaatatttcattcatttatctacttctttttggttgcgcttggtctttgttgctatgtgggcttttctctggttgtgacgagaggcggctcgtctctagttgaggggcacgggcttcttactgtggtggcttctcttgtggagcagaagctctaggcatgtgggcttcagtagttgtggcctctgggctccagggcacagactgaatagttgtggcacatgggcttagtggctcagtgacatgtgggatcttcccggatcagggatcttcctggaccaggcttggagcccgtatctcttgttttggcaggcagattctttaccacttggttgccaggtagcccctgcctttatttttatattcatagaagtttaaatattgcaaaggcaaatacatagcttctcaaaattaaaaaaaaatgatagtg

SEQ ID NO: 42277 - DNA, 1542 bp, Bovine  19866880583908
ttctgactgtttgctacacatcacccatttcctctctgtccatcaagaattcagttgatggtcaattcggtggttttcttcaccccctttaatggtttcccttgcgtttatttttttaaaataattttatttatttatttttggctgtgttgggtcttcgttgctgcacaggcttttctctcattgcggtgagtgggactgctgtccaattgtggtgccctagtgggcttctcactgcggtggctctcttgttgcagagcacagactctagagtgtatgggcttcagtagttgtggaacatgggttcagtagttgtggctgtgggctctagagcacaggctcagcagctgtgggttggtaaatgcaggtctgtgcctctttaaacaggatacctgtggatttggggatgaacctggtgatagttctgcatttagaggaaatgtaaaaataattagttgcttagttgctttatggcatgtgagatctttcccgaccagggctggaatccatgtctcctgcattggcaggcagattcttacccgctaagccatcagggaagccctgtccttgcttttgagagtgtggattgtctgttctagatgtatcgtgaaccaagcaagagcaagggctttagaaaattttttttgggtgtaattttggcaaagttgttatccacagaggaacagttgagttcttgactttagtattttctttgttttttttttttttaatcttaccctgcttaatacaaaatctaatcacgatcaacaaaggcacttgcacaaagcttctgacctactcgcatgtgctcttttaaatcagtcttatgtcatatttgtcctcaactgtagctgatttccctcctgtttggttggacagatagttgtgattaaccagtgtggcttctttttctgatactgtttcatttttaaaaatgatgaattgaaggagaaaataacctcttaggccaaaaagaataaacgtgaatggaggaaatccagattcatccagcagttattcagtgctactgtccatcagattctgtactaaatgttcccttgagagaatcccagcctatcaaaactgaacaagccattcctatctctagtactacccttgctcttttctccctataaaattcccctccctatgcatttcctgtttaataaattggactactgtctgtccacctgctcaagccaaaaaatggatcgtctttgactctactgtctcccacaccaaccttatctgatttatagttcctctgttctttcaaagcctccattctttgcacacactggtctccatacctgggaatctccttttccttcctgttcctagcaagtttatatccattcctcaagttctcttcttccatgtcatcatccctgatcctcctattaaaaatttagtactgcttaagtttttcctcaccatagtattgagttaatccatactaaaaaacataaagcattgtgcagcatccaaattgtttgcctagtttccctaatatgggctttcctagggctcagacggtaaagt

SEQ ID NO: 42278 - DNA, 2106 bp, Bovine  19866880616717
atttcccaggcaagaacactgaagtgggttgccatttcctgctccaggggatcttccctacccagcgatagaaactgtgtttcctgcatctcctgcattggcaggtgagttctttaccgttagtgccacctgggaagctgatatggagtagcacccaccgaatgttttcatgtaggaagacaggataaggcaggcctcagtcctggaggaacttgggtaagtgggcaagtacaaaagcagggatcttgttagttacttgccctggagcatgagactgaggctttgctcaagctacttctcagcaactaaaactgaagaagttactgcagatcagactctgctatctaccaacttgaaagtaaaagtaaaagtcgctcagttgtgtccaactactttgcgaccccttggactatacagttcatggaattctccaggccagaatactggagtgggtagcctgttccttctccaggggatcttcccaaccccgggatagaacccaggtctcctgcattgcaggcagattctttgccagctgagccacaagggaagcccaagaatactggagtgggtagcctatcccttttccaggggatcttcctgacccagtagttgaaccagggtctcctgcattgcaggcagattctttaccaactgagctatcagggaagcccacctaataacttaggacccttataattcctcatcatttggatacaggattgttctcagacctacaagtggggatcatctgtaccaactggctctcgcttcatcctctgtggattgagtttgtgatgagaaatgctctgaggtctgaatgtgggaagcttggcatggctatcaagtcaggagaaggttgtctcaaacatggagataacaccaaactatttttatatttgctgttttctctagaaggataaggaaggtcctgcaatcaaattttagatcaaagttcagaagtggccattgtcctaccaatgatgttcatgactcaaaaccttttaagaaaaatgtcttctgggttttaaccaaggttgcatagctgtgtgggtgcctgatgtgacaatttctactgggtcatgagtttgttagaccctgtggctttggttctctagcagcttcttcttttgaccaggactcagagatcagctactgaaacagtgtctggacaaggaggaaagtcaactgagtgttttttttaaaccttactttaaatttttacccaatcacttcatttccggaaactttttaaaaattatatttactttgttataaattcacttacagcaatttatggggtataaaaaggaagatttgggcattttttgaaaaaaaaaataatttttgtttactggaaaccattcaaaagagtggttttatttacttccaataaatgttagaagtgtcactgaaaaccatagcagtctcattcctggataatctgtttctgtccttattttcctgtgtatgttttaagactttccagagtggttgtttctatttaaggcacgtcatctgtaggattctgaaatacataccagtgctttgaaatttttgataaagcccagttcttaataacaggaaagtttcaaatgcccttagtcacttggccatctgtaaataaatgaagttcaatgggaaaaatagcataaggaagccgttttggttactgtttccattttgttcattcacatcatcagatttcaagatgacaaatatagaaagagtgtgagaacacgtttaaaaaatactatgttttgaaacttggatctgagttcaaacactcaatctaaagaacacttatgattcaaatgtgagttatttattgtctttgtcaatttccagaatttaaatttatgtagggataaagcaaatgcaaagctacatttgaacaacaatggggcacattcttctttttgatttacttatttcttccagcagaggcccttgcattctctgaaaccatgggccctagtcctgagtagacattgatattagaatctcacattattatcgtatccctgatgtccccttctgggatgttggccttgatcactgggtcaccctgaaatgggaggtgattcctgatttatagctccaaat

SEQ ID NO: 42279 - DNA, 1730 bp, Bovine  19866880648826
tcaagggtctaaggcacaaagtggacagaaatttgggagcactgcttaaccaatgctgctgaaggcgtatttctctgtgggttttatgctccctgttacccatccctccatatttataagacagtgaatagcaagtggccccatttggctgagtccaaagcccacacactttctacaacatcacactattatgacacagagccattagcccgtgctaattgcctatttcacttgaatgaaccaatacaacaacatgtggatttgagaagatgatctcatactaaaaacaaataaaataaaggaggaacctgttatatgtagggttccttattacaaagattaaaacccatgggtcaaataacatgttctccagcaacactgtgataacaattctttcctaaaaggaaaattccattgaaaacaagcactttctacgtcctagcagatgacccataataacagcatagagaacaattttccataacaaatcctcttgtaaaaccaatgctgttgcttttcgtggtccctgcccatttccaccttcctttcctagaaaccaagcaactgaagtgatgtggctgtttacacttccaagaggagaacagaaagctgagtgactttaactcagaccctttgttctaccgtcagtggcagttacctttcaaccacactcttctcatccctcacaatacaaacttcagagtcacccagccagaaaggaacccaaataaccccaaacacaccaaaagaaacctaaacaaaacacaaggtaaaaaattccagggtgctagctgctcatggaaacttgctatttcaccagcaaagatctgggtgtcagcactgtgctgtccacactcctcaagtcaggtgtggctggcccaattccacaaggcctcttcctctctggtttttgcattatccatctaccagctgcagcctacttgggccaatgatatcttccctgcatgttcccagaagccctccaactcctcccgcccacctcaatcatcgtctcctcactcctctgggctccgtctccctcttctgtccggctccctcagatcctttcccagtgcccaacctaggtcccatctttaccaggtaacttcatccaagcacactagcttctttccacccccaaattctagagtcctcaccacttagccccgcagaattaagaagctcaatttctttggttgtttcattcgtgacagccctaccttttactgtggagtaaaagtccatgtctcagaattccttggcacacccgccatcccaaccagggtacttaaaaaccaaacagctgccaatgttttccacaattacatgcacactaattctagaaatctgctatgtggaaattccactgtaatttttaaatgcaagtatcccataatgttctgaagcatgaaatttgttgggtttaccagtctctacaccttcactttgcctccctcatttaaccctttccctccttgctcccacagctttctgagctactcccttagaacaccatcataccttcttactatgtcaaagtcagagttacctataaccagtaaaaatgaaaaatgaagctactgtctggaggcagagatgaagttttattcatccttttactcagctggtctctctctattatatatagataggattcagttcagttcagtcgctcagtcgtgtccaactctttgctaccccatgaatcgcagcacgccaggccttcctgc

SEQ ID NO: 42280 - DNA, 1182 bp, Bovine  19866880714440
ttcactttgtttccgctcctatgcagatggaggctcatctatctgaaaggagaatgaaccactgttcattttatcctttaagtaggatgacactcagctgcttaaagatctcttaacacttttagcaaaaccagatgccaagccccattttgcgcacttttttagttgaaataactaacttaacccattacaaattaatctttaaaacaaaccacctgaacgacaaagtatgcctagggaacagatggagtttttatgttttcacatgagcaccaagcaagatgaatgatgccgcacaggaatctgtgcttaatccttccacttccccagtgggatggcttcctttttaatgcctcatgccagggaatgggaatccatttcattacacttaaattgcattgtaaaattacatgtgtgtgttattttgtatgctcataggcatatacatgtgtgctcacactttccatgaaatacttgaattgagcatttgtccaagtgccccattgacttaaatgatgaacatgagttttatgcctaccagcaggaaaattttctgtcctgttgaaatgggctttgaaaactagttccttatatctcagtttctatttattaaataagtcagtgtacatgttttacatatgagcatgttgttaaaaagtgcattttggggggctgagggtgcataaaaataatttagtgctggaaaaatttgtttctaagacaccttcaaaatatttttgtgttaaattctagaatgtaaaactatttgcatttggtatatgcacttacgaataaagaatacctttacaacatctttatcgcagcaagattatttgttgaatttgaaaggaaaaaaaatctcctttagcttgtttccaaggctattatcagttgtccataaggatgtcttcccagtataatatggataaatagaattaacagagcctaaagtttcaatagtcttcagtttttcttcctcagcaaactaaataggaaaattcactgacttgagtgccattatatgaatttaagaaacaccgagcatctattatgtcccaggcactgtagtagatgctaaagaagtaatgatgtaaaattgacaccctcctgctccctgctcccaagaaactcctagtctagaagaatgccattgccttcttttccctctcctacctgctggca

SEQ ID NO: 42281 - DNA, 1752 bp, Bovine  19866880761954
gtcctttagggcttatacaatagaccctttccttctcttcaaatcagcctaaaacactctgaactccaaagtttgttaataatttattagatgaaaactctatgctgctaagtcacttcagtcatgtctgactctgtgcgaccccatagatggcagcccaccaggctcccccgtccctgggattctccaggcaagaacactggagtgtgttgccatttccttctccaatgcatgaaagtgaaaagtcaaagtgaagtccctcagtcgtatccgactgttagcaaccccatggactgcagcctaccaggctcctccatccatgggattttccaggcaagagtactggagtggggtgccattgccttctactgctattttcaaaacagcacagtagaaaagaccgtaagtccaagttgatggcagctgtttcttataaggacatccctaaaataacgaaagcccaatgtgagcccgaagctttccatccatggattcaggccggctgtatgctaagtactaaggattcaataggcaaaatacagaaataatccttgccctcaaggagtttccattccaacagagaagtaagaccctgaacatcaaatcatacatgactatctaactaaaaataaaaggagacagccgacaaatatagccctggcaccccctgaaagcagcccagatccctgaaagtgtagttgagtgaggggagggaagcaagaagatgtcattattcaaaagcattcctaagagaatattttttaaaataaagcttagaaacatttttcctggcaaccgtactcattgttgattctggttatcaagctgcaatgcaaccagcccccattagttaaaatgcctggatatattgatacatatgtactatatattttattctctactcattttttttctttgccagcttcacattttatagacattatcatagggactccaggaatggctccatcttaaacttgacagccagagttacaaagtcttgactttttttgtttcctttctacagctaattttttcaattaaataaacaggaacatttctctcagtgtagaatcaaggcacatcttagtctacttttagaaacaattactatgatctagcctaaaccttaaaatcatagaatcatattaggttggactttgaataaatcttagaatgtgcctcatccaacctttcattttacaaatgcaggaaatgataaggtctatggatttatgagggcctcagtaatttaattcttgagacattaaagatagtacatatcagagtcacacgaactttgccatcattatgcttcctgtagcaaactttttcaaggatatttgtgaaatacatactatgcaaagatgaataagcttggcattgctgacattaagaagttctagtttctttccttacagctccaaagggtcacctacaggttgagacaccacctgttacaagtcaggtaggaccctagactgccctccagatgtacgggaatttcataagaattttattctatgttaagcccattatgatattacaataggattgagcacccatccaccatgcagccaaacatactgcgtcaaagcactgcagtcaacgtctgataaattcacccagaaaagtaaatcaaatctttctcaatctccaggcatctttgtcttggacatgcagagattacatgtgaccatttagatgtaaatgtaggagcaaaaagaatggtatcagaaataaagtatgcat

SEQ ID NO: 42282 - DNA, 1440 bp, Bovine  19866880811602
actgttaggaacctagttaaaaggttaatgcaaaatcactgggacaggatgtcagtaagatgggccaaggaggctctaaagtttaagtgggtagatacagtaagtaaggaatggggaaagcattaattcaatatacagttgactcgacaacatgggtttgaactgctgggtccaggtaaatgcagactttttacaatagtaaatactacaattgctacaggagtcaaggttctttgaatccatggataccaaggtatacaattgacccctgaccctttagggtcaactgtgtattttctgcacgtaatagtcacaatcctagactctaaggatacaggagtgcatcagatatagtctctgcctttataaaggttatattttagttgagaaaatatcagtaaattagagcaaagtgctacaaagatggcaaagtactctgataatggaagggaggtcatctgagtgataggatggttatccctaagacctgaggaagtaattctaggatgaagaaagctgcctcatctgtgaaggatgagaaagagctgccttcaggagagatatggcagaatattccaggccagggatccaaaacatgcagaccctaagaaagtgcttccccaagtgtggtgtggtgctaagagagtgcttccccaagtgtagcatgactgacagagactgaagtaattttaatactcatgtatttatttttacaaatgctttctatttatttcaagggtttatggtttcccatttacagaagtgaaacagttttaggaagtttctgcactagttcaggtgggtgatgagaacctgggtgaggtggtagctacagagatggactaattagagacgtcttttggaagcagaatctgtaagatctgcttctaagatctggcaatcaactgataggaagctaagaggactggtggagtgggaagaggttttctggtgtaacaactaggtatgtatccatcacagagatgcgagaggatcaggcccttccaaaagcagagggggccaaatggagttgtgaaaaatgtgattagtaacggtttgctgccataatcacacatttaaagtgtgttagtatgaatataaaacgaggtttgcattaaggatatgtaagtagcatagagccctagctgggatccacttgtgtgtccacatgtctgacgcctgcatcatatggaatcttgaagatttaggagcaaatctagaggtaaacatccgaggaaaccttaagaaactccccgtgcatgttaaagatggatttttttctgaattttatcaacctacattcaaggactaggaaattaaacctttaagagcacagttttgatttatcagagcccagttttactgatcctaaaatattaaggaggttactttatatactttgtcagcttccttaatgaatttatctgtttttagggaatg

SEQ ID NO: 42283 - DNA, 1256 bp, Bovine  19866880830877
ataaaaatgaaagcttaattaatacttatagtggcaaagagatagggatcatgtgattcaatccatatgatagtttttgaatttattatccctgctacatgagtcagttgagttggtaaatgattcacttgaacagatgtgtctcagtgttgatctaatgaaaatgttctgatatgccatcctggaatgtactatcaccaaaaaaagcactgtgcttaattttagaaccatgcataaaaaaagaaacatgtaaaagaggctctccccagctctcaacactcttctttggaagaaaaggagactgaaattgcttgtccatactaagattgtttctttccggattcatgactctagggtaccttttaagaaaagacccacgttagtgataaaaattattttgaagggtgaaaattttactcatattatcatgtagaagtagtttttaacttttctgcaaatgcaactttagtcttgagtatgctctgtaccttttgtgagaataaaacaaagaacagcaaaaacagcaacaaaattctctctcgtgtttgaaaaccaatcacaataaaaatgcgtttgctaaataggatcttctgacttacaaaacattctgtttagacaggtgcaatacatatccatacaatggagtactgtgcaacggctcctctctggatgtattacacccattaaaaagcagtgatagaatttaagtatcaccgttttgcacacctaaaaactaaaggatctaaacgatggtcataaatgaccttttttttagagtgctactttattcttttacttatctgactgagctgatcttcattgctgtgagagggctttctttagttccagtgagcagaggccactcttcactttctgccacaagggtggtgtcatctgcatatctgaggttattgatatttctcccggcaatcttgattccagcttgtgcttcatccagcctcgaatttctcatgaggtactctgctgctgctactgctgctgctgctaagttgcttcagtcgtgtctgactctgtgcgaccgaatagatggcagcccaccaggctccaccatccctgggattctccaggcaagaacactggagtgggttgccatttccttctccaatgcatgaaagtgaaaagtgaaagtgaagtcactcagtcatgtccaactcttagcgaccccatggactacagcccatcaggctcctcggcccatgggattttccaggcaagagtactggagtggggtgcca

SEQ ID NO: 42284 - DNA, 1255 bp, Bovine  19866880858734
aatttgcctcagctagctagaaatctttgaatttcacagaagatagggatcttatgcccactccttcatcaaataagcaaggaaactaaaagccaggttgactgagtcactcaaagacactgaatcctggcttttgtttttttttttatctcccttaaactacgtacccacagcacttgattctgaaatgattagttactagattttaaagatagttagaatataaaatagattgatttattgtaattaaaactgtaatgaaatttaatatattttaattacagttataaggataactatagtatccttataagcatttaattagaaagttatcaagagagatacactttttgtataatatctgacacaaaaatgcattttatgctcaagtttattagcccacgagaccaacaagtgcaattcagatcaatctaaatgtagaaaataagtacctgataaacatttactgttttagaacttggtttccataaaataatttaagaaattccttagttttctacacaaaatgaatactaactggaatatttctaacccttttcatactaaatcatatattgtttcaggttaaaacagagagaatttttgagcaatgacagatctctccactcaacccagaatatggtatttcagccctcatactttattgtccagaatttgggaaagtacttttaaaaatgaagaaagaagcagtagcagagagggtgagggtgaggagtggggtaaagagtcatattccaagatgattaaatttaattgtttcatagctttctgtaatatagcttgcatagacttttccaccgattttatcagagaagcataagttttggtttgaatatattggaacagaacaaatcagttaactctgttgtcaaacagtttcataaaagtattgcttattgcctataaggagcttgtacccttaataatcagtaaattaaaaatatatatatcattaagaaatcagattcgagatgtttatatattccttctttcaatataattctccacactttaattgatatgtaaactagtttttttttaatgaccaaaaatgtggggacataaagatgaaccaattaaatggcactgctctatattttctttgcagtgagaaattatacatattttgataaatggacacaactccatccagcaaatagctctgtgtattgtggtgaattcttctgcaattacagaactttgctggaatgcccagtggtctctagataaattc

SEQ ID NO: 42285 - DNA, 1156 bp, Bovine  19866880879026
tctgttttgtagcaacagggaaggttctgcatcaagttagctgtgagaatgaatttgaacttacatttccactgtttattcaattctcctgtacacctatctttgtttattgtatggtagaaagtggagggcaatctcatttactttttgatcttcatctttgcaggggttgttttgaatattttcagccagtttatattagaatttggtctccttgcttcaaaatacattcccctcttcttcctttaacttgtagctcctgagttttggtctctccttcggaggcaagaaggatctctgccaaaagccaccaagccacacttaggtaattataataaacaagttggggctctcatttcacatgcagagctgaatgaagcagagctgtggtcaaagagatcccagttgctcctctgttagcaatggcacattaatgcactctcatgctcccctcccccactccaacactttttttctttttttaaaggaagtaaatcaggtcactctttagcatgtgaagggctgtagctttcttctgaaaccaccatcaacaacataaacaaattagaggtagtaaaccacacattctgcccacacataaaccacagtcctcaccagagggcagtctacttaatgtgagaataacagcccagttttataagcctctactgggaataaattccagtttcactggttagaacaaagttgggcagccagagtataggctctcctaggttacatgttgggagacaccgaagtggagagaccaggaaatatattttataagcttctggtacaccaaacttggaccattctttggttttcattatgtagaactgggactgcttgagtggaatggacctggggctgaacttgtccaatgtgcttattttatggaaggggagtcagagacccctcaaaagctacgactctcaagctcttaaggttgctctgggcagggaagacatattgctgaatccagacctccacatctgggcatgcaccactcctgcttttcctgagtgcaaatggcatagtttacaactgccaacttgacccatacaggagttataaaatattccctataccttcctgatgctgatatgcttcctttcctgacaatggtgagtcctcaactaatgtgtccagccctaaa

SEQ ID NO: 42286 - DNA, 1189 bp, Bovine  19866880886696
tgttgtgcccaggaggtctcatggtggttgaaggctggcagagttaatactataaatatgtttccttttcctcctccctctgctgcttatggaaccggctagatatttcatcaaagtattaatttctcaaatgcagacaacttccaagggcataattagattagggagaagaaagctggcaaaagtggcatcatgccacaaattcactttagccatatttagtgcaaacatctctgtgctcccatttcattttatctttatctgattttatactgtagcaataaaaaaaatactcaaagtgaccaaaaattatctctgagccagagacatccatgccaattcttagctagatcttaactgacttttcaaaaatacctttgtagtttttgtcactggtagttaaaaaccacttgagggttttaaatttttttttaattggcaagccaagcactttgcaaagactgtagaaagaattacaaaatcagctggcaatgctggctttggcctggggaattttaaatatgtaattgcagaccattcaaggaactattgcatctttcttttctccctgatttaagatagctactaggttagggaaagtacttcaactttttagttgacatttttagtgtgatgaaaaatcattgtttcatccatgtgtcaattaaaaggaaggacaactcttatttctgaccaaggaaatgttcagtttggcttgtcactgtaatcaaattcatcccaggatgcatgtgaggaaggtcacacaactttttgtgcttagttttttcagaggtaaaataaaaataccttaaagaacatttcaaaccttgattaagatattttgatcccaaaataaattagtccttggaatattggttgtacataatacaatctgttttgattttgtgaaatctataactgggccacaagacaaaatttgctattagccaaggttagaattaaaatgattttattaggataatcatgaaaaagttttatttcagtatcaactcatgttttcagaaatcaagtgaaattattggcaacaagtaagaacacaattgtcttttatcataacttttgtccccctattaaataatatgctatgtgatttttaaaagaagtttctaatgcttcctacttggtttgttaccaatacatggactctgttctaaatgcttcagtactg

SEQ ID NO: 42287 - DNA, 1129 bp, Bovine  19866880905381
cttatatcaatcaaaattgccattttaacagatgtgcatctcaaactcaatatggcactctttacaatgactacatatcccaactgtgaaggcaaaatggttgttacgtggaatatgtctttaaaaccttcccgcggttaagcaaaaaagagagacacaccctagccttattttttccatctggatccaaaacttcagttcatgggcaaagtctatggtatttgtgttggcaagaagaagtgtgtgatttccaaacaccatctagtagtgctgtaacgcagcccacagtgctaatgaggcatggtggtgaatatcgttcttgtaatagtatcaattgtttcaatatgtaaaagtctctttaaagctatatattgaacctatacttatgtctagccatcctaaaattgaatcctacaagttactaacagacttaagcttacaaccatctctgaaaatagatcaaaaggcacaccctgctcaagatggctcaataatgtccttttctgggaaaaagtgagagcagttctcaaaagaacacttttttaattgaatgattgcacaacctaatagagggattgcccagatttggtatttggtgaggggagattcaaccttgctagattaccctcacttcctctggagctctgtccccaggaggatgttaaaatcaaacaaccaagaattatatcagtacagtgcttaatgaagatgtcctatagtggaatttaaacaaatgtgaatgtacttatttttcctatttgattaattgctatattcctcctaaagaaaacacttttcagatacattgaaagattagatcatggctaatctatacatagtatctgtacatacatcactaagaagagctcacaagccagatttcacactcacaaacacatattgtttttgtatttcattatttttttcaatccatacccaacaaaatgatccccatcaccaaccagcctggctgcctaaacaagatttgtaagatcctatcaatgatggtgatggcaagtgaaccatgaggcaagtttgtcaattctgcctcttaaggttggggatgtgaccttgtgtatccacaatataattttactatttatattgtctaaaggaatgccaccatata

SEQ ID NO: 42288 - DNA, 1322 bp, Bovine  19866880920287
attcctatcatgcaaagaccatgatactctggtttaaaagctgaaaatagcatcttttcagtggcacagctaaaccctccattagatgttatggtagtaaaacttcaggatggttttcaaagtctttctaatctgaccagcagtccatttctctaagtctaccacaacttccggaacaagctggcggtcaatctccagttagtctaaaaaagtcacggctcatgacccctctgatctgagatcttgaagtcacgattgtacaagcctccatcttcaccatgacgtgaaagaagacggttgttcttctgaaggatacacaatgtgaaacatgactggcaagttttctccataaacagaacaaatctatccctcacagagctgcctttatttgagcaagacatttgcaaagcttagcgtctccttgaatctattagaaacccttccctgagtgaggaaacagacattgtaaatgaaccatgactcagaaacccccttgtaccagaaaatatcctacagattccagaggcattttatgttctgtctattttcctgacatactagttctaactatctgattcatttattttttgtttaatgttttaaccagtttcaatagattattacagtcaaacaagtgatttctttcagggttaggatttttttctccttctgactttggaagagtttcagattctgttgaaggaaaggctcttttatatactacagaaacaccccataccatatattcagctcagctacaataagaaaagccagacccagatgtcccaagctaaacagaggaaaagggggaaagtaaaaacttaatgttcatttgcagaacgtccctacttacatacaccccagataaccagttggaatcaatgaaaatttataagcttagagaataaaaatctaattctctcatctcagaggaccttccagcactttctattttttatgttctacacagatgacttcaatggcacacagaataactcaacaattaagagagaaagaatgttcatttccatgctttttccagtagaaaacagaactgtgagtcacaaacttgagttacccatgcacataacctatctttagcatatagttatcccctcagattctgtccaaatctggcccagagttattcatttggatcaaaagataaaaaattattatgacctttgatccagagatttcatttctagaaataagaccatgtgtgaaaatgtatctaataaagaacaatcatatacaacatttgttgagcatgtattacaaagcaggcattgtcctaagactttatatccagcatataagca

SEQ ID NO: 42289 - DNA, 2931 bp, Bovine  19866880961540
actgttaatcgcttgaaggccgaggtcatttctcctcagacaatttattgcatggagggcggattatcaaaatgattttctgaaaagaacaattagaaggaataaatgcaaataaaatagtatcataaaatatttctggattgatttttaataaataaaatccaaagtaatatgaaaatgctaatgctctggctagaggggaataatgaccatattctttagggacagagtttccgccaacctctctgagcagcatcatcattccatatctctgccctgtgatcagtgtgtgtcagaatccttcatagtgacaaatgtgctgtccacttgcatctgtggagaatgttttagcagctgagtgattatgaatcaaacctctgagcttacagcccctaccgcctcccaatgcgttcacatttgtcgtctgacaagtaaatgtatcttgactttcctctgagatttttttgcaccgtgtttgatgaaagacatttggcaaattggcagtggtgccctgtacgttgcaatttgtagctagcattaggagtccgggcatgaaatgagagggcaggctccaggataaaggaaaaagaaagaaagctaactacatatgaatagtcgtttgaaaaatcaagcatacaatattccctttgtaagaagagaatcatgtttaggccattcacttaagattttgctctagttttagaagtcagtagtattctgtccagccatgtgtccacacaagataaattttattaattatccttttgagtacaaattgttgccttttatttttaacctgagctcaaaataaattaggcctccaactctgtcttgctgtcttatcagcagaagtatcgttttcttgagttgatcagttgcttgaatgtacagtttttaccagttttaatccttgcatgaagtcttcttagtctactgccctagccttcggagaaacatacagagtgcatacaaaatacaaacacctttttaacagctttctgtgttctccagtggcaaagtgccctgagaaccaaataaacaatggatgagttgattttacaagatggcctgagagtttgctttttctacttacaaattcagcagtaagcagcttccaaataaaatgtgagcatggaagaaacattttaggaaggttgaaaggagagagtctgtcttaactatagataggaagaatcaagctaactttgaaagtaaataccaccctctgattatgactctgtcaaatatgtgtgcagatagacaaaaacttgaagattataagcatagtaaattaggttatttgaggagaagaactaggcaggatactttttctatgggaatactgccctagagtgtggtcatgccaatgtaatatgaagttatgataatatatcatgaagtatcatttcaattcaatcctttttcaggacaaactaatattttaccaacattcttcatgtatgatcccacttaaaaatctagtatatcgatattaatttaacataaagtacatcttacacacttaattttttccttctgcattacatacatttggctctagcagtaactttggaacactggatgtttttcatgctttgagtttttttcgtgggacttcctagttcctatggtttttattacttaggcaaggcatacagaatattttcctataatttccagtttactattttttactgtatattttatttggtcagcttgcaggccaagaagatggtggactcatgtcccaaagaaccctcttgccagagttagaattcagacttcttttgttctaaaaggggaggggtagagaaccaaacatctcttggttctggtcagcctctggagaggatgtattaatttcttccttcctgcagtcactcacaggtgggcctagtgaatagcatgatactaatgctgtctcttaatttaataaaatctgtaacttggttttgttgtctcgtgtatttcattgctctattgtgtatcaaattataaagtgatctgactaaggtcttatggaaaagttcatatgacattgtgtatgcttggttctacctttattgtctttaaagtcaatgaattctctcatctgtttaatattgggacactataatctctttctacagcctctgcattcagtggatttgatgcttcccttttattaataatgatttcttagtttgctagagatgaatgcggcaggaaggatctctgccctgtccttcatggtcttgtgcttttgcctttcagatgtcggctattgaaaacatggcagagaagctggagagcttcagtgccctgaaaccagaggccagtgaacttctacagtctgttccctccatgttcaacttcagagctcctcccaacgccctgccagagaacctcctacggaaaggaaaggagcgctatacctgcaggtaactgcaaagttgatcatgactggcttcccgaaaatctcccctctgatttcaaaaggccatgctgtttgttttggaaattattcttgattggatgattaatagcaaccatgatagatttcaagcacttcaaagtactctttatttagtgagatataaaaatagtggtttaaaagattattattacatgaaaattttaacacaggccgtttggttgtgataaatgaggttggaaatggtccaaatgctatctatttgtttcactttgatgtttatgaattttctttcacagttaattattttcatccaaaggtataatactactgtcctcaagcatatatttatttattaattgtcatggtatttaagaataaggctcttaatgaaggacaaataaggtcaataagtgagaaaactagttaataagtgccttgttactcatcagtagtatagcaaagcttttatttgtttctgttttcttttttaaaaataaatcatgcttatcatttct

SEQ ID NO: 42290 - DNA, 3269 bp, Bovine  19866881001238
ccgttgcaacaggacaggaccttttcttttggaaaaaaataaaacacttttctaaaatctgtctatcaaaatcagtctatgaaacgaaacataaaacataccagcaaaaaatcctttatatataatctatggtttcttttttaaaagcctaaaatctaacaatacagaaggaattatctaatacaaatacaaaacaaaattaatttagaaaataatttcttagtaagatcttcagcattctaaaaagactttcaaaaaatgtagtaatacttacataatttagaatagacctttcccaaaacactgcactgtaacaaatatatttaaagatgaacttaactgataattttgagtgttacaatgatagcagatacaactaaaatacacgcatatgatagtaatacagcattagaagatgacaggagaaaaactcagtcttcaaactttctttacaagtcattctggaagagtgtcatgccatggcaatttaaaataaaattattttagctaagaagcagataatgtgatgaagaaaaacacaataaatcaaccttagccacttcaatcctttaatgtgacaaataataaatgtaaaggctaatttatgtaaagacaaaatactaattaccatcatgttagaggaaatctggtaactactacccttacacaattatgacatcactggtagcagtttttaaaaagaaattttgttcattagatgcttggattaatgaagatgtgaattaaatatagcctctccatttcagcagagttcttaaaaaggctgtcttaattttctttaatttcttcacattccaataaattcctattgaatttaagccagaatagattagttgaacatttttataactttataaattgtatttaaatcctgtatattatattaatacatatgaatgattagacttcttagataaattaaatactaagtttgatgtacattgtacaaaggcagtatttcaaactctaagtcaaccccactggtggcagtttattgtgaaaatgctgagtgtgctgtgaaatggtgatgatctgtacagtttacaagagtttagtttctagttggttcctatgactaggaccccagagaaaacacaattaaagaaatcaataccaatagaaaatatattaattttattacaggtgtagtttaaaagcagaaaacaaatgagccataactaatgcatggcagaaataggaaataatgtcaccatggtgtttaatcagtagtataggaacagactttgtggaactaaaaatttaatgtccaaagactaggcagtgagactaaatcaatacgtggggaaaatggaaggggcaagtggtagtatcagaataaatttgaattttctaagttcattaagaagggaaaggactaatgtgaaactacagccaccaccaactgttatggtttaatctataaaaattttaaacttgaaacttataaaaaaaactcaaatataaaatgtttaataaactggctttctgataactcaaatgatctacttataattgaagttaattttttaacaatttatgaatataatgtaccaaattcagaagtcaagtgttttatactatgcactaagtttctatttagaaaattctttagggttttattttttaaaaagtgcataagaggtataagagaagcttatcaaaacacaactcagtatatttccctcatctccaataatctagaaacttattaaacagtctgcatcaaatttgaaactgcttttaataagataaaaacaccaaatatctatctaaaattcattttgaaaatgtagtctcagacaacttaaatcaaaaaagtattgaccactgattttctccagaattctgagttctacacaacaaaatttatatctagttttctagtttttaagagaagcactttttgtttcattagaaaagttaccttcagtgcactatattaatagagaaatagcacaattcttattcagtacctcaatttttatagtagaaatatgaatttcccccctcacagtttgaatgtgaaagtcttcccttgtggctcagctggtaaagaatccgcctgcaatgtgggagacctggcttcaatccctgggttgggaaaatcccctggagaagggaaaggctacccatcccagttctggcctggagaattcgccagagtcagacacgactgagcaactttcatagtttatatactggtgtatggagcttgctaacagcactgtcatgggctgatactattatggattttgtttaaattttgagaagaaaataaatatattttacaggtcaaaactcaatcataaactgatagatttcacttcagtaaatgaaaggcaatctgaaatgaaaaacagaaatggaattaaggcagctctaaaacaaagttatacttattcaccccaaatagtgctactgcagtataattcattcctttaaaagttgtgtgtataacctagacataaaagccaaacatcaaaacaagcattgcagctatgatgcagcatcaggtgcttttactttggtgaatgagaataatggtcacaactcaaatgaatggtcaatttaatatgaatatatgcaccttaccagcaatgtttatgtttactaccagagacgtcttagcaattccatattcctcacaaagtcaatatagctgttgtaaaaaaatcaactgtggctctgaatacccatttgcggctggcctcagcaacgcgtctggagcaggaggctggctgtctgcgacaggcagcagcaggtggtggtcctcagcccccagtgggagagtcagtggcaaagtcacatcagaaggtttcacgtccagagtttctgacagaggacttttttgtatggagtcttgttcattcaagggatgatcctctatactggaatctagaattttatctgcacctgaagaagggaaaaaactcattatctttaaaaacaaaacaaaaaccccaaggaagactcatctacttaccattcccattctaaccccacctttagtcacaccatttctcttttgctgatctgcccttctccttacctgcacaaacccattctggacctcaagactaggctcacgcatcaactccattacaaaaatggacttaattgctctagaccagggtaagctgtttcttaatcactcatttgtcaatacttcatataccatctccggacacctagctatctatcttactgctatgtaacatcctacttaggtatgccttgaatgctcaaca

SEQ ID NO: 42291 - DNA, 1022 bp, Bovine  19866881026460
gaaaaacagagctgtctgcagctccaggagcaggagagagagtctccagtttaagtcaactaatcctttgcaagaaacagagaactgctcttggccaaagattaatcttgcagttccatcctcacatagaaatcctgcagactgtaataatcttgactttgggactcaggaaaaaatttttttttaatcatgcaaggatttggatcactgatggtcttcactgtggggcttgttgtatttactccagggttattgttcatccttagccagtgggagagtgacagggcatggggagataaagctggcttaggtctcagcagtgctttaaagttgtgggtgccagtcacctttaggaaccttctctgggcaaggcagatgccttaatttggaatgatatttagccagaaattacctaaacctccatggtacgaagacttccaatttccatgggaatgatatgtgtatctcttttttgcttacctagacttccaggtacttactatatgctgtgacacataaaagtttctactacagattattatactaagtgaagtaagagaaagacaaatatgtgatatcatttaaatgtggaatctaaaaaactgatacagatgaacttatttacaaaacagaaatgggctcacagacattgaaaacaaaagggaagtaggggagggataaattaggagtttgggattaacaggtaccctctgctatatataaaatagataaccagcaaggacatattatatggcacagggaactatattcagtgtcttgtaataacttatcataaaaaagaatctggataaaagaatatctatgtatgaataactgaatcactttgttgcacccctgagactaacataacattgcaaatcagctatacttaaaattaaaaaagaagagtttagcaacatgggtatttctaaaaagaaagctattttttttgcaccttagcagcaggtaaaatgttagttggttcacacaatccattgtctcttttctttcatctaaccctg

SEQ ID NO: 42292 - DNA, 3236 bp, Bovine  19866881089262
ccatgggattttccaggcaagagtactggagtagggtgccattgccttctcccccttatggcctaggtgatccccaaataggaggaagaaagaagccatgtctggtctataactctgatgttgggccagtgttttcatggctaccagctccctcagaaagtggggtgaggagcaagtagccttaggtcctgtcaaggttggcagctatgttgggagagcagacccctggtggatagatggctggagctggggagagataatggtgagaagaggacagcatggaggagaaggggcaaacggagctctagaagacctgactgatgaaattactcagttcaccctagatcagtctgaccctttgtccttgccaccccccagactgcatattgaccttctgatgccagtctccacatgctcctacgtgggcaagcctcatggtcagattcagttcaacaaatatttaccaaatgcctaccctgctcctggtgttgtgataggtgttcagaagtgaagggtggtcctatccatcaagagtcctgggcctcactgtgtaacctctgggtccccttagccctgcggagttccacttcttcctctgttcaataaggacaatggtatgtgcctcctggggtcattgtaaggactctgtgacatgaaacttaaaaagagagacacataaaagattccaatacttgtttcctttactccacccattctcttgttccaacctgtttcaaagttctctttaatattcctttctagcagagtccacctgcctgcacagagaagactttaagtgacatttctcctgaggggtgggttgtgtgtgtatgtgtgtgtgcccatggttggtttggacatgtgaggtgctaaggttgttcaatgaagtgaaattcaggtgtagtgaagagagttctttacactaaacctaattatttcaaaccttttagtcttcagaggaaaaaatgaaatatttggcaattaatctcataattcaaatagaaaacttgctttgtttgacttacttgggcaatactctttttaatgtaagtagttcttactaaagtatttttttgaggcaactgagtcattgttatctccatttggcttgtgctatgctgtgtgtagttgcttggtcatgtctgatgctttgtgaccccatggactgtagcccagcaggctcttctgtccatggggattcttcaaataagaacactggagtgttggcttacctaagatatactgggtagcttccagtggctcagacagtaaagaatcttcctgcaatgcaggagactcaggttcgatccctgggttgggaagatcccctagagaagggaatggctacccacttcactgttcttgcatggaaaattccagggacagaggaacatggtgggctacagtccatgtggtcgcaaacagtcagacacaactgagacaccttctgtggaaacttgaattatggaatttatatctataaacagagttttggaatatatttctcaaatatatacatttttagttttctatcccaatgtgaatatgcttattgggataactttatatcccagtaaatgtatgtgcattgttttcctttaatagaattttatgttttctcctatattctgattcttaactatattaattttaggcaagcatagactaggaaattaagctcaagaattttgttctcttaatgtttagctctcaaatattggtgagtccttgctgttttatgtatgtaacactctgtttcatgcccacaagtagatttcttgacatttgggccacattagtaatttaaataagctttttctttcttaaaaatattaagtatctcatggccagcatcactgtcctttacttcacaacttttcttcaatttttctagtgctgttactttcttttattagaagaactgcatttctttttctttgaaataattaaacagctcagtccagataagacactttaatgcattatggtaaccaattttaagtgaacaactttgattttggggcccctggccaggctgttgtttttctgggccattctaaagagagagggagattgaatgtccagaagagtgtctgcgcttgacatttctaagaataactatgataacttcgagtgattctggttaatcttatgacaggaggacagatttgagaactgattaagcctccctttctatcattctgtcctaaaaacacctgggactctcagcagaggaatctatgaatcactgtctgttgtccactcatcctgtccggtcctctccacgctggaactaatcaactgccttgaatgaagcatgacttgcaagctgaattctgaaacctcctggaatattcaggaaggagcaggcacaatctttcagggtgatttggcccacactccaaatgagcctccagatgtagacaagatggtcaagaggtcagacaacacacattttgaatgaattccccttgaccatttttgggttacttgttctcgaaagatattttcaagggagtagtagatcaaaaacatgggatatgtcaatatgtcaatacctcagtcttctatttttcagattgttggtttgaacagatcacctgctgctttgatgtttgtagacagagcggctggttgatggtgtacacgtcgggtagcgttgtcctgagcgggcggggttggcactgtgaacctgctcaccggccagacctgctcacctgactgccagagccgtctggcaggtcagagctggtgtgcagggatgacgcctgcgctggttaccttcaaatactggtttatcttcttgggtgccccctctgctggaacaaaagaataatcattgtctctaagaacaggcaggggcttagaatttggcccccaaagcaatcacctcttctttcctaactgcaggccagcgggataaacacagttcccagggtggagaaggaggactttctgggacaggaaagcatttggtccttccaagtgaggcttctttctggagaactttgggcaagcctctttgagttggactagccagtgtcttccgggaagcggagagattaaagcaccagattagtgatgctacacagctgaatagcaacacatgtggccaaaacacttacagcatcattgtttttgaaaatgaactcccagcacagttcagtacaattttttctagtgtgtcatttcccactctacttccccagccacatacaaagacagaagcagcattt

SEQ ID NO: 42293 - DNA, 837 bp, Bovine  19866881138018
ttgaattgaaatgttttagggctattttaagtgttataatgaaaaggggtaagtttttttcatcattaagcatgtgtaaattatgtaatgtcttttcttcttgaaatccacataatttaagtgctactatagtttatatggggaagagggatggtggctcagacggtaaagcatctgtctgcaatgcaggagacccggcttagatccctgggttgggaagatcccctggagaaggaaatggcagcccactccagtattcttgcctggaaaatcccatgggcggtggagcctggtaggctaccgtccatggggtcgcaaagagtgagacacgactgagcgacttcactttctatagtttatatacatcatgttcgttttcttcaaaagattgtgaagcaaaccccactatatgtaaatttgtacatacagtgaaattctagcagttctcatataattgaactgaattttagatattttagttagatcttttaaaagagttaagaaatattaacataagagatgttttttaatgattatcactgattgttcctcaattattttttcccccaaattttcaactctgtcatttcagtggtccatacatcatgacagttttttgtagtatagttatctgcagtaatgggaggtcattaaagtaagaatggggagtaagcatatagcagtaacacacagaagcaggtacttaatctactaaagatgataaaacacttaacaataaatttacatgcaactttgaagtaactttatttcagataatcttccttttacttttacttaaacaaaaacaaactaaaccagagcaatatctatttattt

SEQ ID NO: 42294 - DNA, 1247 bp, Bovine  19866881148232
cagagggtaaacaactctttgcatgaagatgaaatgtagttgtcacccacttcagtgacatgacacagcaattgaaagctgctggcagtctgactattagacctcctactgaagggacagcaccaggctgccccaagacaagaagttcaggatgggtcctggtaaatttctgcattctacctgggaaagtgtcatctgcttgtccttaagaaatatacatttcagtaggcaataactgaacaaaatgcttgggagcttgcttcttaaaccagagatctgtggatacaatcattcatctacttcgccacagctcacaaaattttacgactacatagaccccaaaccaaaacaaggaggtaattctgtgaaaatgaaagtttctaccagattcttgacatgaaaaacaaatgtagtctctataaacgagagagctttttttttcttttttaaattatgtctatgatggggtagaaggccactgtccatcatggaaatagttgacaattggttacactcaaatcatctactgactggggattttcttggtcttgtacatcttggcttcctacccgatgtctatttcatcatggtccctactgccctctggtcttgatacatataactgccctataagactcttccctaaaatcttcatggtagtgaacaaatgagaagaaaaataacaatctatactttttttaaaaggtggggggtgggtcaactttgaaatgccacaaatcagaaattatgactcatctgtcttggtttatgcagtgttcatcacagtagctgagacacaagctctcaaaaggtttaaataatggtaagtctttactgtgaatattgagtacaaatgattcctctttcacttttaacttataaaaatcaagttaatcatcaaatactgtatcttaagtatctggggacggttcagcccctttgaaaagagtttggcagtttttctaaacgttaaacctagagttctatgtgacccaacaattcctctcctaggtacatagccaagagaattgaaaccagatacgcacacaaaactaattcacaaacattcataacgtcattatttataatagccccccaaaatggaaacaacctaaatgtccatcaactgatcaatggataaacaaaatgcagtgtatccatgcaatggaaaattactcagccataaaatgaatgaagttttgatacatgccacaatatgaatgaaccttgagagcaccatgatatgt

SEQ ID NO: 42295 - DNA, 1253 bp, Bovine  19866881190432
acttgaagactcagatctcttctagtctctccatatttttagagaatctttagtcacaattccagattcctctctcgagaattctatccactaagaaaggcatttccccactcccaccatgattcagagcaaatatgggccatctctgaacagagcaaatagtctttggtgaccagacttaacctaacattccagattgtgatctgttcatttctgaatagactttggtaactagtctcccaaaacacttcccgcatgaaccatgaagccatatattcatgcccttgtatagcccctccccttaaatctagggtagtcacatgacttgtattggccaataggaaaatagcagaaatgacatcgcttgacttcagtgctaggtcataaaagtcctacatcttgggatgcttatccagcaatccagtcactgtgctgtgagaagatcaagccatatggagaaggcatatgcaaacattccagtcaagagccacagccataagttaaagatgtcaggcagagaaagacaaatactatatgatattatctacatgtggaatttaaaaactagtgaatataacaaaaaagaagcagattcatagatacatagagaacaaactagtggttaccagtggagagagggaaaggggaagaggcaatacaggggcaggaggggaagaaaggattattatgggattatatgaaatcatctacatgaaacttttgaaaattgtaaagcattatagaatttaaagaatctttcattcagaagaccaaaaaaaagagacactgttgagttctgacagccagaagcagcagccgtttgattgagccatactgaatgtcaagttcaacagtctcttaatgactacggccccagccaacatctgactgcaaccacgtgagaccccaaataagaaccacctagccaaactctatcactactcagaaccgaaagaaataataataaaaaattgttttaagccaccaaatttgtgactggtttgttacacaaataaaatcagatacaacattgagtctagataccagaatctactttattcaaggcctggaaatgccaaagatgaccctggggtctcaaggacttacaagcaacatgcctccagcctcagatactaaagggctttgactgactccaaactctgaaataaagatcaaccagaggaactgaactctctggtactgggcctagagactgttggagaatatcgcacaacagaaaagtcttatttaac

SEQ ID NO: 42296 - DNA, 702 bp, Bovine  19866881207196
gtcttcatttcttagttatccagctttaagatatgcaacttgtcggtaaactttctttctccttaatgaataatcattttctctgaaagcaatgccaaaccagagaaaattcattttgggcccagtcagacctagaaagaaataggtgagaaatattgctattcagatacctggtacatatatctaaaatcccaaattaccccattcttctttattaccaaacatacattatttgattgtcagctcctgactctaaactcagtcgttaggtatcttgaaagtttgatgctgttgttgctttaatggatattcatgtttcagttaacatatagatttcatgtttcaatgggtaaggcttcgctgcaggactcaaaaccaaacttacaaacgtgagaactatttcttttaaaatgatctagagaggcacacattcattgtaatatcacatttcaggactgcatggctagaatataatgtactgtcaaagcactgcatcaaaattatttaatgaatttctgactccagtaaaatctctttccactattccttcccatctatttaacggaacataagaaaaatttactatccactcacatcattatttttctatgactgcataggtatatgtttgaggggagcaaacaaaaagccaagttcatacactgcattttaaccaatcaaagtaatctacagcaattctgg
